United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 45

SEQ ID NO: 1608915 - RNA, 21 nt, Pseudomonas putida KT2440
accauggcgaugaacugccgg

SEQ ID NO: 1608916 - RNA, 18 nt, Pseudomonas putida KT2440
accauggcuaagccaagc

SEQ ID NO: 1608917 - RNA, 20 nt, Pseudomonas putida KT2440
accaucaccgccagcauggc

SEQ ID NO: 1608918 - RNA, 15 nt, Pseudomonas putida KT2440
accagcuugugcagc

SEQ ID NO: 1608919 - RNA, 14 nt, Pseudomonas putida KT2440
accaggaagcuggg

SEQ ID NO: 1608920 - RNA, 17 nt, Pseudomonas putida KT2440
accaggaucagguaauc

SEQ ID NO: 1608921 - RNA, 18 nt, Pseudomonas putida KT2440
accaugaaaaacaacaac

SEQ ID NO: 1608922 - RNA, 15 nt, Pseudomonas putida KT2440
accaucggcuccagc

SEQ ID NO: 1608923 - RNA, 14 nt, Pseudomonas putida KT2440
accaccaucgccag

SEQ ID NO: 1608924 - RNA, 17 nt, Pseudomonas putida KT2440
accacauccucuuugcu

SEQ ID NO: 1608925 - RNA, 11 nt, Pseudomonas putida KT2440
accacaucacg

SEQ ID NO: 1608926 - RNA, 14 nt, Pseudomonas putida KT2440
accacauacggcgc

SEQ ID NO: 1608927 - RNA, 20 nt, Pseudomonas putida KT2440
accaccuccaccccgcaggc

SEQ ID NO: 1608928 - RNA, 12 nt, Pseudomonas putida KT2440
accaccugggcc

SEQ ID NO: 1608929 - RNA, 13 nt, Pseudomonas putida KT2440
accaccugggcca

SEQ ID NO: 1608930 - RNA, 21 nt, Pseudomonas putida KT2440
accaccugggccaguaccuuc

SEQ ID NO: 1608931 - RNA, 13 nt, Pseudomonas putida KT2440
accaccugcaggg

SEQ ID NO: 1608932 - RNA, 24 nt, Pseudomonas putida KT2440
accaccugccaacgcaccgaccac

SEQ ID NO: 1608933 - RNA, 21 nt, Pseudomonas putida KT2440
accaccugcucggcgcgguca

SEQ ID NO: 1608934 - RNA, 21 nt, Pseudomonas putida KT2440
accaccggguucuugaagaag

SEQ ID NO: 1608935 - RNA, 20 nt, Pseudomonas putida KT2440
accaccgguaggacaaaaac

SEQ ID NO: 1608936 - RNA, 14 nt, Pseudomonas putida KT2440
accacuaucgccag

SEQ ID NO: 1608937 - RNA, 20 nt, Pseudomonas putida KT2440
accacuaucgccagaaacca

SEQ ID NO: 1608938 - RNA, 23 nt, Pseudomonas putida KT2440
accacguuauccagcugcaacag

SEQ ID NO: 1608939 - RNA, 18 nt, Pseudomonas putida KT2440
accacuuccaacacccgg

SEQ ID NO: 1608940 - RNA, 14 nt, Pseudomonas putida KT2440
accacgcccuggcc

SEQ ID NO: 1608941 - RNA, 17 nt, Pseudomonas putida KT2440
accacgcgauuuuuuug

SEQ ID NO: 1608942 - RNA, 15 nt, Pseudomonas putida KT2440
accacguacacacau

SEQ ID NO: 1608943 - RNA, 13 nt, Pseudomonas putida KT2440
accacgccugcgc

SEQ ID NO: 1608944 - RNA, 18 nt, Pseudomonas putida KT2440
accacguccggccagcaa

SEQ ID NO: 1608945 - RNA, 19 nt, Pseudomonas putida KT2440
accacguccggccagcaac

SEQ ID NO: 1608946 - RNA, 21 nt, Pseudomonas putida KT2440
accacuucuggcugggcuucg

SEQ ID NO: 1608947 - RNA, 14 nt, Pseudomonas putida KT2440
accagcaccaccug

SEQ ID NO: 1608948 - RNA, 18 nt, Pseudomonas putida KT2440
accagcagcgccugcagc

SEQ ID NO: 1608949 - RNA, 19 nt, Pseudomonas putida KT2440
accagcaccccgaacgcgg

SEQ ID NO: 1608950 - RNA, 14 nt, Pseudomonas putida KT2440
accagcaccagcuc

SEQ ID NO: 1608951 - RNA, 13 nt, Pseudomonas putida KT2440
accagcaccugca

SEQ ID NO: 1608952 - RNA, 16 nt, Pseudomonas putida KT2440
accagcaccugcaggu

SEQ ID NO: 1608953 - RNA, 21 nt, Pseudomonas putida KT2440
accagcaccugcagguacagc

SEQ ID NO: 1608954 - RNA, 23 nt, Pseudomonas putida KT2440
accagcaccugcagguacagcag

SEQ ID NO: 1608955 - RNA, 23 nt, Pseudomonas putida KT2440
accagcagaucaucgacuucaug

SEQ ID NO: 1608956 - RNA, 18 nt, Pseudomonas putida KT2440
accagcacugccuugccc

SEQ ID NO: 1608957 - RNA, 12 nt, Pseudomonas putida KT2440
accagcacugcu

SEQ ID NO: 1608958 - RNA, 15 nt, Pseudomonas putida KT2440
accagcacugcugcg

SEQ ID NO: 1608959 - RNA, 17 nt, Pseudomonas putida KT2440
accagcgggcccagcag

SEQ ID NO: 1608960 - RNA, 22 nt, Pseudomonas putida KT2440
accagcggucugcugcgucagc

SEQ ID NO: 1608961 - RNA, 22 nt, Pseudomonas putida KT2440
accagcuccaacaagucuuccc

SEQ ID NO: 1608962 - RNA, 19 nt, Pseudomonas putida KT2440
accagcucguucaacaccu

SEQ ID NO: 1608963 - RNA, 13 nt, Pseudomonas putida KT2440
accagcugcacca

SEQ ID NO: 1608964 - RNA, 14 nt, Pseudomonas putida KT2440
accagcugcaccac

SEQ ID NO: 1608965 - RNA, 18 nt, Pseudomonas putida KT2440
accagccgccuuugcccc

SEQ ID NO: 1608966 - RNA, 16 nt, Pseudomonas putida KT2440
accagcccggcccaua

SEQ ID NO: 1608967 - RNA, 18 nt, Pseudomonas putida KT2440
accagccggcaauuuccu

SEQ ID NO: 1608968 - RNA, 15 nt, Pseudomonas putida KT2440
accagcggcagcaag

SEQ ID NO: 1608969 - RNA, 19 nt, Pseudomonas putida KT2440
accacagcugcgccagccg

SEQ ID NO: 1608970 - RNA, 14 nt, Pseudomonas putida KT2440
accacacuagcccc

SEQ ID NO: 1608971 - RNA, 20 nt, Pseudomonas putida KT2440
accacacugcucgucaaacc

SEQ ID NO: 1608972 - RNA, 13 nt, Pseudomonas putida KT2440
accacacagaugc

SEQ ID NO: 1608973 - RNA, 22 nt, Pseudomonas putida KT2440
accaaugucgacguacagcagc

SEQ ID NO: 1608974 - RNA, 22 nt, Pseudomonas putida KT2440
accacaaagccuucccccuccu

SEQ ID NO: 1608975 - RNA, 16 nt, Pseudomonas putida KT2440
accaagcgccccacaa

SEQ ID NO: 1608976 - RNA, 22 nt, Pseudomonas putida KT2440
accaagauuuuuugcucuaaau

SEQ ID NO: 1608977 - RNA, 21 nt, Pseudomonas putida KT2440
accaaucugguuacccaacag

SEQ ID NO: 1608978 - RNA, 21 nt, Pseudomonas putida KT2440
accaaacacgcccuugcccca

SEQ ID NO: 1608979 - RNA, 12 nt, Pseudomonas putida KT2440
acauuguaggcg

SEQ ID NO: 1608980 - RNA, 14 nt, Pseudomonas putida KT2440
acauugcuaauuuc

SEQ ID NO: 1608981 - RNA, 15 nt, Pseudomonas putida KT2440
acaugcggaagcaac

SEQ ID NO: 1608982 - RNA, 21 nt, Pseudomonas putida KT2440
acaugccggcccaaggcacca

SEQ ID NO: 1608983 - RNA, 12 nt, Pseudomonas putida KT2440
acaugaaaguga

SEQ ID NO: 1608984 - RNA, 19 nt, Pseudomonas putida KT2440
acaucggccaccgccgggu

SEQ ID NO: 1608985 - RNA, 20 nt, Pseudomonas putida KT2440
acaucggugaucgcaaaaca

SEQ ID NO: 1608986 - RNA, 20 nt, Pseudomonas putida KT2440
acauccccgccgccagcagc

SEQ ID NO: 1608987 - RNA, 14 nt, Pseudomonas putida KT2440
acauccgaccccag

SEQ ID NO: 1608988 - RNA, 22 nt, Pseudomonas putida KT2440
acauccucuuugcucuucaccu

SEQ ID NO: 1608989 - RNA, 22 nt, Pseudomonas putida KT2440
acaucaugccgcccaugccacc

SEQ ID NO: 1608990 - RNA, 14 nt, Pseudomonas putida KT2440
acauccagcgccgc

SEQ ID NO: 1608991 - RNA, 14 nt, Pseudomonas putida KT2440
acaucaucaucuuc

SEQ ID NO: 1608992 - RNA, 13 nt, Pseudomonas putida KT2440
acaucaccagcag

SEQ ID NO: 1608993 - RNA, 23 nt, Pseudomonas putida KT2440
acaguuugcuuuuucgagcagcg

SEQ ID NO: 1608994 - RNA, 14 nt, Pseudomonas putida KT2440
acaguuucuucagg

SEQ ID NO: 1608995 - RNA, 19 nt, Pseudomonas putida KT2440
acauaaggcagcagcucuu

SEQ ID NO: 1608996 - RNA, 23 nt, Pseudomonas putida KT2440
acauaaaaaagccccggcucgca

SEQ ID NO: 1608997 - RNA, 22 nt, Pseudomonas putida KT2440
acauagcuggcacugcccaagc

SEQ ID NO: 1608998 - RNA, 16 nt, Pseudomonas putida KT2440
acauagaacagcauca

SEQ ID NO: 1608999 - RNA, 16 nt, Pseudomonas putida KT2440
acauacugcuucugcc

SEQ ID NO: 1609000 - RNA, 19 nt, Pseudomonas putida KT2440
acauaccgcugggcacccu

SEQ ID NO: 1609001 - RNA, 15 nt, Pseudomonas putida KT2440
acauacgcaucagcg

SEQ ID NO: 1609002 - RNA, 16 nt, Pseudomonas putida KT2440
acauacgcaucagcgc

SEQ ID NO: 1609003 - RNA, 12 nt, Pseudomonas putida KT2440
acagaucagcca

SEQ ID NO: 1609004 - RNA, 14 nt, Pseudomonas putida KT2440
acagauaaaccugc

SEQ ID NO: 1609005 - RNA, 15 nt, Pseudomonas putida KT2440
acagauaaaccugcc

SEQ ID NO: 1609006 - RNA, 15 nt, Pseudomonas putida KT2440
acagacgggucggaa

SEQ ID NO: 1609007 - RNA, 19 nt, Pseudomonas putida KT2440
acagcaggccaaggaacgu

SEQ ID NO: 1609008 - RNA, 18 nt, Pseudomonas putida KT2440
acagcaguugcugcugcc

SEQ ID NO: 1609009 - RNA, 17 nt, Pseudomonas putida KT2440
acagcauccaaagccaa

SEQ ID NO: 1609010 - RNA, 17 nt, Pseudomonas putida KT2440
acagcaucggcagguca

SEQ ID NO: 1609011 - RNA, 23 nt, Pseudomonas putida KT2440
acagcaucaaucgcuccaggcgg

SEQ ID NO: 1609012 - RNA, 19 nt, Pseudomonas putida KT2440
acagcaauaaaaaagcccc

SEQ ID NO: 1609013 - RNA, 18 nt, Pseudomonas putida KT2440
acagcagcuugaacaacg

SEQ ID NO: 1609014 - RNA, 11 nt, Pseudomonas putida KT2440
acagcaggaac

SEQ ID NO: 1609015 - RNA, 15 nt, Pseudomonas putida KT2440
acagcaggaacagcg

SEQ ID NO: 1609016 - RNA, 19 nt, Pseudomonas putida KT2440
acagcaggaacagcggcag

SEQ ID NO: 1609017 - RNA, 19 nt, Pseudomonas putida KT2440
acacggcgguucugcgcac

SEQ ID NO: 1609018 - RNA, 23 nt, Pseudomonas putida KT2440
acacggacucauagcucagcugg

SEQ ID NO: 1609019 - RNA, 15 nt, Pseudomonas putida KT2440
acacggcaagccacg

SEQ ID NO: 1609020 - RNA, 17 nt, Pseudomonas putida KT2440
acacggcaagccacgcc

SEQ ID NO: 1609021 - RNA, 13 nt, Pseudomonas putida KT2440
acacgcugcugcg

SEQ ID NO: 1609022 - RNA, 17 nt, Pseudomonas putida KT2440
acacgcgcccuguggga

SEQ ID NO: 1609023 - RNA, 17 nt, Pseudomonas putida KT2440
acacgucggcuggcagc

SEQ ID NO: 1609024 - RNA, 15 nt, Pseudomonas putida KT2440
acacgguuuccaggc

SEQ ID NO: 1609025 - RNA, 15 nt, Pseudomonas putida KT2440
acacgggcguucagc

SEQ ID NO: 1609026 - RNA, 18 nt, Pseudomonas putida KT2440
acacgguaugcagguacc

SEQ ID NO: 1609027 - RNA, 18 nt, Pseudomonas putida KT2440
acacgucauacagcccga

SEQ ID NO: 1609028 - RNA, 17 nt, Pseudomonas putida KT2440
acagaagccucaccgcc

SEQ ID NO: 1609029 - RNA, 10 nt, Pseudomonas putida KT2440
acagaacaau

SEQ ID NO: 1609030 - RNA, 12 nt, Pseudomonas putida KT2440
acagaacaauaa

SEQ ID NO: 1609031 - RNA, 13 nt, Pseudomonas putida KT2440
acagaacaauaaa

SEQ ID NO: 1609032 - RNA, 20 nt, Pseudomonas putida KT2440
acacucagccgcugcgccug

SEQ ID NO: 1609033 - RNA, 17 nt, Pseudomonas putida KT2440
acaccaacgcauuuuca

SEQ ID NO: 1609034 - RNA, 21 nt, Pseudomonas putida KT2440
acaccaacuugccaaaauucu

SEQ ID NO: 1609035 - RNA, 23 nt, Pseudomonas putida KT2440
acaccacccggucggccagcugc

SEQ ID NO: 1609036 - RNA, 20 nt, Pseudomonas putida KT2440
acaccagaaagcccgcauga

SEQ ID NO: 1609037 - RNA, 17 nt, Pseudomonas putida KT2440
acaccagacucagcgcu

SEQ ID NO: 1609038 - RNA, 21 nt, Pseudomonas putida KT2440
acaccagacucagcgcuugcc

SEQ ID NO: 1609039 - RNA, 22 nt, Pseudomonas putida KT2440
acaccagcauguccugcugcag

SEQ ID NO: 1609040 - RNA, 22 nt, Pseudomonas putida KT2440
acaccaggccuucugcgcgagu

SEQ ID NO: 1609041 - RNA, 18 nt, Pseudomonas putida KT2440
acaccaucuucaugcaau

SEQ ID NO: 1609042 - RNA, 19 nt, Pseudomonas putida KT2440
acaccaucuucaugcaaua

SEQ ID NO: 1609043 - RNA, 16 nt, Pseudomonas putida KT2440
acaccccgcgcaugau

SEQ ID NO: 1609044 - RNA, 14 nt, Pseudomonas putida KT2440
acacccgccacgcu

SEQ ID NO: 1609045 - RNA, 15 nt, Pseudomonas putida KT2440
acacccgcuccaaca

SEQ ID NO: 1609046 - RNA, 14 nt, Pseudomonas putida KT2440
acaccgacgccgau

SEQ ID NO: 1609047 - RNA, 15 nt, Pseudomonas putida KT2440
acacccucugccauc

SEQ ID NO: 1609048 - RNA, 21 nt, Pseudomonas putida KT2440
acacccggucgcucaacucca

SEQ ID NO: 1609049 - RNA, 23 nt, Pseudomonas putida KT2440
acaccggccccccagccagcaga

SEQ ID NO: 1609050 - RNA, 14 nt, Pseudomonas putida KT2440
acaccggccgccag

SEQ ID NO: 1609051 - RNA, 22 nt, Pseudomonas putida KT2440
acaccggucagguccgccaagg

SEQ ID NO: 1609052 - RNA, 14 nt, Pseudomonas putida KT2440
acaccggccuugcg

SEQ ID NO: 1609053 - RNA, 21 nt, Pseudomonas putida KT2440
acaccggccuuggccagcuca

SEQ ID NO: 1609054 - RNA, 17 nt, Pseudomonas putida KT2440
acaccucccgcgcaucc

SEQ ID NO: 1609055 - RNA, 14 nt, Pseudomonas putida KT2440
acaccugccgcagc

SEQ ID NO: 1609056 - RNA, 18 nt, Pseudomonas putida KT2440
acaccugccagccccgca

SEQ ID NO: 1609057 - RNA, 14 nt, Pseudomonas putida KT2440
acaccugccaggcc

SEQ ID NO: 1609058 - RNA, 16 nt, Pseudomonas putida KT2440
acaccucgacccgccg

SEQ ID NO: 1609059 - RNA, 21 nt, Pseudomonas putida KT2440
acaccucuccaauccgcagcu

SEQ ID NO: 1609060 - RNA, 22 nt, Pseudomonas putida KT2440
acaaucgcgucagcaccggcag

SEQ ID NO: 1609061 - RNA, 16 nt, Pseudomonas putida KT2440
acaaucgccagguaca

SEQ ID NO: 1609062 - RNA, 14 nt, Pseudomonas putida KT2440
acaaucuucuucau

SEQ ID NO: 1609063 - RNA, 15 nt, Pseudomonas putida KT2440
acaaugcacagcgcu

SEQ ID NO: 1609064 - RNA, 21 nt, Pseudomonas putida KT2440
acaauaggccggucccaauaa

SEQ ID NO: 1609065 - RNA, 16 nt, Pseudomonas putida KT2440
acaaguucaaggucau

SEQ ID NO: 1609066 - RNA, 17 nt, Pseudomonas putida KT2440
acaagguacucagcggc

SEQ ID NO: 1609067 - RNA, 21 nt, Pseudomonas putida KT2440
acaagguugcgcaagccucag

SEQ ID NO: 1609068 - RNA, 18 nt, Pseudomonas putida KT2440
acaagguaccccaccggc

SEQ ID NO: 1609069 - RNA, 11 nt, Pseudomonas putida KT2440
acaagggccug

SEQ ID NO: 1609070 - RNA, 13 nt, Pseudomonas putida KT2440
acaaggcugcgcc

SEQ ID NO: 1609071 - RNA, 22 nt, Pseudomonas putida KT2440
acaaggcuguuccacagcaguc

SEQ ID NO: 1609072 - RNA, 20 nt, Pseudomonas putida KT2440
acaaggcucaacuacccuga

SEQ ID NO: 1609073 - RNA, 23 nt, Pseudomonas putida KT2440
acaaggccuggcccaguacgcca

SEQ ID NO: 1609074 - RNA, 22 nt, Pseudomonas putida KT2440
acacagaugccgccgcugccag

SEQ ID NO: 1609075 - RNA, 22 nt, Pseudomonas putida KT2440
acacaccaugcccacaggggcu

SEQ ID NO: 1609076 - RNA, 19 nt, Pseudomonas putida KT2440
acacacauucccuguagga

SEQ ID NO: 1609077 - RNA, 13 nt, Pseudomonas putida KT2440
acacaaggcccca

SEQ ID NO: 1609078 - RNA, 22 nt, Pseudomonas putida KT2440
acacagcauuacgcggcagcag

SEQ ID NO: 1609079 - RNA, 13 nt, Pseudomonas putida KT2440
acacagcaggcca

SEQ ID NO: 1609080 - RNA, 17 nt, Pseudomonas putida KT2440
acacagcggcagacaca

SEQ ID NO: 1609081 - RNA, 18 nt, Pseudomonas putida KT2440
acacauaucagccaacac

SEQ ID NO: 1609082 - RNA, 13 nt, Pseudomonas putida KT2440
acacauaggcagc

SEQ ID NO: 1609083 - RNA, 16 nt, Pseudomonas putida KT2440
acacauaggcagccac

SEQ ID NO: 1609084 - RNA, 18 nt, Pseudomonas putida KT2440
acaauuuucgaccaaggc

SEQ ID NO: 1609085 - RNA, 22 nt, Pseudomonas putida KT2440
acaauuuggggcugccuugcag

SEQ ID NO: 1609086 - RNA, 11 nt, Pseudomonas putida KT2440
acaaaaacaac

SEQ ID NO: 1609087 - RNA, 13 nt, Pseudomonas putida KT2440
acaaaaacaacaa

SEQ ID NO: 1609088 - RNA, 17 nt, Pseudomonas putida KT2440
acaaaaacaacaauagg

SEQ ID NO: 1609089 - RNA, 15 nt, Pseudomonas putida KT2440
aauuuucgaccaagg

SEQ ID NO: 1609090 - RNA, 13 nt, Pseudomonas putida KT2440
acaaccacugcaa

SEQ ID NO: 1609091 - RNA, 14 nt, Pseudomonas putida KT2440
acaacccgcgcugc

SEQ ID NO: 1609092 - RNA, 15 nt, Pseudomonas putida KT2440
acaacccgcgcugcc

SEQ ID NO: 1609093 - RNA, 17 nt, Pseudomonas putida KT2440
acaacccccacagggca

SEQ ID NO: 1609094 - RNA, 20 nt, Pseudomonas putida KT2440
acaaccaagcgaacuauccu

SEQ ID NO: 1609095 - RNA, 12 nt, Pseudomonas putida KT2440
acaacaugguca

SEQ ID NO: 1609096 - RNA, 17 nt, Pseudomonas putida KT2440
acaacagucaacaauca

SEQ ID NO: 1609097 - RNA, 22 nt, Pseudomonas putida KT2440
acaacauaccgcugggcacccu

SEQ ID NO: 1609098 - RNA, 15 nt, Pseudomonas putida KT2440
acaaccgcuuucacu

SEQ ID NO: 1609099 - RNA, 22 nt, Pseudomonas putida KT2440
acaaccugaacaaggccuggcc

SEQ ID NO: 1609100 - RNA, 12 nt, Pseudomonas putida KT2440
acaaccggggca

SEQ ID NO: 1609101 - RNA, 18 nt, Pseudomonas putida KT2440
acaacgaucagcgccgaa

SEQ ID NO: 1609102 - RNA, 21 nt, Pseudomonas putida KT2440
acaacgcgcgggcaauggcca

SEQ ID NO: 1609103 - RNA, 14 nt, Pseudomonas putida KT2440
acaacggcugugcc

SEQ ID NO: 1609104 - RNA, 13 nt, Pseudomonas putida KT2440
acaagaacugcga

SEQ ID NO: 1609105 - RNA, 17 nt, Pseudomonas putida KT2440
acaagaacaacacggca

SEQ ID NO: 1609106 - RNA, 13 nt, Pseudomonas putida KT2440
acaacugcuccag

SEQ ID NO: 1609107 - RNA, 17 nt, Pseudomonas putida KT2440
acaacugcuccaggcag

SEQ ID NO: 1609108 - RNA, 14 nt, Pseudomonas putida KT2440
acaacuaucgagca

SEQ ID NO: 1609109 - RNA, 21 nt, Pseudomonas putida KT2440
acaagauaacaccccccagca

SEQ ID NO: 1609110 - RNA, 15 nt, Pseudomonas putida KT2440
acaagccacgcaccu

SEQ ID NO: 1609111 - RNA, 16 nt, Pseudomonas putida KT2440
acaagccgacaaaaac

SEQ ID NO: 1609112 - RNA, 19 nt, Pseudomonas putida KT2440
acaagccgacaaaaacaac

SEQ ID NO: 1609113 - RNA, 20 nt, Pseudomonas putida KT2440
acaagccgacaaaaacaaca

SEQ ID NO: 1609114 - RNA, 21 nt, Pseudomonas putida KT2440
acaagccgacaaaaacaacaa

SEQ ID NO: 1609115 - RNA, 22 nt, Pseudomonas putida KT2440
acaagccgacaaaaacaacaau

SEQ ID NO: 1609116 - RNA, 15 nt, Pseudomonas putida KT2440
acaagccgcugggcu

SEQ ID NO: 1609117 - RNA, 19 nt, Pseudomonas putida KT2440
acaaacaccggccccccag

SEQ ID NO: 1609118 - RNA, 20 nt, Pseudomonas putida KT2440
acaaaccagcggucugcugc

SEQ ID NO: 1609119 - RNA, 16 nt, Pseudomonas putida KT2440
acaaacgccagcaugc

SEQ ID NO: 1609120 - RNA, 22 nt, Pseudomonas putida KT2440
acaaacgccgggcacaucacca

SEQ ID NO: 1609121 - RNA, 17 nt, Pseudomonas putida KT2440
acaaacggcuuggcugc

SEQ ID NO: 1609122 - RNA, 16 nt, Pseudomonas putida KT2440
acaaagcucaaaugcu

SEQ ID NO: 1609123 - RNA, 18 nt, Pseudomonas putida KT2440
acaaagcggauuucgcca

SEQ ID NO: 1609124 - RNA, 21 nt, Pseudomonas putida KT2440
acaaagccccggcagcgaugc

SEQ ID NO: 1609125 - RNA, 23 nt, Pseudomonas putida KT2440
acaaagccccggcagcgaugccg

SEQ ID NO: 1609126 - RNA, 16 nt, Pseudomonas putida KT2440
acaaaggcgucgcugu

SEQ ID NO: 1609127 - RNA, 17 nt, Pseudomonas putida KT2440
acaaaggccggcaccga

SEQ ID NO: 1609128 - RNA, 18 nt, Pseudomonas putida KT2440
acaaaggccggcaccgac

SEQ ID NO: 1609129 - RNA, 13 nt, Pseudomonas putida KT2440
acaacaaagcccc

SEQ ID NO: 1609130 - RNA, 19 nt, Pseudomonas putida KT2440
acaacaaagccccggcauc

SEQ ID NO: 1609131 - RNA, 14 nt, Pseudomonas putida KT2440
acaacaaccaaucc

SEQ ID NO: 1609132 - RNA, 22 nt, Pseudomonas putida KT2440
acaacaagcgcugguaaaguuc

SEQ ID NO: 1609133 - RNA, 17 nt, Pseudomonas putida KT2440
acaacaaggacugccug

SEQ ID NO: 1609134 - RNA, 16 nt, Pseudomonas putida KT2440
acaaaucggccuugcg

SEQ ID NO: 1609135 - RNA, 16 nt, Pseudomonas putida KT2440
aaggccauuucccugc

SEQ ID NO: 1609136 - RNA, 18 nt, Pseudomonas putida KT2440
aaggccagcggaaucacc

SEQ ID NO: 1609137 - RNA, 16 nt, Pseudomonas putida KT2440
aaggcccgcgccgaca

SEQ ID NO: 1609138 - RNA, 22 nt, Pseudomonas putida KT2440
aaggccagugccgcaagcaguc

SEQ ID NO: 1609139 - RNA, 19 nt, Pseudomonas putida KT2440
aaggccguucccacaaagu

SEQ ID NO: 1609140 - RNA, 21 nt, Pseudomonas putida KT2440
aaggcccugcauaugcagggc

SEQ ID NO: 1609141 - RNA, 13 nt, Pseudomonas putida KT2440
aaggccguaggcc

SEQ ID NO: 1609142 - RNA, 16 nt, Pseudomonas putida KT2440
aaggcgcgucccccgg

SEQ ID NO: 1609143 - RNA, 17 nt, Pseudomonas putida KT2440
aaggcaccacggaaggc

SEQ ID NO: 1609144 - RNA, 18 nt, Pseudomonas putida KT2440
aaggcaccacggaaggcc

SEQ ID NO: 1609145 - RNA, 22 nt, Pseudomonas putida KT2440
aaggcaaucgugaucaucccca

SEQ ID NO: 1609146 - RNA, 23 nt, Pseudomonas putida KT2440
aaggcaaugcccauggccaggcu

SEQ ID NO: 1609147 - RNA, 19 nt, Pseudomonas putida KT2440
aaggcaaagaagucgccac

SEQ ID NO: 1609148 - RNA, 17 nt, Pseudomonas putida KT2440
aaggcauucagcucggc

SEQ ID NO: 1609149 - RNA, 16 nt, Pseudomonas putida KT2440
aaggccaaccacgccu

SEQ ID NO: 1609150 - RNA, 21 nt, Pseudomonas putida KT2440
aaggccaaccacgccugcgcc

SEQ ID NO: 1609151 - RNA, 15 nt, Pseudomonas putida KT2440
aaggccaacugcgcc

SEQ ID NO: 1609152 - RNA, 16 nt, Pseudomonas putida KT2440
aaggcaggucagcgag

SEQ ID NO: 1609153 - RNA, 22 nt, Pseudomonas putida KT2440
aaggugggguugaccaggcagu

SEQ ID NO: 1609154 - RNA, 16 nt, Pseudomonas putida KT2440
aagguugacacccucu

SEQ ID NO: 1609155 - RNA, 22 nt, Pseudomonas putida KT2440
aagguugacacccucuugaauc

SEQ ID NO: 1609156 - RNA, 17 nt, Pseudomonas putida KT2440
aagguuggggccaggcu

SEQ ID NO: 1609157 - RNA, 16 nt, Pseudomonas putida KT2440
aagguugccaccagca

SEQ ID NO: 1609158 - RNA, 23 nt, Pseudomonas putida KT2440
aaggcuuuggccguagccaggca

SEQ ID NO: 1609159 - RNA, 15 nt, Pseudomonas putida KT2440
aagguaguaaaaaua

SEQ ID NO: 1609160 - RNA, 16 nt, Pseudomonas putida KT2440
aagguaucggccaugg

SEQ ID NO: 1609161 - RNA, 22 nt, Pseudomonas putida KT2440
aagguauggccuuucugcuucc

SEQ ID NO: 1609162 - RNA, 15 nt, Pseudomonas putida KT2440
aaggucuucagcuca

SEQ ID NO: 1609163 - RNA, 19 nt, Pseudomonas putida KT2440
aaggcugcccucgggcagc

SEQ ID NO: 1609164 - RNA, 15 nt, Pseudomonas putida KT2440
aaggcugcgcuugag

SEQ ID NO: 1609165 - RNA, 21 nt, Pseudomonas putida KT2440
aaggcuggcaacccgccuccu

SEQ ID NO: 1609166 - RNA, 15 nt, Pseudomonas putida KT2440
aaggcuggccagacg

SEQ ID NO: 1609167 - RNA, 15 nt, Pseudomonas putida KT2440
aaggcuuggugcuca

SEQ ID NO: 1609168 - RNA, 20 nt, Pseudomonas putida KT2440
aaggcuuggugcucaugauc

SEQ ID NO: 1609169 - RNA, 20 nt, Pseudomonas putida KT2440
aagcuguugucgcgaguguc

SEQ ID NO: 1609170 - RNA, 22 nt, Pseudomonas putida KT2440
aagcugcgccgcaaaccccuuc

SEQ ID NO: 1609171 - RNA, 13 nt, Pseudomonas putida KT2440
aagcugcgcucga

SEQ ID NO: 1609172 - RNA, 13 nt, Pseudomonas putida KT2440
aagcugcugauaa

SEQ ID NO: 1609173 - RNA, 15 nt, Pseudomonas putida KT2440
aagcugucagcaccu

SEQ ID NO: 1609174 - RNA, 21 nt, Pseudomonas putida KT2440
aaggaucagcucggcaacgau

SEQ ID NO: 1609175 - RNA, 18 nt, Pseudomonas putida KT2440
aagcgucuggacccacgg

SEQ ID NO: 1609176 - RNA, 19 nt, Pseudomonas putida KT2440
aagcgucuggacccacgga

SEQ ID NO: 1609177 - RNA, 19 nt, Pseudomonas putida KT2440
aagcggcacuaccaggccc

SEQ ID NO: 1609178 - RNA, 17 nt, Pseudomonas putida KT2440
aagcggaucggccggcg

SEQ ID NO: 1609179 - RNA, 17 nt, Pseudomonas putida KT2440
aagcggccaccugcccc

SEQ ID NO: 1609180 - RNA, 14 nt, Pseudomonas putida KT2440
aagcggccggcccc

SEQ ID NO: 1609181 - RNA, 22 nt, Pseudomonas putida KT2440
aagccacgccagaaccugacaa

SEQ ID NO: 1609182 - RNA, 19 nt, Pseudomonas putida KT2440
aagcgcugacugccaggcc

SEQ ID NO: 1609183 - RNA, 19 nt, Pseudomonas putida KT2440
aagcggaaguucacacuca

SEQ ID NO: 1609184 - RNA, 23 nt, Pseudomonas putida KT2440
aagccaagcgccgucgaacgucc

SEQ ID NO: 1609185 - RNA, 16 nt, Pseudomonas putida KT2440
aagcuaucgccagcag

SEQ ID NO: 1609186 - RNA, 14 nt, Pseudomonas putida KT2440
aagcucuccagcag

SEQ ID NO: 1609187 - RNA, 15 nt, Pseudomonas putida KT2440
aagcucuccagcagg

SEQ ID NO: 1609188 - RNA, 14 nt, Pseudomonas putida KT2440
aagugauggccugg

SEQ ID NO: 1609189 - RNA, 13 nt, Pseudomonas putida KT2440
aaguguuugaagc

SEQ ID NO: 1609190 - RNA, 18 nt, Pseudomonas putida KT2440
aagucaaccaacuccuuc

SEQ ID NO: 1609191 - RNA, 14 nt, Pseudomonas putida KT2440
aagucaaccucaac

SEQ ID NO: 1609192 - RNA, 15 nt, Pseudomonas putida KT2440
aaguauuaauuugaa

SEQ ID NO: 1609193 - RNA, 19 nt, Pseudomonas putida KT2440
aaguauuaauuugaacaau

SEQ ID NO: 1609194 - RNA, 19 nt, Pseudomonas putida KT2440
aagucgucggcaagcuugc

SEQ ID NO: 1609195 - RNA, 18 nt, Pseudomonas putida KT2440
aaguccugcaaaggcccu

SEQ ID NO: 1609196 - RNA, 17 nt, Pseudomonas putida KT2440
aaguccgccaggaaguc

SEQ ID NO: 1609197 - RNA, 13 nt, Pseudomonas putida KT2440
aagucagccaggu

SEQ ID NO: 1609198 - RNA, 23 nt, Pseudomonas putida KT2440
aagucagccagguuuuugauguc

SEQ ID NO: 1609199 - RNA, 15 nt, Pseudomonas putida KT2440
aauaaaaacaacagg

SEQ ID NO: 1609200 - RNA, 17 nt, Pseudomonas putida KT2440
aagauguguuggccgga

SEQ ID NO: 1609201 - RNA, 14 nt, Pseudomonas putida KT2440
aagaucuaugacca

SEQ ID NO: 1609202 - RNA, 14 nt, Pseudomonas putida KT2440
aagaucgcccagcu

SEQ ID NO: 1609203 - RNA, 15 nt, Pseudomonas putida KT2440
aagaucgcccagcug

SEQ ID NO: 1609204 - RNA, 16 nt, Pseudomonas putida KT2440
aagaucaagccccugg

SEQ ID NO: 1609205 - RNA, 14 nt, Pseudomonas putida KT2440
aagauacgcgcaga

SEQ ID NO: 1609206 - RNA, 22 nt, Pseudomonas putida KT2440
aagcagccccagggcccucaac

SEQ ID NO: 1609207 - RNA, 11 nt, Pseudomonas putida KT2440
aagcagcgaau

SEQ ID NO: 1609208 - RNA, 19 nt, Pseudomonas putida KT2440
aagcagaacaucaggucug

SEQ ID NO: 1609209 - RNA, 13 nt, Pseudomonas putida KT2440
aagcagugcugcc

SEQ ID NO: 1609210 - RNA, 15 nt, Pseudomonas putida KT2440
aagcagucccagcac

SEQ ID NO: 1609211 - RNA, 11 nt, Pseudomonas putida KT2440
aagcaggaugg

SEQ ID NO: 1609212 - RNA, 22 nt, Pseudomonas putida KT2440
aagcaggauggugacugccagc

SEQ ID NO: 1609213 - RNA, 23 nt, Pseudomonas putida KT2440
aagcauuacuucuuggagcggcc

SEQ ID NO: 1609214 - RNA, 21 nt, Pseudomonas putida KT2440
aagcauucgcauuaccagcac

SEQ ID NO: 1609215 - RNA, 16 nt, Pseudomonas putida KT2440
aagcacgcgcugagga

SEQ ID NO: 1609216 - RNA, 21 nt, Pseudomonas putida KT2440
aagcacgucgcgauugaucag

SEQ ID NO: 1609217 - RNA, 19 nt, Pseudomonas putida KT2440
aagcaccagguuugcugcc

SEQ ID NO: 1609218 - RNA, 15 nt, Pseudomonas putida KT2440
aagcaaucagaacgu

SEQ ID NO: 1609219 - RNA, 13 nt, Pseudomonas putida KT2440
aagcaaacgccag

SEQ ID NO: 1609220 - RNA, 21 nt, Pseudomonas putida KT2440
aagaggccggcacaggaaggc

SEQ ID NO: 1609221 - RNA, 22 nt, Pseudomonas putida KT2440
aagaggccggcacaggaaggca

SEQ ID NO: 1609222 - RNA, 23 nt, Pseudomonas putida KT2440
aagaggccggcacaggaaggcau

SEQ ID NO: 1609223 - RNA, 18 nt, Pseudomonas putida KT2440
aagaggcccgaacagaca

SEQ ID NO: 1609224 - RNA, 14 nt, Pseudomonas putida KT2440
aagaggcagcgaaa

SEQ ID NO: 1609225 - RNA, 15 nt, Pseudomonas putida KT2440
aagacggcagaucag

SEQ ID NO: 1609226 - RNA, 16 nt, Pseudomonas putida KT2440
aagagaagcugcagcu

SEQ ID NO: 1609227 - RNA, 17 nt, Pseudomonas putida KT2440
aagagaagcugcagcuu

SEQ ID NO: 1609228 - RNA, 23 nt, Pseudomonas putida KT2440
aagaauugcugguugaucaacug

SEQ ID NO: 1609229 - RNA, 15 nt, Pseudomonas putida KT2440
aagaccggguccagc

SEQ ID NO: 1609230 - RNA, 19 nt, Pseudomonas putida KT2440
aagaccgccgcccagguca

SEQ ID NO: 1609231 - RNA, 15 nt, Pseudomonas putida KT2440
aaugucagcgcucgg

SEQ ID NO: 1609232 - RNA, 18 nt, Pseudomonas putida KT2440
aaugucagcgcucggguu

SEQ ID NO: 1609233 - RNA, 20 nt, Pseudomonas putida KT2440
aaugucgacguacagcagcu

SEQ ID NO: 1609234 - RNA, 21 nt, Pseudomonas putida KT2440
aaugucuucaaucgucaugau

SEQ ID NO: 1609235 - RNA, 21 nt, Pseudomonas putida KT2440
aaugggucgcgaagcggcccc

SEQ ID NO: 1609236 - RNA, 14 nt, Pseudomonas putida KT2440
aauggguggcggca

SEQ ID NO: 1609237 - RNA, 18 nt, Pseudomonas putida KT2440
aauggguacgcaccuugc

SEQ ID NO: 1609238 - RNA, 17 nt, Pseudomonas putida KT2440
aaugggcugcaaagcag

SEQ ID NO: 1609239 - RNA, 16 nt, Pseudomonas putida KT2440
aaugggcuuccccagc

SEQ ID NO: 1609240 - RNA, 18 nt, Pseudomonas putida KT2440
aauggucggggugagggg

SEQ ID NO: 1609241 - RNA, 23 nt, Pseudomonas putida KT2440
aauggcgguuuugagacgcaugu

SEQ ID NO: 1609242 - RNA, 17 nt, Pseudomonas putida KT2440
aauggcacccucaccaa

SEQ ID NO: 1609243 - RNA, 23 nt, Pseudomonas putida KT2440
aaugcagaugguccggcaucacu

SEQ ID NO: 1609244 - RNA, 13 nt, Pseudomonas putida KT2440
aaugcacgccugg

SEQ ID NO: 1609245 - RNA, 22 nt, Pseudomonas putida KT2440
aaugcacgccugucuagccgcc

SEQ ID NO: 1609246 - RNA, 15 nt, Pseudomonas putida KT2440
aaugccaguugauca

SEQ ID NO: 1609247 - RNA, 16 nt, Pseudomonas putida KT2440
aaugcuacagaagccu

SEQ ID NO: 1609248 - RNA, 15 nt, Pseudomonas putida KT2440
aaugcuccgccacca

SEQ ID NO: 1609249 - RNA, 16 nt, Pseudomonas putida KT2440
aaugcuccgccaccag

SEQ ID NO: 1609250 - RNA, 14 nt, Pseudomonas putida KT2440
aaugcucgccugcu

SEQ ID NO: 1609251 - RNA, 18 nt, Pseudomonas putida KT2440
aauuacagcuugccagcg

SEQ ID NO: 1609252 - RNA, 19 nt, Pseudomonas putida KT2440
aauuacuuggccugggcuu

SEQ ID NO: 1609253 - RNA, 19 nt, Pseudomonas putida KT2440
aaucggcagaauuucaggc

SEQ ID NO: 1609254 - RNA, 20 nt, Pseudomonas putida KT2440
aaucgggauggcaccggcag

SEQ ID NO: 1609255 - RNA, 18 nt, Pseudomonas putida KT2440
aaucggcgccaggaucga

SEQ ID NO: 1609256 - RNA, 20 nt, Pseudomonas putida KT2440
aaucgaaggcauagcgguac

SEQ ID NO: 1609257 - RNA, 18 nt, Pseudomonas putida KT2440
aaucgaccugcaggcccu

SEQ ID NO: 1609258 - RNA, 20 nt, Pseudomonas putida KT2440
aaucucggucugucaaccca

SEQ ID NO: 1609259 - RNA, 14 nt, Pseudomonas putida KT2440
aaucucgcccuugu

SEQ ID NO: 1609260 - RNA, 13 nt, Pseudomonas putida KT2440
aaucuccagcccg

SEQ ID NO: 1609261 - RNA, 20 nt, Pseudomonas putida KT2440
aaucuccagcccgaaaccau

SEQ ID NO: 1609262 - RNA, 21 nt, Pseudomonas putida KT2440
aaugaguccgguaacgaaggc

SEQ ID NO: 1609263 - RNA, 21 nt, Pseudomonas putida KT2440
aaugagggaugagaaagcccg

SEQ ID NO: 1609264 - RNA, 21 nt, Pseudomonas putida KT2440
aaugcaccacgcgcaaaugcu

SEQ ID NO: 1609265 - RNA, 15 nt, Pseudomonas putida KT2440
aaugaucaagaaguc

SEQ ID NO: 1609266 - RNA, 14 nt, Pseudomonas putida KT2440
aaucugcucuuuga

SEQ ID NO: 1609267 - RNA, 13 nt, Pseudomonas putida KT2440
aaucugccugcug

SEQ ID NO: 1609268 - RNA, 18 nt, Pseudomonas putida KT2440
aaucugccugcugcaaca

SEQ ID NO: 1609269 - RNA, 15 nt, Pseudomonas putida KT2440
aaucugcagcagcau

SEQ ID NO: 1609270 - RNA, 21 nt, Pseudomonas putida KT2440
aaucuucggcuuugaacagcu

SEQ ID NO: 1609271 - RNA, 19 nt, Pseudomonas putida KT2440
aaucaagagcccggaagcu

SEQ ID NO: 1609272 - RNA, 14 nt, Pseudomonas putida KT2440
aaucaaccagcccg

SEQ ID NO: 1609273 - RNA, 20 nt, Pseudomonas putida KT2440
aaucagcucacaggcucagu

SEQ ID NO: 1609274 - RNA, 14 nt, Pseudomonas putida KT2440
aaucagcacugugc

SEQ ID NO: 1609275 - RNA, 21 nt, Pseudomonas putida KT2440
aaucagcaugcccagcgccac

SEQ ID NO: 1609276 - RNA, 13 nt, Pseudomonas putida KT2440
aaucagccuucag

SEQ ID NO: 1609277 - RNA, 22 nt, Pseudomonas putida KT2440
aaucagccuucagugcuucaca

SEQ ID NO: 1609278 - RNA, 19 nt, Pseudomonas putida KT2440
aaucaccugcacaucggcc

SEQ ID NO: 1609279 - RNA, 13 nt, Pseudomonas putida KT2440
aauaugcagugcc

SEQ ID NO: 1609280 - RNA, 22 nt, Pseudomonas putida KT2440
aauagcuccugauccaccucuc

SEQ ID NO: 1609281 - RNA, 14 nt, Pseudomonas putida KT2440
aauacccaacagca

SEQ ID NO: 1609282 - RNA, 18 nt, Pseudomonas putida KT2440
aauacgagggugaaccca

SEQ ID NO: 1609283 - RNA, 18 nt, Pseudomonas putida KT2440
aauacucagaccaacaac

SEQ ID NO: 1609284 - RNA, 15 nt, Pseudomonas putida KT2440
aauacauacaccaac

SEQ ID NO: 1609285 - RNA, 12 nt, Pseudomonas putida KT2440
aauacauccagg

SEQ ID NO: 1609286 - RNA, 15 nt, Pseudomonas putida KT2440
aauacacccacaccu

SEQ ID NO: 1609287 - RNA, 22 nt, Pseudomonas putida KT2440
aauacacccacaccucgacccg

SEQ ID NO: 1609288 - RNA, 14 nt, Pseudomonas putida KT2440
uuuuuguccauucu

SEQ ID NO: 1609289 - RNA, 16 nt, Pseudomonas putida KT2440
uuuuugaaaaaugauc

SEQ ID NO: 1609290 - RNA, 18 nt, Pseudomonas putida KT2440
uuuuugaaaaaaagauuu

SEQ ID NO: 1609291 - RNA, 19 nt, Pseudomonas putida KT2440
aaaugugcgcaucaacgaa

SEQ ID NO: 1609292 - RNA, 16 nt, Pseudomonas putida KT2440
uuuugaaaaaugauca

SEQ ID NO: 1609293 - RNA, 19 nt, Pseudomonas putida KT2440
uuuugaagucgagcgccgc

SEQ ID NO: 1609294 - RNA, 14 nt, Pseudomonas putida KT2440
uuuucuaaguccuu

SEQ ID NO: 1609295 - RNA, 23 nt, Pseudomonas putida KT2440
uuuucuggugccggccucuucgc

SEQ ID NO: 1609296 - RNA, 14 nt, Pseudomonas putida KT2440
uuuugcguggccug

SEQ ID NO: 1609297 - RNA, 17 nt, Pseudomonas putida KT2440
uuugggcugcgcggcag

SEQ ID NO: 1609298 - RNA, 12 nt, Pseudomonas putida KT2440
uuuggcucaggu

SEQ ID NO: 1609299 - RNA, 15 nt, Pseudomonas putida KT2440
uuugggcuugagcuc

SEQ ID NO: 1609300 - RNA, 20 nt, Pseudomonas putida KT2440
uuuggucacccgugcugcuc

SEQ ID NO: 1609301 - RNA, 15 nt, Pseudomonas putida KT2440
uuugcuggccugcag

SEQ ID NO: 1609302 - RNA, 17 nt, Pseudomonas putida KT2440
uuugucaacaaaaaacg

SEQ ID NO: 1609303 - RNA, 17 nt, Pseudomonas putida KT2440
uuugguuuuuucacuca

SEQ ID NO: 1609304 - RNA, 12 nt, Pseudomonas putida KT2440
uuuguccauucu

SEQ ID NO: 1609305 - RNA, 14 nt, Pseudomonas putida KT2440
uuuuauaaagagac

SEQ ID NO: 1609306 - RNA, 22 nt, Pseudomonas putida KT2440
uuuuccugcgggucauccucaa

SEQ ID NO: 1609307 - RNA, 21 nt, Pseudomonas putida KT2440
uuuucgcggguaaacccgcuc

SEQ ID NO: 1609308 - RNA, 19 nt, Pseudomonas putida KT2440
uuuuccaguuggcagggca

SEQ ID NO: 1609309 - RNA, 19 nt, Pseudomonas putida KT2440
uuuuccccuuauauuucac

SEQ ID NO: 1609310 - RNA, 14 nt, Pseudomonas putida KT2440
uuuucacacgccac

SEQ ID NO: 1609311 - RNA, 22 nt, Pseudomonas putida KT2440
uuuucagguuuaccauuuuccu

SEQ ID NO: 1609312 - RNA, 21 nt, Pseudomonas putida KT2440
uuuucauaccgagaaugaaac

SEQ ID NO: 1609313 - RNA, 16 nt, Pseudomonas putida KT2440
uuucuauuuaccuguc

SEQ ID NO: 1609314 - RNA, 23 nt, Pseudomonas putida KT2440
uuucuaguacuuuuucagguuua

SEQ ID NO: 1609315 - RNA, 13 nt, Pseudomonas putida KT2440
uuucggugcgcug

SEQ ID NO: 1609316 - RNA, 17 nt, Pseudomonas putida KT2440
uuucgcggcccagccca

SEQ ID NO: 1609317 - RNA, 19 nt, Pseudomonas putida KT2440
uuuccugcgcggccuugcc

SEQ ID NO: 1609318 - RNA, 20 nt, Pseudomonas putida KT2440
uuuccgggcaaugcaggcag

SEQ ID NO: 1609319 - RNA, 13 nt, Pseudomonas putida KT2440
uuugaacaauuua

SEQ ID NO: 1609320 - RNA, 13 nt, Pseudomonas putida KT2440
uuugaacaccuua

SEQ ID NO: 1609321 - RNA, 16 nt, Pseudomonas putida KT2440
uuugaauuggagcuga

SEQ ID NO: 1609322 - RNA, 21 nt, Pseudomonas putida KT2440
uuugacgcugcucauccuuuu

SEQ ID NO: 1609323 - RNA, 23 nt, Pseudomonas putida KT2440
uuucuucgaccugcguggugccu

SEQ ID NO: 1609324 - RNA, 19 nt, Pseudomonas putida KT2440
uuucuugaggcacaaaaaa

SEQ ID NO: 1609325 - RNA, 14 nt, Pseudomonas putida KT2440
uuugcaaaacuugg

SEQ ID NO: 1609326 - RNA, 23 nt, Pseudomonas putida KT2440
uuugcaaaacuuggguagugcau

SEQ ID NO: 1609327 - RNA, 23 nt, Pseudomonas putida KT2440
uuugcgccuuagacgguuacgug

SEQ ID NO: 1609328 - RNA, 13 nt, Pseudomonas putida KT2440
uuugcguggcacc

SEQ ID NO: 1609329 - RNA, 22 nt, Pseudomonas putida KT2440
uuugcucuaaaucgaccugcag

SEQ ID NO: 1609330 - RNA, 23 nt, Pseudomonas putida KT2440
uuugccaccacccggggcagcau

SEQ ID NO: 1609331 - RNA, 16 nt, Pseudomonas putida KT2440
uuucacucaugguuuu

SEQ ID NO: 1609332 - RNA, 15 nt, Pseudomonas putida KT2440
uuucaggcgcagcac

SEQ ID NO: 1609333 - RNA, 20 nt, Pseudomonas putida KT2440
uuucaggcgcucaccuacug

SEQ ID NO: 1609334 - RNA, 14 nt, Pseudomonas putida KT2440
uuucagguuuacca

SEQ ID NO: 1609335 - RNA, 22 nt, Pseudomonas putida KT2440
uuucagguuuaccauuuuccuu

SEQ ID NO: 1609336 - RNA, 20 nt, Pseudomonas putida KT2440
uuuccaccccggcagugccu

SEQ ID NO: 1609337 - RNA, 21 nt, Pseudomonas putida KT2440
uuuccagcgccacccaggcau

SEQ ID NO: 1609338 - RNA, 22 nt, Pseudomonas putida KT2440
uuucauccacauaggccagcuc

SEQ ID NO: 1609339 - RNA, 20 nt, Pseudomonas putida KT2440
uuucaccccuuuacuggcca

SEQ ID NO: 1609340 - RNA, 18 nt, Pseudomonas putida KT2440
uuucaccacuaccgcaaa

SEQ ID NO: 1609341 - RNA, 17 nt, Pseudomonas putida KT2440
uuucacacucgccagga

SEQ ID NO: 1609342 - RNA, 15 nt, Pseudomonas putida KT2440
uuucacagcaaaaaa

SEQ ID NO: 1609343 - RNA, 20 nt, Pseudomonas putida KT2440
uuucaauuuccggcuuugau

SEQ ID NO: 1609344 - RNA, 20 nt, Pseudomonas putida KT2440
uuguuggggucugcuuugca

SEQ ID NO: 1609345 - RNA, 20 nt, Pseudomonas putida KT2440
uuguugguguggcagcucug

SEQ ID NO: 1609346 - RNA, 16 nt, Pseudomonas putida KT2440
uugcugcagcaggcug

SEQ ID NO: 1609347 - RNA, 12 nt, Pseudomonas putida KT2440
uugcugcagguc

SEQ ID NO: 1609348 - RNA, 13 nt, Pseudomonas putida KT2440
uuuacgcauugcc

SEQ ID NO: 1609349 - RNA, 15 nt, Pseudomonas putida KT2440
uuuacuggccaucca

SEQ ID NO: 1609350 - RNA, 18 nt, Pseudomonas putida KT2440
uuuacccgcgaagaagcc

SEQ ID NO: 1609351 - RNA, 18 nt, Pseudomonas putida KT2440
uugacggugaauuccuug

SEQ ID NO: 1609352 - RNA, 19 nt, Pseudomonas putida KT2440
uugacggugaauuccuugc

SEQ ID NO: 1609353 - RNA, 22 nt, Pseudomonas putida KT2440
uugaccgugaucaucagcgccg

SEQ ID NO: 1609354 - RNA, 14 nt, Pseudomonas putida KT2440
uugacccccuucgg

SEQ ID NO: 1609355 - RNA, 19 nt, Pseudomonas putida KT2440
uugacgaucgccagcccca

SEQ ID NO: 1609356 - RNA, 23 nt, Pseudomonas putida KT2440
uugaagcgaaaccuaaacugugg

SEQ ID NO: 1609357 - RNA, 22 nt, Pseudomonas putida KT2440
uugaagcaccagguuugcugcc

SEQ ID NO: 1609358 - RNA, 23 nt, Pseudomonas putida KT2440
uugaagcaccagguuugcugccu

SEQ ID NO: 1609359 - RNA, 19 nt, Pseudomonas putida KT2440
uugaacccgugcaucugcu

SEQ ID NO: 1609360 - RNA, 16 nt, Pseudomonas putida KT2440
uugaaugccgccaucc

SEQ ID NO: 1609361 - RNA, 17 nt, Pseudomonas putida KT2440
uucugcauguccagccc

SEQ ID NO: 1609362 - RNA, 13 nt, Pseudomonas putida KT2440
uucugccagcucc

SEQ ID NO: 1609363 - RNA, 19 nt, Pseudomonas putida KT2440
uucugccagcuccuggcuc

SEQ ID NO: 1609364 - RNA, 20 nt, Pseudomonas putida KT2440
uucuugaagaugaccuuguc

SEQ ID NO: 1609365 - RNA, 21 nt, Pseudomonas putida KT2440
uucuugacgggugaccaggcc

SEQ ID NO: 1609366 - RNA, 14 nt, Pseudomonas putida KT2440
uucuugaagaagcu

SEQ ID NO: 1609367 - RNA, 14 nt, Pseudomonas putida KT2440
uucuugcaguucuu

SEQ ID NO: 1609368 - RNA, 19 nt, Pseudomonas putida KT2440
uucuuuacaacccagacuc

SEQ ID NO: 1609369 - RNA, 20 nt, Pseudomonas putida KT2440
uucuuucgacaugcaguuga

SEQ ID NO: 1609370 - RNA, 20 nt, Pseudomonas putida KT2440
uugaaacugccccuguucca

SEQ ID NO: 1609371 - RNA, 13 nt, Pseudomonas putida KT2440
uugaaagacugcu

SEQ ID NO: 1609372 - RNA, 13 nt, Pseudomonas putida KT2440
uugaacagcagcg

SEQ ID NO: 1609373 - RNA, 16 nt, Pseudomonas putida KT2440
uugaacagcagcgccg

SEQ ID NO: 1609374 - RNA, 14 nt, Pseudomonas putida KT2440
uugaaauuuuugcu

SEQ ID NO: 1609375 - RNA, 19 nt, Pseudomonas putida KT2440
uugaacacauccucaaagg

SEQ ID NO: 1609376 - RNA, 12 nt, Pseudomonas putida KT2440
uugaucaacccg

SEQ ID NO: 1609377 - RNA, 11 nt, Pseudomonas putida KT2440
uugaucagccu

SEQ ID NO: 1609378 - RNA, 16 nt, Pseudomonas putida KT2440
uugaucaggaaggcgu

SEQ ID NO: 1609379 - RNA, 21 nt, Pseudomonas putida KT2440
uugaucaggcccggcugaaac

SEQ ID NO: 1609380 - RNA, 15 nt, Pseudomonas putida KT2440
uugauauccagcacc

SEQ ID NO: 1609381 - RNA, 19 nt, Pseudomonas putida KT2440
uugagcacgaaacugcgcu

SEQ ID NO: 1609382 - RNA, 17 nt, Pseudomonas putida KT2440
uugagacauucaccgcc

SEQ ID NO: 1609383 - RNA, 15 nt, Pseudomonas putida KT2440
uugaugaucugcucc

SEQ ID NO: 1609384 - RNA, 21 nt, Pseudomonas putida KT2440
uugccaacagcaguugcugcu

SEQ ID NO: 1609385 - RNA, 23 nt, Pseudomonas putida KT2440
uugcacucccccuuggugcaaug

SEQ ID NO: 1609386 - RNA, 20 nt, Pseudomonas putida KT2440
uugcccgagcgcuuaaauca

SEQ ID NO: 1609387 - RNA, 17 nt, Pseudomonas putida KT2440
uugcccgacaccucaau

SEQ ID NO: 1609388 - RNA, 21 nt, Pseudomonas putida KT2440
uugccaagcacggcgccgacc

SEQ ID NO: 1609389 - RNA, 13 nt, Pseudomonas putida KT2440
uugccaccagugc

SEQ ID NO: 1609390 - RNA, 16 nt, Pseudomonas putida KT2440
uugccaccacccgggg

SEQ ID NO: 1609391 - RNA, 22 nt, Pseudomonas putida KT2440
uugccaccacccggggcagcau

SEQ ID NO: 1609392 - RNA, 18 nt, Pseudomonas putida KT2440
uugccgcgccgcaaagac

SEQ ID NO: 1609393 - RNA, 18 nt, Pseudomonas putida KT2440
uugcccuguuucuucaag

SEQ ID NO: 1609394 - RNA, 15 nt, Pseudomonas putida KT2440
uugcccuguggcugu

SEQ ID NO: 1609395 - RNA, 23 nt, Pseudomonas putida KT2440
uugcccgcgaaugggccgcagag

SEQ ID NO: 1609396 - RNA, 19 nt, Pseudomonas putida KT2440
uugcccgcgacgaaaccca

SEQ ID NO: 1609397 - RNA, 19 nt, Pseudomonas putida KT2440
uugcucuuguuccgccgcu

SEQ ID NO: 1609398 - RNA, 17 nt, Pseudomonas putida KT2440
uugcucgcccgcaacau

SEQ ID NO: 1609399 - RNA, 16 nt, Pseudomonas putida KT2440
uugcucggugcugcug

SEQ ID NO: 1609400 - RNA, 20 nt, Pseudomonas putida KT2440
uugcucuaaaucgaccugca

SEQ ID NO: 1609401 - RNA, 19 nt, Pseudomonas putida KT2440
uugcuccgcgaggcucuug

SEQ ID NO: 1609402 - RNA, 22 nt, Pseudomonas putida KT2440
uugcuccaguucauucccggcc

SEQ ID NO: 1609403 - RNA, 19 nt, Pseudomonas putida KT2440
uugcucauccacaccuucg

SEQ ID NO: 1609404 - RNA, 15 nt, Pseudomonas putida KT2440
uugcucaacuucccu

SEQ ID NO: 1609405 - RNA, 24 nt, Pseudomonas putida KT2440
uugcgucgcgaugggcugcaaagc

SEQ ID NO: 1609406 - RNA, 16 nt, Pseudomonas putida KT2440
uugcgugccucagcca

SEQ ID NO: 1609407 - RNA, 22 nt, Pseudomonas putida KT2440
uugcgcagcggcgucaccuucc

SEQ ID NO: 1609408 - RNA, 20 nt, Pseudomonas putida KT2440
uugcgcacgcgcuuuuccag

SEQ ID NO: 1609409 - RNA, 12 nt, Pseudomonas putida KT2440
uugcgcacggcc

SEQ ID NO: 1609410 - RNA, 20 nt, Pseudomonas putida KT2440
uugccuguccccuuggcccu

SEQ ID NO: 1609411 - RNA, 17 nt, Pseudomonas putida KT2440
uugccuguugccaaugc

SEQ ID NO: 1609412 - RNA, 20 nt, Pseudomonas putida KT2440
uugccuggcuuuccaggucc

SEQ ID NO: 1609413 - RNA, 13 nt, Pseudomonas putida KT2440
uugccuggaauuc

SEQ ID NO: 1609414 - RNA, 15 nt, Pseudomonas putida KT2440
uucccgcgcaaaugc

SEQ ID NO: 1609415 - RNA, 21 nt, Pseudomonas putida KT2440
uucccgccauguugcgcagca

SEQ ID NO: 1609416 - RNA, 21 nt, Pseudomonas putida KT2440
uucccgccauugcaccacgcc

SEQ ID NO: 1609417 - RNA, 18 nt, Pseudomonas putida KT2440
uucccauccacuucgcaa

SEQ ID NO: 1609418 - RNA, 23 nt, Pseudomonas putida KT2440
uucccagcaccccagcaccaccc

SEQ ID NO: 1609419 - RNA, 14 nt, Pseudomonas putida KT2440
uucccaauccucag

SEQ ID NO: 1609420 - RNA, 20 nt, Pseudomonas putida KT2440
uuccuggaagcggaaguuca

SEQ ID NO: 1609421 - RNA, 18 nt, Pseudomonas putida KT2440
uuccuggccuuccuugcc

SEQ ID NO: 1609422 - RNA, 20 nt, Pseudomonas putida KT2440
uuccugggaagcugcagcag

SEQ ID NO: 1609423 - RNA, 19 nt, Pseudomonas putida KT2440
uuccugugccgcuuuggca

SEQ ID NO: 1609424 - RNA, 14 nt, Pseudomonas putida KT2440
uuccugcaccuugu

SEQ ID NO: 1609425 - RNA, 12 nt, Pseudomonas putida KT2440
uuccuccaucuc

SEQ ID NO: 1609426 - RNA, 15 nt, Pseudomonas putida KT2440
uuccgcguccuugac

SEQ ID NO: 1609427 - RNA, 18 nt, Pseudomonas putida KT2440
uuccgcgugcccccccaa

SEQ ID NO: 1609428 - RNA, 17 nt, Pseudomonas putida KT2440
uuccggauugucaugcg

SEQ ID NO: 1609429 - RNA, 19 nt, Pseudomonas putida KT2440
uuccggcacggugcuacca

SEQ ID NO: 1609430 - RNA, 17 nt, Pseudomonas putida KT2440
uuccagcccuuccacca

SEQ ID NO: 1609431 - RNA, 15 nt, Pseudomonas putida KT2440
uuccagccugcagca

SEQ ID NO: 1609432 - RNA, 20 nt, Pseudomonas putida KT2440
uuccagaaucugcacacugc

SEQ ID NO: 1609433 - RNA, 16 nt, Pseudomonas putida KT2440
uuccaccggcacggca

SEQ ID NO: 1609434 - RNA, 14 nt, Pseudomonas putida KT2440
uuccaccuggccac

SEQ ID NO: 1609435 - RNA, 23 nt, Pseudomonas putida KT2440
uuccaccgccucgaccuggcccg

SEQ ID NO: 1609436 - RNA, 19 nt, Pseudomonas putida KT2440
uuccaccauucccugcaca

SEQ ID NO: 1609437 - RNA, 17 nt, Pseudomonas putida KT2440
uucaggggcccuuggcc

SEQ ID NO: 1609438 - RNA, 14 nt, Pseudomonas putida KT2440
uucaggcgcucacc

SEQ ID NO: 1609439 - RNA, 20 nt, Pseudomonas putida KT2440
uucaggcgcucaccccgccc

SEQ ID NO: 1609440 - RNA, 24 nt, Pseudomonas putida KT2440
uuccacacggcgguucugcgcacg

SEQ ID NO: 1609441 - RNA, 15 nt, Pseudomonas putida KT2440
uucagguacagcagc

SEQ ID NO: 1609442 - RNA, 18 nt, Pseudomonas putida KT2440
uuccaucgaaguguugcc

SEQ ID NO: 1609443 - RNA, 23 nt, Pseudomonas putida KT2440
uuccauuugcgcuggcugccgcg

SEQ ID NO: 1609444 - RNA, 20 nt, Pseudomonas putida KT2440
uuccauuucgaagcugucuu

SEQ ID NO: 1609445 - RNA, 13 nt, Pseudomonas putida KT2440
uuccagcugucau

SEQ ID NO: 1609446 - RNA, 18 nt, Pseudomonas putida KT2440
uuccagcugucauuaccc

SEQ ID NO: 1609447 - RNA, 20 nt, Pseudomonas putida KT2440
uuccagcuucugcugguccu

SEQ ID NO: 1609448 - RNA, 13 nt, Pseudomonas putida KT2440
uuccagcuccuuc

SEQ ID NO: 1609449 - RNA, 15 nt, Pseudomonas putida KT2440
uuccagguggccgcc

SEQ ID NO: 1609450 - RNA, 20 nt, Pseudomonas putida KT2440
uuccagugaagcuuccaguu

SEQ ID NO: 1609451 - RNA, 23 nt, Pseudomonas putida KT2440
uuccagugccgccaccuggcugc

SEQ ID NO: 1609452 - RNA, 19 nt, Pseudomonas putida KT2440
uucgaacacccgcuugccu

SEQ ID NO: 1609453 - RNA, 15 nt, Pseudomonas putida KT2440
uucgcaggcacgccc

SEQ ID NO: 1609454 - RNA, 13 nt, Pseudomonas putida KT2440
uuccuugcagcuc

SEQ ID NO: 1609455 - RNA, 21 nt, Pseudomonas putida KT2440
uuccuugcccagccaacccuc

SEQ ID NO: 1609456 - RNA, 18 nt, Pseudomonas putida KT2440
uucgcugucuuccagggc

SEQ ID NO: 1609457 - RNA, 21 nt, Pseudomonas putida KT2440
uucgcuaaccucugcaugcca

SEQ ID NO: 1609458 - RNA, 16 nt, Pseudomonas putida KT2440
uucgcucacaaagccc

SEQ ID NO: 1609459 - RNA, 23 nt, Pseudomonas putida KT2440
uucgccaaggccucgaacagcag

SEQ ID NO: 1609460 - RNA, 15 nt, Pseudomonas putida KT2440
uucgccggcacgccc

SEQ ID NO: 1609461 - RNA, 12 nt, Pseudomonas putida KT2440
uucgguguccuu

SEQ ID NO: 1609462 - RNA, 18 nt, Pseudomonas putida KT2440
uucggugugcuccagcuc

SEQ ID NO: 1609463 - RNA, 20 nt, Pseudomonas putida KT2440
uucggugugcuccagcucca

SEQ ID NO: 1609464 - RNA, 16 nt, Pseudomonas putida KT2440
uucggugcucaggcuc

SEQ ID NO: 1609465 - RNA, 14 nt, Pseudomonas putida KT2440
uucugcaccuugcc

SEQ ID NO: 1609466 - RNA, 17 nt, Pseudomonas putida KT2440
uucucuuccggcaggua

SEQ ID NO: 1609467 - RNA, 20 nt, Pseudomonas putida KT2440
uucucggucgccaaccccac

SEQ ID NO: 1609468 - RNA, 13 nt, Pseudomonas putida KT2440
uucucggcaaagc

SEQ ID NO: 1609469 - RNA, 16 nt, Pseudomonas putida KT2440
uucucggcaaagcguu

SEQ ID NO: 1609470 - RNA, 15 nt, Pseudomonas putida KT2440
uucucguuagaaauc

SEQ ID NO: 1609471 - RNA, 11 nt, Pseudomonas putida KT2440
uucucacugau

SEQ ID NO: 1609472 - RNA, 22 nt, Pseudomonas putida KT2440
uucuagcuuggucucguugcuu

SEQ ID NO: 1609473 - RNA, 15 nt, Pseudomonas putida KT2440
uuauagcuuuuuugg

SEQ ID NO: 1609474 - RNA, 16 nt, Pseudomonas putida KT2440
uuaucugggguggggu

SEQ ID NO: 1609475 - RNA, 20 nt, Pseudomonas putida KT2440
uuaucgagcuacagccccuu

SEQ ID NO: 1609476 - RNA, 20 nt, Pseudomonas putida KT2440
uuaugccgcguuccuuucuc

SEQ ID NO: 1609477 - RNA, 22 nt, Pseudomonas putida KT2440
uuauggaugccaauuuccauac

SEQ ID NO: 1609478 - RNA, 15 nt, Pseudomonas putida KT2440
uucagccguucaccu

SEQ ID NO: 1609479 - RNA, 19 nt, Pseudomonas putida KT2440
uucaggcacggcaccagca

SEQ ID NO: 1609480 - RNA, 15 nt, Pseudomonas putida KT2440
uucaggcaaaacaaa

SEQ ID NO: 1609481 - RNA, 18 nt, Pseudomonas putida KT2440
uucagcaccuucuugccc

SEQ ID NO: 1609482 - RNA, 20 nt, Pseudomonas putida KT2440
uucagcacaccgcucaaccu

SEQ ID NO: 1609483 - RNA, 21 nt, Pseudomonas putida KT2440
uucacgcacggccuucccgcc

SEQ ID NO: 1609484 - RNA, 17 nt, Pseudomonas putida KT2440
uucacgcaagcgccuga

SEQ ID NO: 1609485 - RNA, 17 nt, Pseudomonas putida KT2440
uucaccuccaguugcca

SEQ ID NO: 1609486 - RNA, 16 nt, Pseudomonas putida KT2440
uucacacucgccagga

SEQ ID NO: 1609487 - RNA, 15 nt, Pseudomonas putida KT2440
uucacagcaaaaaau

SEQ ID NO: 1609488 - RNA, 18 nt, Pseudomonas putida KT2440
uucacaccggccuuggcc

SEQ ID NO: 1609489 - RNA, 22 nt, Pseudomonas putida KT2440
uucacagcguugcagaaacucg

SEQ ID NO: 1609490 - RNA, 23 nt, Pseudomonas putida KT2440
uucacagcguugcagaaacucgu

SEQ ID NO: 1609491 - RNA, 23 nt, Pseudomonas putida KT2440
uucaagaggagugcuucauagcc

SEQ ID NO: 1609492 - RNA, 14 nt, Pseudomonas putida KT2440
uucaagcaccgcgc

SEQ ID NO: 1609493 - RNA, 22 nt, Pseudomonas putida KT2440
uuagacgguuacgugcaggcgc

SEQ ID NO: 1609494 - RNA, 15 nt, Pseudomonas putida KT2440
uuagcuuauucgaug

SEQ ID NO: 1609495 - RNA, 22 nt, Pseudomonas putida KT2440
uuacuggccaauugcgccauca

SEQ ID NO: 1609496 - RNA, 11 nt, Pseudomonas putida KT2440
uuacucccaca

SEQ ID NO: 1609497 - RNA, 14 nt, Pseudomonas putida KT2440
uuacucccacagcg

SEQ ID NO: 1609498 - RNA, 20 nt, Pseudomonas putida KT2440
uuacuugcacaucccagaac

SEQ ID NO: 1609499 - RNA, 19 nt, Pseudomonas putida KT2440
uuacugguggacacugccg

SEQ ID NO: 1609500 - RNA, 11 nt, Pseudomonas putida KT2440
uuagaacagau

SEQ ID NO: 1609501 - RNA, 11 nt, Pseudomonas putida KT2440
uuacccugguc

SEQ ID NO: 1609502 - RNA, 18 nt, Pseudomonas putida KT2440
uuacccucgggacugugc

SEQ ID NO: 1609503 - RNA, 18 nt, Pseudomonas putida KT2440
uuacccgcgaacaccggc

SEQ ID NO: 1609504 - RNA, 18 nt, Pseudomonas putida KT2440
uuacccgcgaagaagccg

SEQ ID NO: 1609505 - RNA, 23 nt, Pseudomonas putida KT2440
uuacccgcgaagcguuuacugcu

SEQ ID NO: 1609506 - RNA, 22 nt, Pseudomonas putida KT2440
uuagguagcggggccgcuuugu

SEQ ID NO: 1609507 - RNA, 18 nt, Pseudomonas putida KT2440
uuaguauggaaauggaau

SEQ ID NO: 1609508 - RNA, 16 nt, Pseudomonas putida KT2440
uuaccacauaacugcc

SEQ ID NO: 1609509 - RNA, 11 nt, Pseudomonas putida KT2440
uuaccaccggg

SEQ ID NO: 1609510 - RNA, 13 nt, Pseudomonas putida KT2440
uuaauuugaacaa

SEQ ID NO: 1609511 - RNA, 16 nt, Pseudomonas putida KT2440
uuaauuccggccggcu

SEQ ID NO: 1609512 - RNA, 16 nt, Pseudomonas putida KT2440
ugugccguaccugugg

SEQ ID NO: 1609513 - RNA, 16 nt, Pseudomonas putida KT2440
uuaagcgccggcgggg

SEQ ID NO: 1609514 - RNA, 21 nt, Pseudomonas putida KT2440
uuaagaagccgacccacuugu

SEQ ID NO: 1609515 - RNA, 21 nt, Pseudomonas putida KT2440
uggccagacucagcugcugcu

SEQ ID NO: 1609516 - RNA, 14 nt, Pseudomonas putida KT2440
uggccacuguugca

SEQ ID NO: 1609517 - RNA, 12 nt, Pseudomonas putida KT2440
uggcccaaggcg

SEQ ID NO: 1609518 - RNA, 16 nt, Pseudomonas putida KT2440
uggccccggccaggcc

SEQ ID NO: 1609519 - RNA, 14 nt, Pseudomonas putida KT2440
uggccccacccaac

SEQ ID NO: 1609520 - RNA, 11 nt, Pseudomonas putida KT2440
uggcccacccg

SEQ ID NO: 1609521 - RNA, 19 nt, Pseudomonas putida KT2440
uggcccagccagcgugggc

SEQ ID NO: 1609522 - RNA, 19 nt, Pseudomonas putida KT2440
uggcccaguacgccaccca

SEQ ID NO: 1609523 - RNA, 17 nt, Pseudomonas putida KT2440
uggcaugggugagcacg

SEQ ID NO: 1609524 - RNA, 13 nt, Pseudomonas putida KT2440
uggcaucgcugcc

SEQ ID NO: 1609525 - RNA, 21 nt, Pseudomonas putida KT2440
uggcaucaaugcaauguuuuc

SEQ ID NO: 1609526 - RNA, 22 nt, Pseudomonas putida KT2440
uggcaggugaucguugcgcgcc

SEQ ID NO: 1609527 - RNA, 21 nt, Pseudomonas putida KT2440
uggcagguaaaaaucaugcag

SEQ ID NO: 1609528 - RNA, 20 nt, Pseudomonas putida KT2440
uggcagguucgaccacugca

SEQ ID NO: 1609529 - RNA, 13 nt, Pseudomonas putida KT2440
uggcaguguggca

SEQ ID NO: 1609530 - RNA, 18 nt, Pseudomonas putida KT2440
uggcacucucgcggugcc

SEQ ID NO: 1609531 - RNA, 13 nt, Pseudomonas putida KT2440
uggcaagggcgga

SEQ ID NO: 1609532 - RNA, 18 nt, Pseudomonas putida KT2440
uggauagcagcucaacca

SEQ ID NO: 1609533 - RNA, 13 nt, Pseudomonas putida KT2440
uggauagagcauc

SEQ ID NO: 1609534 - RNA, 14 nt, Pseudomonas putida KT2440
uggauagagcaucc

SEQ ID NO: 1609535 - RNA, 19 nt, Pseudomonas putida KT2440
uggauagaguacucggcua

SEQ ID NO: 1609536 - RNA, 23 nt, Pseudomonas putida KT2440
uggaucggcgugcggcuggcuuc

SEQ ID NO: 1609537 - RNA, 16 nt, Pseudomonas putida KT2440
uggauccgccaccaac

SEQ ID NO: 1609538 - RNA, 14 nt, Pseudomonas putida KT2440
uggaucagccgcgc

SEQ ID NO: 1609539 - RNA, 13 nt, Pseudomonas putida KT2440
uggaucagcucau

SEQ ID NO: 1609540 - RNA, 14 nt, Pseudomonas putida KT2440
uggaggaguccagc

SEQ ID NO: 1609541 - RNA, 16 nt, Pseudomonas putida KT2440
uggaggcugggcguga

SEQ ID NO: 1609542 - RNA, 17 nt, Pseudomonas putida KT2440
uggaguacgggcacacc

SEQ ID NO: 1609543 - RNA, 16 nt, Pseudomonas putida KT2440
uggagagccccaccag

SEQ ID NO: 1609544 - RNA, 20 nt, Pseudomonas putida KT2440
uggagagcgauuccaagugc

SEQ ID NO: 1609545 - RNA, 22 nt, Pseudomonas putida KT2440
uggacggccggugguaauuggc

SEQ ID NO: 1609546 - RNA, 13 nt, Pseudomonas putida KT2440
uggacgccgcacc

SEQ ID NO: 1609547 - RNA, 15 nt, Pseudomonas putida KT2440
uggacuugccuuggc

SEQ ID NO: 1609548 - RNA, 12 nt, Pseudomonas putida KT2440
uggcccucugcg

SEQ ID NO: 1609549 - RNA, 15 nt, Pseudomonas putida KT2440
uggcccugaucugcc

SEQ ID NO: 1609550 - RNA, 18 nt, Pseudomonas putida KT2440
uggcccgccaguaggcug

SEQ ID NO: 1609551 - RNA, 19 nt, Pseudomonas putida KT2440
uggcccgccgccaccagcg

SEQ ID NO: 1609552 - RNA, 14 nt, Pseudomonas putida KT2440
uggcccgcagcgcu

SEQ ID NO: 1609553 - RNA, 16 nt, Pseudomonas putida KT2440
uggcccgcagcgcuuc

SEQ ID NO: 1609554 - RNA, 23 nt, Pseudomonas putida KT2440
uggccuugaucaggcccugcugc

SEQ ID NO: 1609555 - RNA, 13 nt, Pseudomonas putida KT2440
uggccuucucuuc

SEQ ID NO: 1609556 - RNA, 19 nt, Pseudomonas putida KT2440
uggccuucucuuccgccag

SEQ ID NO: 1609557 - RNA, 18 nt, Pseudomonas putida KT2440
uggccuuccuugcccagc

SEQ ID NO: 1609558 - RNA, 12 nt, Pseudomonas putida KT2440
uggccugcucac

SEQ ID NO: 1609559 - RNA, 16 nt, Pseudomonas putida KT2440
uggcgacuucgugcgc

SEQ ID NO: 1609560 - RNA, 20 nt, Pseudomonas putida KT2440
uggcgagcaggcccgccccu

SEQ ID NO: 1609561 - RNA, 15 nt, Pseudomonas putida KT2440
uggcgcaggccgcug

SEQ ID NO: 1609562 - RNA, 19 nt, Pseudomonas putida KT2440
uggcgcaggccgcuggccg

SEQ ID NO: 1609563 - RNA, 12 nt, Pseudomonas putida KT2440
uggcgcaggcug

SEQ ID NO: 1609564 - RNA, 22 nt, Pseudomonas putida KT2440
uggcgcagcaaggucgccgccg

SEQ ID NO: 1609565 - RNA, 22 nt, Pseudomonas putida KT2440
uggcgcagcagguccagcuccg

SEQ ID NO: 1609566 - RNA, 15 nt, Pseudomonas putida KT2440
uggcgcaaucuugcc

SEQ ID NO: 1609567 - RNA, 15 nt, Pseudomonas putida KT2440
uggcgcaagccgugc

SEQ ID NO: 1609568 - RNA, 16 nt, Pseudomonas putida KT2440
uggcgcaccgagcgcu

SEQ ID NO: 1609569 - RNA, 19 nt, Pseudomonas putida KT2440
uggcgcacagggcgaugcc

SEQ ID NO: 1609570 - RNA, 18 nt, Pseudomonas putida KT2440
uggcgcaugacuuccagg

SEQ ID NO: 1609571 - RNA, 13 nt, Pseudomonas putida KT2440
uggcgcaccagcg

SEQ ID NO: 1609572 - RNA, 16 nt, Pseudomonas putida KT2440
uggcgcaguucgucca

SEQ ID NO: 1609573 - RNA, 17 nt, Pseudomonas putida KT2440
uggcgcaguucguccag

SEQ ID NO: 1609574 - RNA, 16 nt, Pseudomonas putida KT2440
uggcgucacagacaug

SEQ ID NO: 1609575 - RNA, 15 nt, Pseudomonas putida KT2440
uggcguuuuucacac

SEQ ID NO: 1609576 - RNA, 23 nt, Pseudomonas putida KT2440
uggcguuuuucacacgccacuaa

SEQ ID NO: 1609577 - RNA, 18 nt, Pseudomonas putida KT2440
uggcguccagcagugcca

SEQ ID NO: 1609578 - RNA, 21 nt, Pseudomonas putida KT2440
uggcuagccucaucagagcgu

SEQ ID NO: 1609579 - RNA, 18 nt, Pseudomonas putida KT2440
uggcuacccgcucggccu

SEQ ID NO: 1609580 - RNA, 15 nt, Pseudomonas putida KT2440
uggcucagcgagcgg

SEQ ID NO: 1609581 - RNA, 16 nt, Pseudomonas putida KT2440
uggcucacacccaggc

SEQ ID NO: 1609582 - RNA, 16 nt, Pseudomonas putida KT2440
uggcucaacuggcagg

SEQ ID NO: 1609583 - RNA, 19 nt, Pseudomonas putida KT2440
uggcgguugaccagggcgu

SEQ ID NO: 1609584 - RNA, 12 nt, Pseudomonas putida KT2440
uggcggccgcag

SEQ ID NO: 1609585 - RNA, 15 nt, Pseudomonas putida KT2440
uggcgcgaccaucac

SEQ ID NO: 1609586 - RNA, 18 nt, Pseudomonas putida KT2440
uggcgcccggcgcuggug

SEQ ID NO: 1609587 - RNA, 20 nt, Pseudomonas putida KT2440
ugggaccgcuguuaccagag

SEQ ID NO: 1609588 - RNA, 22 nt, Pseudomonas putida KT2440
uggcugugauacagcacgcgca

SEQ ID NO: 1609589 - RNA, 23 nt, Pseudomonas putida KT2440
uggcugugcacccgugccugccu

SEQ ID NO: 1609590 - RNA, 20 nt, Pseudomonas putida KT2440
uggcuggcaccggcugcgcc

SEQ ID NO: 1609591 - RNA, 17 nt, Pseudomonas putida KT2440
uggcuggucuccagcag

SEQ ID NO: 1609592 - RNA, 21 nt, Pseudomonas putida KT2440
uggcuggucuccagcagugcc

SEQ ID NO: 1609593 - RNA, 15 nt, Pseudomonas putida KT2440
uggcuggugaaggca

SEQ ID NO: 1609594 - RNA, 15 nt, Pseudomonas putida KT2440
uggcuguaccggccu

SEQ ID NO: 1609595 - RNA, 16 nt, Pseudomonas putida KT2440
uggcuguugcgguugc

SEQ ID NO: 1609596 - RNA, 22 nt, Pseudomonas putida KT2440
uggcuguugcgguugccaagca

SEQ ID NO: 1609597 - RNA, 14 nt, Pseudomonas putida KT2440
uggcuaugccggcc

SEQ ID NO: 1609598 - RNA, 18 nt, Pseudomonas putida KT2440
uggcucaugcgccagggc

SEQ ID NO: 1609599 - RNA, 12 nt, Pseudomonas putida KT2440
uggcuccaccac

SEQ ID NO: 1609600 - RNA, 15 nt, Pseudomonas putida KT2440
uggcucgcagccaau

SEQ ID NO: 1609601 - RNA, 18 nt, Pseudomonas putida KT2440
uggcucgaaucaagccug

SEQ ID NO: 1609602 - RNA, 21 nt, Pseudomonas putida KT2440
uggcucgaaucaagccugcgc

SEQ ID NO: 1609603 - RNA, 18 nt, Pseudomonas putida KT2440
uggcucgcugccccaguc

SEQ ID NO: 1609604 - RNA, 21 nt, Pseudomonas putida KT2440
uggcucuccucucccaccagc

SEQ ID NO: 1609605 - RNA, 19 nt, Pseudomonas putida KT2440
uggcucuucaacaccagca

SEQ ID NO: 1609606 - RNA, 13 nt, Pseudomonas putida KT2440
uggcugcggcagg

SEQ ID NO: 1609607 - RNA, 19 nt, Pseudomonas putida KT2440
uggcugcgggugcccgggc

SEQ ID NO: 1609608 - RNA, 15 nt, Pseudomonas putida KT2440
uggcugcccgagagc

SEQ ID NO: 1609609 - RNA, 17 nt, Pseudomonas putida KT2440
uggcugccuucgcucag

SEQ ID NO: 1609610 - RNA, 23 nt, Pseudomonas putida KT2440
uggcugccgcggguggcuucguc

SEQ ID NO: 1609611 - RNA, 23 nt, Pseudomonas putida KT2440
uggcugaggguuguugaagaaga

SEQ ID NO: 1609612 - RNA, 19 nt, Pseudomonas putida KT2440
uggcugcaggucggccagc

SEQ ID NO: 1609613 - RNA, 17 nt, Pseudomonas putida KT2440
uggcugagcgcauuauc

SEQ ID NO: 1609614 - RNA, 22 nt, Pseudomonas putida KT2440
uggcugauagccgccagcauca

SEQ ID NO: 1609615 - RNA, 18 nt, Pseudomonas putida KT2440
ugggccaguaccuucugg

SEQ ID NO: 1609616 - RNA, 22 nt, Pseudomonas putida KT2440
ugggcccgccauucuucuccag

SEQ ID NO: 1609617 - RNA, 16 nt, Pseudomonas putida KT2440
ugggccggcgcccugc

SEQ ID NO: 1609618 - RNA, 13 nt, Pseudomonas putida KT2440
ugggccugcacga

SEQ ID NO: 1609619 - RNA, 16 nt, Pseudomonas putida KT2440
ugggccccaggcggug

SEQ ID NO: 1609620 - RNA, 23 nt, Pseudomonas putida KT2440
ugggcauccagcuugccaccauc

SEQ ID NO: 1609621 - RNA, 19 nt, Pseudomonas putida KT2440
ugggagcgggcgugcccgc

SEQ ID NO: 1609622 - RNA, 21 nt, Pseudomonas putida KT2440
ugggagcgggcuugcccgcga

SEQ ID NO: 1609623 - RNA, 15 nt, Pseudomonas putida KT2440
ugggagagcgccugc

SEQ ID NO: 1609624 - RNA, 14 nt, Pseudomonas putida KT2440
ugggagcaggcaug

SEQ ID NO: 1609625 - RNA, 17 nt, Pseudomonas putida KT2440
ugggguauuugcagugg

SEQ ID NO: 1609626 - RNA, 19 nt, Pseudomonas putida KT2440
ugggcuucaugcugcugca

SEQ ID NO: 1609627 - RNA, 22 nt, Pseudomonas putida KT2440
ugggcuucaugcugcugcagca

SEQ ID NO: 1609628 - RNA, 15 nt, Pseudomonas putida KT2440
ugggcuuccccagcc

SEQ ID NO: 1609629 - RNA, 19 nt, Pseudomonas putida KT2440
ugggcuuugaaagguuuau

SEQ ID NO: 1609630 - RNA, 14 nt, Pseudomonas putida KT2440
uggguaacccugcu

SEQ ID NO: 1609631 - RNA, 21 nt, Pseudomonas putida KT2440
uggguaaucaguaccaggccu

SEQ ID NO: 1609632 - RNA, 19 nt, Pseudomonas putida KT2440
ugggcgaugaucgccuggc

SEQ ID NO: 1609633 - RNA, 21 nt, Pseudomonas putida KT2440
ugggcgaugaucgccuggccg

SEQ ID NO: 1609634 - RNA, 12 nt, Pseudomonas putida KT2440
ugggcgagccac

SEQ ID NO: 1609635 - RNA, 12 nt, Pseudomonas putida KT2440
ugggccugugcc

SEQ ID NO: 1609636 - RNA, 13 nt, Pseudomonas putida KT2440
ugggccugugccg

SEQ ID NO: 1609637 - RNA, 22 nt, Pseudomonas putida KT2440
ugggcgaacgccugcagggccu

SEQ ID NO: 1609638 - RNA, 13 nt, Pseudomonas putida KT2440
ugugcaagucuga

SEQ ID NO: 1609639 - RNA, 11 nt, Pseudomonas putida KT2440
ugugcacugcg

SEQ ID NO: 1609640 - RNA, 17 nt, Pseudomonas putida KT2440
ugugcccgacaccggcc

SEQ ID NO: 1609641 - RNA, 22 nt, Pseudomonas putida KT2440
ugugcccgcgaaucguccugga

SEQ ID NO: 1609642 - RNA, 15 nt, Pseudomonas putida KT2440
ugugaaacaccacac

SEQ ID NO: 1609643 - RNA, 16 nt, Pseudomonas putida KT2440
ugugaagccagggcaa

SEQ ID NO: 1609644 - RNA, 19 nt, Pseudomonas putida KT2440
ugugaagccagggcaagca

SEQ ID NO: 1609645 - RNA, 18 nt, Pseudomonas putida KT2440
ugucuuccagaccagaca

SEQ ID NO: 1609646 - RNA, 12 nt, Pseudomonas putida KT2440
ugucuuccaggg

SEQ ID NO: 1609647 - RNA, 12 nt, Pseudomonas putida KT2440
ugucuuccaggu

SEQ ID NO: 1609648 - RNA, 15 nt, Pseudomonas putida KT2440
ugucugcaacugccc

SEQ ID NO: 1609649 - RNA, 15 nt, Pseudomonas putida KT2440
ugucugacagcagga

SEQ ID NO: 1609650 - RNA, 18 nt, Pseudomonas putida KT2440
ugucuuccaguuccaucc

SEQ ID NO: 1609651 - RNA, 20 nt, Pseudomonas putida KT2440
ugucuuccaguuccauccag

SEQ ID NO: 1609652 - RNA, 19 nt, Pseudomonas putida KT2440
ugucucgcccaugggcuuu

SEQ ID NO: 1609653 - RNA, 21 nt, Pseudomonas putida KT2440
ugucuccgaacgccuuggccu

SEQ ID NO: 1609654 - RNA, 22 nt, Pseudomonas putida KT2440
ugucuccgaacgccuuggccuc

SEQ ID NO: 1609655 - RNA, 20 nt, Pseudomonas putida KT2440
ugucggcgaaggcuggccuc

SEQ ID NO: 1609656 - RNA, 20 nt, Pseudomonas putida KT2440
ugucggccagaucggccagc

SEQ ID NO: 1609657 - RNA, 19 nt, Pseudomonas putida KT2440
ugucggcacgcgccagcag

SEQ ID NO: 1609658 - RNA, 18 nt, Pseudomonas putida KT2440
ugucggcgucggccaugc

SEQ ID NO: 1609659 - RNA, 14 nt, Pseudomonas putida KT2440
ugucguccagcucg

SEQ ID NO: 1609660 - RNA, 15 nt, Pseudomonas putida KT2440
ugucguccagcucgc

SEQ ID NO: 1609661 - RNA, 19 nt, Pseudomonas putida KT2440
uguccuuguugaccccggg

SEQ ID NO: 1609662 - RNA, 17 nt, Pseudomonas putida KT2440
uguccuugcacuccccc

SEQ ID NO: 1609663 - RNA, 20 nt, Pseudomonas putida KT2440
uguccuuggccaacugcagc

SEQ ID NO: 1609664 - RNA, 19 nt, Pseudomonas putida KT2440
uguccuuggcccagccauc

SEQ ID NO: 1609665 - RNA, 17 nt, Pseudomonas putida KT2440
ugucgaccuggcucuuc

SEQ ID NO: 1609666 - RNA, 21 nt, Pseudomonas putida KT2440
ugucgacagugaauuccuugc

SEQ ID NO: 1609667 - RNA, 16 nt, Pseudomonas putida KT2440
ugucgaagcgcaccuc

SEQ ID NO: 1609668 - RNA, 17 nt, Pseudomonas putida KT2440
ugucgaagcgcucccag

SEQ ID NO: 1609669 - RNA, 20 nt, Pseudomonas putida KT2440
ugucgaacaggcugccgcgg

SEQ ID NO: 1609670 - RNA, 15 nt, Pseudomonas putida KT2440
ugucgaaccccugau

SEQ ID NO: 1609671 - RNA, 15 nt, Pseudomonas putida KT2440
ugucgaugccugcua

SEQ ID NO: 1609672 - RNA, 16 nt, Pseudomonas putida KT2440
ugucgaugccugcuaa

SEQ ID NO: 1609673 - RNA, 17 nt, Pseudomonas putida KT2440
uguccgcgccagcggcc

SEQ ID NO: 1609674 - RNA, 12 nt, Pseudomonas putida KT2440
uguccgccgccg

SEQ ID NO: 1609675 - RNA, 22 nt, Pseudomonas putida KT2440
uguccugcugcaggcucugaau

SEQ ID NO: 1609676 - RNA, 23 nt, Pseudomonas putida KT2440
uguccugauguucggugcucagg

SEQ ID NO: 1609677 - RNA, 23 nt, Pseudomonas putida KT2440
ugucaggugguaguccuugccgc

SEQ ID NO: 1609678 - RNA, 18 nt, Pseudomonas putida KT2440
ugucagcggcgcagcgcu

SEQ ID NO: 1609679 - RNA, 17 nt, Pseudomonas putida KT2440
ugucagcgccagcggcu

SEQ ID NO: 1609680 - RNA, 22 nt, Pseudomonas putida KT2440
ugucagcaaccacgcuuggcuc

SEQ ID NO: 1609681 - RNA, 17 nt, Pseudomonas putida KT2440
ugucagcagcuucagcc

SEQ ID NO: 1609682 - RNA, 22 nt, Pseudomonas putida KT2440
ugucaccgagacgaucaccagg

SEQ ID NO: 1609683 - RNA, 21 nt, Pseudomonas putida KT2440
ugucacccuugggcaccagcu

SEQ ID NO: 1609684 - RNA, 22 nt, Pseudomonas putida KT2440
ugucaccccguucgcccugcgc

SEQ ID NO: 1609685 - RNA, 19 nt, Pseudomonas putida KT2440
uguccauccaugcaaucac

SEQ ID NO: 1609686 - RNA, 15 nt, Pseudomonas putida KT2440
ugucaggggugccuu

SEQ ID NO: 1609687 - RNA, 13 nt, Pseudomonas putida KT2440
ugucccccagccc

SEQ ID NO: 1609688 - RNA, 15 nt, Pseudomonas putida KT2440
ugucccggcccagcc

SEQ ID NO: 1609689 - RNA, 16 nt, Pseudomonas putida KT2440
ugucccggcacaaccg

SEQ ID NO: 1609690 - RNA, 17 nt, Pseudomonas putida KT2440
uguccccgccgugcagu

SEQ ID NO: 1609691 - RNA, 16 nt, Pseudomonas putida KT2440
ugucccgcccugagcc

SEQ ID NO: 1609692 - RNA, 20 nt, Pseudomonas putida KT2440
uguaucggauuggcgcggcu

SEQ ID NO: 1609693 - RNA, 17 nt, Pseudomonas putida KT2440
uguagcaauggcccugg

SEQ ID NO: 1609694 - RNA, 15 nt, Pseudomonas putida KT2440
uguagcccaccaccu

SEQ ID NO: 1609695 - RNA, 13 nt, Pseudomonas putida KT2440
uguauucgagcuu

SEQ ID NO: 1609696 - RNA, 13 nt, Pseudomonas putida KT2440
uguauuuagucag

SEQ ID NO: 1609697 - RNA, 17 nt, Pseudomonas putida KT2440
uggucuagagaucugca

SEQ ID NO: 1609698 - RNA, 18 nt, Pseudomonas putida KT2440
ugggucgggaacagcucu

SEQ ID NO: 1609699 - RNA, 22 nt, Pseudomonas putida KT2440
ugggucagcugguucugcugca

SEQ ID NO: 1609700 - RNA, 12 nt, Pseudomonas putida KT2440
uggguccaggca

SEQ ID NO: 1609701 - RNA, 14 nt, Pseudomonas putida KT2440
ugggucaguuugac

SEQ ID NO: 1609702 - RNA, 18 nt, Pseudomonas putida KT2440
uggguauugucggucagg

SEQ ID NO: 1609703 - RNA, 18 nt, Pseudomonas putida KT2440
uggguccugcgccaggca

SEQ ID NO: 1609704 - RNA, 16 nt, Pseudomonas putida KT2440
uggugauguucucauc

SEQ ID NO: 1609705 - RNA, 14 nt, Pseudomonas putida KT2440
uggugcaccagcuu

SEQ ID NO: 1609706 - RNA, 14 nt, Pseudomonas putida KT2440
uggugccaucaccg

SEQ ID NO: 1609707 - RNA, 13 nt, Pseudomonas putida KT2440
uggugcgcccggc

SEQ ID NO: 1609708 - RNA, 17 nt, Pseudomonas putida KT2440
uggugcgccuccagcag

SEQ ID NO: 1609709 - RNA, 17 nt, Pseudomonas putida KT2440
uggugccugucgucagc

SEQ ID NO: 1609710 - RNA, 14 nt, Pseudomonas putida KT2440
uggugcggcugggc

SEQ ID NO: 1609711 - RNA, 21 nt, Pseudomonas putida KT2440
uggugccagcggccacuuaca

SEQ ID NO: 1609712 - RNA, 12 nt, Pseudomonas putida KT2440
uggugcuggcgg

SEQ ID NO: 1609713 - RNA, 17 nt, Pseudomonas putida KT2440
ugguggcauagcgcggc

SEQ ID NO: 1609714 - RNA, 13 nt, Pseudomonas putida KT2440
ugguggcccugac

SEQ ID NO: 1609715 - RNA, 12 nt, Pseudomonas putida KT2440
ugguggucagcc

SEQ ID NO: 1609716 - RNA, 19 nt, Pseudomonas putida KT2440
ugguggucacguuugcaaa

SEQ ID NO: 1609717 - RNA, 18 nt, Pseudomonas putida KT2440
ugguguacagcaacaccg

SEQ ID NO: 1609718 - RNA, 22 nt, Pseudomonas putida KT2440
uggugugaaauagccacgcauc

SEQ ID NO: 1609719 - RNA, 17 nt, Pseudomonas putida KT2440
ugguguccggcaugugc

SEQ ID NO: 1609720 - RNA, 20 nt, Pseudomonas putida KT2440
uggugucggccagggcccgc

SEQ ID NO: 1609721 - RNA, 13 nt, Pseudomonas putida KT2440
ugguuaucuucuc

SEQ ID NO: 1609722 - RNA, 15 nt, Pseudomonas putida KT2440
uguacauggccgcca

SEQ ID NO: 1609723 - RNA, 18 nt, Pseudomonas putida KT2440
uguacgcuggccaaggcc

SEQ ID NO: 1609724 - RNA, 16 nt, Pseudomonas putida KT2440
uguacagcacaccuuc

SEQ ID NO: 1609725 - RNA, 19 nt, Pseudomonas putida KT2440
uguacagaucgauccccug

SEQ ID NO: 1609726 - RNA, 19 nt, Pseudomonas putida KT2440
uguacaguggcacuggcgc

SEQ ID NO: 1609727 - RNA, 14 nt, Pseudomonas putida KT2440
ugguugaugcgcuc

SEQ ID NO: 1609728 - RNA, 17 nt, Pseudomonas putida KT2440
ugguuggcggagccagc

SEQ ID NO: 1609729 - RNA, 20 nt, Pseudomonas putida KT2440
ugguuggcggagccagccac

SEQ ID NO: 1609730 - RNA, 16 nt, Pseudomonas putida KT2440
ugguucauugccaaca

SEQ ID NO: 1609731 - RNA, 16 nt, Pseudomonas putida KT2440
ugguucaucaccagcc

SEQ ID NO: 1609732 - RNA, 19 nt, Pseudomonas putida KT2440
ugguucaucgacuugcguc

SEQ ID NO: 1609733 - RNA, 18 nt, Pseudomonas putida KT2440
ugguucuugccgagcagc

SEQ ID NO: 1609734 - RNA, 15 nt, Pseudomonas putida KT2440
ugguucugcugcagc

SEQ ID NO: 1609735 - RNA, 17 nt, Pseudomonas putida KT2440
ugguugaccgagaacag

SEQ ID NO: 1609736 - RNA, 13 nt, Pseudomonas putida KT2440
ugguuugugggua

SEQ ID NO: 1609737 - RNA, 16 nt, Pseudomonas putida KT2440
ugguuuggccucuggc

SEQ ID NO: 1609738 - RNA, 17 nt, Pseudomonas putida KT2440
ugccugcaugcgugccu

SEQ ID NO: 1609739 - RNA, 19 nt, Pseudomonas putida KT2440
ugccugaccggucagcccg

SEQ ID NO: 1609740 - RNA, 19 nt, Pseudomonas putida KT2440
ugccugcaaucagcucaca

SEQ ID NO: 1609741 - RNA, 16 nt, Pseudomonas putida KT2440
ugccugauugccuggc

SEQ ID NO: 1609742 - RNA, 21 nt, Pseudomonas putida KT2440
ugccugugucgaaccacugau

SEQ ID NO: 1609743 - RNA, 16 nt, Pseudomonas putida KT2440
ugccuguugccaaugc

SEQ ID NO: 1609744 - RNA, 22 nt, Pseudomonas putida KT2440
ugccuucggccacacgggcguu

SEQ ID NO: 1609745 - RNA, 14 nt, Pseudomonas putida KT2440
ugccuuccucggcc

SEQ ID NO: 1609746 - RNA, 22 nt, Pseudomonas putida KT2440
ugccuucgguggcaauggccug

SEQ ID NO: 1609747 - RNA, 12 nt, Pseudomonas putida KT2440
ugccuucagggg

SEQ ID NO: 1609748 - RNA, 14 nt, Pseudomonas putida KT2440
ugccggcccaaggc

SEQ ID NO: 1609749 - RNA, 20 nt, Pseudomonas putida KT2440
ugccggccucaauuccaguc

SEQ ID NO: 1609750 - RNA, 12 nt, Pseudomonas putida KT2440
ugccggccucuu

SEQ ID NO: 1609751 - RNA, 20 nt, Pseudomonas putida KT2440
ugccggccucuucgcggccu

SEQ ID NO: 1609752 - RNA, 22 nt, Pseudomonas putida KT2440
ugccggccagcgccugcaggcc

SEQ ID NO: 1609753 - RNA, 12 nt, Pseudomonas putida KT2440
ugccggccuuga

SEQ ID NO: 1609754 - RNA, 22 nt, Pseudomonas putida KT2440
ugccggcgccuccagcaacauc

SEQ ID NO: 1609755 - RNA, 15 nt, Pseudomonas putida KT2440
ugccggcgagcgcgu

SEQ ID NO: 1609756 - RNA, 17 nt, Pseudomonas putida KT2440
ugccagagaauuucucc

SEQ ID NO: 1609757 - RNA, 15 nt, Pseudomonas putida KT2440
ugccacgacaccggg

SEQ ID NO: 1609758 - RNA, 21 nt, Pseudomonas putida KT2440
ugccaccccgcaaagcccugc

SEQ ID NO: 1609759 - RNA, 22 nt, Pseudomonas putida KT2440
ugccaccccgcaaagcccugcc

SEQ ID NO: 1609760 - RNA, 16 nt, Pseudomonas putida KT2440
ugccgucgggcacgau

SEQ ID NO: 1609761 - RNA, 19 nt, Pseudomonas putida KT2440
ugccgguggugaaaugguu

SEQ ID NO: 1609762 - RNA, 16 nt, Pseudomonas putida KT2440
ugccggugcgcgggcg

SEQ ID NO: 1609763 - RNA, 13 nt, Pseudomonas putida KT2440
ugccggucggccu

SEQ ID NO: 1609764 - RNA, 17 nt, Pseudomonas putida KT2440
ugccggucgggcaaggc

SEQ ID NO: 1609765 - RNA, 22 nt, Pseudomonas putida KT2440
ugccgguagugaugcaucagcu

SEQ ID NO: 1609766 - RNA, 14 nt, Pseudomonas putida KT2440
ugccggucagcagc

SEQ ID NO: 1609767 - RNA, 15 nt, Pseudomonas putida KT2440
ugccggucagcagca

SEQ ID NO: 1609768 - RNA, 15 nt, Pseudomonas putida KT2440
ugcgauccaggauca

SEQ ID NO: 1609769 - RNA, 20 nt, Pseudomonas putida KT2440
ugcgauagaacuccaccagc

SEQ ID NO: 1609770 - RNA, 23 nt, Pseudomonas putida KT2440
ugcgauagaacuccaccagccca

SEQ ID NO: 1609771 - RNA, 13 nt, Pseudomonas putida KT2440
ugcgaaucugcau

SEQ ID NO: 1609772 - RNA, 12 nt, Pseudomonas putida KT2440
ugcgaagcggcc

SEQ ID NO: 1609773 - RNA, 16 nt, Pseudomonas putida KT2440
ugcgaagcaagcgcau

SEQ ID NO: 1609774 - RNA, 23 nt, Pseudomonas putida KT2440
ugcgaagcaagcgcaugguggua

SEQ ID NO: 1609775 - RNA, 22 nt, Pseudomonas putida KT2440
ugcgaaaaccccggcucggucc

SEQ ID NO: 1609776 - RNA, 13 nt, Pseudomonas putida KT2440
ugcgaacugcaga

SEQ ID NO: 1609777 - RNA, 16 nt, Pseudomonas putida KT2440
ugcgaacugcagagcc

SEQ ID NO: 1609778 - RNA, 15 nt, Pseudomonas putida KT2440
ugccuuuggccgcca

SEQ ID NO: 1609779 - RNA, 24 nt, Pseudomonas putida KT2440
ugccuuggcauuggugccagcgcc

SEQ ID NO: 1609780 - RNA, 17 nt, Pseudomonas putida KT2440
ugccuugcccagcucca

SEQ ID NO: 1609781 - RNA, 13 nt, Pseudomonas putida KT2440
ugccuugcccugc

SEQ ID NO: 1609782 - RNA, 15 nt, Pseudomonas putida KT2440
ugcgccgcucugccc

SEQ ID NO: 1609783 - RNA, 15 nt, Pseudomonas putida KT2440
ugcgccgcgcgggcg

SEQ ID NO: 1609784 - RNA, 15 nt, Pseudomonas putida KT2440
ugcgccaguggguug

SEQ ID NO: 1609785 - RNA, 20 nt, Pseudomonas putida KT2440
ugcgccagcaguuucagcgg

SEQ ID NO: 1609786 - RNA, 14 nt, Pseudomonas putida KT2440
ugcgcccgaucacc

SEQ ID NO: 1609787 - RNA, 18 nt, Pseudomonas putida KT2440
ugcgcccggcaaacacau

SEQ ID NO: 1609788 - RNA, 15 nt, Pseudomonas putida KT2440
ugcgcccggccaggu

SEQ ID NO: 1609789 - RNA, 23 nt, Pseudomonas putida KT2440
ugcgcccgcacagcacguucagc

SEQ ID NO: 1609790 - RNA, 18 nt, Pseudomonas putida KT2440
ugcgcaccagagggaagg

SEQ ID NO: 1609791 - RNA, 23 nt, Pseudomonas putida KT2440
ugcgcaccggaguccccaccggc

SEQ ID NO: 1609792 - RNA, 15 nt, Pseudomonas putida KT2440
ugcgcaauccuugcc

SEQ ID NO: 1609793 - RNA, 16 nt, Pseudomonas putida KT2440
ugcgcaauccuugccc

SEQ ID NO: 1609794 - RNA, 18 nt, Pseudomonas putida KT2440
ugcgaugguacagcucac

SEQ ID NO: 1609795 - RNA, 20 nt, Pseudomonas putida KT2440
ugcgccaaaaccuguuccag

SEQ ID NO: 1609796 - RNA, 23 nt, Pseudomonas putida KT2440
ugcgccaaaaccuguuccagccc

SEQ ID NO: 1609797 - RNA, 21 nt, Pseudomonas putida KT2440
ugcgccaccucggcgaaaagc

SEQ ID NO: 1609798 - RNA, 18 nt, Pseudomonas putida KT2440
ugcgccaccgacuccggc

SEQ ID NO: 1609799 - RNA, 21 nt, Pseudomonas putida KT2440
ugcgcacgcgcuuuuccagca

SEQ ID NO: 1609800 - RNA, 21 nt, Pseudomonas putida KT2440
ugcuccagcucacagcacucg

SEQ ID NO: 1609801 - RNA, 20 nt, Pseudomonas putida KT2440
ugcuccaggccugcggcagc

SEQ ID NO: 1609802 - RNA, 21 nt, Pseudomonas putida KT2440
ugcuccaggccugcggcagcc

SEQ ID NO: 1609803 - RNA, 22 nt, Pseudomonas putida KT2440
ugcuccaggccugcggcagcca

SEQ ID NO: 1609804 - RNA, 13 nt, Pseudomonas putida KT2440
ugcuccaugggca

SEQ ID NO: 1609805 - RNA, 21 nt, Pseudomonas putida KT2440
ugcuccaugguagauaagagu

SEQ ID NO: 1609806 - RNA, 19 nt, Pseudomonas putida KT2440
ugcuccacaaucucgcccu

SEQ ID NO: 1609807 - RNA, 15 nt, Pseudomonas putida KT2440
ugcuccaccugccac

SEQ ID NO: 1609808 - RNA, 23 nt, Pseudomonas putida KT2440
ugcucaugauccagucagacucc

SEQ ID NO: 1609809 - RNA, 12 nt, Pseudomonas putida KT2440
ugcuccaacccc

SEQ ID NO: 1609810 - RNA, 15 nt, Pseudomonas putida KT2440
ugcuccaagugccgu

SEQ ID NO: 1609811 - RNA, 21 nt, Pseudomonas putida KT2440
ugcucgaacucuuccagcucg

SEQ ID NO: 1609812 - RNA, 11 nt, Pseudomonas putida KT2440
ugcuccggccg

SEQ ID NO: 1609813 - RNA, 16 nt, Pseudomonas putida KT2440
ugcuccggcgacagcu

SEQ ID NO: 1609814 - RNA, 14 nt, Pseudomonas putida KT2440
ugcucaccagcuuc

SEQ ID NO: 1609815 - RNA, 12 nt, Pseudomonas putida KT2440
ugcucaccgcca

SEQ ID NO: 1609816 - RNA, 20 nt, Pseudomonas putida KT2440
ugcucaaggugucgauacuc

SEQ ID NO: 1609817 - RNA, 21 nt, Pseudomonas putida KT2440
ugcucaacuucccucugccug

SEQ ID NO: 1609818 - RNA, 23 nt, Pseudomonas putida KT2440
ugcucaaccggugcaacugccac

SEQ ID NO: 1609819 - RNA, 13 nt, Pseudomonas putida KT2440
ugcucaggcgcuc

SEQ ID NO: 1609820 - RNA, 20 nt, Pseudomonas putida KT2440
ugcucagugcuggcguguug

SEQ ID NO: 1609821 - RNA, 20 nt, Pseudomonas putida KT2440
ugcucaucgcggccgaaggc

SEQ ID NO: 1609822 - RNA, 18 nt, Pseudomonas putida KT2440
ugcucaucggcgccggcc

SEQ ID NO: 1609823 - RNA, 18 nt, Pseudomonas putida KT2440
ugcucauccacaccuucg

SEQ ID NO: 1609824 - RNA, 22 nt, Pseudomonas putida KT2440
ugcucaggaucacgucacccag

SEQ ID NO: 1609825 - RNA, 22 nt, Pseudomonas putida KT2440
ugcucagcugggcguuuccagg

SEQ ID NO: 1609826 - RNA, 13 nt, Pseudomonas putida KT2440
ugcucaggaacau

SEQ ID NO: 1609827 - RNA, 16 nt, Pseudomonas putida KT2440
ugcuauccgcuugcug

SEQ ID NO: 1609828 - RNA, 16 nt, Pseudomonas putida KT2440
ugcuaauuucagguuu

SEQ ID NO: 1609829 - RNA, 21 nt, Pseudomonas putida KT2440
ugcggccaaugcacgccuguc

SEQ ID NO: 1609830 - RNA, 18 nt, Pseudomonas putida KT2440
ugcggcgacgcacuucac

SEQ ID NO: 1609831 - RNA, 20 nt, Pseudomonas putida KT2440
ugcggcgccgucuucagaca

SEQ ID NO: 1609832 - RNA, 22 nt, Pseudomonas putida KT2440
ugcggcgccaucggcacgccag

SEQ ID NO: 1609833 - RNA, 17 nt, Pseudomonas putida KT2440
ugcggcuguucgcagca

SEQ ID NO: 1609834 - RNA, 15 nt, Pseudomonas putida KT2440
ugcggcuccggcgug

SEQ ID NO: 1609835 - RNA, 19 nt, Pseudomonas putida KT2440
ugcgcuucaaauagaagaa

SEQ ID NO: 1609836 - RNA, 11 nt, Pseudomonas putida KT2440
ugcgcugggca

SEQ ID NO: 1609837 - RNA, 17 nt, Pseudomonas putida KT2440
ugcgccggcuugccuuc

SEQ ID NO: 1609838 - RNA, 22 nt, Pseudomonas putida KT2440
ugcgcuggaauuauuggccagc

SEQ ID NO: 1609839 - RNA, 12 nt, Pseudomonas putida KT2440
ugcgcuggcccu

SEQ ID NO: 1609840 - RNA, 23 nt, Pseudomonas putida KT2440
ugcgccggucgcguucuuucucc

SEQ ID NO: 1609841 - RNA, 14 nt, Pseudomonas putida KT2440
ugcgccgucaccag

SEQ ID NO: 1609842 - RNA, 18 nt, Pseudomonas putida KT2440
ugcgccgggacagcacca

SEQ ID NO: 1609843 - RNA, 15 nt, Pseudomonas putida KT2440
ugcguaaggccggga

SEQ ID NO: 1609844 - RNA, 20 nt, Pseudomonas putida KT2440
ugcgggaccagcaccaccug

SEQ ID NO: 1609845 - RNA, 21 nt, Pseudomonas putida KT2440
ugcgguccugcaccacaugca

SEQ ID NO: 1609846 - RNA, 14 nt, Pseudomonas putida KT2440
ugcggugcaugcgc

SEQ ID NO: 1609847 - RNA, 17 nt, Pseudomonas putida KT2440
ugcgugccuugccuggg

SEQ ID NO: 1609848 - RNA, 18 nt, Pseudomonas putida KT2440
ugcgugccucgcccaggu

SEQ ID NO: 1609849 - RNA, 21 nt, Pseudomonas putida KT2440
ugcgugccugcugcucgcuau

SEQ ID NO: 1609850 - RNA, 21 nt, Pseudomonas putida KT2440
ugcgugcaguguguugcggug

SEQ ID NO: 1609851 - RNA, 21 nt, Pseudomonas putida KT2440
ugcguuucgcuggccugcccc

SEQ ID NO: 1609852 - RNA, 15 nt, Pseudomonas putida KT2440
ugcguuuuaaaagaa

SEQ ID NO: 1609853 - RNA, 20 nt, Pseudomonas putida KT2440
ugcguccccggguccaccuc

SEQ ID NO: 1609854 - RNA, 20 nt, Pseudomonas putida KT2440
ugcgucccgaaagggccgca

SEQ ID NO: 1609855 - RNA, 14 nt, Pseudomonas putida KT2440
ugcgucaucaucag

SEQ ID NO: 1609856 - RNA, 15 nt, Pseudomonas putida KT2440
ugcgugaaacgcagc

SEQ ID NO: 1609857 - RNA, 20 nt, Pseudomonas putida KT2440
ugcgucgcgaaagggccgca

SEQ ID NO: 1609858 - RNA, 20 nt, Pseudomonas putida KT2440
ugcgucggccgaugucuuug

SEQ ID NO: 1609859 - RNA, 19 nt, Pseudomonas putida KT2440
uggaaguugccauuuugga

SEQ ID NO: 1609860 - RNA, 21 nt, Pseudomonas putida KT2440
uggaagggcggguugcacagg

SEQ ID NO: 1609861 - RNA, 21 nt, Pseudomonas putida KT2440
uggaauaagaucuaugaccaa

SEQ ID NO: 1609862 - RNA, 18 nt, Pseudomonas putida KT2440
uggacagcggcagcaucg

SEQ ID NO: 1609863 - RNA, 12 nt, Pseudomonas putida KT2440
uggacagcagcu

SEQ ID NO: 1609864 - RNA, 19 nt, Pseudomonas putida KT2440
uggacagcccaaggccugc

SEQ ID NO: 1609865 - RNA, 15 nt, Pseudomonas putida KT2440
uggacaaucucggca

SEQ ID NO: 1609866 - RNA, 19 nt, Pseudomonas putida KT2440
uggacccaaucgcugugca

SEQ ID NO: 1609867 - RNA, 16 nt, Pseudomonas putida KT2440
uggaagauggucucga

SEQ ID NO: 1609868 - RNA, 13 nt, Pseudomonas putida KT2440
uggaacugcugca

SEQ ID NO: 1609869 - RNA, 15 nt, Pseudomonas putida KT2440
uggaaccccauccac

SEQ ID NO: 1609870 - RNA, 14 nt, Pseudomonas putida KT2440
uggaaaaugaugca

SEQ ID NO: 1609871 - RNA, 15 nt, Pseudomonas putida KT2440
uggaaaacagcgcgc

SEQ ID NO: 1609872 - RNA, 13 nt, Pseudomonas putida KT2440
uggaaaagcaagg

SEQ ID NO: 1609873 - RNA, 16 nt, Pseudomonas putida KT2440
ugcuuuuuugugccug

SEQ ID NO: 1609874 - RNA, 22 nt, Pseudomonas putida KT2440
ugcuuggcagcggcuggcgcuc

SEQ ID NO: 1609875 - RNA, 18 nt, Pseudomonas putida KT2440
ugcuuggcagugaugccg

SEQ ID NO: 1609876 - RNA, 15 nt, Pseudomonas putida KT2440
ugcuugcccagaucc

SEQ ID NO: 1609877 - RNA, 16 nt, Pseudomonas putida KT2440
ugcuugcggaacaccc

SEQ ID NO: 1609878 - RNA, 18 nt, Pseudomonas putida KT2440
ugcuugcgggcccaguuc

SEQ ID NO: 1609879 - RNA, 22 nt, Pseudomonas putida KT2440
ugcuucugccguucacugaugu

SEQ ID NO: 1609880 - RNA, 16 nt, Pseudomonas putida KT2440
ugcuugacccccuucg

SEQ ID NO: 1609881 - RNA, 20 nt, Pseudomonas putida KT2440
ugcuucgggaauaccaggcc

SEQ ID NO: 1609882 - RNA, 18 nt, Pseudomonas putida KT2440
ugcuucgcgggcacgccc

SEQ ID NO: 1609883 - RNA, 16 nt, Pseudomonas putida KT2440
ugcuucgcugccagga

SEQ ID NO: 1609884 - RNA, 16 nt, Pseudomonas putida KT2440
ugcuucaucugcgccu

SEQ ID NO: 1609885 - RNA, 14 nt, Pseudomonas putida KT2440
ugcuucaccuugcc

SEQ ID NO: 1609886 - RNA, 23 nt, Pseudomonas putida KT2440
ugcuucaaccgugguucuugccg

SEQ ID NO: 1609887 - RNA, 19 nt, Pseudomonas putida KT2440
ugcuuaccagcuuggcgcc

SEQ ID NO: 1609888 - RNA, 15 nt, Pseudomonas putida KT2440
ugcugugaaacgagu

SEQ ID NO: 1609889 - RNA, 18 nt, Pseudomonas putida KT2440
ugcuguguuaccagucca

SEQ ID NO: 1609890 - RNA, 13 nt, Pseudomonas putida KT2440
ugcuggggccgca

SEQ ID NO: 1609891 - RNA, 14 nt, Pseudomonas putida KT2440
ugcuggggccgcaa

SEQ ID NO: 1609892 - RNA, 13 nt, Pseudomonas putida KT2440
ugcugggucagca

SEQ ID NO: 1609893 - RNA, 14 nt, Pseudomonas putida KT2440
ugcugguggccacg

SEQ ID NO: 1609894 - RNA, 21 nt, Pseudomonas putida KT2440
ugcugguguggcgccagggca

SEQ ID NO: 1609895 - RNA, 22 nt, Pseudomonas putida KT2440
ugcugguucaucgacuggaugc

SEQ ID NO: 1609896 - RNA, 18 nt, Pseudomonas putida KT2440
ugcuguaaucggcgcuga

SEQ ID NO: 1609897 - RNA, 19 nt, Pseudomonas putida KT2440
ugcugccgcccucuugcug

SEQ ID NO: 1609898 - RNA, 20 nt, Pseudomonas putida KT2440
ugcugccuuuuccugcugca

SEQ ID NO: 1609899 - RNA, 17 nt, Pseudomonas putida KT2440
ugcugcgcagcccuguc

SEQ ID NO: 1609900 - RNA, 20 nt, Pseudomonas putida KT2440
ugcugcggccgcgccggguu

SEQ ID NO: 1609901 - RNA, 20 nt, Pseudomonas putida KT2440
ugcugcggggugcucugccg

SEQ ID NO: 1609902 - RNA, 16 nt, Pseudomonas putida KT2440
ugcugcgucagcaucc

SEQ ID NO: 1609903 - RNA, 22 nt, Pseudomonas putida KT2440
ugcugcgucagcauccaacccu

SEQ ID NO: 1609904 - RNA, 20 nt, Pseudomonas putida KT2440
ugcugcgucucuuccuccau

SEQ ID NO: 1609905 - RNA, 18 nt, Pseudomonas putida KT2440
ugcugcucuuucggcagc

SEQ ID NO: 1609906 - RNA, 12 nt, Pseudomonas putida KT2440
ugcugcucugca

SEQ ID NO: 1609907 - RNA, 17 nt, Pseudomonas putida KT2440
ugcugcucugcaaugcc

SEQ ID NO: 1609908 - RNA, 22 nt, Pseudomonas putida KT2440
ugcuggcacgccuucagcagcc

SEQ ID NO: 1609909 - RNA, 16 nt, Pseudomonas putida KT2440
ugcuggaacugcugca

SEQ ID NO: 1609910 - RNA, 21 nt, Pseudomonas putida KT2440
ugcugcugcagcacugccugc

SEQ ID NO: 1609911 - RNA, 12 nt, Pseudomonas putida KT2440
ugcuggccagga

SEQ ID NO: 1609912 - RNA, 19 nt, Pseudomonas putida KT2440
ugcuggccaucccgcugug

SEQ ID NO: 1609913 - RNA, 15 nt, Pseudomonas putida KT2440
ugcuggccaaggucu

SEQ ID NO: 1609914 - RNA, 11 nt, Pseudomonas putida KT2440
ugcuggccacc

SEQ ID NO: 1609915 - RNA, 18 nt, Pseudomonas putida KT2440
ugcuggccgcgcaggaag

SEQ ID NO: 1609916 - RNA, 16 nt, Pseudomonas putida KT2440
ugcuggcgacgcugcc

SEQ ID NO: 1609917 - RNA, 17 nt, Pseudomonas putida KT2440
aaauguaggaucaagua

SEQ ID NO: 1609918 - RNA, 14 nt, Pseudomonas putida KT2440
ugcugcagauugca

SEQ ID NO: 1609919 - RNA, 15 nt, Pseudomonas putida KT2440
ugcugcaggcucuga

SEQ ID NO: 1609920 - RNA, 19 nt, Pseudomonas putida KT2440
ugcugcaggcucugaaugu

SEQ ID NO: 1609921 - RNA, 17 nt, Pseudomonas putida KT2440
ugcugcagggcccagcc

SEQ ID NO: 1609922 - RNA, 15 nt, Pseudomonas putida KT2440
ugcugcaacagcucc

SEQ ID NO: 1609923 - RNA, 16 nt, Pseudomonas putida KT2440
ugcugcaacagcucca

SEQ ID NO: 1609924 - RNA, 20 nt, Pseudomonas putida KT2440
ugcugcaacagcuccagcaa

SEQ ID NO: 1609925 - RNA, 14 nt, Pseudomonas putida KT2440
ugcugauguuggcc

SEQ ID NO: 1609926 - RNA, 19 nt, Pseudomonas putida KT2440
ugcugauguuggccaucac

SEQ ID NO: 1609927 - RNA, 11 nt, Pseudomonas putida KT2440
ugcugccaggc

SEQ ID NO: 1609928 - RNA, 12 nt, Pseudomonas putida KT2440
ugcugccaggca

SEQ ID NO: 1609929 - RNA, 17 nt, Pseudomonas putida KT2440
ugcugcaguucuuccag

SEQ ID NO: 1609930 - RNA, 21 nt, Pseudomonas putida KT2440
ugcugccccaugcgaacugca

SEQ ID NO: 1609931 - RNA, 16 nt, Pseudomonas putida KT2440
ugcugagcuugacuuc

SEQ ID NO: 1609932 - RNA, 21 nt, Pseudomonas putida KT2440
ugcugaugauauuugccacuc

SEQ ID NO: 1609933 - RNA, 15 nt, Pseudomonas putida KT2440
ugcugaucagguugc

SEQ ID NO: 1609934 - RNA, 16 nt, Pseudomonas putida KT2440
ugcugaccaccgugcu

SEQ ID NO: 1609935 - RNA, 14 nt, Pseudomonas putida KT2440
ugcugacccggaau

SEQ ID NO: 1609936 - RNA, 20 nt, Pseudomonas putida KT2440
ugcugaagcucuccagcagg

SEQ ID NO: 1609937 - RNA, 22 nt, Pseudomonas putida KT2440
ugcucuucgaguuuggccagcc

SEQ ID NO: 1609938 - RNA, 19 nt, Pseudomonas putida KT2440
ugcucuucgauccgcgcca

SEQ ID NO: 1609939 - RNA, 18 nt, Pseudomonas putida KT2440
ugcucuucaaccaguuca

SEQ ID NO: 1609940 - RNA, 12 nt, Pseudomonas putida KT2440
ugcucuggcccg

SEQ ID NO: 1609941 - RNA, 22 nt, Pseudomonas putida KT2440
ugcucguguuagcugggcuuga

SEQ ID NO: 1609942 - RNA, 15 nt, Pseudomonas putida KT2440
ugcucgucucuggcc

SEQ ID NO: 1609943 - RNA, 14 nt, Pseudomonas putida KT2440
ugcucgucagcccc

SEQ ID NO: 1609944 - RNA, 19 nt, Pseudomonas putida KT2440
ugcucguccaucaccgcca

SEQ ID NO: 1609945 - RNA, 15 nt, Pseudomonas putida KT2440
ugcucgcucaggcuc

SEQ ID NO: 1609946 - RNA, 14 nt, Pseudomonas putida KT2440
ugcucgcuggcuug

SEQ ID NO: 1609947 - RNA, 16 nt, Pseudomonas putida KT2440
ugcucgcuggcuuguu

SEQ ID NO: 1609948 - RNA, 16 nt, Pseudomonas putida KT2440
ugcucgcgggccugga

SEQ ID NO: 1609949 - RNA, 13 nt, Pseudomonas putida KT2440
ugcucggccagcc

SEQ ID NO: 1609950 - RNA, 13 nt, Pseudomonas putida KT2440
ugcucggccagcu

SEQ ID NO: 1609951 - RNA, 12 nt, Pseudomonas putida KT2440
ugcucggccugg

SEQ ID NO: 1609952 - RNA, 13 nt, Pseudomonas putida KT2440
ugcucggccuugc

SEQ ID NO: 1609953 - RNA, 13 nt, Pseudomonas putida KT2440
ugcucgaggaagc

SEQ ID NO: 1609954 - RNA, 17 nt, Pseudomonas putida KT2440
ugaaacugaucagcuuc

SEQ ID NO: 1609955 - RNA, 13 nt, Pseudomonas putida KT2440
ugaaacuccaucg

SEQ ID NO: 1609956 - RNA, 19 nt, Pseudomonas putida KT2440
ugaaagccuaaaggcaugc

SEQ ID NO: 1609957 - RNA, 14 nt, Pseudomonas putida KT2440
ugaaaaaaggcccu

SEQ ID NO: 1609958 - RNA, 17 nt, Pseudomonas putida KT2440
ugaacugggcauccagc

SEQ ID NO: 1609959 - RNA, 21 nt, Pseudomonas putida KT2440
ugaacugggcauccagcuugc

SEQ ID NO: 1609960 - RNA, 16 nt, Pseudomonas putida KT2440
ugaacuucuucggguc

SEQ ID NO: 1609961 - RNA, 12 nt, Pseudomonas putida KT2440
ugaacuuccagu

SEQ ID NO: 1609962 - RNA, 13 nt, Pseudomonas putida KT2440
ugaagccacgcuc

SEQ ID NO: 1609963 - RNA, 15 nt, Pseudomonas putida KT2440
ugaagauuuucagcc

SEQ ID NO: 1609964 - RNA, 18 nt, Pseudomonas putida KT2440
ugaagacgcacacucccc

SEQ ID NO: 1609965 - RNA, 20 nt, Pseudomonas putida KT2440
ugaagcuuccaguuggccgg

SEQ ID NO: 1609966 - RNA, 16 nt, Pseudomonas putida KT2440
ugaaggacaucaccag

SEQ ID NO: 1609967 - RNA, 13 nt, Pseudomonas putida KT2440
ugaagcugcgcuc

SEQ ID NO: 1609968 - RNA, 16 nt, Pseudomonas putida KT2440
ugaagcugcgcucgau

SEQ ID NO: 1609969 - RNA, 13 nt, Pseudomonas putida KT2440
ugaagcucuccag

SEQ ID NO: 1609970 - RNA, 14 nt, Pseudomonas putida KT2440
ugaagcucuccagc

SEQ ID NO: 1609971 - RNA, 15 nt, Pseudomonas putida KT2440
ugaagcucuccagca

SEQ ID NO: 1609972 - RNA, 19 nt, Pseudomonas putida KT2440
ugaaguagaacuggcgcag

SEQ ID NO: 1609973 - RNA, 20 nt, Pseudomonas putida KT2440
ugaaguauaaaggucuuuug

SEQ ID NO: 1609974 - RNA, 21 nt, Pseudomonas putida KT2440
ugaauaaagaaagugaugaaa

SEQ ID NO: 1609975 - RNA, 20 nt, Pseudomonas putida KT2440
ugaacggcuguuccucgcca

SEQ ID NO: 1609976 - RNA, 17 nt, Pseudomonas putida KT2440
ugaacagguugcgcgcc

SEQ ID NO: 1609977 - RNA, 16 nt, Pseudomonas putida KT2440
ugaacagguugcugcc

SEQ ID NO: 1609978 - RNA, 15 nt, Pseudomonas putida KT2440
ugaacagcuucaaca

SEQ ID NO: 1609979 - RNA, 22 nt, Pseudomonas putida KT2440
ugaacagcgcccagaucagcag

SEQ ID NO: 1609980 - RNA, 13 nt, Pseudomonas putida KT2440
ugaacagcgccuu

SEQ ID NO: 1609981 - RNA, 13 nt, Pseudomonas putida KT2440
ugaacagcgcugc

SEQ ID NO: 1609982 - RNA, 16 nt, Pseudomonas putida KT2440
ugaaauccucaaccug

SEQ ID NO: 1609983 - RNA, 23 nt, Pseudomonas putida KT2440
ugaacagcagcgccgccaggccc

SEQ ID NO: 1609984 - RNA, 16 nt, Pseudomonas putida KT2440
ugaacagcaucagcca

SEQ ID NO: 1609985 - RNA, 21 nt, Pseudomonas putida KT2440
ugaacagcaucagccaugggc

SEQ ID NO: 1609986 - RNA, 22 nt, Pseudomonas putida KT2440
ugaaccgcgccuacaggcccca

SEQ ID NO: 1609987 - RNA, 15 nt, Pseudomonas putida KT2440
ugaaccucaccgccg

SEQ ID NO: 1609988 - RNA, 20 nt, Pseudomonas putida KT2440
ugaaccugaccuugcugcuc

SEQ ID NO: 1609989 - RNA, 20 nt, Pseudomonas putida KT2440
ugaaccccaccccagcguuc

SEQ ID NO: 1609990 - RNA, 15 nt, Pseudomonas putida KT2440
ugaacccgcuccuac

SEQ ID NO: 1609991 - RNA, 18 nt, Pseudomonas putida KT2440
ucuuucggcagcacccgc

SEQ ID NO: 1609992 - RNA, 15 nt, Pseudomonas putida KT2440
ucuuugccacucagc

SEQ ID NO: 1609993 - RNA, 15 nt, Pseudomonas putida KT2440
ucuuuggccugcuug

SEQ ID NO: 1609994 - RNA, 14 nt, Pseudomonas putida KT2440
ucuuugaacgaggu

SEQ ID NO: 1609995 - RNA, 17 nt, Pseudomonas putida KT2440
ucuuugagggucagcug

SEQ ID NO: 1609996 - RNA, 19 nt, Pseudomonas putida KT2440
ucuuggccagggccuuuuc

SEQ ID NO: 1609997 - RNA, 13 nt, Pseudomonas putida KT2440
ucuugcugccguc

SEQ ID NO: 1609998 - RNA, 14 nt, Pseudomonas putida KT2440
ucuugcugaacagc

SEQ ID NO: 1609999 - RNA, 18 nt, Pseudomonas putida KT2440
ucuugcugaacagccggc

SEQ ID NO: 1610000 - RNA, 16 nt, Pseudomonas putida KT2440
ucuugucgacagugaa

SEQ ID NO: 1610001 - RNA, 19 nt, Pseudomonas putida KT2440
ucuuguggcucauguaaua

SEQ ID NO: 1610002 - RNA, 15 nt, Pseudomonas putida KT2440
ucuuguguuuugccu

SEQ ID NO: 1610003 - RNA, 15 nt, Pseudomonas putida KT2440
ucuuucaacagcugg

SEQ ID NO: 1610004 - RNA, 17 nt, Pseudomonas putida KT2440
ucuuucaacagcuggcu

SEQ ID NO: 1610005 - RNA, 18 nt, Pseudomonas putida KT2440
ucuuuaccguuggcuagc

SEQ ID NO: 1610006 - RNA, 20 nt, Pseudomonas putida KT2440
ucuugcgugcaugggccagg

SEQ ID NO: 1610007 - RNA, 13 nt, Pseudomonas putida KT2440
ucuugccgugcuc

SEQ ID NO: 1610008 - RNA, 13 nt, Pseudomonas putida KT2440
ucuugcgcacgcg

SEQ ID NO: 1610009 - RNA, 18 nt, Pseudomonas putida KT2440
ucuugcaguucuugaucc

SEQ ID NO: 1610010 - RNA, 15 nt, Pseudomonas putida KT2440
ucuugaggcacaaaa

SEQ ID NO: 1610011 - RNA, 19 nt, Pseudomonas putida KT2440
ucuugcaccugucccagcu

SEQ ID NO: 1610012 - RNA, 16 nt, Pseudomonas putida KT2440
ucuucuuucagguaac

SEQ ID NO: 1610013 - RNA, 20 nt, Pseudomonas putida KT2440
ucuucuuuaagccccugcgg

SEQ ID NO: 1610014 - RNA, 23 nt, Pseudomonas putida KT2440
ucuucuuuaagccccugcggcug

SEQ ID NO: 1610015 - RNA, 16 nt, Pseudomonas putida KT2440
ucuugaagaugaccuu

SEQ ID NO: 1610016 - RNA, 17 nt, Pseudomonas putida KT2440
ucuugaauccccuuaua

SEQ ID NO: 1610017 - RNA, 15 nt, Pseudomonas putida KT2440
ucuugagcuggccgu

SEQ ID NO: 1610018 - RNA, 21 nt, Pseudomonas putida KT2440
ucuugaccccgccuggggguc

SEQ ID NO: 1610019 - RNA, 13 nt, Pseudomonas putida KT2440
ucuucgccugcag

SEQ ID NO: 1610020 - RNA, 15 nt, Pseudomonas putida KT2440
ucuucgccugcagca

SEQ ID NO: 1610021 - RNA, 13 nt, Pseudomonas putida KT2440
ucuucgccggcau

SEQ ID NO: 1610022 - RNA, 22 nt, Pseudomonas putida KT2440
ucuucugccaguugcuucugca

SEQ ID NO: 1610023 - RNA, 15 nt, Pseudomonas putida KT2440
ucuucugcagccacc

SEQ ID NO: 1610024 - RNA, 21 nt, Pseudomonas putida KT2440
ucuucucguugggcuugaucc

SEQ ID NO: 1610025 - RNA, 12 nt, Pseudomonas putida KT2440
ucuucaggcaau

SEQ ID NO: 1610026 - RNA, 13 nt, Pseudomonas putida KT2440
ucuucaggcaaug

SEQ ID NO: 1610027 - RNA, 16 nt, Pseudomonas putida KT2440
ucuucaggcaauggcg

SEQ ID NO: 1610028 - RNA, 19 nt, Pseudomonas putida KT2440
ucuucaugaaguacuuggc

SEQ ID NO: 1610029 - RNA, 22 nt, Pseudomonas putida KT2440
ucuucaugaaguacuuggcgcc

SEQ ID NO: 1610030 - RNA, 18 nt, Pseudomonas putida KT2440
ucuucaugcaauaaccaa

SEQ ID NO: 1610031 - RNA, 22 nt, Pseudomonas putida KT2440
ucuuccgcacgggucaccucau

SEQ ID NO: 1610032 - RNA, 16 nt, Pseudomonas putida KT2440
ucuuaacucauuaauu

SEQ ID NO: 1610033 - RNA, 20 nt, Pseudomonas putida KT2440
ucugguaggccggccguggg

SEQ ID NO: 1610034 - RNA, 15 nt, Pseudomonas putida KT2440
ucugguacaacaaca

SEQ ID NO: 1610035 - RNA, 22 nt, Pseudomonas putida KT2440
ucugguacaacaacaaaaaaaa

SEQ ID NO: 1610036 - RNA, 23 nt, Pseudomonas putida KT2440
ucugccagugucaguugcucgcc

SEQ ID NO: 1610037 - RNA, 19 nt, Pseudomonas putida KT2440
ucugccaguugcuucugca

SEQ ID NO: 1610038 - RNA, 20 nt, Pseudomonas putida KT2440
ucugccaguugcuucugcag

SEQ ID NO: 1610039 - RNA, 15 nt, Pseudomonas putida KT2440
ucugauuugcgcuac

SEQ ID NO: 1610040 - RNA, 23 nt, Pseudomonas putida KT2440
ucugauuugcgcuacagcuuuga

SEQ ID NO: 1610041 - RNA, 20 nt, Pseudomonas putida KT2440
ucugauguaucgaacagccc

SEQ ID NO: 1610042 - RNA, 15 nt, Pseudomonas putida KT2440
ucugaugugugcccc

SEQ ID NO: 1610043 - RNA, 23 nt, Pseudomonas putida KT2440
ucugcgccugugcaaagaacacu

SEQ ID NO: 1610044 - RNA, 20 nt, Pseudomonas putida KT2440
ucugcgccacggcgcugacc

SEQ ID NO: 1610045 - RNA, 14 nt, Pseudomonas putida KT2440
ucugcgacugcagg

SEQ ID NO: 1610046 - RNA, 13 nt, Pseudomonas putida KT2440
ucugccgcagccc

SEQ ID NO: 1610047 - RNA, 22 nt, Pseudomonas putida KT2440
ucugccggcgaauccagccggc

SEQ ID NO: 1610048 - RNA, 15 nt, Pseudomonas putida KT2440
ucugccguuggcccg

SEQ ID NO: 1610049 - RNA, 19 nt, Pseudomonas putida KT2440
ucuggcgcacguacuccac

SEQ ID NO: 1610050 - RNA, 14 nt, Pseudomonas putida KT2440
ucuggcccugggag

SEQ ID NO: 1610051 - RNA, 16 nt, Pseudomonas putida KT2440
ucuggcgccugacacu

SEQ ID NO: 1610052 - RNA, 20 nt, Pseudomonas putida KT2440
ucugcuggauacccagcgcc

SEQ ID NO: 1610053 - RNA, 22 nt, Pseudomonas putida KT2440
ucugcucgcccaccgacagccc

SEQ ID NO: 1610054 - RNA, 23 nt, Pseudomonas putida KT2440
ucugcucggcguacuccagagcc

SEQ ID NO: 1610055 - RNA, 16 nt, Pseudomonas putida KT2440
ucugcucuucugccag

SEQ ID NO: 1610056 - RNA, 17 nt, Pseudomonas putida KT2440
ucugcgugauggcagcu

SEQ ID NO: 1610057 - RNA, 15 nt, Pseudomonas putida KT2440
ucucgguauccggcu

SEQ ID NO: 1610058 - RNA, 15 nt, Pseudomonas putida KT2440
ucucgucacuggcug

SEQ ID NO: 1610059 - RNA, 16 nt, Pseudomonas putida KT2440
ucucgucacuggcugc

SEQ ID NO: 1610060 - RNA, 13 nt, Pseudomonas putida KT2440
ucucgucguagcc

SEQ ID NO: 1610061 - RNA, 15 nt, Pseudomonas putida KT2440
ucucgucgaggcugu

SEQ ID NO: 1610062 - RNA, 19 nt, Pseudomonas putida KT2440
ucgcauuaccagcaccauc

SEQ ID NO: 1610063 - RNA, 20 nt, Pseudomonas putida KT2440
ucgcauuucuagcuuggucu

SEQ ID NO: 1610064 - RNA, 18 nt, Pseudomonas putida KT2440
ucgcaugcggccgugaac

SEQ ID NO: 1610065 - RNA, 18 nt, Pseudomonas putida KT2440
ucucuuccgccagccaac

SEQ ID NO: 1610066 - RNA, 23 nt, Pseudomonas putida KT2440
ucugacaacuaucgagcauggcg

SEQ ID NO: 1610067 - RNA, 14 nt, Pseudomonas putida KT2440
ucugauagccaggg

SEQ ID NO: 1610068 - RNA, 12 nt, Pseudomonas putida KT2440
ugacaugcacaa

SEQ ID NO: 1610069 - RNA, 16 nt, Pseudomonas putida KT2440
ugacccuuccagcccg

SEQ ID NO: 1610070 - RNA, 17 nt, Pseudomonas putida KT2440
ugacccggugcacccac

SEQ ID NO: 1610071 - RNA, 17 nt, Pseudomonas putida KT2440
ugaccaccgugcugugu

SEQ ID NO: 1610072 - RNA, 23 nt, Pseudomonas putida KT2440
ugaccaccagacgggcauggugg

SEQ ID NO: 1610073 - RNA, 14 nt, Pseudomonas putida KT2440
ugaccacaaagccu

SEQ ID NO: 1610074 - RNA, 18 nt, Pseudomonas putida KT2440
ugaccguuggucgcgccg

SEQ ID NO: 1610075 - RNA, 19 nt, Pseudomonas putida KT2440
ugacgaccgauaaagagaa

SEQ ID NO: 1610076 - RNA, 20 nt, Pseudomonas putida KT2440
ugaccggggcugcuuugcag

SEQ ID NO: 1610077 - RNA, 19 nt, Pseudomonas putida KT2440
ugacgaucgccagccccag

SEQ ID NO: 1610078 - RNA, 21 nt, Pseudomonas putida KT2440
ugagacgcauguugaaacacc

SEQ ID NO: 1610079 - RNA, 20 nt, Pseudomonas putida KT2440
ugagagggucggcgggcgga

SEQ ID NO: 1610080 - RNA, 21 nt, Pseudomonas putida KT2440
ugagaaccuccgccaacugca

SEQ ID NO: 1610081 - RNA, 17 nt, Pseudomonas putida KT2440
ugagaccgaggggccgc

SEQ ID NO: 1610082 - RNA, 19 nt, Pseudomonas putida KT2440
ugagaccgaggggccgcua

SEQ ID NO: 1610083 - RNA, 17 nt, Pseudomonas putida KT2440
ugacuucgcugcccgag

SEQ ID NO: 1610084 - RNA, 18 nt, Pseudomonas putida KT2440
ugacuucgcugcccgagc

SEQ ID NO: 1610085 - RNA, 23 nt, Pseudomonas putida KT2440
ugacuucucccgggcaaucagua

SEQ ID NO: 1610086 - RNA, 22 nt, Pseudomonas putida KT2440
ugacucagcggccuuucugcuu

SEQ ID NO: 1610087 - RNA, 11 nt, Pseudomonas putida KT2440
ugacucaugcc

SEQ ID NO: 1610088 - RNA, 13 nt, Pseudomonas putida KT2440
ugacuccgcccca

SEQ ID NO: 1610089 - RNA, 19 nt, Pseudomonas putida KT2440
ugacuccgccccaaaccag

SEQ ID NO: 1610090 - RNA, 16 nt, Pseudomonas putida KT2440
ugacucgaccgccgca

SEQ ID NO: 1610091 - RNA, 21 nt, Pseudomonas putida KT2440
ugacgucauucaaggucagcu

SEQ ID NO: 1610092 - RNA, 15 nt, Pseudomonas putida KT2440
ugacguccagcucaa

SEQ ID NO: 1610093 - RNA, 18 nt, Pseudomonas putida KT2440
ugacgggugaccaggccc

SEQ ID NO: 1610094 - RNA, 16 nt, Pseudomonas putida KT2440
ugacgcugcacuucca

SEQ ID NO: 1610095 - RNA, 15 nt, Pseudomonas putida KT2440
ugacguuggccgcca

SEQ ID NO: 1610096 - RNA, 20 nt, Pseudomonas putida KT2440
ugacgugcgcuccuggucau

SEQ ID NO: 1610097 - RNA, 20 nt, Pseudomonas putida KT2440
ugaucagcugccacucuuca

SEQ ID NO: 1610098 - RNA, 18 nt, Pseudomonas putida KT2440
ugaucagcgacaccgcca

SEQ ID NO: 1610099 - RNA, 12 nt, Pseudomonas putida KT2440
ugaucagggaca

SEQ ID NO: 1610100 - RNA, 21 nt, Pseudomonas putida KT2440
ugaucaggcccugcugcuucu

SEQ ID NO: 1610101 - RNA, 18 nt, Pseudomonas putida KT2440
ugaucagguuacuggcca

SEQ ID NO: 1610102 - RNA, 15 nt, Pseudomonas putida KT2440
ugauccucacgcaca

SEQ ID NO: 1610103 - RNA, 15 nt, Pseudomonas putida KT2440
ugauccgccuggccc

SEQ ID NO: 1610104 - RNA, 22 nt, Pseudomonas putida KT2440
ugaucauccacaaucagcacug

SEQ ID NO: 1610105 - RNA, 14 nt, Pseudomonas putida KT2440
ugaucauccccagc

SEQ ID NO: 1610106 - RNA, 15 nt, Pseudomonas putida KT2440
ugaucaucagcgccg

SEQ ID NO: 1610107 - RNA, 19 nt, Pseudomonas putida KT2440
ugaucaugcccauggccag

SEQ ID NO: 1610108 - RNA, 14 nt, Pseudomonas putida KT2440
ugaucgcguuaccc

SEQ ID NO: 1610109 - RNA, 15 nt, Pseudomonas putida KT2440
ugaucgcuacagagg

SEQ ID NO: 1610110 - RNA, 12 nt, Pseudomonas putida KT2440
ugaucgccgccg

SEQ ID NO: 1610111 - RNA, 12 nt, Pseudomonas putida KT2440
ugaucggcuggc

SEQ ID NO: 1610112 - RNA, 18 nt, Pseudomonas putida KT2440
ugaucuguugcugcaggu

SEQ ID NO: 1610113 - RNA, 18 nt, Pseudomonas putida KT2440
ugaucugcuggauaccca

SEQ ID NO: 1610114 - RNA, 22 nt, Pseudomonas putida KT2440
ugauagcgcuuuuccaguuccu

SEQ ID NO: 1610115 - RNA, 13 nt, Pseudomonas putida KT2440
ugauagccagggc

SEQ ID NO: 1610116 - RNA, 17 nt, Pseudomonas putida KT2440
ugauacggggaggccgu

SEQ ID NO: 1610117 - RNA, 18 nt, Pseudomonas putida KT2440
ugauaccugcuugcugac

SEQ ID NO: 1610118 - RNA, 16 nt, Pseudomonas putida KT2440
ugauacgcccauccaa

SEQ ID NO: 1610119 - RNA, 16 nt, Pseudomonas putida KT2440
ugauacuucugaccaa

SEQ ID NO: 1610120 - RNA, 12 nt, Pseudomonas putida KT2440
ugagggucagcu

SEQ ID NO: 1610121 - RNA, 14 nt, Pseudomonas putida KT2440
ugagggcgccgacc

SEQ ID NO: 1610122 - RNA, 13 nt, Pseudomonas putida KT2440
ugagguccgccuc

SEQ ID NO: 1610123 - RNA, 18 nt, Pseudomonas putida KT2440
ugaggugccauagcacca

SEQ ID NO: 1610124 - RNA, 18 nt, Pseudomonas putida KT2440
ugaguucgcuaagguggu

SEQ ID NO: 1610125 - RNA, 21 nt, Pseudomonas putida KT2440
ugaguucccaggcagccucca

SEQ ID NO: 1610126 - RNA, 22 nt, Pseudomonas putida KT2440
ugaguucccaggcagccuccag

SEQ ID NO: 1610127 - RNA, 13 nt, Pseudomonas putida KT2440
ugaggccuucagc

SEQ ID NO: 1610128 - RNA, 11 nt, Pseudomonas putida KT2440
ugaggaaguga

SEQ ID NO: 1610129 - RNA, 17 nt, Pseudomonas putida KT2440
ugagcucuacaccuaac

SEQ ID NO: 1610130 - RNA, 19 nt, Pseudomonas putida KT2440
ugagcaagcgcgcgcccac

SEQ ID NO: 1610131 - RNA, 18 nt, Pseudomonas putida KT2440
ugcauucugccucaauac

SEQ ID NO: 1610132 - RNA, 16 nt, Pseudomonas putida KT2440
ugcaucauucgcgcca

SEQ ID NO: 1610133 - RNA, 12 nt, Pseudomonas putida KT2440
ugcaucaggguc

SEQ ID NO: 1610134 - RNA, 19 nt, Pseudomonas putida KT2440
ugcaucugcgccccgcucg

SEQ ID NO: 1610135 - RNA, 17 nt, Pseudomonas putida KT2440
ugcaucgucacauccug

SEQ ID NO: 1610136 - RNA, 15 nt, Pseudomonas putida KT2440
ugcauuuaacggcug

SEQ ID NO: 1610137 - RNA, 17 nt, Pseudomonas putida KT2440
ugccacccaugccaccc

SEQ ID NO: 1610138 - RNA, 11 nt, Pseudomonas putida KT2440
ugccacccaag

SEQ ID NO: 1610139 - RNA, 14 nt, Pseudomonas putida KT2440
ugccacccaaggca

SEQ ID NO: 1610140 - RNA, 22 nt, Pseudomonas putida KT2440
ugccacccacaggcacgacuga

SEQ ID NO: 1610141 - RNA, 19 nt, Pseudomonas putida KT2440
ugccaccaguucauggcuc

SEQ ID NO: 1610142 - RNA, 20 nt, Pseudomonas putida KT2440
ugccaccacccggggcagca

SEQ ID NO: 1610143 - RNA, 22 nt, Pseudomonas putida KT2440
ugccaccacccggggcagcauc

SEQ ID NO: 1610144 - RNA, 14 nt, Pseudomonas putida KT2440
ugccaauuuccaua

SEQ ID NO: 1610145 - RNA, 17 nt, Pseudomonas putida KT2440
ugcaggucgauguccag

SEQ ID NO: 1610146 - RNA, 19 nt, Pseudomonas putida KT2440
ugcaggucgauguccaggc

SEQ ID NO: 1610147 - RNA, 13 nt, Pseudomonas putida KT2440
ugcaggucggcac

SEQ ID NO: 1610148 - RNA, 22 nt, Pseudomonas putida KT2440
ugcagguaccaguuguacucga

SEQ ID NO: 1610149 - RNA, 14 nt, Pseudomonas putida KT2440
ugcagcucuugucg

SEQ ID NO: 1610150 - RNA, 21 nt, Pseudomonas putida KT2440
ugcagcucuugucgacaguga

SEQ ID NO: 1610151 - RNA, 22 nt, Pseudomonas putida KT2440
ugcagcucuugucgacagugaa

SEQ ID NO: 1610152 - RNA, 16 nt, Pseudomonas putida KT2440
ugcagcucagccagca

SEQ ID NO: 1610153 - RNA, 21 nt, Pseudomonas putida KT2440
ugcagcucgacaaacugcuga

SEQ ID NO: 1610154 - RNA, 22 nt, Pseudomonas putida KT2440
ugcagguggugguccccuucgu

SEQ ID NO: 1610155 - RNA, 16 nt, Pseudomonas putida KT2440
ugcaggugcagggugc

SEQ ID NO: 1610156 - RNA, 17 nt, Pseudomonas putida KT2440
ugcaggugcagggugcc

SEQ ID NO: 1610157 - RNA, 20 nt, Pseudomonas putida KT2440
ugcagugaagaauucaggca

SEQ ID NO: 1610158 - RNA, 16 nt, Pseudomonas putida KT2440
ugcagugccucacgca

SEQ ID NO: 1610159 - RNA, 14 nt, Pseudomonas putida KT2440
ugcagugcccgcga

SEQ ID NO: 1610160 - RNA, 22 nt, Pseudomonas putida KT2440
ugcagugguugugcuggcccuu

SEQ ID NO: 1610161 - RNA, 17 nt, Pseudomonas putida KT2440
ugcaguguguugcggug

SEQ ID NO: 1610162 - RNA, 20 nt, Pseudomonas putida KT2440
ugcaucagcgugugacccag

SEQ ID NO: 1610163 - RNA, 22 nt, Pseudomonas putida KT2440
ugcaguucgcugcgcaaggcau

SEQ ID NO: 1610164 - RNA, 16 nt, Pseudomonas putida KT2440
ugcaguucuaccagca

SEQ ID NO: 1610165 - RNA, 11 nt, Pseudomonas putida KT2440
ugcaguugagc

SEQ ID NO: 1610166 - RNA, 17 nt, Pseudomonas putida KT2440
ugcaguuguccaggcug

SEQ ID NO: 1610167 - RNA, 18 nt, Pseudomonas putida KT2440
ugcaguugucugcuagga

SEQ ID NO: 1610168 - RNA, 14 nt, Pseudomonas putida KT2440
ugcacaggccagcc

SEQ ID NO: 1610169 - RNA, 18 nt, Pseudomonas putida KT2440
ugcacacgucgccugggc

SEQ ID NO: 1610170 - RNA, 16 nt, Pseudomonas putida KT2440
ugcacagcguccaguu

SEQ ID NO: 1610171 - RNA, 13 nt, Pseudomonas putida KT2440
ugcacaucccaga

SEQ ID NO: 1610172 - RNA, 12 nt, Pseudomonas putida KT2440
ugcaccaccugc

SEQ ID NO: 1610173 - RNA, 22 nt, Pseudomonas putida KT2440
ugcaccaccugcuccugguccu

SEQ ID NO: 1610174 - RNA, 19 nt, Pseudomonas putida KT2440
ugcaccacgcgcaaaugcu

SEQ ID NO: 1610175 - RNA, 20 nt, Pseudomonas putida KT2440
ugcaccacgcgcaaaugcuu

SEQ ID NO: 1610176 - RNA, 18 nt, Pseudomonas putida KT2440
ugcaccacggucggccug

SEQ ID NO: 1610177 - RNA, 10 nt, Pseudomonas putida KT2440
ugcaccaacg

SEQ ID NO: 1610178 - RNA, 16 nt, Pseudomonas putida KT2440
ugcacagcaucagcac

SEQ ID NO: 1610179 - RNA, 15 nt, Pseudomonas putida KT2440
ugcacagcgagcagc

SEQ ID NO: 1610180 - RNA, 21 nt, Pseudomonas putida KT2440
ugcacacugcccagcagcccc

SEQ ID NO: 1610181 - RNA, 14 nt, Pseudomonas putida KT2440
ugcacacgcaacug

SEQ ID NO: 1610182 - RNA, 15 nt, Pseudomonas putida KT2440
ugcacacgcaacuga

SEQ ID NO: 1610183 - RNA, 16 nt, Pseudomonas putida KT2440
ugcacacgcaacugau

SEQ ID NO: 1610184 - RNA, 14 nt, Pseudomonas putida KT2440
ugcacaaguuucaa

SEQ ID NO: 1610185 - RNA, 16 nt, Pseudomonas putida KT2440
ugcacuaagggcaggc

SEQ ID NO: 1610186 - RNA, 18 nt, Pseudomonas putida KT2440
ugcacgucgcgcagggcc

SEQ ID NO: 1610187 - RNA, 23 nt, Pseudomonas putida KT2440
ugcaccugacgagcgaaauaggu

SEQ ID NO: 1610188 - RNA, 22 nt, Pseudomonas putida KT2440
ugcaccucauagaucagcaucg

SEQ ID NO: 1610189 - RNA, 18 nt, Pseudomonas putida KT2440
ugcaccucggaugccacg

SEQ ID NO: 1610190 - RNA, 13 nt, Pseudomonas putida KT2440
ugcaccuccgccc

SEQ ID NO: 1610191 - RNA, 14 nt, Pseudomonas putida KT2440
ugcaccggccuugc

SEQ ID NO: 1610192 - RNA, 17 nt, Pseudomonas putida KT2440
ugcaccguggcagcaau

SEQ ID NO: 1610193 - RNA, 13 nt, Pseudomonas putida KT2440
ugcaccaguuccu

SEQ ID NO: 1610194 - RNA, 16 nt, Pseudomonas putida KT2440
ugcaccaggaagcugg

SEQ ID NO: 1610195 - RNA, 18 nt, Pseudomonas putida KT2440
ugcaccaggaagcuggga

SEQ ID NO: 1610196 - RNA, 17 nt, Pseudomonas putida KT2440
ugcaccaggucaggaca

SEQ ID NO: 1610197 - RNA, 13 nt, Pseudomonas putida KT2440
ugcaccaggucca

SEQ ID NO: 1610198 - RNA, 19 nt, Pseudomonas putida KT2440
ugcaccaggcccagccggg

SEQ ID NO: 1610199 - RNA, 21 nt, Pseudomonas putida KT2440
ugcaccaggcccagccgggcc

SEQ ID NO: 1610200 - RNA, 22 nt, Pseudomonas putida KT2440
ugcaccaggcccagccgggcca

SEQ ID NO: 1610201 - RNA, 14 nt, Pseudomonas putida KT2440
ugcaccagcaccac

SEQ ID NO: 1610202 - RNA, 13 nt, Pseudomonas putida KT2440
ugcaccaacacuu

SEQ ID NO: 1610203 - RNA, 18 nt, Pseudomonas putida KT2440
ugcaccacaugcacggcg

SEQ ID NO: 1610204 - RNA, 16 nt, Pseudomonas putida KT2440
ugcagauccaggugcc

SEQ ID NO: 1610205 - RNA, 23 nt, Pseudomonas putida KT2440
ugcagauugcccuguggcugugg

SEQ ID NO: 1610206 - RNA, 13 nt, Pseudomonas putida KT2440
ugcacuggcaggc

SEQ ID NO: 1610207 - RNA, 14 nt, Pseudomonas putida KT2440
ugcacuggcaggcc

SEQ ID NO: 1610208 - RNA, 12 nt, Pseudomonas putida KT2440
ugcacugccugg

SEQ ID NO: 1610209 - RNA, 19 nt, Pseudomonas putida KT2440
ugcacugccuggcucaggc

SEQ ID NO: 1610210 - RNA, 17 nt, Pseudomonas putida KT2440
ugcacugaagauuuuca

SEQ ID NO: 1610211 - RNA, 16 nt, Pseudomonas putida KT2440
ugcagcccuucgcagg

SEQ ID NO: 1610212 - RNA, 18 nt, Pseudomonas putida KT2440
ugcagcccuucgcaggca

SEQ ID NO: 1610213 - RNA, 20 nt, Pseudomonas putida KT2440
ugcagcccuucgcaggcacg

SEQ ID NO: 1610214 - RNA, 15 nt, Pseudomonas putida KT2440
ugcagccgcacccag

SEQ ID NO: 1610215 - RNA, 22 nt, Pseudomonas putida KT2440
ugcagccgcacccaggccacga

SEQ ID NO: 1610216 - RNA, 17 nt, Pseudomonas putida KT2440
ugcagccguugcugggc

SEQ ID NO: 1610217 - RNA, 18 nt, Pseudomonas putida KT2440
ugcagccggccccugcuc

SEQ ID NO: 1610218 - RNA, 22 nt, Pseudomonas putida KT2440
ugcagcgucgccucgggguaga

SEQ ID NO: 1610219 - RNA, 21 nt, Pseudomonas putida KT2440
ugcagcaacgccuuggccugc

SEQ ID NO: 1610220 - RNA, 22 nt, Pseudomonas putida KT2440
ugcagcacaggucucgaacgcu

SEQ ID NO: 1610221 - RNA, 18 nt, Pseudomonas putida KT2440
ugcagcaccuccaccuuc

SEQ ID NO: 1610222 - RNA, 20 nt, Pseudomonas putida KT2440
ugcagcacuucgaucaggca

SEQ ID NO: 1610223 - RNA, 20 nt, Pseudomonas putida KT2440
ugcagcccggcaaacuccac

SEQ ID NO: 1610224 - RNA, 18 nt, Pseudomonas putida KT2440
ugcagccccuucuauuaa

SEQ ID NO: 1610225 - RNA, 15 nt, Pseudomonas putida KT2440
ugcaacagcuccagc

SEQ ID NO: 1610226 - RNA, 14 nt, Pseudomonas putida KT2440
ugcaacauguccac

SEQ ID NO: 1610227 - RNA, 19 nt, Pseudomonas putida KT2440
ugcaacagaaguggagauc

SEQ ID NO: 1610228 - RNA, 23 nt, Pseudomonas putida KT2440
ugcaaaugccccgggcaggccau

SEQ ID NO: 1610229 - RNA, 15 nt, Pseudomonas putida KT2440
ugcaacugccacgcc

SEQ ID NO: 1610230 - RNA, 22 nt, Pseudomonas putida KT2440
ugcaacugccacgcccgcugca

SEQ ID NO: 1610231 - RNA, 19 nt, Pseudomonas putida KT2440
ugcaacgccuugcgcucga

SEQ ID NO: 1610232 - RNA, 18 nt, Pseudomonas putida KT2440
ugcaaggaucaccaaggc

SEQ ID NO: 1610233 - RNA, 19 nt, Pseudomonas putida KT2440
ugcaaggaucaccaaggcu

SEQ ID NO: 1610234 - RNA, 22 nt, Pseudomonas putida KT2440
ugcaagccggcgaacagcacug

SEQ ID NO: 1610235 - RNA, 16 nt, Pseudomonas putida KT2440
ugcaaggccagcggaa

SEQ ID NO: 1610236 - RNA, 18 nt, Pseudomonas putida KT2440
ugcaaggucaaacucccc

SEQ ID NO: 1610237 - RNA, 19 nt, Pseudomonas putida KT2440
ugcaagguccaggcguggg

SEQ ID NO: 1610238 - RNA, 19 nt, Pseudomonas putida KT2440
ugcaaugguaaauucaaua

SEQ ID NO: 1610239 - RNA, 18 nt, Pseudomonas putida KT2440
ugcaauccgaacuuaaua

SEQ ID NO: 1610240 - RNA, 14 nt, Pseudomonas putida KT2440
ugcaaugcagcccc

SEQ ID NO: 1610241 - RNA, 22 nt, Pseudomonas putida KT2440
ugcaaucgagccgaacagcagg

SEQ ID NO: 1610242 - RNA, 18 nt, Pseudomonas putida KT2440
ugcaauaaccaaucaacg

SEQ ID NO: 1610243 - RNA, 17 nt, Pseudomonas putida KT2440
ugcaagucucgcgccuu

SEQ ID NO: 1610244 - RNA, 16 nt, Pseudomonas putida KT2440
ugcaagucugaaaaca

SEQ ID NO: 1610245 - RNA, 18 nt, Pseudomonas putida KT2440
ugcaauaccagccuggcc

SEQ ID NO: 1610246 - RNA, 14 nt, Pseudomonas putida KT2440
ugcaauaccgugcu

SEQ ID NO: 1610247 - RNA, 21 nt, Pseudomonas putida KT2440
ugcaaucagcucacaggcuca

SEQ ID NO: 1610248 - RNA, 12 nt, Pseudomonas putida KT2440
ugcaaagcgccc

SEQ ID NO: 1610249 - RNA, 23 nt, Pseudomonas putida KT2440
ugcaaagcgcgucugauagccag

SEQ ID NO: 1610250 - RNA, 19 nt, Pseudomonas putida KT2440
ugcaaauacggccaauaac

SEQ ID NO: 1610251 - RNA, 20 nt, Pseudomonas putida KT2440
ugcaaaacuuggguagugca

SEQ ID NO: 1610252 - RNA, 20 nt, Pseudomonas putida KT2440
ugaugaucagggacaugggg

SEQ ID NO: 1610253 - RNA, 16 nt, Pseudomonas putida KT2440
ugaugauaccgaacag

SEQ ID NO: 1610254 - RNA, 17 nt, Pseudomonas putida KT2440
ugaugaugcaguagcca

SEQ ID NO: 1610255 - RNA, 22 nt, Pseudomonas putida KT2440
ucaguugcaagucucgcgccuu

SEQ ID NO: 1610256 - RNA, 21 nt, Pseudomonas putida KT2440
ucaguuugacggugaauuccu

SEQ ID NO: 1610257 - RNA, 10 nt, Pseudomonas putida KT2440
ucaugugugc

SEQ ID NO: 1610258 - RNA, 14 nt, Pseudomonas putida KT2440
ucauugaguuggug

SEQ ID NO: 1610259 - RNA, 18 nt, Pseudomonas putida KT2440
ucauugacggucagugaa

SEQ ID NO: 1610260 - RNA, 14 nt, Pseudomonas putida KT2440
ucauuagccuucau

SEQ ID NO: 1610261 - RNA, 12 nt, Pseudomonas putida KT2440
uccaacaaacuc

SEQ ID NO: 1610262 - RNA, 13 nt, Pseudomonas putida KT2440
uccaaagccagcg

SEQ ID NO: 1610263 - RNA, 16 nt, Pseudomonas putida KT2440
ucauuguucuggccac

SEQ ID NO: 1610264 - RNA, 16 nt, Pseudomonas putida KT2440
ucauugccgugcucgu

SEQ ID NO: 1610265 - RNA, 14 nt, Pseudomonas putida KT2440
uccacgccucgaug

SEQ ID NO: 1610266 - RNA, 20 nt, Pseudomonas putida KT2440
uccacgccucgaugugcgug

SEQ ID NO: 1610267 - RNA, 19 nt, Pseudomonas putida KT2440
uccacggcaaucggcaggc

SEQ ID NO: 1610268 - RNA, 15 nt, Pseudomonas putida KT2440
uccacguucccgcca

SEQ ID NO: 1610269 - RNA, 17 nt, Pseudomonas putida KT2440
uccacuucgcaacgcuu

SEQ ID NO: 1610270 - RNA, 13 nt, Pseudomonas putida KT2440
uccacuuccagca

SEQ ID NO: 1610271 - RNA, 14 nt, Pseudomonas putida KT2440
uccacuuccagcag

SEQ ID NO: 1610272 - RNA, 16 nt, Pseudomonas putida KT2440
uccacuuccagcagcu

SEQ ID NO: 1610273 - RNA, 15 nt, Pseudomonas putida KT2440
uccacacccugcgaa

SEQ ID NO: 1610274 - RNA, 16 nt, Pseudomonas putida KT2440
uccacaccgacaucca

SEQ ID NO: 1610275 - RNA, 18 nt, Pseudomonas putida KT2440
uccacacgcugcugcgua

SEQ ID NO: 1610276 - RNA, 18 nt, Pseudomonas putida KT2440
uccacacucgacgcugcc

SEQ ID NO: 1610277 - RNA, 21 nt, Pseudomonas putida KT2440
uccacacucgacgcugccguc

SEQ ID NO: 1610278 - RNA, 12 nt, Pseudomonas putida KT2440
uccacaccagcg

SEQ ID NO: 1610279 - RNA, 20 nt, Pseudomonas putida KT2440
uccacaccaaagucagccag

SEQ ID NO: 1610280 - RNA, 16 nt, Pseudomonas putida KT2440
uccaaugcgucaucga

SEQ ID NO: 1610281 - RNA, 19 nt, Pseudomonas putida KT2440
uccacaaucucgcccuugu

SEQ ID NO: 1610282 - RNA, 15 nt, Pseudomonas putida KT2440
uccacaaucagcacu

SEQ ID NO: 1610283 - RNA, 22 nt, Pseudomonas putida KT2440
uccaccccgcaggccgcagccu

SEQ ID NO: 1610284 - RNA, 13 nt, Pseudomonas putida KT2440
uccaccccuucca

SEQ ID NO: 1610285 - RNA, 19 nt, Pseudomonas putida KT2440
uccaccaucaagucauccg

SEQ ID NO: 1610286 - RNA, 17 nt, Pseudomonas putida KT2440
uccacccaccuuggccc

SEQ ID NO: 1610287 - RNA, 16 nt, Pseudomonas putida KT2440
uccaccauucccugca

SEQ ID NO: 1610288 - RNA, 17 nt, Pseudomonas putida KT2440
uccaccauucccugcac

SEQ ID NO: 1610289 - RNA, 12 nt, Pseudomonas putida KT2440
uccaccaggccg

SEQ ID NO: 1610290 - RNA, 21 nt, Pseudomonas putida KT2440
uccaccaggccgaucaccagc

SEQ ID NO: 1610291 - RNA, 22 nt, Pseudomonas putida KT2440
uccaccaggcuggccaccacca

SEQ ID NO: 1610292 - RNA, 13 nt, Pseudomonas putida KT2440
uccacagcagucu

SEQ ID NO: 1610293 - RNA, 14 nt, Pseudomonas putida KT2440
uccaccagccgccg

SEQ ID NO: 1610294 - RNA, 17 nt, Pseudomonas putida KT2440
uccaacgcauccaggcg

SEQ ID NO: 1610295 - RNA, 22 nt, Pseudomonas putida KT2440
uccaacgcugccuugcccagcu

SEQ ID NO: 1610296 - RNA, 23 nt, Pseudomonas putida KT2440
uccaacucgcgcauccagccaga

SEQ ID NO: 1610297 - RNA, 14 nt, Pseudomonas putida KT2440
uccaaccagccagc

SEQ ID NO: 1610298 - RNA, 12 nt, Pseudomonas putida KT2440
uccaaccccagc

SEQ ID NO: 1610299 - RNA, 19 nt, Pseudomonas putida KT2440
uccaauacauacaccaacg

SEQ ID NO: 1610300 - RNA, 15 nt, Pseudomonas putida KT2440
uccaagcgucggcca

SEQ ID NO: 1610301 - RNA, 21 nt, Pseudomonas putida KT2440
uccaaugccgccuugcagaaa

SEQ ID NO: 1610302 - RNA, 18 nt, Pseudomonas putida KT2440
uccaaugagaauaauucu

SEQ ID NO: 1610303 - RNA, 15 nt, Pseudomonas putida KT2440
uccaguugcaagccu

SEQ ID NO: 1610304 - RNA, 17 nt, Pseudomonas putida KT2440
uccaguuggcagggcac

SEQ ID NO: 1610305 - RNA, 20 nt, Pseudomonas putida KT2440
uccauagguuauccacaccc

SEQ ID NO: 1610306 - RNA, 11 nt, Pseudomonas putida KT2440
uccaucaaucg

SEQ ID NO: 1610307 - RNA, 15 nt, Pseudomonas putida KT2440
uccagguggccgcca

SEQ ID NO: 1610308 - RNA, 16 nt, Pseudomonas putida KT2440
uccaggugaaucagcg

SEQ ID NO: 1610309 - RNA, 20 nt, Pseudomonas putida KT2440
uccaggugaaucagcggcag

SEQ ID NO: 1610310 - RNA, 22 nt, Pseudomonas putida KT2440
uccaggugcccaugaucuugcu

SEQ ID NO: 1610311 - RNA, 16 nt, Pseudomonas putida KT2440
uccagguccaggccag

SEQ ID NO: 1610312 - RNA, 17 nt, Pseudomonas putida KT2440
uccagguucucgcucca

SEQ ID NO: 1610313 - RNA, 16 nt, Pseudomonas putida KT2440
uccagguuaucuagca

SEQ ID NO: 1610314 - RNA, 17 nt, Pseudomonas putida KT2440
uccagguuuggguuggc

SEQ ID NO: 1610315 - RNA, 16 nt, Pseudomonas putida KT2440
uccaggcccauuucgc

SEQ ID NO: 1610316 - RNA, 19 nt, Pseudomonas putida KT2440
uccaggcguucaucgaagg

SEQ ID NO: 1610317 - RNA, 17 nt, Pseudomonas putida KT2440
uccagugcuucacugcc

SEQ ID NO: 1610318 - RNA, 21 nt, Pseudomonas putida KT2440
uccagucggccugaugccuca

SEQ ID NO: 1610319 - RNA, 23 nt, Pseudomonas putida KT2440
uccagucggcauccucaagcugc

SEQ ID NO: 1610320 - RNA, 19 nt, Pseudomonas putida KT2440
uccagcggcgacaggugcc

SEQ ID NO: 1610321 - RNA, 16 nt, Pseudomonas putida KT2440
uccagcgucccgguca

SEQ ID NO: 1610322 - RNA, 13 nt, Pseudomonas putida KT2440
uccaggcacaccg

SEQ ID NO: 1610323 - RNA, 17 nt, Pseudomonas putida KT2440
uccaggcacaccgagcc

SEQ ID NO: 1610324 - RNA, 19 nt, Pseudomonas putida KT2440
uccagcgcggccacgcccu

SEQ ID NO: 1610325 - RNA, 21 nt, Pseudomonas putida KT2440
uccagcgcggccacgcccuuu

SEQ ID NO: 1610326 - RNA, 22 nt, Pseudomonas putida KT2440
uccagcgccacccaggcauaca

SEQ ID NO: 1610327 - RNA, 17 nt, Pseudomonas putida KT2440
uccagcgccgcgccacc

SEQ ID NO: 1610328 - RNA, 17 nt, Pseudomonas putida KT2440
uccagcgccucccccag

SEQ ID NO: 1610329 - RNA, 22 nt, Pseudomonas putida KT2440
uccagcgccucccccagcgcgg

SEQ ID NO: 1610330 - RNA, 19 nt, Pseudomonas putida KT2440
uccagcagguuuuccagcc

SEQ ID NO: 1610331 - RNA, 13 nt, Pseudomonas putida KT2440
uccacuugucccg

SEQ ID NO: 1610332 - RNA, 15 nt, Pseudomonas putida KT2440
ucccacaggugcagc

SEQ ID NO: 1610333 - RNA, 21 nt, Pseudomonas putida KT2440
ucccacaggugcagcacaggu

SEQ ID NO: 1610334 - RNA, 13 nt, Pseudomonas putida KT2440
ucccacagguucg

SEQ ID NO: 1610335 - RNA, 19 nt, Pseudomonas putida KT2440
ucccacaggaaucaccaga

SEQ ID NO: 1610336 - RNA, 19 nt, Pseudomonas putida KT2440
ucccacagggaccucacag

SEQ ID NO: 1610337 - RNA, 22 nt, Pseudomonas putida KT2440
ucccacagggaccucacagccu

SEQ ID NO: 1610338 - RNA, 22 nt, Pseudomonas putida KT2440
ucccaacgcaaauccuccugcg

SEQ ID NO: 1610339 - RNA, 18 nt, Pseudomonas putida KT2440
ucccaauaauaaaaaaag

SEQ ID NO: 1610340 - RNA, 18 nt, Pseudomonas putida KT2440
uccauugcucgucucugg

SEQ ID NO: 1610341 - RNA, 23 nt, Pseudomonas putida KT2440
uccauuucgaagcugucuucuuu

SEQ ID NO: 1610342 - RNA, 23 nt, Pseudomonas putida KT2440
uccauguuacggcccaggggcag

SEQ ID NO: 1610343 - RNA, 21 nt, Pseudomonas putida KT2440
uccauguucaccguacccgcc

SEQ ID NO: 1610344 - RNA, 17 nt, Pseudomonas putida KT2440
uccaucgcaauccccuc

SEQ ID NO: 1610345 - RNA, 13 nt, Pseudomonas putida KT2440
uccaucaccgcca

SEQ ID NO: 1610346 - RNA, 22 nt, Pseudomonas putida KT2440
uccaucaccggcgaguccugcc

SEQ ID NO: 1610347 - RNA, 14 nt, Pseudomonas putida KT2440
uccaucaccugccc

SEQ ID NO: 1610348 - RNA, 15 nt, Pseudomonas putida KT2440
uccaugaaggccggc

SEQ ID NO: 1610349 - RNA, 14 nt, Pseudomonas putida KT2440
uccaucuugcugcu

SEQ ID NO: 1610350 - RNA, 12 nt, Pseudomonas putida KT2440
uccgcagccccg

SEQ ID NO: 1610351 - RNA, 21 nt, Pseudomonas putida KT2440
uccgccaagguaaucuggcug

SEQ ID NO: 1610352 - RNA, 17 nt, Pseudomonas putida KT2440
uccgccaacaccaccuc

SEQ ID NO: 1610353 - RNA, 22 nt, Pseudomonas putida KT2440
uccgcacaggcuggccaccaug

SEQ ID NO: 1610354 - RNA, 16 nt, Pseudomonas putida KT2440
uccgcaccgggcaaaa

SEQ ID NO: 1610355 - RNA, 14 nt, Pseudomonas putida KT2440
uccgcaaaucccug

SEQ ID NO: 1610356 - RNA, 20 nt, Pseudomonas putida KT2440
uccgcaaauucucgagcuga

SEQ ID NO: 1610357 - RNA, 15 nt, Pseudomonas putida KT2440
uccgauacgccgccc

SEQ ID NO: 1610358 - RNA, 16 nt, Pseudomonas putida KT2440
uccgcucauuggaaaa

SEQ ID NO: 1610359 - RNA, 14 nt, Pseudomonas putida KT2440
uccgcgagggcauc

SEQ ID NO: 1610360 - RNA, 22 nt, Pseudomonas putida KT2440
uccgcgaguaaagccagcagcc

SEQ ID NO: 1610361 - RNA, 23 nt, Pseudomonas putida KT2440
uccgcgaguaaagccagcagccu

SEQ ID NO: 1610362 - RNA, 20 nt, Pseudomonas putida KT2440
uccgcgcauaaaacucgcuu

SEQ ID NO: 1610363 - RNA, 22 nt, Pseudomonas putida KT2440
uccgccccuacgcugguucuga

SEQ ID NO: 1610364 - RNA, 17 nt, Pseudomonas putida KT2440
uccgccccauagccugc

SEQ ID NO: 1610365 - RNA, 20 nt, Pseudomonas putida KT2440
uccgccccauagccugcugc

SEQ ID NO: 1610366 - RNA, 21 nt, Pseudomonas putida KT2440
uccgccccauagccugcugcu

SEQ ID NO: 1610367 - RNA, 14 nt, Pseudomonas putida KT2440
uccgccgcuuuguu

SEQ ID NO: 1610368 - RNA, 13 nt, Pseudomonas putida KT2440
uccgccuggcccg

SEQ ID NO: 1610369 - RNA, 13 nt, Pseudomonas putida KT2440
uccgccucauccu

SEQ ID NO: 1610370 - RNA, 20 nt, Pseudomonas putida KT2440
uccgagagugcuggggccgc

SEQ ID NO: 1610371 - RNA, 14 nt, Pseudomonas putida KT2440
uccgagaagguggc

SEQ ID NO: 1610372 - RNA, 18 nt, Pseudomonas putida KT2440
uccgacaaugccagcaaa

SEQ ID NO: 1610373 - RNA, 15 nt, Pseudomonas putida KT2440
uccgacaaaugcacc

SEQ ID NO: 1610374 - RNA, 13 nt, Pseudomonas putida KT2440
uccgacaggcugu

SEQ ID NO: 1610375 - RNA, 13 nt, Pseudomonas putida KT2440
ucccugaucauac

SEQ ID NO: 1610376 - RNA, 21 nt, Pseudomonas putida KT2440
ucccugagcuucaaucaugaa

SEQ ID NO: 1610377 - RNA, 16 nt, Pseudomonas putida KT2440
ucccuguaggugcggc

SEQ ID NO: 1610378 - RNA, 19 nt, Pseudomonas putida KT2440
ucccucgguuucucacccc

SEQ ID NO: 1610379 - RNA, 15 nt, Pseudomonas putida KT2440
ucccuccugugcccg

SEQ ID NO: 1610380 - RNA, 23 nt, Pseudomonas putida KT2440
ucccuaacggggggcucagcccg

SEQ ID NO: 1610381 - RNA, 14 nt, Pseudomonas putida KT2440
ucccgcacugcugc

SEQ ID NO: 1610382 - RNA, 15 nt, Pseudomonas putida KT2440
ucccgcacugcugcc

SEQ ID NO: 1610383 - RNA, 16 nt, Pseudomonas putida KT2440
ucccgcacugcugccg

SEQ ID NO: 1610384 - RNA, 19 nt, Pseudomonas putida KT2440
ucccgccauauucgcggcg

SEQ ID NO: 1610385 - RNA, 19 nt, Pseudomonas putida KT2440
ucccgcauuggguggcccc

SEQ ID NO: 1610386 - RNA, 19 nt, Pseudomonas putida KT2440
ucccgcgcauccuccgccc

SEQ ID NO: 1610387 - RNA, 17 nt, Pseudomonas putida KT2440
ucccgcgcaugcugcca

SEQ ID NO: 1610388 - RNA, 17 nt, Pseudomonas putida KT2440
ucccgcguccagggcag

SEQ ID NO: 1610389 - RNA, 15 nt, Pseudomonas putida KT2440
ucccggacagcagca

SEQ ID NO: 1610390 - RNA, 21 nt, Pseudomonas putida KT2440
ucccgcucgguaucggccagc

SEQ ID NO: 1610391 - RNA, 21 nt, Pseudomonas putida KT2440
ucccgcguaggugcgcggccg

SEQ ID NO: 1610392 - RNA, 14 nt, Pseudomonas putida KT2440
ucccggccagggcu

SEQ ID NO: 1610393 - RNA, 15 nt, Pseudomonas putida KT2440
ucccggccagggcug

SEQ ID NO: 1610394 - RNA, 14 nt, Pseudomonas putida KT2440
ucccggcacaaccg

SEQ ID NO: 1610395 - RNA, 13 nt, Pseudomonas putida KT2440
ucccggcaccgcu

SEQ ID NO: 1610396 - RNA, 15 nt, Pseudomonas putida KT2440
ucccggucaccugca

SEQ ID NO: 1610397 - RNA, 23 nt, Pseudomonas putida KT2440
ucccgucggccucuccgaggccg

SEQ ID NO: 1610398 - RNA, 21 nt, Pseudomonas putida KT2440
ucccguucgcggucggucagc

SEQ ID NO: 1610399 - RNA, 21 nt, Pseudomonas putida KT2440
uccccuggaaauucucggcug

SEQ ID NO: 1610400 - RNA, 16 nt, Pseudomonas putida KT2440
ucccgaggucagcagu

SEQ ID NO: 1610401 - RNA, 16 nt, Pseudomonas putida KT2440
ucccgcaagccagccu

SEQ ID NO: 1610402 - RNA, 19 nt, Pseudomonas putida KT2440
ucccgcaagccagccuccg

SEQ ID NO: 1610403 - RNA, 20 nt, Pseudomonas putida KT2440
ucccgaugcgcuugaggcuu

SEQ ID NO: 1610404 - RNA, 13 nt, Pseudomonas putida KT2440
ucccgagccagga

SEQ ID NO: 1610405 - RNA, 18 nt, Pseudomonas putida KT2440
uccccgccagugaccgcu

SEQ ID NO: 1610406 - RNA, 17 nt, Pseudomonas putida KT2440
uccccgcccaagcggca

SEQ ID NO: 1610407 - RNA, 18 nt, Pseudomonas putida KT2440
uccccgcccaagcggcag

SEQ ID NO: 1610408 - RNA, 20 nt, Pseudomonas putida KT2440
uccccgaguauccccaccac

SEQ ID NO: 1610409 - RNA, 14 nt, Pseudomonas putida KT2440
uccccgcgccgccg

SEQ ID NO: 1610410 - RNA, 15 nt, Pseudomonas putida KT2440
uccccgcgccgccga

SEQ ID NO: 1610411 - RNA, 18 nt, Pseudomonas putida KT2440
uccccgccgccagcagcg

SEQ ID NO: 1610412 - RNA, 13 nt, Pseudomonas putida KT2440
uccccucagacag

SEQ ID NO: 1610413 - RNA, 18 nt, Pseudomonas putida KT2440
uccccgguaaugcuggug

SEQ ID NO: 1610414 - RNA, 17 nt, Pseudomonas putida KT2440
uccccaccggcaccauc

SEQ ID NO: 1610415 - RNA, 22 nt, Pseudomonas putida KT2440
ucccauguagaccaccagcguu

SEQ ID NO: 1610416 - RNA, 15 nt, Pseudomonas putida KT2440
ucccccggcccagcc

SEQ ID NO: 1610417 - RNA, 16 nt, Pseudomonas putida KT2440
ucccccuccacccggu

SEQ ID NO: 1610418 - RNA, 14 nt, Pseudomonas putida KT2440
ucccccuccacugu

SEQ ID NO: 1610419 - RNA, 14 nt, Pseudomonas putida KT2440
ucccccccaaucgc

SEQ ID NO: 1610420 - RNA, 17 nt, Pseudomonas putida KT2440
ucccccaucaguugcag

SEQ ID NO: 1610421 - RNA, 22 nt, Pseudomonas putida KT2440
ucccccaucaguugcagcaacg

SEQ ID NO: 1610422 - RNA, 16 nt, Pseudomonas putida KT2440
ucccccacuucugccg

SEQ ID NO: 1610423 - RNA, 16 nt, Pseudomonas putida KT2440
uccccaucagcagcug

SEQ ID NO: 1610424 - RNA, 12 nt, Pseudomonas putida KT2440
ucccaggcagcc

SEQ ID NO: 1610425 - RNA, 20 nt, Pseudomonas putida KT2440
ucccagcuggcaaugcaacu

SEQ ID NO: 1610426 - RNA, 23 nt, Pseudomonas putida KT2440
ucccagccugggcgugaaagcag

SEQ ID NO: 1610427 - RNA, 14 nt, Pseudomonas putida KT2440
ucccagcaggcaca

SEQ ID NO: 1610428 - RNA, 19 nt, Pseudomonas putida KT2440
ucccacgaggaccugcguu

SEQ ID NO: 1610429 - RNA, 15 nt, Pseudomonas putida KT2440
uccuggucgcgggcc

SEQ ID NO: 1610430 - RNA, 23 nt, Pseudomonas putida KT2440
uccugggggcguaaagcgcccca

SEQ ID NO: 1610431 - RNA, 22 nt, Pseudomonas putida KT2440
uccugguaaggcucgcccucgc

SEQ ID NO: 1610432 - RNA, 21 nt, Pseudomonas putida KT2440
uccugggaagcugcagcagcu

SEQ ID NO: 1610433 - RNA, 14 nt, Pseudomonas putida KT2440
uccuucaucuguca

SEQ ID NO: 1610434 - RNA, 13 nt, Pseudomonas putida KT2440
uccuggcuggcag

SEQ ID NO: 1610435 - RNA, 14 nt, Pseudomonas putida KT2440
uccuggaucagccg

SEQ ID NO: 1610436 - RNA, 22 nt, Pseudomonas putida KT2440
uccuggccgcccgccucgacaa

SEQ ID NO: 1610437 - RNA, 16 nt, Pseudomonas putida KT2440
uccugcugcaggcucu

SEQ ID NO: 1610438 - RNA, 14 nt, Pseudomonas putida KT2440
uccugcugcaacaa

SEQ ID NO: 1610439 - RNA, 11 nt, Pseudomonas putida KT2440
uccugcugcug

SEQ ID NO: 1610440 - RNA, 16 nt, Pseudomonas putida KT2440
uccugcgugcugugca

SEQ ID NO: 1610441 - RNA, 23 nt, Pseudomonas putida KT2440
uccuggaaaagcaaggcucaggc

SEQ ID NO: 1610442 - RNA, 17 nt, Pseudomonas putida KT2440
uccugcuugccgggugc

SEQ ID NO: 1610443 - RNA, 19 nt, Pseudomonas putida KT2440
uccugccgacgccgcuucu

SEQ ID NO: 1610444 - RNA, 17 nt, Pseudomonas putida KT2440
uccugcguacccagccc

SEQ ID NO: 1610445 - RNA, 18 nt, Pseudomonas putida KT2440
uccugcguacccagcccc

SEQ ID NO: 1610446 - RNA, 12 nt, Pseudomonas putida KT2440
uccugcagggcg

SEQ ID NO: 1610447 - RNA, 21 nt, Pseudomonas putida KT2440
uccugcagggcgagcacaccc

SEQ ID NO: 1610448 - RNA, 13 nt, Pseudomonas putida KT2440
uccugcagcacca

SEQ ID NO: 1610449 - RNA, 22 nt, Pseudomonas putida KT2440
uccugcacaacccuaucagggc

SEQ ID NO: 1610450 - RNA, 21 nt, Pseudomonas putida KT2440
uccugcaggaaccuccguugc

SEQ ID NO: 1610451 - RNA, 19 nt, Pseudomonas putida KT2440
uccugcagccgcaccugcc

SEQ ID NO: 1610452 - RNA, 22 nt, Pseudomonas putida KT2440
uccugcaccuuguuacccgcau

SEQ ID NO: 1610453 - RNA, 17 nt, Pseudomonas putida KT2440
uccugcaaggcaaugcc

SEQ ID NO: 1610454 - RNA, 12 nt, Pseudomonas putida KT2440
uccugcaccaca

SEQ ID NO: 1610455 - RNA, 15 nt, Pseudomonas putida KT2440
uccugcaccgaagca

SEQ ID NO: 1610456 - RNA, 19 nt, Pseudomonas putida KT2440
uccucauaaugcuccgcca

SEQ ID NO: 1610457 - RNA, 12 nt, Pseudomonas putida KT2440
uccuccaacaau

SEQ ID NO: 1610458 - RNA, 19 nt, Pseudomonas putida KT2440
uccucaucgaugcccgucc

SEQ ID NO: 1610459 - RNA, 13 nt, Pseudomonas putida KT2440
uccuccccuuccc

SEQ ID NO: 1610460 - RNA, 16 nt, Pseudomonas putida KT2440
uccucggccagcggcc

SEQ ID NO: 1610461 - RNA, 13 nt, Pseudomonas putida KT2440
uccucggccaggc

SEQ ID NO: 1610462 - RNA, 15 nt, Pseudomonas putida KT2440
uccucguaggucaug

SEQ ID NO: 1610463 - RNA, 17 nt, Pseudomonas putida KT2440
uccucgugaccgaccac

SEQ ID NO: 1610464 - RNA, 19 nt, Pseudomonas putida KT2440
uccucgacacccagucgcc

SEQ ID NO: 1610465 - RNA, 16 nt, Pseudomonas putida KT2440
uccucgacgaccaguu

SEQ ID NO: 1610466 - RNA, 15 nt, Pseudomonas putida KT2440
uccucgaucaccugc

SEQ ID NO: 1610467 - RNA, 16 nt, Pseudomonas putida KT2440
uccucgaucaccugcg

SEQ ID NO: 1610468 - RNA, 22 nt, Pseudomonas putida KT2440
uccugaagugaauagccggcac

SEQ ID NO: 1610469 - RNA, 19 nt, Pseudomonas putida KT2440
uccugaacggugaagucaa

SEQ ID NO: 1610470 - RNA, 20 nt, Pseudomonas putida KT2440
uccucugcccgcagcuucaa

SEQ ID NO: 1610471 - RNA, 22 nt, Pseudomonas putida KT2440
uccugaguuagacauuagaaaa

SEQ ID NO: 1610472 - RNA, 20 nt, Pseudomonas putida KT2440
uccugaccaacuuuucaggu

SEQ ID NO: 1610473 - RNA, 20 nt, Pseudomonas putida KT2440
uccugagcggugaaacccuc

SEQ ID NO: 1610474 - RNA, 16 nt, Pseudomonas putida KT2440
uccugcaacucggccu

SEQ ID NO: 1610475 - RNA, 15 nt, Pseudomonas putida KT2440
uccugcaacccguca

SEQ ID NO: 1610476 - RNA, 13 nt, Pseudomonas putida KT2440
uccugcaaaggcc

SEQ ID NO: 1610477 - RNA, 23 nt, Pseudomonas putida KT2440
uccuacaagguaccccaccggcc

SEQ ID NO: 1610478 - RNA, 12 nt, Pseudomonas putida KT2440
uccuacgcgcca

SEQ ID NO: 1610479 - RNA, 16 nt, Pseudomonas putida KT2440
uccuacgggcaaccgc

SEQ ID NO: 1610480 - RNA, 22 nt, Pseudomonas putida KT2440
uccuaccacguacacacaucug

SEQ ID NO: 1610481 - RNA, 16 nt, Pseudomonas putida KT2440
uccuagcggcgucaau

SEQ ID NO: 1610482 - RNA, 14 nt, Pseudomonas putida KT2440
uccuacaaagcggc

SEQ ID NO: 1610483 - RNA, 21 nt, Pseudomonas putida KT2440
uccucacggcagugcacccgc

SEQ ID NO: 1610484 - RNA, 21 nt, Pseudomonas putida KT2440
uccucaaucacauccacagcc

SEQ ID NO: 1610485 - RNA, 18 nt, Pseudomonas putida KT2440
uccuauguuguguuaagu

SEQ ID NO: 1610486 - RNA, 18 nt, Pseudomonas putida KT2440
uccuaugagacuagcagu

SEQ ID NO: 1610487 - RNA, 14 nt, Pseudomonas putida KT2440
uccuagguaguaaa

SEQ ID NO: 1610488 - RNA, 19 nt, Pseudomonas putida KT2440
uccguagugaaugcuguug

SEQ ID NO: 1610489 - RNA, 18 nt, Pseudomonas putida KT2440
uccgucgccggccggcuc

SEQ ID NO: 1610490 - RNA, 22 nt, Pseudomonas putida KT2440
uccgucgccggccggcucgcca

SEQ ID NO: 1610491 - RNA, 19 nt, Pseudomonas putida KT2440
uccggcaccccuuucucca

SEQ ID NO: 1610492 - RNA, 18 nt, Pseudomonas putida KT2440
uccggcagguaagucggc

SEQ ID NO: 1610493 - RNA, 17 nt, Pseudomonas putida KT2440
uccggcaucauccugcu

SEQ ID NO: 1610494 - RNA, 16 nt, Pseudomonas putida KT2440
uccggcaaaccaugga

SEQ ID NO: 1610495 - RNA, 21 nt, Pseudomonas putida KT2440
uccggcaaaccauggaagcuc

SEQ ID NO: 1610496 - RNA, 16 nt, Pseudomonas putida KT2440
uccgcuggcuuguccu

SEQ ID NO: 1610497 - RNA, 21 nt, Pseudomonas putida KT2440
uccgcuugacgaucgccagcc

SEQ ID NO: 1610498 - RNA, 14 nt, Pseudomonas putida KT2440
uccgcuuagcagcu

SEQ ID NO: 1610499 - RNA, 12 nt, Pseudomonas putida KT2440
uccgggcugcug

SEQ ID NO: 1610500 - RNA, 12 nt, Pseudomonas putida KT2440
uccgguaacugg

SEQ ID NO: 1610501 - RNA, 19 nt, Pseudomonas putida KT2440
uccggguucugcaggaugu

SEQ ID NO: 1610502 - RNA, 22 nt, Pseudomonas putida KT2440
uccggguccauccccgcacgcg

SEQ ID NO: 1610503 - RNA, 19 nt, Pseudomonas putida KT2440
uccggucacugcgcggccg

SEQ ID NO: 1610504 - RNA, 13 nt, Pseudomonas putida KT2440
uccggcgcuuugc

SEQ ID NO: 1610505 - RNA, 15 nt, Pseudomonas putida KT2440
uccggcuccuugaug

SEQ ID NO: 1610506 - RNA, 17 nt, Pseudomonas putida KT2440
ucgcagguauccggguc

SEQ ID NO: 1610507 - RNA, 11 nt, Pseudomonas putida KT2440
ucgcagguucg

SEQ ID NO: 1610508 - RNA, 16 nt, Pseudomonas putida KT2440
ucgcagguucgaaucc

SEQ ID NO: 1610509 - RNA, 23 nt, Pseudomonas putida KT2440
ucgcaguacaacgucacaugcgc

SEQ ID NO: 1610510 - RNA, 18 nt, Pseudomonas putida KT2440
ucgcaguacuugcuggau

SEQ ID NO: 1610511 - RNA, 15 nt, Pseudomonas putida KT2440
ucgcagccaaugcug

SEQ ID NO: 1610512 - RNA, 14 nt, Pseudomonas putida KT2440
ucgcagcagcaccg

SEQ ID NO: 1610513 - RNA, 15 nt, Pseudomonas putida KT2440
ucgcaauugaugcaa

SEQ ID NO: 1610514 - RNA, 16 nt, Pseudomonas putida KT2440
ucgcacaggcggaugu

SEQ ID NO: 1610515 - RNA, 12 nt, Pseudomonas putida KT2440
ucgauggccagg

SEQ ID NO: 1610516 - RNA, 13 nt, Pseudomonas putida KT2440
ucgauggccagga

SEQ ID NO: 1610517 - RNA, 20 nt, Pseudomonas putida KT2440
ucgauguaggcagcugccuu

SEQ ID NO: 1610518 - RNA, 17 nt, Pseudomonas putida KT2440
ucgauguccagcgaggg

SEQ ID NO: 1610519 - RNA, 17 nt, Pseudomonas putida KT2440
ucgauugggucuuccag

SEQ ID NO: 1610520 - RNA, 16 nt, Pseudomonas putida KT2440
ucgauuuccaccggcu

SEQ ID NO: 1610521 - RNA, 15 nt, Pseudomonas putida KT2440
ucgauuuccagugcc

SEQ ID NO: 1610522 - RNA, 20 nt, Pseudomonas putida KT2440
ucgauuuugcagucgauguc

SEQ ID NO: 1610523 - RNA, 16 nt, Pseudomonas putida KT2440
ucgcaaaaaacuucaa

SEQ ID NO: 1610524 - RNA, 19 nt, Pseudomonas putida KT2440
ucgaucccggacagcagca

SEQ ID NO: 1610525 - RNA, 21 nt, Pseudomonas putida KT2440
ucgauccgggugcuggcucgc

SEQ ID NO: 1610526 - RNA, 13 nt, Pseudomonas putida KT2440
ucgaucucacagg

SEQ ID NO: 1610527 - RNA, 16 nt, Pseudomonas putida KT2440
ucgaucgagccacuga

SEQ ID NO: 1610528 - RNA, 19 nt, Pseudomonas putida KT2440
ucgaucgccauguguacgc

SEQ ID NO: 1610529 - RNA, 21 nt, Pseudomonas putida KT2440
ucgaucuuguuggucaggcca

SEQ ID NO: 1610530 - RNA, 18 nt, Pseudomonas putida KT2440
ucgaugaacucacccgcc

SEQ ID NO: 1610531 - RNA, 16 nt, Pseudomonas putida KT2440
ucgaucuccaggugca

SEQ ID NO: 1610532 - RNA, 19 nt, Pseudomonas putida KT2440
ucgaucuccaggugcacca

SEQ ID NO: 1610533 - RNA, 15 nt, Pseudomonas putida KT2440
ucgaugauggcugcc

SEQ ID NO: 1610534 - RNA, 19 nt, Pseudomonas putida KT2440
ucgaugcaauccgccacaa

SEQ ID NO: 1610535 - RNA, 22 nt, Pseudomonas putida KT2440
ucgaugcacagcucgcgcugcc

SEQ ID NO: 1610536 - RNA, 19 nt, Pseudomonas putida KT2440
ucgauagcagcgcuaugcc

SEQ ID NO: 1610537 - RNA, 22 nt, Pseudomonas putida KT2440
ucgauacggucuuuuccccuua

SEQ ID NO: 1610538 - RNA, 13 nt, Pseudomonas putida KT2440
ucgauagccugca

SEQ ID NO: 1610539 - RNA, 15 nt, Pseudomonas putida KT2440
ucgaucaggaaggca

SEQ ID NO: 1610540 - RNA, 21 nt, Pseudomonas putida KT2440
ucgaucaggucgacacccagc

SEQ ID NO: 1610541 - RNA, 18 nt, Pseudomonas putida KT2440
ucgaucacgaaucggguc

SEQ ID NO: 1610542 - RNA, 16 nt, Pseudomonas putida KT2440
ucgaucagcggcucca

SEQ ID NO: 1610543 - RNA, 16 nt, Pseudomonas putida KT2440
ucgauccaggugcgca

SEQ ID NO: 1610544 - RNA, 17 nt, Pseudomonas putida KT2440
ucgauauuggggcugcu

SEQ ID NO: 1610545 - RNA, 16 nt, Pseudomonas putida KT2440
ucgagucgacagugac

SEQ ID NO: 1610546 - RNA, 17 nt, Pseudomonas putida KT2440
ucgagguugcgcuccau

SEQ ID NO: 1610547 - RNA, 14 nt, Pseudomonas putida KT2440
ucgaggcgcgcgcc

SEQ ID NO: 1610548 - RNA, 15 nt, Pseudomonas putida KT2440
ucgagguaucugccg

SEQ ID NO: 1610549 - RNA, 17 nt, Pseudomonas putida KT2440
ucgagcgcaccuggaug

SEQ ID NO: 1610550 - RNA, 13 nt, Pseudomonas putida KT2440
ucgagcgccgccc

SEQ ID NO: 1610551 - RNA, 18 nt, Pseudomonas putida KT2440
ucgagcaugaucaccgcc

SEQ ID NO: 1610552 - RNA, 15 nt, Pseudomonas putida KT2440
ucgagccgaucagga

SEQ ID NO: 1610553 - RNA, 21 nt, Pseudomonas putida KT2440
ucgagccgaucaggaagcccc

SEQ ID NO: 1610554 - RNA, 16 nt, Pseudomonas putida KT2440
ucgagcuuggcgucca

SEQ ID NO: 1610555 - RNA, 21 nt, Pseudomonas putida KT2440
ucgagcuuggcguccacagcc

SEQ ID NO: 1610556 - RNA, 16 nt, Pseudomonas putida KT2440
ucgacuucaucaccuc

SEQ ID NO: 1610557 - RNA, 22 nt, Pseudomonas putida KT2440
ucgacuucccgcaagccagccu

SEQ ID NO: 1610558 - RNA, 16 nt, Pseudomonas putida KT2440
ucgacucccgcugccu

SEQ ID NO: 1610559 - RNA, 18 nt, Pseudomonas putida KT2440
ucgacucccgcugccuuc

SEQ ID NO: 1610560 - RNA, 15 nt, Pseudomonas putida KT2440
ucgagauguggcccg

SEQ ID NO: 1610561 - RNA, 15 nt, Pseudomonas putida KT2440
ucgagcaccacggcg

SEQ ID NO: 1610562 - RNA, 14 nt, Pseudomonas putida KT2440
ucgacgcugcuguc

SEQ ID NO: 1610563 - RNA, 16 nt, Pseudomonas putida KT2440
ucgacgcgcgcagccu

SEQ ID NO: 1610564 - RNA, 16 nt, Pseudomonas putida KT2440
ucgacguacagcagcu

SEQ ID NO: 1610565 - RNA, 13 nt, Pseudomonas putida KT2440
ucgaccuggcccg

SEQ ID NO: 1610566 - RNA, 19 nt, Pseudomonas putida KT2440
ucgaccuggcccgcuugcc

SEQ ID NO: 1610567 - RNA, 11 nt, Pseudomonas putida KT2440
ucgaccuggcu

SEQ ID NO: 1610568 - RNA, 20 nt, Pseudomonas putida KT2440
ucgaccugcccggcguucag

SEQ ID NO: 1610569 - RNA, 22 nt, Pseudomonas putida KT2440
ucgaccagggccuuggccuggg

SEQ ID NO: 1610570 - RNA, 15 nt, Pseudomonas putida KT2440
ucgaccagcaguguc

SEQ ID NO: 1610571 - RNA, 14 nt, Pseudomonas putida KT2440
ucgacccccuugcc

SEQ ID NO: 1610572 - RNA, 18 nt, Pseudomonas putida KT2440
ucgacccccuugccagca

SEQ ID NO: 1610573 - RNA, 16 nt, Pseudomonas putida KT2440
ucgaccacgcacagcu

SEQ ID NO: 1610574 - RNA, 18 nt, Pseudomonas putida KT2440
ucgaccacgcacagcugu

SEQ ID NO: 1610575 - RNA, 22 nt, Pseudomonas putida KT2440
ucgacccuggcauagcaguccu

SEQ ID NO: 1610576 - RNA, 14 nt, Pseudomonas putida KT2440
ucgacccgcugccc

SEQ ID NO: 1610577 - RNA, 22 nt, Pseudomonas putida KT2440
ucgacccgccgguugcgcagcc

SEQ ID NO: 1610578 - RNA, 20 nt, Pseudomonas putida KT2440
ucgacaugcaguugagcccu

SEQ ID NO: 1610579 - RNA, 21 nt, Pseudomonas putida KT2440
ucgaccacgaucuuggccagg

SEQ ID NO: 1610580 - RNA, 21 nt, Pseudomonas putida KT2440
ucgacagguugugguagucgc

SEQ ID NO: 1610581 - RNA, 18 nt, Pseudomonas putida KT2440
ucgacagugaauuccuug

SEQ ID NO: 1610582 - RNA, 21 nt, Pseudomonas putida KT2440
ucgacaaucggcucaacagcc

SEQ ID NO: 1610583 - RNA, 16 nt, Pseudomonas putida KT2440
ucgaauguccagaucc

SEQ ID NO: 1610584 - RNA, 18 nt, Pseudomonas putida KT2440
ucgaaucaagccugcgca

SEQ ID NO: 1610585 - RNA, 13 nt, Pseudomonas putida KT2440
ucgaauccccuua

SEQ ID NO: 1610586 - RNA, 19 nt, Pseudomonas putida KT2440
ucgacaaagcucaaaugcu

SEQ ID NO: 1610587 - RNA, 23 nt, Pseudomonas putida KT2440
ucgacaaagcucaaaugcuggca

SEQ ID NO: 1610588 - RNA, 22 nt, Pseudomonas putida KT2440
ucgacaaaguugccgaugaugc

SEQ ID NO: 1610589 - RNA, 17 nt, Pseudomonas putida KT2440
ucgaacggcgccagcag

SEQ ID NO: 1610590 - RNA, 18 nt, Pseudomonas putida KT2440
ucgaacggcgccagcagu

SEQ ID NO: 1610591 - RNA, 20 nt, Pseudomonas putida KT2440
ucgaaccccugauguggcug

SEQ ID NO: 1610592 - RNA, 13 nt, Pseudomonas putida KT2440
ucgaacuccugca

SEQ ID NO: 1610593 - RNA, 23 nt, Pseudomonas putida KT2440
ucgaacuccuugucgcaauggaa

SEQ ID NO: 1610594 - RNA, 13 nt, Pseudomonas putida KT2440
ucgaaccugcccg

SEQ ID NO: 1610595 - RNA, 13 nt, Pseudomonas putida KT2440
ucgaagcgcaccu

SEQ ID NO: 1610596 - RNA, 12 nt, Pseudomonas putida KT2440
ucgaagcgcucc

SEQ ID NO: 1610597 - RNA, 12 nt, Pseudomonas putida KT2440
ucgaagucgucc

SEQ ID NO: 1610598 - RNA, 22 nt, Pseudomonas putida KT2440
ucgaaguauuccagaaucugca

SEQ ID NO: 1610599 - RNA, 15 nt, Pseudomonas putida KT2440
ucgaaguaggcauuc

SEQ ID NO: 1610600 - RNA, 22 nt, Pseudomonas putida KT2440
ucgaaagcccauaaaccccagc

SEQ ID NO: 1610601 - RNA, 19 nt, Pseudomonas putida KT2440
ucgaaaccaucaaucaacu

SEQ ID NO: 1610602 - RNA, 21 nt, Pseudomonas putida KT2440
ucgaaaaucucguucaugccc

SEQ ID NO: 1610603 - RNA, 14 nt, Pseudomonas putida KT2440
ucgaaccagcagca

SEQ ID NO: 1610604 - RNA, 19 nt, Pseudomonas putida KT2440
ucgaacauuuccagcauga

SEQ ID NO: 1610605 - RNA, 17 nt, Pseudomonas putida KT2440
ucgaacagcucuuccag

SEQ ID NO: 1610606 - RNA, 23 nt, Pseudomonas putida KT2440
ucgaacacggcguggugcugcau

SEQ ID NO: 1610607 - RNA, 18 nt, Pseudomonas putida KT2440
ucgaacacuucacgcaca

SEQ ID NO: 1610608 - RNA, 21 nt, Pseudomonas putida KT2440
ucgaacaacgccucgggcgcu

SEQ ID NO: 1610609 - RNA, 16 nt, Pseudomonas putida KT2440
ucgaacaccacccggu

SEQ ID NO: 1610610 - RNA, 22 nt, Pseudomonas putida KT2440
ucgaacaccagggugggaaugc

SEQ ID NO: 1610611 - RNA, 16 nt, Pseudomonas putida KT2440
ucgaacaacuguccug

SEQ ID NO: 1610612 - RNA, 19 nt, Pseudomonas putida KT2440
ucgaacaacuugugcauca

SEQ ID NO: 1610613 - RNA, 18 nt, Pseudomonas putida KT2440
uccuuuguuuucaucugc

SEQ ID NO: 1610614 - RNA, 21 nt, Pseudomonas putida KT2440
ucgaaaaccugcugacaccgc

SEQ ID NO: 1610615 - RNA, 23 nt, Pseudomonas putida KT2440
uccuuggccgguuucagucagcc

SEQ ID NO: 1610616 - RNA, 21 nt, Pseudomonas putida KT2440
uccuuggugcaugcaagcagc

SEQ ID NO: 1610617 - RNA, 16 nt, Pseudomonas putida KT2440
uccuuggccaaugcca

SEQ ID NO: 1610618 - RNA, 15 nt, Pseudomonas putida KT2440
uccuugcuggccacc

SEQ ID NO: 1610619 - RNA, 18 nt, Pseudomonas putida KT2440
uccuugcguugcaacaag

SEQ ID NO: 1610620 - RNA, 13 nt, Pseudomonas putida KT2440
uccuugaucagga

SEQ ID NO: 1610621 - RNA, 13 nt, Pseudomonas putida KT2440
uccuugaucaggg

SEQ ID NO: 1610622 - RNA, 15 nt, Pseudomonas putida KT2440
uccuugcacuccccc

SEQ ID NO: 1610623 - RNA, 23 nt, Pseudomonas putida KT2440
uccuugcagcgccgcauccagca

SEQ ID NO: 1610624 - RNA, 13 nt, Pseudomonas putida KT2440
uccuugcagggca

SEQ ID NO: 1610625 - RNA, 21 nt, Pseudomonas putida KT2440
uccuugucgcaauggaaacau

SEQ ID NO: 1610626 - RNA, 21 nt, Pseudomonas putida KT2440
uccuugacggggcacaacccg

SEQ ID NO: 1610627 - RNA, 21 nt, Pseudomonas putida KT2440
uccuugaaguaguccccauca

SEQ ID NO: 1610628 - RNA, 23 nt, Pseudomonas putida KT2440
uccuugcacaguucgaaaaccug

SEQ ID NO: 1610629 - RNA, 19 nt, Pseudomonas putida KT2440
uccuucuugugcacaaagc

SEQ ID NO: 1610630 - RNA, 23 nt, Pseudomonas putida KT2440
uccuucuuugaaaguggccaagc

SEQ ID NO: 1610631 - RNA, 12 nt, Pseudomonas putida KT2440
uccuugaaauuc

SEQ ID NO: 1610632 - RNA, 13 nt, Pseudomonas putida KT2440
uccuugaaauuca

SEQ ID NO: 1610633 - RNA, 14 nt, Pseudomonas putida KT2440
uccuugaaauucaa

SEQ ID NO: 1610634 - RNA, 24 nt, Pseudomonas putida KT2440
uccuucugccguuugcuggccugc

SEQ ID NO: 1610635 - RNA, 16 nt, Pseudomonas putida KT2440
uccuucgccacgaaca

SEQ ID NO: 1610636 - RNA, 21 nt, Pseudomonas putida KT2440
uagucgacaauuuggggcugc

SEQ ID NO: 1610637 - RNA, 23 nt, Pseudomonas putida KT2440
uaguggcguuuuucacacgccac

SEQ ID NO: 1610638 - RNA, 14 nt, Pseudomonas putida KT2440
uaguucgugcaccc

SEQ ID NO: 1610639 - RNA, 19 nt, Pseudomonas putida KT2440
uagguggacaccauggccu

SEQ ID NO: 1610640 - RNA, 23 nt, Pseudomonas putida KT2440
uaggugguguugggcgggccgcc

SEQ ID NO: 1610641 - RNA, 17 nt, Pseudomonas putida KT2440
uaguaagccagcccugc

SEQ ID NO: 1610642 - RNA, 11 nt, Pseudomonas putida KT2440
uagucagggug

SEQ ID NO: 1610643 - RNA, 21 nt, Pseudomonas putida KT2440
uagucagaaaguuugguuuuu

SEQ ID NO: 1610644 - RNA, 19 nt, Pseudomonas putida KT2440
uaguaauggccgaugaacu

SEQ ID NO: 1610645 - RNA, 17 nt, Pseudomonas putida KT2440
uauaagcuaccggcuag

SEQ ID NO: 1610646 - RNA, 19 nt, Pseudomonas putida KT2440
uauaagccccaugcgacca

SEQ ID NO: 1610647 - RNA, 19 nt, Pseudomonas putida KT2440
uauaucucgggcuuccagu

SEQ ID NO: 1610648 - RNA, 21 nt, Pseudomonas putida KT2440
uauauuuuccugaguuagaca

SEQ ID NO: 1610649 - RNA, 17 nt, Pseudomonas putida KT2440
uaucgaucaggaaggca

SEQ ID NO: 1610650 - RNA, 19 nt, Pseudomonas putida KT2440
uaucgaauagcccaccuuc

SEQ ID NO: 1610651 - RNA, 16 nt, Pseudomonas putida KT2440
uaucgacuucggccau

SEQ ID NO: 1610652 - RNA, 17 nt, Pseudomonas putida KT2440
uauccuugcccaccagg

SEQ ID NO: 1610653 - RNA, 15 nt, Pseudomonas putida KT2440
uauccuccagcccug

SEQ ID NO: 1610654 - RNA, 19 nt, Pseudomonas putida KT2440
uauccuccagcccugcucg

SEQ ID NO: 1610655 - RNA, 22 nt, Pseudomonas putida KT2440
uauccuccagcccugcucgcca

SEQ ID NO: 1610656 - RNA, 22 nt, Pseudomonas putida KT2440
uauccuacgcgccagucagaag

SEQ ID NO: 1610657 - RNA, 11 nt, Pseudomonas putida KT2440
uauccagcccg

SEQ ID NO: 1610658 - RNA, 21 nt, Pseudomonas putida KT2440
uaucaggcaugccagcagcug

SEQ ID NO: 1610659 - RNA, 23 nt, Pseudomonas putida KT2440
uaucagcgccagcacgcaggcca

SEQ ID NO: 1610660 - RNA, 14 nt, Pseudomonas putida KT2440
uaugcucuuuccaa

SEQ ID NO: 1610661 - RNA, 21 nt, Pseudomonas putida KT2440
uaugccaagccacuggccagc

SEQ ID NO: 1610662 - RNA, 22 nt, Pseudomonas putida KT2440
uaugggucgacugaccgcgcau

SEQ ID NO: 1610663 - RNA, 12 nt, Pseudomonas putida KT2440
uauggcuucacg

SEQ ID NO: 1610664 - RNA, 18 nt, Pseudomonas putida KT2440
uaugggaagucgccgcgg

SEQ ID NO: 1610665 - RNA, 13 nt, Pseudomonas putida KT2440
uauggcuccacca

SEQ ID NO: 1610666 - RNA, 19 nt, Pseudomonas putida KT2440
uauggccuuucugcuucca

SEQ ID NO: 1610667 - RNA, 14 nt, Pseudomonas putida KT2440
uauggaaauggaau

SEQ ID NO: 1610668 - RNA, 15 nt, Pseudomonas putida KT2440
uaugauagucaucug

SEQ ID NO: 1610669 - RNA, 21 nt, Pseudomonas putida KT2440
uaucucugguacaacaacaaa

SEQ ID NO: 1610670 - RNA, 16 nt, Pseudomonas putida KT2440
uaugaaaaggcccugc

SEQ ID NO: 1610671 - RNA, 12 nt, Pseudomonas putida KT2440
uauuggccaggu

SEQ ID NO: 1610672 - RNA, 18 nt, Pseudomonas putida KT2440
uauguccauccaugcaau

SEQ ID NO: 1610673 - RNA, 19 nt, Pseudomonas putida KT2440
uaugugcacauucuccagu

SEQ ID NO: 1610674 - RNA, 18 nt, Pseudomonas putida KT2440
uauguggggcgugcucgg

SEQ ID NO: 1610675 - RNA, 19 nt, Pseudomonas putida KT2440
uauuaaggcaaguggaagc

SEQ ID NO: 1610676 - RNA, 21 nt, Pseudomonas putida KT2440
ucaaucagggauacugcugaa

SEQ ID NO: 1610677 - RNA, 15 nt, Pseudomonas putida KT2440
ucaauggcugggggc

SEQ ID NO: 1610678 - RNA, 12 nt, Pseudomonas putida KT2440
ucaccacgcccu

SEQ ID NO: 1610679 - RNA, 18 nt, Pseudomonas putida KT2440
ucaccacgcccuggcccg

SEQ ID NO: 1610680 - RNA, 20 nt, Pseudomonas putida KT2440
ucaccacgggaaugaacugc

SEQ ID NO: 1610681 - RNA, 17 nt, Pseudomonas putida KT2440
ucaccagguugcgugcc

SEQ ID NO: 1610682 - RNA, 15 nt, Pseudomonas putida KT2440
ucaccagguugcguu

SEQ ID NO: 1610683 - RNA, 18 nt, Pseudomonas putida KT2440
ucaccagguuguggccca

SEQ ID NO: 1610684 - RNA, 20 nt, Pseudomonas putida KT2440
ucaccagguuguggcccaug

SEQ ID NO: 1610685 - RNA, 12 nt, Pseudomonas putida KT2440
ucaccagcuuca

SEQ ID NO: 1610686 - RNA, 14 nt, Pseudomonas putida KT2440
ucaccaucaagccc

SEQ ID NO: 1610687 - RNA, 19 nt, Pseudomonas putida KT2440
ucaccaguuuuuguaccug

SEQ ID NO: 1610688 - RNA, 16 nt, Pseudomonas putida KT2440
ucacauaguugggcug

SEQ ID NO: 1610689 - RNA, 13 nt, Pseudomonas putida KT2440
aaaucgcugcggc

SEQ ID NO: 1610690 - RNA, 18 nt, Pseudomonas putida KT2440
ucacaggccauagcccuc

SEQ ID NO: 1610691 - RNA, 12 nt, Pseudomonas putida KT2440
ucacagccaagc

SEQ ID NO: 1610692 - RNA, 16 nt, Pseudomonas putida KT2440
ucacagcacaaggcuc

SEQ ID NO: 1610693 - RNA, 18 nt, Pseudomonas putida KT2440
ucacagccuucaggguug

SEQ ID NO: 1610694 - RNA, 22 nt, Pseudomonas putida KT2440
ucacagcgggggcagugcccag

SEQ ID NO: 1610695 - RNA, 21 nt, Pseudomonas putida KT2440
ucaacaauuuucgaccaaggc

SEQ ID NO: 1610696 - RNA, 22 nt, Pseudomonas putida KT2440
ucaacaauuuucgaccaaggcu

SEQ ID NO: 1610697 - RNA, 15 nt, Pseudomonas putida KT2440
ucaacaaaccgaccc

SEQ ID NO: 1610698 - RNA, 21 nt, Pseudomonas putida KT2440
ucaacaaaccgacccugcugc

SEQ ID NO: 1610699 - RNA, 13 nt, Pseudomonas putida KT2440
ucaacaaaucggc

SEQ ID NO: 1610700 - RNA, 16 nt, Pseudomonas putida KT2440
ucaacaccaucuucau

SEQ ID NO: 1610701 - RNA, 21 nt, Pseudomonas putida KT2440
ucaacaccagcauguccugcu

SEQ ID NO: 1610702 - RNA, 17 nt, Pseudomonas putida KT2440
ucaacaccagacucagc

SEQ ID NO: 1610703 - RNA, 12 nt, Pseudomonas putida KT2440
ucaacaccagca

SEQ ID NO: 1610704 - RNA, 14 nt, Pseudomonas putida KT2440
ucaacagcaggugc

SEQ ID NO: 1610705 - RNA, 15 nt, Pseudomonas putida KT2440
ucaacagccacgccc

SEQ ID NO: 1610706 - RNA, 12 nt, Pseudomonas putida KT2440
ucaacgccuccc

SEQ ID NO: 1610707 - RNA, 19 nt, Pseudomonas putida KT2440
ucaacgccucccccacccc

SEQ ID NO: 1610708 - RNA, 20 nt, Pseudomonas putida KT2440
ucaacggcaacgccagcaau

SEQ ID NO: 1610709 - RNA, 14 nt, Pseudomonas putida KT2440
ucaacuucccucug

SEQ ID NO: 1610710 - RNA, 14 nt, Pseudomonas putida KT2440
ucaacuccauggcc

SEQ ID NO: 1610711 - RNA, 16 nt, Pseudomonas putida KT2440
ucaacuccauggccag

SEQ ID NO: 1610712 - RNA, 17 nt, Pseudomonas putida KT2440
ucaacucaucacucuug

SEQ ID NO: 1610713 - RNA, 21 nt, Pseudomonas putida KT2440
ucaaccuuugcggcacaucuc

SEQ ID NO: 1610714 - RNA, 13 nt, Pseudomonas putida KT2440
ucaacgccgccag

SEQ ID NO: 1610715 - RNA, 13 nt, Pseudomonas putida KT2440
ucaacgccagggc

SEQ ID NO: 1610716 - RNA, 21 nt, Pseudomonas putida KT2440
ucaacgccaucaggcagcuca

SEQ ID NO: 1610717 - RNA, 20 nt, Pseudomonas putida KT2440
ucaacccucgcccagaaucu

SEQ ID NO: 1610718 - RNA, 13 nt, Pseudomonas putida KT2440
ucaaccgccucca

SEQ ID NO: 1610719 - RNA, 14 nt, Pseudomonas putida KT2440
ucaaaaugcuuuua

SEQ ID NO: 1610720 - RNA, 15 nt, Pseudomonas putida KT2440
ucaaaacucugcagg

SEQ ID NO: 1610721 - RNA, 18 nt, Pseudomonas putida KT2440
ucaaaacucugcagguca

SEQ ID NO: 1610722 - RNA, 16 nt, Pseudomonas putida KT2440
ucaaaccccugucaag

SEQ ID NO: 1610723 - RNA, 18 nt, Pseudomonas putida KT2440
ucaaauuuagagugcccc

SEQ ID NO: 1610724 - RNA, 16 nt, Pseudomonas putida KT2440
ucaaagcgcaaaacca

SEQ ID NO: 1610725 - RNA, 21 nt, Pseudomonas putida KT2440
ucaaagccauaccgcauccca

SEQ ID NO: 1610726 - RNA, 18 nt, Pseudomonas putida KT2440
ucaaagccugcuccagca

SEQ ID NO: 1610727 - RNA, 14 nt, Pseudomonas putida KT2440
ucacggcgcaggcc

SEQ ID NO: 1610728 - RNA, 12 nt, Pseudomonas putida KT2440
ucacggcauccc

SEQ ID NO: 1610729 - RNA, 15 nt, Pseudomonas putida KT2440
ucacggcugaagaag

SEQ ID NO: 1610730 - RNA, 17 nt, Pseudomonas putida KT2440
ucacggcugaagaagcu

SEQ ID NO: 1610731 - RNA, 13 nt, Pseudomonas putida KT2440
ucacgggcaggcc

SEQ ID NO: 1610732 - RNA, 16 nt, Pseudomonas putida KT2440
ucacgucacagccaag

SEQ ID NO: 1610733 - RNA, 14 nt, Pseudomonas putida KT2440
ucacgucacccagg

SEQ ID NO: 1610734 - RNA, 14 nt, Pseudomonas putida KT2440
ucacgucggccugc

SEQ ID NO: 1610735 - RNA, 19 nt, Pseudomonas putida KT2440
ucacgugccuucaccagcu

SEQ ID NO: 1610736 - RNA, 20 nt, Pseudomonas putida KT2440
ucacgucuggcaccaguucc

SEQ ID NO: 1610737 - RNA, 19 nt, Pseudomonas putida KT2440
ucacccgcgccaccagccc

SEQ ID NO: 1610738 - RNA, 21 nt, Pseudomonas putida KT2440
ucaccauggcuaagccaagcc

SEQ ID NO: 1610739 - RNA, 19 nt, Pseudomonas putida KT2440
ucacccgggaacagcagca

SEQ ID NO: 1610740 - RNA, 22 nt, Pseudomonas putida KT2440
ucacccgggaacagcagcaccg

SEQ ID NO: 1610741 - RNA, 17 nt, Pseudomonas putida KT2440
ucacccgcgaaagggcc

SEQ ID NO: 1610742 - RNA, 17 nt, Pseudomonas putida KT2440
ucacccgcgaagaggcc

SEQ ID NO: 1610743 - RNA, 18 nt, Pseudomonas putida KT2440
ucacccguggcagccccc

SEQ ID NO: 1610744 - RNA, 16 nt, Pseudomonas putida KT2440
ucacccugacgcugca

SEQ ID NO: 1610745 - RNA, 23 nt, Pseudomonas putida KT2440
ucacccugacgcugcacuuccac

SEQ ID NO: 1610746 - RNA, 22 nt, Pseudomonas putida KT2440
ucacccuugggcaccagcuucc

SEQ ID NO: 1610747 - RNA, 18 nt, Pseudomonas putida KT2440
ucacgcaucugcgcuacc

SEQ ID NO: 1610748 - RNA, 23 nt, Pseudomonas putida KT2440
ucacgcauguaguccaaagcuuu

SEQ ID NO: 1610749 - RNA, 19 nt, Pseudomonas putida KT2440
ucacgcccaucaggaacag

SEQ ID NO: 1610750 - RNA, 17 nt, Pseudomonas putida KT2440
ucacgcccgacuggcug

SEQ ID NO: 1610751 - RNA, 14 nt, Pseudomonas putida KT2440
ucacgcccgggcca

SEQ ID NO: 1610752 - RNA, 17 nt, Pseudomonas putida KT2440
ucacggaucagccgcgg

SEQ ID NO: 1610753 - RNA, 15 nt, Pseudomonas putida KT2440
ucacugccagcaccu

SEQ ID NO: 1610754 - RNA, 15 nt, Pseudomonas putida KT2440
ucacuggcuuccucu

SEQ ID NO: 1610755 - RNA, 22 nt, Pseudomonas putida KT2440
ucacuggcuuccucuucaaggc

SEQ ID NO: 1610756 - RNA, 17 nt, Pseudomonas putida KT2440
ucacuggccagcagggc

SEQ ID NO: 1610757 - RNA, 18 nt, Pseudomonas putida KT2440
ucacuuccggcugcagca

SEQ ID NO: 1610758 - RNA, 13 nt, Pseudomonas putida KT2440
ucacuuccacacg

SEQ ID NO: 1610759 - RNA, 14 nt, Pseudomonas putida KT2440
ucacuuccaccugc

SEQ ID NO: 1610760 - RNA, 19 nt, Pseudomonas putida KT2440
ucacuuccaccugcgccuu

SEQ ID NO: 1610761 - RNA, 21 nt, Pseudomonas putida KT2440
ucagaacgaggcguuggccaa

SEQ ID NO: 1610762 - RNA, 18 nt, Pseudomonas putida KT2440
ucagaccuccgucugcuc

SEQ ID NO: 1610763 - RNA, 20 nt, Pseudomonas putida KT2440
ucagaccuccgucugcucug

SEQ ID NO: 1610764 - RNA, 18 nt, Pseudomonas putida KT2440
ucagaauuugccccuucc

SEQ ID NO: 1610765 - RNA, 18 nt, Pseudomonas putida KT2440
ucagagcgaaaugggccg

SEQ ID NO: 1610766 - RNA, 22 nt, Pseudomonas putida KT2440
ucagacgcggaacuggcugacc

SEQ ID NO: 1610767 - RNA, 15 nt, Pseudomonas putida KT2440
ucagauggcccgguc

SEQ ID NO: 1610768 - RNA, 23 nt, Pseudomonas putida KT2440
ucagauggcccggucccgcugcc

SEQ ID NO: 1610769 - RNA, 13 nt, Pseudomonas putida KT2440
ucagaucacccuu

SEQ ID NO: 1610770 - RNA, 20 nt, Pseudomonas putida KT2440
ucagaucacccuuggccacc

SEQ ID NO: 1610771 - RNA, 23 nt, Pseudomonas putida KT2440
ucagaucacccuuggccaccuuc

SEQ ID NO: 1610772 - RNA, 17 nt, Pseudomonas putida KT2440
aaaucggguaacaggga

SEQ ID NO: 1610773 - RNA, 18 nt, Pseudomonas putida KT2440
ucagcaacccggccaggc

SEQ ID NO: 1610774 - RNA, 18 nt, Pseudomonas putida KT2440
ucagcaacgccaccaguu

SEQ ID NO: 1610775 - RNA, 17 nt, Pseudomonas putida KT2440
ucagugcggucaggcca

SEQ ID NO: 1610776 - RNA, 22 nt, Pseudomonas putida KT2440
ucagugccgggggugcuuaagu

SEQ ID NO: 1610777 - RNA, 17 nt, Pseudomonas putida KT2440
ucagugccugggucagc

SEQ ID NO: 1610778 - RNA, 21 nt, Pseudomonas putida KT2440
ucagugaugcuugcgcggcac

SEQ ID NO: 1610779 - RNA, 18 nt, Pseudomonas putida KT2440
ucaguggucuucaaggcc

SEQ ID NO: 1610780 - RNA, 18 nt, Pseudomonas putida KT2440
ucagugugaccuucaacc

SEQ ID NO: 1610781 - RNA, 19 nt, Pseudomonas putida KT2440
ucagugugggggcggccuc

SEQ ID NO: 1610782 - RNA, 20 nt, Pseudomonas putida KT2440
ucagucgguagagcaaauga

SEQ ID NO: 1610783 - RNA, 15 nt, Pseudomonas putida KT2440
ucagguagccuucca

SEQ ID NO: 1610784 - RNA, 17 nt, Pseudomonas putida KT2440
ucagguacucgcccgcc

SEQ ID NO: 1610785 - RNA, 21 nt, Pseudomonas putida KT2440
ucagguauugcgcaaggccgc

SEQ ID NO: 1610786 - RNA, 23 nt, Pseudomonas putida KT2440
ucagguauugcgcaaggccgcgg

SEQ ID NO: 1610787 - RNA, 20 nt, Pseudomonas putida KT2440
ucaggucgacacccagcacc

SEQ ID NO: 1610788 - RNA, 17 nt, Pseudomonas putida KT2440
ucagguaggccgcagcc

SEQ ID NO: 1610789 - RNA, 17 nt, Pseudomonas putida KT2440
ucaguaccuggccgcgu

SEQ ID NO: 1610790 - RNA, 13 nt, Pseudomonas putida KT2440
ucaggucgccagg

SEQ ID NO: 1610791 - RNA, 20 nt, Pseudomonas putida KT2440
ucaggcgucaggcuugcuuc

SEQ ID NO: 1610792 - RNA, 17 nt, Pseudomonas putida KT2440
ucaggcuguccacacca

SEQ ID NO: 1610793 - RNA, 20 nt, Pseudomonas putida KT2440
ucaggcugagcagaccagcc

SEQ ID NO: 1610794 - RNA, 13 nt, Pseudomonas putida KT2440
ucaggcugaucac

SEQ ID NO: 1610795 - RNA, 18 nt, Pseudomonas putida KT2440
ucaggcugaucaccgccg

SEQ ID NO: 1610796 - RNA, 23 nt, Pseudomonas putida KT2440
ucaggacggucaugcucagcugg

SEQ ID NO: 1610797 - RNA, 16 nt, Pseudomonas putida KT2440
ucagcucuucgaucuc

SEQ ID NO: 1610798 - RNA, 12 nt, Pseudomonas putida KT2440
ucaggcacaggc

SEQ ID NO: 1610799 - RNA, 20 nt, Pseudomonas putida KT2440
ucaggcagcucaaagagcaa

SEQ ID NO: 1610800 - RNA, 16 nt, Pseudomonas putida KT2440
ucaggcagaagguagg

SEQ ID NO: 1610801 - RNA, 17 nt, Pseudomonas putida KT2440
ucaggccaugcugcgcc

SEQ ID NO: 1610802 - RNA, 22 nt, Pseudomonas putida KT2440
ucaggcaugacaaacgccagca

SEQ ID NO: 1610803 - RNA, 17 nt, Pseudomonas putida KT2440
ucaggcaugccagcagc

SEQ ID NO: 1610804 - RNA, 20 nt, Pseudomonas putida KT2440
ucaggcaucacgucacagcc

SEQ ID NO: 1610805 - RNA, 21 nt, Pseudomonas putida KT2440
ucaggccgaugggcaggccau

SEQ ID NO: 1610806 - RNA, 16 nt, Pseudomonas putida KT2440
ucaggccgccuuggcu

SEQ ID NO: 1610807 - RNA, 15 nt, Pseudomonas putida KT2440
ucaggcccugcugcu

SEQ ID NO: 1610808 - RNA, 14 nt, Pseudomonas putida KT2440
ucaggccgaaggcc

SEQ ID NO: 1610809 - RNA, 19 nt, Pseudomonas putida KT2440
ucagcagguugaacagcag

SEQ ID NO: 1610810 - RNA, 16 nt, Pseudomonas putida KT2440
ucagcaggcgcggcgu

SEQ ID NO: 1610811 - RNA, 21 nt, Pseudomonas putida KT2440
ucagcaggaagcuguacagcg

SEQ ID NO: 1610812 - RNA, 23 nt, Pseudomonas putida KT2440
ucagcagcaggcgcgagccuugc

SEQ ID NO: 1610813 - RNA, 14 nt, Pseudomonas putida KT2440
ucagcauggccagu

SEQ ID NO: 1610814 - RNA, 18 nt, Pseudomonas putida KT2440
ucagcauggccaguuccu

SEQ ID NO: 1610815 - RNA, 21 nt, Pseudomonas putida KT2440
ucagcaucgggucacgcuccu

SEQ ID NO: 1610816 - RNA, 15 nt, Pseudomonas putida KT2440
ucagcaugucccggg

SEQ ID NO: 1610817 - RNA, 18 nt, Pseudomonas putida KT2440
ucagcacugugcucgccc

SEQ ID NO: 1610818 - RNA, 18 nt, Pseudomonas putida KT2440
ucagcaccggcaguagaa

SEQ ID NO: 1610819 - RNA, 17 nt, Pseudomonas putida KT2440
ucagcaccuucuugccc

SEQ ID NO: 1610820 - RNA, 14 nt, Pseudomonas putida KT2440
ucagcacgcccauc

SEQ ID NO: 1610821 - RNA, 13 nt, Pseudomonas putida KT2440
ucagcacacccag

SEQ ID NO: 1610822 - RNA, 23 nt, Pseudomonas putida KT2440
ucagcacacccagcacgaaggcc

SEQ ID NO: 1610823 - RNA, 19 nt, Pseudomonas putida KT2440
ucagcacaccgcucaaccu

SEQ ID NO: 1610824 - RNA, 18 nt, Pseudomonas putida KT2440
ucagcacauucagcagcg

SEQ ID NO: 1610825 - RNA, 14 nt, Pseudomonas putida KT2440
ucagcaaucccgcc

SEQ ID NO: 1610826 - RNA, 15 nt, Pseudomonas putida KT2440
ucagcaaucccgccc

SEQ ID NO: 1610827 - RNA, 21 nt, Pseudomonas putida KT2440
ucagcaaucccgccccaaagg

SEQ ID NO: 1610828 - RNA, 16 nt, Pseudomonas putida KT2440
ucagcaagccgccgau

SEQ ID NO: 1610829 - RNA, 22 nt, Pseudomonas putida KT2440
ucagcgcugacucagcggccuu

SEQ ID NO: 1610830 - RNA, 16 nt, Pseudomonas putida KT2440
ucagcgcucaaaaaaa

SEQ ID NO: 1610831 - RNA, 14 nt, Pseudomonas putida KT2440
ucagcggcacggcc

SEQ ID NO: 1610832 - RNA, 18 nt, Pseudomonas putida KT2440
ucagcggccuuucugcuu

SEQ ID NO: 1610833 - RNA, 19 nt, Pseudomonas putida KT2440
ucagcggccuuucugcuuc

SEQ ID NO: 1610834 - RNA, 14 nt, Pseudomonas putida KT2440
ucagcgucaugaac

SEQ ID NO: 1610835 - RNA, 14 nt, Pseudomonas putida KT2440
ucagcuccucugcc

SEQ ID NO: 1610836 - RNA, 16 nt, Pseudomonas putida KT2440
ucagcucgaacccacu

SEQ ID NO: 1610837 - RNA, 17 nt, Pseudomonas putida KT2440
ucagcgcguccagcaac

SEQ ID NO: 1610838 - RNA, 13 nt, Pseudomonas putida KT2440
ucagcgccccauc

SEQ ID NO: 1610839 - RNA, 16 nt, Pseudomonas putida KT2440
ucagccgacagauagg

SEQ ID NO: 1610840 - RNA, 14 nt, Pseudomonas putida KT2440
ucagccgagccaac

SEQ ID NO: 1610841 - RNA, 20 nt, Pseudomonas putida KT2440
ucagcccuugccagugaucc

SEQ ID NO: 1610842 - RNA, 19 nt, Pseudomonas putida KT2440
ucagcccauuucaccugcu

SEQ ID NO: 1610843 - RNA, 21 nt, Pseudomonas putida KT2440
ucagccaccgcacucugcugc

SEQ ID NO: 1610844 - RNA, 12 nt, Pseudomonas putida KT2440
ucagccacaucc

SEQ ID NO: 1610845 - RNA, 21 nt, Pseudomonas putida KT2440
ucagccaaccgccccacccau

SEQ ID NO: 1610846 - RNA, 16 nt, Pseudomonas putida KT2440
guggcgcagcaucauc

SEQ ID NO: 1610847 - RNA, 19 nt, Pseudomonas putida KT2440
guggcgcagcaucaucucu

SEQ ID NO: 1610848 - RNA, 14 nt, Pseudomonas putida KT2440
guggcgaucccugu

SEQ ID NO: 1610849 - RNA, 13 nt, Pseudomonas putida KT2440
guggcguaccggg

SEQ ID NO: 1610850 - RNA, 20 nt, Pseudomonas putida KT2440
guggcguugucagcaaccgg

SEQ ID NO: 1610851 - RNA, 13 nt, Pseudomonas putida KT2440
guggcucaucagc

SEQ ID NO: 1610852 - RNA, 15 nt, Pseudomonas putida KT2440
guggccuucgcgggc

SEQ ID NO: 1610853 - RNA, 14 nt, Pseudomonas putida KT2440
guggcagaacaucg

SEQ ID NO: 1610854 - RNA, 16 nt, Pseudomonas putida KT2440
guggcagguucgacca

SEQ ID NO: 1610855 - RNA, 16 nt, Pseudomonas putida KT2440
guggcauagcgcggcg

SEQ ID NO: 1610856 - RNA, 17 nt, Pseudomonas putida KT2440
guggauauccagcgagg

SEQ ID NO: 1610857 - RNA, 17 nt, Pseudomonas putida KT2440
guggcacccacagcgcc

SEQ ID NO: 1610858 - RNA, 19 nt, Pseudomonas putida KT2440
guggcaauggccugcaugu

SEQ ID NO: 1610859 - RNA, 22 nt, Pseudomonas putida KT2440
guggaagugcuucaccuugccu

SEQ ID NO: 1610860 - RNA, 15 nt, Pseudomonas putida KT2440
guggaaguuccugcu

SEQ ID NO: 1610861 - RNA, 23 nt, Pseudomonas putida KT2440
gugcuguaugauucgccucccgc

SEQ ID NO: 1610862 - RNA, 16 nt, Pseudomonas putida KT2440
guggaaauuggccagc

SEQ ID NO: 1610863 - RNA, 20 nt, Pseudomonas putida KT2440
guggaaauuggccagcaggc

SEQ ID NO: 1610864 - RNA, 14 nt, Pseudomonas putida KT2440
gugcuguugagcca

SEQ ID NO: 1610865 - RNA, 21 nt, Pseudomonas putida KT2440
guguucgccguuguucacggu

SEQ ID NO: 1610866 - RNA, 17 nt, Pseudomonas putida KT2440
guguucgcgggcaagcc

SEQ ID NO: 1610867 - RNA, 14 nt, Pseudomonas putida KT2440
guguucgcgggcau

SEQ ID NO: 1610868 - RNA, 21 nt, Pseudomonas putida KT2440
guguucccagcaccccagcac

SEQ ID NO: 1610869 - RNA, 20 nt, Pseudomonas putida KT2440
guguucgaacgggcauuuuu

SEQ ID NO: 1610870 - RNA, 18 nt, Pseudomonas putida KT2440
guguucgggguguggcca

SEQ ID NO: 1610871 - RNA, 17 nt, Pseudomonas putida KT2440
guguucugguugaacug

SEQ ID NO: 1610872 - RNA, 18 nt, Pseudomonas putida KT2440
guguggccaaggcggcga

SEQ ID NO: 1610873 - RNA, 20 nt, Pseudomonas putida KT2440
guguggccacacugcucagu

SEQ ID NO: 1610874 - RNA, 14 nt, Pseudomonas putida KT2440
guguggugcggcug

SEQ ID NO: 1610875 - RNA, 20 nt, Pseudomonas putida KT2440
gugugaugcagccagccucu

SEQ ID NO: 1610876 - RNA, 20 nt, Pseudomonas putida KT2440
gugugacccaguucgcggau

SEQ ID NO: 1610877 - RNA, 19 nt, Pseudomonas putida KT2440
gugugcgccgucaccagcg

SEQ ID NO: 1610878 - RNA, 13 nt, Pseudomonas putida KT2440
gugugcucacggu

SEQ ID NO: 1610879 - RNA, 16 nt, Pseudomonas putida KT2440
gugugcuccagcucca

SEQ ID NO: 1610880 - RNA, 16 nt, Pseudomonas putida KT2440
gugugcucgaggaagc

SEQ ID NO: 1610881 - RNA, 22 nt, Pseudomonas putida KT2440
guguggcaaauagaugcaggug

SEQ ID NO: 1610882 - RNA, 15 nt, Pseudomonas putida KT2440
guguaccauccagua

SEQ ID NO: 1610883 - RNA, 20 nt, Pseudomonas putida KT2440
gugggucaugucggcagcca

SEQ ID NO: 1610884 - RNA, 12 nt, Pseudomonas putida KT2440
guggggcugacu

SEQ ID NO: 1610885 - RNA, 18 nt, Pseudomonas putida KT2440
gugggguugaccaggcag

SEQ ID NO: 1610886 - RNA, 15 nt, Pseudomonas putida KT2440
gugucuucuguuguu

SEQ ID NO: 1610887 - RNA, 18 nt, Pseudomonas putida KT2440
gugucagcguacacugca

SEQ ID NO: 1610888 - RNA, 20 nt, Pseudomonas putida KT2440
gugucagcguacacugcagg

SEQ ID NO: 1610889 - RNA, 18 nt, Pseudomonas putida KT2440
gugucaggugguaguccu

SEQ ID NO: 1610890 - RNA, 15 nt, Pseudomonas putida KT2440
guucaucggcaaaca

SEQ ID NO: 1610891 - RNA, 16 nt, Pseudomonas putida KT2440
guucaucggcaaacac

SEQ ID NO: 1610892 - RNA, 19 nt, Pseudomonas putida KT2440
guucaggcaggaacuggcu

SEQ ID NO: 1610893 - RNA, 23 nt, Pseudomonas putida KT2440
guuccagaagcggcuaccgcugc

SEQ ID NO: 1610894 - RNA, 18 nt, Pseudomonas putida KT2440
guuccaagcgucggccac

SEQ ID NO: 1610895 - RNA, 14 nt, Pseudomonas putida KT2440
guucacccgcgaau

SEQ ID NO: 1610896 - RNA, 18 nt, Pseudomonas putida KT2440
guucagcccuugcugcag

SEQ ID NO: 1610897 - RNA, 12 nt, Pseudomonas putida KT2440
guucaccagcag

SEQ ID NO: 1610898 - RNA, 15 nt, Pseudomonas putida KT2440
guucgaaaaccugcu

SEQ ID NO: 1610899 - RNA, 16 nt, Pseudomonas putida KT2440
guucgcagccauaguu

SEQ ID NO: 1610900 - RNA, 13 nt, Pseudomonas putida KT2440
guuccuuucucaa

SEQ ID NO: 1610901 - RNA, 17 nt, Pseudomonas putida KT2440
guucggcguacugcacg

SEQ ID NO: 1610902 - RNA, 20 nt, Pseudomonas putida KT2440
guuccuggcgcuccuccagc

SEQ ID NO: 1610903 - RNA, 15 nt, Pseudomonas putida KT2440
guuccgcguccuuga

SEQ ID NO: 1610904 - RNA, 13 nt, Pseudomonas putida KT2440
guuccgcccagcu

SEQ ID NO: 1610905 - RNA, 21 nt, Pseudomonas putida KT2440
guuccgaacugccccggcggc

SEQ ID NO: 1610906 - RNA, 22 nt, Pseudomonas putida KT2440
guuccgaacugccccggcggcg

SEQ ID NO: 1610907 - RNA, 17 nt, Pseudomonas putida KT2440
guuccauuucacuggcu

SEQ ID NO: 1610908 - RNA, 23 nt, Pseudomonas putida KT2440
guucccaaugucacuucuuucag

SEQ ID NO: 1610909 - RNA, 21 nt, Pseudomonas putida KT2440
guuaccucccgcacauuucac

SEQ ID NO: 1610910 - RNA, 16 nt, Pseudomonas putida KT2440
guuaugacuggccucg

SEQ ID NO: 1610911 - RNA, 12 nt, Pseudomonas putida KT2440
guuaagcgccac

SEQ ID NO: 1610912 - RNA, 17 nt, Pseudomonas putida KT2440
guuacccaccagcucca

SEQ ID NO: 1610913 - RNA, 18 nt, Pseudomonas putida KT2440
guucucgguauccggcuc

SEQ ID NO: 1610914 - RNA, 18 nt, Pseudomonas putida KT2440
guucuccagcuccuggcc

SEQ ID NO: 1610915 - RNA, 22 nt, Pseudomonas putida KT2440
guucuaccguuggcaucugcug

SEQ ID NO: 1610916 - RNA, 14 nt, Pseudomonas putida KT2440
guugcagaaacucg

SEQ ID NO: 1610917 - RNA, 20 nt, Pseudomonas putida KT2440
guugcaccucggaugccacg

SEQ ID NO: 1610918 - RNA, 19 nt, Pseudomonas putida KT2440
guugcgaugggcugcaaag

SEQ ID NO: 1610919 - RNA, 19 nt, Pseudomonas putida KT2440
guuggccaucugguugcug

SEQ ID NO: 1610920 - RNA, 14 nt, Pseudomonas putida KT2440
guugcuuucagcuc

SEQ ID NO: 1610921 - RNA, 23 nt, Pseudomonas putida KT2440
guuggacagcgcccggcgcagca

SEQ ID NO: 1610922 - RNA, 21 nt, Pseudomonas putida KT2440
guuggucuagagaucugcagg

SEQ ID NO: 1610923 - RNA, 22 nt, Pseudomonas putida KT2440
guuggugccggucggcguccac

SEQ ID NO: 1610924 - RNA, 19 nt, Pseudomonas putida KT2440
guuggugcgccuccagcag

SEQ ID NO: 1610925 - RNA, 21 nt, Pseudomonas putida KT2440
guuggugcgccuccagcagcg

SEQ ID NO: 1610926 - RNA, 13 nt, Pseudomonas putida KT2440
guugguguccuug

SEQ ID NO: 1610927 - RNA, 14 nt, Pseudomonas putida KT2440
guugguguccuugu

SEQ ID NO: 1610928 - RNA, 20 nt, Pseudomonas putida KT2440
guugcggucgguggucagcu

SEQ ID NO: 1610929 - RNA, 21 nt, Pseudomonas putida KT2440
guugcggaacauacgcaucag

SEQ ID NO: 1610930 - RNA, 19 nt, Pseudomonas putida KT2440
guugcgcagcagcaggccc

SEQ ID NO: 1610931 - RNA, 20 nt, Pseudomonas putida KT2440
guugcgcucaaccgaccugc

SEQ ID NO: 1610932 - RNA, 23 nt, Pseudomonas putida KT2440
guugcgcucaaccgaccugcaac

SEQ ID NO: 1610933 - RNA, 14 nt, Pseudomonas putida KT2440
guugcguugcagcu

SEQ ID NO: 1610934 - RNA, 15 nt, Pseudomonas putida KT2440
guugcguugcagcuu

SEQ ID NO: 1610935 - RNA, 13 nt, Pseudomonas putida KT2440
guugucauggcua

SEQ ID NO: 1610936 - RNA, 17 nt, Pseudomonas putida KT2440
guugucccgcccugagc

SEQ ID NO: 1610937 - RNA, 12 nt, Pseudomonas putida KT2440
guuguccagcag

SEQ ID NO: 1610938 - RNA, 14 nt, Pseudomonas putida KT2440
guuguccagcagca

SEQ ID NO: 1610939 - RNA, 19 nt, Pseudomonas putida KT2440
guuguccagcagcagcgca

SEQ ID NO: 1610940 - RNA, 21 nt, Pseudomonas putida KT2440
guuguccagcagcagcgcacc

SEQ ID NO: 1610941 - RNA, 13 nt, Pseudomonas putida KT2440
guuguccagcagg

SEQ ID NO: 1610942 - RNA, 15 nt, Pseudomonas putida KT2440
guugucacccagcac

SEQ ID NO: 1610943 - RNA, 20 nt, Pseudomonas putida KT2440
guugucgaacagcauccagc

SEQ ID NO: 1610944 - RNA, 23 nt, Pseudomonas putida KT2440
guuucaacggguaguugcccggg

SEQ ID NO: 1610945 - RNA, 18 nt, Pseudomonas putida KT2440
guuucacagcacaaggcu

SEQ ID NO: 1610946 - RNA, 15 nt, Pseudomonas putida KT2440
guuucacuaccaccu

SEQ ID NO: 1610947 - RNA, 22 nt, Pseudomonas putida KT2440
guuucacccuugggcucagccg

SEQ ID NO: 1610948 - RNA, 16 nt, Pseudomonas putida KT2440
guuucagucgaagucu

SEQ ID NO: 1610949 - RNA, 21 nt, Pseudomonas putida KT2440
guuuucaaugcugcucgcccg

SEQ ID NO: 1610950 - RNA, 13 nt, Pseudomonas putida KT2440
guuuugagagggu

SEQ ID NO: 1610951 - RNA, 16 nt, Pseudomonas putida KT2440
guuuugccuccagcuu

SEQ ID NO: 1610952 - RNA, 16 nt, Pseudomonas putida KT2440
guuucugcucuucugc

SEQ ID NO: 1610953 - RNA, 14 nt, Pseudomonas putida KT2440
guuucuuaguauuu

SEQ ID NO: 1610954 - RNA, 20 nt, Pseudomonas putida KT2440
guuugaucauuucaucgcca

SEQ ID NO: 1610955 - RNA, 18 nt, Pseudomonas putida KT2440
guuugagccggcgcuggg

SEQ ID NO: 1610956 - RNA, 21 nt, Pseudomonas putida KT2440
guuugcgaagguaaccugguu

SEQ ID NO: 1610957 - RNA, 15 nt, Pseudomonas putida KT2440
guuugucgcccgccu

SEQ ID NO: 1610958 - RNA, 15 nt, Pseudomonas putida KT2440
guuucggcggccugc

SEQ ID NO: 1610959 - RNA, 16 nt, Pseudomonas putida KT2440
guuucggcggccugca

SEQ ID NO: 1610960 - RNA, 19 nt, Pseudomonas putida KT2440
guuucgaugauauccaugu

SEQ ID NO: 1610961 - RNA, 18 nt, Pseudomonas putida KT2440
guuucgcccccggcggcg

SEQ ID NO: 1610962 - RNA, 22 nt, Pseudomonas putida KT2440
aaaucaagagcccggaagcuuc

SEQ ID NO: 1610963 - RNA, 16 nt, Pseudomonas putida KT2440
guuucucgcagcagca

SEQ ID NO: 1610964 - RNA, 18 nt, Pseudomonas putida KT2440
guuucucgcagcagcacc

SEQ ID NO: 1610965 - RNA, 16 nt, Pseudomonas putida KT2440
guuuccagcccuucca

SEQ ID NO: 1610966 - RNA, 21 nt, Pseudomonas putida KT2440
guuuccagcaaccgccccugc

SEQ ID NO: 1610967 - RNA, 12 nt, Pseudomonas putida KT2440
guuuccagguuc

SEQ ID NO: 1610968 - RNA, 14 nt, Pseudomonas putida KT2440
gugaagcccugcug

SEQ ID NO: 1610969 - RNA, 22 nt, Pseudomonas putida KT2440
gugaagaagaacuccuccagcu

SEQ ID NO: 1610970 - RNA, 21 nt, Pseudomonas putida KT2440
gugaagaauucaggcaucuga

SEQ ID NO: 1610971 - RNA, 22 nt, Pseudomonas putida KT2440
gugaacccgauuacaagggccu

SEQ ID NO: 1610972 - RNA, 23 nt, Pseudomonas putida KT2440
gugaagcucgaucugccugccuc

SEQ ID NO: 1610973 - RNA, 22 nt, Pseudomonas putida KT2440
gugaagcgcacuuggccugcug

SEQ ID NO: 1610974 - RNA, 12 nt, Pseudomonas putida KT2440
gugaaggccagg

SEQ ID NO: 1610975 - RNA, 23 nt, Pseudomonas putida KT2440
gugaaggccaggaacagcgcagc

SEQ ID NO: 1610976 - RNA, 20 nt, Pseudomonas putida KT2440
gugaagucgguggucaccag

SEQ ID NO: 1610977 - RNA, 12 nt, Pseudomonas putida KT2440
gugaaucagccc

SEQ ID NO: 1610978 - RNA, 20 nt, Pseudomonas putida KT2440
gugacgaccucggccagguc

SEQ ID NO: 1610979 - RNA, 21 nt, Pseudomonas putida KT2440
gugacgugcgcuccuggucau

SEQ ID NO: 1610980 - RNA, 20 nt, Pseudomonas putida KT2440
gugaccaggcccagcaggua

SEQ ID NO: 1610981 - RNA, 18 nt, Pseudomonas putida KT2440
gugaccagcggcagcaag

SEQ ID NO: 1610982 - RNA, 17 nt, Pseudomonas putida KT2440
aaauaggccuuggcuuc

SEQ ID NO: 1610983 - RNA, 22 nt, Pseudomonas putida KT2440
gugagccugcacccgcgcgccc

SEQ ID NO: 1610984 - RNA, 14 nt, Pseudomonas putida KT2440
gugacugaugauga

SEQ ID NO: 1610985 - RNA, 15 nt, Pseudomonas putida KT2440
gugacugccagcacg

SEQ ID NO: 1610986 - RNA, 23 nt, Pseudomonas putida KT2440
gugcaauaccagccuggccccac

SEQ ID NO: 1610987 - RNA, 15 nt, Pseudomonas putida KT2440
gugaucgcaucaucc

SEQ ID NO: 1610988 - RNA, 14 nt, Pseudomonas putida KT2440
gugaucauccccag

SEQ ID NO: 1610989 - RNA, 21 nt, Pseudomonas putida KT2440
gugauucaagacaguggaaac

SEQ ID NO: 1610990 - RNA, 17 nt, Pseudomonas putida KT2440
gugaucguacgccggcg

SEQ ID NO: 1610991 - RNA, 13 nt, Pseudomonas putida KT2440
gugcacgccagcc

SEQ ID NO: 1610992 - RNA, 18 nt, Pseudomonas putida KT2440
gugcacggguucacggaa

SEQ ID NO: 1610993 - RNA, 13 nt, Pseudomonas putida KT2440
gugcacugccugg

SEQ ID NO: 1610994 - RNA, 16 nt, Pseudomonas putida KT2440
gugcacugccuggcuc

SEQ ID NO: 1610995 - RNA, 20 nt, Pseudomonas putida KT2440
gugcacuuucgcggcccagc

SEQ ID NO: 1610996 - RNA, 21 nt, Pseudomonas putida KT2440
gugcacaagcugcugauaauu

SEQ ID NO: 1610997 - RNA, 16 nt, Pseudomonas putida KT2440
gugcacaaagcccaag

SEQ ID NO: 1610998 - RNA, 21 nt, Pseudomonas putida KT2440
gugcaagggauaucaggcccu

SEQ ID NO: 1610999 - RNA, 19 nt, Pseudomonas putida KT2440
gugcagcgcucgcugccgg

SEQ ID NO: 1611000 - RNA, 15 nt, Pseudomonas putida KT2440
gugcagauccaggug

SEQ ID NO: 1611001 - RNA, 22 nt, Pseudomonas putida KT2440
gugcagauccaggugcccauga

SEQ ID NO: 1611002 - RNA, 21 nt, Pseudomonas putida KT2440
gugcagauugcccuguggcug

SEQ ID NO: 1611003 - RNA, 11 nt, Pseudomonas putida KT2440
gugcagggcug

SEQ ID NO: 1611004 - RNA, 20 nt, Pseudomonas putida KT2440
gugcagggggguaaggcugg

SEQ ID NO: 1611005 - RNA, 16 nt, Pseudomonas putida KT2440
gugcaggguaggggug

SEQ ID NO: 1611006 - RNA, 22 nt, Pseudomonas putida KT2440
gugcagggaagggcaaugauca

SEQ ID NO: 1611007 - RNA, 19 nt, Pseudomonas putida KT2440
gugaaagucgaccagcagc

SEQ ID NO: 1611008 - RNA, 20 nt, Pseudomonas putida KT2440
gucuugucugacagcaggaa

SEQ ID NO: 1611009 - RNA, 19 nt, Pseudomonas putida KT2440
gucuuccaccaccuccauc

SEQ ID NO: 1611010 - RNA, 17 nt, Pseudomonas putida KT2440
gucuuccagaccagaca

SEQ ID NO: 1611011 - RNA, 18 nt, Pseudomonas putida KT2440
gucuucaagcucgaagcg

SEQ ID NO: 1611012 - RNA, 17 nt, Pseudomonas putida KT2440
gucuucaaggccaccac

SEQ ID NO: 1611013 - RNA, 23 nt, Pseudomonas putida KT2440
gucuucaaucgucaugaucgcua

SEQ ID NO: 1611014 - RNA, 19 nt, Pseudomonas putida KT2440
gucuucgaucucggccagc

SEQ ID NO: 1611015 - RNA, 23 nt, Pseudomonas putida KT2440
gucuucgaucuggaucacugcca

SEQ ID NO: 1611016 - RNA, 23 nt, Pseudomonas putida KT2440
gucuuccggcagggugaaguuga

SEQ ID NO: 1611017 - RNA, 17 nt, Pseudomonas putida KT2440
gucuuccucgacccagc

SEQ ID NO: 1611018 - RNA, 12 nt, Pseudomonas putida KT2440
gucuuccagcug

SEQ ID NO: 1611019 - RNA, 14 nt, Pseudomonas putida KT2440
gucuuccagggcaa

SEQ ID NO: 1611020 - RNA, 11 nt, Pseudomonas putida KT2440
gucuuccaggu

SEQ ID NO: 1611021 - RNA, 16 nt, Pseudomonas putida KT2440
gucuuccccuuggcga

SEQ ID NO: 1611022 - RNA, 17 nt, Pseudomonas putida KT2440
gucguggucgccgucgc

SEQ ID NO: 1611023 - RNA, 14 nt, Pseudomonas putida KT2440
gucguggcgcuggc

SEQ ID NO: 1611024 - RNA, 20 nt, Pseudomonas putida KT2440
gucguuacccaccagcucca

SEQ ID NO: 1611025 - RNA, 17 nt, Pseudomonas putida KT2440
gucguuacccagguaga

SEQ ID NO: 1611026 - RNA, 14 nt, Pseudomonas putida KT2440
gucguucuccugcg

SEQ ID NO: 1611027 - RNA, 16 nt, Pseudomonas putida KT2440
gucuccagcagugccg

SEQ ID NO: 1611028 - RNA, 17 nt, Pseudomonas putida KT2440
gucucgaacgcugugcc

SEQ ID NO: 1611029 - RNA, 18 nt, Pseudomonas putida KT2440
gucucgaacgcugugccg

SEQ ID NO: 1611030 - RNA, 19 nt, Pseudomonas putida KT2440
gucuccgugcucaggcggc

SEQ ID NO: 1611031 - RNA, 23 nt, Pseudomonas putida KT2440
gucuccuaugagacuagcagucc

SEQ ID NO: 1611032 - RNA, 20 nt, Pseudomonas putida KT2440
gucuccgcgcuugcucaacu

SEQ ID NO: 1611033 - RNA, 20 nt, Pseudomonas putida KT2440
gucucgccgcuguacaccag

SEQ ID NO: 1611034 - RNA, 12 nt, Pseudomonas putida KT2440
gucucgcgccuu

SEQ ID NO: 1611035 - RNA, 16 nt, Pseudomonas putida KT2440
gucucgaccacuuccc

SEQ ID NO: 1611036 - RNA, 17 nt, Pseudomonas putida KT2440
gucucuacgcccauggc

SEQ ID NO: 1611037 - RNA, 18 nt, Pseudomonas putida KT2440
gucucugaccggcacugc

SEQ ID NO: 1611038 - RNA, 22 nt, Pseudomonas putida KT2440
gucucugaccggcacugcacag

SEQ ID NO: 1611039 - RNA, 23 nt, Pseudomonas putida KT2440
gucucugaccggcacugcacagc

SEQ ID NO: 1611040 - RNA, 17 nt, Pseudomonas putida KT2440
gucucgucacuggcugc

SEQ ID NO: 1611041 - RNA, 16 nt, Pseudomonas putida KT2440
gucucuuucaggcaca

SEQ ID NO: 1611042 - RNA, 20 nt, Pseudomonas putida KT2440
gucucuuccugcaccugguu

SEQ ID NO: 1611043 - RNA, 21 nt, Pseudomonas putida KT2440
gucucuuccugcaccugguug

SEQ ID NO: 1611044 - RNA, 21 nt, Pseudomonas putida KT2440
gucugcacgcgugccugguug

SEQ ID NO: 1611045 - RNA, 22 nt, Pseudomonas putida KT2440
gucugcacgcgugccugguugc

SEQ ID NO: 1611046 - RNA, 16 nt, Pseudomonas putida KT2440
gucugcauaggcgcug

SEQ ID NO: 1611047 - RNA, 20 nt, Pseudomonas putida KT2440
gucugccaguucaugcagcg

SEQ ID NO: 1611048 - RNA, 16 nt, Pseudomonas putida KT2440
gucugccgcagccccg

SEQ ID NO: 1611049 - RNA, 15 nt, Pseudomonas putida KT2440
gucugacagcaggaa

SEQ ID NO: 1611050 - RNA, 16 nt, Pseudomonas putida KT2440
gucugacagcaggaac

SEQ ID NO: 1611051 - RNA, 13 nt, Pseudomonas putida KT2440
gucuggcaccagu

SEQ ID NO: 1611052 - RNA, 14 nt, Pseudomonas putida KT2440
gucuguacaaaaga

SEQ ID NO: 1611053 - RNA, 18 nt, Pseudomonas putida KT2440
gucugcgcuucaagcagg

SEQ ID NO: 1611054 - RNA, 19 nt, Pseudomonas putida KT2440
gucugcgcgggaagcccgu

SEQ ID NO: 1611055 - RNA, 18 nt, Pseudomonas putida KT2440
gucugcgugauggcagcu

SEQ ID NO: 1611056 - RNA, 21 nt, Pseudomonas putida KT2440
gucugcgugcacccaaccugc

SEQ ID NO: 1611057 - RNA, 20 nt, Pseudomonas putida KT2440
gucugcucagccaaccgccc

SEQ ID NO: 1611058 - RNA, 16 nt, Pseudomonas putida KT2440
gucugcugcggccgcg

SEQ ID NO: 1611059 - RNA, 14 nt, Pseudomonas putida KT2440
gucggccagcugcu

SEQ ID NO: 1611060 - RNA, 15 nt, Pseudomonas putida KT2440
gucggccagcugcug

SEQ ID NO: 1611061 - RNA, 15 nt, Pseudomonas putida KT2440
gucggcguccacugc

SEQ ID NO: 1611062 - RNA, 14 nt, Pseudomonas putida KT2440
gucggcuggcagcu

SEQ ID NO: 1611063 - RNA, 19 nt, Pseudomonas putida KT2440
gucggcaaucugcucgacg

SEQ ID NO: 1611064 - RNA, 18 nt, Pseudomonas putida KT2440
gucgcuugucgccacccg

SEQ ID NO: 1611065 - RNA, 15 nt, Pseudomonas putida KT2440
gucgcuggacgcugu

SEQ ID NO: 1611066 - RNA, 21 nt, Pseudomonas putida KT2440
gucgcugguccacgguucugg

SEQ ID NO: 1611067 - RNA, 21 nt, Pseudomonas putida KT2440
gucgggcacaggcccagcaug

SEQ ID NO: 1611068 - RNA, 23 nt, Pseudomonas putida KT2440
gucggugaagccgaccacuucga

SEQ ID NO: 1611069 - RNA, 18 nt, Pseudomonas putida KT2440
gucgccgucgcacaggcg

SEQ ID NO: 1611070 - RNA, 18 nt, Pseudomonas putida KT2440
gucgccucgacgcagaca

SEQ ID NO: 1611071 - RNA, 16 nt, Pseudomonas putida KT2440
gucgccgugcagcacc

SEQ ID NO: 1611072 - RNA, 21 nt, Pseudomonas putida KT2440
gucgccuacaagggugaagua

SEQ ID NO: 1611073 - RNA, 13 nt, Pseudomonas putida KT2440
gucgccugggcau

SEQ ID NO: 1611074 - RNA, 20 nt, Pseudomonas putida KT2440
gucgccuucacacaggcugu

SEQ ID NO: 1611075 - RNA, 20 nt, Pseudomonas putida KT2440
gucgccuuugugcuuucugg

SEQ ID NO: 1611076 - RNA, 21 nt, Pseudomonas putida KT2440
gucgcggccuacccgggcgca

SEQ ID NO: 1611077 - RNA, 23 nt, Pseudomonas putida KT2440
gucgcggccuacccgggcgcagg

SEQ ID NO: 1611078 - RNA, 16 nt, Pseudomonas putida KT2440
gucgcggcgcuggccg

SEQ ID NO: 1611079 - RNA, 21 nt, Pseudomonas putida KT2440
gucgcugauuucgucaccgau

SEQ ID NO: 1611080 - RNA, 16 nt, Pseudomonas putida KT2440
gucgcgggccagccca

SEQ ID NO: 1611081 - RNA, 22 nt, Pseudomonas putida KT2440
gucgcgggccagcccauccagg

SEQ ID NO: 1611082 - RNA, 21 nt, Pseudomonas putida KT2440
gucgccgcggguaccaccugg

SEQ ID NO: 1611083 - RNA, 19 nt, Pseudomonas putida KT2440
gucgccgaaccccaccagc

SEQ ID NO: 1611084 - RNA, 14 nt, Pseudomonas putida KT2440
gucgcacccaccgc

SEQ ID NO: 1611085 - RNA, 15 nt, Pseudomonas putida KT2440
gucgcacaugaagcc

SEQ ID NO: 1611086 - RNA, 17 nt, Pseudomonas putida KT2440
gucgcacaugaagccgc

SEQ ID NO: 1611087 - RNA, 19 nt, Pseudomonas putida KT2440
gucgcacaugaagccgcgc

SEQ ID NO: 1611088 - RNA, 14 nt, Pseudomonas putida KT2440
gucgcacaggucca

SEQ ID NO: 1611089 - RNA, 21 nt, Pseudomonas putida KT2440
gucgcacagguccagccgcca

SEQ ID NO: 1611090 - RNA, 22 nt, Pseudomonas putida KT2440
gucgacgauacccagcgcgcgc

SEQ ID NO: 1611091 - RNA, 12 nt, Pseudomonas putida KT2440
gucgaccggagc

SEQ ID NO: 1611092 - RNA, 17 nt, Pseudomonas putida KT2440
gucgaccugggccaggu

SEQ ID NO: 1611093 - RNA, 17 nt, Pseudomonas putida KT2440
gucgaccugguccagcu

SEQ ID NO: 1611094 - RNA, 15 nt, Pseudomonas putida KT2440
gucgaccagaagggc

SEQ ID NO: 1611095 - RNA, 12 nt, Pseudomonas putida KT2440
gucgacagugac

SEQ ID NO: 1611096 - RNA, 22 nt, Pseudomonas putida KT2440
gucgaaaccgaaaccacugcug

SEQ ID NO: 1611097 - RNA, 23 nt, Pseudomonas putida KT2440
gucgaaaccgaaaccacugcugu

SEQ ID NO: 1611098 - RNA, 20 nt, Pseudomonas putida KT2440
guccuuguaagagcggccuu

SEQ ID NO: 1611099 - RNA, 13 nt, Pseudomonas putida KT2440
guccuuggccaau

SEQ ID NO: 1611100 - RNA, 17 nt, Pseudomonas putida KT2440
guccuuggcccagccau

SEQ ID NO: 1611101 - RNA, 23 nt, Pseudomonas putida KT2440
guccuucggagguagccaccuga

SEQ ID NO: 1611102 - RNA, 15 nt, Pseudomonas putida KT2440
guccuugcagggcac

SEQ ID NO: 1611103 - RNA, 16 nt, Pseudomonas putida KT2440
guccuugcagggcacc

SEQ ID NO: 1611104 - RNA, 13 nt, Pseudomonas putida KT2440
guccuugcacucc

SEQ ID NO: 1611105 - RNA, 13 nt, Pseudomonas putida KT2440
guccugcugcagg

SEQ ID NO: 1611106 - RNA, 17 nt, Pseudomonas putida KT2440
guccuggacccgcagca

SEQ ID NO: 1611107 - RNA, 16 nt, Pseudomonas putida KT2440
guccugcaccacaugc

SEQ ID NO: 1611108 - RNA, 16 nt, Pseudomonas putida KT2440
gucgauccgggugcug

SEQ ID NO: 1611109 - RNA, 15 nt, Pseudomonas putida KT2440
gucgaucagcggcuc

SEQ ID NO: 1611110 - RNA, 20 nt, Pseudomonas putida KT2440
gucgaucagcuugugaaccc

SEQ ID NO: 1611111 - RNA, 13 nt, Pseudomonas putida KT2440
gucgagccaggcg

SEQ ID NO: 1611112 - RNA, 15 nt, Pseudomonas putida KT2440
gucgagcaucugcug

SEQ ID NO: 1611113 - RNA, 19 nt, Pseudomonas putida KT2440
gucgagcagggugccuuca

SEQ ID NO: 1611114 - RNA, 17 nt, Pseudomonas putida KT2440
gucgagccggguccacc

SEQ ID NO: 1611115 - RNA, 16 nt, Pseudomonas putida KT2440
guccgguaacuggccc

SEQ ID NO: 1611116 - RNA, 14 nt, Pseudomonas putida KT2440
guccgggucgccgu

SEQ ID NO: 1611117 - RNA, 18 nt, Pseudomonas putida KT2440
guccgggcccaugccacg

SEQ ID NO: 1611118 - RNA, 20 nt, Pseudomonas putida KT2440
guccucccaguacaugaucg

SEQ ID NO: 1611119 - RNA, 16 nt, Pseudomonas putida KT2440
guccugcgccaggcau

SEQ ID NO: 1611120 - RNA, 16 nt, Pseudomonas putida KT2440
guccugcgcgcuugaa

SEQ ID NO: 1611121 - RNA, 21 nt, Pseudomonas putida KT2440
guccugcaacugggcaauguu

SEQ ID NO: 1611122 - RNA, 14 nt, Pseudomonas putida KT2440
guccugcaaaggcc

SEQ ID NO: 1611123 - RNA, 15 nt, Pseudomonas putida KT2440
guccugcaaaggccc

SEQ ID NO: 1611124 - RNA, 14 nt, Pseudomonas putida KT2440
guccggccagcaac

SEQ ID NO: 1611125 - RNA, 23 nt, Pseudomonas putida KT2440
gucccggcccagccgcgacugga

SEQ ID NO: 1611126 - RNA, 16 nt, Pseudomonas putida KT2440
gucccggcacaaccga

SEQ ID NO: 1611127 - RNA, 22 nt, Pseudomonas putida KT2440
gucccggcacaaccgaacccgc

SEQ ID NO: 1611128 - RNA, 23 nt, Pseudomonas putida KT2440
gucccgccauauucgcggcggcc

SEQ ID NO: 1611129 - RNA, 15 nt, Pseudomonas putida KT2440
gucccgcccugagcc

SEQ ID NO: 1611130 - RNA, 17 nt, Pseudomonas putida KT2440
gucccgcugccguagca

SEQ ID NO: 1611131 - RNA, 18 nt, Pseudomonas putida KT2440
gucccgaaagggccgcaa

SEQ ID NO: 1611132 - RNA, 22 nt, Pseudomonas putida KT2440
gucccgaaagggccgcaaagcg

SEQ ID NO: 1611133 - RNA, 12 nt, Pseudomonas putida KT2440
gucaccgcccag

SEQ ID NO: 1611134 - RNA, 17 nt, Pseudomonas putida KT2440
gucaccgccccagcgcg

SEQ ID NO: 1611135 - RNA, 20 nt, Pseudomonas putida KT2440
gucacgcccaucaggaacag

SEQ ID NO: 1611136 - RNA, 14 nt, Pseudomonas putida KT2440
gucacgcucggcca

SEQ ID NO: 1611137 - RNA, 14 nt, Pseudomonas putida KT2440
gucacggcugaaga

SEQ ID NO: 1611138 - RNA, 18 nt, Pseudomonas putida KT2440
gucacggcugaagaagcu

SEQ ID NO: 1611139 - RNA, 17 nt, Pseudomonas putida KT2440
gucacccguggcagccc

SEQ ID NO: 1611140 - RNA, 19 nt, Pseudomonas putida KT2440
gucacccguggcagccccc

SEQ ID NO: 1611141 - RNA, 22 nt, Pseudomonas putida KT2440
gucaaucuaaaaucaucggcaa

SEQ ID NO: 1611142 - RNA, 16 nt, Pseudomonas putida KT2440
gucaauuggagcggcc

SEQ ID NO: 1611143 - RNA, 19 nt, Pseudomonas putida KT2440
ggugaacggcggguggaaa

SEQ ID NO: 1611144 - RNA, 18 nt, Pseudomonas putida KT2440
ggugaacccgcuccugca

SEQ ID NO: 1611145 - RNA, 21 nt, Pseudomonas putida KT2440
ggugaacccgcuccugcaggg

SEQ ID NO: 1611146 - RNA, 14 nt, Pseudomonas putida KT2440
ggugaagcccugcu

SEQ ID NO: 1611147 - RNA, 16 nt, Pseudomonas putida KT2440
ggugaaggcaggucag

SEQ ID NO: 1611148 - RNA, 22 nt, Pseudomonas putida KT2440
gucaacucaggcugagcagacc

SEQ ID NO: 1611149 - RNA, 21 nt, Pseudomonas putida KT2440
gucaagcuggcgcaaucuugc

SEQ ID NO: 1611150 - RNA, 20 nt, Pseudomonas putida KT2440
gucaaggccagcgccugcug

SEQ ID NO: 1611151 - RNA, 21 nt, Pseudomonas putida KT2440
gucagccaccaccagcuccac

SEQ ID NO: 1611152 - RNA, 16 nt, Pseudomonas putida KT2440
gucagcaguggcucca

SEQ ID NO: 1611153 - RNA, 20 nt, Pseudomonas putida KT2440
gucagccagugcugccugcu

SEQ ID NO: 1611154 - RNA, 15 nt, Pseudomonas putida KT2440
gucagcccauccaga

SEQ ID NO: 1611155 - RNA, 20 nt, Pseudomonas putida KT2440
gucagcagcuucagccaggg

SEQ ID NO: 1611156 - RNA, 16 nt, Pseudomonas putida KT2440
gucacugagccaggcc

SEQ ID NO: 1611157 - RNA, 18 nt, Pseudomonas putida KT2440
gucacugcagaucaccag

SEQ ID NO: 1611158 - RNA, 19 nt, Pseudomonas putida KT2440
gucacggguauagccaugc

SEQ ID NO: 1611159 - RNA, 16 nt, Pseudomonas putida KT2440
gucacgugccuucacc

SEQ ID NO: 1611160 - RNA, 20 nt, Pseudomonas putida KT2440
gucacguuguagcccaccac

SEQ ID NO: 1611161 - RNA, 15 nt, Pseudomonas putida KT2440
gucaggcucagcagg

SEQ ID NO: 1611162 - RNA, 20 nt, Pseudomonas putida KT2440
gucagguagcucgacgccgu

SEQ ID NO: 1611163 - RNA, 14 nt, Pseudomonas putida KT2440
gucagggucuuccg

SEQ ID NO: 1611164 - RNA, 14 nt, Pseudomonas putida KT2440
gucagggcugcaag

SEQ ID NO: 1611165 - RNA, 22 nt, Pseudomonas putida KT2440
gucagcgaauaguagaagcaga

SEQ ID NO: 1611166 - RNA, 21 nt, Pseudomonas putida KT2440
gucagccugccauaccugcuu

SEQ ID NO: 1611167 - RNA, 16 nt, Pseudomonas putida KT2440
gucagcgacugccaau

SEQ ID NO: 1611168 - RNA, 20 nt, Pseudomonas putida KT2440
gucagccgcggugaagacca

SEQ ID NO: 1611169 - RNA, 12 nt, Pseudomonas putida KT2440
gucagccugcca

SEQ ID NO: 1611170 - RNA, 16 nt, Pseudomonas putida KT2440
gucagccguugaccag

SEQ ID NO: 1611171 - RNA, 19 nt, Pseudomonas putida KT2440
gucaucgacuucaaugccc

SEQ ID NO: 1611172 - RNA, 18 nt, Pseudomonas putida KT2440
gucaucgauccccaguuc

SEQ ID NO: 1611173 - RNA, 14 nt, Pseudomonas putida KT2440
gucaucgaacaccu

SEQ ID NO: 1611174 - RNA, 17 nt, Pseudomonas putida KT2440
gucaucgaacaccucuc

SEQ ID NO: 1611175 - RNA, 22 nt, Pseudomonas putida KT2440
gucaucgaagaucagcucaugg

SEQ ID NO: 1611176 - RNA, 17 nt, Pseudomonas putida KT2440
gucauccggcgcggccu

SEQ ID NO: 1611177 - RNA, 19 nt, Pseudomonas putida KT2440
gucauccggcgcggccugc

SEQ ID NO: 1611178 - RNA, 13 nt, Pseudomonas putida KT2440
gucauccucaggg

SEQ ID NO: 1611179 - RNA, 23 nt, Pseudomonas putida KT2440
gucauccugcgcggccacuacca

SEQ ID NO: 1611180 - RNA, 21 nt, Pseudomonas putida KT2440
gucauccaggcuggccagcaa

SEQ ID NO: 1611181 - RNA, 23 nt, Pseudomonas putida KT2440
gucauccaggcuggccagcaagu

SEQ ID NO: 1611182 - RNA, 13 nt, Pseudomonas putida KT2440
gucaucaucagca

SEQ ID NO: 1611183 - RNA, 15 nt, Pseudomonas putida KT2440
gucauccgccaggcu

SEQ ID NO: 1611184 - RNA, 21 nt, Pseudomonas putida KT2440
gucauccgccaggcucuccag

SEQ ID NO: 1611185 - RNA, 20 nt, Pseudomonas putida KT2440
gucauccacaucacugcugu

SEQ ID NO: 1611186 - RNA, 21 nt, Pseudomonas putida KT2440
gucaggucgaucccgccgagc

SEQ ID NO: 1611187 - RNA, 20 nt, Pseudomonas putida KT2440
gucaggugcaucgucacauc

SEQ ID NO: 1611188 - RNA, 12 nt, Pseudomonas putida KT2440
gucagguggcug

SEQ ID NO: 1611189 - RNA, 22 nt, Pseudomonas putida KT2440
gucaucacccgggaacagcagc

SEQ ID NO: 1611190 - RNA, 23 nt, Pseudomonas putida KT2440
gucaucacccgggaacagcagca

SEQ ID NO: 1611191 - RNA, 13 nt, Pseudomonas putida KT2440
gucaucaccaccc

SEQ ID NO: 1611192 - RNA, 20 nt, Pseudomonas putida KT2440
gucaucgggaucagcacgcc

SEQ ID NO: 1611193 - RNA, 22 nt, Pseudomonas putida KT2440
gucaugggaccgcuguuaccag

SEQ ID NO: 1611194 - RNA, 14 nt, Pseudomonas putida KT2440
gucauggcgcgcca

SEQ ID NO: 1611195 - RNA, 13 nt, Pseudomonas putida KT2440
guccaccgcgcaa

SEQ ID NO: 1611196 - RNA, 17 nt, Pseudomonas putida KT2440
guccagcgcggccacgc

SEQ ID NO: 1611197 - RNA, 14 nt, Pseudomonas putida KT2440
guccaccagcaggc

SEQ ID NO: 1611198 - RNA, 22 nt, Pseudomonas putida KT2440
guccaauagccauuccggcugc

SEQ ID NO: 1611199 - RNA, 20 nt, Pseudomonas putida KT2440
guccagcucgcgcagggcau

SEQ ID NO: 1611200 - RNA, 17 nt, Pseudomonas putida KT2440
guccagcguucggccag

SEQ ID NO: 1611201 - RNA, 20 nt, Pseudomonas putida KT2440
guccagcguucggccagcac

SEQ ID NO: 1611202 - RNA, 13 nt, Pseudomonas putida KT2440
guccaggccagcu

SEQ ID NO: 1611203 - RNA, 24 nt, Pseudomonas putida KT2440
guccaggcccgccagagcauggcc

SEQ ID NO: 1611204 - RNA, 12 nt, Pseudomonas putida KT2440
guccaucugcuu

SEQ ID NO: 1611205 - RNA, 15 nt, Pseudomonas putida KT2440
guccaucuugcugcu

SEQ ID NO: 1611206 - RNA, 19 nt, Pseudomonas putida KT2440
guccaucuugcugcucugc

SEQ ID NO: 1611207 - RNA, 14 nt, Pseudomonas putida KT2440
uacgccgccgaggc

SEQ ID NO: 1611208 - RNA, 20 nt, Pseudomonas putida KT2440
uacgccggcgcacgcaugcg

SEQ ID NO: 1611209 - RNA, 19 nt, Pseudomonas putida KT2440
uacgccgucuucccaucca

SEQ ID NO: 1611210 - RNA, 18 nt, Pseudomonas putida KT2440
uacgccgcugucauccug

SEQ ID NO: 1611211 - RNA, 19 nt, Pseudomonas putida KT2440
uacgccggccaaggucagc

SEQ ID NO: 1611212 - RNA, 23 nt, Pseudomonas putida KT2440
uacgccggccaaggucagcaagc

SEQ ID NO: 1611213 - RNA, 22 nt, Pseudomonas putida KT2440
uacgccugaaccaccgggaucu

SEQ ID NO: 1611214 - RNA, 13 nt, Pseudomonas putida KT2440
uacgcccauccaa

SEQ ID NO: 1611215 - RNA, 14 nt, Pseudomonas putida KT2440
uacgcacauagccc

SEQ ID NO: 1611216 - RNA, 16 nt, Pseudomonas putida KT2440
uacgcaccgcuaccau

SEQ ID NO: 1611217 - RNA, 16 nt, Pseudomonas putida KT2440
uacgcaucagcgcagc

SEQ ID NO: 1611218 - RNA, 19 nt, Pseudomonas putida KT2440
uacgcacugggugcacagg

SEQ ID NO: 1611219 - RNA, 21 nt, Pseudomonas putida KT2440
uacgcauggucacguagaaca

SEQ ID NO: 1611220 - RNA, 18 nt, Pseudomonas putida KT2440
uaccguagcggucaugca

SEQ ID NO: 1611221 - RNA, 21 nt, Pseudomonas putida KT2440
uacgcgaggcauccacacccu

SEQ ID NO: 1611222 - RNA, 21 nt, Pseudomonas putida KT2440
uacgcgcaggcagcucgaugu

SEQ ID NO: 1611223 - RNA, 15 nt, Pseudomonas putida KT2440
uacgcgccagucaga

SEQ ID NO: 1611224 - RNA, 22 nt, Pseudomonas putida KT2440
uacgcgccagucagaagcagcu

SEQ ID NO: 1611225 - RNA, 19 nt, Pseudomonas putida KT2440
uacgcgccaucaaaugggu

SEQ ID NO: 1611226 - RNA, 14 nt, Pseudomonas putida KT2440
uacggccaucagca

SEQ ID NO: 1611227 - RNA, 14 nt, Pseudomonas putida KT2440
uacggcugauggug

SEQ ID NO: 1611228 - RNA, 23 nt, Pseudomonas putida KT2440
uacggcuugauauccagcaccgg

SEQ ID NO: 1611229 - RNA, 23 nt, Pseudomonas putida KT2440
uacgucggggaauggcccagcca

SEQ ID NO: 1611230 - RNA, 13 nt, Pseudomonas putida KT2440
uacucggccaggu

SEQ ID NO: 1611231 - RNA, 18 nt, Pseudomonas putida KT2440
uacucgcccgccagguag

SEQ ID NO: 1611232 - RNA, 17 nt, Pseudomonas putida KT2440
uacuagauggcugaaau

SEQ ID NO: 1611233 - RNA, 16 nt, Pseudomonas putida KT2440
uacuugcugcagggca

SEQ ID NO: 1611234 - RNA, 17 nt, Pseudomonas putida KT2440
uacugcugggucagcac

SEQ ID NO: 1611235 - RNA, 18 nt, Pseudomonas putida KT2440
uacuggaagagcaggaag

SEQ ID NO: 1611236 - RNA, 19 nt, Pseudomonas putida KT2440
uacuggaagagcaggaaga

SEQ ID NO: 1611237 - RNA, 20 nt, Pseudomonas putida KT2440
uacuggaagagcaggaagau

SEQ ID NO: 1611238 - RNA, 16 nt, Pseudomonas putida KT2440
uacugcgucuuguagu

SEQ ID NO: 1611239 - RNA, 14 nt, Pseudomonas putida KT2440
uacuggccauccag

SEQ ID NO: 1611240 - RNA, 15 nt, Pseudomonas putida KT2440
uacuggccauccagu

SEQ ID NO: 1611241 - RNA, 12 nt, Pseudomonas putida KT2440
uacuggccgcug

SEQ ID NO: 1611242 - RNA, 23 nt, Pseudomonas putida KT2440
uacuggccgcugaaccucaccgc

SEQ ID NO: 1611243 - RNA, 22 nt, Pseudomonas putida KT2440
uaccggauagcgccgaucagcu

SEQ ID NO: 1611244 - RNA, 14 nt, Pseudomonas putida KT2440
uaccggauugggaa

SEQ ID NO: 1611245 - RNA, 18 nt, Pseudomonas putida KT2440
uaccggauugggaaaccg

SEQ ID NO: 1611246 - RNA, 14 nt, Pseudomonas putida KT2440
uaccgcaucccaau

SEQ ID NO: 1611247 - RNA, 23 nt, Pseudomonas putida KT2440
uaccgcaucccaauguggauagu

SEQ ID NO: 1611248 - RNA, 20 nt, Pseudomonas putida KT2440
uaccgcauucuuggccagga

SEQ ID NO: 1611249 - RNA, 16 nt, Pseudomonas putida KT2440
uaccgcaacaccugcc

SEQ ID NO: 1611250 - RNA, 21 nt, Pseudomonas putida KT2440
uacccuguacccgcuggcuga

SEQ ID NO: 1611251 - RNA, 15 nt, Pseudomonas putida KT2440
uacccugcgggagcg

SEQ ID NO: 1611252 - RNA, 22 nt, Pseudomonas putida KT2440
uaccccguugcgcagcagcagg

SEQ ID NO: 1611253 - RNA, 23 nt, Pseudomonas putida KT2440
uaccccuccugaccaacuuuuca

SEQ ID NO: 1611254 - RNA, 20 nt, Pseudomonas putida KT2440
uaccccucgacgccuuggcg

SEQ ID NO: 1611255 - RNA, 23 nt, Pseudomonas putida KT2440
uaccccucgacgccuuggcgcag

SEQ ID NO: 1611256 - RNA, 21 nt, Pseudomonas putida KT2440
uaccccugcgccuguuuucca

SEQ ID NO: 1611257 - RNA, 22 nt, Pseudomonas putida KT2440
uaccccuuugcugccugugccg

SEQ ID NO: 1611258 - RNA, 15 nt, Pseudomonas putida KT2440
uacccgcauaaccac

SEQ ID NO: 1611259 - RNA, 19 nt, Pseudomonas putida KT2440
uaccaggucgccagcacca

SEQ ID NO: 1611260 - RNA, 21 nt, Pseudomonas putida KT2440
uaccaggcccgcuauccucga

SEQ ID NO: 1611261 - RNA, 17 nt, Pseudomonas putida KT2440
uaccauccaucaccaug

SEQ ID NO: 1611262 - RNA, 19 nt, Pseudomonas putida KT2440
uaccauccaucaccauggc

SEQ ID NO: 1611263 - RNA, 13 nt, Pseudomonas putida KT2440
uaccaugaaaaac

SEQ ID NO: 1611264 - RNA, 23 nt, Pseudomonas putida KT2440
uaccaugaaaaacaacaaccaau

SEQ ID NO: 1611265 - RNA, 21 nt, Pseudomonas putida KT2440
uacccaggcgcgccugcaccu

SEQ ID NO: 1611266 - RNA, 20 nt, Pseudomonas putida KT2440
uacccaggugaugcaggcaa

SEQ ID NO: 1611267 - RNA, 18 nt, Pseudomonas putida KT2440
uaccccacaaccccugca

SEQ ID NO: 1611268 - RNA, 23 nt, Pseudomonas putida KT2440
uacccaccagauucgccaaggcc

SEQ ID NO: 1611269 - RNA, 18 nt, Pseudomonas putida KT2440
uacccaacuccagcgcgg

SEQ ID NO: 1611270 - RNA, 12 nt, Pseudomonas putida KT2440
uacccaagcaca

SEQ ID NO: 1611271 - RNA, 14 nt, Pseudomonas putida KT2440
uacccaauaaaaac

SEQ ID NO: 1611272 - RNA, 16 nt, Pseudomonas putida KT2440
uacccaauaaaaacaa

SEQ ID NO: 1611273 - RNA, 18 nt, Pseudomonas putida KT2440
uacccaauaaaaacaaca

SEQ ID NO: 1611274 - RNA, 23 nt, Pseudomonas putida KT2440
uacccacgccauguaccgggcgg

SEQ ID NO: 1611275 - RNA, 16 nt, Pseudomonas putida KT2440
uacccaaacucuugag

SEQ ID NO: 1611276 - RNA, 12 nt, Pseudomonas putida KT2440
uaccagcagcac

SEQ ID NO: 1611277 - RNA, 23 nt, Pseudomonas putida KT2440
uaccaccgcauccgcaccccaag

SEQ ID NO: 1611278 - RNA, 13 nt, Pseudomonas putida KT2440
uaccagacgcagg

SEQ ID NO: 1611279 - RNA, 16 nt, Pseudomonas putida KT2440
uaccagacgcaggcaa

SEQ ID NO: 1611280 - RNA, 22 nt, Pseudomonas putida KT2440
uaccacacgaauggguggcagc

SEQ ID NO: 1611281 - RNA, 20 nt, Pseudomonas putida KT2440
uacauccagcuccagcacca

SEQ ID NO: 1611282 - RNA, 22 nt, Pseudomonas putida KT2440
uacauagcaggaucuagcccaa

SEQ ID NO: 1611283 - RNA, 16 nt, Pseudomonas putida KT2440
uacaagugguuaaccu

SEQ ID NO: 1611284 - RNA, 19 nt, Pseudomonas putida KT2440
uacagguagugcgcggccg

SEQ ID NO: 1611285 - RNA, 22 nt, Pseudomonas putida KT2440
uacagguucuugcggugcaugc

SEQ ID NO: 1611286 - RNA, 15 nt, Pseudomonas putida KT2440
uacagguuguaaaca

SEQ ID NO: 1611287 - RNA, 16 nt, Pseudomonas putida KT2440
uacaacaacaaaaaaa

SEQ ID NO: 1611288 - RNA, 16 nt, Pseudomonas putida KT2440
uacaacugccacccuc

SEQ ID NO: 1611289 - RNA, 17 nt, Pseudomonas putida KT2440
uacaacugccacccucc

SEQ ID NO: 1611290 - RNA, 14 nt, Pseudomonas putida KT2440
uacaagccggcgcu

SEQ ID NO: 1611291 - RNA, 20 nt, Pseudomonas putida KT2440
uaaucgccaggcccagcccc

SEQ ID NO: 1611292 - RNA, 13 nt, Pseudomonas putida KT2440
uaauccaucacca

SEQ ID NO: 1611293 - RNA, 23 nt, Pseudomonas putida KT2440
uaauccaucaccacaaaaccuuc

SEQ ID NO: 1611294 - RNA, 13 nt, Pseudomonas putida KT2440
uaauccagcugcu

SEQ ID NO: 1611295 - RNA, 19 nt, Pseudomonas putida KT2440
uaaucaggcuguccacacc

SEQ ID NO: 1611296 - RNA, 16 nt, Pseudomonas putida KT2440
uaauacugcuuccagg

SEQ ID NO: 1611297 - RNA, 17 nt, Pseudomonas putida KT2440
uaacguggacagcagcu

SEQ ID NO: 1611298 - RNA, 20 nt, Pseudomonas putida KT2440
uaacuggcccacccggcuga

SEQ ID NO: 1611299 - RNA, 18 nt, Pseudomonas putida KT2440
uaacugcgcaccagaggg

SEQ ID NO: 1611300 - RNA, 22 nt, Pseudomonas putida KT2440
aaauccccauguaggagauucu

SEQ ID NO: 1611301 - RNA, 16 nt, Pseudomonas putida KT2440
aaauccauccaguuca

SEQ ID NO: 1611302 - RNA, 15 nt, Pseudomonas putida KT2440
uaagaagcaaccgcu

SEQ ID NO: 1611303 - RNA, 19 nt, Pseudomonas putida KT2440
uaagcgccaccaccgcuga

SEQ ID NO: 1611304 - RNA, 16 nt, Pseudomonas putida KT2440
uaagcugucagcaccu

SEQ ID NO: 1611305 - RNA, 13 nt, Pseudomonas putida KT2440
uaaggcagcagcu

SEQ ID NO: 1611306 - RNA, 19 nt, Pseudomonas putida KT2440
uaaggaucaugaacgagga

SEQ ID NO: 1611307 - RNA, 24 nt, Pseudomonas putida KT2440
uaaggaucaugaacgaggacugca

SEQ ID NO: 1611308 - RNA, 19 nt, Pseudomonas putida KT2440
uaaggaucgcgcagcagcu

SEQ ID NO: 1611309 - RNA, 22 nt, Pseudomonas putida KT2440
uaagccgcaggccaaugcagcu

SEQ ID NO: 1611310 - RNA, 21 nt, Pseudomonas putida KT2440
uaagccucgagcgcuuucagc

SEQ ID NO: 1611311 - RNA, 20 nt, Pseudomonas putida KT2440
uaagcgacacccuggucaug

SEQ ID NO: 1611312 - RNA, 14 nt, Pseudomonas putida KT2440
uaagcccgcuccua

SEQ ID NO: 1611313 - RNA, 14 nt, Pseudomonas putida KT2440
uaauaaaaaaagag

SEQ ID NO: 1611314 - RNA, 22 nt, Pseudomonas putida KT2440
uaacaaguucaaggucaucgcu

SEQ ID NO: 1611315 - RNA, 11 nt, Pseudomonas putida KT2440
uaacaaggcac

SEQ ID NO: 1611316 - RNA, 18 nt, Pseudomonas putida KT2440
uaacaccccccagcagcg

SEQ ID NO: 1611317 - RNA, 13 nt, Pseudomonas putida KT2440
uaacaagaacaac

SEQ ID NO: 1611318 - RNA, 22 nt, Pseudomonas putida KT2440
uaacgcccuucauacagcgccu

SEQ ID NO: 1611319 - RNA, 17 nt, Pseudomonas putida KT2440
uaacgcgccgcugccug

SEQ ID NO: 1611320 - RNA, 18 nt, Pseudomonas putida KT2440
uaacgcgccgcugccugg

SEQ ID NO: 1611321 - RNA, 15 nt, Pseudomonas putida KT2440
uaacgcuuggccaga

SEQ ID NO: 1611322 - RNA, 17 nt, Pseudomonas putida KT2440
uaacgggcaaggcuggc

SEQ ID NO: 1611323 - RNA, 18 nt, Pseudomonas putida KT2440
uaacggcuggcgcaugca

SEQ ID NO: 1611324 - RNA, 19 nt, Pseudomonas putida KT2440
uaaccccccacccagcuca

SEQ ID NO: 1611325 - RNA, 20 nt, Pseudomonas putida KT2440
uaacccugguacagauggca

SEQ ID NO: 1611326 - RNA, 19 nt, Pseudomonas putida KT2440
uaaccagucgauaaaccgu

SEQ ID NO: 1611327 - RNA, 17 nt, Pseudomonas putida KT2440
uaacacuugccgcccuc

SEQ ID NO: 1611328 - RNA, 14 nt, Pseudomonas putida KT2440
uaaagccagcagcc

SEQ ID NO: 1611329 - RNA, 20 nt, Pseudomonas putida KT2440
guuuugggcacgaugaaaua

SEQ ID NO: 1611330 - RNA, 13 nt, Pseudomonas putida KT2440
uaaaccagcagcg

SEQ ID NO: 1611331 - RNA, 22 nt, Pseudomonas putida KT2440
uaaacugugggagcaggcaugc

SEQ ID NO: 1611332 - RNA, 16 nt, Pseudomonas putida KT2440
gcugagcccaaccucu

SEQ ID NO: 1611333 - RNA, 15 nt, Pseudomonas putida KT2440
gcugagcgacagcau

SEQ ID NO: 1611334 - RNA, 11 nt, Pseudomonas putida KT2440
gcugagcagcg

SEQ ID NO: 1611335 - RNA, 16 nt, Pseudomonas putida KT2440
gcugauccgccuggcc

SEQ ID NO: 1611336 - RNA, 17 nt, Pseudomonas putida KT2440
gcugaucaagcccgcuc

SEQ ID NO: 1611337 - RNA, 17 nt, Pseudomonas putida KT2440
gcugauucagcacaccg

SEQ ID NO: 1611338 - RNA, 12 nt, Pseudomonas putida KT2440
gcugcagggcac

SEQ ID NO: 1611339 - RNA, 16 nt, Pseudomonas putida KT2440
gcugcaggcucugaau

SEQ ID NO: 1611340 - RNA, 22 nt, Pseudomonas putida KT2440
gcugcaggcucugaaugucagc

SEQ ID NO: 1611341 - RNA, 18 nt, Pseudomonas putida KT2440
gcugcagggcccagccac

SEQ ID NO: 1611342 - RNA, 20 nt, Pseudomonas putida KT2440
gcugcagggcccagccaccg

SEQ ID NO: 1611343 - RNA, 20 nt, Pseudomonas putida KT2440
gcugccacccacaggcacga

SEQ ID NO: 1611344 - RNA, 21 nt, Pseudomonas putida KT2440
gcugcacuucgauacccagcc

SEQ ID NO: 1611345 - RNA, 14 nt, Pseudomonas putida KT2440
gcugcagcacugcc

SEQ ID NO: 1611346 - RNA, 18 nt, Pseudomonas putida KT2440
gcugcagcagcuuccugu

SEQ ID NO: 1611347 - RNA, 12 nt, Pseudomonas putida KT2440
gcugcagcaggc

SEQ ID NO: 1611348 - RNA, 15 nt, Pseudomonas putida KT2440
gcugcagcaggcugg

SEQ ID NO: 1611349 - RNA, 16 nt, Pseudomonas putida KT2440
gcugcagcaggcuggc

SEQ ID NO: 1611350 - RNA, 15 nt, Pseudomonas putida KT2440
gcugcagcauggcgu

SEQ ID NO: 1611351 - RNA, 19 nt, Pseudomonas putida KT2440
gcugcaaucgagccgaaca

SEQ ID NO: 1611352 - RNA, 23 nt, Pseudomonas putida KT2440
gcugcaaucgagccgaacagcag

SEQ ID NO: 1611353 - RNA, 20 nt, Pseudomonas putida KT2440
gcugcaagguguuggucagg

SEQ ID NO: 1611354 - RNA, 16 nt, Pseudomonas putida KT2440
gcugcaaagcagaccc

SEQ ID NO: 1611355 - RNA, 18 nt, Pseudomonas putida KT2440
gcugcaaagcagacccag

SEQ ID NO: 1611356 - RNA, 19 nt, Pseudomonas putida KT2440
gcugcaaagcagccccagg

SEQ ID NO: 1611357 - RNA, 20 nt, Pseudomonas putida KT2440
gcugcaacacgucauacagc

SEQ ID NO: 1611358 - RNA, 18 nt, Pseudomonas putida KT2440
gcugcaacagaaaaugcc

SEQ ID NO: 1611359 - RNA, 14 nt, Pseudomonas putida KT2440
gcugcaacagcggc

SEQ ID NO: 1611360 - RNA, 18 nt, Pseudomonas putida KT2440
gcugcaacagcucaucca

SEQ ID NO: 1611361 - RNA, 20 nt, Pseudomonas putida KT2440
gcugcaacagcucauccagg

SEQ ID NO: 1611362 - RNA, 22 nt, Pseudomonas putida KT2440
gcugcaacagcucauccaggcu

SEQ ID NO: 1611363 - RNA, 17 nt, Pseudomonas putida KT2440
gcugcaacagcuccagc

SEQ ID NO: 1611364 - RNA, 18 nt, Pseudomonas putida KT2440
gcugaccucgacccgccc

SEQ ID NO: 1611365 - RNA, 19 nt, Pseudomonas putida KT2440
gcugaccgggucgacgcgc

SEQ ID NO: 1611366 - RNA, 15 nt, Pseudomonas putida KT2440
gcugacaccgcugcc

SEQ ID NO: 1611367 - RNA, 20 nt, Pseudomonas putida KT2440
gcugaaugaaaaagccccgc

SEQ ID NO: 1611368 - RNA, 19 nt, Pseudomonas putida KT2440
gcugaagaagcuaccccac

SEQ ID NO: 1611369 - RNA, 17 nt, Pseudomonas putida KT2440
gcugaagcucuccagca

SEQ ID NO: 1611370 - RNA, 19 nt, Pseudomonas putida KT2440
gcugaagcucuccagcagg

SEQ ID NO: 1611371 - RNA, 20 nt, Pseudomonas putida KT2440
gcugaagcucuccagcaggu

SEQ ID NO: 1611372 - RNA, 13 nt, Pseudomonas putida KT2440
gcucuccuuuuuu

SEQ ID NO: 1611373 - RNA, 19 nt, Pseudomonas putida KT2440
gcucucgucgguuuccucg

SEQ ID NO: 1611374 - RNA, 21 nt, Pseudomonas putida KT2440
gcucucgucgguuuccucgac

SEQ ID NO: 1611375 - RNA, 17 nt, Pseudomonas putida KT2440
gcugaacacgcccgcgu

SEQ ID NO: 1611376 - RNA, 22 nt, Pseudomonas putida KT2440
gcugaacacgcucaugaacagc

SEQ ID NO: 1611377 - RNA, 14 nt, Pseudomonas putida KT2440
gcugaacagccggc

SEQ ID NO: 1611378 - RNA, 16 nt, Pseudomonas putida KT2440
gcugaacagccggccc

SEQ ID NO: 1611379 - RNA, 20 nt, Pseudomonas putida KT2440
gcugcugguacaugccgccg

SEQ ID NO: 1611380 - RNA, 21 nt, Pseudomonas putida KT2440
gcugcugguacaugccgccga

SEQ ID NO: 1611381 - RNA, 16 nt, Pseudomonas putida KT2440
gcugcugguccucgac

SEQ ID NO: 1611382 - RNA, 16 nt, Pseudomonas putida KT2440
gcugcugcgcagcccu

SEQ ID NO: 1611383 - RNA, 14 nt, Pseudomonas putida KT2440
gcugcugccgcccc

SEQ ID NO: 1611384 - RNA, 16 nt, Pseudomonas putida KT2440
gcugcuggcacgccuu

SEQ ID NO: 1611385 - RNA, 17 nt, Pseudomonas putida KT2440
gcugcuggccgccagac

SEQ ID NO: 1611386 - RNA, 21 nt, Pseudomonas putida KT2440
gcugcugcucuuucggcagca

SEQ ID NO: 1611387 - RNA, 14 nt, Pseudomonas putida KT2440
gcuggaucuugcug

SEQ ID NO: 1611388 - RNA, 15 nt, Pseudomonas putida KT2440
gcuggaugaagcccg

SEQ ID NO: 1611389 - RNA, 13 nt, Pseudomonas putida KT2440
gcuggacagcggc

SEQ ID NO: 1611390 - RNA, 18 nt, Pseudomonas putida KT2440
gcuggacagcggcagcau

SEQ ID NO: 1611391 - RNA, 22 nt, Pseudomonas putida KT2440
gcuggaucagugucugcgccug

SEQ ID NO: 1611392 - RNA, 19 nt, Pseudomonas putida KT2440
gcuggaauuauuggccagc

SEQ ID NO: 1611393 - RNA, 18 nt, Pseudomonas putida KT2440
gcuggacaccucccgcgc

SEQ ID NO: 1611394 - RNA, 22 nt, Pseudomonas putida KT2440
gcuggacaagccaaccaaagga

SEQ ID NO: 1611395 - RNA, 15 nt, Pseudomonas putida KT2440
gcugcgugccugcug

SEQ ID NO: 1611396 - RNA, 18 nt, Pseudomonas putida KT2440
gcugcgugccugcugcuc

SEQ ID NO: 1611397 - RNA, 20 nt, Pseudomonas putida KT2440
gcugcgugccugcugcucgc

SEQ ID NO: 1611398 - RNA, 20 nt, Pseudomonas putida KT2440
gcugcucaccauguuccagu

SEQ ID NO: 1611399 - RNA, 15 nt, Pseudomonas putida KT2440
gcugcgcgccauggc

SEQ ID NO: 1611400 - RNA, 16 nt, Pseudomonas putida KT2440
gcugcgcgccauggcg

SEQ ID NO: 1611401 - RNA, 18 nt, Pseudomonas putida KT2440
gcugcgcgauucggggau

SEQ ID NO: 1611402 - RNA, 18 nt, Pseudomonas putida KT2440
gcugcgcggcagcccuuc

SEQ ID NO: 1611403 - RNA, 21 nt, Pseudomonas putida KT2440
gcugcgccgcucugcccgcgc

SEQ ID NO: 1611404 - RNA, 23 nt, Pseudomonas putida KT2440
gcugcgcgaaguggauauccagc

SEQ ID NO: 1611405 - RNA, 19 nt, Pseudomonas putida KT2440
gcugcgcaaggcauucagc

SEQ ID NO: 1611406 - RNA, 13 nt, Pseudomonas putida KT2440
gcugccagcaggg

SEQ ID NO: 1611407 - RNA, 17 nt, Pseudomonas putida KT2440
gcugccagcagggcagg

SEQ ID NO: 1611408 - RNA, 16 nt, Pseudomonas putida KT2440
gcugccacgcaugccu

SEQ ID NO: 1611409 - RNA, 20 nt, Pseudomonas putida KT2440
gcugccacguuuucgcggcc

SEQ ID NO: 1611410 - RNA, 15 nt, Pseudomonas putida KT2440
gcugccgcgcagccc

SEQ ID NO: 1611411 - RNA, 21 nt, Pseudomonas putida KT2440
gcugccggaacguuuccagca

SEQ ID NO: 1611412 - RNA, 20 nt, Pseudomonas putida KT2440
gcugccggaccugccgcagc

SEQ ID NO: 1611413 - RNA, 13 nt, Pseudomonas putida KT2440
gcugccggccagc

SEQ ID NO: 1611414 - RNA, 16 nt, Pseudomonas putida KT2440
gcugccggccagcgcc

SEQ ID NO: 1611415 - RNA, 22 nt, Pseudomonas putida KT2440
gcugcgaguucaggcgcccugc

SEQ ID NO: 1611416 - RNA, 21 nt, Pseudomonas putida KT2440
gcugcgauagaacuccaccag

SEQ ID NO: 1611417 - RNA, 22 nt, Pseudomonas putida KT2440
gcugcgauagaacuccaccagc

SEQ ID NO: 1611418 - RNA, 18 nt, Pseudomonas putida KT2440
gcugcgaaugggcugcaa

SEQ ID NO: 1611419 - RNA, 18 nt, Pseudomonas putida KT2440
gcugcgaggccccagacc

SEQ ID NO: 1611420 - RNA, 14 nt, Pseudomonas putida KT2440
gcugcgcagguugg

SEQ ID NO: 1611421 - RNA, 23 nt, Pseudomonas putida KT2440
gcugcgcagguuggugcaauugc

SEQ ID NO: 1611422 - RNA, 15 nt, Pseudomonas putida KT2440
gcugcgcaguacagg

SEQ ID NO: 1611423 - RNA, 21 nt, Pseudomonas putida KT2440
gcugcgcaucacccgccccuc

SEQ ID NO: 1611424 - RNA, 14 nt, Pseudomonas putida KT2440
gcugcgccagccgc

SEQ ID NO: 1611425 - RNA, 18 nt, Pseudomonas putida KT2440
gcugccggucggccugca

SEQ ID NO: 1611426 - RNA, 13 nt, Pseudomonas putida KT2440
gcugccgugcagg

SEQ ID NO: 1611427 - RNA, 22 nt, Pseudomonas putida KT2440
gcugccuucccgucgagccggg

SEQ ID NO: 1611428 - RNA, 13 nt, Pseudomonas putida KT2440
gcugccuuccaac

SEQ ID NO: 1611429 - RNA, 12 nt, Pseudomonas putida KT2440
gcugccuugccc

SEQ ID NO: 1611430 - RNA, 17 nt, Pseudomonas putida KT2440
gcugccuugcccagcuc

SEQ ID NO: 1611431 - RNA, 16 nt, Pseudomonas putida KT2440
gcugccuuuggccgcc

SEQ ID NO: 1611432 - RNA, 17 nt, Pseudomonas putida KT2440
gcugccuuuggccgcca

SEQ ID NO: 1611433 - RNA, 19 nt, Pseudomonas putida KT2440
gcucgucgcacucugggcu

SEQ ID NO: 1611434 - RNA, 13 nt, Pseudomonas putida KT2440
gcucgucguccuc

SEQ ID NO: 1611435 - RNA, 17 nt, Pseudomonas putida KT2440
gcucgcuuuccaaaccu

SEQ ID NO: 1611436 - RNA, 20 nt, Pseudomonas putida KT2440
gcucgcuuuccaaaccugcg

SEQ ID NO: 1611437 - RNA, 17 nt, Pseudomonas putida KT2440
gcucgggguuggugcca

SEQ ID NO: 1611438 - RNA, 17 nt, Pseudomonas putida KT2440
gcucgguaucggccagc

SEQ ID NO: 1611439 - RNA, 21 nt, Pseudomonas putida KT2440
gcucgcuccagggcaggcuga

SEQ ID NO: 1611440 - RNA, 14 nt, Pseudomonas putida KT2440
gcucgccgcccagu

SEQ ID NO: 1611441 - RNA, 12 nt, Pseudomonas putida KT2440
gcucgccggccu

SEQ ID NO: 1611442 - RNA, 16 nt, Pseudomonas putida KT2440
gcucgccggccuuggc

SEQ ID NO: 1611443 - RNA, 15 nt, Pseudomonas putida KT2440
gcucgcccagcagcc

SEQ ID NO: 1611444 - RNA, 16 nt, Pseudomonas putida KT2440
gcucgcagccaaugcu

SEQ ID NO: 1611445 - RNA, 17 nt, Pseudomonas putida KT2440
gcucgcacaucuugcug

SEQ ID NO: 1611446 - RNA, 22 nt, Pseudomonas putida KT2440
gcucgaugccuuugcaaagcgc

SEQ ID NO: 1611447 - RNA, 19 nt, Pseudomonas putida KT2440
gcucgaucucacaggcgau

SEQ ID NO: 1611448 - RNA, 15 nt, Pseudomonas putida KT2440
gcucgaucugccugc

SEQ ID NO: 1611449 - RNA, 18 nt, Pseudomonas putida KT2440
gcucgacguuuaccugca

SEQ ID NO: 1611450 - RNA, 19 nt, Pseudomonas putida KT2440
gcucgagcccgccagcagg

SEQ ID NO: 1611451 - RNA, 16 nt, Pseudomonas putida KT2440
gcucgacaaacugcug

SEQ ID NO: 1611452 - RNA, 17 nt, Pseudomonas putida KT2440
gcucgacaaacugcuga

SEQ ID NO: 1611453 - RNA, 15 nt, Pseudomonas putida KT2440
gcucgacaagccgcu

SEQ ID NO: 1611454 - RNA, 15 nt, Pseudomonas putida KT2440
gcucgacccgcguca

SEQ ID NO: 1611455 - RNA, 23 nt, Pseudomonas putida KT2440
gcucgacauccagcgccgccaug

SEQ ID NO: 1611456 - RNA, 16 nt, Pseudomonas putida KT2440
gcuccugguccugcgc

SEQ ID NO: 1611457 - RNA, 21 nt, Pseudomonas putida KT2440
gcuccuucucgaacagcuggc

SEQ ID NO: 1611458 - RNA, 16 nt, Pseudomonas putida KT2440
gcuccuuauccuucag

SEQ ID NO: 1611459 - RNA, 16 nt, Pseudomonas putida KT2440
gcuccugcggucagcc

SEQ ID NO: 1611460 - RNA, 17 nt, Pseudomonas putida KT2440
gcuccugcagguaucac

SEQ ID NO: 1611461 - RNA, 17 nt, Pseudomonas putida KT2440
gcuccugcaugccuucc

SEQ ID NO: 1611462 - RNA, 21 nt, Pseudomonas putida KT2440
gcgguaugggugaugcuggug

SEQ ID NO: 1611463 - RNA, 20 nt, Pseudomonas putida KT2440
gcggucaauuggagcggccu

SEQ ID NO: 1611464 - RNA, 14 nt, Pseudomonas putida KT2440
gcgguagugcaggc

SEQ ID NO: 1611465 - RNA, 15 nt, Pseudomonas putida KT2440
gcgguagugcggccg

SEQ ID NO: 1611466 - RNA, 16 nt, Pseudomonas putida KT2440
gcgguacagcacccag

SEQ ID NO: 1611467 - RNA, 16 nt, Pseudomonas putida KT2440
gcgguauaggccgcaa

SEQ ID NO: 1611468 - RNA, 14 nt, Pseudomonas putida KT2440
gcucauacugcuga

SEQ ID NO: 1611469 - RNA, 20 nt, Pseudomonas putida KT2440
gcucauacugcugacccgga

SEQ ID NO: 1611470 - RNA, 23 nt, Pseudomonas putida KT2440
gcucaucgcggccgaaggcgcug

SEQ ID NO: 1611471 - RNA, 18 nt, Pseudomonas putida KT2440
gcucaucuaccugagccu

SEQ ID NO: 1611472 - RNA, 15 nt, Pseudomonas putida KT2440
gcucaugaacagcgc

SEQ ID NO: 1611473 - RNA, 16 nt, Pseudomonas putida KT2440
gcucaugaacagcgcc

SEQ ID NO: 1611474 - RNA, 14 nt, Pseudomonas putida KT2440
gcuccaaccccagc

SEQ ID NO: 1611475 - RNA, 16 nt, Pseudomonas putida KT2440
gcuccaaccccagcgc

SEQ ID NO: 1611476 - RNA, 17 nt, Pseudomonas putida KT2440
gcuccaaccccagcgca

SEQ ID NO: 1611477 - RNA, 23 nt, Pseudomonas putida KT2440
gcuccaacaaacucgacgccccg

SEQ ID NO: 1611478 - RNA, 18 nt, Pseudomonas putida KT2440
gcuccaacaagucuuccc

SEQ ID NO: 1611479 - RNA, 20 nt, Pseudomonas putida KT2440
gcuccaacaagucuuccccu

SEQ ID NO: 1611480 - RNA, 20 nt, Pseudomonas putida KT2440
gcucaucugcgccagugggu

SEQ ID NO: 1611481 - RNA, 13 nt, Pseudomonas putida KT2440
gcuccaccacagc

SEQ ID NO: 1611482 - RNA, 19 nt, Pseudomonas putida KT2440
gcuccacacucgacgcugc

SEQ ID NO: 1611483 - RNA, 14 nt, Pseudomonas putida KT2440
gcuccagcgcacgc

SEQ ID NO: 1611484 - RNA, 15 nt, Pseudomonas putida KT2440
gcuccagcccagcgc

SEQ ID NO: 1611485 - RNA, 16 nt, Pseudomonas putida KT2440
gcuccagcccagcgcc

SEQ ID NO: 1611486 - RNA, 19 nt, Pseudomonas putida KT2440
gcuccagcccagcgccagu

SEQ ID NO: 1611487 - RNA, 18 nt, Pseudomonas putida KT2440
gcuccagcaccucgcuca

SEQ ID NO: 1611488 - RNA, 20 nt, Pseudomonas putida KT2440
gcuccagcaccucgcucagc

SEQ ID NO: 1611489 - RNA, 16 nt, Pseudomonas putida KT2440
gcuccagcaacugcgc

SEQ ID NO: 1611490 - RNA, 14 nt, Pseudomonas putida KT2440
gcuccagcagcucc

SEQ ID NO: 1611491 - RNA, 17 nt, Pseudomonas putida KT2440
gcuccggcguguccagc

SEQ ID NO: 1611492 - RNA, 20 nt, Pseudomonas putida KT2440
gcuccggcguguccagcagg

SEQ ID NO: 1611493 - RNA, 21 nt, Pseudomonas putida KT2440
gcuccggguacuucucgacca

SEQ ID NO: 1611494 - RNA, 21 nt, Pseudomonas putida KT2440
gcuccggccaaaaguugcuca

SEQ ID NO: 1611495 - RNA, 21 nt, Pseudomonas putida KT2440
gcuccuacaacggcugugccg

SEQ ID NO: 1611496 - RNA, 14 nt, Pseudomonas putida KT2440
gcuccuacaaggua

SEQ ID NO: 1611497 - RNA, 22 nt, Pseudomonas putida KT2440
gcuccuacacaggucauuugca

SEQ ID NO: 1611498 - RNA, 15 nt, Pseudomonas putida KT2440
gcuccuacaggcgac

SEQ ID NO: 1611499 - RNA, 21 nt, Pseudomonas putida KT2440
gcuccuaccacguacacacau

SEQ ID NO: 1611500 - RNA, 22 nt, Pseudomonas putida KT2440
gcuccuacgacgggcugagccc

SEQ ID NO: 1611501 - RNA, 21 nt, Pseudomonas putida KT2440
gcuccuacgggcaaccgcauc

SEQ ID NO: 1611502 - RNA, 23 nt, Pseudomonas putida KT2440
gcuccuacuacggccugugucca

SEQ ID NO: 1611503 - RNA, 19 nt, Pseudomonas putida KT2440
gcuccucggccguaaaguc

SEQ ID NO: 1611504 - RNA, 19 nt, Pseudomonas putida KT2440
gcuccgccaaaccccagca

SEQ ID NO: 1611505 - RNA, 20 nt, Pseudomonas putida KT2440
gcuccgccaaaccccagcaa

SEQ ID NO: 1611506 - RNA, 21 nt, Pseudomonas putida KT2440
gcuccgccaaaccccagcaag

SEQ ID NO: 1611507 - RNA, 19 nt, Pseudomonas putida KT2440
gcuccgacauugaucggcg

SEQ ID NO: 1611508 - RNA, 16 nt, Pseudomonas putida KT2440
gcuccagcucacagca

SEQ ID NO: 1611509 - RNA, 19 nt, Pseudomonas putida KT2440
gcuccaguucauucccggc

SEQ ID NO: 1611510 - RNA, 17 nt, Pseudomonas putida KT2440
gcuccaguugcaagccu

SEQ ID NO: 1611511 - RNA, 20 nt, Pseudomonas putida KT2440
gcuccaguugcaagccuucg

SEQ ID NO: 1611512 - RNA, 20 nt, Pseudomonas putida KT2440
gcucccacaggaaucaccag

SEQ ID NO: 1611513 - RNA, 15 nt, Pseudomonas putida KT2440
gcucccacaggaaug

SEQ ID NO: 1611514 - RNA, 14 nt, Pseudomonas putida KT2440
gcucccacaggggc

SEQ ID NO: 1611515 - RNA, 22 nt, Pseudomonas putida KT2440
gcucccacagguaugugagcug

SEQ ID NO: 1611516 - RNA, 20 nt, Pseudomonas putida KT2440
gcucccacaggugcagcaca

SEQ ID NO: 1611517 - RNA, 12 nt, Pseudomonas putida KT2440
gcuccauccagu

SEQ ID NO: 1611518 - RNA, 15 nt, Pseudomonas putida KT2440
gcuccaugggcaggc

SEQ ID NO: 1611519 - RNA, 15 nt, Pseudomonas putida KT2440
gcuuguuauggcacu

SEQ ID NO: 1611520 - RNA, 14 nt, Pseudomonas putida KT2440
gcuuuccaaaccug

SEQ ID NO: 1611521 - RNA, 17 nt, Pseudomonas putida KT2440
gcuuucaggcgcagcac

SEQ ID NO: 1611522 - RNA, 17 nt, Pseudomonas putida KT2440
gcuuucagcgccgcuuc

SEQ ID NO: 1611523 - RNA, 18 nt, Pseudomonas putida KT2440
gcuuucacuucauccagc

SEQ ID NO: 1611524 - RNA, 19 nt, Pseudomonas putida KT2440
gcuuggucggcgccccuuu

SEQ ID NO: 1611525 - RNA, 18 nt, Pseudomonas putida KT2440
gcuuggucccccacuucu

SEQ ID NO: 1611526 - RNA, 15 nt, Pseudomonas putida KT2440
aaaggcccucagagu

SEQ ID NO: 1611527 - RNA, 23 nt, Pseudomonas putida KT2440
aaaggcgacuccugaacggugaa

SEQ ID NO: 1611528 - RNA, 15 nt, Pseudomonas putida KT2440
gcuuguccagccacu

SEQ ID NO: 1611529 - RNA, 13 nt, Pseudomonas putida KT2440
gcuugucuuccag

SEQ ID NO: 1611530 - RNA, 14 nt, Pseudomonas putida KT2440
gcuugucuuccagc

SEQ ID NO: 1611531 - RNA, 15 nt, Pseudomonas putida KT2440
gcuugucuuccagcu

SEQ ID NO: 1611532 - RNA, 16 nt, Pseudomonas putida KT2440
gcuugucuuccagcug

SEQ ID NO: 1611533 - RNA, 23 nt, Pseudomonas putida KT2440
gcuuguaaagaauucggacugug

SEQ ID NO: 1611534 - RNA, 21 nt, Pseudomonas putida KT2440
gcuugucgagguugcgcucca

SEQ ID NO: 1611535 - RNA, 19 nt, Pseudomonas putida KT2440
gcuuggccagggugcgggc

SEQ ID NO: 1611536 - RNA, 19 nt, Pseudomonas putida KT2440
gcuuggcaccggcagcagc

SEQ ID NO: 1611537 - RNA, 14 nt, Pseudomonas putida KT2440
gcuuggcacgcugg

SEQ ID NO: 1611538 - RNA, 18 nt, Pseudomonas putida KT2440
gcuuggccaccacguagu

SEQ ID NO: 1611539 - RNA, 23 nt, Pseudomonas putida KT2440
gcuuggccagaaacggcggcaga

SEQ ID NO: 1611540 - RNA, 18 nt, Pseudomonas putida KT2440
gcuuggccagacucagcu

SEQ ID NO: 1611541 - RNA, 17 nt, Pseudomonas putida KT2440
gcuuggcguaauccagc

SEQ ID NO: 1611542 - RNA, 22 nt, Pseudomonas putida KT2440
gcuuggaaauguucaacagccg

SEQ ID NO: 1611543 - RNA, 18 nt, Pseudomonas putida KT2440
gcuuggacaggccccagu

SEQ ID NO: 1611544 - RNA, 17 nt, Pseudomonas putida KT2440
gcuuggcuucggcggcu

SEQ ID NO: 1611545 - RNA, 13 nt, Pseudomonas putida KT2440
aaaggcaugggcc

SEQ ID NO: 1611546 - RNA, 14 nt, Pseudomonas putida KT2440
gcuugacccccuuc

SEQ ID NO: 1611547 - RNA, 14 nt, Pseudomonas putida KT2440
gcuugaacuugcuc

SEQ ID NO: 1611548 - RNA, 14 nt, Pseudomonas putida KT2440
gcuugaagcggccu

SEQ ID NO: 1611549 - RNA, 18 nt, Pseudomonas putida KT2440
gcuucuugcaccgcuccg

SEQ ID NO: 1611550 - RNA, 20 nt, Pseudomonas putida KT2440
gcuugacagcguuggcacga

SEQ ID NO: 1611551 - RNA, 18 nt, Pseudomonas putida KT2440
gcuugaccguuugcagcg

SEQ ID NO: 1611552 - RNA, 16 nt, Pseudomonas putida KT2440
gcuugagcgcagcgac

SEQ ID NO: 1611553 - RNA, 13 nt, Pseudomonas putida KT2440
gcuugaggcccau

SEQ ID NO: 1611554 - RNA, 20 nt, Pseudomonas putida KT2440
gcuugaguugaguggggugg

SEQ ID NO: 1611555 - RNA, 13 nt, Pseudomonas putida KT2440
gcuugaggugcca

SEQ ID NO: 1611556 - RNA, 18 nt, Pseudomonas putida KT2440
gcuugaggugccauagca

SEQ ID NO: 1611557 - RNA, 18 nt, Pseudomonas putida KT2440
gcuugagucucggcuagc

SEQ ID NO: 1611558 - RNA, 15 nt, Pseudomonas putida KT2440
gcuugaucuggucac

SEQ ID NO: 1611559 - RNA, 15 nt, Pseudomonas putida KT2440
gcuugccagcguucu

SEQ ID NO: 1611560 - RNA, 17 nt, Pseudomonas putida KT2440
gcuugccacccaggccc

SEQ ID NO: 1611561 - RNA, 20 nt, Pseudomonas putida KT2440
gcuugccacggcguggagcg

SEQ ID NO: 1611562 - RNA, 17 nt, Pseudomonas putida KT2440
gcuugccauucuugucc

SEQ ID NO: 1611563 - RNA, 20 nt, Pseudomonas putida KT2440
gcuugcccaugaagcggccg

SEQ ID NO: 1611564 - RNA, 22 nt, Pseudomonas putida KT2440
gcuugcccgcgaagcagccacc

SEQ ID NO: 1611565 - RNA, 20 nt, Pseudomonas putida KT2440
gcuugcccgcgaagggccgc

SEQ ID NO: 1611566 - RNA, 22 nt, Pseudomonas putida KT2440
gcuugcccgcgaagggccgcca

SEQ ID NO: 1611567 - RNA, 17 nt, Pseudomonas putida KT2440
gcuugcccggcuccagg

SEQ ID NO: 1611568 - RNA, 18 nt, Pseudomonas putida KT2440
gcuugcggaacaccccuu

SEQ ID NO: 1611569 - RNA, 13 nt, Pseudomonas putida KT2440
gcuugcucaaggu

SEQ ID NO: 1611570 - RNA, 22 nt, Pseudomonas putida KT2440
gcuugcucgcggcgcagggugu

SEQ ID NO: 1611571 - RNA, 17 nt, Pseudomonas putida KT2440
gcuugccuuccucggcc

SEQ ID NO: 1611572 - RNA, 23 nt, Pseudomonas putida KT2440
gcuugccuuccucggccaugcgc

SEQ ID NO: 1611573 - RNA, 15 nt, Pseudomonas putida KT2440
gcuugccggaagauc

SEQ ID NO: 1611574 - RNA, 22 nt, Pseudomonas putida KT2440
gcuugcgacuugugcauccugc

SEQ ID NO: 1611575 - RNA, 18 nt, Pseudomonas putida KT2440
gcuucucaagcaucuggu

SEQ ID NO: 1611576 - RNA, 17 nt, Pseudomonas putida KT2440
gcuucucgcgcuuggcc

SEQ ID NO: 1611577 - RNA, 14 nt, Pseudomonas putida KT2440
gcuucuaccacugg

SEQ ID NO: 1611578 - RNA, 16 nt, Pseudomonas putida KT2440
gcuucugcuucagcuc

SEQ ID NO: 1611579 - RNA, 18 nt, Pseudomonas putida KT2440
gcuucuggauaugcucca

SEQ ID NO: 1611580 - RNA, 13 nt, Pseudomonas putida KT2440
gcuucugagccag

SEQ ID NO: 1611581 - RNA, 15 nt, Pseudomonas putida KT2440
gcuucugagccagcc

SEQ ID NO: 1611582 - RNA, 14 nt, Pseudomonas putida KT2440
gcuucugcaacucc

SEQ ID NO: 1611583 - RNA, 16 nt, Pseudomonas putida KT2440
gcuucucggcaaagcg

SEQ ID NO: 1611584 - RNA, 21 nt, Pseudomonas putida KT2440
gcuucucggcaaagcguucgg

SEQ ID NO: 1611585 - RNA, 14 nt, Pseudomonas putida KT2440
gcuucuggcccugg

SEQ ID NO: 1611586 - RNA, 21 nt, Pseudomonas putida KT2440
gcuucgaggauuuucaccuuc

SEQ ID NO: 1611587 - RNA, 22 nt, Pseudomonas putida KT2440
gcuucgaucagcgccugcucau

SEQ ID NO: 1611588 - RNA, 15 nt, Pseudomonas putida KT2440
gcuucgaugcccggc

SEQ ID NO: 1611589 - RNA, 14 nt, Pseudomonas putida KT2440
gcuucgccagcgcc

SEQ ID NO: 1611590 - RNA, 16 nt, Pseudomonas putida KT2440
gcuucgcccagugccu

SEQ ID NO: 1611591 - RNA, 22 nt, Pseudomonas putida KT2440
gcuucgcgacccauuugcagca

SEQ ID NO: 1611592 - RNA, 16 nt, Pseudomonas putida KT2440
gcuucgcggccaagcc

SEQ ID NO: 1611593 - RNA, 16 nt, Pseudomonas putida KT2440
gcuucggcaugcacgg

SEQ ID NO: 1611594 - RNA, 18 nt, Pseudomonas putida KT2440
gcuucggcugaucucuuc

SEQ ID NO: 1611595 - RNA, 21 nt, Pseudomonas putida KT2440
gcuucggugugcuccagcucc

SEQ ID NO: 1611596 - RNA, 20 nt, Pseudomonas putida KT2440
gcuucagggucgggcacagg

SEQ ID NO: 1611597 - RNA, 22 nt, Pseudomonas putida KT2440
gcuucagggucgggcacaggcc

SEQ ID NO: 1611598 - RNA, 18 nt, Pseudomonas putida KT2440
gcuucagguucacuucca

SEQ ID NO: 1611599 - RNA, 21 nt, Pseudomonas putida KT2440
gcuucacgggucaugccaccg

SEQ ID NO: 1611600 - RNA, 18 nt, Pseudomonas putida KT2440
gcuucauaucacaaacaa

SEQ ID NO: 1611601 - RNA, 14 nt, Pseudomonas putida KT2440
gcuuccaccauucc

SEQ ID NO: 1611602 - RNA, 20 nt, Pseudomonas putida KT2440
gcuucaugaaaaacccggcc

SEQ ID NO: 1611603 - RNA, 12 nt, Pseudomonas putida KT2440
gcuucaugaagu

SEQ ID NO: 1611604 - RNA, 22 nt, Pseudomonas putida KT2440
gcuuccaguuggccggcauggc

SEQ ID NO: 1611605 - RNA, 23 nt, Pseudomonas putida KT2440
gcuuccagcaggacccggcugga

SEQ ID NO: 1611606 - RNA, 13 nt, Pseudomonas putida KT2440
gcuucccccaauc

SEQ ID NO: 1611607 - RNA, 21 nt, Pseudomonas putida KT2440
gcuucccgguaacgggccagc

SEQ ID NO: 1611608 - RNA, 15 nt, Pseudomonas putida KT2440
gcuucccggccuggc

SEQ ID NO: 1611609 - RNA, 21 nt, Pseudomonas putida KT2440
gcuuccucuucaaggcccagu

SEQ ID NO: 1611610 - RNA, 22 nt, Pseudomonas putida KT2440
gcuuccuggccuuccuugccca

SEQ ID NO: 1611611 - RNA, 17 nt, Pseudomonas putida KT2440
gcuucgacgaagaagcc

SEQ ID NO: 1611612 - RNA, 24 nt, Pseudomonas putida KT2440
gcuuccgccaccacgaacaguggc

SEQ ID NO: 1611613 - RNA, 22 nt, Pseudomonas putida KT2440
gcuucaagcagguaaccgcugc

SEQ ID NO: 1611614 - RNA, 15 nt, Pseudomonas putida KT2440
gcuucaaacccgguu

SEQ ID NO: 1611615 - RNA, 14 nt, Pseudomonas putida KT2440
gcuucaacaagguc

SEQ ID NO: 1611616 - RNA, 21 nt, Pseudomonas putida KT2440
gcuucaaguuuggcuuugccc

SEQ ID NO: 1611617 - RNA, 14 nt, Pseudomonas putida KT2440
gcuguuccagcccg

SEQ ID NO: 1611618 - RNA, 15 nt, Pseudomonas putida KT2440
gcuguuccauuuccc

SEQ ID NO: 1611619 - RNA, 19 nt, Pseudomonas putida KT2440
gcuguuccagaagcggcua

SEQ ID NO: 1611620 - RNA, 12 nt, Pseudomonas putida KT2440
gcuguuccagca

SEQ ID NO: 1611621 - RNA, 17 nt, Pseudomonas putida KT2440
gcuguuaggcuugacga

SEQ ID NO: 1611622 - RNA, 16 nt, Pseudomonas putida KT2440
gcuguugagcagcagc

SEQ ID NO: 1611623 - RNA, 22 nt, Pseudomonas putida KT2440
gcuguucuugaacucgccgcgc

SEQ ID NO: 1611624 - RNA, 19 nt, Pseudomonas putida KT2440
gcuguuccucgccauggcc

SEQ ID NO: 1611625 - RNA, 14 nt, Pseudomonas putida KT2440
gcuguucgcagcac

SEQ ID NO: 1611626 - RNA, 18 nt, Pseudomonas putida KT2440
gcuguucgucggccuugu

SEQ ID NO: 1611627 - RNA, 18 nt, Pseudomonas putida KT2440
gcuguccagcaagggccu

SEQ ID NO: 1611628 - RNA, 13 nt, Pseudomonas putida KT2440
gcuuaaguuucau

SEQ ID NO: 1611629 - RNA, 14 nt, Pseudomonas putida KT2440
gcuuacaacugcuc

SEQ ID NO: 1611630 - RNA, 18 nt, Pseudomonas putida KT2440
gcuguuuuagaaaucgcu

SEQ ID NO: 1611631 - RNA, 19 nt, Pseudomonas putida KT2440
gcuguuugaagcgagagcu

SEQ ID NO: 1611632 - RNA, 15 nt, Pseudomonas putida KT2440
gcuguagcgcccaca

SEQ ID NO: 1611633 - RNA, 22 nt, Pseudomonas putida KT2440
gcuguaugauucgccucccgcu

SEQ ID NO: 1611634 - RNA, 15 nt, Pseudomonas putida KT2440
gcugucaccauugcu

SEQ ID NO: 1611635 - RNA, 20 nt, Pseudomonas putida KT2440
gcugucacccuugggcacca

SEQ ID NO: 1611636 - RNA, 23 nt, Pseudomonas putida KT2440
gcugucacgaugaugcuauggcu

SEQ ID NO: 1611637 - RNA, 16 nt, Pseudomonas putida KT2440
gcuggugaaggcaggu

SEQ ID NO: 1611638 - RNA, 17 nt, Pseudomonas putida KT2440
gcuggugagcguccauc

SEQ ID NO: 1611639 - RNA, 14 nt, Pseudomonas putida KT2440
gcuggucguuggug

SEQ ID NO: 1611640 - RNA, 20 nt, Pseudomonas putida KT2440
gcuggucgcugcccucggcc

SEQ ID NO: 1611641 - RNA, 18 nt, Pseudomonas putida KT2440
gcuggucgccgugcagca

SEQ ID NO: 1611642 - RNA, 21 nt, Pseudomonas putida KT2440
gcugguccgggcccaugccac

SEQ ID NO: 1611643 - RNA, 15 nt, Pseudomonas putida KT2440
gcuggucgaaccagu

SEQ ID NO: 1611644 - RNA, 22 nt, Pseudomonas putida KT2440
gcuggucgagcaaggcauccac

SEQ ID NO: 1611645 - RNA, 15 nt, Pseudomonas putida KT2440
gcuggcacgugcagg

SEQ ID NO: 1611646 - RNA, 16 nt, Pseudomonas putida KT2440
gcuggcacugcggcuc

SEQ ID NO: 1611647 - RNA, 20 nt, Pseudomonas putida KT2440
gcuggcacgccuucagcagc

SEQ ID NO: 1611648 - RNA, 21 nt, Pseudomonas putida KT2440
gcuggcacgccuucagcagcc

SEQ ID NO: 1611649 - RNA, 19 nt, Pseudomonas putida KT2440
ggccaaucgaucugcucgc

SEQ ID NO: 1611650 - RNA, 23 nt, Pseudomonas putida KT2440
ggccaauaucuggugcagguuga

SEQ ID NO: 1611651 - RNA, 14 nt, Pseudomonas putida KT2440
ggccaaugccagga

SEQ ID NO: 1611652 - RNA, 19 nt, Pseudomonas putida KT2440
ggccaagccaccgccacca

SEQ ID NO: 1611653 - RNA, 16 nt, Pseudomonas putida KT2440
ggccaagguugccacc

SEQ ID NO: 1611654 - RNA, 17 nt, Pseudomonas putida KT2440
ggccaaguacggccagc

SEQ ID NO: 1611655 - RNA, 22 nt, Pseudomonas putida KT2440
aaaguccaucugcuucuggugg

SEQ ID NO: 1611656 - RNA, 17 nt, Pseudomonas putida KT2440
ggcauucggcgagccuu

SEQ ID NO: 1611657 - RNA, 23 nt, Pseudomonas putida KT2440
ggcaucgcugcccgggcaaagca

SEQ ID NO: 1611658 - RNA, 15 nt, Pseudomonas putida KT2440
ggcaucgcugccggg

SEQ ID NO: 1611659 - RNA, 18 nt, Pseudomonas putida KT2440
ggcaucggcgugcugcgu

SEQ ID NO: 1611660 - RNA, 13 nt, Pseudomonas putida KT2440
ggcaucggcgccc

SEQ ID NO: 1611661 - RNA, 13 nt, Pseudomonas putida KT2440
ggcaugcgcaggc

SEQ ID NO: 1611662 - RNA, 18 nt, Pseudomonas putida KT2440
ggcaugcgucuggcggcc

SEQ ID NO: 1611663 - RNA, 14 nt, Pseudomonas putida KT2440
aaaguccggcgaag

SEQ ID NO: 1611664 - RNA, 22 nt, Pseudomonas putida KT2440
aaaguccaaggcggugcauucu

SEQ ID NO: 1611665 - RNA, 15 nt, Pseudomonas putida KT2440
aaagucagccagccg

SEQ ID NO: 1611666 - RNA, 19 nt, Pseudomonas putida KT2440
ggcagguucgaccacugca

SEQ ID NO: 1611667 - RNA, 19 nt, Pseudomonas putida KT2440
ggcagguugaugugcaggu

SEQ ID NO: 1611668 - RNA, 18 nt, Pseudomonas putida KT2440
ggcagggugaucgcgcug

SEQ ID NO: 1611669 - RNA, 19 nt, Pseudomonas putida KT2440
ggcagggugaucgcgcugg

SEQ ID NO: 1611670 - RNA, 18 nt, Pseudomonas putida KT2440
ggcaggucagcgagcggg

SEQ ID NO: 1611671 - RNA, 16 nt, Pseudomonas putida KT2440
ggcaggucgacccgcg

SEQ ID NO: 1611672 - RNA, 19 nt, Pseudomonas putida KT2440
ggcaggucgaugaucgccg

SEQ ID NO: 1611673 - RNA, 19 nt, Pseudomonas putida KT2440
ggcaggggacagccacaug

SEQ ID NO: 1611674 - RNA, 13 nt, Pseudomonas putida KT2440
ggcaucacgcugg

SEQ ID NO: 1611675 - RNA, 11 nt, Pseudomonas putida KT2440
ggcaggcuggc

SEQ ID NO: 1611676 - RNA, 14 nt, Pseudomonas putida KT2440
ggcagggcacacuu

SEQ ID NO: 1611677 - RNA, 19 nt, Pseudomonas putida KT2440
ggcaggcgguccagcaagc

SEQ ID NO: 1611678 - RNA, 16 nt, Pseudomonas putida KT2440
ggcaggcgcagcugcc

SEQ ID NO: 1611679 - RNA, 18 nt, Pseudomonas putida KT2440
ggcaggccaugcccgccc

SEQ ID NO: 1611680 - RNA, 15 nt, Pseudomonas putida KT2440
ggcaggccggccacc

SEQ ID NO: 1611681 - RNA, 22 nt, Pseudomonas putida KT2440
ggcaggcccggcagguugaugu

SEQ ID NO: 1611682 - RNA, 12 nt, Pseudomonas putida KT2440
ggcagcucgccg

SEQ ID NO: 1611683 - RNA, 15 nt, Pseudomonas putida KT2440
ggcagcucgagcaug

SEQ ID NO: 1611684 - RNA, 18 nt, Pseudomonas putida KT2440
ggcagcugcagugcuggg

SEQ ID NO: 1611685 - RNA, 17 nt, Pseudomonas putida KT2440
ggcagcuugcccugcuu

SEQ ID NO: 1611686 - RNA, 18 nt, Pseudomonas putida KT2440
ggcagcgaucagugccuu

SEQ ID NO: 1611687 - RNA, 15 nt, Pseudomonas putida KT2440
ggcagcgaugccggg

SEQ ID NO: 1611688 - RNA, 15 nt, Pseudomonas putida KT2440
ggcagacaaguccuu

SEQ ID NO: 1611689 - RNA, 16 nt, Pseudomonas putida KT2440
ggcagacacaggcgcu

SEQ ID NO: 1611690 - RNA, 13 nt, Pseudomonas putida KT2440
ggcagaauuucag

SEQ ID NO: 1611691 - RNA, 13 nt, Pseudomonas putida KT2440
ggcaagccgagca

SEQ ID NO: 1611692 - RNA, 14 nt, Pseudomonas putida KT2440
ggcaaggcauccag

SEQ ID NO: 1611693 - RNA, 18 nt, Pseudomonas putida KT2440
ggcaaggcuggcaacccg

SEQ ID NO: 1611694 - RNA, 17 nt, Pseudomonas putida KT2440
ggcaagggccugcaggc

SEQ ID NO: 1611695 - RNA, 21 nt, Pseudomonas putida KT2440
ggcaagggccugcaggcagca

SEQ ID NO: 1611696 - RNA, 19 nt, Pseudomonas putida KT2440
ggcagaugcuccaacccca

SEQ ID NO: 1611697 - RNA, 18 nt, Pseudomonas putida KT2440
ggcagaucacgcaaccuc

SEQ ID NO: 1611698 - RNA, 13 nt, Pseudomonas putida KT2440
ggcagauccugca

SEQ ID NO: 1611699 - RNA, 19 nt, Pseudomonas putida KT2440
ggcagauccugcagccgca

SEQ ID NO: 1611700 - RNA, 14 nt, Pseudomonas putida KT2440
ggcagaucgaaaga

SEQ ID NO: 1611701 - RNA, 13 nt, Pseudomonas putida KT2440
ggcagccggcgcc

SEQ ID NO: 1611702 - RNA, 23 nt, Pseudomonas putida KT2440
ggcagcccuucgcgggcacgccc

SEQ ID NO: 1611703 - RNA, 19 nt, Pseudomonas putida KT2440
ggcagcgacagcugcggca

SEQ ID NO: 1611704 - RNA, 18 nt, Pseudomonas putida KT2440
ggcagccguucccgggca

SEQ ID NO: 1611705 - RNA, 15 nt, Pseudomonas putida KT2440
ggcagccugccaggu

SEQ ID NO: 1611706 - RNA, 16 nt, Pseudomonas putida KT2440
ggccgaaggggcgggu

SEQ ID NO: 1611707 - RNA, 14 nt, Pseudomonas putida KT2440
ggccgaaggccagc

SEQ ID NO: 1611708 - RNA, 15 nt, Pseudomonas putida KT2440
ggccgaaggccagcc

SEQ ID NO: 1611709 - RNA, 21 nt, Pseudomonas putida KT2440
ggccgaaggccguggcaaggc

SEQ ID NO: 1611710 - RNA, 13 nt, Pseudomonas putida KT2440
ggccgaagcgguc

SEQ ID NO: 1611711 - RNA, 16 nt, Pseudomonas putida KT2440
ggcccuuggcagcgcu

SEQ ID NO: 1611712 - RNA, 14 nt, Pseudomonas putida KT2440
ggcccuuucgcggg

SEQ ID NO: 1611713 - RNA, 23 nt, Pseudomonas putida KT2440
ggccgaaaaaaucaugcgcuggc

SEQ ID NO: 1611714 - RNA, 19 nt, Pseudomonas putida KT2440
ggccgaaacgcgacagggc

SEQ ID NO: 1611715 - RNA, 18 nt, Pseudomonas putida KT2440
ggccgaaaccagccccuu

SEQ ID NO: 1611716 - RNA, 16 nt, Pseudomonas putida KT2440
ggccgaaaccgcccgg

SEQ ID NO: 1611717 - RNA, 14 nt, Pseudomonas putida KT2440
ggcccugugccggg

SEQ ID NO: 1611718 - RNA, 15 nt, Pseudomonas putida KT2440
ggcccugugccgggg

SEQ ID NO: 1611719 - RNA, 13 nt, Pseudomonas putida KT2440
ggcccugugggag

SEQ ID NO: 1611720 - RNA, 20 nt, Pseudomonas putida KT2440
ggcccugggauuucggcggc

SEQ ID NO: 1611721 - RNA, 21 nt, Pseudomonas putida KT2440
ggcccugggauuucggcggcg

SEQ ID NO: 1611722 - RNA, 21 nt, Pseudomonas putida KT2440
ggcccugcauaugcagggccu

SEQ ID NO: 1611723 - RNA, 15 nt, Pseudomonas putida KT2440
ggcccugacgccagc

SEQ ID NO: 1611724 - RNA, 18 nt, Pseudomonas putida KT2440
ggcccugacgccagcgcu

SEQ ID NO: 1611725 - RNA, 23 nt, Pseudomonas putida KT2440
ggcccugaacuuggccuccagca

SEQ ID NO: 1611726 - RNA, 22 nt, Pseudomonas putida KT2440
ggcccugacaggcgaucaguca

SEQ ID NO: 1611727 - RNA, 12 nt, Pseudomonas putida KT2440
ggcccugcagcg

SEQ ID NO: 1611728 - RNA, 16 nt, Pseudomonas putida KT2440
ggcccugcuggccaau

SEQ ID NO: 1611729 - RNA, 14 nt, Pseudomonas putida KT2440
ggcccggcuggcca

SEQ ID NO: 1611730 - RNA, 16 nt, Pseudomonas putida KT2440
ggcccgugacgaaggc

SEQ ID NO: 1611731 - RNA, 14 nt, Pseudomonas putida KT2440
ggcccggucccgcu

SEQ ID NO: 1611732 - RNA, 18 nt, Pseudomonas putida KT2440
ggcccgguuggcgcuucc

SEQ ID NO: 1611733 - RNA, 19 nt, Pseudomonas putida KT2440
ggcccgugguuggagcgca

SEQ ID NO: 1611734 - RNA, 21 nt, Pseudomonas putida KT2440
ggcccgugguuggagcgcagg

SEQ ID NO: 1611735 - RNA, 21 nt, Pseudomonas putida KT2440
ggcccuccccguuuggcagcu

SEQ ID NO: 1611736 - RNA, 18 nt, Pseudomonas putida KT2440
ggcccucaacccucgccc

SEQ ID NO: 1611737 - RNA, 13 nt, Pseudomonas putida KT2440
ggcccucaagggc

SEQ ID NO: 1611738 - RNA, 18 nt, Pseudomonas putida KT2440
ggcccucgguggcucucc

SEQ ID NO: 1611739 - RNA, 15 nt, Pseudomonas putida KT2440
ggcccgaacgcagcg

SEQ ID NO: 1611740 - RNA, 19 nt, Pseudomonas putida KT2440
ggcccgaugggcgucgccu

SEQ ID NO: 1611741 - RNA, 16 nt, Pseudomonas putida KT2440
aaagucgaccagcagc

SEQ ID NO: 1611742 - RNA, 17 nt, Pseudomonas putida KT2440
ggcccggcauccuuggg

SEQ ID NO: 1611743 - RNA, 20 nt, Pseudomonas putida KT2440
ggcccgcucguacgucgccu

SEQ ID NO: 1611744 - RNA, 21 nt, Pseudomonas putida KT2440
ggcccgccggcaacuccucca

SEQ ID NO: 1611745 - RNA, 23 nt, Pseudomonas putida KT2440
ggcccgccggcaacuccuccagc

SEQ ID NO: 1611746 - RNA, 14 nt, Pseudomonas putida KT2440
ggcccgcgccaggc

SEQ ID NO: 1611747 - RNA, 19 nt, Pseudomonas putida KT2440
ggcccgccaguaggcugca

SEQ ID NO: 1611748 - RNA, 15 nt, Pseudomonas putida KT2440
ggcccgcccagcugg

SEQ ID NO: 1611749 - RNA, 14 nt, Pseudomonas putida KT2440
ggccccggccaggc

SEQ ID NO: 1611750 - RNA, 16 nt, Pseudomonas putida KT2440
ggccccuucgauucag

SEQ ID NO: 1611751 - RNA, 20 nt, Pseudomonas putida KT2440
ggccccuucgauucaggccu

SEQ ID NO: 1611752 - RNA, 13 nt, Pseudomonas putida KT2440
ggccccaggugcc

SEQ ID NO: 1611753 - RNA, 22 nt, Pseudomonas putida KT2440
ggccccauuucaauuuccggcu

SEQ ID NO: 1611754 - RNA, 16 nt, Pseudomonas putida KT2440
ggccccccagccagca

SEQ ID NO: 1611755 - RNA, 23 nt, Pseudomonas putida KT2440
ggcccccugguuuuccaccggca

SEQ ID NO: 1611756 - RNA, 17 nt, Pseudomonas putida KT2440
ggccccgauacagcgcg

SEQ ID NO: 1611757 - RNA, 16 nt, Pseudomonas putida KT2440
ggcccaugucgaucag

SEQ ID NO: 1611758 - RNA, 21 nt, Pseudomonas putida KT2440
ggcccauuccgggucgccagu

SEQ ID NO: 1611759 - RNA, 19 nt, Pseudomonas putida KT2440
ggccccaagcuucaccuca

SEQ ID NO: 1611760 - RNA, 21 nt, Pseudomonas putida KT2440
ggcccauuucgcgggucaggg

SEQ ID NO: 1611761 - RNA, 18 nt, Pseudomonas putida KT2440
ggccccagacaaucaccu

SEQ ID NO: 1611762 - RNA, 13 nt, Pseudomonas putida KT2440
ggccccacgcagu

SEQ ID NO: 1611763 - RNA, 21 nt, Pseudomonas putida KT2440
ggccccacccaacucgcuucc

SEQ ID NO: 1611764 - RNA, 16 nt, Pseudomonas putida KT2440
ggccccaggccaucca

SEQ ID NO: 1611765 - RNA, 17 nt, Pseudomonas putida KT2440
ggccccaggccauccag

SEQ ID NO: 1611766 - RNA, 16 nt, Pseudomonas putida KT2440
ggccccaggcggugca

SEQ ID NO: 1611767 - RNA, 23 nt, Pseudomonas putida KT2440
ggcccaguucuccggcagguuga

SEQ ID NO: 1611768 - RNA, 21 nt, Pseudomonas putida KT2440
ggcccaucgcauaugccccag

SEQ ID NO: 1611769 - RNA, 16 nt, Pseudomonas putida KT2440
ggcccaggggcagguc

SEQ ID NO: 1611770 - RNA, 11 nt, Pseudomonas putida KT2440
ggcccaguucc

SEQ ID NO: 1611771 - RNA, 21 nt, Pseudomonas putida KT2440
ggcccaguucggacaggcgcu

SEQ ID NO: 1611772 - RNA, 13 nt, Pseudomonas putida KT2440
ggcccagccgcga

SEQ ID NO: 1611773 - RNA, 12 nt, Pseudomonas putida KT2440
ggcccagccccg

SEQ ID NO: 1611774 - RNA, 13 nt, Pseudomonas putida KT2440
ggcccagccccgc

SEQ ID NO: 1611775 - RNA, 13 nt, Pseudomonas putida KT2440
ggcccagcaggua

SEQ ID NO: 1611776 - RNA, 16 nt, Pseudomonas putida KT2440
ggcccacgccuuccac

SEQ ID NO: 1611777 - RNA, 17 nt, Pseudomonas putida KT2440
ggcccacggcguccagg

SEQ ID NO: 1611778 - RNA, 19 nt, Pseudomonas putida KT2440
ggcccacggcguccaggcc

SEQ ID NO: 1611779 - RNA, 23 nt, Pseudomonas putida KT2440
ggccaggguaccgccguccacca

SEQ ID NO: 1611780 - RNA, 21 nt, Pseudomonas putida KT2440
ggccaggguacgauagggcgg

SEQ ID NO: 1611781 - RNA, 20 nt, Pseudomonas putida KT2440
ggccagggcaucggacaggu

SEQ ID NO: 1611782 - RNA, 14 nt, Pseudomonas putida KT2440
ggccaggcucgacg

SEQ ID NO: 1611783 - RNA, 17 nt, Pseudomonas putida KT2440
ggccaggcucgacggcg

SEQ ID NO: 1611784 - RNA, 16 nt, Pseudomonas putida KT2440
ggccaggaacagcgcc

SEQ ID NO: 1611785 - RNA, 15 nt, Pseudomonas putida KT2440
ggccagcugcugcgg

SEQ ID NO: 1611786 - RNA, 18 nt, Pseudomonas putida KT2440
ggccagcugcugcggcac

SEQ ID NO: 1611787 - RNA, 18 nt, Pseudomonas putida KT2440
ggccagcugcgcaccggc

SEQ ID NO: 1611788 - RNA, 13 nt, Pseudomonas putida KT2440
ggccagcaaggca

SEQ ID NO: 1611789 - RNA, 17 nt, Pseudomonas putida KT2440
ggccagcaaacccucgg

SEQ ID NO: 1611790 - RNA, 12 nt, Pseudomonas putida KT2440
ggccagcaaaga

SEQ ID NO: 1611791 - RNA, 14 nt, Pseudomonas putida KT2440
ggccagcucggcag

SEQ ID NO: 1611792 - RNA, 13 nt, Pseudomonas putida KT2440
ggccagcuccuuc

SEQ ID NO: 1611793 - RNA, 18 nt, Pseudomonas putida KT2440
ggccagcacuacgccggc

SEQ ID NO: 1611794 - RNA, 19 nt, Pseudomonas putida KT2440
ggccagcacuacgccggcc

SEQ ID NO: 1611795 - RNA, 15 nt, Pseudomonas putida KT2440
ggccaugcccuugcc

SEQ ID NO: 1611796 - RNA, 15 nt, Pseudomonas putida KT2440
ggcccaccagucugc

SEQ ID NO: 1611797 - RNA, 13 nt, Pseudomonas putida KT2440
ggccagggugcgg

SEQ ID NO: 1611798 - RNA, 19 nt, Pseudomonas putida KT2440
ggccagguagacgaucgag

SEQ ID NO: 1611799 - RNA, 15 nt, Pseudomonas putida KT2440
ggccaggucgauccg

SEQ ID NO: 1611800 - RNA, 16 nt, Pseudomonas putida KT2440
ggccaguugccccagg

SEQ ID NO: 1611801 - RNA, 19 nt, Pseudomonas putida KT2440
ggccauaguugaccagcac

SEQ ID NO: 1611802 - RNA, 20 nt, Pseudomonas putida KT2440
ggccauaccuucggggaugu

SEQ ID NO: 1611803 - RNA, 17 nt, Pseudomonas putida KT2440
ggccauauugcugagcc

SEQ ID NO: 1611804 - RNA, 20 nt, Pseudomonas putida KT2440
ggccauauugcugagccagu

SEQ ID NO: 1611805 - RNA, 23 nt, Pseudomonas putida KT2440
ggccauauugcugagccaguuca

SEQ ID NO: 1611806 - RNA, 23 nt, Pseudomonas putida KT2440
ggccaguuguucgucgagcacca

SEQ ID NO: 1611807 - RNA, 17 nt, Pseudomonas putida KT2440
ggcaaccugcacuaucu

SEQ ID NO: 1611808 - RNA, 18 nt, Pseudomonas putida KT2440
ggcaacccuucggccagc

SEQ ID NO: 1611809 - RNA, 14 nt, Pseudomonas putida KT2440
ggcaacccgccucc

SEQ ID NO: 1611810 - RNA, 17 nt, Pseudomonas putida KT2440
ggcaagcccauggcugg

SEQ ID NO: 1611811 - RNA, 21 nt, Pseudomonas putida KT2440
ggcaagcccgcgaagaggcca

SEQ ID NO: 1611812 - RNA, 23 nt, Pseudomonas putida KT2440
ggcaagcccgcgaagaggccagg

SEQ ID NO: 1611813 - RNA, 17 nt, Pseudomonas putida KT2440
ggcaagcccgcuccuac

SEQ ID NO: 1611814 - RNA, 17 nt, Pseudomonas putida KT2440
ggcaacagccgggcagc

SEQ ID NO: 1611815 - RNA, 23 nt, Pseudomonas putida KT2440
ggcaaccaggugugccacuucau

SEQ ID NO: 1611816 - RNA, 18 nt, Pseudomonas putida KT2440
ggcaaaagaaaaagggca

SEQ ID NO: 1611817 - RNA, 19 nt, Pseudomonas putida KT2440
ggauuuggggcgcccggca

SEQ ID NO: 1611818 - RNA, 20 nt, Pseudomonas putida KT2440
ggauucagcacgcuggccag

SEQ ID NO: 1611819 - RNA, 22 nt, Pseudomonas putida KT2440
ggauguucccauugagcuguuu

SEQ ID NO: 1611820 - RNA, 12 nt, Pseudomonas putida KT2440
ggauggccgcag

SEQ ID NO: 1611821 - RNA, 15 nt, Pseudomonas putida KT2440
ggaugcucugcagca

SEQ ID NO: 1611822 - RNA, 13 nt, Pseudomonas putida KT2440
ggaugcugaagcu

SEQ ID NO: 1611823 - RNA, 20 nt, Pseudomonas putida KT2440
ggaugcucgauaccguacug

SEQ ID NO: 1611824 - RNA, 20 nt, Pseudomonas putida KT2440
ggaugcggcugaccccaccc

SEQ ID NO: 1611825 - RNA, 16 nt, Pseudomonas putida KT2440
ggaugcgggcuuucca

SEQ ID NO: 1611826 - RNA, 20 nt, Pseudomonas putida KT2440
ggaugcgggcuuuccacgcc

SEQ ID NO: 1611827 - RNA, 21 nt, Pseudomonas putida KT2440
ggaugccagcggugccaguca

SEQ ID NO: 1611828 - RNA, 20 nt, Pseudomonas putida KT2440
ggauggugacugccagcacg

SEQ ID NO: 1611829 - RNA, 14 nt, Pseudomonas putida KT2440
ggauggugcgcucg

SEQ ID NO: 1611830 - RNA, 22 nt, Pseudomonas putida KT2440
ggaucucgcugucguccagcuc

SEQ ID NO: 1611831 - RNA, 20 nt, Pseudomonas putida KT2440
ggaucuccucggccagcggc

SEQ ID NO: 1611832 - RNA, 16 nt, Pseudomonas putida KT2440
ggaucugacggcgcug

SEQ ID NO: 1611833 - RNA, 14 nt, Pseudomonas putida KT2440
ggaucuccucggcc

SEQ ID NO: 1611834 - RNA, 22 nt, Pseudomonas putida KT2440
ggaucugcugcagcauggcguc

SEQ ID NO: 1611835 - RNA, 22 nt, Pseudomonas putida KT2440
ggaugagccuucacugugcagg

SEQ ID NO: 1611836 - RNA, 15 nt, Pseudomonas putida KT2440
ggaucggguuuaccc

SEQ ID NO: 1611837 - RNA, 21 nt, Pseudomonas putida KT2440
ggaucgggcacaacuccaccc

SEQ ID NO: 1611838 - RNA, 12 nt, Pseudomonas putida KT2440
ggaucagcucau

SEQ ID NO: 1611839 - RNA, 23 nt, Pseudomonas putida KT2440
ggaucaggaacaaucuucuucau

SEQ ID NO: 1611840 - RNA, 21 nt, Pseudomonas putida KT2440
ggaucaucggcacgcccagca

SEQ ID NO: 1611841 - RNA, 23 nt, Pseudomonas putida KT2440
ggauagaacaagccccuccuaag

SEQ ID NO: 1611842 - RNA, 19 nt, Pseudomonas putida KT2440
ggauagaacgggucauugc

SEQ ID NO: 1611843 - RNA, 16 nt, Pseudomonas putida KT2440
ggauagcaaaggcgac

SEQ ID NO: 1611844 - RNA, 14 nt, Pseudomonas putida KT2440
ggaucaacugccgc

SEQ ID NO: 1611845 - RNA, 17 nt, Pseudomonas putida KT2440
aaaggucugcugcggcc

SEQ ID NO: 1611846 - RNA, 14 nt, Pseudomonas putida KT2440
ggacuucagcaguu

SEQ ID NO: 1611847 - RNA, 15 nt, Pseudomonas putida KT2440
ggagauuggccagca

SEQ ID NO: 1611848 - RNA, 16 nt, Pseudomonas putida KT2440
ggagagcagggcugcg

SEQ ID NO: 1611849 - RNA, 16 nt, Pseudomonas putida KT2440
ggacuucuucaacgcg

SEQ ID NO: 1611850 - RNA, 22 nt, Pseudomonas putida KT2440
ggacgaagccgacccgggccag

SEQ ID NO: 1611851 - RNA, 14 nt, Pseudomonas putida KT2440
aaaggcuuuggccg

SEQ ID NO: 1611852 - RNA, 18 nt, Pseudomonas putida KT2440
aaaggcuuucgauaucgg

SEQ ID NO: 1611853 - RNA, 12 nt, Pseudomonas putida KT2440
ggacaggcccca

SEQ ID NO: 1611854 - RNA, 21 nt, Pseudomonas putida KT2440
ggacagcaauuccaaugagaa

SEQ ID NO: 1611855 - RNA, 16 nt, Pseudomonas putida KT2440
ggaaugcccgggcgca

SEQ ID NO: 1611856 - RNA, 15 nt, Pseudomonas putida KT2440
ggaauggcccagcca

SEQ ID NO: 1611857 - RNA, 14 nt, Pseudomonas putida KT2440
ggaauuauuggcca

SEQ ID NO: 1611858 - RNA, 17 nt, Pseudomonas putida KT2440
ggaauuauuggccagca

SEQ ID NO: 1611859 - RNA, 23 nt, Pseudomonas putida KT2440
ggaauuauuggccagcaacggug

SEQ ID NO: 1611860 - RNA, 17 nt, Pseudomonas putida KT2440
ggaaugucaccgcggca

SEQ ID NO: 1611861 - RNA, 14 nt, Pseudomonas putida KT2440
ggaagugguuggca

SEQ ID NO: 1611862 - RNA, 21 nt, Pseudomonas putida KT2440
ggaaguugccauuuuggauuu

SEQ ID NO: 1611863 - RNA, 14 nt, Pseudomonas putida KT2440
ggaagucgccgcgg

SEQ ID NO: 1611864 - RNA, 18 nt, Pseudomonas putida KT2440
ggacaacaaggacugccu

SEQ ID NO: 1611865 - RNA, 12 nt, Pseudomonas putida KT2440
ggacaccagguu

SEQ ID NO: 1611866 - RNA, 12 nt, Pseudomonas putida KT2440
ggacacaggccg

SEQ ID NO: 1611867 - RNA, 13 nt, Pseudomonas putida KT2440
ggacaccaggcug

SEQ ID NO: 1611868 - RNA, 17 nt, Pseudomonas putida KT2440
ggaagccccgcgcgucc

SEQ ID NO: 1611869 - RNA, 18 nt, Pseudomonas putida KT2440
ggaacugcgcgagccaau

SEQ ID NO: 1611870 - RNA, 21 nt, Pseudomonas putida KT2440
ggaacucuggcgugaagcucu

SEQ ID NO: 1611871 - RNA, 17 nt, Pseudomonas putida KT2440
ggaagcugcagcagcuu

SEQ ID NO: 1611872 - RNA, 14 nt, Pseudomonas putida KT2440
ggaagcgcccgccc

SEQ ID NO: 1611873 - RNA, 16 nt, Pseudomonas putida KT2440
ggaagcgcccgcccac

SEQ ID NO: 1611874 - RNA, 21 nt, Pseudomonas putida KT2440
ggaacagcucgauggccagga

SEQ ID NO: 1611875 - RNA, 16 nt, Pseudomonas putida KT2440
ggaacagcggcagcaa

SEQ ID NO: 1611876 - RNA, 22 nt, Pseudomonas putida KT2440
ggaacagcguggccagcccaag

SEQ ID NO: 1611877 - RNA, 14 nt, Pseudomonas putida KT2440
ggaacacuucgcuu

SEQ ID NO: 1611878 - RNA, 22 nt, Pseudomonas putida KT2440
gcuuucccccagccaacgcccc

SEQ ID NO: 1611879 - RNA, 16 nt, Pseudomonas putida KT2440
ggaacacccagucgcc

SEQ ID NO: 1611880 - RNA, 14 nt, Pseudomonas putida KT2440
ggucgaccugcccg

SEQ ID NO: 1611881 - RNA, 15 nt, Pseudomonas putida KT2440
ggucgaccugggcca

SEQ ID NO: 1611882 - RNA, 20 nt, Pseudomonas putida KT2440
gguccuugaguucccaggca

SEQ ID NO: 1611883 - RNA, 17 nt, Pseudomonas putida KT2440
gguccuugaacggcauu

SEQ ID NO: 1611884 - RNA, 22 nt, Pseudomonas putida KT2440
gguccuugaacggcauuuccag

SEQ ID NO: 1611885 - RNA, 14 nt, Pseudomonas putida KT2440
gguccuucaccacc

SEQ ID NO: 1611886 - RNA, 15 nt, Pseudomonas putida KT2440
gguccuucaccacca

SEQ ID NO: 1611887 - RNA, 18 nt, Pseudomonas putida KT2440
gguccugcaccacaugca

SEQ ID NO: 1611888 - RNA, 19 nt, Pseudomonas putida KT2440
ggucgaugcaggagcggcu

SEQ ID NO: 1611889 - RNA, 23 nt, Pseudomonas putida KT2440
ggucgccaaacaguuggugggca

SEQ ID NO: 1611890 - RNA, 12 nt, Pseudomonas putida KT2440
ggucgagcugcc

SEQ ID NO: 1611891 - RNA, 15 nt, Pseudomonas putida KT2440
ggucgccgugcagca

SEQ ID NO: 1611892 - RNA, 22 nt, Pseudomonas putida KT2440
ggucgccgcuguucagcccuug

SEQ ID NO: 1611893 - RNA, 12 nt, Pseudomonas putida KT2440
ggucgccagcac

SEQ ID NO: 1611894 - RNA, 15 nt, Pseudomonas putida KT2440
ggucgcgggccagcc

SEQ ID NO: 1611895 - RNA, 22 nt, Pseudomonas putida KT2440
ggucgcguucuuucucccaggc

SEQ ID NO: 1611896 - RNA, 15 nt, Pseudomonas putida KT2440
ggucgcuaucggcag

SEQ ID NO: 1611897 - RNA, 12 nt, Pseudomonas putida KT2440
ggucgcucaacu

SEQ ID NO: 1611898 - RNA, 21 nt, Pseudomonas putida KT2440
ggucgcugcccucggccgggg

SEQ ID NO: 1611899 - RNA, 20 nt, Pseudomonas putida KT2440
ggucgcguuguucagcagcg

SEQ ID NO: 1611900 - RNA, 14 nt, Pseudomonas putida KT2440
ggucggcagggccg

SEQ ID NO: 1611901 - RNA, 14 nt, Pseudomonas putida KT2440
ggucugcugcggcc

SEQ ID NO: 1611902 - RNA, 16 nt, Pseudomonas putida KT2440
ggucuggcgcaggaag

SEQ ID NO: 1611903 - RNA, 23 nt, Pseudomonas putida KT2440
ggugaaacccucuggguagccac

SEQ ID NO: 1611904 - RNA, 18 nt, Pseudomonas putida KT2440
ggucuuuucgccacuggc

SEQ ID NO: 1611905 - RNA, 15 nt, Pseudomonas putida KT2440
ggucugauugggccc

SEQ ID NO: 1611906 - RNA, 14 nt, Pseudomonas putida KT2440
ggucucguugcuuu

SEQ ID NO: 1611907 - RNA, 18 nt, Pseudomonas putida KT2440
ggucggcguccacugcac

SEQ ID NO: 1611908 - RNA, 15 nt, Pseudomonas putida KT2440
ggucgggcacaggcc

SEQ ID NO: 1611909 - RNA, 15 nt, Pseudomonas putida KT2440
ggucggcgccaggcc

SEQ ID NO: 1611910 - RNA, 15 nt, Pseudomonas putida KT2440
ggucgguggucagcu

SEQ ID NO: 1611911 - RNA, 14 nt, Pseudomonas putida KT2440
ggucaucgggauca

SEQ ID NO: 1611912 - RNA, 21 nt, Pseudomonas putida KT2440
ggucauccaggcuggccagca

SEQ ID NO: 1611913 - RNA, 21 nt, Pseudomonas putida KT2440
ggucauccaguggcgugugug

SEQ ID NO: 1611914 - RNA, 13 nt, Pseudomonas putida KT2440
ggucauacaucca

SEQ ID NO: 1611915 - RNA, 17 nt, Pseudomonas putida KT2440
ggucaucaccaccccca

SEQ ID NO: 1611916 - RNA, 18 nt, Pseudomonas putida KT2440
ggucaucaccacccccag

SEQ ID NO: 1611917 - RNA, 17 nt, Pseudomonas putida KT2440
gguccagccacgaaucg

SEQ ID NO: 1611918 - RNA, 13 nt, Pseudomonas putida KT2440
gguccaccucugc

SEQ ID NO: 1611919 - RNA, 13 nt, Pseudomonas putida KT2440
gguccaccagcag

SEQ ID NO: 1611920 - RNA, 13 nt, Pseudomonas putida KT2440
gguccaccagccc

SEQ ID NO: 1611921 - RNA, 17 nt, Pseudomonas putida KT2440
ggucauuugcagugcuu

SEQ ID NO: 1611922 - RNA, 16 nt, Pseudomonas putida KT2440
ggucauggucguguug

SEQ ID NO: 1611923 - RNA, 20 nt, Pseudomonas putida KT2440
gguccggcccuucuccgccu

SEQ ID NO: 1611924 - RNA, 22 nt, Pseudomonas putida KT2440
gguccggcccuucuccgccuac

SEQ ID NO: 1611925 - RNA, 21 nt, Pseudomonas putida KT2440
ggucccguaauucuggcuggc

SEQ ID NO: 1611926 - RNA, 20 nt, Pseudomonas putida KT2440
gguccccuucgucgaugucc

SEQ ID NO: 1611927 - RNA, 12 nt, Pseudomonas putida KT2440
gguccaggccag

SEQ ID NO: 1611928 - RNA, 22 nt, Pseudomonas putida KT2440
gguccagcguucggccagcacu

SEQ ID NO: 1611929 - RNA, 16 nt, Pseudomonas putida KT2440
gguccagcaaccgggu

SEQ ID NO: 1611930 - RNA, 13 nt, Pseudomonas putida KT2440
ggucagccaggcg

SEQ ID NO: 1611931 - RNA, 12 nt, Pseudomonas putida KT2440
ggucagcuggcc

SEQ ID NO: 1611932 - RNA, 16 nt, Pseudomonas putida KT2440
ggucagcuucugggua

SEQ ID NO: 1611933 - RNA, 12 nt, Pseudomonas putida KT2440
ggucaggcguau

SEQ ID NO: 1611934 - RNA, 15 nt, Pseudomonas putida KT2440
ggucaggucaaagcg

SEQ ID NO: 1611935 - RNA, 11 nt, Pseudomonas putida KT2440
ggucagguccg

SEQ ID NO: 1611936 - RNA, 16 nt, Pseudomonas putida KT2440
ggucagcauccagcca

SEQ ID NO: 1611937 - RNA, 18 nt, Pseudomonas putida KT2440
ggucagcaucuucuuccc

SEQ ID NO: 1611938 - RNA, 19 nt, Pseudomonas putida KT2440
ggucagcauggccaguucc

SEQ ID NO: 1611939 - RNA, 15 nt, Pseudomonas putida KT2440
ggucagcacuugcuu

SEQ ID NO: 1611940 - RNA, 17 nt, Pseudomonas putida KT2440
ggucacugagccaggcc

SEQ ID NO: 1611941 - RNA, 23 nt, Pseudomonas putida KT2440
ggucacucugccgccccuccacc

SEQ ID NO: 1611942 - RNA, 20 nt, Pseudomonas putida KT2440
ggucacgauccccaccagca

SEQ ID NO: 1611943 - RNA, 13 nt, Pseudomonas putida KT2440
ggucacggcugaa

SEQ ID NO: 1611944 - RNA, 17 nt, Pseudomonas putida KT2440
ggucacgcucggccagu

SEQ ID NO: 1611945 - RNA, 15 nt, Pseudomonas putida KT2440
ggucacgccaucccc

SEQ ID NO: 1611946 - RNA, 15 nt, Pseudomonas putida KT2440
ggucacgcccaucag

SEQ ID NO: 1611947 - RNA, 22 nt, Pseudomonas putida KT2440
ggucaccuuguccagcaggcca

SEQ ID NO: 1611948 - RNA, 16 nt, Pseudomonas putida KT2440
ggucaccaucaagccc

SEQ ID NO: 1611949 - RNA, 15 nt, Pseudomonas putida KT2440
ggucaccgcccagcu

SEQ ID NO: 1611950 - RNA, 17 nt, Pseudomonas putida KT2440
ggucacccugacgcugc

SEQ ID NO: 1611951 - RNA, 21 nt, Pseudomonas putida KT2440
ggucacccgugcugcucgccu

SEQ ID NO: 1611952 - RNA, 22 nt, Pseudomonas putida KT2440
ggucaaucagggauacugcuga

SEQ ID NO: 1611953 - RNA, 18 nt, Pseudomonas putida KT2440
gguaugaugcgcggcauu

SEQ ID NO: 1611954 - RNA, 21 nt, Pseudomonas putida KT2440
gguauucggguguccacaaac

SEQ ID NO: 1611955 - RNA, 19 nt, Pseudomonas putida KT2440
gguauucacaccugccgcg

SEQ ID NO: 1611956 - RNA, 21 nt, Pseudomonas putida KT2440
gguagucgcucaggcggcgca

SEQ ID NO: 1611957 - RNA, 16 nt, Pseudomonas putida KT2440
gguaguccggcacguu

SEQ ID NO: 1611958 - RNA, 21 nt, Pseudomonas putida KT2440
gguaguucacuggccagcagg

SEQ ID NO: 1611959 - RNA, 22 nt, Pseudomonas putida KT2440
gguaguucacuggccagcaggg

SEQ ID NO: 1611960 - RNA, 20 nt, Pseudomonas putida KT2440
gguaggcaccccggccgcuu

SEQ ID NO: 1611961 - RNA, 21 nt, Pseudomonas putida KT2440
gguaggcaccccggccgcuug

SEQ ID NO: 1611962 - RNA, 15 nt, Pseudomonas putida KT2440
gguagggaaauccuc

SEQ ID NO: 1611963 - RNA, 14 nt, Pseudomonas putida KT2440
gguaguuggccggg

SEQ ID NO: 1611964 - RNA, 17 nt, Pseudomonas putida KT2440
gguaucacgcuccugca

SEQ ID NO: 1611965 - RNA, 14 nt, Pseudomonas putida KT2440
gguaucgagcacuu

SEQ ID NO: 1611966 - RNA, 23 nt, Pseudomonas putida KT2440
gguaucgaugcacagcucgcgcu

SEQ ID NO: 1611967 - RNA, 15 nt, Pseudomonas putida KT2440
gguacagauggcacc

SEQ ID NO: 1611968 - RNA, 14 nt, Pseudomonas putida KT2440
gguacagcacugca

SEQ ID NO: 1611969 - RNA, 19 nt, Pseudomonas putida KT2440
gguacaacaacaaaaaaaa

SEQ ID NO: 1611970 - RNA, 16 nt, Pseudomonas putida KT2440
gguacccgccagcaau

SEQ ID NO: 1611971 - RNA, 13 nt, Pseudomonas putida KT2440
gguaccagcaggc

SEQ ID NO: 1611972 - RNA, 15 nt, Pseudomonas putida KT2440
gguacagggucagga

SEQ ID NO: 1611973 - RNA, 18 nt, Pseudomonas putida KT2440
gguacagcucacuggcca

SEQ ID NO: 1611974 - RNA, 20 nt, Pseudomonas putida KT2440
gguacagcucacuggccaac

SEQ ID NO: 1611975 - RNA, 17 nt, Pseudomonas putida KT2440
gguacaggcaaagaaac

SEQ ID NO: 1611976 - RNA, 21 nt, Pseudomonas putida KT2440
gguaccuguggggcaacugcg

SEQ ID NO: 1611977 - RNA, 15 nt, Pseudomonas putida KT2440
gguaccgccguccac

SEQ ID NO: 1611978 - RNA, 19 nt, Pseudomonas putida KT2440
gguaccgucgaucagcuuc

SEQ ID NO: 1611979 - RNA, 12 nt, Pseudomonas putida KT2440
gguaccgugcug

SEQ ID NO: 1611980 - RNA, 22 nt, Pseudomonas putida KT2440
gguaccgugcugcaggcuggca

SEQ ID NO: 1611981 - RNA, 17 nt, Pseudomonas putida KT2440
gguaccggccagcugcg

SEQ ID NO: 1611982 - RNA, 17 nt, Pseudomonas putida KT2440
gguaccgcucugcgcca

SEQ ID NO: 1611983 - RNA, 15 nt, Pseudomonas putida KT2440
gguacgcgcaggcag

SEQ ID NO: 1611984 - RNA, 21 nt, Pseudomonas putida KT2440
gguacggguucaagggcaggg

SEQ ID NO: 1611985 - RNA, 19 nt, Pseudomonas putida KT2440
gguacucgcccgccaggua

SEQ ID NO: 1611986 - RNA, 18 nt, Pseudomonas putida KT2440
gguagaccuucuggcagc

SEQ ID NO: 1611987 - RNA, 22 nt, Pseudomonas putida KT2440
gguagcacgggcgcugaagcca

SEQ ID NO: 1611988 - RNA, 18 nt, Pseudomonas putida KT2440
gguagcgcccgggcauca

SEQ ID NO: 1611989 - RNA, 13 nt, Pseudomonas putida KT2440
gguagcggccagc

SEQ ID NO: 1611990 - RNA, 17 nt, Pseudomonas putida KT2440
gguagcggccagcccgc

SEQ ID NO: 1611991 - RNA, 14 nt, Pseudomonas putida KT2440
gguagccguggcug

SEQ ID NO: 1611992 - RNA, 17 nt, Pseudomonas putida KT2440
gguagccucgacccgcu

SEQ ID NO: 1611993 - RNA, 13 nt, Pseudomonas putida KT2440
gggugccagacca

SEQ ID NO: 1611994 - RNA, 14 nt, Pseudomonas putida KT2440
gggugccaucaggg

SEQ ID NO: 1611995 - RNA, 22 nt, Pseudomonas putida KT2440
ggguggaaguuccugcucucgg

SEQ ID NO: 1611996 - RNA, 19 nt, Pseudomonas putida KT2440
ggguggaaauuggccagca

SEQ ID NO: 1611997 - RNA, 21 nt, Pseudomonas putida KT2440
ggguggaaauuggcgagcagg

SEQ ID NO: 1611998 - RNA, 13 nt, Pseudomonas putida KT2440
gggugcucugccg

SEQ ID NO: 1611999 - RNA, 16 nt, Pseudomonas putida KT2440
ggguucacagccggca

SEQ ID NO: 1612000 - RNA, 17 nt, Pseudomonas putida KT2440
ggguuaccuugaucugu

SEQ ID NO: 1612001 - RNA, 15 nt, Pseudomonas putida KT2440
ggguggugucgcugu

SEQ ID NO: 1612002 - RNA, 20 nt, Pseudomonas putida KT2440
ggguguauugccgccgggcc

SEQ ID NO: 1612003 - RNA, 17 nt, Pseudomonas putida KT2440
gggugucaacaggcugg

SEQ ID NO: 1612004 - RNA, 13 nt, Pseudomonas putida KT2440
ggguguggccaau

SEQ ID NO: 1612005 - RNA, 23 nt, Pseudomonas putida KT2440
gggugucgguggcggccagcgca

SEQ ID NO: 1612006 - RNA, 17 nt, Pseudomonas putida KT2440
ggguguuggcugugaga

SEQ ID NO: 1612007 - RNA, 12 nt, Pseudomonas putida KT2440
gguaauuggccg

SEQ ID NO: 1612008 - RNA, 17 nt, Pseudomonas putida KT2440
gguaauggccggcugug

SEQ ID NO: 1612009 - RNA, 12 nt, Pseudomonas putida KT2440
gguaaucagcuu

SEQ ID NO: 1612010 - RNA, 17 nt, Pseudomonas putida KT2440
gguaauaccacaucccc

SEQ ID NO: 1612011 - RNA, 16 nt, Pseudomonas putida KT2440
gguaacggcucugaca

SEQ ID NO: 1612012 - RNA, 20 nt, Pseudomonas putida KT2440
gguaagccaugcgcaggcag

SEQ ID NO: 1612013 - RNA, 17 nt, Pseudomonas putida KT2440
gguaacguuggccgggg

SEQ ID NO: 1612014 - RNA, 22 nt, Pseudomonas putida KT2440
ggguuuauuucucuuccuggcu

SEQ ID NO: 1612015 - RNA, 21 nt, Pseudomonas putida KT2440
ggguuuacccgcgaagaagcc

SEQ ID NO: 1612016 - RNA, 13 nt, Pseudomonas putida KT2440
ggguuugaagccc

SEQ ID NO: 1612017 - RNA, 23 nt, Pseudomonas putida KT2440
ggguuuucaaaaguuggcacgca

SEQ ID NO: 1612018 - RNA, 18 nt, Pseudomonas putida KT2440
gguaaacccgcuccuaca

SEQ ID NO: 1612019 - RNA, 14 nt, Pseudomonas putida KT2440
gguaaaacagccuu

SEQ ID NO: 1612020 - RNA, 18 nt, Pseudomonas putida KT2440
gguaaccgccugaaauuu

SEQ ID NO: 1612021 - RNA, 14 nt, Pseudomonas putida KT2440
gggcggcgcccagu

SEQ ID NO: 1612022 - RNA, 18 nt, Pseudomonas putida KT2440
gggcguaaagcgccccag

SEQ ID NO: 1612023 - RNA, 13 nt, Pseudomonas putida KT2440
gggcgugccaggc

SEQ ID NO: 1612024 - RNA, 18 nt, Pseudomonas putida KT2440
gggcgucggucgccccca

SEQ ID NO: 1612025 - RNA, 20 nt, Pseudomonas putida KT2440
gggcucugugggagcgggcu

SEQ ID NO: 1612026 - RNA, 19 nt, Pseudomonas putida KT2440
gggcugcauugcagcccca

SEQ ID NO: 1612027 - RNA, 20 nt, Pseudomonas putida KT2440
gggcugcaccgcagccccag

SEQ ID NO: 1612028 - RNA, 19 nt, Pseudomonas putida KT2440
gggcugauugagcagcugg

SEQ ID NO: 1612029 - RNA, 19 nt, Pseudomonas putida KT2440
gggcugcaaagcagccccc

SEQ ID NO: 1612030 - RNA, 20 nt, Pseudomonas putida KT2440
gggcugcaaagcagccccca

SEQ ID NO: 1612031 - RNA, 21 nt, Pseudomonas putida KT2440
gggcugcaaagcagccccggc

SEQ ID NO: 1612032 - RNA, 19 nt, Pseudomonas putida KT2440
gggcuacaugaaccacaca

SEQ ID NO: 1612033 - RNA, 22 nt, Pseudomonas putida KT2440
gggcuacacgcgcccuguggga

SEQ ID NO: 1612034 - RNA, 23 nt, Pseudomonas putida KT2440
gggcuacgaucaaaugaucgcca

SEQ ID NO: 1612035 - RNA, 17 nt, Pseudomonas putida KT2440
gggcucaauagcggcgg

SEQ ID NO: 1612036 - RNA, 13 nt, Pseudomonas putida KT2440
gggcucagccgcc

SEQ ID NO: 1612037 - RNA, 14 nt, Pseudomonas putida KT2440
gggcuaaaaccggu

SEQ ID NO: 1612038 - RNA, 20 nt, Pseudomonas putida KT2440
gggcguuguguugcugggcg

SEQ ID NO: 1612039 - RNA, 17 nt, Pseudomonas putida KT2440
gggcguuccagccaggc

SEQ ID NO: 1612040 - RNA, 12 nt, Pseudomonas putida KT2440
gggcgcugucgg

SEQ ID NO: 1612041 - RNA, 22 nt, Pseudomonas putida KT2440
gggcgcuaccgaggucugcgcg

SEQ ID NO: 1612042 - RNA, 20 nt, Pseudomonas putida KT2440
gggcgcuggaagugcugaga

SEQ ID NO: 1612043 - RNA, 14 nt, Pseudomonas putida KT2440
gggcgcugaagcca

SEQ ID NO: 1612044 - RNA, 22 nt, Pseudomonas putida KT2440
gggcgcgauugccuuccuugaa

SEQ ID NO: 1612045 - RNA, 19 nt, Pseudomonas putida KT2440
gggcgcagagcgccccggc

SEQ ID NO: 1612046 - RNA, 19 nt, Pseudomonas putida KT2440
gggcgcaaugcgccccggc

SEQ ID NO: 1612047 - RNA, 19 nt, Pseudomonas putida KT2440
gggcgagcaggugacccug

SEQ ID NO: 1612048 - RNA, 16 nt, Pseudomonas putida KT2440
gggcgagcgcgcaggc

SEQ ID NO: 1612049 - RNA, 18 nt, Pseudomonas putida KT2440
gggcgagcgcgcaggcgg

SEQ ID NO: 1612050 - RNA, 23 nt, Pseudomonas putida KT2440
gggcgaugcccuucaggccccag

SEQ ID NO: 1612051 - RNA, 18 nt, Pseudomonas putida KT2440
gggcgacagacagggccu

SEQ ID NO: 1612052 - RNA, 18 nt, Pseudomonas putida KT2440
gggccuugaucugcugcg

SEQ ID NO: 1612053 - RNA, 21 nt, Pseudomonas putida KT2440
gggccuuguuauccaggcugg

SEQ ID NO: 1612054 - RNA, 21 nt, Pseudomonas putida KT2440
gggccuuuccgcacucaggug

SEQ ID NO: 1612055 - RNA, 16 nt, Pseudomonas putida KT2440
gggcgaaauggcgaau

SEQ ID NO: 1612056 - RNA, 19 nt, Pseudomonas putida KT2440
gggccguuacucccacagc

SEQ ID NO: 1612057 - RNA, 20 nt, Pseudomonas putida KT2440
gggccugacgugcgcggggc

SEQ ID NO: 1612058 - RNA, 17 nt, Pseudomonas putida KT2440
gggccugaccgcccagc

SEQ ID NO: 1612059 - RNA, 22 nt, Pseudomonas putida KT2440
gggccugcacgaucgaccgggu

SEQ ID NO: 1612060 - RNA, 15 nt, Pseudomonas putida KT2440
gggccuggagcaagg

SEQ ID NO: 1612061 - RNA, 10 nt, Pseudomonas putida KT2440
gggccugugc

SEQ ID NO: 1612062 - RNA, 16 nt, Pseudomonas putida KT2440
gggccugugccgggcc

SEQ ID NO: 1612063 - RNA, 22 nt, Pseudomonas putida KT2440
gggccgggcacgacacuccgcu

SEQ ID NO: 1612064 - RNA, 14 nt, Pseudomonas putida KT2440
gggccggcacaggc

SEQ ID NO: 1612065 - RNA, 17 nt, Pseudomonas putida KT2440
gggccgcuugcucaggc

SEQ ID NO: 1612066 - RNA, 18 nt, Pseudomonas putida KT2440
gggccgcuuggcggcccu

SEQ ID NO: 1612067 - RNA, 13 nt, Pseudomonas putida KT2440
gggccggcgcccu

SEQ ID NO: 1612068 - RNA, 18 nt, Pseudomonas putida KT2440
gggcccucaacccucgcc

SEQ ID NO: 1612069 - RNA, 17 nt, Pseudomonas putida KT2440
gggccgaaaggugcagc

SEQ ID NO: 1612070 - RNA, 20 nt, Pseudomonas putida KT2440
gggccgcaaagcggccccag

SEQ ID NO: 1612071 - RNA, 19 nt, Pseudomonas putida KT2440
gggccgcaaagcggccccc

SEQ ID NO: 1612072 - RNA, 20 nt, Pseudomonas putida KT2440
gggccgccaagcggccccaa

SEQ ID NO: 1612073 - RNA, 20 nt, Pseudomonas putida KT2440
gggccgccaagcggccccag

SEQ ID NO: 1612074 - RNA, 20 nt, Pseudomonas putida KT2440
gggccgcgcuuggcggcccu

SEQ ID NO: 1612075 - RNA, 12 nt, Pseudomonas putida KT2440
gggccgcgcagg

SEQ ID NO: 1612076 - RNA, 20 nt, Pseudomonas putida KT2440
gggccgcgacgcggccccag

SEQ ID NO: 1612077 - RNA, 13 nt, Pseudomonas putida KT2440
gggccgccuugcg

SEQ ID NO: 1612078 - RNA, 21 nt, Pseudomonas putida KT2440
gggccaggcuuuccagguccu

SEQ ID NO: 1612079 - RNA, 12 nt, Pseudomonas putida KT2440
gggccagccgcg

SEQ ID NO: 1612080 - RNA, 17 nt, Pseudomonas putida KT2440
gggccagccgcgccagg

SEQ ID NO: 1612081 - RNA, 18 nt, Pseudomonas putida KT2440
gggccagccgcgccaggu

SEQ ID NO: 1612082 - RNA, 19 nt, Pseudomonas putida KT2440
gggccagccgcgccagguc

SEQ ID NO: 1612083 - RNA, 21 nt, Pseudomonas putida KT2440
gggccagcggcuuuucuuuac

SEQ ID NO: 1612084 - RNA, 17 nt, Pseudomonas putida KT2440
gggccaugcccaccgca

SEQ ID NO: 1612085 - RNA, 17 nt, Pseudomonas putida KT2440
gggccauucgcgggcau

SEQ ID NO: 1612086 - RNA, 22 nt, Pseudomonas putida KT2440
gggcccagcaggugcccaagcg

SEQ ID NO: 1612087 - RNA, 18 nt, Pseudomonas putida KT2440
gggccccaccaggcaccg

SEQ ID NO: 1612088 - RNA, 13 nt, Pseudomonas putida KT2440
gggccccaggcgg

SEQ ID NO: 1612089 - RNA, 13 nt, Pseudomonas putida KT2440
gggcccgcccagc

SEQ ID NO: 1612090 - RNA, 14 nt, Pseudomonas putida KT2440
gggcccgcagggcc

SEQ ID NO: 1612091 - RNA, 15 nt, Pseudomonas putida KT2440
gggccaaguggcugg

SEQ ID NO: 1612092 - RNA, 15 nt, Pseudomonas putida KT2440
gggcauggccgcccu

SEQ ID NO: 1612093 - RNA, 20 nt, Pseudomonas putida KT2440
gggcaucgaucccuggggcc

SEQ ID NO: 1612094 - RNA, 19 nt, Pseudomonas putida KT2440
gggugaacccgcuccugca

SEQ ID NO: 1612095 - RNA, 17 nt, Pseudomonas putida KT2440
gggucucgcggcuggug

SEQ ID NO: 1612096 - RNA, 18 nt, Pseudomonas putida KT2440
gggucugcccggccagca

SEQ ID NO: 1612097 - RNA, 23 nt, Pseudomonas putida KT2440
gggucgcugccgugcaggucagc

SEQ ID NO: 1612098 - RNA, 18 nt, Pseudomonas putida KT2440
gggucgaccugggccagg

SEQ ID NO: 1612099 - RNA, 19 nt, Pseudomonas putida KT2440
gggucgaccugggccaggu

SEQ ID NO: 1612100 - RNA, 13 nt, Pseudomonas putida KT2440
gggucgagccagg

SEQ ID NO: 1612101 - RNA, 15 nt, Pseudomonas putida KT2440
gggucgagccaggcg

SEQ ID NO: 1612102 - RNA, 19 nt, Pseudomonas putida KT2440
gggucgacgcgcaagcuga

SEQ ID NO: 1612103 - RNA, 15 nt, Pseudomonas putida KT2440
gggucgcccgcaaca

SEQ ID NO: 1612104 - RNA, 13 nt, Pseudomonas putida KT2440
gggucagcuccuc

SEQ ID NO: 1612105 - RNA, 13 nt, Pseudomonas putida KT2440
gggucagcggggu

SEQ ID NO: 1612106 - RNA, 17 nt, Pseudomonas putida KT2440
gggucaguucagccagg

SEQ ID NO: 1612107 - RNA, 21 nt, Pseudomonas putida KT2440
gggucaggucgcugugcggcg

SEQ ID NO: 1612108 - RNA, 16 nt, Pseudomonas putida KT2440
gggucaggugcggggc

SEQ ID NO: 1612109 - RNA, 16 nt, Pseudomonas putida KT2440
gggucaugccaccgcc

SEQ ID NO: 1612110 - RNA, 22 nt, Pseudomonas putida KT2440
gggucauugcugaucccugccc

SEQ ID NO: 1612111 - RNA, 22 nt, Pseudomonas putida KT2440
gggucccugguucgaguccagg

SEQ ID NO: 1612112 - RNA, 17 nt, Pseudomonas putida KT2440
ggguaugccacgacacc

SEQ ID NO: 1612113 - RNA, 17 nt, Pseudomonas putida KT2440
gggucaaggccagcgcc

SEQ ID NO: 1612114 - RNA, 23 nt, Pseudomonas putida KT2440
gggucacucccgggaucaccgca

SEQ ID NO: 1612115 - RNA, 20 nt, Pseudomonas putida KT2440
gggucacggcugaagaagcu

SEQ ID NO: 1612116 - RNA, 20 nt, Pseudomonas putida KT2440
gggggcucaauagcggcggu

SEQ ID NO: 1612117 - RNA, 18 nt, Pseudomonas putida KT2440
gggggcguaaagcgcccc

SEQ ID NO: 1612118 - RNA, 19 nt, Pseudomonas putida KT2440
ggggugcaaagcgccccca

SEQ ID NO: 1612119 - RNA, 12 nt, Pseudomonas putida KT2440
ggggugagcggc

SEQ ID NO: 1612120 - RNA, 15 nt, Pseudomonas putida KT2440
ggggucugcccggcc

SEQ ID NO: 1612121 - RNA, 18 nt, Pseudomonas putida KT2440
ggggucugcccggccagc

SEQ ID NO: 1612122 - RNA, 19 nt, Pseudomonas putida KT2440
ggggucugcccggccagca

SEQ ID NO: 1612123 - RNA, 13 nt, Pseudomonas putida KT2440
ggggugaggggau

SEQ ID NO: 1612124 - RNA, 19 nt, Pseudomonas putida KT2440
gggguguuacgccaggcgu

SEQ ID NO: 1612125 - RNA, 14 nt, Pseudomonas putida KT2440
ggguacuccaccac

SEQ ID NO: 1612126 - RNA, 23 nt, Pseudomonas putida KT2440
ggguagaccuucuggcagccgcc

SEQ ID NO: 1612127 - RNA, 21 nt, Pseudomonas putida KT2440
ggguaaucgccaggcccagcc

SEQ ID NO: 1612128 - RNA, 20 nt, Pseudomonas putida KT2440
ggguagccagcccaggcugg

SEQ ID NO: 1612129 - RNA, 17 nt, Pseudomonas putida KT2440
ggguagccccgaggaag

SEQ ID NO: 1612130 - RNA, 14 nt, Pseudomonas putida KT2440
ggguaguccuccaa

SEQ ID NO: 1612131 - RNA, 16 nt, Pseudomonas putida KT2440
ggguaagccggcggcc

SEQ ID NO: 1612132 - RNA, 16 nt, Pseudomonas putida KT2440
ggguaaacccauuccu

SEQ ID NO: 1612133 - RNA, 18 nt, Pseudomonas putida KT2440
ggguaaucaguaccaggc

SEQ ID NO: 1612134 - RNA, 18 nt, Pseudomonas putida KT2440
gggcuguuccagcagcga

SEQ ID NO: 1612135 - RNA, 18 nt, Pseudomonas putida KT2440
gggcugcugcgcagccca

SEQ ID NO: 1612136 - RNA, 17 nt, Pseudomonas putida KT2440
gggcugcgcggcagccc

SEQ ID NO: 1612137 - RNA, 13 nt, Pseudomonas putida KT2440
gggcuucgagcag

SEQ ID NO: 1612138 - RNA, 21 nt, Pseudomonas putida KT2440
gggcuucuaccugagcuucaa

SEQ ID NO: 1612139 - RNA, 22 nt, Pseudomonas putida KT2440
gggcuugggaaugugucagggc

SEQ ID NO: 1612140 - RNA, 19 nt, Pseudomonas putida KT2440
gggcuuuuacuugagucug

SEQ ID NO: 1612141 - RNA, 16 nt, Pseudomonas putida KT2440
ggggaauggcccagcc

SEQ ID NO: 1612142 - RNA, 16 nt, Pseudomonas putida KT2440
ggggacuccggccggg

SEQ ID NO: 1612143 - RNA, 19 nt, Pseudomonas putida KT2440
ggggaucgggauguucagg

SEQ ID NO: 1612144 - RNA, 12 nt, Pseudomonas putida KT2440
ggggcaacugcg

SEQ ID NO: 1612145 - RNA, 23 nt, Pseudomonas putida KT2440
ggggcaacugcgcgauagccugu

SEQ ID NO: 1612146 - RNA, 12 nt, Pseudomonas putida KT2440
ggggcagcauca

SEQ ID NO: 1612147 - RNA, 15 nt, Pseudomonas putida KT2440
ggggccgcgcagcgg

SEQ ID NO: 1612148 - RNA, 13 nt, Pseudomonas putida KT2440
ggggccaggcgcg

SEQ ID NO: 1612149 - RNA, 21 nt, Pseudomonas putida KT2440
ggggcaggcccggcagguuga

SEQ ID NO: 1612150 - RNA, 16 nt, Pseudomonas putida KT2440
ggggcagugcccaguc

SEQ ID NO: 1612151 - RNA, 12 nt, Pseudomonas putida KT2440
ggggcaggcugu

SEQ ID NO: 1612152 - RNA, 13 nt, Pseudomonas putida KT2440
ggggcaggcugug

SEQ ID NO: 1612153 - RNA, 14 nt, Pseudomonas putida KT2440
ggggcgcuccagca

SEQ ID NO: 1612154 - RNA, 13 nt, Pseudomonas putida KT2440
ggggcgcuggaag

SEQ ID NO: 1612155 - RNA, 13 nt, Pseudomonas putida KT2440
ggggccgcucugc

SEQ ID NO: 1612156 - RNA, 16 nt, Pseudomonas putida KT2440
ggggccgcuuggcggc

SEQ ID NO: 1612157 - RNA, 19 nt, Pseudomonas putida KT2440
ggggcugcaaugcagcccc

SEQ ID NO: 1612158 - RNA, 22 nt, Pseudomonas putida KT2440
ggggcugacgcgccgugccagg

SEQ ID NO: 1612159 - RNA, 17 nt, Pseudomonas putida KT2440
ggggcugcugcgcagcc

SEQ ID NO: 1612160 - RNA, 21 nt, Pseudomonas putida KT2440
ggggcugcugcgcagccccaa

SEQ ID NO: 1612161 - RNA, 20 nt, Pseudomonas putida KT2440
ggggcugcuuugcagcccau

SEQ ID NO: 1612162 - RNA, 17 nt, Pseudomonas putida KT2440
gggggcagugcccaguc

SEQ ID NO: 1612163 - RNA, 20 nt, Pseudomonas putida KT2440
gggggcgacagacagggccu

SEQ ID NO: 1612164 - RNA, 16 nt, Pseudomonas putida KT2440
gggggccccaccaggc

SEQ ID NO: 1612165 - RNA, 23 nt, Pseudomonas putida KT2440
gggggccccaccaggcaccgagu

SEQ ID NO: 1612166 - RNA, 17 nt, Pseudomonas putida KT2440
ggggcguuuaaaccuuc

SEQ ID NO: 1612167 - RNA, 17 nt, Pseudomonas putida KT2440
ggggcggguggaggugc

SEQ ID NO: 1612168 - RNA, 21 nt, Pseudomonas putida KT2440
ggggcgggugggugcagcuga

SEQ ID NO: 1612169 - RNA, 15 nt, Pseudomonas putida KT2440
gggagcgggcgcgcc

SEQ ID NO: 1612170 - RNA, 20 nt, Pseudomonas putida KT2440
gggagcgggcgcgcccgcga

SEQ ID NO: 1612171 - RNA, 16 nt, Pseudomonas putida KT2440
gggagcgggcgugccc

SEQ ID NO: 1612172 - RNA, 20 nt, Pseudomonas putida KT2440
gggagcgggcgugcccgcga

SEQ ID NO: 1612173 - RNA, 15 nt, Pseudomonas putida KT2440
gggagcgggcuugcc

SEQ ID NO: 1612174 - RNA, 13 nt, Pseudomonas putida KT2440
gggagcguagaac

SEQ ID NO: 1612175 - RNA, 21 nt, Pseudomonas putida KT2440
gggagcggccuugugcggccc

SEQ ID NO: 1612176 - RNA, 20 nt, Pseudomonas putida KT2440
gggacagccacaugccagcu

SEQ ID NO: 1612177 - RNA, 18 nt, Pseudomonas putida KT2440
gggaauugcagcccgcag

SEQ ID NO: 1612178 - RNA, 16 nt, Pseudomonas putida KT2440
gggaagguggccggca

SEQ ID NO: 1612179 - RNA, 16 nt, Pseudomonas putida KT2440
gggaaguccgccagga

SEQ ID NO: 1612180 - RNA, 22 nt, Pseudomonas putida KT2440
ggcuuuuuuuugccuggaauuc

SEQ ID NO: 1612181 - RNA, 17 nt, Pseudomonas putida KT2440
ggcuuuuuugugccuca

SEQ ID NO: 1612182 - RNA, 13 nt, Pseudomonas putida KT2440
ggcuuuuuuugcc

SEQ ID NO: 1612183 - RNA, 21 nt, Pseudomonas putida KT2440
ggcuuuuuuauugccuuugaa

SEQ ID NO: 1612184 - RNA, 17 nt, Pseudomonas putida KT2440
ggcuuucguaggagcgg

SEQ ID NO: 1612185 - RNA, 21 nt, Pseudomonas putida KT2440
ggcuuugaaagguuuauugua

SEQ ID NO: 1612186 - RNA, 16 nt, Pseudomonas putida KT2440
gggaagaugcacacca

SEQ ID NO: 1612187 - RNA, 20 nt, Pseudomonas putida KT2440
gggaagaugcacaccaguuc

SEQ ID NO: 1612188 - RNA, 22 nt, Pseudomonas putida KT2440
gggaagcgcccgcccaccacca

SEQ ID NO: 1612189 - RNA, 16 nt, Pseudomonas putida KT2440
gggaagcugcagcagc

SEQ ID NO: 1612190 - RNA, 16 nt, Pseudomonas putida KT2440
gggaacagcucuggca

SEQ ID NO: 1612191 - RNA, 17 nt, Pseudomonas putida KT2440
gggaacagcucuggcag

SEQ ID NO: 1612192 - RNA, 11 nt, Pseudomonas putida KT2440
gggaacagcag

SEQ ID NO: 1612193 - RNA, 12 nt, Pseudomonas putida KT2440
gggaacagcagc

SEQ ID NO: 1612194 - RNA, 18 nt, Pseudomonas putida KT2440
gggaaaccgugucgggca

SEQ ID NO: 1612195 - RNA, 20 nt, Pseudomonas putida KT2440
gggaucgcgcaagccuuugc

SEQ ID NO: 1612196 - RNA, 18 nt, Pseudomonas putida KT2440
gggaucgagaucaggugg

SEQ ID NO: 1612197 - RNA, 15 nt, Pseudomonas putida KT2440
gggauaucaggcccu

SEQ ID NO: 1612198 - RNA, 22 nt, Pseudomonas putida KT2440
gggaucaccgcaagcugcaccg

SEQ ID NO: 1612199 - RNA, 20 nt, Pseudomonas putida KT2440
gggauaccggugucuuccgg

SEQ ID NO: 1612200 - RNA, 16 nt, Pseudomonas putida KT2440
gggauagagccgccuu

SEQ ID NO: 1612201 - RNA, 18 nt, Pseudomonas putida KT2440
gggagucgaaccugcccg

SEQ ID NO: 1612202 - RNA, 19 nt, Pseudomonas putida KT2440
gggagucgaaccugcccgg

SEQ ID NO: 1612203 - RNA, 23 nt, Pseudomonas putida KT2440
gggaguaacggcccuugcucaau

SEQ ID NO: 1612204 - RNA, 18 nt, Pseudomonas putida KT2440
gggaugcagucgaccggg

SEQ ID NO: 1612205 - RNA, 17 nt, Pseudomonas putida KT2440
gggaucuugcuggccgg

SEQ ID NO: 1612206 - RNA, 20 nt, Pseudomonas putida KT2440
gggauggcaccggcucugcc

SEQ ID NO: 1612207 - RNA, 14 nt, Pseudomonas putida KT2440
gggauggcggcgcc

SEQ ID NO: 1612208 - RNA, 14 nt, Pseudomonas putida KT2440
gggcaaacaggcug

SEQ ID NO: 1612209 - RNA, 21 nt, Pseudomonas putida KT2440
gggcaaaaugcagcaagcugg

SEQ ID NO: 1612210 - RNA, 12 nt, Pseudomonas putida KT2440
gggcaaaaaagu

SEQ ID NO: 1612211 - RNA, 20 nt, Pseudomonas putida KT2440
gggcaagcccgcacccacag

SEQ ID NO: 1612212 - RNA, 13 nt, Pseudomonas putida KT2440
gggcaaagcccau

SEQ ID NO: 1612213 - RNA, 17 nt, Pseudomonas putida KT2440
gggcaaagcccauuucg

SEQ ID NO: 1612214 - RNA, 14 nt, Pseudomonas putida KT2440
gggcaagugcgugc

SEQ ID NO: 1612215 - RNA, 17 nt, Pseudomonas putida KT2440
gggcaagugcgugcaag

SEQ ID NO: 1612216 - RNA, 12 nt, Pseudomonas putida KT2440
gggcaaucgcca

SEQ ID NO: 1612217 - RNA, 19 nt, Pseudomonas putida KT2440
gggcacacuucgccgugcu

SEQ ID NO: 1612218 - RNA, 14 nt, Pseudomonas putida KT2440
gggcacaggcccag

SEQ ID NO: 1612219 - RNA, 12 nt, Pseudomonas putida KT2440
gggcacaggccg

SEQ ID NO: 1612220 - RNA, 19 nt, Pseudomonas putida KT2440
gggcacaggccgcgcauga

SEQ ID NO: 1612221 - RNA, 15 nt, Pseudomonas putida KT2440
gggcaaugcaggcag

SEQ ID NO: 1612222 - RNA, 15 nt, Pseudomonas putida KT2440
gggcaauguccagcc

SEQ ID NO: 1612223 - RNA, 18 nt, Pseudomonas putida KT2440
gggcaauguccaggugcu

SEQ ID NO: 1612224 - RNA, 13 nt, Pseudomonas putida KT2440
gggcacugcccgg

SEQ ID NO: 1612225 - RNA, 16 nt, Pseudomonas putida KT2440
gggcaccggccaccag

SEQ ID NO: 1612226 - RNA, 17 nt, Pseudomonas putida KT2440
gggcaccggccaccagg

SEQ ID NO: 1612227 - RNA, 22 nt, Pseudomonas putida KT2440
gggcaccggccaccaggcgcgg

SEQ ID NO: 1612228 - RNA, 13 nt, Pseudomonas putida KT2440
gggcacggcugcc

SEQ ID NO: 1612229 - RNA, 22 nt, Pseudomonas putida KT2440
gggcacgccaaucaccugcaca

SEQ ID NO: 1612230 - RNA, 23 nt, Pseudomonas putida KT2440
gggcagaguaaccgcggcugacg

SEQ ID NO: 1612231 - RNA, 15 nt, Pseudomonas putida KT2440
gggcagccgucggcg

SEQ ID NO: 1612232 - RNA, 17 nt, Pseudomonas putida KT2440
gggcagcgggcucgccc

SEQ ID NO: 1612233 - RNA, 23 nt, Pseudomonas putida KT2440
gggcaggccaugcccgcccgggc

SEQ ID NO: 1612234 - RNA, 23 nt, Pseudomonas putida KT2440
gggcaggcugauggauuccucgc

SEQ ID NO: 1612235 - RNA, 18 nt, Pseudomonas putida KT2440
ggcuggcgggguggccgg

SEQ ID NO: 1612236 - RNA, 13 nt, Pseudomonas putida KT2440
ggcuggccagcaa

SEQ ID NO: 1612237 - RNA, 12 nt, Pseudomonas putida KT2440
ggcuggcagccg

SEQ ID NO: 1612238 - RNA, 14 nt, Pseudomonas putida KT2440
ggcuggcagcgggc

SEQ ID NO: 1612239 - RNA, 20 nt, Pseudomonas putida KT2440
ggcuggcagcugcagugcug

SEQ ID NO: 1612240 - RNA, 21 nt, Pseudomonas putida KT2440
ggcuggcagcugcagugcugg

SEQ ID NO: 1612241 - RNA, 21 nt, Pseudomonas putida KT2440
ggcuggcauaguccaggaagc

SEQ ID NO: 1612242 - RNA, 20 nt, Pseudomonas putida KT2440
ggcuggcauucaacgcccgc

SEQ ID NO: 1612243 - RNA, 19 nt, Pseudomonas putida KT2440
ggcuggacuaacaggugcu

SEQ ID NO: 1612244 - RNA, 22 nt, Pseudomonas putida KT2440
ggcuggagagguacacccccag

SEQ ID NO: 1612245 - RNA, 22 nt, Pseudomonas putida KT2440
ggcugcguuuaccggcaccgcc

SEQ ID NO: 1612246 - RNA, 14 nt, Pseudomonas putida KT2440
ggcugcgugccugc

SEQ ID NO: 1612247 - RNA, 15 nt, Pseudomonas putida KT2440
ggcugcugugguuug

SEQ ID NO: 1612248 - RNA, 17 nt, Pseudomonas putida KT2440
ggcuggacaccucccgc

SEQ ID NO: 1612249 - RNA, 17 nt, Pseudomonas putida KT2440
ggcugggccccaggcgg

SEQ ID NO: 1612250 - RNA, 20 nt, Pseudomonas putida KT2440
ggcugggucacccaggugag

SEQ ID NO: 1612251 - RNA, 17 nt, Pseudomonas putida KT2440
ggcugguauugccuggc

SEQ ID NO: 1612252 - RNA, 20 nt, Pseudomonas putida KT2440
ggcuggugaaggcaggucag

SEQ ID NO: 1612253 - RNA, 21 nt, Pseudomonas putida KT2440
ggcuggugaaggcaggucagc

SEQ ID NO: 1612254 - RNA, 19 nt, Pseudomonas putida KT2440
ggcuggugacaacgcccgc

SEQ ID NO: 1612255 - RNA, 15 nt, Pseudomonas putida KT2440
ggcugguggcggcau

SEQ ID NO: 1612256 - RNA, 22 nt, Pseudomonas putida KT2440
ggcugucggcgucggccaugcc

SEQ ID NO: 1612257 - RNA, 15 nt, Pseudomonas putida KT2440
ggcuguaccggccuc

SEQ ID NO: 1612258 - RNA, 12 nt, Pseudomonas putida KT2440
ggcugucacgau

SEQ ID NO: 1612259 - RNA, 16 nt, Pseudomonas putida KT2440
ggcuguauagcccugc

SEQ ID NO: 1612260 - RNA, 18 nt, Pseudomonas putida KT2440
ggcuguuucagcccuugc

SEQ ID NO: 1612261 - RNA, 17 nt, Pseudomonas putida KT2440
ggcuguucgucggccuu

SEQ ID NO: 1612262 - RNA, 15 nt, Pseudomonas putida KT2440
ggcuguuccauuucc

SEQ ID NO: 1612263 - RNA, 18 nt, Pseudomonas putida KT2440
ggcuguuccauuucccua

SEQ ID NO: 1612264 - RNA, 17 nt, Pseudomonas putida KT2440
ggcuuccccagccuuca

SEQ ID NO: 1612265 - RNA, 23 nt, Pseudomonas putida KT2440
ggcuucccgguaacgggccagcc

SEQ ID NO: 1612266 - RNA, 16 nt, Pseudomonas putida KT2440
ggcuuccagucggccu

SEQ ID NO: 1612267 - RNA, 13 nt, Pseudomonas putida KT2440
ggcuuccagcgau

SEQ ID NO: 1612268 - RNA, 19 nt, Pseudomonas putida KT2440
ggcuucagguucacuucca

SEQ ID NO: 1612269 - RNA, 16 nt, Pseudomonas putida KT2440
ggcuucuucgcgggca

SEQ ID NO: 1612270 - RNA, 17 nt, Pseudomonas putida KT2440
ggcuucuuugcaagccu

SEQ ID NO: 1612271 - RNA, 18 nt, Pseudomonas putida KT2440
ggcuugaaucccugagcc

SEQ ID NO: 1612272 - RNA, 22 nt, Pseudomonas putida KT2440
ggcuugauccgcgcuaccuggu

SEQ ID NO: 1612273 - RNA, 14 nt, Pseudomonas putida KT2440
ggcuucuaccacug

SEQ ID NO: 1612274 - RNA, 15 nt, Pseudomonas putida KT2440
ggcuucuaccacugg

SEQ ID NO: 1612275 - RNA, 16 nt, Pseudomonas putida KT2440
ggcuucuaccacuggg

SEQ ID NO: 1612276 - RNA, 17 nt, Pseudomonas putida KT2440
ggcuugcucaagguguc

SEQ ID NO: 1612277 - RNA, 18 nt, Pseudomonas putida KT2440
ggcuuggcuucggcggcu

SEQ ID NO: 1612278 - RNA, 15 nt, Pseudomonas putida KT2440
ggcuuggcacgcugg

SEQ ID NO: 1612279 - RNA, 16 nt, Pseudomonas putida KT2440
ggcuuggcacgcuggc

SEQ ID NO: 1612280 - RNA, 23 nt, Pseudomonas putida KT2440
ggcuuggcagcaccgcugccagc

SEQ ID NO: 1612281 - RNA, 12 nt, Pseudomonas putida KT2440
ggcucgcagcca

SEQ ID NO: 1612282 - RNA, 22 nt, Pseudomonas putida KT2440
ggcucgcagccaaugcugauga

SEQ ID NO: 1612283 - RNA, 20 nt, Pseudomonas putida KT2440
ggcucgcaugagccggggcu

SEQ ID NO: 1612284 - RNA, 18 nt, Pseudomonas putida KT2440
ggcucgcccgggucaggu

SEQ ID NO: 1612285 - RNA, 14 nt, Pseudomonas putida KT2440
ggcucgcucaggcg

SEQ ID NO: 1612286 - RNA, 14 nt, Pseudomonas putida KT2440
ggcucgcugcccca

SEQ ID NO: 1612287 - RNA, 16 nt, Pseudomonas putida KT2440
ggcucgcugccccagu

SEQ ID NO: 1612288 - RNA, 18 nt, Pseudomonas putida KT2440
ggcucggggccgaugggc

SEQ ID NO: 1612289 - RNA, 18 nt, Pseudomonas putida KT2440
ggcucgucgaacagcaug

SEQ ID NO: 1612290 - RNA, 17 nt, Pseudomonas putida KT2440
ggcucggugugcaccug

SEQ ID NO: 1612291 - RNA, 19 nt, Pseudomonas putida KT2440
ggcucucagcccauuucac

SEQ ID NO: 1612292 - RNA, 22 nt, Pseudomonas putida KT2440
ggcucugggcaaaaucgaccag

SEQ ID NO: 1612293 - RNA, 17 nt, Pseudomonas putida KT2440
ggcucuguuccauuuca

SEQ ID NO: 1612294 - RNA, 21 nt, Pseudomonas putida KT2440
ggcucuguuucugccccuggc

SEQ ID NO: 1612295 - RNA, 12 nt, Pseudomonas putida KT2440
ggcucugcagcg

SEQ ID NO: 1612296 - RNA, 14 nt, Pseudomonas putida KT2440
ggcuccaucuccag

SEQ ID NO: 1612297 - RNA, 21 nt, Pseudomonas putida KT2440
ggcuccaaccguacccuuccu

SEQ ID NO: 1612298 - RNA, 15 nt, Pseudomonas putida KT2440
ggcucaucugccggc

SEQ ID NO: 1612299 - RNA, 21 nt, Pseudomonas putida KT2440
ggcuccaccugcuccagcacc

SEQ ID NO: 1612300 - RNA, 13 nt, Pseudomonas putida KT2440
ggcuccacugcaa

SEQ ID NO: 1612301 - RNA, 19 nt, Pseudomonas putida KT2440
ggcucgacacgcuugcgaa

SEQ ID NO: 1612302 - RNA, 23 nt, Pseudomonas putida KT2440
ggcucgacacgcuugcgaaggag

SEQ ID NO: 1612303 - RNA, 14 nt, Pseudomonas putida KT2440
ggcucaugcgccag

SEQ ID NO: 1612304 - RNA, 17 nt, Pseudomonas putida KT2440
ggcucaugcgccagggc

SEQ ID NO: 1612305 - RNA, 21 nt, Pseudomonas putida KT2440
ggcucaugcgccagggcugau

SEQ ID NO: 1612306 - RNA, 23 nt, Pseudomonas putida KT2440
ggcucaucagcaacccggccagg

SEQ ID NO: 1612307 - RNA, 19 nt, Pseudomonas putida KT2440
ggcguauuugaccagcccg

SEQ ID NO: 1612308 - RNA, 16 nt, Pseudomonas putida KT2440
ggcguagcacaagggc

SEQ ID NO: 1612309 - RNA, 14 nt, Pseudomonas putida KT2440
ggcguagcagguac

SEQ ID NO: 1612310 - RNA, 18 nt, Pseudomonas putida KT2440
ggcugaaaucuuugcuuc

SEQ ID NO: 1612311 - RNA, 21 nt, Pseudomonas putida KT2440
ggcugaaauggcggcccagcc

SEQ ID NO: 1612312 - RNA, 21 nt, Pseudomonas putida KT2440
ggcugaacacgcucaugaaca

SEQ ID NO: 1612313 - RNA, 20 nt, Pseudomonas putida KT2440
ggcucuucaacaccagcaug

SEQ ID NO: 1612314 - RNA, 15 nt, Pseudomonas putida KT2440
ggcucuucuuucagg

SEQ ID NO: 1612315 - RNA, 19 nt, Pseudomonas putida KT2440
ggcugcaaugcagccccuu

SEQ ID NO: 1612316 - RNA, 21 nt, Pseudomonas putida KT2440
ggcugcaaagcagacccagaa

SEQ ID NO: 1612317 - RNA, 20 nt, Pseudomonas putida KT2440
ggcugcaaagcagccccggc

SEQ ID NO: 1612318 - RNA, 14 nt, Pseudomonas putida KT2440
ggcugaucaccgcc

SEQ ID NO: 1612319 - RNA, 22 nt, Pseudomonas putida KT2440
ggcugauguugaugugcggcgc

SEQ ID NO: 1612320 - RNA, 12 nt, Pseudomonas putida KT2440
ggcugaggaaca

SEQ ID NO: 1612321 - RNA, 12 nt, Pseudomonas putida KT2440
ggcugagcccgg

SEQ ID NO: 1612322 - RNA, 13 nt, Pseudomonas putida KT2440
ggcugagcccggc

SEQ ID NO: 1612323 - RNA, 15 nt, Pseudomonas putida KT2440
ggcugagccggcugg

SEQ ID NO: 1612324 - RNA, 16 nt, Pseudomonas putida KT2440
ggcugcauugcagccc

SEQ ID NO: 1612325 - RNA, 17 nt, Pseudomonas putida KT2440
ggcugccagcgcgcugc

SEQ ID NO: 1612326 - RNA, 19 nt, Pseudomonas putida KT2440
ggcugcccucgggcagccu

SEQ ID NO: 1612327 - RNA, 20 nt, Pseudomonas putida KT2440
ggcugcccucgggcagccuu

SEQ ID NO: 1612328 - RNA, 12 nt, Pseudomonas putida KT2440
ggcugcgcggca

SEQ ID NO: 1612329 - RNA, 15 nt, Pseudomonas putida KT2440
ggcugcgcggcagcc

SEQ ID NO: 1612330 - RNA, 22 nt, Pseudomonas putida KT2440
ggcugcggcagguaggcccagc

SEQ ID NO: 1612331 - RNA, 17 nt, Pseudomonas putida KT2440
ggcugccuacccaggca

SEQ ID NO: 1612332 - RNA, 21 nt, Pseudomonas putida KT2440
ggcugccuucgcucaggugca

SEQ ID NO: 1612333 - RNA, 16 nt, Pseudomonas putida KT2440
ggcugccgcgcagccc

SEQ ID NO: 1612334 - RNA, 21 nt, Pseudomonas putida KT2440
ggcugccgcgcagcccaaaca

SEQ ID NO: 1612335 - RNA, 15 nt, Pseudomonas putida KT2440
ggcgacgcacuucac

SEQ ID NO: 1612336 - RNA, 14 nt, Pseudomonas putida KT2440
ggcgacgcggugcu

SEQ ID NO: 1612337 - RNA, 14 nt, Pseudomonas putida KT2440
ggcgagcaggucau

SEQ ID NO: 1612338 - RNA, 13 nt, Pseudomonas putida KT2440
ggcgagcaggccc

SEQ ID NO: 1612339 - RNA, 18 nt, Pseudomonas putida KT2440
ggcgacgugcccagauca

SEQ ID NO: 1612340 - RNA, 14 nt, Pseudomonas putida KT2440
ggccgacuggcgca

SEQ ID NO: 1612341 - RNA, 20 nt, Pseudomonas putida KT2440
ggccgacaguguugccggcg

SEQ ID NO: 1612342 - RNA, 14 nt, Pseudomonas putida KT2440
ggccgacaacggug

SEQ ID NO: 1612343 - RNA, 13 nt, Pseudomonas putida KT2440
ggccuuucugcuu

SEQ ID NO: 1612344 - RNA, 16 nt, Pseudomonas putida KT2440
ggccuuucugcuucca

SEQ ID NO: 1612345 - RNA, 19 nt, Pseudomonas putida KT2440
ggccuuucugcuuccacuc

SEQ ID NO: 1612346 - RNA, 18 nt, Pseudomonas putida KT2440
ggcgacaggugccucugc

SEQ ID NO: 1612347 - RNA, 16 nt, Pseudomonas putida KT2440
ggcgaugaucgcggcg

SEQ ID NO: 1612348 - RNA, 21 nt, Pseudomonas putida KT2440
ggcgaugcaucaauggcuggg

SEQ ID NO: 1612349 - RNA, 16 nt, Pseudomonas putida KT2440
ggcgaugcgcccccca

SEQ ID NO: 1612350 - RNA, 21 nt, Pseudomonas putida KT2440
ggcgaugcgccccccaggcgg

SEQ ID NO: 1612351 - RNA, 15 nt, Pseudomonas putida KT2440
ggcgcaccgccgggu

SEQ ID NO: 1612352 - RNA, 18 nt, Pseudomonas putida KT2440
ggcgcacguacuccacca

SEQ ID NO: 1612353 - RNA, 16 nt, Pseudomonas putida KT2440
ggcgcaccagcggcuu

SEQ ID NO: 1612354 - RNA, 14 nt, Pseudomonas putida KT2440
ggcgcaaaaguccc

SEQ ID NO: 1612355 - RNA, 22 nt, Pseudomonas putida KT2440
ggcgcacucucgucaccugaca

SEQ ID NO: 1612356 - RNA, 12 nt, Pseudomonas putida KT2440
ggcgcaggcugu

SEQ ID NO: 1612357 - RNA, 14 nt, Pseudomonas putida KT2440
ggcgcaggcugucg

SEQ ID NO: 1612358 - RNA, 12 nt, Pseudomonas putida KT2440
ggcgccagcagu

SEQ ID NO: 1612359 - RNA, 17 nt, Pseudomonas putida KT2440
ggcgccacugaggcgua

SEQ ID NO: 1612360 - RNA, 19 nt, Pseudomonas putida KT2440
ggcgguguaucuccaugcu

SEQ ID NO: 1612361 - RNA, 21 nt, Pseudomonas putida KT2440
ggcgguaugggugaugcuggu

SEQ ID NO: 1612362 - RNA, 15 nt, Pseudomonas putida KT2440
ggcgguuaagaaggc

SEQ ID NO: 1612363 - RNA, 15 nt, Pseudomonas putida KT2440
ggcggguagaggaag

SEQ ID NO: 1612364 - RNA, 17 nt, Pseudomonas putida KT2440
ggcgggucagguggcug

SEQ ID NO: 1612365 - RNA, 18 nt, Pseudomonas putida KT2440
ggcgggugggugcagcug

SEQ ID NO: 1612366 - RNA, 23 nt, Pseudomonas putida KT2440
ggcggcgcucgaucucacaggcg

SEQ ID NO: 1612367 - RNA, 18 nt, Pseudomonas putida KT2440
ggcgggccaucugcuugg

SEQ ID NO: 1612368 - RNA, 14 nt, Pseudomonas putida KT2440
ggcgggcaaacugg

SEQ ID NO: 1612369 - RNA, 16 nt, Pseudomonas putida KT2440
ggcggauuugcccgcu

SEQ ID NO: 1612370 - RNA, 12 nt, Pseudomonas putida KT2440
ggcggcagcggc

SEQ ID NO: 1612371 - RNA, 22 nt, Pseudomonas putida KT2440
ggcggaucugacggcgcugcug

SEQ ID NO: 1612372 - RNA, 16 nt, Pseudomonas putida KT2440
ggcggauagccccgcc

SEQ ID NO: 1612373 - RNA, 21 nt, Pseudomonas putida KT2440
ggcggagauuggccagcaggc

SEQ ID NO: 1612374 - RNA, 15 nt, Pseudomonas putida KT2440
ggcggcaucucgcac

SEQ ID NO: 1612375 - RNA, 23 nt, Pseudomonas putida KT2440
ggcggccaaacuggaugauggua

SEQ ID NO: 1612376 - RNA, 20 nt, Pseudomonas putida KT2440
ggcggcauccaggcgggcga

SEQ ID NO: 1612377 - RNA, 15 nt, Pseudomonas putida KT2440
ggcgcggugccggca

SEQ ID NO: 1612378 - RNA, 21 nt, Pseudomonas putida KT2440
ggcgcguaguacuccagcagc

SEQ ID NO: 1612379 - RNA, 23 nt, Pseudomonas putida KT2440
ggcgcgucagccguugaccaggu

SEQ ID NO: 1612380 - RNA, 18 nt, Pseudomonas putida KT2440
ggcgcugaucaagcccgc

SEQ ID NO: 1612381 - RNA, 19 nt, Pseudomonas putida KT2440
ggcgcugaucaagcccgcu

SEQ ID NO: 1612382 - RNA, 16 nt, Pseudomonas putida KT2440
ggcgcugaucagcugg

SEQ ID NO: 1612383 - RNA, 20 nt, Pseudomonas putida KT2440
ggcgcugaugcggacccagc

SEQ ID NO: 1612384 - RNA, 22 nt, Pseudomonas putida KT2440
ggcgcgucccccgguaccagca

SEQ ID NO: 1612385 - RNA, 20 nt, Pseudomonas putida KT2440
ggcgcggaauucgcggcggc

SEQ ID NO: 1612386 - RNA, 18 nt, Pseudomonas putida KT2440
ggcgcggcagcaugaaca

SEQ ID NO: 1612387 - RNA, 18 nt, Pseudomonas putida KT2440
ggcgcggccugcuccaca

SEQ ID NO: 1612388 - RNA, 17 nt, Pseudomonas putida KT2440
ggcgcgcccgcucccac

SEQ ID NO: 1612389 - RNA, 20 nt, Pseudomonas putida KT2440
ggcgcgcccugcucauccag

SEQ ID NO: 1612390 - RNA, 16 nt, Pseudomonas putida KT2440
ggcgcgcggcucggcc

SEQ ID NO: 1612391 - RNA, 20 nt, Pseudomonas putida KT2440
ggcgccgguggcggccgcag

SEQ ID NO: 1612392 - RNA, 22 nt, Pseudomonas putida KT2440
ggcgcgacaugaucagcggggu

SEQ ID NO: 1612393 - RNA, 21 nt, Pseudomonas putida KT2440
ggcgcgaccaucaccgccagc

SEQ ID NO: 1612394 - RNA, 19 nt, Pseudomonas putida KT2440
ggcgcgaauuuccggguuc

SEQ ID NO: 1612395 - RNA, 19 nt, Pseudomonas putida KT2440
ggcgcgaaaagccugcacc

SEQ ID NO: 1612396 - RNA, 22 nt, Pseudomonas putida KT2440
gccuucgccaagguccagccac

SEQ ID NO: 1612397 - RNA, 16 nt, Pseudomonas putida KT2440
gccuucgccacugcca

SEQ ID NO: 1612398 - RNA, 16 nt, Pseudomonas putida KT2440
gccuucaggcgcuggu

SEQ ID NO: 1612399 - RNA, 17 nt, Pseudomonas putida KT2440
gccuucagcgccccauc

SEQ ID NO: 1612400 - RNA, 13 nt, Pseudomonas putida KT2440
gccuucaccagcu

SEQ ID NO: 1612401 - RNA, 23 nt, Pseudomonas putida KT2440
gccuucagcaggcgcggcguggc

SEQ ID NO: 1612402 - RNA, 20 nt, Pseudomonas putida KT2440
gccuucgcucaggugcaccu

SEQ ID NO: 1612403 - RNA, 13 nt, Pseudomonas putida KT2440
gccuucgcuggcg

SEQ ID NO: 1612404 - RNA, 21 nt, Pseudomonas putida KT2440
gccuucgcccgaccgccagcc

SEQ ID NO: 1612405 - RNA, 15 nt, Pseudomonas putida KT2440
gccuugcagcccuuc

SEQ ID NO: 1612406 - RNA, 21 nt, Pseudomonas putida KT2440
gccuugauacgcccauccaac

SEQ ID NO: 1612407 - RNA, 16 nt, Pseudomonas putida KT2440
gccuugaucaaugccc

SEQ ID NO: 1612408 - RNA, 21 nt, Pseudomonas putida KT2440
gccuugaucaggcccugcugc

SEQ ID NO: 1612409 - RNA, 11 nt, Pseudomonas putida KT2440
gccuugaaaag

SEQ ID NO: 1612410 - RNA, 22 nt, Pseudomonas putida KT2440
gccuucggugcuggcgcucaau

SEQ ID NO: 1612411 - RNA, 13 nt, Pseudomonas putida KT2440
gccuuucugcucg

SEQ ID NO: 1612412 - RNA, 17 nt, Pseudomonas putida KT2440
gccuuugugcuuucugg

SEQ ID NO: 1612413 - RNA, 22 nt, Pseudomonas putida KT2440
gccuuuucacacauaucagcca

SEQ ID NO: 1612414 - RNA, 22 nt, Pseudomonas putida KT2440
gccuuugccccugaucauccac

SEQ ID NO: 1612415 - RNA, 22 nt, Pseudomonas putida KT2440
gccuuugauuacuugacgauga

SEQ ID NO: 1612416 - RNA, 13 nt, Pseudomonas putida KT2440
gccuuggccagcg

SEQ ID NO: 1612417 - RNA, 14 nt, Pseudomonas putida KT2440
gccuuggccaccuc

SEQ ID NO: 1612418 - RNA, 21 nt, Pseudomonas putida KT2440
gccuuggcauagcgcucgcgc

SEQ ID NO: 1612419 - RNA, 22 nt, Pseudomonas putida KT2440
gccuuggacaccaggcugguga

SEQ ID NO: 1612420 - RNA, 15 nt, Pseudomonas putida KT2440
gccuuggccuggcga

SEQ ID NO: 1612421 - RNA, 14 nt, Pseudomonas putida KT2440
gccuuggcgcagca

SEQ ID NO: 1612422 - RNA, 16 nt, Pseudomonas putida KT2440
gccuuggccgcuggcc

SEQ ID NO: 1612423 - RNA, 19 nt, Pseudomonas putida KT2440
gccuuggccgcuggcccuu

SEQ ID NO: 1612424 - RNA, 20 nt, Pseudomonas putida KT2440
gccuuggccgcuggcccuuc

SEQ ID NO: 1612425 - RNA, 14 nt, Pseudomonas putida KT2440
gcgaagaagacacc

SEQ ID NO: 1612426 - RNA, 22 nt, Pseudomonas putida KT2440
gcgaagaagccggcaucgccaa

SEQ ID NO: 1612427 - RNA, 15 nt, Pseudomonas putida KT2440
gcgaagaccgccgcc

SEQ ID NO: 1612428 - RNA, 17 nt, Pseudomonas putida KT2440
gcgaagcggccaaccgc

SEQ ID NO: 1612429 - RNA, 13 nt, Pseudomonas putida KT2440
gcgaagcaggcug

SEQ ID NO: 1612430 - RNA, 14 nt, Pseudomonas putida KT2440
gcgaagcaggcugc

SEQ ID NO: 1612431 - RNA, 17 nt, Pseudomonas putida KT2440
gcgaagcccguggcccu

SEQ ID NO: 1612432 - RNA, 16 nt, Pseudomonas putida KT2440
gcgaagaggccagcac

SEQ ID NO: 1612433 - RNA, 15 nt, Pseudomonas putida KT2440
gcgaagagggcgaca

SEQ ID NO: 1612434 - RNA, 21 nt, Pseudomonas putida KT2440
gcgaaccaggugcgguccggc

SEQ ID NO: 1612435 - RNA, 14 nt, Pseudomonas putida KT2440
gccuuuuccagcuc

SEQ ID NO: 1612436 - RNA, 18 nt, Pseudomonas putida KT2440
gccuuuuccaccagcccu

SEQ ID NO: 1612437 - RNA, 21 nt, Pseudomonas putida KT2440
gcgaaacgcggcaaccugcac

SEQ ID NO: 1612438 - RNA, 23 nt, Pseudomonas putida KT2440
gcgaaacgaaacccugcugggcg

SEQ ID NO: 1612439 - RNA, 22 nt, Pseudomonas putida KT2440
gcgaaagcaagguagcggcggc

SEQ ID NO: 1612440 - RNA, 13 nt, Pseudomonas putida KT2440
gcgaaaggcgcuc

SEQ ID NO: 1612441 - RNA, 15 nt, Pseudomonas putida KT2440
gcgaaagggccgggc

SEQ ID NO: 1612442 - RNA, 16 nt, Pseudomonas putida KT2440
gcgaaagggccgggcc

SEQ ID NO: 1612443 - RNA, 15 nt, Pseudomonas putida KT2440
gcgaaagccagcagu

SEQ ID NO: 1612444 - RNA, 23 nt, Pseudomonas putida KT2440
gcgaaaugauccccggcgacggc

SEQ ID NO: 1612445 - RNA, 13 nt, Pseudomonas putida KT2440
gcgaaauacccaa

SEQ ID NO: 1612446 - RNA, 17 nt, Pseudomonas putida KT2440
gcgaacaggccugucac

SEQ ID NO: 1612447 - RNA, 21 nt, Pseudomonas putida KT2440
gcgaacaccggcagagccggu

SEQ ID NO: 1612448 - RNA, 16 nt, Pseudomonas putida KT2440
gccugggcgguccuuc

SEQ ID NO: 1612449 - RNA, 16 nt, Pseudomonas putida KT2440
gccuggcuuuccaggu

SEQ ID NO: 1612450 - RNA, 22 nt, Pseudomonas putida KT2440
gccuggcuuuccagguccuugc

SEQ ID NO: 1612451 - RNA, 21 nt, Pseudomonas putida KT2440
gccuggguuuuaaccggcccu

SEQ ID NO: 1612452 - RNA, 15 nt, Pseudomonas putida KT2440
gccuggucgccgcca

SEQ ID NO: 1612453 - RNA, 22 nt, Pseudomonas putida KT2440
gccugggguauuugcagugguu

SEQ ID NO: 1612454 - RNA, 19 nt, Pseudomonas putida KT2440
gccuggggcaggcccggca

SEQ ID NO: 1612455 - RNA, 21 nt, Pseudomonas putida KT2440
gccugggucacggcauccccg

SEQ ID NO: 1612456 - RNA, 20 nt, Pseudomonas putida KT2440
gccugggucaaccccaggug

SEQ ID NO: 1612457 - RNA, 15 nt, Pseudomonas putida KT2440
gccugggccgguccu

SEQ ID NO: 1612458 - RNA, 17 nt, Pseudomonas putida KT2440
gccugggccggugggca

SEQ ID NO: 1612459 - RNA, 13 nt, Pseudomonas putida KT2440
gccuguccgggcu

SEQ ID NO: 1612460 - RNA, 17 nt, Pseudomonas putida KT2440
gccuguucgauuucacc

SEQ ID NO: 1612461 - RNA, 21 nt, Pseudomonas putida KT2440
gccugucuagccgccugccgc

SEQ ID NO: 1612462 - RNA, 18 nt, Pseudomonas putida KT2440
gccuguccccuuggcccu

SEQ ID NO: 1612463 - RNA, 15 nt, Pseudomonas putida KT2440
gccuguuuuccauug

SEQ ID NO: 1612464 - RNA, 17 nt, Pseudomonas putida KT2440
gccuucacacaggcugu

SEQ ID NO: 1612465 - RNA, 16 nt, Pseudomonas putida KT2440
gccuucaaccucacug

SEQ ID NO: 1612466 - RNA, 23 nt, Pseudomonas putida KT2440
gccugcugguacagccggcugcg

SEQ ID NO: 1612467 - RNA, 17 nt, Pseudomonas putida KT2440
gccugcuggcgaagagu

SEQ ID NO: 1612468 - RNA, 16 nt, Pseudomonas putida KT2440
gccugcuggccgcgca

SEQ ID NO: 1612469 - RNA, 23 nt, Pseudomonas putida KT2440
gccugcugcaacagcucauccag

SEQ ID NO: 1612470 - RNA, 13 nt, Pseudomonas putida KT2440
gccugcuuggccg

SEQ ID NO: 1612471 - RNA, 23 nt, Pseudomonas putida KT2440
gccugcuugaucaggcccggcug

SEQ ID NO: 1612472 - RNA, 14 nt, Pseudomonas putida KT2440
gccuggccugcaga

SEQ ID NO: 1612473 - RNA, 15 nt, Pseudomonas putida KT2440
gccuggcccgcagcg

SEQ ID NO: 1612474 - RNA, 20 nt, Pseudomonas putida KT2440
gccuggccacuguugcagcg

SEQ ID NO: 1612475 - RNA, 15 nt, Pseudomonas putida KT2440
gccugcugcagcucg

SEQ ID NO: 1612476 - RNA, 12 nt, Pseudomonas putida KT2440
gccugcugcugg

SEQ ID NO: 1612477 - RNA, 18 nt, Pseudomonas putida KT2440
gccugcggccaggccggc

SEQ ID NO: 1612478 - RNA, 20 nt, Pseudomonas putida KT2440
gccugcggccaggccggcgc

SEQ ID NO: 1612479 - RNA, 17 nt, Pseudomonas putida KT2440
gccugcggcagccagca

SEQ ID NO: 1612480 - RNA, 15 nt, Pseudomonas putida KT2440
gccugcgcuccagca

SEQ ID NO: 1612481 - RNA, 21 nt, Pseudomonas putida KT2440
gccugccgggucaaggccagc

SEQ ID NO: 1612482 - RNA, 23 nt, Pseudomonas putida KT2440
gccucuucacggcuaaagccgca

SEQ ID NO: 1612483 - RNA, 23 nt, Pseudomonas putida KT2440
gccucuucgcgggcaagcccgcu

SEQ ID NO: 1612484 - RNA, 23 nt, Pseudomonas putida KT2440
gccucuucgcggguaagcccgcu

SEQ ID NO: 1612485 - RNA, 20 nt, Pseudomonas putida KT2440
gccucuucuucaaggcugcu

SEQ ID NO: 1612486 - RNA, 19 nt, Pseudomonas putida KT2440
gccucguccaucuugcugc

SEQ ID NO: 1612487 - RNA, 18 nt, Pseudomonas putida KT2440
gccucgguccaccccaug

SEQ ID NO: 1612488 - RNA, 15 nt, Pseudomonas putida KT2440
gccucgggcgcucgc

SEQ ID NO: 1612489 - RNA, 17 nt, Pseudomonas putida KT2440
gccucgugcagcugcac

SEQ ID NO: 1612490 - RNA, 17 nt, Pseudomonas putida KT2440
gccucguucgggcacuc

SEQ ID NO: 1612491 - RNA, 15 nt, Pseudomonas putida KT2440
gccucuacccgccgc

SEQ ID NO: 1612492 - RNA, 22 nt, Pseudomonas putida KT2440
gccucgcugccuuuggccgcca

SEQ ID NO: 1612493 - RNA, 17 nt, Pseudomonas putida KT2440
gccucggccggguuuuu

SEQ ID NO: 1612494 - RNA, 15 nt, Pseudomonas putida KT2440
gccucgcgcauggcc

SEQ ID NO: 1612495 - RNA, 21 nt, Pseudomonas putida KT2440
gccucgccguacucggucugg

SEQ ID NO: 1612496 - RNA, 14 nt, Pseudomonas putida KT2440
gccucgccauaagc

SEQ ID NO: 1612497 - RNA, 18 nt, Pseudomonas putida KT2440
gccucgcccuugucagcc

SEQ ID NO: 1612498 - RNA, 19 nt, Pseudomonas putida KT2440
gccucgcccuugucagccg

SEQ ID NO: 1612499 - RNA, 16 nt, Pseudomonas putida KT2440
gccucgacccgcuggc

SEQ ID NO: 1612500 - RNA, 15 nt, Pseudomonas putida KT2440
gccucgauuucuuca

SEQ ID NO: 1612501 - RNA, 22 nt, Pseudomonas putida KT2440
gccucgcaaaccugcgcuugca

SEQ ID NO: 1612502 - RNA, 19 nt, Pseudomonas putida KT2440
gccucgaucccgccgccag

SEQ ID NO: 1612503 - RNA, 13 nt, Pseudomonas putida KT2440
gccucaggcccca

SEQ ID NO: 1612504 - RNA, 15 nt, Pseudomonas putida KT2440
gccucaggccccagg

SEQ ID NO: 1612505 - RNA, 17 nt, Pseudomonas putida KT2440
gccucaccuccaccgau

SEQ ID NO: 1612506 - RNA, 14 nt, Pseudomonas putida KT2440
gccucagccaggcu

SEQ ID NO: 1612507 - RNA, 14 nt, Pseudomonas putida KT2440
gccucaccgccgca

SEQ ID NO: 1612508 - RNA, 19 nt, Pseudomonas putida KT2440
gccuaucuucgucauggga

SEQ ID NO: 1612509 - RNA, 18 nt, Pseudomonas putida KT2440
gccucacauucaccgcca

SEQ ID NO: 1612510 - RNA, 20 nt, Pseudomonas putida KT2440
gccuaucgcucuggcacuca

SEQ ID NO: 1612511 - RNA, 22 nt, Pseudomonas putida KT2440
gccuaucgcucuggcacucaag

SEQ ID NO: 1612512 - RNA, 20 nt, Pseudomonas putida KT2440
gccuccacaccgacauccac

SEQ ID NO: 1612513 - RNA, 15 nt, Pseudomonas putida KT2440
gccuccaccaccugc

SEQ ID NO: 1612514 - RNA, 15 nt, Pseudomonas putida KT2440
gccuccaccgggaug

SEQ ID NO: 1612515 - RNA, 12 nt, Pseudomonas putida KT2440
gccuccagcagc

SEQ ID NO: 1612516 - RNA, 21 nt, Pseudomonas putida KT2440
gccuccagcagcgacaccagc

SEQ ID NO: 1612517 - RNA, 17 nt, Pseudomonas putida KT2440
gccuccagcaggggcag

SEQ ID NO: 1612518 - RNA, 23 nt, Pseudomonas putida KT2440
gccucauagcuuucaggcgcagc

SEQ ID NO: 1612519 - RNA, 19 nt, Pseudomonas putida KT2440
gccucauccucgcccacca

SEQ ID NO: 1612520 - RNA, 14 nt, Pseudomonas putida KT2440
gccucaugaucugc

SEQ ID NO: 1612521 - RNA, 21 nt, Pseudomonas putida KT2440
gccucaugcagcaccuccugc

SEQ ID NO: 1612522 - RNA, 17 nt, Pseudomonas putida KT2440
gccuccugcugcugcau

SEQ ID NO: 1612523 - RNA, 16 nt, Pseudomonas putida KT2440
gccucgaacagcaguu

SEQ ID NO: 1612524 - RNA, 16 nt, Pseudomonas putida KT2440
gccucgaacauggcca

SEQ ID NO: 1612525 - RNA, 23 nt, Pseudomonas putida KT2440
gccucgaaguaggcaaacggcuc

SEQ ID NO: 1612526 - RNA, 15 nt, Pseudomonas putida KT2440
gccuccggcccaucc

SEQ ID NO: 1612527 - RNA, 13 nt, Pseudomonas putida KT2440
gccuccagcuggc

SEQ ID NO: 1612528 - RNA, 23 nt, Pseudomonas putida KT2440
gccuccagcuggccaucgacccg

SEQ ID NO: 1612529 - RNA, 19 nt, Pseudomonas putida KT2440
gccuccagcuuuggcugca

SEQ ID NO: 1612530 - RNA, 20 nt, Pseudomonas putida KT2440
gccucccaggacuucagcag

SEQ ID NO: 1612531 - RNA, 13 nt, Pseudomonas putida KT2440
gccucccccaccc

SEQ ID NO: 1612532 - RNA, 14 nt, Pseudomonas putida KT2440
gccucccccacccc

SEQ ID NO: 1612533 - RNA, 23 nt, Pseudomonas putida KT2440
gccucccccacccccgccccacg

SEQ ID NO: 1612534 - RNA, 12 nt, Pseudomonas putida KT2440
gccgugcggcca

SEQ ID NO: 1612535 - RNA, 19 nt, Pseudomonas putida KT2440
gccgugcggccaaagcugu

SEQ ID NO: 1612536 - RNA, 13 nt, Pseudomonas putida KT2440
gccgugcgcggca

SEQ ID NO: 1612537 - RNA, 18 nt, Pseudomonas putida KT2440
gccgugcgcggcaucagc

SEQ ID NO: 1612538 - RNA, 17 nt, Pseudomonas putida KT2440
gccgugcuugaggccgc

SEQ ID NO: 1612539 - RNA, 21 nt, Pseudomonas putida KT2440
gccgugcuugaggccgccauu

SEQ ID NO: 1612540 - RNA, 20 nt, Pseudomonas putida KT2440
gccgugaagaggccagugag

SEQ ID NO: 1612541 - RNA, 15 nt, Pseudomonas putida KT2440
gccguggcaaggccc

SEQ ID NO: 1612542 - RNA, 21 nt, Pseudomonas putida KT2440
gccguguucccagcaccccag

SEQ ID NO: 1612543 - RNA, 15 nt, Pseudomonas putida KT2440
gccuacaggcaaccg

SEQ ID NO: 1612544 - RNA, 18 nt, Pseudomonas putida KT2440
gccuacaggcaaccgcau

SEQ ID NO: 1612545 - RNA, 13 nt, Pseudomonas putida KT2440
gccuagcaaggcc

SEQ ID NO: 1612546 - RNA, 14 nt, Pseudomonas putida KT2440
gccuagcaaggccu

SEQ ID NO: 1612547 - RNA, 16 nt, Pseudomonas putida KT2440
gccuagcaaggccucc

SEQ ID NO: 1612548 - RNA, 20 nt, Pseudomonas putida KT2440
gccuagcaaggccuccaggu

SEQ ID NO: 1612549 - RNA, 18 nt, Pseudomonas putida KT2440
gccuacagcggccugugc

SEQ ID NO: 1612550 - RNA, 15 nt, Pseudomonas putida KT2440
gccuacaacauaccg

SEQ ID NO: 1612551 - RNA, 15 nt, Pseudomonas putida KT2440
gccguugucacgcgc

SEQ ID NO: 1612552 - RNA, 15 nt, Pseudomonas putida KT2440
gccguugucgcccgc

SEQ ID NO: 1612553 - RNA, 22 nt, Pseudomonas putida KT2440
gccguuguucggcaaaggccuc

SEQ ID NO: 1612554 - RNA, 16 nt, Pseudomonas putida KT2440
gccguuugcuggccug

SEQ ID NO: 1612555 - RNA, 12 nt, Pseudomonas putida KT2440
gccguccagcug

SEQ ID NO: 1612556 - RNA, 21 nt, Pseudomonas putida KT2440
gccguccagguccaggccagc

SEQ ID NO: 1612557 - RNA, 22 nt, Pseudomonas putida KT2440
gccguccggcaaucugcccaca

SEQ ID NO: 1612558 - RNA, 23 nt, Pseudomonas putida KT2440
gccgucuuugagggucagcuggc

SEQ ID NO: 1612559 - RNA, 15 nt, Pseudomonas putida KT2440
gccgucuuuuccgug

SEQ ID NO: 1612560 - RNA, 21 nt, Pseudomonas putida KT2440
gccgcuucgcggccaagccgc

SEQ ID NO: 1612561 - RNA, 19 nt, Pseudomonas putida KT2440
gccgcuugaucuuguccug

SEQ ID NO: 1612562 - RNA, 21 nt, Pseudomonas putida KT2440
gccgcuugaucuuguccugga

SEQ ID NO: 1612563 - RNA, 14 nt, Pseudomonas putida KT2440
gccgcuuggcggcc

SEQ ID NO: 1612564 - RNA, 15 nt, Pseudomonas putida KT2440
gccgcuuggcggccc

SEQ ID NO: 1612565 - RNA, 15 nt, Pseudomonas putida KT2440
gccgcuuugcggccc

SEQ ID NO: 1612566 - RNA, 21 nt, Pseudomonas putida KT2440
gccgucaccagcgucaccccu

SEQ ID NO: 1612567 - RNA, 17 nt, Pseudomonas putida KT2440
gccgucaacgaggccgc

SEQ ID NO: 1612568 - RNA, 21 nt, Pseudomonas putida KT2440
gcgcaugcucgcgggccugga

SEQ ID NO: 1612569 - RNA, 16 nt, Pseudomonas putida KT2440
gcgcaugaaggacauc

SEQ ID NO: 1612570 - RNA, 21 nt, Pseudomonas putida KT2440
gcgcaugaaggacaucaccag

SEQ ID NO: 1612571 - RNA, 19 nt, Pseudomonas putida KT2440
gcgcauccuccgcccugcc

SEQ ID NO: 1612572 - RNA, 21 nt, Pseudomonas putida KT2440
gcgcauccuccgcccugcccu

SEQ ID NO: 1612573 - RNA, 20 nt, Pseudomonas putida KT2440
gcgcauccucggugcgcggu

SEQ ID NO: 1612574 - RNA, 13 nt, Pseudomonas putida KT2440
gcgcaucauccac

SEQ ID NO: 1612575 - RNA, 23 nt, Pseudomonas putida KT2440
gcgcauccggaauuucugcaccu

SEQ ID NO: 1612576 - RNA, 18 nt, Pseudomonas putida KT2440
gcgcaucaggcugcgccc

SEQ ID NO: 1612577 - RNA, 17 nt, Pseudomonas putida KT2440
gcgcaucagccgcgccc

SEQ ID NO: 1612578 - RNA, 21 nt, Pseudomonas putida KT2440
gcgcaucagccgcgcccucuu

SEQ ID NO: 1612579 - RNA, 14 nt, Pseudomonas putida KT2440
gcgcaucauggcgg

SEQ ID NO: 1612580 - RNA, 18 nt, Pseudomonas putida KT2440
gcgcauccacaggcgccc

SEQ ID NO: 1612581 - RNA, 11 nt, Pseudomonas putida KT2440
gcgcauggccg

SEQ ID NO: 1612582 - RNA, 16 nt, Pseudomonas putida KT2440
gcgcauggccgcuucc

SEQ ID NO: 1612583 - RNA, 18 nt, Pseudomonas putida KT2440
gcgcauuucguccaggcu

SEQ ID NO: 1612584 - RNA, 22 nt, Pseudomonas putida KT2440
gcgcauugauagcggcagcgac

SEQ ID NO: 1612585 - RNA, 15 nt, Pseudomonas putida KT2440
gcgcauugaucgccg

SEQ ID NO: 1612586 - RNA, 17 nt, Pseudomonas putida KT2440
gcgccaaacgccagggc

SEQ ID NO: 1612587 - RNA, 19 nt, Pseudomonas putida KT2440
gcgccaaacgccagggccg

SEQ ID NO: 1612588 - RNA, 22 nt, Pseudomonas putida KT2440
gcgccaaaggcgcgucccccgg

SEQ ID NO: 1612589 - RNA, 21 nt, Pseudomonas putida KT2440
gcgccaaaaccuguuccagcc

SEQ ID NO: 1612590 - RNA, 16 nt, Pseudomonas putida KT2440
gcgccaauaccgcgca

SEQ ID NO: 1612591 - RNA, 19 nt, Pseudomonas putida KT2440
gcgccaaucaucgccagca

SEQ ID NO: 1612592 - RNA, 18 nt, Pseudomonas putida KT2440
gcgccagcaaugcccgcu

SEQ ID NO: 1612593 - RNA, 21 nt, Pseudomonas putida KT2440
gcgccagcaacgcagccagga

SEQ ID NO: 1612594 - RNA, 22 nt, Pseudomonas putida KT2440
gcgccagcaacgcagccaggau

SEQ ID NO: 1612595 - RNA, 17 nt, Pseudomonas putida KT2440
gcgccagcagcgcgugc

SEQ ID NO: 1612596 - RNA, 15 nt, Pseudomonas putida KT2440
gcgccagcagccggg

SEQ ID NO: 1612597 - RNA, 18 nt, Pseudomonas putida KT2440
gcgccagcagccgggccu

SEQ ID NO: 1612598 - RNA, 17 nt, Pseudomonas putida KT2440
gcgccagcacgcaggcc

SEQ ID NO: 1612599 - RNA, 14 nt, Pseudomonas putida KT2440
gcgccagccauucc

SEQ ID NO: 1612600 - RNA, 16 nt, Pseudomonas putida KT2440
gcgccagccgccacga

SEQ ID NO: 1612601 - RNA, 12 nt, Pseudomonas putida KT2440
gcgccagccgcu

SEQ ID NO: 1612602 - RNA, 16 nt, Pseudomonas putida KT2440
gcgccagccgcucagc

SEQ ID NO: 1612603 - RNA, 23 nt, Pseudomonas putida KT2440
gcgccagcggguggucgcugcgg

SEQ ID NO: 1612604 - RNA, 17 nt, Pseudomonas putida KT2440
gcgccagcggccagcgc

SEQ ID NO: 1612605 - RNA, 14 nt, Pseudomonas putida KT2440
gcgccacgccgcca

SEQ ID NO: 1612606 - RNA, 16 nt, Pseudomonas putida KT2440
gcgccacgccgccaga

SEQ ID NO: 1612607 - RNA, 17 nt, Pseudomonas putida KT2440
gcgccacauagcuggca

SEQ ID NO: 1612608 - RNA, 13 nt, Pseudomonas putida KT2440
gcgccaccgggcg

SEQ ID NO: 1612609 - RNA, 15 nt, Pseudomonas putida KT2440
gcgccaccaccgcug

SEQ ID NO: 1612610 - RNA, 23 nt, Pseudomonas putida KT2440
gcgccacccagaacagccacagc

SEQ ID NO: 1612611 - RNA, 17 nt, Pseudomonas putida KT2440
gcgcacggcaucggccg

SEQ ID NO: 1612612 - RNA, 17 nt, Pseudomonas putida KT2440
gcgcacuuguuccagcc

SEQ ID NO: 1612613 - RNA, 15 nt, Pseudomonas putida KT2440
gcgcacuugccagcc

SEQ ID NO: 1612614 - RNA, 19 nt, Pseudomonas putida KT2440
gcgcacuugccagccgccc

SEQ ID NO: 1612615 - RNA, 11 nt, Pseudomonas putida KT2440
gcgcacuucca

SEQ ID NO: 1612616 - RNA, 18 nt, Pseudomonas putida KT2440
gcgcacuuccacacccag

SEQ ID NO: 1612617 - RNA, 15 nt, Pseudomonas putida KT2440
gcgcacugccgccgg

SEQ ID NO: 1612618 - RNA, 17 nt, Pseudomonas putida KT2440
gcgcacucucccgcagc

SEQ ID NO: 1612619 - RNA, 16 nt, Pseudomonas putida KT2440
gcgcacgaagaucacc

SEQ ID NO: 1612620 - RNA, 20 nt, Pseudomonas putida KT2440
gcgcacgacccguacuuuuc

SEQ ID NO: 1612621 - RNA, 23 nt, Pseudomonas putida KT2440
gcgcacgcgcuuuuccagcaaag

SEQ ID NO: 1612622 - RNA, 23 nt, Pseudomonas putida KT2440
gcgcacgcugcccaggugccagg

SEQ ID NO: 1612623 - RNA, 19 nt, Pseudomonas putida KT2440
gcgcaccgguuacacccau

SEQ ID NO: 1612624 - RNA, 22 nt, Pseudomonas putida KT2440
gcgcaccggaguccccaccggc

SEQ ID NO: 1612625 - RNA, 13 nt, Pseudomonas putida KT2440
gcgcagcagcucc

SEQ ID NO: 1612626 - RNA, 17 nt, Pseudomonas putida KT2440
gcgcagcaucugcacgu

SEQ ID NO: 1612627 - RNA, 13 nt, Pseudomonas putida KT2440
gcgcagccccaaa

SEQ ID NO: 1612628 - RNA, 14 nt, Pseudomonas putida KT2440
gcgcagccaccagc

SEQ ID NO: 1612629 - RNA, 15 nt, Pseudomonas putida KT2440
gcgcagccaccagcu

SEQ ID NO: 1612630 - RNA, 21 nt, Pseudomonas putida KT2440
gcgcagcaaggucgccgccgu

SEQ ID NO: 1612631 - RNA, 16 nt, Pseudomonas putida KT2440
gcgcagaugguggcau

SEQ ID NO: 1612632 - RNA, 13 nt, Pseudomonas putida KT2440
gcgcagcacuucc

SEQ ID NO: 1612633 - RNA, 16 nt, Pseudomonas putida KT2440
gcgcagagccacgggu

SEQ ID NO: 1612634 - RNA, 17 nt, Pseudomonas putida KT2440
gcgcagaucccgcucgg

SEQ ID NO: 1612635 - RNA, 19 nt, Pseudomonas putida KT2440
gcgcagcguaauagcuggu

SEQ ID NO: 1612636 - RNA, 16 nt, Pseudomonas putida KT2440
gcgcaggaagucuucc

SEQ ID NO: 1612637 - RNA, 14 nt, Pseudomonas putida KT2440
gcgcaggaagaagg

SEQ ID NO: 1612638 - RNA, 13 nt, Pseudomonas putida KT2440
gcgcaggcagcga

SEQ ID NO: 1612639 - RNA, 20 nt, Pseudomonas putida KT2440
gcgcagcggcgucaccuucc

SEQ ID NO: 1612640 - RNA, 14 nt, Pseudomonas putida KT2440
gcgcagccggccuu

SEQ ID NO: 1612641 - RNA, 16 nt, Pseudomonas putida KT2440
gcgcagccggccuugc

SEQ ID NO: 1612642 - RNA, 19 nt, Pseudomonas putida KT2440
gcgcaggcugucgaacagg

SEQ ID NO: 1612643 - RNA, 12 nt, Pseudomonas putida KT2440
gcgcaggcggcu

SEQ ID NO: 1612644 - RNA, 22 nt, Pseudomonas putida KT2440
gcgcagggugccggccagcggc

SEQ ID NO: 1612645 - RNA, 15 nt, Pseudomonas putida KT2440
gcgcagggugucggu

SEQ ID NO: 1612646 - RNA, 21 nt, Pseudomonas putida KT2440
gcgcagggugucgguggcggc

SEQ ID NO: 1612647 - RNA, 23 nt, Pseudomonas putida KT2440
gcgcagggugucgguggcggcca

SEQ ID NO: 1612648 - RNA, 19 nt, Pseudomonas putida KT2440
gcgcaggcuuucggccacc

SEQ ID NO: 1612649 - RNA, 18 nt, Pseudomonas putida KT2440
gcgcagggcaucgcgcag

SEQ ID NO: 1612650 - RNA, 20 nt, Pseudomonas putida KT2440
gcgcaggcgguucaaaucuu

SEQ ID NO: 1612651 - RNA, 18 nt, Pseudomonas putida KT2440
gcgcagguccaggcgcaa

SEQ ID NO: 1612652 - RNA, 23 nt, Pseudomonas putida KT2440
gcgcagguuggugcaauugcagu

SEQ ID NO: 1612653 - RNA, 22 nt, Pseudomonas putida KT2440
gcgcaguaccuguggcagcggc

SEQ ID NO: 1612654 - RNA, 19 nt, Pseudomonas putida KT2440
gcgcaguggucauagucac

SEQ ID NO: 1612655 - RNA, 15 nt, Pseudomonas putida KT2440
gcgcaguucguccag

SEQ ID NO: 1612656 - RNA, 22 nt, Pseudomonas putida KT2440
gcgcaguucgauguaggcagcu

SEQ ID NO: 1612657 - RNA, 22 nt, Pseudomonas putida KT2440
gcgcaccgccggguugcucauc

SEQ ID NO: 1612658 - RNA, 13 nt, Pseudomonas putida KT2440
gcgcaccagcggc

SEQ ID NO: 1612659 - RNA, 19 nt, Pseudomonas putida KT2440
gcgcaauugccggucgggc

SEQ ID NO: 1612660 - RNA, 14 nt, Pseudomonas putida KT2440
gcgcaaugcgcccc

SEQ ID NO: 1612661 - RNA, 15 nt, Pseudomonas putida KT2440
gcgcaaugcccagcg

SEQ ID NO: 1612662 - RNA, 18 nt, Pseudomonas putida KT2440
gcgcaaugcccagcgcgc

SEQ ID NO: 1612663 - RNA, 20 nt, Pseudomonas putida KT2440
gcgcaaugcccagcgcgccg

SEQ ID NO: 1612664 - RNA, 17 nt, Pseudomonas putida KT2440
gcgcaacagugccccuu

SEQ ID NO: 1612665 - RNA, 20 nt, Pseudomonas putida KT2440
gcgcaaaugcuugcccgccu

SEQ ID NO: 1612666 - RNA, 14 nt, Pseudomonas putida KT2440
gcgcaaaucgccaa

SEQ ID NO: 1612667 - RNA, 22 nt, Pseudomonas putida KT2440
gcgcaacagcaaggcaucggcg

SEQ ID NO: 1612668 - RNA, 18 nt, Pseudomonas putida KT2440
gcgcaacgcgccauggcc

SEQ ID NO: 1612669 - RNA, 16 nt, Pseudomonas putida KT2440
gcgcaacgacaaggua

SEQ ID NO: 1612670 - RNA, 14 nt, Pseudomonas putida KT2440
gcgcaacugcccag

SEQ ID NO: 1612671 - RNA, 16 nt, Pseudomonas putida KT2440
gcgcaacugcccagga

SEQ ID NO: 1612672 - RNA, 15 nt, Pseudomonas putida KT2440
gcgcaaggccgcggc

SEQ ID NO: 1612673 - RNA, 13 nt, Pseudomonas putida KT2440
gcgcaaggggucg

SEQ ID NO: 1612674 - RNA, 19 nt, Pseudomonas putida KT2440
gcgcaagcgguugcccgcu

SEQ ID NO: 1612675 - RNA, 21 nt, Pseudomonas putida KT2440
gcgauguuggccgagucggug

SEQ ID NO: 1612676 - RNA, 20 nt, Pseudomonas putida KT2440
gcgauugcgauccgccccau

SEQ ID NO: 1612677 - RNA, 13 nt, Pseudomonas putida KT2440
gcgauugcggccu

SEQ ID NO: 1612678 - RNA, 16 nt, Pseudomonas putida KT2440
gcgcaaaaccaccagc

SEQ ID NO: 1612679 - RNA, 17 nt, Pseudomonas putida KT2440
gcgcaaaaccaccagcc

SEQ ID NO: 1612680 - RNA, 22 nt, Pseudomonas putida KT2440
gcgaugguacagcucacuggcc

SEQ ID NO: 1612681 - RNA, 18 nt, Pseudomonas putida KT2440
gcgaugggcugcaaagca

SEQ ID NO: 1612682 - RNA, 23 nt, Pseudomonas putida KT2440
gcgauggcgucgacucgaugcca

SEQ ID NO: 1612683 - RNA, 18 nt, Pseudomonas putida KT2440
gcgauggucugcuccagu

SEQ ID NO: 1612684 - RNA, 23 nt, Pseudomonas putida KT2440
gcgauggcggaucagcgcgucca

SEQ ID NO: 1612685 - RNA, 19 nt, Pseudomonas putida KT2440
gcgaugaucgagccgauca

SEQ ID NO: 1612686 - RNA, 14 nt, Pseudomonas putida KT2440
gcgaugaucgccug

SEQ ID NO: 1612687 - RNA, 22 nt, Pseudomonas putida KT2440
gcgaugaucgccuggccggccg

SEQ ID NO: 1612688 - RNA, 21 nt, Pseudomonas putida KT2440
gcgaugcacgcgcagagaagc

SEQ ID NO: 1612689 - RNA, 14 nt, Pseudomonas putida KT2440
gcgaugcgccgcgc

SEQ ID NO: 1612690 - RNA, 14 nt, Pseudomonas putida KT2440
gcgaugcgcuggca

SEQ ID NO: 1612691 - RNA, 15 nt, Pseudomonas putida KT2440
gcgaucuccugcagg

SEQ ID NO: 1612692 - RNA, 17 nt, Pseudomonas putida KT2440
gcgaucggcuuucauug

SEQ ID NO: 1612693 - RNA, 16 nt, Pseudomonas putida KT2440
gcgaggaaacccgcgc

SEQ ID NO: 1612694 - RNA, 15 nt, Pseudomonas putida KT2440
gcgagcuugcucgcg

SEQ ID NO: 1612695 - RNA, 18 nt, Pseudomonas putida KT2440
gcgagcugucgcgccagu

SEQ ID NO: 1612696 - RNA, 15 nt, Pseudomonas putida KT2440
gcgaguucaggcgcc

SEQ ID NO: 1612697 - RNA, 22 nt, Pseudomonas putida KT2440
gcgaguucaggcgcccugcgcc

SEQ ID NO: 1612698 - RNA, 12 nt, Pseudomonas putida KT2440
gcgacgggaagu

SEQ ID NO: 1612699 - RNA, 14 nt, Pseudomonas putida KT2440
gcgacgggcugcuc

SEQ ID NO: 1612700 - RNA, 18 nt, Pseudomonas putida KT2440
gcgacgggcugcucccgc

SEQ ID NO: 1612701 - RNA, 16 nt, Pseudomonas putida KT2440
gcgaagguaaccuggu

SEQ ID NO: 1612702 - RNA, 18 nt, Pseudomonas putida KT2440
gcgaagucacaccaucgg

SEQ ID NO: 1612703 - RNA, 18 nt, Pseudomonas putida KT2440
gcgagcccuuguccaggu

SEQ ID NO: 1612704 - RNA, 12 nt, Pseudomonas putida KT2440
gcgagcccgcgc

SEQ ID NO: 1612705 - RNA, 13 nt, Pseudomonas putida KT2440
gcgagccagauca

SEQ ID NO: 1612706 - RNA, 24 nt, Pseudomonas putida KT2440
gcgagccaauuucaacgcucgcgc

SEQ ID NO: 1612707 - RNA, 16 nt, Pseudomonas putida KT2440
gcgacucgcggccggu

SEQ ID NO: 1612708 - RNA, 22 nt, Pseudomonas putida KT2440
gcgacuccugugggagcgggcg

SEQ ID NO: 1612709 - RNA, 18 nt, Pseudomonas putida KT2440
gcgagaaugcugcgcagc

SEQ ID NO: 1612710 - RNA, 19 nt, Pseudomonas putida KT2440
gcgagaaugcugcgcagcu

SEQ ID NO: 1612711 - RNA, 15 nt, Pseudomonas putida KT2440
gcgcccggcgcagca

SEQ ID NO: 1612712 - RNA, 13 nt, Pseudomonas putida KT2440
gcgcccggcgcug

SEQ ID NO: 1612713 - RNA, 18 nt, Pseudomonas putida KT2440
gcgcccggcgcuggugca

SEQ ID NO: 1612714 - RNA, 19 nt, Pseudomonas putida KT2440
gcgcccggcuugcccgggc

SEQ ID NO: 1612715 - RNA, 20 nt, Pseudomonas putida KT2440
gcgcccgguggcgcggccgg

SEQ ID NO: 1612716 - RNA, 16 nt, Pseudomonas putida KT2440
gcgcccggugcaagcc

SEQ ID NO: 1612717 - RNA, 14 nt, Pseudomonas putida KT2440
gcgcccgaggcaau

SEQ ID NO: 1612718 - RNA, 22 nt, Pseudomonas putida KT2440
gcgcccgcaaccucggccgcau

SEQ ID NO: 1612719 - RNA, 17 nt, Pseudomonas putida KT2440
gcgcccgcgaagaggcc

SEQ ID NO: 1612720 - RNA, 19 nt, Pseudomonas putida KT2440
gcgcccgcccaccaccagc

SEQ ID NO: 1612721 - RNA, 20 nt, Pseudomonas putida KT2440
gcgcccgcccaccaccagcc

SEQ ID NO: 1612722 - RNA, 22 nt, Pseudomonas putida KT2440
gcgccccaagcgggccaagguc

SEQ ID NO: 1612723 - RNA, 22 nt, Pseudomonas putida KT2440
gcgcccccugggcgucaaaguu

SEQ ID NO: 1612724 - RNA, 21 nt, Pseudomonas putida KT2440
gcgcccgaacaacaggucggc

SEQ ID NO: 1612725 - RNA, 19 nt, Pseudomonas putida KT2440
gcgccaguacgccagcagc

SEQ ID NO: 1612726 - RNA, 13 nt, Pseudomonas putida KT2440
gcgccagggcaac

SEQ ID NO: 1612727 - RNA, 14 nt, Pseudomonas putida KT2440
gcgccaggucggac

SEQ ID NO: 1612728 - RNA, 19 nt, Pseudomonas putida KT2440
gcgccaggucggacagggu

SEQ ID NO: 1612729 - RNA, 13 nt, Pseudomonas putida KT2440
gcgccaggucggc

SEQ ID NO: 1612730 - RNA, 21 nt, Pseudomonas putida KT2440
gcgccaggcauugcucgauua

SEQ ID NO: 1612731 - RNA, 15 nt, Pseudomonas putida KT2440
gcgccauggccuggc

SEQ ID NO: 1612732 - RNA, 20 nt, Pseudomonas putida KT2440
gcgccauuggccgcgcgccc

SEQ ID NO: 1612733 - RNA, 12 nt, Pseudomonas putida KT2440
gcgcccagaaca

SEQ ID NO: 1612734 - RNA, 15 nt, Pseudomonas putida KT2440
gcgcccacgcggguc

SEQ ID NO: 1612735 - RNA, 17 nt, Pseudomonas putida KT2440
gcgcccaaugcagccgc

SEQ ID NO: 1612736 - RNA, 19 nt, Pseudomonas putida KT2440
gcgcccaaugcagccgccc

SEQ ID NO: 1612737 - RNA, 13 nt, Pseudomonas putida KT2440
gcgccaucggcac

SEQ ID NO: 1612738 - RNA, 22 nt, Pseudomonas putida KT2440
gcgccaucggcacgccagcagc

SEQ ID NO: 1612739 - RNA, 15 nt, Pseudomonas putida KT2440
gcgccaugagugcag

SEQ ID NO: 1612740 - RNA, 14 nt, Pseudomonas putida KT2440
gcgccaucaaggcc

SEQ ID NO: 1612741 - RNA, 15 nt, Pseudomonas putida KT2440
gcgcccugggcgccg

SEQ ID NO: 1612742 - RNA, 12 nt, Pseudomonas putida KT2440
gcgcccuguggg

SEQ ID NO: 1612743 - RNA, 20 nt, Pseudomonas putida KT2440
gcgcccugugggagcggccu

SEQ ID NO: 1612744 - RNA, 14 nt, Pseudomonas putida KT2440
gcgccgagcgcggc

SEQ ID NO: 1612745 - RNA, 22 nt, Pseudomonas putida KT2440
gcgccgagcgcggcgcccagca

SEQ ID NO: 1612746 - RNA, 23 nt, Pseudomonas putida KT2440
gcgccgagcgagugaccuuggcu

SEQ ID NO: 1612747 - RNA, 20 nt, Pseudomonas putida KT2440
gcgccgaccaguaccacagc

SEQ ID NO: 1612748 - RNA, 23 nt, Pseudomonas putida KT2440
gcgccgaccgaaccggcgcuggc

SEQ ID NO: 1612749 - RNA, 15 nt, Pseudomonas putida KT2440
gcgccgccagcugcu

SEQ ID NO: 1612750 - RNA, 16 nt, Pseudomonas putida KT2440
gcgccgccacauccag

SEQ ID NO: 1612751 - RNA, 12 nt, Pseudomonas putida KT2440
gcgccgcaucca

SEQ ID NO: 1612752 - RNA, 16 nt, Pseudomonas putida KT2440
gcgccgcauccagcac

SEQ ID NO: 1612753 - RNA, 22 nt, Pseudomonas putida KT2440
gcgccgccaaccccuccagcac

SEQ ID NO: 1612754 - RNA, 23 nt, Pseudomonas putida KT2440
gcgccgcaucgccacgggcguga

SEQ ID NO: 1612755 - RNA, 18 nt, Pseudomonas putida KT2440
gcgccgaucacaccggca

SEQ ID NO: 1612756 - RNA, 22 nt, Pseudomonas putida KT2440
gcgccgauaaagguugcccggc

SEQ ID NO: 1612757 - RNA, 19 nt, Pseudomonas putida KT2440
gcgccgaugaagcaggccg

SEQ ID NO: 1612758 - RNA, 22 nt, Pseudomonas putida KT2440
gcgccgaugcucgucagccccu

SEQ ID NO: 1612759 - RNA, 14 nt, Pseudomonas putida KT2440
gcgccgcugccugg

SEQ ID NO: 1612760 - RNA, 21 nt, Pseudomonas putida KT2440
gcgccgcucugcccgcgccac

SEQ ID NO: 1612761 - RNA, 21 nt, Pseudomonas putida KT2440
gcgccggauuucuuccauggc

SEQ ID NO: 1612762 - RNA, 16 nt, Pseudomonas putida KT2440
gcgccgcucgcccagc

SEQ ID NO: 1612763 - RNA, 17 nt, Pseudomonas putida KT2440
gcgccgcucgcccagca

SEQ ID NO: 1612764 - RNA, 19 nt, Pseudomonas putida KT2440
gcgccgcucgcccagcagc

SEQ ID NO: 1612765 - RNA, 16 nt, Pseudomonas putida KT2440
gcgccgcgcgggcggc

SEQ ID NO: 1612766 - RNA, 15 nt, Pseudomonas putida KT2440
gcgccgccgcugcug

SEQ ID NO: 1612767 - RNA, 13 nt, Pseudomonas putida KT2440
gcgccgccaggcc

SEQ ID NO: 1612768 - RNA, 13 nt, Pseudomonas putida KT2440
gcgccgccaggca

SEQ ID NO: 1612769 - RNA, 16 nt, Pseudomonas putida KT2440
gcgccgccaggcagca

SEQ ID NO: 1612770 - RNA, 15 nt, Pseudomonas putida KT2440
gcgccgcccagcucu

SEQ ID NO: 1612771 - RNA, 16 nt, Pseudomonas putida KT2440
gcgccgcccagcucuu

SEQ ID NO: 1612772 - RNA, 12 nt, Pseudomonas putida KT2440
gcgccgcccagu

SEQ ID NO: 1612773 - RNA, 15 nt, Pseudomonas putida KT2440
gcgccgcccgcgcgg

SEQ ID NO: 1612774 - RNA, 17 nt, Pseudomonas putida KT2440
gcgccgcccgcgcggcg

SEQ ID NO: 1612775 - RNA, 14 nt, Pseudomonas putida KT2440
gcgccggcuugccu

SEQ ID NO: 1612776 - RNA, 16 nt, Pseudomonas putida KT2440
gcgccgucgccucccc

SEQ ID NO: 1612777 - RNA, 23 nt, Pseudomonas putida KT2440
gcgccgguggcggccgcagcccc

SEQ ID NO: 1612778 - RNA, 18 nt, Pseudomonas putida KT2440
gcgccgguauucgcgagc

SEQ ID NO: 1612779 - RNA, 19 nt, Pseudomonas putida KT2440
gcgccgguauucgcgagcc

SEQ ID NO: 1612780 - RNA, 22 nt, Pseudomonas putida KT2440
gcgccggguuacccaucugcuc

SEQ ID NO: 1612781 - RNA, 13 nt, Pseudomonas putida KT2440
gcgccuccagcug

SEQ ID NO: 1612782 - RNA, 14 nt, Pseudomonas putida KT2440
gcgccuccagcagc

SEQ ID NO: 1612783 - RNA, 15 nt, Pseudomonas putida KT2440
gcgccuccagcagcg

SEQ ID NO: 1612784 - RNA, 16 nt, Pseudomonas putida KT2440
gcgccuacaggcaacc

SEQ ID NO: 1612785 - RNA, 21 nt, Pseudomonas putida KT2440
gcgccuacaggcaaccgcauc

SEQ ID NO: 1612786 - RNA, 16 nt, Pseudomonas putida KT2440
gcgccuacaggcccca

SEQ ID NO: 1612787 - RNA, 17 nt, Pseudomonas putida KT2440
gcgccuacaggccccac

SEQ ID NO: 1612788 - RNA, 21 nt, Pseudomonas putida KT2440
gcgccuaucagaucgagcgcc

SEQ ID NO: 1612789 - RNA, 22 nt, Pseudomonas putida KT2440
gcgccuaucagaucgagcgccc

SEQ ID NO: 1612790 - RNA, 23 nt, Pseudomonas putida KT2440
gcgccgugcuacggccgugcagg

SEQ ID NO: 1612791 - RNA, 21 nt, Pseudomonas putida KT2440
gcgccucuugcaccuguccca

SEQ ID NO: 1612792 - RNA, 16 nt, Pseudomonas putida KT2440
gcgccucuuugcccug

SEQ ID NO: 1612793 - RNA, 15 nt, Pseudomonas putida KT2440
gcgccugacaugcac

SEQ ID NO: 1612794 - RNA, 22 nt, Pseudomonas putida KT2440
gcgccugacgcagugcagccgc

SEQ ID NO: 1612795 - RNA, 17 nt, Pseudomonas putida KT2440
gcgccugcaccuggcug

SEQ ID NO: 1612796 - RNA, 18 nt, Pseudomonas putida KT2440
gcgccugcgccagugccu

SEQ ID NO: 1612797 - RNA, 19 nt, Pseudomonas putida KT2440
gcgccugccgggccagggu

SEQ ID NO: 1612798 - RNA, 14 nt, Pseudomonas putida KT2440
gcgccugcaggccc

SEQ ID NO: 1612799 - RNA, 18 nt, Pseudomonas putida KT2440
gcgccugcaggcccaggu

SEQ ID NO: 1612800 - RNA, 14 nt, Pseudomonas putida KT2440
gcgccuggucauca

SEQ ID NO: 1612801 - RNA, 20 nt, Pseudomonas putida KT2440
gcgccuggucaucagauggc

SEQ ID NO: 1612802 - RNA, 15 nt, Pseudomonas putida KT2440
gcgccuggucgccgc

SEQ ID NO: 1612803 - RNA, 20 nt, Pseudomonas putida KT2440
gcgccugcugcuggaucagu

SEQ ID NO: 1612804 - RNA, 17 nt, Pseudomonas putida KT2440
gcgccugcugccaggcc

SEQ ID NO: 1612805 - RNA, 23 nt, Pseudomonas putida KT2440
gcgccugcugccaggccgcacgc

SEQ ID NO: 1612806 - RNA, 15 nt, Pseudomonas putida KT2440
gcgccugcucaucca

SEQ ID NO: 1612807 - RNA, 16 nt, Pseudomonas putida KT2440
gcgccuggccugcaga

SEQ ID NO: 1612808 - RNA, 14 nt, Pseudomonas putida KT2440
gcgcggcgcccagc

SEQ ID NO: 1612809 - RNA, 18 nt, Pseudomonas putida KT2440
gcgcggcaugcccgcccc

SEQ ID NO: 1612810 - RNA, 21 nt, Pseudomonas putida KT2440
gcgcggcagcccuucgcgggc

SEQ ID NO: 1612811 - RNA, 13 nt, Pseudomonas putida KT2440
gcgcggcaaggug

SEQ ID NO: 1612812 - RNA, 22 nt, Pseudomonas putida KT2440
gcgcggcaaagguggcaccgcc

SEQ ID NO: 1612813 - RNA, 17 nt, Pseudomonas putida KT2440
gcgcgcugugcucagca

SEQ ID NO: 1612814 - RNA, 14 nt, Pseudomonas putida KT2440
gcgcgccgccacau

SEQ ID NO: 1612815 - RNA, 15 nt, Pseudomonas putida KT2440
gcgcgccgccaggcg

SEQ ID NO: 1612816 - RNA, 19 nt, Pseudomonas putida KT2440
gcgccuucauaggcggcca

SEQ ID NO: 1612817 - RNA, 19 nt, Pseudomonas putida KT2440
gcgccuugauuaccagcgc

SEQ ID NO: 1612818 - RNA, 23 nt, Pseudomonas putida KT2440
gcgccuugucggcacgcgccagc

SEQ ID NO: 1612819 - RNA, 15 nt, Pseudomonas putida KT2440
gcgcgcauccacagg

SEQ ID NO: 1612820 - RNA, 19 nt, Pseudomonas putida KT2440
gcgcgcauccacaggcgcc

SEQ ID NO: 1612821 - RNA, 13 nt, Pseudomonas putida KT2440
gcgcgcaacagca

SEQ ID NO: 1612822 - RNA, 12 nt, Pseudomonas putida KT2440
gcgcgccagcag

SEQ ID NO: 1612823 - RNA, 22 nt, Pseudomonas putida KT2440
gcgcgccacgcaccagggcugg

SEQ ID NO: 1612824 - RNA, 21 nt, Pseudomonas putida KT2440
gcgcgaugcgguugcaggacu

SEQ ID NO: 1612825 - RNA, 16 nt, Pseudomonas putida KT2440
gcgcgacuggugcucu

SEQ ID NO: 1612826 - RNA, 16 nt, Pseudomonas putida KT2440
gcgcgacgcagcagcg

SEQ ID NO: 1612827 - RNA, 16 nt, Pseudomonas putida KT2440
gcggcuacccagccgg

SEQ ID NO: 1612828 - RNA, 23 nt, Pseudomonas putida KT2440
gcggcguauacccggucagggug

SEQ ID NO: 1612829 - RNA, 19 nt, Pseudomonas putida KT2440
gcggccgaucacucggcag

SEQ ID NO: 1612830 - RNA, 15 nt, Pseudomonas putida KT2440
gcggcgcccagcaac

SEQ ID NO: 1612831 - RNA, 22 nt, Pseudomonas putida KT2440
gcggcgcgaucaucgaagccag

SEQ ID NO: 1612832 - RNA, 11 nt, Pseudomonas putida KT2440
gcggcgcuggc

SEQ ID NO: 1612833 - RNA, 15 nt, Pseudomonas putida KT2440
gcgggugccgcagca

SEQ ID NO: 1612834 - RNA, 23 nt, Pseudomonas putida KT2440
gcggguggaaauuggccagcagg

SEQ ID NO: 1612835 - RNA, 13 nt, Pseudomonas putida KT2440
gcggguuugcgug

SEQ ID NO: 1612836 - RNA, 19 nt, Pseudomonas putida KT2440
gcgggucauccaggaaaag

SEQ ID NO: 1612837 - RNA, 17 nt, Pseudomonas putida KT2440
gcgggucgagccaggcg

SEQ ID NO: 1612838 - RNA, 16 nt, Pseudomonas putida KT2440
gcgggucguugaaaac

SEQ ID NO: 1612839 - RNA, 18 nt, Pseudomonas putida KT2440
gcgggucuuccaccaccu

SEQ ID NO: 1612840 - RNA, 14 nt, Pseudomonas putida KT2440
gcgggcgugcccgc

SEQ ID NO: 1612841 - RNA, 14 nt, Pseudomonas putida KT2440
gcgggcucgcccac

SEQ ID NO: 1612842 - RNA, 16 nt, Pseudomonas putida KT2440
gcgggcucgcccacuc

SEQ ID NO: 1612843 - RNA, 14 nt, Pseudomonas putida KT2440
gcgggcucgcccgc

SEQ ID NO: 1612844 - RNA, 17 nt, Pseudomonas putida KT2440
gcgggcuacacgcgccc

SEQ ID NO: 1612845 - RNA, 21 nt, Pseudomonas putida KT2440
gcgggcguuguguugcugggc

SEQ ID NO: 1612846 - RNA, 14 nt, Pseudomonas putida KT2440
gcgggcgcgcccgc

SEQ ID NO: 1612847 - RNA, 22 nt, Pseudomonas putida KT2440
gcgggcgcgacaaucaggcguc

SEQ ID NO: 1612848 - RNA, 19 nt, Pseudomonas putida KT2440
gcgggcguaccuggcugcu

SEQ ID NO: 1612849 - RNA, 20 nt, Pseudomonas putida KT2440
gcgggcguaccuggcugcug

SEQ ID NO: 1612850 - RNA, 17 nt, Pseudomonas putida KT2440
gcggggauucaacagcg

SEQ ID NO: 1612851 - RNA, 21 nt, Pseudomonas putida KT2440
gcgggcuuuuuuuugccugga

SEQ ID NO: 1612852 - RNA, 22 nt, Pseudomonas putida KT2440
gcggcuuuagccgugaagaggc

SEQ ID NO: 1612853 - RNA, 13 nt, Pseudomonas putida KT2440
gcggcuugcucgc

SEQ ID NO: 1612854 - RNA, 15 nt, Pseudomonas putida KT2440
gcggcucgaugcugc

SEQ ID NO: 1612855 - RNA, 19 nt, Pseudomonas putida KT2440
gcggcucgcugaacacgca

SEQ ID NO: 1612856 - RNA, 12 nt, Pseudomonas putida KT2440
gcggcugagccg

SEQ ID NO: 1612857 - RNA, 17 nt, Pseudomonas putida KT2440
gcggcugccccaacugc

SEQ ID NO: 1612858 - RNA, 22 nt, Pseudomonas putida KT2440
gcggcugcccgugcugucggug

SEQ ID NO: 1612859 - RNA, 19 nt, Pseudomonas putida KT2440
gcggcugccuacccaggca

SEQ ID NO: 1612860 - RNA, 15 nt, Pseudomonas putida KT2440
gcgggcccagcaggu

SEQ ID NO: 1612861 - RNA, 16 nt, Pseudomonas putida KT2440
gcgggagucgaaccug

SEQ ID NO: 1612862 - RNA, 20 nt, Pseudomonas putida KT2440
gcgggcaugcccgcucccac

SEQ ID NO: 1612863 - RNA, 14 nt, Pseudomonas putida KT2440
gcgggccaagguca

SEQ ID NO: 1612864 - RNA, 16 nt, Pseudomonas putida KT2440
gcgggccaaggucagc

SEQ ID NO: 1612865 - RNA, 19 nt, Pseudomonas putida KT2440
gcgggaaguuaccgcccgc

SEQ ID NO: 1612866 - RNA, 13 nt, Pseudomonas putida KT2440
gcggcccccagca

SEQ ID NO: 1612867 - RNA, 22 nt, Pseudomonas putida KT2440
gcggccccugugggagcggggg

SEQ ID NO: 1612868 - RNA, 22 nt, Pseudomonas putida KT2440
gcggcccuucgcgggcacgccc

SEQ ID NO: 1612869 - RNA, 18 nt, Pseudomonas putida KT2440
gcggccgaaggcgcuggc

SEQ ID NO: 1612870 - RNA, 16 nt, Pseudomonas putida KT2440
gcggcccaaucgccac

SEQ ID NO: 1612871 - RNA, 12 nt, Pseudomonas putida KT2440
gcggccccagau

SEQ ID NO: 1612872 - RNA, 22 nt, Pseudomonas putida KT2440
gcggccccagauuucucagcug

SEQ ID NO: 1612873 - RNA, 15 nt, Pseudomonas putida KT2440
gcggccaccugcccc

SEQ ID NO: 1612874 - RNA, 20 nt, Pseudomonas putida KT2440
gcggccaccggccacgcgca

SEQ ID NO: 1612875 - RNA, 22 nt, Pseudomonas putida KT2440
gcggccaacgcugcucggccuc

SEQ ID NO: 1612876 - RNA, 19 nt, Pseudomonas putida KT2440
gcggccaaagcuguugaag

SEQ ID NO: 1612877 - RNA, 20 nt, Pseudomonas putida KT2440
gcggccaaugaucgagcgca

SEQ ID NO: 1612878 - RNA, 19 nt, Pseudomonas putida KT2440
gcggccaaggcguggcuug

SEQ ID NO: 1612879 - RNA, 20 nt, Pseudomonas putida KT2440
gcggccacagcgccaacgcc

SEQ ID NO: 1612880 - RNA, 12 nt, Pseudomonas putida KT2440
gcggcaggcugg

SEQ ID NO: 1612881 - RNA, 18 nt, Pseudomonas putida KT2440
gcggcaggcgcagcugcc

SEQ ID NO: 1612882 - RNA, 18 nt, Pseudomonas putida KT2440
gcggaucgugacggucug

SEQ ID NO: 1612883 - RNA, 14 nt, Pseudomonas putida KT2440
gcggaccaggugca

SEQ ID NO: 1612884 - RNA, 23 nt, Pseudomonas putida KT2440
gcggacccuugugugggccuugc

SEQ ID NO: 1612885 - RNA, 17 nt, Pseudomonas putida KT2440
gcggcagcggcgaacgg

SEQ ID NO: 1612886 - RNA, 11 nt, Pseudomonas putida KT2440
gcggcaaccug

SEQ ID NO: 1612887 - RNA, 13 nt, Pseudomonas putida KT2440
gcggcaaccugca

SEQ ID NO: 1612888 - RNA, 21 nt, Pseudomonas putida KT2440
gcggcaaacuucucgccucag

SEQ ID NO: 1612889 - RNA, 13 nt, Pseudomonas putida KT2440
gcgcuggcgcgcu

SEQ ID NO: 1612890 - RNA, 15 nt, Pseudomonas putida KT2440
gcgcuggcccuugcc

SEQ ID NO: 1612891 - RNA, 19 nt, Pseudomonas putida KT2440
gcgcugguacagcaggaac

SEQ ID NO: 1612892 - RNA, 13 nt, Pseudomonas putida KT2440
gcgcuguccagcg

SEQ ID NO: 1612893 - RNA, 14 nt, Pseudomonas putida KT2440
gcgcuguccagcgc

SEQ ID NO: 1612894 - RNA, 15 nt, Pseudomonas putida KT2440
gcgcugucccccagc

SEQ ID NO: 1612895 - RNA, 23 nt, Pseudomonas putida KT2440
gcgcugguaaaguucuucuuuaa

SEQ ID NO: 1612896 - RNA, 18 nt, Pseudomonas putida KT2440
gcgcuguggcgcccggcg

SEQ ID NO: 1612897 - RNA, 14 nt, Pseudomonas putida KT2440
gcgcuucauccagc

SEQ ID NO: 1612898 - RNA, 14 nt, Pseudomonas putida KT2440
gcggaacauggugu

SEQ ID NO: 1612899 - RNA, 18 nt, Pseudomonas putida KT2440
gcggaagcucuccagggu

SEQ ID NO: 1612900 - RNA, 13 nt, Pseudomonas putida KT2440
gcggaaggcagcg

SEQ ID NO: 1612901 - RNA, 18 nt, Pseudomonas putida KT2440
gcgcugaucagcuggucg

SEQ ID NO: 1612902 - RNA, 23 nt, Pseudomonas putida KT2440
gcgcucgucgaacucgcgcccac

SEQ ID NO: 1612903 - RNA, 14 nt, Pseudomonas putida KT2440
gcgcucgcuccagg

SEQ ID NO: 1612904 - RNA, 16 nt, Pseudomonas putida KT2440
gcgcucgcugccggcg

SEQ ID NO: 1612905 - RNA, 20 nt, Pseudomonas putida KT2440
gcgcucgcugccggcguggc

SEQ ID NO: 1612906 - RNA, 22 nt, Pseudomonas putida KT2440
gcgcucgcugccggcguggcga

SEQ ID NO: 1612907 - RNA, 20 nt, Pseudomonas putida KT2440
gcgcucgaucucacaggcga

SEQ ID NO: 1612908 - RNA, 17 nt, Pseudomonas putida KT2440
gcgcucgaugcgguggg

SEQ ID NO: 1612909 - RNA, 15 nt, Pseudomonas putida KT2440
gcgcucgagcccgcc

SEQ ID NO: 1612910 - RNA, 17 nt, Pseudomonas putida KT2440
gcgcucgagcccgccag

SEQ ID NO: 1612911 - RNA, 23 nt, Pseudomonas putida KT2440
gcgcucgacgcgcgcagccuggc

SEQ ID NO: 1612912 - RNA, 15 nt, Pseudomonas putida KT2440
gcgcucgacauccag

SEQ ID NO: 1612913 - RNA, 18 nt, Pseudomonas putida KT2440
gcgcucgacauccagcgc

SEQ ID NO: 1612914 - RNA, 20 nt, Pseudomonas putida KT2440
gcgcugauucaacgccccag

SEQ ID NO: 1612915 - RNA, 13 nt, Pseudomonas putida KT2440
gcgcugccaggcc

SEQ ID NO: 1612916 - RNA, 19 nt, Pseudomonas putida KT2440
gcgcugccugcuggcggcu

SEQ ID NO: 1612917 - RNA, 22 nt, Pseudomonas putida KT2440
gcgcugcgcagccaacugguug

SEQ ID NO: 1612918 - RNA, 22 nt, Pseudomonas putida KT2440
gcgcugcugguacaugccgccg

SEQ ID NO: 1612919 - RNA, 17 nt, Pseudomonas putida KT2440
gcagucguacgcgggca

SEQ ID NO: 1612920 - RNA, 17 nt, Pseudomonas putida KT2440
gcagugaugccgugguu

SEQ ID NO: 1612921 - RNA, 15 nt, Pseudomonas putida KT2440
gcagugcaauaccag

SEQ ID NO: 1612922 - RNA, 21 nt, Pseudomonas putida KT2440
gcagugcacccaucggcgcga

SEQ ID NO: 1612923 - RNA, 11 nt, Pseudomonas putida KT2440
gcagugcagcc

SEQ ID NO: 1612924 - RNA, 16 nt, Pseudomonas putida KT2440
gcaguccacuugcguu

SEQ ID NO: 1612925 - RNA, 20 nt, Pseudomonas putida KT2440
gcagucagccacauccucug

SEQ ID NO: 1612926 - RNA, 14 nt, Pseudomonas putida KT2440
gcagucaccuggcc

SEQ ID NO: 1612927 - RNA, 17 nt, Pseudomonas putida KT2440
gcagucccagcaccgcg

SEQ ID NO: 1612928 - RNA, 15 nt, Pseudomonas putida KT2440
gcagucccguuggcc

SEQ ID NO: 1612929 - RNA, 19 nt, Pseudomonas putida KT2440
gcagucccguuggcccgcc

SEQ ID NO: 1612930 - RNA, 23 nt, Pseudomonas putida KT2440
gcaguccuuucgcgacacaaggc

SEQ ID NO: 1612931 - RNA, 21 nt, Pseudomonas putida KT2440
gcagucgaaggggaucagcac

SEQ ID NO: 1612932 - RNA, 20 nt, Pseudomonas putida KT2440
gcagucgaccgggcagaccu

SEQ ID NO: 1612933 - RNA, 18 nt, Pseudomonas putida KT2440
gcagggcgagcacacccg

SEQ ID NO: 1612934 - RNA, 21 nt, Pseudomonas putida KT2440
gcaggggcugccuugcagccc

SEQ ID NO: 1612935 - RNA, 21 nt, Pseudomonas putida KT2440
gcaggggcuggacuaacaggu

SEQ ID NO: 1612936 - RNA, 12 nt, Pseudomonas putida KT2440
gcagggguggga

SEQ ID NO: 1612937 - RNA, 18 nt, Pseudomonas putida KT2440
gcagguuguucggcaggc

SEQ ID NO: 1612938 - RNA, 19 nt, Pseudomonas putida KT2440
gcagguuguucggcaggcu

SEQ ID NO: 1612939 - RNA, 14 nt, Pseudomonas putida KT2440
gcagguuggcgcga

SEQ ID NO: 1612940 - RNA, 22 nt, Pseudomonas putida KT2440
gcagucaaagccuuuuuucggg

SEQ ID NO: 1612941 - RNA, 15 nt, Pseudomonas putida KT2440
gcaguuggccgacga

SEQ ID NO: 1612942 - RNA, 15 nt, Pseudomonas putida KT2440
gcaguugcugcugcc

SEQ ID NO: 1612943 - RNA, 19 nt, Pseudomonas putida KT2440
gcaguugaaugccgccauc

SEQ ID NO: 1612944 - RNA, 22 nt, Pseudomonas putida KT2440
gcaguugaaugccgccauccuc

SEQ ID NO: 1612945 - RNA, 14 nt, Pseudomonas putida KT2440
gcaguugcccuggg

SEQ ID NO: 1612946 - RNA, 13 nt, Pseudomonas putida KT2440
gcauaaccaccac

SEQ ID NO: 1612947 - RNA, 15 nt, Pseudomonas putida KT2440
gcauaaccaccaccg

SEQ ID NO: 1612948 - RNA, 19 nt, Pseudomonas putida KT2440
gcaguguacauggccgcca

SEQ ID NO: 1612949 - RNA, 22 nt, Pseudomonas putida KT2440
gcaguguguugcgguggaagcu

SEQ ID NO: 1612950 - RNA, 20 nt, Pseudomonas putida KT2440
gcaguucgcgcaccaucggc

SEQ ID NO: 1612951 - RNA, 16 nt, Pseudomonas putida KT2440
gcaguucguccaggcu

SEQ ID NO: 1612952 - RNA, 17 nt, Pseudomonas putida KT2440
gcaguucauccggcggc

SEQ ID NO: 1612953 - RNA, 15 nt, Pseudomonas putida KT2440
gcagugccugugaga

SEQ ID NO: 1612954 - RNA, 22 nt, Pseudomonas putida KT2440
gcagugcggcaaccaccaacag

SEQ ID NO: 1612955 - RNA, 14 nt, Pseudomonas putida KT2440
gcagugcugccacg

SEQ ID NO: 1612956 - RNA, 14 nt, Pseudomonas putida KT2440
gcagugccagcaac

SEQ ID NO: 1612957 - RNA, 16 nt, Pseudomonas putida KT2440
gcagugccguggcagg

SEQ ID NO: 1612958 - RNA, 18 nt, Pseudomonas putida KT2440
gcagugccguggcaggca

SEQ ID NO: 1612959 - RNA, 13 nt, Pseudomonas putida KT2440
gcaguggcaagcc

SEQ ID NO: 1612960 - RNA, 18 nt, Pseudomonas putida KT2440
gcaguggugcucagcggc

SEQ ID NO: 1612961 - RNA, 22 nt, Pseudomonas putida KT2440
gcaguggugcucagcggcaccu

SEQ ID NO: 1612962 - RNA, 17 nt, Pseudomonas putida KT2440
gcagugguugugcuggc

SEQ ID NO: 1612963 - RNA, 22 nt, Pseudomonas putida KT2440
gcagggcccccgauuccaaggu

SEQ ID NO: 1612964 - RNA, 14 nt, Pseudomonas putida KT2440
gcagggccgcgcuu

SEQ ID NO: 1612965 - RNA, 15 nt, Pseudomonas putida KT2440
gcagggcaccaguug

SEQ ID NO: 1612966 - RNA, 21 nt, Pseudomonas putida KT2440
gcaggcugucgaacaggcugc

SEQ ID NO: 1612967 - RNA, 21 nt, Pseudomonas putida KT2440
gcaggcuggcgggguggccgg

SEQ ID NO: 1612968 - RNA, 15 nt, Pseudomonas putida KT2440
gcaggcuggcguggu

SEQ ID NO: 1612969 - RNA, 14 nt, Pseudomonas putida KT2440
gcaggcgcagcugc

SEQ ID NO: 1612970 - RNA, 15 nt, Pseudomonas putida KT2440
gcaggcgcagcugcc

SEQ ID NO: 1612971 - RNA, 23 nt, Pseudomonas putida KT2440
gcaggcguguuagccguggggcu

SEQ ID NO: 1612972 - RNA, 21 nt, Pseudomonas putida KT2440
gcaggcugcgugccugcugcu

SEQ ID NO: 1612973 - RNA, 22 nt, Pseudomonas putida KT2440
gcaggcucugaaugucagcgcu

SEQ ID NO: 1612974 - RNA, 18 nt, Pseudomonas putida KT2440
gcaggcucugcuccagcu

SEQ ID NO: 1612975 - RNA, 19 nt, Pseudomonas putida KT2440
gcaggcucugcuccagcug

SEQ ID NO: 1612976 - RNA, 15 nt, Pseudomonas putida KT2440
gcaggcucuccacgu

SEQ ID NO: 1612977 - RNA, 19 nt, Pseudomonas putida KT2440
gcaggcuaauggcgcgccu

SEQ ID NO: 1612978 - RNA, 19 nt, Pseudomonas putida KT2440
gcaggcucagggccgcaga

SEQ ID NO: 1612979 - RNA, 23 nt, Pseudomonas putida KT2440
gcaggcuaugccggucagcagca

SEQ ID NO: 1612980 - RNA, 19 nt, Pseudomonas putida KT2440
gcaggagcgagcaagcucg

SEQ ID NO: 1612981 - RNA, 22 nt, Pseudomonas putida KT2440
gcaggacuacaucuucgcgcuc

SEQ ID NO: 1612982 - RNA, 21 nt, Pseudomonas putida KT2440
gcaggagcggcuuugcguccc

SEQ ID NO: 1612983 - RNA, 12 nt, Pseudomonas putida KT2440
gcaggagcgggc

SEQ ID NO: 1612984 - RNA, 20 nt, Pseudomonas putida KT2440
gcaggccgacaacagcaugc

SEQ ID NO: 1612985 - RNA, 17 nt, Pseudomonas putida KT2440
gcagcuuggccauuucc

SEQ ID NO: 1612986 - RNA, 13 nt, Pseudomonas putida KT2440
gcaggaacuggcu

SEQ ID NO: 1612987 - RNA, 16 nt, Pseudomonas putida KT2440
gcaggaacaaccugaa

SEQ ID NO: 1612988 - RNA, 19 nt, Pseudomonas putida KT2440
gcagcuugcgcaagggguc

SEQ ID NO: 1612989 - RNA, 20 nt, Pseudomonas putida KT2440
gcagcuugcgcaaggggucg

SEQ ID NO: 1612990 - RNA, 20 nt, Pseudomonas putida KT2440
gcagcuugaggucgccaggg

SEQ ID NO: 1612991 - RNA, 20 nt, Pseudomonas putida KT2440
gcagcuucucaagcaucugg

SEQ ID NO: 1612992 - RNA, 13 nt, Pseudomonas putida KT2440
gcagcuucccggc

SEQ ID NO: 1612993 - RNA, 16 nt, Pseudomonas putida KT2440
gcagcuucccggccug

SEQ ID NO: 1612994 - RNA, 19 nt, Pseudomonas putida KT2440
gcagcuucccggccuggcg

SEQ ID NO: 1612995 - RNA, 15 nt, Pseudomonas putida KT2440
gcagcuuccgccacc

SEQ ID NO: 1612996 - RNA, 13 nt, Pseudomonas putida KT2440
gcagcuuccacca

SEQ ID NO: 1612997 - RNA, 17 nt, Pseudomonas putida KT2440
gcagcugggugaucagc

SEQ ID NO: 1612998 - RNA, 20 nt, Pseudomonas putida KT2440
gcagcuggucgagcaaggca

SEQ ID NO: 1612999 - RNA, 18 nt, Pseudomonas putida KT2440
gcagcuucaacuccacca

SEQ ID NO: 1613000 - RNA, 14 nt, Pseudomonas putida KT2440
gcagcgggucgcac

SEQ ID NO: 1613001 - RNA, 15 nt, Pseudomonas putida KT2440
gcaaccgcauccccg

SEQ ID NO: 1613002 - RNA, 20 nt, Pseudomonas putida KT2440
gcaacccuucggccagcagu

SEQ ID NO: 1613003 - RNA, 17 nt, Pseudomonas putida KT2440
gcagcucccgagccagg

SEQ ID NO: 1613004 - RNA, 18 nt, Pseudomonas putida KT2440
gcagcugcagugcugggc

SEQ ID NO: 1613005 - RNA, 16 nt, Pseudomonas putida KT2440
gcagcuccagccagau

SEQ ID NO: 1613006 - RNA, 15 nt, Pseudomonas putida KT2440
gcagcucagccagca

SEQ ID NO: 1613007 - RNA, 17 nt, Pseudomonas putida KT2440
gcagcucagccagcaag

SEQ ID NO: 1613008 - RNA, 23 nt, Pseudomonas putida KT2440
gcagcucaugcgggucaagcugg

SEQ ID NO: 1613009 - RNA, 17 nt, Pseudomonas putida KT2440
gcauccacaccagcggc

SEQ ID NO: 1613010 - RNA, 14 nt, Pseudomonas putida KT2440
gcauccacacccug

SEQ ID NO: 1613011 - RNA, 15 nt, Pseudomonas putida KT2440
gcauccaccugcagg

SEQ ID NO: 1613012 - RNA, 12 nt, Pseudomonas putida KT2440
gcauccagcgcc

SEQ ID NO: 1613013 - RNA, 14 nt, Pseudomonas putida KT2440
gcauccagccagau

SEQ ID NO: 1613014 - RNA, 15 nt, Pseudomonas putida KT2440
gcaucaucucugccg

SEQ ID NO: 1613015 - RNA, 15 nt, Pseudomonas putida KT2440
gcaucauccugcugg

SEQ ID NO: 1613016 - RNA, 19 nt, Pseudomonas putida KT2440
gcauccagguuccccccac

SEQ ID NO: 1613017 - RNA, 11 nt, Pseudomonas putida KT2440
gcauccaggcg

SEQ ID NO: 1613018 - RNA, 16 nt, Pseudomonas putida KT2440
gcaucgaacuccugca

SEQ ID NO: 1613019 - RNA, 16 nt, Pseudomonas putida KT2440
gcaucgaagcaggccg

SEQ ID NO: 1613020 - RNA, 11 nt, Pseudomonas putida KT2440
gcauccuuggg

SEQ ID NO: 1613021 - RNA, 20 nt, Pseudomonas putida KT2440
gcaucgaccggcaggcgcuu

SEQ ID NO: 1613022 - RNA, 21 nt, Pseudomonas putida KT2440
gcaucgacagguccaccgcuu

SEQ ID NO: 1613023 - RNA, 19 nt, Pseudomonas putida KT2440
gcauccugcgugcugugca

SEQ ID NO: 1613024 - RNA, 12 nt, Pseudomonas putida KT2440
gcaucucggcca

SEQ ID NO: 1613025 - RNA, 16 nt, Pseudomonas putida KT2440
gcaucguuauccagca

SEQ ID NO: 1613026 - RNA, 19 nt, Pseudomonas putida KT2440
gcaucguuauccagcaccc

SEQ ID NO: 1613027 - RNA, 17 nt, Pseudomonas putida KT2440
gcaucaagucgcccagu

SEQ ID NO: 1613028 - RNA, 21 nt, Pseudomonas putida KT2440
gcaucaacguucccaauguca

SEQ ID NO: 1613029 - RNA, 14 nt, Pseudomonas putida KT2440
gcaucaacgcugcc

SEQ ID NO: 1613030 - RNA, 16 nt, Pseudomonas putida KT2440
gcaucagggucugagc

SEQ ID NO: 1613031 - RNA, 22 nt, Pseudomonas putida KT2440
gcaucauccgagcugagcagcg

SEQ ID NO: 1613032 - RNA, 15 nt, Pseudomonas putida KT2440
gcauauccuuuguag

SEQ ID NO: 1613033 - RNA, 19 nt, Pseudomonas putida KT2440
gcaucaaauuuagagugcc

SEQ ID NO: 1613034 - RNA, 17 nt, Pseudomonas putida KT2440
gcauagcagaacagaaa

SEQ ID NO: 1613035 - RNA, 15 nt, Pseudomonas putida KT2440
gcauaacgccccagc

SEQ ID NO: 1613036 - RNA, 14 nt, Pseudomonas putida KT2440
gcauaacggcuggc

SEQ ID NO: 1613037 - RNA, 13 nt, Pseudomonas putida KT2440
gcaugcugugccc

SEQ ID NO: 1613038 - RNA, 15 nt, Pseudomonas putida KT2440
gcaugcugugcccug

SEQ ID NO: 1613039 - RNA, 20 nt, Pseudomonas putida KT2440
gcauggcaaacagcaccagc

SEQ ID NO: 1613040 - RNA, 23 nt, Pseudomonas putida KT2440
gcauggcaaucaaugacaauugu

SEQ ID NO: 1613041 - RNA, 18 nt, Pseudomonas putida KT2440
gcauggccgccacaugcu

SEQ ID NO: 1613042 - RNA, 20 nt, Pseudomonas putida KT2440
gcauggccaguuccuggcac

SEQ ID NO: 1613043 - RNA, 15 nt, Pseudomonas putida KT2440
gcauggccagccggc

SEQ ID NO: 1613044 - RNA, 23 nt, Pseudomonas putida KT2440
gcauggccggauagagcccggcg

SEQ ID NO: 1613045 - RNA, 18 nt, Pseudomonas putida KT2440
gcauggcgaucucuuccc

SEQ ID NO: 1613046 - RNA, 19 nt, Pseudomonas putida KT2440
gcauggcgaucucuucccu

SEQ ID NO: 1613047 - RNA, 14 nt, Pseudomonas putida KT2440
gcaugguggaaguc

SEQ ID NO: 1613048 - RNA, 14 nt, Pseudomonas putida KT2440
gcauguagccaauc

SEQ ID NO: 1613049 - RNA, 17 nt, Pseudomonas putida KT2440
gcauguccugaagcagg

SEQ ID NO: 1613050 - RNA, 18 nt, Pseudomonas putida KT2440
gcauguccugaagcaggg

SEQ ID NO: 1613051 - RNA, 15 nt, Pseudomonas putida KT2440
gcauguccuuggccc

SEQ ID NO: 1613052 - RNA, 22 nt, Pseudomonas putida KT2440
gcaucuucuucacguccagcca

SEQ ID NO: 1613053 - RNA, 13 nt, Pseudomonas putida KT2440
gcaucuucuuccc

SEQ ID NO: 1613054 - RNA, 20 nt, Pseudomonas putida KT2440
gcaucugguaauaccacauc

SEQ ID NO: 1613055 - RNA, 23 nt, Pseudomonas putida KT2440
gcaucugcucccccaggcugcca

SEQ ID NO: 1613056 - RNA, 21 nt, Pseudomonas putida KT2440
gcaugccaguagaagcccaga

SEQ ID NO: 1613057 - RNA, 17 nt, Pseudomonas putida KT2440
gcaugcccagcgccacc

SEQ ID NO: 1613058 - RNA, 20 nt, Pseudomonas putida KT2440
gcaugccauugcaccacccc

SEQ ID NO: 1613059 - RNA, 13 nt, Pseudomonas putida KT2440
gcaugccagcagc

SEQ ID NO: 1613060 - RNA, 14 nt, Pseudomonas putida KT2440
gcaugccagcagcu

SEQ ID NO: 1613061 - RNA, 15 nt, Pseudomonas putida KT2440
gcaugcaagcagcca

SEQ ID NO: 1613062 - RNA, 23 nt, Pseudomonas putida KT2440
gcaugcaacggcacacgcaccac

SEQ ID NO: 1613063 - RNA, 19 nt, Pseudomonas putida KT2440
gcauucgcauuaccagcac

SEQ ID NO: 1613064 - RNA, 22 nt, Pseudomonas putida KT2440
gcauucggcgagccuuucaugu

SEQ ID NO: 1613065 - RNA, 16 nt, Pseudomonas putida KT2440
gcauugauagcggcag

SEQ ID NO: 1613066 - RNA, 22 nt, Pseudomonas putida KT2440
gcauugaucgccgccagggugu

SEQ ID NO: 1613067 - RNA, 16 nt, Pseudomonas putida KT2440
gcauugcagccccaau

SEQ ID NO: 1613068 - RNA, 19 nt, Pseudomonas putida KT2440
gcauuggccaacuccaugu

SEQ ID NO: 1613069 - RNA, 20 nt, Pseudomonas putida KT2440
gcauuggagcguugcaggcg

SEQ ID NO: 1613070 - RNA, 20 nt, Pseudomonas putida KT2440
gcauuggaggugcgcggcag

SEQ ID NO: 1613071 - RNA, 13 nt, Pseudomonas putida KT2440
gcauuacaggcag

SEQ ID NO: 1613072 - RNA, 14 nt, Pseudomonas putida KT2440
gcauuacaggcaga

SEQ ID NO: 1613073 - RNA, 19 nt, Pseudomonas putida KT2440
gcauuucgucgagcucgau

SEQ ID NO: 1613074 - RNA, 18 nt, Pseudomonas putida KT2440
gcauuuccauacgugcac

SEQ ID NO: 1613075 - RNA, 17 nt, Pseudomonas putida KT2440
gcauuuucaccgagcug

SEQ ID NO: 1613076 - RNA, 22 nt, Pseudomonas putida KT2440
gccagcgcgguagcugccgcgu

SEQ ID NO: 1613077 - RNA, 15 nt, Pseudomonas putida KT2440
gccagcgcgcugcgc

SEQ ID NO: 1613078 - RNA, 16 nt, Pseudomonas putida KT2440
gccagcgcgcugcgca

SEQ ID NO: 1613079 - RNA, 15 nt, Pseudomonas putida KT2440
gccagcgccuggcga

SEQ ID NO: 1613080 - RNA, 13 nt, Pseudomonas putida KT2440
gccagcggccgcu

SEQ ID NO: 1613081 - RNA, 22 nt, Pseudomonas putida KT2440
gccagcggcaguugcaggcgca

SEQ ID NO: 1613082 - RNA, 16 nt, Pseudomonas putida KT2440
gccagcuccacacucg

SEQ ID NO: 1613083 - RNA, 13 nt, Pseudomonas putida KT2440
gccagcuccacca

SEQ ID NO: 1613084 - RNA, 21 nt, Pseudomonas putida KT2440
gccagcgucuuuggccugcuu

SEQ ID NO: 1613085 - RNA, 19 nt, Pseudomonas putida KT2440
gccagcguucucgcucagg

SEQ ID NO: 1613086 - RNA, 13 nt, Pseudomonas putida KT2440
gccagcucggcag

SEQ ID NO: 1613087 - RNA, 23 nt, Pseudomonas putida KT2440
gccagcuccuucgcuucgcgcac

SEQ ID NO: 1613088 - RNA, 16 nt, Pseudomonas putida KT2440
gccagcguaagcuggc

SEQ ID NO: 1613089 - RNA, 16 nt, Pseudomonas putida KT2440
gccagcgucagggucu

SEQ ID NO: 1613090 - RNA, 21 nt, Pseudomonas putida KT2440
gccagcguggccgccaacagc

SEQ ID NO: 1613091 - RNA, 18 nt, Pseudomonas putida KT2440
gccagcgugaaccggcug

SEQ ID NO: 1613092 - RNA, 19 nt, Pseudomonas putida KT2440
gccagcgugaaccggcugu

SEQ ID NO: 1613093 - RNA, 19 nt, Pseudomonas putida KT2440
gccaggagaacacccagcg

SEQ ID NO: 1613094 - RNA, 22 nt, Pseudomonas putida KT2440
gccaggagaacacccagcgcau

SEQ ID NO: 1613095 - RNA, 20 nt, Pseudomonas putida KT2440
gccaggcaguuucaggcgcu

SEQ ID NO: 1613096 - RNA, 14 nt, Pseudomonas putida KT2440
gccaggcacuggcc

SEQ ID NO: 1613097 - RNA, 15 nt, Pseudomonas putida KT2440
gccaggcacuggcca

SEQ ID NO: 1613098 - RNA, 17 nt, Pseudomonas putida KT2440
gccaggcacuggccagc

SEQ ID NO: 1613099 - RNA, 22 nt, Pseudomonas putida KT2440
gccaggcaaaguugagcgccgc

SEQ ID NO: 1613100 - RNA, 18 nt, Pseudomonas putida KT2440
gccaggcacccagccagc

SEQ ID NO: 1613101 - RNA, 15 nt, Pseudomonas putida KT2440
gccaggauggcuuug

SEQ ID NO: 1613102 - RNA, 17 nt, Pseudomonas putida KT2440
gccaggcccagccccgc

SEQ ID NO: 1613103 - RNA, 13 nt, Pseudomonas putida KT2440
gccaggcccacca

SEQ ID NO: 1613104 - RNA, 13 nt, Pseudomonas putida KT2440
gccaggcccagcc

SEQ ID NO: 1613105 - RNA, 17 nt, Pseudomonas putida KT2440
gccaggccaaacaggcc

SEQ ID NO: 1613106 - RNA, 16 nt, Pseudomonas putida KT2440
gccaggccgugcuuga

SEQ ID NO: 1613107 - RNA, 14 nt, Pseudomonas putida KT2440
gccaggccggcgca

SEQ ID NO: 1613108 - RNA, 16 nt, Pseudomonas putida KT2440
gccaggccggcgcaga

SEQ ID NO: 1613109 - RNA, 13 nt, Pseudomonas putida KT2440
gccagcuuggcuu

SEQ ID NO: 1613110 - RNA, 19 nt, Pseudomonas putida KT2440
gccagcuuggucagggcaa

SEQ ID NO: 1613111 - RNA, 17 nt, Pseudomonas putida KT2440
gccagcuuggcaggcuu

SEQ ID NO: 1613112 - RNA, 17 nt, Pseudomonas putida KT2440
gccaggaacagcgcagc

SEQ ID NO: 1613113 - RNA, 19 nt, Pseudomonas putida KT2440
gccaggaacagcgcagcca

SEQ ID NO: 1613114 - RNA, 15 nt, Pseudomonas putida KT2440
gccaggaacagcgcc

SEQ ID NO: 1613115 - RNA, 17 nt, Pseudomonas putida KT2440
gccaggacgauggugaa

SEQ ID NO: 1613116 - RNA, 22 nt, Pseudomonas putida KT2440
gccagcugcugcggcaccucgu

SEQ ID NO: 1613117 - RNA, 17 nt, Pseudomonas putida KT2440
gccagcucggccgaugc

SEQ ID NO: 1613118 - RNA, 19 nt, Pseudomonas putida KT2440
gccagcucggccgaugcca

SEQ ID NO: 1613119 - RNA, 12 nt, Pseudomonas putida KT2440
gccagcugcgca

SEQ ID NO: 1613120 - RNA, 16 nt, Pseudomonas putida KT2440
gccagcaggccgccga

SEQ ID NO: 1613121 - RNA, 11 nt, Pseudomonas putida KT2440
gccagcaggcc

SEQ ID NO: 1613122 - RNA, 14 nt, Pseudomonas putida KT2440
gccagcaggccacc

SEQ ID NO: 1613123 - RNA, 17 nt, Pseudomonas putida KT2440
gccagcaggccaccggc

SEQ ID NO: 1613124 - RNA, 22 nt, Pseudomonas putida KT2440
gccagcaggccaccggcagcac

SEQ ID NO: 1613125 - RNA, 23 nt, Pseudomonas putida KT2440
gccagcagcggguuccccagcaa

SEQ ID NO: 1613126 - RNA, 18 nt, Pseudomonas putida KT2440
gccagcaguucgcagcca

SEQ ID NO: 1613127 - RNA, 17 nt, Pseudomonas putida KT2440
gccagcagccccccuuc

SEQ ID NO: 1613128 - RNA, 13 nt, Pseudomonas putida KT2440
gccagcagcgcgu

SEQ ID NO: 1613129 - RNA, 22 nt, Pseudomonas putida KT2440
gccagcagcgcauggcucaacu

SEQ ID NO: 1613130 - RNA, 12 nt, Pseudomonas putida KT2440
gccagccaacgc

SEQ ID NO: 1613131 - RNA, 23 nt, Pseudomonas putida KT2440
gccagccagguauggccagagcg

SEQ ID NO: 1613132 - RNA, 22 nt, Pseudomonas putida KT2440
gccagccauuccuugcgcggcg

SEQ ID NO: 1613133 - RNA, 15 nt, Pseudomonas putida KT2440
gccagcccauccagg

SEQ ID NO: 1613134 - RNA, 18 nt, Pseudomonas putida KT2440
gccagcccauccagggcu

SEQ ID NO: 1613135 - RNA, 23 nt, Pseudomonas putida KT2440
gccagcccauccagggcuuccug

SEQ ID NO: 1613136 - RNA, 15 nt, Pseudomonas putida KT2440
gccagcccauggcgc

SEQ ID NO: 1613137 - RNA, 21 nt, Pseudomonas putida KT2440
gccagccccaacccaccagca

SEQ ID NO: 1613138 - RNA, 15 nt, Pseudomonas putida KT2440
gccagcagugcggca

SEQ ID NO: 1613139 - RNA, 15 nt, Pseudomonas putida KT2440
gccagcaucucggcc

SEQ ID NO: 1613140 - RNA, 16 nt, Pseudomonas putida KT2440
gccagcaugcugguua

SEQ ID NO: 1613141 - RNA, 15 nt, Pseudomonas putida KT2440
gccagcgcacagcug

SEQ ID NO: 1613142 - RNA, 20 nt, Pseudomonas putida KT2440
gccagccuucgccaacugca

SEQ ID NO: 1613143 - RNA, 18 nt, Pseudomonas putida KT2440
gccagcgccugcugccag

SEQ ID NO: 1613144 - RNA, 21 nt, Pseudomonas putida KT2440
gccagcgccugcugccaggcc

SEQ ID NO: 1613145 - RNA, 14 nt, Pseudomonas putida KT2440
gccagcgccucacc

SEQ ID NO: 1613146 - RNA, 15 nt, Pseudomonas putida KT2440
gccagcgccucaccg

SEQ ID NO: 1613147 - RNA, 12 nt, Pseudomonas putida KT2440
gccagcgccugc

SEQ ID NO: 1613148 - RNA, 15 nt, Pseudomonas putida KT2440
gccagcgccugcagg

SEQ ID NO: 1613149 - RNA, 17 nt, Pseudomonas putida KT2440
gccagccgcaggcgccc

SEQ ID NO: 1613150 - RNA, 20 nt, Pseudomonas putida KT2440
gccagccgcgccaggucggc

SEQ ID NO: 1613151 - RNA, 21 nt, Pseudomonas putida KT2440
gccagccgcaaccgggucggc

SEQ ID NO: 1613152 - RNA, 14 nt, Pseudomonas putida KT2440
gccagccccagccc

SEQ ID NO: 1613153 - RNA, 13 nt, Pseudomonas putida KT2440
gccagccgcggca

SEQ ID NO: 1613154 - RNA, 14 nt, Pseudomonas putida KT2440
gccagccugcagcg

SEQ ID NO: 1613155 - RNA, 13 nt, Pseudomonas putida KT2440
gccagccugcagc

SEQ ID NO: 1613156 - RNA, 17 nt, Pseudomonas putida KT2440
gccagccguugcgccgc

SEQ ID NO: 1613157 - RNA, 22 nt, Pseudomonas putida KT2440
gccagccguuguacaagcuggc

SEQ ID NO: 1613158 - RNA, 14 nt, Pseudomonas putida KT2440
gccagccuccggcc

SEQ ID NO: 1613159 - RNA, 16 nt, Pseudomonas putida KT2440
gccacauccucugccc

SEQ ID NO: 1613160 - RNA, 15 nt, Pseudomonas putida KT2440
gccacauccagcgcc

SEQ ID NO: 1613161 - RNA, 16 nt, Pseudomonas putida KT2440
gccacauccagcgccu

SEQ ID NO: 1613162 - RNA, 19 nt, Pseudomonas putida KT2440
gccaccaaccggccagugg

SEQ ID NO: 1613163 - RNA, 15 nt, Pseudomonas putida KT2440
gccacaugaaggccg

SEQ ID NO: 1613164 - RNA, 20 nt, Pseudomonas putida KT2440
gccaccacccggggcagcau

SEQ ID NO: 1613165 - RNA, 17 nt, Pseudomonas putida KT2440
gccaccacacuggucac

SEQ ID NO: 1613166 - RNA, 14 nt, Pseudomonas putida KT2440
gccaccaccagcaa

SEQ ID NO: 1613167 - RNA, 22 nt, Pseudomonas putida KT2440
gccacacacauucccuguagga

SEQ ID NO: 1613168 - RNA, 19 nt, Pseudomonas putida KT2440
gccacacacccgggcccgc

SEQ ID NO: 1613169 - RNA, 23 nt, Pseudomonas putida KT2440
gccacacaagccccccuguagga

SEQ ID NO: 1613170 - RNA, 20 nt, Pseudomonas putida KT2440
gccacacccgcuacaccggc

SEQ ID NO: 1613171 - RNA, 13 nt, Pseudomonas putida KT2440
gccacaccgaagc

SEQ ID NO: 1613172 - RNA, 17 nt, Pseudomonas putida KT2440
gccacagguacugcgca

SEQ ID NO: 1613173 - RNA, 16 nt, Pseudomonas putida KT2440
gccacaacggcgcgcc

SEQ ID NO: 1613174 - RNA, 19 nt, Pseudomonas putida KT2440
gccaaauucgaccagcagu

SEQ ID NO: 1613175 - RNA, 20 nt, Pseudomonas putida KT2440
gccaaaguccggcgaagcac

SEQ ID NO: 1613176 - RNA, 22 nt, Pseudomonas putida KT2440
gccaaagcugaaugaaaaagcc

SEQ ID NO: 1613177 - RNA, 13 nt, Pseudomonas putida KT2440
gccacgcccgcug

SEQ ID NO: 1613178 - RNA, 19 nt, Pseudomonas putida KT2440
gccacgcccgcugcaugcu

SEQ ID NO: 1613179 - RNA, 21 nt, Pseudomonas putida KT2440
gccacgcccauggcuccaccc

SEQ ID NO: 1613180 - RNA, 19 nt, Pseudomonas putida KT2440
gccacgcccaacccagcca

SEQ ID NO: 1613181 - RNA, 21 nt, Pseudomonas putida KT2440
gccacgcccaacccagccagc

SEQ ID NO: 1613182 - RNA, 15 nt, Pseudomonas putida KT2440
gccacgcccaacccc

SEQ ID NO: 1613183 - RNA, 17 nt, Pseudomonas putida KT2440
gccacgcaccucggcca

SEQ ID NO: 1613184 - RNA, 16 nt, Pseudomonas putida KT2440
gccaccuguugccgcu

SEQ ID NO: 1613185 - RNA, 14 nt, Pseudomonas putida KT2440
gccaccucaucuac

SEQ ID NO: 1613186 - RNA, 23 nt, Pseudomonas putida KT2440
gccaccugccacacacccgggcc

SEQ ID NO: 1613187 - RNA, 15 nt, Pseudomonas putida KT2440
gccaccugccccagc

SEQ ID NO: 1613188 - RNA, 16 nt, Pseudomonas putida KT2440
gccaccugcccgggcc

SEQ ID NO: 1613189 - RNA, 19 nt, Pseudomonas putida KT2440
gccaccugcccgggccgcu

SEQ ID NO: 1613190 - RNA, 13 nt, Pseudomonas putida KT2440
gccaccuggccuu

SEQ ID NO: 1613191 - RNA, 14 nt, Pseudomonas putida KT2440
gccaccgcgcgcca

SEQ ID NO: 1613192 - RNA, 19 nt, Pseudomonas putida KT2440
gccaccgcgcgccaguucg

SEQ ID NO: 1613193 - RNA, 14 nt, Pseudomonas putida KT2440
gccaccgcgaugga

SEQ ID NO: 1613194 - RNA, 20 nt, Pseudomonas putida KT2440
gccaccaucuugcccagggc

SEQ ID NO: 1613195 - RNA, 18 nt, Pseudomonas putida KT2440
gccaccgugagcauggca

SEQ ID NO: 1613196 - RNA, 15 nt, Pseudomonas putida KT2440
gccaccaggcgcggc

SEQ ID NO: 1613197 - RNA, 21 nt, Pseudomonas putida KT2440
gccaccaggcgcggcagcaug

SEQ ID NO: 1613198 - RNA, 18 nt, Pseudomonas putida KT2440
gccaccaggccuuugacu

SEQ ID NO: 1613199 - RNA, 17 nt, Pseudomonas putida KT2440
gccaccaucgaccuggc

SEQ ID NO: 1613200 - RNA, 18 nt, Pseudomonas putida KT2440
gccaccaucgaccuggcc

SEQ ID NO: 1613201 - RNA, 18 nt, Pseudomonas putida KT2440
gccaccaucgacucacgc

SEQ ID NO: 1613202 - RNA, 20 nt, Pseudomonas putida KT2440
gccaccaucgccggcacgcu

SEQ ID NO: 1613203 - RNA, 16 nt, Pseudomonas putida KT2440
gccaccagcaucaaca

SEQ ID NO: 1613204 - RNA, 19 nt, Pseudomonas putida KT2440
gccaccagcaucaacaggu

SEQ ID NO: 1613205 - RNA, 12 nt, Pseudomonas putida KT2440
gccaccagcacc

SEQ ID NO: 1613206 - RNA, 21 nt, Pseudomonas putida KT2440
gccaccagaugaccaaagauc

SEQ ID NO: 1613207 - RNA, 13 nt, Pseudomonas putida KT2440
gccagcaacaggc

SEQ ID NO: 1613208 - RNA, 14 nt, Pseudomonas putida KT2440
gccagcaacaggcu

SEQ ID NO: 1613209 - RNA, 14 nt, Pseudomonas putida KT2440
gccagcaacaagcu

SEQ ID NO: 1613210 - RNA, 19 nt, Pseudomonas putida KT2440
gccagcaacaagcuggaca

SEQ ID NO: 1613211 - RNA, 24 nt, Pseudomonas putida KT2440
gccagcaacaagcuggacaugcac

SEQ ID NO: 1613212 - RNA, 20 nt, Pseudomonas putida KT2440
gccagcaaaaguuggcugac

SEQ ID NO: 1613213 - RNA, 19 nt, Pseudomonas putida KT2440
gccagaucucgcgcuuuuc

SEQ ID NO: 1613214 - RNA, 16 nt, Pseudomonas putida KT2440
gccagaucggccagcu

SEQ ID NO: 1613215 - RNA, 22 nt, Pseudomonas putida KT2440
gccagaugcgccgggacagcac

SEQ ID NO: 1613216 - RNA, 17 nt, Pseudomonas putida KT2440
gccagaugcgcgcugca

SEQ ID NO: 1613217 - RNA, 21 nt, Pseudomonas putida KT2440
gccagaugcgcgcugcaauca

SEQ ID NO: 1613218 - RNA, 23 nt, Pseudomonas putida KT2440
gccagcaccaucaggcacaggcc

SEQ ID NO: 1613219 - RNA, 20 nt, Pseudomonas putida KT2440
gccagcacguucucgcucag

SEQ ID NO: 1613220 - RNA, 13 nt, Pseudomonas putida KT2440
gccagcacgccgg

SEQ ID NO: 1613221 - RNA, 17 nt, Pseudomonas putida KT2440
gccagcacgcaggccag

SEQ ID NO: 1613222 - RNA, 18 nt, Pseudomonas putida KT2440
gccagcacggccagcacc

SEQ ID NO: 1613223 - RNA, 20 nt, Pseudomonas putida KT2440
gccagcacacgguaggcguc

SEQ ID NO: 1613224 - RNA, 21 nt, Pseudomonas putida KT2440
gccacggaucaccuggccgug

SEQ ID NO: 1613225 - RNA, 17 nt, Pseudomonas putida KT2440
gccacggcaauggcccg

SEQ ID NO: 1613226 - RNA, 16 nt, Pseudomonas putida KT2440
gccacgcugccaggac

SEQ ID NO: 1613227 - RNA, 12 nt, Pseudomonas putida KT2440
gccacgcgcgcc

SEQ ID NO: 1613228 - RNA, 16 nt, Pseudomonas putida KT2440
gccagaaagccacugc

SEQ ID NO: 1613229 - RNA, 20 nt, Pseudomonas putida KT2440
gccagaaaaguuggccaugu

SEQ ID NO: 1613230 - RNA, 14 nt, Pseudomonas putida KT2440
gccagaccaccuca

SEQ ID NO: 1613231 - RNA, 17 nt, Pseudomonas putida KT2440
gccagaccaccucaucc

SEQ ID NO: 1613232 - RNA, 23 nt, Pseudomonas putida KT2440
gccagaccaccucaucccccggc

SEQ ID NO: 1613233 - RNA, 17 nt, Pseudomonas putida KT2440
gccagacaacuggccag

SEQ ID NO: 1613234 - RNA, 14 nt, Pseudomonas putida KT2440
gccagacgaccagc

SEQ ID NO: 1613235 - RNA, 18 nt, Pseudomonas putida KT2440
gccagacgaccagcaugc

SEQ ID NO: 1613236 - RNA, 15 nt, Pseudomonas putida KT2440
gccgcgaagcggccc

SEQ ID NO: 1613237 - RNA, 15 nt, Pseudomonas putida KT2440
gccgccuucuccagc

SEQ ID NO: 1613238 - RNA, 15 nt, Pseudomonas putida KT2440
gccgcgaacgccccg

SEQ ID NO: 1613239 - RNA, 15 nt, Pseudomonas putida KT2440
gccgccuugcagaaa

SEQ ID NO: 1613240 - RNA, 15 nt, Pseudomonas putida KT2440
gccgcgcgggcggcg

SEQ ID NO: 1613241 - RNA, 16 nt, Pseudomonas putida KT2440
gccgcgcccucuuccg

SEQ ID NO: 1613242 - RNA, 18 nt, Pseudomonas putida KT2440
gccgcgaugaugaucaau

SEQ ID NO: 1613243 - RNA, 15 nt, Pseudomonas putida KT2440
gccgccgcagcaauc

SEQ ID NO: 1613244 - RNA, 15 nt, Pseudomonas putida KT2440
gccgccgccagacca

SEQ ID NO: 1613245 - RNA, 20 nt, Pseudomonas putida KT2440
gccgccccuccacccaccuu

SEQ ID NO: 1613246 - RNA, 22 nt, Pseudomonas putida KT2440
gccgcccgcuuuuggcugugca

SEQ ID NO: 1613247 - RNA, 13 nt, Pseudomonas putida KT2440
gccgcgcuguggc

SEQ ID NO: 1613248 - RNA, 19 nt, Pseudomonas putida KT2440
gccgcgcuguggcgcccgg

SEQ ID NO: 1613249 - RNA, 20 nt, Pseudomonas putida KT2440
gccgcgcuguggcgcccggc

SEQ ID NO: 1613250 - RNA, 21 nt, Pseudomonas putida KT2440
gccgcgcuguggcgcccggcg

SEQ ID NO: 1613251 - RNA, 18 nt, Pseudomonas putida KT2440
gccgcguccuugaucagg

SEQ ID NO: 1613252 - RNA, 22 nt, Pseudomonas putida KT2440
gccgcguucgcccaggcgccgc

SEQ ID NO: 1613253 - RNA, 14 nt, Pseudomonas putida KT2440
gccgcguugucagg

SEQ ID NO: 1613254 - RNA, 14 nt, Pseudomonas putida KT2440
gccgcuacgcgccc

SEQ ID NO: 1613255 - RNA, 21 nt, Pseudomonas putida KT2440
gccgcucagccaccugugggu

SEQ ID NO: 1613256 - RNA, 15 nt, Pseudomonas putida KT2440
gccgcucaccccaua

SEQ ID NO: 1613257 - RNA, 16 nt, Pseudomonas putida KT2440
gccgcucugcccgcgc

SEQ ID NO: 1613258 - RNA, 13 nt, Pseudomonas putida KT2440
gccgcugccaacc

SEQ ID NO: 1613259 - RNA, 12 nt, Pseudomonas putida KT2440
gccgcugccaca

SEQ ID NO: 1613260 - RNA, 15 nt, Pseudomonas putida KT2440
gccgcugcugcgccu

SEQ ID NO: 1613261 - RNA, 16 nt, Pseudomonas putida KT2440
gccgcugcugcgccuc

SEQ ID NO: 1613262 - RNA, 16 nt, Pseudomonas putida KT2440
gccgcugcggcugcuc

SEQ ID NO: 1613263 - RNA, 15 nt, Pseudomonas putida KT2440
gccgcugcgccugcc

SEQ ID NO: 1613264 - RNA, 16 nt, Pseudomonas putida KT2440
gccgcugcgccugccg

SEQ ID NO: 1613265 - RNA, 13 nt, Pseudomonas putida KT2440
gccgcuggcggcg

SEQ ID NO: 1613266 - RNA, 16 nt, Pseudomonas putida KT2440
gccgcuggcuuccuca

SEQ ID NO: 1613267 - RNA, 12 nt, Pseudomonas putida KT2440
gccgcuggcccu

SEQ ID NO: 1613268 - RNA, 13 nt, Pseudomonas putida KT2440
gccgcugugccag

SEQ ID NO: 1613269 - RNA, 16 nt, Pseudomonas putida KT2440
gccgcuguucagcccu

SEQ ID NO: 1613270 - RNA, 19 nt, Pseudomonas putida KT2440
gccgcuguucagcccuugc

SEQ ID NO: 1613271 - RNA, 17 nt, Pseudomonas putida KT2440
gccgcuucacuguccug

SEQ ID NO: 1613272 - RNA, 19 nt, Pseudomonas putida KT2440
gccgcugguagucauccuc

SEQ ID NO: 1613273 - RNA, 20 nt, Pseudomonas putida KT2440
gccgaacaggccggcugcag

SEQ ID NO: 1613274 - RNA, 17 nt, Pseudomonas putida KT2440
gccgaacagucauccag

SEQ ID NO: 1613275 - RNA, 11 nt, Pseudomonas putida KT2440
gccgaaccacc

SEQ ID NO: 1613276 - RNA, 17 nt, Pseudomonas putida KT2440
gccgaaccaccgaugcu

SEQ ID NO: 1613277 - RNA, 20 nt, Pseudomonas putida KT2440
gccgaacgggccaccaaagg

SEQ ID NO: 1613278 - RNA, 20 nt, Pseudomonas putida KT2440
gccgacacaccaauggccau

SEQ ID NO: 1613279 - RNA, 21 nt, Pseudomonas putida KT2440
gccgacaacgguguggccagu

SEQ ID NO: 1613280 - RNA, 14 nt, Pseudomonas putida KT2440
gccgacaacagcau

SEQ ID NO: 1613281 - RNA, 21 nt, Pseudomonas putida KT2440
gccgacaaaacugagcaagaa

SEQ ID NO: 1613282 - RNA, 19 nt, Pseudomonas putida KT2440
gccgacaaaaacaacaaua

SEQ ID NO: 1613283 - RNA, 22 nt, Pseudomonas putida KT2440
gccgacuggcgcaccagcggcu

SEQ ID NO: 1613284 - RNA, 14 nt, Pseudomonas putida KT2440
gccgacuccaacgc

SEQ ID NO: 1613285 - RNA, 17 nt, Pseudomonas putida KT2440
gccgaccaguaccacag

SEQ ID NO: 1613286 - RNA, 20 nt, Pseudomonas putida KT2440
gccgaccaguaccacagcca

SEQ ID NO: 1613287 - RNA, 19 nt, Pseudomonas putida KT2440
gccgacccgggccagccac

SEQ ID NO: 1613288 - RNA, 19 nt, Pseudomonas putida KT2440
gccgaccgaaccggcgcug

SEQ ID NO: 1613289 - RNA, 13 nt, Pseudomonas putida KT2440
gccgaccgcgcgc

SEQ ID NO: 1613290 - RNA, 21 nt, Pseudomonas putida KT2440
gcccugcucuucgauccgcgc

SEQ ID NO: 1613291 - RNA, 15 nt, Pseudomonas putida KT2440
gcccugcucauccag

SEQ ID NO: 1613292 - RNA, 18 nt, Pseudomonas putida KT2440
gcccugcucauccagcaa

SEQ ID NO: 1613293 - RNA, 18 nt, Pseudomonas putida KT2440
gcccgggcacgggccagc

SEQ ID NO: 1613294 - RNA, 16 nt, Pseudomonas putida KT2440
gcccugcgccugcagu

SEQ ID NO: 1613295 - RNA, 18 nt, Pseudomonas putida KT2440
gcccgggcgcaggcagca

SEQ ID NO: 1613296 - RNA, 13 nt, Pseudomonas putida KT2440
gcccugccgccuu

SEQ ID NO: 1613297 - RNA, 21 nt, Pseudomonas putida KT2440
gcccugccgccuucuccagcu

SEQ ID NO: 1613298 - RNA, 23 nt, Pseudomonas putida KT2440
gcccuguacauccagcuccagca

SEQ ID NO: 1613299 - RNA, 17 nt, Pseudomonas putida KT2440
gcccuguaccgccucgg

SEQ ID NO: 1613300 - RNA, 21 nt, Pseudomonas putida KT2440
gcccugugcuuugagcaggcg

SEQ ID NO: 1613301 - RNA, 19 nt, Pseudomonas putida KT2440
gcccugugggagcggccuu

SEQ ID NO: 1613302 - RNA, 16 nt, Pseudomonas putida KT2440
gcccuucugcgccaaa

SEQ ID NO: 1613303 - RNA, 15 nt, Pseudomonas putida KT2440
gccgaacagcaggca

SEQ ID NO: 1613304 - RNA, 15 nt, Pseudomonas putida KT2440
gccgaaauaugcagu

SEQ ID NO: 1613305 - RNA, 20 nt, Pseudomonas putida KT2440
gccgaaauaugcagugcccg

SEQ ID NO: 1613306 - RNA, 13 nt, Pseudomonas putida KT2440
gcccuugcucaau

SEQ ID NO: 1613307 - RNA, 22 nt, Pseudomonas putida KT2440
gcccuugcucaggucguacggc

SEQ ID NO: 1613308 - RNA, 18 nt, Pseudomonas putida KT2440
gcccuugcugcagcaggc

SEQ ID NO: 1613309 - RNA, 20 nt, Pseudomonas putida KT2440
gcccuugcugcagcaggcug

SEQ ID NO: 1613310 - RNA, 18 nt, Pseudomonas putida KT2440
gcccuuggcagcgcugca

SEQ ID NO: 1613311 - RNA, 22 nt, Pseudomonas putida KT2440
gcccuugccaccagugccgggu

SEQ ID NO: 1613312 - RNA, 15 nt, Pseudomonas putida KT2440
gccgaaaccgcccgg

SEQ ID NO: 1613313 - RNA, 17 nt, Pseudomonas putida KT2440
gccgaaaccagccccuu

SEQ ID NO: 1613314 - RNA, 15 nt, Pseudomonas putida KT2440
gccgcagcgcauggu

SEQ ID NO: 1613315 - RNA, 20 nt, Pseudomonas putida KT2440
gccgcagcaguuggccgacg

SEQ ID NO: 1613316 - RNA, 13 nt, Pseudomonas putida KT2440
gccgcagccaugc

SEQ ID NO: 1613317 - RNA, 16 nt, Pseudomonas putida KT2440
gccgccagaccaccuc

SEQ ID NO: 1613318 - RNA, 17 nt, Pseudomonas putida KT2440
gccgccagaccauaagc

SEQ ID NO: 1613319 - RNA, 18 nt, Pseudomonas putida KT2440
gccgccagaccauaagcg

SEQ ID NO: 1613320 - RNA, 22 nt, Pseudomonas putida KT2440
gccgcauuucgacgcagaggug

SEQ ID NO: 1613321 - RNA, 16 nt, Pseudomonas putida KT2440
gccgccaccuggcugc

SEQ ID NO: 1613322 - RNA, 17 nt, Pseudomonas putida KT2440
gccgccaccuggcugcg

SEQ ID NO: 1613323 - RNA, 13 nt, Pseudomonas putida KT2440
gccgcaucagccg

SEQ ID NO: 1613324 - RNA, 21 nt, Pseudomonas putida KT2440
gccgaugaccugcgucaggac

SEQ ID NO: 1613325 - RNA, 14 nt, Pseudomonas putida KT2440
gccgauuuggcccg

SEQ ID NO: 1613326 - RNA, 18 nt, Pseudomonas putida KT2440
gccgauuuggcccgcugc

SEQ ID NO: 1613327 - RNA, 15 nt, Pseudomonas putida KT2440
gccgcaaagcggccc

SEQ ID NO: 1613328 - RNA, 21 nt, Pseudomonas putida KT2440
gccgcaaagcggccccagcgu

SEQ ID NO: 1613329 - RNA, 18 nt, Pseudomonas putida KT2440
gccgcaaagcggccccca

SEQ ID NO: 1613330 - RNA, 19 nt, Pseudomonas putida KT2440
gccgcaaagcggccccuuc

SEQ ID NO: 1613331 - RNA, 15 nt, Pseudomonas putida KT2440
gccgcaccuacaggg

SEQ ID NO: 1613332 - RNA, 16 nt, Pseudomonas putida KT2440
gccgcaccugcccgcc

SEQ ID NO: 1613333 - RNA, 12 nt, Pseudomonas putida KT2440
gccgcaagcagu

SEQ ID NO: 1613334 - RNA, 14 nt, Pseudomonas putida KT2440
gccgcaagcagucc

SEQ ID NO: 1613335 - RNA, 19 nt, Pseudomonas putida KT2440
gccgcaagcagucccagca

SEQ ID NO: 1613336 - RNA, 19 nt, Pseudomonas putida KT2440
gccgagcgcggcgcccagc

SEQ ID NO: 1613337 - RNA, 18 nt, Pseudomonas putida KT2440
gccgagcaucuuccagcc

SEQ ID NO: 1613338 - RNA, 20 nt, Pseudomonas putida KT2440
gccgagcaucuuccagccug

SEQ ID NO: 1613339 - RNA, 23 nt, Pseudomonas putida KT2440
gccgagaggcgcugcgggucuuu

SEQ ID NO: 1613340 - RNA, 13 nt, Pseudomonas putida KT2440
gccgagcaggagc

SEQ ID NO: 1613341 - RNA, 21 nt, Pseudomonas putida KT2440
gccgagcaggagcugaacugc

SEQ ID NO: 1613342 - RNA, 19 nt, Pseudomonas putida KT2440
gccgagcuuuguagcuccc

SEQ ID NO: 1613343 - RNA, 15 nt, Pseudomonas putida KT2440
gccgaggacaacaag

SEQ ID NO: 1613344 - RNA, 18 nt, Pseudomonas putida KT2440
gccgaggacaacaaggac

SEQ ID NO: 1613345 - RNA, 15 nt, Pseudomonas putida KT2440
gccgaggccaugugc

SEQ ID NO: 1613346 - RNA, 14 nt, Pseudomonas putida KT2440
gccgaggccggguu

SEQ ID NO: 1613347 - RNA, 18 nt, Pseudomonas putida KT2440
gccgauaccgaacaccag

SEQ ID NO: 1613348 - RNA, 14 nt, Pseudomonas putida KT2440
gccaucgagcaccg

SEQ ID NO: 1613349 - RNA, 15 nt, Pseudomonas putida KT2440
gccaucgacccgcug

SEQ ID NO: 1613350 - RNA, 13 nt, Pseudomonas putida KT2440
gccaucugguugc

SEQ ID NO: 1613351 - RNA, 20 nt, Pseudomonas putida KT2440
gccaucugguugcuggcgcc

SEQ ID NO: 1613352 - RNA, 14 nt, Pseudomonas putida KT2440
gccaucgcaccacg

SEQ ID NO: 1613353 - RNA, 18 nt, Pseudomonas putida KT2440
gccauccgguaugcccau

SEQ ID NO: 1613354 - RNA, 17 nt, Pseudomonas putida KT2440
gccaucagugcccccgc

SEQ ID NO: 1613355 - RNA, 14 nt, Pseudomonas putida KT2440
gccaucaucugcug

SEQ ID NO: 1613356 - RNA, 15 nt, Pseudomonas putida KT2440
gccaggcucuccagc

SEQ ID NO: 1613357 - RNA, 16 nt, Pseudomonas putida KT2440
gccaggcucuccagcc

SEQ ID NO: 1613358 - RNA, 18 nt, Pseudomonas putida KT2440
gccaggcucuccagccgc

SEQ ID NO: 1613359 - RNA, 23 nt, Pseudomonas putida KT2440
gccaggcucuccagccgcugcug

SEQ ID NO: 1613360 - RNA, 13 nt, Pseudomonas putida KT2440
gccaggcugagcc

SEQ ID NO: 1613361 - RNA, 14 nt, Pseudomonas putida KT2440
gccaggcugagccc

SEQ ID NO: 1613362 - RNA, 20 nt, Pseudomonas putida KT2440
gccauaucggcuugugcccg

SEQ ID NO: 1613363 - RNA, 19 nt, Pseudomonas putida KT2440
gccauauucgcggcggccg

SEQ ID NO: 1613364 - RNA, 18 nt, Pseudomonas putida KT2440
gccauauugcugagccag

SEQ ID NO: 1613365 - RNA, 15 nt, Pseudomonas putida KT2440
gccaggcgcgguucg

SEQ ID NO: 1613366 - RNA, 18 nt, Pseudomonas putida KT2440
gccaggcguauucggcca

SEQ ID NO: 1613367 - RNA, 18 nt, Pseudomonas putida KT2440
gccaggcucgacggcgca

SEQ ID NO: 1613368 - RNA, 20 nt, Pseudomonas putida KT2440
gccauuggggcugcauugca

SEQ ID NO: 1613369 - RNA, 15 nt, Pseudomonas putida KT2440
gccauugcaccaccc

SEQ ID NO: 1613370 - RNA, 16 nt, Pseudomonas putida KT2440
gccauugcccagccug

SEQ ID NO: 1613371 - RNA, 17 nt, Pseudomonas putida KT2440
gccauugcccaguucgu

SEQ ID NO: 1613372 - RNA, 16 nt, Pseudomonas putida KT2440
gccauuggcccacgcu

SEQ ID NO: 1613373 - RNA, 23 nt, Pseudomonas putida KT2440
gccauuggccgcgcgcccaucug

SEQ ID NO: 1613374 - RNA, 16 nt, Pseudomonas putida KT2440
gcccaaucggguaaaa

SEQ ID NO: 1613375 - RNA, 14 nt, Pseudomonas putida KT2440
gcccaaugccguga

SEQ ID NO: 1613376 - RNA, 16 nt, Pseudomonas putida KT2440
gcccaaacgccaacag

SEQ ID NO: 1613377 - RNA, 18 nt, Pseudomonas putida KT2440
gcccaacgccugaagcac

SEQ ID NO: 1613378 - RNA, 20 nt, Pseudomonas putida KT2440
gcccaaccguuccugcagga

SEQ ID NO: 1613379 - RNA, 13 nt, Pseudomonas putida KT2440
gcccaacccagcc

SEQ ID NO: 1613380 - RNA, 14 nt, Pseudomonas putida KT2440
gcccaacccagcca

SEQ ID NO: 1613381 - RNA, 16 nt, Pseudomonas putida KT2440
gcccaacccagccagc

SEQ ID NO: 1613382 - RNA, 23 nt, Pseudomonas putida KT2440
gcccaacccagccagcgacagca

SEQ ID NO: 1613383 - RNA, 15 nt, Pseudomonas putida KT2440
gccaugaaaaagccc

SEQ ID NO: 1613384 - RNA, 18 nt, Pseudomonas putida KT2440
gccaugaaaaagcccggc

SEQ ID NO: 1613385 - RNA, 12 nt, Pseudomonas putida KT2440
gccaugccccua

SEQ ID NO: 1613386 - RNA, 21 nt, Pseudomonas putida KT2440
gccaugccguaagccgcaggc

SEQ ID NO: 1613387 - RNA, 13 nt, Pseudomonas putida KT2440
gccaugccgccga

SEQ ID NO: 1613388 - RNA, 16 nt, Pseudomonas putida KT2440
gccauguugcgcagca

SEQ ID NO: 1613389 - RNA, 17 nt, Pseudomonas putida KT2440
gccaugcugcgccagga

SEQ ID NO: 1613390 - RNA, 17 nt, Pseudomonas putida KT2440
gcccaggugccaggcuc

SEQ ID NO: 1613391 - RNA, 20 nt, Pseudomonas putida KT2440
gcccagguuauacgccgccg

SEQ ID NO: 1613392 - RNA, 23 nt, Pseudomonas putida KT2440
gcccauaaaccccagccuucagc

SEQ ID NO: 1613393 - RNA, 20 nt, Pseudomonas putida KT2440
gcccaucccggucaccugca

SEQ ID NO: 1613394 - RNA, 22 nt, Pseudomonas putida KT2440
gcccaucccgcuucgccagcgc

SEQ ID NO: 1613395 - RNA, 14 nt, Pseudomonas putida KT2440
gcccauggccagcg

SEQ ID NO: 1613396 - RNA, 16 nt, Pseudomonas putida KT2440
gcccaucaggaacagc

SEQ ID NO: 1613397 - RNA, 18 nt, Pseudomonas putida KT2440
gcccauccagggcuuccu

SEQ ID NO: 1613398 - RNA, 19 nt, Pseudomonas putida KT2440
gcccauccaacgcauccag

SEQ ID NO: 1613399 - RNA, 22 nt, Pseudomonas putida KT2440
gcccauccagaaauccauccag

SEQ ID NO: 1613400 - RNA, 17 nt, Pseudomonas putida KT2440
gcccagaaucucaacca

SEQ ID NO: 1613401 - RNA, 18 nt, Pseudomonas putida KT2440
gcccagcaggugcccaag

SEQ ID NO: 1613402 - RNA, 15 nt, Pseudomonas putida KT2440
gcccagccccgagca

SEQ ID NO: 1613403 - RNA, 15 nt, Pseudomonas putida KT2440
gcccagcccagcccg

SEQ ID NO: 1613404 - RNA, 23 nt, Pseudomonas putida KT2440
gcccagccaccgacgaacagggc

SEQ ID NO: 1613405 - RNA, 19 nt, Pseudomonas putida KT2440
gcccagcaugcgcuugagc

SEQ ID NO: 1613406 - RNA, 15 nt, Pseudomonas putida KT2440
gcccagccaucgagc

SEQ ID NO: 1613407 - RNA, 18 nt, Pseudomonas putida KT2440
gcccagccagcgugggcc

SEQ ID NO: 1613408 - RNA, 16 nt, Pseudomonas putida KT2440
gcccagcucgcuggcc

SEQ ID NO: 1613409 - RNA, 17 nt, Pseudomonas putida KT2440
gcccagcucgcuggcca

SEQ ID NO: 1613410 - RNA, 18 nt, Pseudomonas putida KT2440
gcccagcuacgcgagcca

SEQ ID NO: 1613411 - RNA, 20 nt, Pseudomonas putida KT2440
gcccagcuacgcgagccacc

SEQ ID NO: 1613412 - RNA, 20 nt, Pseudomonas putida KT2440
gcccagcuucuccagcaagc

SEQ ID NO: 1613413 - RNA, 14 nt, Pseudomonas putida KT2440
gcccagggcugcuu

SEQ ID NO: 1613414 - RNA, 19 nt, Pseudomonas putida KT2440
gcccaggaucacuggccug

SEQ ID NO: 1613415 - RNA, 16 nt, Pseudomonas putida KT2440
gcccaccgacagcccg

SEQ ID NO: 1613416 - RNA, 16 nt, Pseudomonas putida KT2440
gcccaccgagcuuggg

SEQ ID NO: 1613417 - RNA, 16 nt, Pseudomonas putida KT2440
gcccaccgaucacggg

SEQ ID NO: 1613418 - RNA, 15 nt, Pseudomonas putida KT2440
gcccaccgcugcaau

SEQ ID NO: 1613419 - RNA, 12 nt, Pseudomonas putida KT2440
gcccaccagguc

SEQ ID NO: 1613420 - RNA, 22 nt, Pseudomonas putida KT2440
gcccaccaggucauaguucugg

SEQ ID NO: 1613421 - RNA, 17 nt, Pseudomonas putida KT2440
gcccaccagcugcacca

SEQ ID NO: 1613422 - RNA, 19 nt, Pseudomonas putida KT2440
gcccaccagcugcaccacc

SEQ ID NO: 1613423 - RNA, 18 nt, Pseudomonas putida KT2440
gcccaccaggauuggccg

SEQ ID NO: 1613424 - RNA, 13 nt, Pseudomonas putida KT2440
gcccaccagcgcu

SEQ ID NO: 1613425 - RNA, 13 nt, Pseudomonas putida KT2440
gcccacccaccac

SEQ ID NO: 1613426 - RNA, 20 nt, Pseudomonas putida KT2440
gcccaccagugaggucggga

SEQ ID NO: 1613427 - RNA, 12 nt, Pseudomonas putida KT2440
gcccaccagcgc

SEQ ID NO: 1613428 - RNA, 15 nt, Pseudomonas putida KT2440
gcccaccaccuucuc

SEQ ID NO: 1613429 - RNA, 20 nt, Pseudomonas putida KT2440
gcccacaugcgagccgcugc

SEQ ID NO: 1613430 - RNA, 21 nt, Pseudomonas putida KT2440
gcccacuuccugaagacgcuu

SEQ ID NO: 1613431 - RNA, 19 nt, Pseudomonas putida KT2440
gcccacuucugcggccagg

SEQ ID NO: 1613432 - RNA, 22 nt, Pseudomonas putida KT2440
gcccacucacgcaacucuaccu

SEQ ID NO: 1613433 - RNA, 22 nt, Pseudomonas putida KT2440
gcccaccgucaggcucagcagg

SEQ ID NO: 1613434 - RNA, 17 nt, Pseudomonas putida KT2440
gcccacgcggguccagc

SEQ ID NO: 1613435 - RNA, 19 nt, Pseudomonas putida KT2440
gcccacgcggguccagcgc

SEQ ID NO: 1613436 - RNA, 20 nt, Pseudomonas putida KT2440
gcccacgcggguccagcgcg

SEQ ID NO: 1613437 - RNA, 17 nt, Pseudomonas putida KT2440
gcccaccuuggcgguga

SEQ ID NO: 1613438 - RNA, 12 nt, Pseudomonas putida KT2440
gcccccagcccg

SEQ ID NO: 1613439 - RNA, 22 nt, Pseudomonas putida KT2440
gcccccagcccggcgccgagcc

SEQ ID NO: 1613440 - RNA, 13 nt, Pseudomonas putida KT2440
gcccccagccggu

SEQ ID NO: 1613441 - RNA, 21 nt, Pseudomonas putida KT2440
gcccccgccugcuggccgcgc

SEQ ID NO: 1613442 - RNA, 13 nt, Pseudomonas putida KT2440
gcccccgcugcac

SEQ ID NO: 1613443 - RNA, 18 nt, Pseudomonas putida KT2440
gcccccgcugcacaggcc

SEQ ID NO: 1613444 - RNA, 13 nt, Pseudomonas putida KT2440
gcccccggcggcg

SEQ ID NO: 1613445 - RNA, 18 nt, Pseudomonas putida KT2440
gccccaugcgaacugcag

SEQ ID NO: 1613446 - RNA, 23 nt, Pseudomonas putida KT2440
gccccaugcgaacugcagagccu

SEQ ID NO: 1613447 - RNA, 15 nt, Pseudomonas putida KT2440
gcccccaaaccgcug

SEQ ID NO: 1613448 - RNA, 22 nt, Pseudomonas putida KT2440
gcccccaaaccgcugcccagcg

SEQ ID NO: 1613449 - RNA, 16 nt, Pseudomonas putida KT2440
gcccccaaagccgcca

SEQ ID NO: 1613450 - RNA, 14 nt, Pseudomonas putida KT2440
gcccauggcgcagc

SEQ ID NO: 1613451 - RNA, 13 nt, Pseudomonas putida KT2440
gcccauggcuggc

SEQ ID NO: 1613452 - RNA, 15 nt, Pseudomonas putida KT2440
gcccauggcccugau

SEQ ID NO: 1613453 - RNA, 17 nt, Pseudomonas putida KT2440
gcccauggcccugaucu

SEQ ID NO: 1613454 - RNA, 22 nt, Pseudomonas putida KT2440
gccccaucaccagcccgaagcg

SEQ ID NO: 1613455 - RNA, 15 nt, Pseudomonas putida KT2440
gccccaucacccccg

SEQ ID NO: 1613456 - RNA, 13 nt, Pseudomonas putida KT2440
gcccauucgcggg

SEQ ID NO: 1613457 - RNA, 20 nt, Pseudomonas putida KT2440
gcccauucgcgggcaagccc

SEQ ID NO: 1613458 - RNA, 11 nt, Pseudomonas putida KT2440
gcccccugguu

SEQ ID NO: 1613459 - RNA, 14 nt, Pseudomonas putida KT2440
gccccgccagcgcc

SEQ ID NO: 1613460 - RNA, 16 nt, Pseudomonas putida KT2440
gccccgcccgaagggc

SEQ ID NO: 1613461 - RNA, 14 nt, Pseudomonas putida KT2440
gccccggccugcac

SEQ ID NO: 1613462 - RNA, 16 nt, Pseudomonas putida KT2440
gccccggccagugccu

SEQ ID NO: 1613463 - RNA, 23 nt, Pseudomonas putida KT2440
gccccggcgauacucaccgccgc

SEQ ID NO: 1613464 - RNA, 14 nt, Pseudomonas putida KT2440
gccccggcgccgcc

SEQ ID NO: 1613465 - RNA, 15 nt, Pseudomonas putida KT2440
gccccggcgccgcca

SEQ ID NO: 1613466 - RNA, 17 nt, Pseudomonas putida KT2440
gccccggcgccgccagg

SEQ ID NO: 1613467 - RNA, 19 nt, Pseudomonas putida KT2440
gccccggcgccgccaggca

SEQ ID NO: 1613468 - RNA, 16 nt, Pseudomonas putida KT2440
gccccggcuaucucag

SEQ ID NO: 1613469 - RNA, 13 nt, Pseudomonas putida KT2440
gccccggcggcgc

SEQ ID NO: 1613470 - RNA, 23 nt, Pseudomonas putida KT2440
gccccuuggcacggccagccagc

SEQ ID NO: 1613471 - RNA, 12 nt, Pseudomonas putida KT2440
gccccuuggcca

SEQ ID NO: 1613472 - RNA, 17 nt, Pseudomonas putida KT2440
gcccgaaaccaugcagg

SEQ ID NO: 1613473 - RNA, 16 nt, Pseudomonas putida KT2440
gcccgaaaccgccagc

SEQ ID NO: 1613474 - RNA, 18 nt, Pseudomonas putida KT2440
gcccgaacgggcucaccu

SEQ ID NO: 1613475 - RNA, 23 nt, Pseudomonas putida KT2440
gcccgaaccuugcuugaccuugu

SEQ ID NO: 1613476 - RNA, 17 nt, Pseudomonas putida KT2440
gcccgaacgacacggca

SEQ ID NO: 1613477 - RNA, 12 nt, Pseudomonas putida KT2440
gcccgaacaaca

SEQ ID NO: 1613478 - RNA, 14 nt, Pseudomonas putida KT2440
gcccgaacaacagg

SEQ ID NO: 1613479 - RNA, 23 nt, Pseudomonas putida KT2440
gcccgaagcuaucgccagcaggc

SEQ ID NO: 1613480 - RNA, 14 nt, Pseudomonas putida KT2440
gcccgacuggcugg

SEQ ID NO: 1613481 - RNA, 14 nt, Pseudomonas putida KT2440
gccccggugcaucc

SEQ ID NO: 1613482 - RNA, 19 nt, Pseudomonas putida KT2440
gccccggugcauccaacgc

SEQ ID NO: 1613483 - RNA, 22 nt, Pseudomonas putida KT2440
gccccgguucgcgagaaccggg

SEQ ID NO: 1613484 - RNA, 15 nt, Pseudomonas putida KT2440
gccccgggugcagcc

SEQ ID NO: 1613485 - RNA, 15 nt, Pseudomonas putida KT2440
gccccgguccagcac

SEQ ID NO: 1613486 - RNA, 22 nt, Pseudomonas putida KT2440
gccccgguccagcacacugagc

SEQ ID NO: 1613487 - RNA, 19 nt, Pseudomonas putida KT2440
gccccuuccccaggccgcc

SEQ ID NO: 1613488 - RNA, 22 nt, Pseudomonas putida KT2440
gccccuuccgaccggucauaca

SEQ ID NO: 1613489 - RNA, 16 nt, Pseudomonas putida KT2440
gccccuucaaggggcc

SEQ ID NO: 1613490 - RNA, 14 nt, Pseudomonas putida KT2440
gccccguccacagc

SEQ ID NO: 1613491 - RNA, 15 nt, Pseudomonas putida KT2440
gccccguauacccau

SEQ ID NO: 1613492 - RNA, 15 nt, Pseudomonas putida KT2440
gcccgcgaacaaggc

SEQ ID NO: 1613493 - RNA, 21 nt, Pseudomonas putida KT2440
gcccgcgaacacgggcgaagc

SEQ ID NO: 1613494 - RNA, 15 nt, Pseudomonas putida KT2440
gcccgcgaagaggcc

SEQ ID NO: 1613495 - RNA, 18 nt, Pseudomonas putida KT2440
gcccgcgaagaggccagc

SEQ ID NO: 1613496 - RNA, 18 nt, Pseudomonas putida KT2440
gcccgcgaagaggccggc

SEQ ID NO: 1613497 - RNA, 19 nt, Pseudomonas putida KT2440
gcccgcgaagaggccggca

SEQ ID NO: 1613498 - RNA, 17 nt, Pseudomonas putida KT2440
gcccgcgaagggccgcu

SEQ ID NO: 1613499 - RNA, 18 nt, Pseudomonas putida KT2440
gcccgcgaaucguccugg

SEQ ID NO: 1613500 - RNA, 23 nt, Pseudomonas putida KT2440
gcccgccgccaccagcgccgcca

SEQ ID NO: 1613501 - RNA, 19 nt, Pseudomonas putida KT2440
gcccgccuuccuugggggu

SEQ ID NO: 1613502 - RNA, 20 nt, Pseudomonas putida KT2440
gcccgccuuggcauagcgcu

SEQ ID NO: 1613503 - RNA, 18 nt, Pseudomonas putida KT2440
gcccgcccccacagagcc

SEQ ID NO: 1613504 - RNA, 16 nt, Pseudomonas putida KT2440
gcccgcccgccugcgc

SEQ ID NO: 1613505 - RNA, 18 nt, Pseudomonas putida KT2440
gcccgaucgccucgcugg

SEQ ID NO: 1613506 - RNA, 19 nt, Pseudomonas putida KT2440
gcccggccgcgccaccggg

SEQ ID NO: 1613507 - RNA, 12 nt, Pseudomonas putida KT2440
gcccggcgcagc

SEQ ID NO: 1613508 - RNA, 13 nt, Pseudomonas putida KT2440
gcccggcaaacac

SEQ ID NO: 1613509 - RNA, 19 nt, Pseudomonas putida KT2440
gcccggcaaacacauccac

SEQ ID NO: 1613510 - RNA, 19 nt, Pseudomonas putida KT2440
gcccggauggcggugaugc

SEQ ID NO: 1613511 - RNA, 16 nt, Pseudomonas putida KT2440
gcccggcaaucgccag

SEQ ID NO: 1613512 - RNA, 21 nt, Pseudomonas putida KT2440
gcccggcaaucgccaggcgca

SEQ ID NO: 1613513 - RNA, 17 nt, Pseudomonas putida KT2440
gcccggacugcaccagg

SEQ ID NO: 1613514 - RNA, 22 nt, Pseudomonas putida KT2440
gcccggcauacuugggcgcagu

SEQ ID NO: 1613515 - RNA, 21 nt, Pseudomonas putida KT2440
gcccggcacgguugcgcccgg

SEQ ID NO: 1613516 - RNA, 21 nt, Pseudomonas putida KT2440
gcccggcagaucgagcgccgc

SEQ ID NO: 1613517 - RNA, 14 nt, Pseudomonas putida KT2440
gcccggccaacaac

SEQ ID NO: 1613518 - RNA, 12 nt, Pseudomonas putida KT2440
gcccggccagcg

SEQ ID NO: 1613519 - RNA, 14 nt, Pseudomonas putida KT2440
gcccggccagcagg

SEQ ID NO: 1613520 - RNA, 13 nt, Pseudomonas putida KT2440
gcccggcgcgcgc

SEQ ID NO: 1613521 - RNA, 16 nt, Pseudomonas putida KT2440
gcccggcgcuggugca

SEQ ID NO: 1613522 - RNA, 13 nt, Pseudomonas putida KT2440
gcccggcuggcca

SEQ ID NO: 1613523 - RNA, 16 nt, Pseudomonas putida KT2440
gcccggcuugcccggg

SEQ ID NO: 1613524 - RNA, 15 nt, Pseudomonas putida KT2440
gcccggcuccgcgca

SEQ ID NO: 1613525 - RNA, 16 nt, Pseudomonas putida KT2440
gcccggcuccgcgcaa

SEQ ID NO: 1613526 - RNA, 18 nt, Pseudomonas putida KT2440
gcccggcucaccgcagcc

SEQ ID NO: 1613527 - RNA, 22 nt, Pseudomonas putida KT2440
gcccggcucaccgcagcccagc

SEQ ID NO: 1613528 - RNA, 17 nt, Pseudomonas putida KT2440
gcccgggcaaagcacca

SEQ ID NO: 1613529 - RNA, 14 nt, Pseudomonas putida KT2440
gcccgggaacggcu

SEQ ID NO: 1613530 - RNA, 13 nt, Pseudomonas putida KT2440
gcccgggccgcuu

SEQ ID NO: 1613531 - RNA, 20 nt, Pseudomonas putida KT2440
gcccgcgcgcgaugcgccgc

SEQ ID NO: 1613532 - RNA, 19 nt, Pseudomonas putida KT2440
gcccgcgcagcuuccacca

SEQ ID NO: 1613533 - RNA, 15 nt, Pseudomonas putida KT2440
gcccgcgcaaaggcg

SEQ ID NO: 1613534 - RNA, 16 nt, Pseudomonas putida KT2440
gcccgcgccgcccagc

SEQ ID NO: 1613535 - RNA, 21 nt, Pseudomonas putida KT2440
gcccgcgccacccgcugggcu

SEQ ID NO: 1613536 - RNA, 13 nt, Pseudomonas putida KT2440
gcccgcgccaggc

SEQ ID NO: 1613537 - RNA, 21 nt, Pseudomonas putida KT2440
gcccgcgucugccgcagcccc

SEQ ID NO: 1613538 - RNA, 22 nt, Pseudomonas putida KT2440
gcccgcgugagauguucaccag

SEQ ID NO: 1613539 - RNA, 14 nt, Pseudomonas putida KT2440
gcccgcgugcgccc

SEQ ID NO: 1613540 - RNA, 20 nt, Pseudomonas putida KT2440
gcccgcgugcuucaagccau

SEQ ID NO: 1613541 - RNA, 23 nt, Pseudomonas putida KT2440
gcccgcguucaugccggccccag

SEQ ID NO: 1613542 - RNA, 23 nt, Pseudomonas putida KT2440
gcccgcuacgacccugaagcccu

SEQ ID NO: 1613543 - RNA, 19 nt, Pseudomonas putida KT2440
gcccgcggcucacccacca

SEQ ID NO: 1613544 - RNA, 21 nt, Pseudomonas putida KT2440
gcccgcgguaaugcgcacggc

SEQ ID NO: 1613545 - RNA, 17 nt, Pseudomonas putida KT2440
gcccgcguacucggcca

SEQ ID NO: 1613546 - RNA, 17 nt, Pseudomonas putida KT2440
gcccgcggcccacagug

SEQ ID NO: 1613547 - RNA, 17 nt, Pseudomonas putida KT2440
gcccgcggcgaacacag

SEQ ID NO: 1613548 - RNA, 21 nt, Pseudomonas putida KT2440
gcccgcggcgaacacagcggc

SEQ ID NO: 1613549 - RNA, 22 nt, Pseudomonas putida KT2440
gcccgcugaaacaucagccggu

SEQ ID NO: 1613550 - RNA, 15 nt, Pseudomonas putida KT2440
gcccgcugccaccuu

SEQ ID NO: 1613551 - RNA, 13 nt, Pseudomonas putida KT2440
gcccgcugcgccg

SEQ ID NO: 1613552 - RNA, 12 nt, Pseudomonas putida KT2440
gcccgcucgcca

SEQ ID NO: 1613553 - RNA, 16 nt, Pseudomonas putida KT2440
gcccgcucccacagga

SEQ ID NO: 1613554 - RNA, 21 nt, Pseudomonas putida KT2440
gcccgcucccacagguccagc

SEQ ID NO: 1613555 - RNA, 13 nt, Pseudomonas putida KT2440
gcccgcugcuucc

SEQ ID NO: 1613556 - RNA, 18 nt, Pseudomonas putida KT2440
gcccgcuucaacagcuuc

SEQ ID NO: 1613557 - RNA, 14 nt, Pseudomonas putida KT2440
gcaacaccgccauu

SEQ ID NO: 1613558 - RNA, 18 nt, Pseudomonas putida KT2440
gcaacaccugccgcagcu

SEQ ID NO: 1613559 - RNA, 15 nt, Pseudomonas putida KT2440
gcaacaccggucagg

SEQ ID NO: 1613560 - RNA, 14 nt, Pseudomonas putida KT2440
gcaacaccagcagc

SEQ ID NO: 1613561 - RNA, 15 nt, Pseudomonas putida KT2440
gcaacaccagcagcc

SEQ ID NO: 1613562 - RNA, 19 nt, Pseudomonas putida KT2440
gcaacaaccuggccgggcu

SEQ ID NO: 1613563 - RNA, 20 nt, Pseudomonas putida KT2440
gcaacaggucgaccugcccg

SEQ ID NO: 1613564 - RNA, 17 nt, Pseudomonas putida KT2440
gcaacagcgccuggcga

SEQ ID NO: 1613565 - RNA, 16 nt, Pseudomonas putida KT2440
gcaacagcuccagcaa

SEQ ID NO: 1613566 - RNA, 17 nt, Pseudomonas putida KT2440
gcaacagcuccagcaac

SEQ ID NO: 1613567 - RNA, 12 nt, Pseudomonas putida KT2440
gcaacagcugcg

SEQ ID NO: 1613568 - RNA, 18 nt, Pseudomonas putida KT2440
gcaaccacgcuuggcuca

SEQ ID NO: 1613569 - RNA, 17 nt, Pseudomonas putida KT2440
gcaaccaggcgccgagc

SEQ ID NO: 1613570 - RNA, 22 nt, Pseudomonas putida KT2440
gcaaccaggcgccgagcgcggc

SEQ ID NO: 1613571 - RNA, 17 nt, Pseudomonas putida KT2440
gcaacauucaccagcca

SEQ ID NO: 1613572 - RNA, 21 nt, Pseudomonas putida KT2440
gcaacauucaccagccaggca

SEQ ID NO: 1613573 - RNA, 13 nt, Pseudomonas putida KT2440
gcaaccaccaaca

SEQ ID NO: 1613574 - RNA, 16 nt, Pseudomonas putida KT2440
gcaaccaccaacagca

SEQ ID NO: 1613575 - RNA, 16 nt, Pseudomonas putida KT2440
gcaacauguccacacc

SEQ ID NO: 1613576 - RNA, 18 nt, Pseudomonas putida KT2440
gcaacauguccacacccg

SEQ ID NO: 1613577 - RNA, 15 nt, Pseudomonas putida KT2440
gcaacaugaagccau

SEQ ID NO: 1613578 - RNA, 19 nt, Pseudomonas putida KT2440
gcaacaucgaucuggugac

SEQ ID NO: 1613579 - RNA, 16 nt, Pseudomonas putida KT2440
gcaacaucgcccccgc

SEQ ID NO: 1613580 - RNA, 19 nt, Pseudomonas putida KT2440
gcaacaucgcccccgcugc

SEQ ID NO: 1613581 - RNA, 21 nt, Pseudomonas putida KT2440
gcaacaguuuucaaugcugcu

SEQ ID NO: 1613582 - RNA, 20 nt, Pseudomonas putida KT2440
gcaacauaaggugcaaagcg

SEQ ID NO: 1613583 - RNA, 17 nt, Pseudomonas putida KT2440
gcaaaugcugccaugca

SEQ ID NO: 1613584 - RNA, 17 nt, Pseudomonas putida KT2440
gcaaaugcuugcccgcc

SEQ ID NO: 1613585 - RNA, 14 nt, Pseudomonas putida KT2440
gcaaaugcaccccu

SEQ ID NO: 1613586 - RNA, 13 nt, Pseudomonas putida KT2440
gcaaaucacugac

SEQ ID NO: 1613587 - RNA, 23 nt, Pseudomonas putida KT2440
gcaaauccgccccuacgcugguu

SEQ ID NO: 1613588 - RNA, 13 nt, Pseudomonas putida KT2440
gcaaauccuccug

SEQ ID NO: 1613589 - RNA, 16 nt, Pseudomonas putida KT2440
gcaaagucuucagcca

SEQ ID NO: 1613590 - RNA, 16 nt, Pseudomonas putida KT2440
gcaaaguccagcauca

SEQ ID NO: 1613591 - RNA, 23 nt, Pseudomonas putida KT2440
gcaaaggcuugucaugccuuggc

SEQ ID NO: 1613592 - RNA, 17 nt, Pseudomonas putida KT2440
gcaaauacggccaauaa

SEQ ID NO: 1613593 - RNA, 14 nt, Pseudomonas putida KT2440
gcaaauaguuuuau

SEQ ID NO: 1613594 - RNA, 19 nt, Pseudomonas putida KT2440
gcaaacccggccagcaggu

SEQ ID NO: 1613595 - RNA, 17 nt, Pseudomonas putida KT2440
gcaaaccgaccaggcag

SEQ ID NO: 1613596 - RNA, 18 nt, Pseudomonas putida KT2440
gcaaaccgaccaggcagu

SEQ ID NO: 1613597 - RNA, 19 nt, Pseudomonas putida KT2440
gcaaaccgaccaggcagua

SEQ ID NO: 1613598 - RNA, 17 nt, Pseudomonas putida KT2440
gcaaacgccuguuucuc

SEQ ID NO: 1613599 - RNA, 17 nt, Pseudomonas putida KT2440
gcaaagcccgccccaau

SEQ ID NO: 1613600 - RNA, 16 nt, Pseudomonas putida KT2440
gcaaagcggccccagc

SEQ ID NO: 1613601 - RNA, 16 nt, Pseudomonas putida KT2440
gcaaagcggcccccac

SEQ ID NO: 1613602 - RNA, 18 nt, Pseudomonas putida KT2440
gcaaagcggcccccagca

SEQ ID NO: 1613603 - RNA, 19 nt, Pseudomonas putida KT2440
gcaaagcggcccccagcaa

SEQ ID NO: 1613604 - RNA, 16 nt, Pseudomonas putida KT2440
gcaaagcagacccaga

SEQ ID NO: 1613605 - RNA, 23 nt, Pseudomonas putida KT2440
gcaaagcccaguucuuggcggcu

SEQ ID NO: 1613606 - RNA, 21 nt, Pseudomonas putida KT2440
gcaaaggcuagcagcaucacc

SEQ ID NO: 1613607 - RNA, 16 nt, Pseudomonas putida KT2440
gcaaagcugaucgaua

SEQ ID NO: 1613608 - RNA, 23 nt, Pseudomonas putida KT2440
gcaaagcguucgguguccuugca

SEQ ID NO: 1613609 - RNA, 20 nt, Pseudomonas putida KT2440
gcaaagcgggucgccagguu

SEQ ID NO: 1613610 - RNA, 23 nt, Pseudomonas putida KT2440
gcaaagcagccccagggcccuca

SEQ ID NO: 1613611 - RNA, 14 nt, Pseudomonas putida KT2440
gcaaagcagccccg

SEQ ID NO: 1613612 - RNA, 18 nt, Pseudomonas putida KT2440
gcaaacuccacugugccc

SEQ ID NO: 1613613 - RNA, 22 nt, Pseudomonas putida KT2440
gcaaagaacggugcugccgagg

SEQ ID NO: 1613614 - RNA, 18 nt, Pseudomonas putida KT2440
gcaaacuggcgcccggca

SEQ ID NO: 1613615 - RNA, 15 nt, Pseudomonas putida KT2440
gcaaaagaaaaaggg

SEQ ID NO: 1613616 - RNA, 12 nt, Pseudomonas putida KT2440
gcaaaaccugcc

SEQ ID NO: 1613617 - RNA, 12 nt, Pseudomonas putida KT2440
gcaaaaccacca

SEQ ID NO: 1613618 - RNA, 15 nt, Pseudomonas putida KT2440
gcaaaaccaccagcc

SEQ ID NO: 1613619 - RNA, 16 nt, Pseudomonas putida KT2440
gcaaaaucgaccaggg

SEQ ID NO: 1613620 - RNA, 20 nt, Pseudomonas putida KT2440
gcaaaaucgaccagggccuu

SEQ ID NO: 1613621 - RNA, 16 nt, Pseudomonas putida KT2440
gauuuuugaaaaauga

SEQ ID NO: 1613622 - RNA, 13 nt, Pseudomonas putida KT2440
gauuugauggggc

SEQ ID NO: 1613623 - RNA, 23 nt, Pseudomonas putida KT2440
gauuuccagugccgccaccuggc

SEQ ID NO: 1613624 - RNA, 14 nt, Pseudomonas putida KT2440
gauugggccgcaca

SEQ ID NO: 1613625 - RNA, 20 nt, Pseudomonas putida KT2440
gauugggaaaacacaggcac

SEQ ID NO: 1613626 - RNA, 18 nt, Pseudomonas putida KT2440
gauuguuaagaagccgac

SEQ ID NO: 1613627 - RNA, 15 nt, Pseudomonas putida KT2440
gauuccagcagggga

SEQ ID NO: 1613628 - RNA, 15 nt, Pseudomonas putida KT2440
gauucgccaaggccu

SEQ ID NO: 1613629 - RNA, 17 nt, Pseudomonas putida KT2440
gauuccguaccaguucc

SEQ ID NO: 1613630 - RNA, 13 nt, Pseudomonas putida KT2440
gauuggccagcag

SEQ ID NO: 1613631 - RNA, 17 nt, Pseudomonas putida KT2440
gauugccuggcuuucca

SEQ ID NO: 1613632 - RNA, 15 nt, Pseudomonas putida KT2440
gauugcgauccgccc

SEQ ID NO: 1613633 - RNA, 18 nt, Pseudomonas putida KT2440
gauugccagggugccaga

SEQ ID NO: 1613634 - RNA, 19 nt, Pseudomonas putida KT2440
gauugccagggugccagac

SEQ ID NO: 1613635 - RNA, 22 nt, Pseudomonas putida KT2440
gauugccucaggccccaggcca

SEQ ID NO: 1613636 - RNA, 16 nt, Pseudomonas putida KT2440
gauugaauucuggcuu

SEQ ID NO: 1613637 - RNA, 21 nt, Pseudomonas putida KT2440
gauucuacgccguacugcugg

SEQ ID NO: 1613638 - RNA, 15 nt, Pseudomonas putida KT2440
gauucugccagcucc

SEQ ID NO: 1613639 - RNA, 22 nt, Pseudomonas putida KT2440
gaugucguugaugaucugcucc

SEQ ID NO: 1613640 - RNA, 19 nt, Pseudomonas putida KT2440
gaugucggcgugcaccacg

SEQ ID NO: 1613641 - RNA, 20 nt, Pseudomonas putida KT2440
gauuacccugcgccaggcau

SEQ ID NO: 1613642 - RNA, 15 nt, Pseudomonas putida KT2440
gauuacaagggccug

SEQ ID NO: 1613643 - RNA, 20 nt, Pseudomonas putida KT2440
gauuacaagggccugugccg

SEQ ID NO: 1613644 - RNA, 18 nt, Pseudomonas putida KT2440
gauuacaaacggcuuggc

SEQ ID NO: 1613645 - RNA, 14 nt, Pseudomonas putida KT2440
gaugguggcauagc

SEQ ID NO: 1613646 - RNA, 23 nt, Pseudomonas putida KT2440
gauguacgccaggugauuuccuc

SEQ ID NO: 1613647 - RNA, 12 nt, Pseudomonas putida KT2440
gauguaguucuu

SEQ ID NO: 1613648 - RNA, 15 nt, Pseudomonas putida KT2440
gauguaggcagcugc

SEQ ID NO: 1613649 - RNA, 18 nt, Pseudomonas putida KT2440
gauggucuucgccgccau

SEQ ID NO: 1613650 - RNA, 18 nt, Pseudomonas putida KT2440
gauggugacugccagcac

SEQ ID NO: 1613651 - RNA, 17 nt, Pseudomonas putida KT2440
gaugggcccgagccccc

SEQ ID NO: 1613652 - RNA, 17 nt, Pseudomonas putida KT2440
gaugggccgcuccuuca

SEQ ID NO: 1613653 - RNA, 16 nt, Pseudomonas putida KT2440
gaugggcacuggccac

SEQ ID NO: 1613654 - RNA, 21 nt, Pseudomonas putida KT2440
gauggaccgacuucaaaacca

SEQ ID NO: 1613655 - RNA, 23 nt, Pseudomonas putida KT2440
gauggcaccgacuuccccggcgc

SEQ ID NO: 1613656 - RNA, 18 nt, Pseudomonas putida KT2440
gauggcaccggcucugcc

SEQ ID NO: 1613657 - RNA, 19 nt, Pseudomonas putida KT2440
gaugcuuuugauggucucc

SEQ ID NO: 1613658 - RNA, 20 nt, Pseudomonas putida KT2440
gaugcugucgucaagcucuu

SEQ ID NO: 1613659 - RNA, 13 nt, Pseudomonas putida KT2440
gaugcugcgggcg

SEQ ID NO: 1613660 - RNA, 22 nt, Pseudomonas putida KT2440
gauggccgcuugcugaucaauc

SEQ ID NO: 1613661 - RNA, 19 nt, Pseudomonas putida KT2440
gauggccgcaggcccaaac

SEQ ID NO: 1613662 - RNA, 21 nt, Pseudomonas putida KT2440
gauggccaauaccgcugcaac

SEQ ID NO: 1613663 - RNA, 13 nt, Pseudomonas putida KT2440
gauggccaccagc

SEQ ID NO: 1613664 - RNA, 15 nt, Pseudomonas putida KT2440
gauggccaccagcac

SEQ ID NO: 1613665 - RNA, 15 nt, Pseudomonas putida KT2440
gauggccaggaacag

SEQ ID NO: 1613666 - RNA, 16 nt, Pseudomonas putida KT2440
gauggcagacaagucc

SEQ ID NO: 1613667 - RNA, 18 nt, Pseudomonas putida KT2440
gauggcagacaaguccuu

SEQ ID NO: 1613668 - RNA, 16 nt, Pseudomonas putida KT2440
gauggcgcauggccug

SEQ ID NO: 1613669 - RNA, 21 nt, Pseudomonas putida KT2440
gaugcaccaggcccagccggg

SEQ ID NO: 1613670 - RNA, 18 nt, Pseudomonas putida KT2440
gaugcacgccagcaucac

SEQ ID NO: 1613671 - RNA, 19 nt, Pseudomonas putida KT2440
gaugcagcagugccagcaa

SEQ ID NO: 1613672 - RNA, 14 nt, Pseudomonas putida KT2440
gaugccccugcgcc

SEQ ID NO: 1613673 - RNA, 19 nt, Pseudomonas putida KT2440
gaugccaucgaguaucgcc

SEQ ID NO: 1613674 - RNA, 20 nt, Pseudomonas putida KT2440
gaugccagcggugccaguca

SEQ ID NO: 1613675 - RNA, 24 nt, Pseudomonas putida KT2440
gaugccagcggugccagucauucc

SEQ ID NO: 1613676 - RNA, 21 nt, Pseudomonas putida KT2440
gaugccauugaucaccuccac

SEQ ID NO: 1613677 - RNA, 12 nt, Pseudomonas putida KT2440
gaugcagggcug

SEQ ID NO: 1613678 - RNA, 18 nt, Pseudomonas putida KT2440
gaugcaucaauggcuggg

SEQ ID NO: 1613679 - RNA, 16 nt, Pseudomonas putida KT2440
gaugcgggaccagcac

SEQ ID NO: 1613680 - RNA, 15 nt, Pseudomonas putida KT2440
gaugcgggcaaagaa

SEQ ID NO: 1613681 - RNA, 17 nt, Pseudomonas putida KT2440
gaugcucugcagcagcg

SEQ ID NO: 1613682 - RNA, 17 nt, Pseudomonas putida KT2440
gaugaagaaugcgcagg

SEQ ID NO: 1613683 - RNA, 20 nt, Pseudomonas putida KT2440
gaugaacccggcaaugguca

SEQ ID NO: 1613684 - RNA, 13 nt, Pseudomonas putida KT2440
gaugaaggcugcu

SEQ ID NO: 1613685 - RNA, 13 nt, Pseudomonas putida KT2440
gaugaagcggucg

SEQ ID NO: 1613686 - RNA, 17 nt, Pseudomonas putida KT2440
gaugaaguggcgcaggc

SEQ ID NO: 1613687 - RNA, 20 nt, Pseudomonas putida KT2440
gaugaagccacgcucgugca

SEQ ID NO: 1613688 - RNA, 18 nt, Pseudomonas putida KT2440
gaucugugggagcggccu

SEQ ID NO: 1613689 - RNA, 16 nt, Pseudomonas putida KT2440
gaucuguccuccugcc

SEQ ID NO: 1613690 - RNA, 19 nt, Pseudomonas putida KT2440
gaucuucgccggcaucgcc

SEQ ID NO: 1613691 - RNA, 13 nt, Pseudomonas putida KT2440
gaucuucucuucc

SEQ ID NO: 1613692 - RNA, 20 nt, Pseudomonas putida KT2440
gaucuugccuucggccacac

SEQ ID NO: 1613693 - RNA, 17 nt, Pseudomonas putida KT2440
gaucuugguggucagcc

SEQ ID NO: 1613694 - RNA, 20 nt, Pseudomonas putida KT2440
gaucuuguuggucaggccau

SEQ ID NO: 1613695 - RNA, 21 nt, Pseudomonas putida KT2440
gaugacccuuccagcccgccu

SEQ ID NO: 1613696 - RNA, 17 nt, Pseudomonas putida KT2440
gaugaggcgaugcaggg

SEQ ID NO: 1613697 - RNA, 12 nt, Pseudomonas putida KT2440
gaugagccuuca

SEQ ID NO: 1613698 - RNA, 13 nt, Pseudomonas putida KT2440
aaagccugcacca

SEQ ID NO: 1613699 - RNA, 20 nt, Pseudomonas putida KT2440
aaagccgcuucuggacaaga

SEQ ID NO: 1613700 - RNA, 14 nt, Pseudomonas putida KT2440
aaagccuaaaggca

SEQ ID NO: 1613701 - RNA, 17 nt, Pseudomonas putida KT2440
gaugaucagggacaugg

SEQ ID NO: 1613702 - RNA, 19 nt, Pseudomonas putida KT2440
gaugaguuccguugcuacu

SEQ ID NO: 1613703 - RNA, 13 nt, Pseudomonas putida KT2440
gagauugagagga

SEQ ID NO: 1613704 - RNA, 18 nt, Pseudomonas putida KT2440
gagauuggucggcagggc

SEQ ID NO: 1613705 - RNA, 18 nt, Pseudomonas putida KT2440
gagauuccgggcugcugc

SEQ ID NO: 1613706 - RNA, 23 nt, Pseudomonas putida KT2440
gagauuugccuuggaaugcacau

SEQ ID NO: 1613707 - RNA, 14 nt, Pseudomonas putida KT2440
gagaucuccuguag

SEQ ID NO: 1613708 - RNA, 14 nt, Pseudomonas putida KT2440
gagaugugcgcggu

SEQ ID NO: 1613709 - RNA, 21 nt, Pseudomonas putida KT2440
gacucacgcucguuguccagc

SEQ ID NO: 1613710 - RNA, 14 nt, Pseudomonas putida KT2440
gacucauagcucag

SEQ ID NO: 1613711 - RNA, 20 nt, Pseudomonas putida KT2440
gacucauagcucagcuggau

SEQ ID NO: 1613712 - RNA, 14 nt, Pseudomonas putida KT2440
gacucaugccuucg

SEQ ID NO: 1613713 - RNA, 17 nt, Pseudomonas putida KT2440
gagagguacacccccag

SEQ ID NO: 1613714 - RNA, 17 nt, Pseudomonas putida KT2440
gagagggucggcgggcg

SEQ ID NO: 1613715 - RNA, 16 nt, Pseudomonas putida KT2440
gagaggcgggucaggu

SEQ ID NO: 1613716 - RNA, 23 nt, Pseudomonas putida KT2440
gagcaagaacgcuauuguggcaa

SEQ ID NO: 1613717 - RNA, 17 nt, Pseudomonas putida KT2440
gagcaacuugcgcagcu

SEQ ID NO: 1613718 - RNA, 21 nt, Pseudomonas putida KT2440
gagcaaggcauccaccugcag

SEQ ID NO: 1613719 - RNA, 13 nt, Pseudomonas putida KT2440
gagcaauacaucc

SEQ ID NO: 1613720 - RNA, 14 nt, Pseudomonas putida KT2440
gagcaaccagcaga

SEQ ID NO: 1613721 - RNA, 14 nt, Pseudomonas putida KT2440
gagccaaggccgcc

SEQ ID NO: 1613722 - RNA, 17 nt, Pseudomonas putida KT2440
gagcagcggcaccuacc

SEQ ID NO: 1613723 - RNA, 20 nt, Pseudomonas putida KT2440
gagcuaacgacccaaaaaug

SEQ ID NO: 1613724 - RNA, 21 nt, Pseudomonas putida KT2440
gagcuaacgacccaaaaaugg

SEQ ID NO: 1613725 - RNA, 21 nt, Pseudomonas putida KT2440
gagcuaacgacccggaaaaug

SEQ ID NO: 1613726 - RNA, 16 nt, Pseudomonas putida KT2440
gagcuauuuggcucca

SEQ ID NO: 1613727 - RNA, 17 nt, Pseudomonas putida KT2440
gagcgcgggcagacacu

SEQ ID NO: 1613728 - RNA, 18 nt, Pseudomonas putida KT2440
gagcggcuucuaccgcac

SEQ ID NO: 1613729 - RNA, 14 nt, Pseudomonas putida KT2440
gagcgggcaugccc

SEQ ID NO: 1613730 - RNA, 17 nt, Pseudomonas putida KT2440
gagcgggucagccugcc

SEQ ID NO: 1613731 - RNA, 14 nt, Pseudomonas putida KT2440
gagcgcgcccccga

SEQ ID NO: 1613732 - RNA, 21 nt, Pseudomonas putida KT2440
gagcgccgcccgggaggguga

SEQ ID NO: 1613733 - RNA, 20 nt, Pseudomonas putida KT2440
gagcgccgcgcgggcggcgc

SEQ ID NO: 1613734 - RNA, 19 nt, Pseudomonas putida KT2440
gagcgccgugcucggccuu

SEQ ID NO: 1613735 - RNA, 19 nt, Pseudomonas putida KT2440
gagcgacuucgaccacggc

SEQ ID NO: 1613736 - RNA, 16 nt, Pseudomonas putida KT2440
gagcgcauuaucugug

SEQ ID NO: 1613737 - RNA, 23 nt, Pseudomonas putida KT2440
gagccguccaggaacgcugccuc

SEQ ID NO: 1613738 - RNA, 21 nt, Pseudomonas putida KT2440
gagccuacagcaaccgcguga

SEQ ID NO: 1613739 - RNA, 17 nt, Pseudomonas putida KT2440
gagccucacacagcauu

SEQ ID NO: 1613740 - RNA, 16 nt, Pseudomonas putida KT2440
gagccugcacccaggc

SEQ ID NO: 1613741 - RNA, 18 nt, Pseudomonas putida KT2440
gagccugcacccaggcuc

SEQ ID NO: 1613742 - RNA, 15 nt, Pseudomonas putida KT2440
gagccugcagggccu

SEQ ID NO: 1613743 - RNA, 21 nt, Pseudomonas putida KT2440
gagccacucggcaaucugcuu

SEQ ID NO: 1613744 - RNA, 22 nt, Pseudomonas putida KT2440
gagccagacauugaagaagccc

SEQ ID NO: 1613745 - RNA, 12 nt, Pseudomonas putida KT2440
gagccaaccgcu

SEQ ID NO: 1613746 - RNA, 15 nt, Pseudomonas putida KT2440
gagccgaucaggaag

SEQ ID NO: 1613747 - RNA, 18 nt, Pseudomonas putida KT2440
gagccgaucaggaagccc

SEQ ID NO: 1613748 - RNA, 17 nt, Pseudomonas putida KT2440
gagccgauaugcggggu

SEQ ID NO: 1613749 - RNA, 15 nt, Pseudomonas putida KT2440
gagucggcucuggca

SEQ ID NO: 1613750 - RNA, 17 nt, Pseudomonas putida KT2440
gaguccuugcgugccuc

SEQ ID NO: 1613751 - RNA, 15 nt, Pseudomonas putida KT2440
gaguauucuccuucu

SEQ ID NO: 1613752 - RNA, 14 nt, Pseudomonas putida KT2440
gagugcaugcuguu

SEQ ID NO: 1613753 - RNA, 21 nt, Pseudomonas putida KT2440
gauaaccuggcucggcugggc

SEQ ID NO: 1613754 - RNA, 22 nt, Pseudomonas putida KT2440
gauaacguccagagggccugca

SEQ ID NO: 1613755 - RNA, 23 nt, Pseudomonas putida KT2440
gauaacguccagagggccugcau

SEQ ID NO: 1613756 - RNA, 17 nt, Pseudomonas putida KT2440
gauaaacacgaacauca

SEQ ID NO: 1613757 - RNA, 18 nt, Pseudomonas putida KT2440
gauaaacacgaacaucag

SEQ ID NO: 1613758 - RNA, 20 nt, Pseudomonas putida KT2440
gauaaacacgaacaucagca

SEQ ID NO: 1613759 - RNA, 13 nt, Pseudomonas putida KT2440
gauaaaccagcag

SEQ ID NO: 1613760 - RNA, 15 nt, Pseudomonas putida KT2440
gauaaaccagcagcg

SEQ ID NO: 1613761 - RNA, 18 nt, Pseudomonas putida KT2440
gauaaaccagcagcgccu

SEQ ID NO: 1613762 - RNA, 14 nt, Pseudomonas putida KT2440
gauaaaccugccac

SEQ ID NO: 1613763 - RNA, 18 nt, Pseudomonas putida KT2440
gauaaaccgugcaaacaa

SEQ ID NO: 1613764 - RNA, 17 nt, Pseudomonas putida KT2440
gaguuucaucggucuua

SEQ ID NO: 1613765 - RNA, 21 nt, Pseudomonas putida KT2440
gaggccgucaggccuccccgc

SEQ ID NO: 1613766 - RNA, 15 nt, Pseudomonas putida KT2440
gaggcgaauggcagg

SEQ ID NO: 1613767 - RNA, 16 nt, Pseudomonas putida KT2440
gaggcgaauggcaggu

SEQ ID NO: 1613768 - RNA, 23 nt, Pseudomonas putida KT2440
gaggcgaauggcaggugaucguu

SEQ ID NO: 1613769 - RNA, 16 nt, Pseudomonas putida KT2440
gaggcgaugcagggcu

SEQ ID NO: 1613770 - RNA, 13 nt, Pseudomonas putida KT2440
gaggcgcgcgccu

SEQ ID NO: 1613771 - RNA, 21 nt, Pseudomonas putida KT2440
gaggcgcgcgccuggguggcg

SEQ ID NO: 1613772 - RNA, 15 nt, Pseudomonas putida KT2440
gaggguggcaaugcu

SEQ ID NO: 1613773 - RNA, 17 nt, Pseudomonas putida KT2440
gaggguggcgaucacgu

SEQ ID NO: 1613774 - RNA, 20 nt, Pseudomonas putida KT2440
gagggugacccagcgcuggu

SEQ ID NO: 1613775 - RNA, 19 nt, Pseudomonas putida KT2440
gagggucgugagccugcac

SEQ ID NO: 1613776 - RNA, 21 nt, Pseudomonas putida KT2440
gaggggacgaucugcagcacc

SEQ ID NO: 1613777 - RNA, 15 nt, Pseudomonas putida KT2440
gagguaaaggucaca

SEQ ID NO: 1613778 - RNA, 14 nt, Pseudomonas putida KT2440
gaggguuccaggcc

SEQ ID NO: 1613779 - RNA, 21 nt, Pseudomonas putida KT2440
gagguaggccgucagcagcag

SEQ ID NO: 1613780 - RNA, 16 nt, Pseudomonas putida KT2440
gagguauacacuggcu

SEQ ID NO: 1613781 - RNA, 20 nt, Pseudomonas putida KT2440
gaguaaucgaugaaauucac

SEQ ID NO: 1613782 - RNA, 19 nt, Pseudomonas putida KT2440
gagcucgaucuugccuucg

SEQ ID NO: 1613783 - RNA, 14 nt, Pseudomonas putida KT2440
gaggaacaacuugg

SEQ ID NO: 1613784 - RNA, 22 nt, Pseudomonas putida KT2440
gaggaaaagcagcuccagcguu

SEQ ID NO: 1613785 - RNA, 19 nt, Pseudomonas putida KT2440
gaggcccucaagggcgcug

SEQ ID NO: 1613786 - RNA, 17 nt, Pseudomonas putida KT2440
gaggccaguaccagcag

SEQ ID NO: 1613787 - RNA, 19 nt, Pseudomonas putida KT2440
gaggccaguaccagcagca

SEQ ID NO: 1613788 - RNA, 11 nt, Pseudomonas putida KT2440
gaggccagcac

SEQ ID NO: 1613789 - RNA, 17 nt, Pseudomonas putida KT2440
gaggccgguacugccca

SEQ ID NO: 1613790 - RNA, 21 nt, Pseudomonas putida KT2440
gaggccgguaggccuccccgc

SEQ ID NO: 1613791 - RNA, 20 nt, Pseudomonas putida KT2440
gaggccggcacagaccgcaa

SEQ ID NO: 1613792 - RNA, 19 nt, Pseudomonas putida KT2440
gaggccggcacaggaaggc

SEQ ID NO: 1613793 - RNA, 18 nt, Pseudomonas putida KT2440
gaggaggccggggaugcg

SEQ ID NO: 1613794 - RNA, 22 nt, Pseudomonas putida KT2440
gaggagggcugcaucacuugca

SEQ ID NO: 1613795 - RNA, 22 nt, Pseudomonas putida KT2440
gaggcauuuucgaucaucgcca

SEQ ID NO: 1613796 - RNA, 16 nt, Pseudomonas putida KT2440
gaucccgcuccucggc

SEQ ID NO: 1613797 - RNA, 17 nt, Pseudomonas putida KT2440
gauccccaccagcauca

SEQ ID NO: 1613798 - RNA, 15 nt, Pseudomonas putida KT2440
gaucccgaugcgcuu

SEQ ID NO: 1613799 - RNA, 23 nt, Pseudomonas putida KT2440
gaucccgacaaaguggaaggcau

SEQ ID NO: 1613800 - RNA, 14 nt, Pseudomonas putida KT2440
gaucccgccgagca

SEQ ID NO: 1613801 - RNA, 22 nt, Pseudomonas putida KT2440
gaucccgccgagcauccgcgcc

SEQ ID NO: 1613802 - RNA, 17 nt, Pseudomonas putida KT2440
gaucccgccgccagacc

SEQ ID NO: 1613803 - RNA, 14 nt, Pseudomonas putida KT2440
gaucccuggggcca

SEQ ID NO: 1613804 - RNA, 12 nt, Pseudomonas putida KT2440
gauccgcggcau

SEQ ID NO: 1613805 - RNA, 21 nt, Pseudomonas putida KT2440
gauccggccguguucaggcac

SEQ ID NO: 1613806 - RNA, 12 nt, Pseudomonas putida KT2440
gauccggcacuc

SEQ ID NO: 1613807 - RNA, 23 nt, Pseudomonas putida KT2440
gauccaucuucaccuugccuacc

SEQ ID NO: 1613808 - RNA, 19 nt, Pseudomonas putida KT2440
gauccaccucucagcacca

SEQ ID NO: 1613809 - RNA, 16 nt, Pseudomonas putida KT2440
gauccacagcgggucg

SEQ ID NO: 1613810 - RNA, 14 nt, Pseudomonas putida KT2440
gaucauuucaucgc

SEQ ID NO: 1613811 - RNA, 14 nt, Pseudomonas putida KT2440
aaagccgccaugug

SEQ ID NO: 1613812 - RNA, 19 nt, Pseudomonas putida KT2440
gauccuguggaagcgggcg

SEQ ID NO: 1613813 - RNA, 16 nt, Pseudomonas putida KT2440
gaucgaagcagcagcu

SEQ ID NO: 1613814 - RNA, 13 nt, Pseudomonas putida KT2440
gaucgaaaaaccg

SEQ ID NO: 1613815 - RNA, 14 nt, Pseudomonas putida KT2440
gaucgauccccugc

SEQ ID NO: 1613816 - RNA, 16 nt, Pseudomonas putida KT2440
gaucgagccgaucagg

SEQ ID NO: 1613817 - RNA, 15 nt, Pseudomonas putida KT2440
gaucgcaagcuggcg

SEQ ID NO: 1613818 - RNA, 21 nt, Pseudomonas putida KT2440
gaucgaugcacguaccuggcu

SEQ ID NO: 1613819 - RNA, 18 nt, Pseudomonas putida KT2440
aaagccaccggacagaau

SEQ ID NO: 1613820 - RNA, 12 nt, Pseudomonas putida KT2440
gauccugcagcc

SEQ ID NO: 1613821 - RNA, 16 nt, Pseudomonas putida KT2440
aaagccacugcaccaa

SEQ ID NO: 1613822 - RNA, 23 nt, Pseudomonas putida KT2440
aaagccagcagugcggcaaccac

SEQ ID NO: 1613823 - RNA, 23 nt, Pseudomonas putida KT2440
aaagcccauaaaccccagccuuc

SEQ ID NO: 1613824 - RNA, 16 nt, Pseudomonas putida KT2440
aaagccccggcucgca

SEQ ID NO: 1613825 - RNA, 15 nt, Pseudomonas putida KT2440
aaagcccgccccaau

SEQ ID NO: 1613826 - RNA, 14 nt, Pseudomonas putida KT2440
gaucgccagcccca

SEQ ID NO: 1613827 - RNA, 15 nt, Pseudomonas putida KT2440
gaucgccagccccag

SEQ ID NO: 1613828 - RNA, 12 nt, Pseudomonas putida KT2440
gaucgccuccag

SEQ ID NO: 1613829 - RNA, 19 nt, Pseudomonas putida KT2440
gaucgcgcuggcacugcgg

SEQ ID NO: 1613830 - RNA, 23 nt, Pseudomonas putida KT2440
gaucgcgcuuggcaccggcagca

SEQ ID NO: 1613831 - RNA, 19 nt, Pseudomonas putida KT2440
gaucggguacuccaccacc

SEQ ID NO: 1613832 - RNA, 18 nt, Pseudomonas putida KT2440
gaucggccgccagaucau

SEQ ID NO: 1613833 - RNA, 14 nt, Pseudomonas putida KT2440
gaucggcuggccau

SEQ ID NO: 1613834 - RNA, 17 nt, Pseudomonas putida KT2440
gaucggcaguggcucgu

SEQ ID NO: 1613835 - RNA, 23 nt, Pseudomonas putida KT2440
gaucgucgacaacgcacccgccu

SEQ ID NO: 1613836 - RNA, 13 nt, Pseudomonas putida KT2440
gaucguugguccg

SEQ ID NO: 1613837 - RNA, 15 nt, Pseudomonas putida KT2440
gaucuggucacccug

SEQ ID NO: 1613838 - RNA, 18 nt, Pseudomonas putida KT2440
gaucuggcgcagcgggga

SEQ ID NO: 1613839 - RNA, 17 nt, Pseudomonas putida KT2440
gaucuggaucacugcca

SEQ ID NO: 1613840 - RNA, 11 nt, Pseudomonas putida KT2440
gaucugccccu

SEQ ID NO: 1613841 - RNA, 15 nt, Pseudomonas putida KT2440
gaucugcggugggca

SEQ ID NO: 1613842 - RNA, 17 nt, Pseudomonas putida KT2440
gaucucgcuucauggcc

SEQ ID NO: 1613843 - RNA, 16 nt, Pseudomonas putida KT2440
gaucugcagguggugg

SEQ ID NO: 1613844 - RNA, 19 nt, Pseudomonas putida KT2440
gaucugaaaguucagcgcc

SEQ ID NO: 1613845 - RNA, 22 nt, Pseudomonas putida KT2440
gaucugagcagcagagagauug

SEQ ID NO: 1613846 - RNA, 15 nt, Pseudomonas putida KT2440
gaucucggccagcag

SEQ ID NO: 1613847 - RNA, 16 nt, Pseudomonas putida KT2440
gaucucggccagcagg

SEQ ID NO: 1613848 - RNA, 21 nt, Pseudomonas putida KT2440
gaucucgcccaugauguggcu

SEQ ID NO: 1613849 - RNA, 22 nt, Pseudomonas putida KT2440
gaucucgcccaugauguggcug

SEQ ID NO: 1613850 - RNA, 15 nt, Pseudomonas putida KT2440
gaucucgauccggcc

SEQ ID NO: 1613851 - RNA, 20 nt, Pseudomonas putida KT2440
gaucucgccagccugcagcg

SEQ ID NO: 1613852 - RNA, 15 nt, Pseudomonas putida KT2440
gaucucaagcaaucc

SEQ ID NO: 1613853 - RNA, 16 nt, Pseudomonas putida KT2440
gaucuccucggccagc

SEQ ID NO: 1613854 - RNA, 18 nt, Pseudomonas putida KT2440
gaucucacgcgccacaua

SEQ ID NO: 1613855 - RNA, 17 nt, Pseudomonas putida KT2440
gaucuaugaccaacuuu

SEQ ID NO: 1613856 - RNA, 14 nt, Pseudomonas putida KT2440
gaucauuaccugca

SEQ ID NO: 1613857 - RNA, 14 nt, Pseudomonas putida KT2440
gaucauucaggcac

SEQ ID NO: 1613858 - RNA, 15 nt, Pseudomonas putida KT2440
gaucauucaggcacg

SEQ ID NO: 1613859 - RNA, 17 nt, Pseudomonas putida KT2440
gaucaugcggcaagcca

SEQ ID NO: 1613860 - RNA, 23 nt, Pseudomonas putida KT2440
gaucaugaacgaggacugcacca

SEQ ID NO: 1613861 - RNA, 17 nt, Pseudomonas putida KT2440
gaucaucggcacgccca

SEQ ID NO: 1613862 - RNA, 21 nt, Pseudomonas putida KT2440
gaucauccacaaucagcacug

SEQ ID NO: 1613863 - RNA, 16 nt, Pseudomonas putida KT2440
gaucaucgaagccagu

SEQ ID NO: 1613864 - RNA, 18 nt, Pseudomonas putida KT2440
gaucaucgaagccaguac

SEQ ID NO: 1613865 - RNA, 13 nt, Pseudomonas putida KT2440
gaucaucaucggc

SEQ ID NO: 1613866 - RNA, 19 nt, Pseudomonas putida KT2440
gaucagcgccgaaccagca

SEQ ID NO: 1613867 - RNA, 15 nt, Pseudomonas putida KT2440
gaucagcgccugcuc

SEQ ID NO: 1613868 - RNA, 20 nt, Pseudomonas putida KT2440
gaucagcgcagacuggguga

SEQ ID NO: 1613869 - RNA, 14 nt, Pseudomonas putida KT2440
gaucagccgugaca

SEQ ID NO: 1613870 - RNA, 13 nt, Pseudomonas putida KT2440
gaucagcggcgcc

SEQ ID NO: 1613871 - RNA, 22 nt, Pseudomonas putida KT2440
gaucagcggcuuguucagcugg

SEQ ID NO: 1613872 - RNA, 18 nt, Pseudomonas putida KT2440
gaucagcgcguccagcaa

SEQ ID NO: 1613873 - RNA, 18 nt, Pseudomonas putida KT2440
gaucaggcaggccagcac

SEQ ID NO: 1613874 - RNA, 14 nt, Pseudomonas putida KT2440
gaucaggugcagga

SEQ ID NO: 1613875 - RNA, 16 nt, Pseudomonas putida KT2440
gaucagguugcccagc

SEQ ID NO: 1613876 - RNA, 19 nt, Pseudomonas putida KT2440
gaucaggucgacacccagc

SEQ ID NO: 1613877 - RNA, 18 nt, Pseudomonas putida KT2440
gaucaggcuucagaagcc

SEQ ID NO: 1613878 - RNA, 21 nt, Pseudomonas putida KT2440
gaucagggucagggccaggcc

SEQ ID NO: 1613879 - RNA, 16 nt, Pseudomonas putida KT2440
gaucaacgccgccagc

SEQ ID NO: 1613880 - RNA, 20 nt, Pseudomonas putida KT2440
gauauggcuccaccacagcu

SEQ ID NO: 1613881 - RNA, 14 nt, Pseudomonas putida KT2440
gaucaccagccccu

SEQ ID NO: 1613882 - RNA, 15 nt, Pseudomonas putida KT2440
gaucacaucgugaag

SEQ ID NO: 1613883 - RNA, 17 nt, Pseudomonas putida KT2440
gaucacccuuggccacc

SEQ ID NO: 1613884 - RNA, 15 nt, Pseudomonas putida KT2440
gaucaccgccagcag

SEQ ID NO: 1613885 - RNA, 16 nt, Pseudomonas putida KT2440
gaucaccgccagcggc

SEQ ID NO: 1613886 - RNA, 15 nt, Pseudomonas putida KT2440
gaucaccgccgccac

SEQ ID NO: 1613887 - RNA, 19 nt, Pseudomonas putida KT2440
gaucacguggcugaugcca

SEQ ID NO: 1613888 - RNA, 16 nt, Pseudomonas putida KT2440
gaucacuuccauggca

SEQ ID NO: 1613889 - RNA, 13 nt, Pseudomonas putida KT2440
gaucacuuccugg

SEQ ID NO: 1613890 - RNA, 15 nt, Pseudomonas putida KT2440
gaucacugccagcac

SEQ ID NO: 1613891 - RNA, 17 nt, Pseudomonas putida KT2440
gaucacgcuuaagucuu

SEQ ID NO: 1613892 - RNA, 19 nt, Pseudomonas putida KT2440
gaucacgcuuaagucuucu

SEQ ID NO: 1613893 - RNA, 14 nt, Pseudomonas putida KT2440
gaucacgcaggccc

SEQ ID NO: 1613894 - RNA, 17 nt, Pseudomonas putida KT2440
gaucagcaugucccggg

SEQ ID NO: 1613895 - RNA, 16 nt, Pseudomonas putida KT2440
gaucacuuccaccugc

SEQ ID NO: 1613896 - RNA, 13 nt, Pseudomonas putida KT2440
gauagagccgccu

SEQ ID NO: 1613897 - RNA, 18 nt, Pseudomonas putida KT2440
gauagaaccguuucagua

SEQ ID NO: 1613898 - RNA, 16 nt, Pseudomonas putida KT2440
gauagaacgggucauu

SEQ ID NO: 1613899 - RNA, 20 nt, Pseudomonas putida KT2440
gauaccuggguccaggcaca

SEQ ID NO: 1613900 - RNA, 20 nt, Pseudomonas putida KT2440
gauaccugugggagcgggcg

SEQ ID NO: 1613901 - RNA, 18 nt, Pseudomonas putida KT2440
gauaagcaugggucagac

SEQ ID NO: 1613902 - RNA, 12 nt, Pseudomonas putida KT2440
gauagcaaaccg

SEQ ID NO: 1613903 - RNA, 15 nt, Pseudomonas putida KT2440
gauagauaucaagca

SEQ ID NO: 1613904 - RNA, 24 nt, Pseudomonas putida KT2440
gauaguggcguuuuucacacgcca

SEQ ID NO: 1613905 - RNA, 17 nt, Pseudomonas putida KT2440
gauaguccagcaacucc

SEQ ID NO: 1613906 - RNA, 16 nt, Pseudomonas putida KT2440
gauaugcuccauguuc

SEQ ID NO: 1613907 - RNA, 13 nt, Pseudomonas putida KT2440
cuuuccaaaccug

SEQ ID NO: 1613908 - RNA, 20 nt, Pseudomonas putida KT2440
cuuucccacauguaaugaaa

SEQ ID NO: 1613909 - RNA, 19 nt, Pseudomonas putida KT2440
cuuucuuggcaugcgacgc

SEQ ID NO: 1613910 - RNA, 20 nt, Pseudomonas putida KT2440
cuuucuccagcaacaacgcc

SEQ ID NO: 1613911 - RNA, 13 nt, Pseudomonas putida KT2440
cuuucucccaggc

SEQ ID NO: 1613912 - RNA, 22 nt, Pseudomonas putida KT2440
cuuuguuguuugggccugugcc

SEQ ID NO: 1613913 - RNA, 17 nt, Pseudomonas putida KT2440
cuuuguguugauucaga

SEQ ID NO: 1613914 - RNA, 15 nt, Pseudomonas putida KT2440
cuuuguucauggugg

SEQ ID NO: 1613915 - RNA, 18 nt, Pseudomonas putida KT2440
cuuugugcacaagcugcu

SEQ ID NO: 1613916 - RNA, 15 nt, Pseudomonas putida KT2440
cuuugcugcaggucc

SEQ ID NO: 1613917 - RNA, 17 nt, Pseudomonas putida KT2440
cuuugauuacuugacga

SEQ ID NO: 1613918 - RNA, 15 nt, Pseudomonas putida KT2440
cuuugcagcccuucg

SEQ ID NO: 1613919 - RNA, 22 nt, Pseudomonas putida KT2440
cuuugcagcccuucgcaggcac

SEQ ID NO: 1613920 - RNA, 17 nt, Pseudomonas putida KT2440
cuuuagcaggcaagccc

SEQ ID NO: 1613921 - RNA, 17 nt, Pseudomonas putida KT2440
cuuucaggcgcagcaca

SEQ ID NO: 1613922 - RNA, 20 nt, Pseudomonas putida KT2440
cuuucauaccccuccggccc

SEQ ID NO: 1613923 - RNA, 17 nt, Pseudomonas putida KT2440
cuuucaccgcuucuuug

SEQ ID NO: 1613924 - RNA, 18 nt, Pseudomonas putida KT2440
cuuucaggcacagcacgg

SEQ ID NO: 1613925 - RNA, 20 nt, Pseudomonas putida KT2440
cuuucagcucaaucagccaa

SEQ ID NO: 1613926 - RNA, 14 nt, Pseudomonas putida KT2440
cuuucagcgccugc

SEQ ID NO: 1613927 - RNA, 17 nt, Pseudomonas putida KT2440
cuucgcuguaaccuggu

SEQ ID NO: 1613928 - RNA, 18 nt, Pseudomonas putida KT2440
cuucgcugucuuccaggg

SEQ ID NO: 1613929 - RNA, 14 nt, Pseudomonas putida KT2440
cuucggcaaucacc

SEQ ID NO: 1613930 - RNA, 21 nt, Pseudomonas putida KT2440
cuucggagguagccaccugau

SEQ ID NO: 1613931 - RNA, 15 nt, Pseudomonas putida KT2440
cuucggcaucggccu

SEQ ID NO: 1613932 - RNA, 17 nt, Pseudomonas putida KT2440
cuucgcucacaaagccc

SEQ ID NO: 1613933 - RNA, 22 nt, Pseudomonas putida KT2440
cuucgcuggcgacgaagcugcu

SEQ ID NO: 1613934 - RNA, 23 nt, Pseudomonas putida KT2440
cuucgcuggcgacgaagcugcug

SEQ ID NO: 1613935 - RNA, 22 nt, Pseudomonas putida KT2440
cuucggcgauauggcuccacca

SEQ ID NO: 1613936 - RNA, 13 nt, Pseudomonas putida KT2440
cuucggccagcag

SEQ ID NO: 1613937 - RNA, 21 nt, Pseudomonas putida KT2440
cuucggccaguuucagcgccu

SEQ ID NO: 1613938 - RNA, 22 nt, Pseudomonas putida KT2440
cuuuaccguuggcuagccgcca

SEQ ID NO: 1613939 - RNA, 19 nt, Pseudomonas putida KT2440
gaaaagcaaggcucaggcc

SEQ ID NO: 1613940 - RNA, 16 nt, Pseudomonas putida KT2440
cuuuuuuugccuguug

SEQ ID NO: 1613941 - RNA, 15 nt, Pseudomonas putida KT2440
cuuuuuuauugcugu

SEQ ID NO: 1613942 - RNA, 23 nt, Pseudomonas putida KT2440
gaaaaaaagugguugacaagcaa

SEQ ID NO: 1613943 - RNA, 15 nt, Pseudomonas putida KT2440
gaaaaagcccaguuc

SEQ ID NO: 1613944 - RNA, 17 nt, Pseudomonas putida KT2440
gaaaaaggggugcaaag

SEQ ID NO: 1613945 - RNA, 22 nt, Pseudomonas putida KT2440
cuuuuccugcgggucauccuca

SEQ ID NO: 1613946 - RNA, 19 nt, Pseudomonas putida KT2440
cuuuucaccuccaguugcc

SEQ ID NO: 1613947 - RNA, 15 nt, Pseudomonas putida KT2440
cuuuugcccuucugg

SEQ ID NO: 1613948 - RNA, 17 nt, Pseudomonas putida KT2440
cuuuucuuuacaaccca

SEQ ID NO: 1613949 - RNA, 19 nt, Pseudomonas putida KT2440
gaacgacacgugguugcac

SEQ ID NO: 1613950 - RNA, 23 nt, Pseudomonas putida KT2440
gaacgacuucggcaacagccggg

SEQ ID NO: 1613951 - RNA, 20 nt, Pseudomonas putida KT2440
gaaccugugaagccagggca

SEQ ID NO: 1613952 - RNA, 21 nt, Pseudomonas putida KT2440
gaacgaaaaacuccuugagau

SEQ ID NO: 1613953 - RNA, 14 nt, Pseudomonas putida KT2440
gaaccuacccggua

SEQ ID NO: 1613954 - RNA, 12 nt, Pseudomonas putida KT2440
gaaccuccgcca

SEQ ID NO: 1613955 - RNA, 20 nt, Pseudomonas putida KT2440
gaaccgcuguucugcccggc

SEQ ID NO: 1613956 - RNA, 20 nt, Pseudomonas putida KT2440
gaaccggcgaucagggugua

SEQ ID NO: 1613957 - RNA, 21 nt, Pseudomonas putida KT2440
gaacccgauuacaagggccug

SEQ ID NO: 1613958 - RNA, 22 nt, Pseudomonas putida KT2440
gaacccgcuccuaccacguaca

SEQ ID NO: 1613959 - RNA, 18 nt, Pseudomonas putida KT2440
gaacccgcugccacccac

SEQ ID NO: 1613960 - RNA, 13 nt, Pseudomonas putida KT2440
gaacccgcuggcg

SEQ ID NO: 1613961 - RNA, 18 nt, Pseudomonas putida KT2440
gaacccgugcaucugcuc

SEQ ID NO: 1613962 - RNA, 12 nt, Pseudomonas putida KT2440
gaaccacaucac

SEQ ID NO: 1613963 - RNA, 18 nt, Pseudomonas putida KT2440
gaaccagcagcaccugcc

SEQ ID NO: 1613964 - RNA, 20 nt, Pseudomonas putida KT2440
gaaccaggauauugccgacu

SEQ ID NO: 1613965 - RNA, 14 nt, Pseudomonas putida KT2440
gaaccccacucucc

SEQ ID NO: 1613966 - RNA, 19 nt, Pseudomonas putida KT2440
gaacccaaucauauacauc

SEQ ID NO: 1613967 - RNA, 13 nt, Pseudomonas putida KT2440
gaacccacuguca

SEQ ID NO: 1613968 - RNA, 17 nt, Pseudomonas putida KT2440
gaaccacacagaugccg

SEQ ID NO: 1613969 - RNA, 15 nt, Pseudomonas putida KT2440
gaaccacagcacgcc

SEQ ID NO: 1613970 - RNA, 17 nt, Pseudomonas putida KT2440
gaacaucacgaaggugu

SEQ ID NO: 1613971 - RNA, 13 nt, Pseudomonas putida KT2440
gaacaucagcagg

SEQ ID NO: 1613972 - RNA, 20 nt, Pseudomonas putida KT2440
gaacuacgcgccagcaugga

SEQ ID NO: 1613973 - RNA, 22 nt, Pseudomonas putida KT2440
gaacucgaucggcacccccuuc

SEQ ID NO: 1613974 - RNA, 14 nt, Pseudomonas putida KT2440
gaacuccugcaccg

SEQ ID NO: 1613975 - RNA, 15 nt, Pseudomonas putida KT2440
gaacucaguuacaga

SEQ ID NO: 1613976 - RNA, 22 nt, Pseudomonas putida KT2440
gaacucaguuacagaggcauga

SEQ ID NO: 1613977 - RNA, 17 nt, Pseudomonas putida KT2440
gaacucggcgagccgcc

SEQ ID NO: 1613978 - RNA, 18 nt, Pseudomonas putida KT2440
gaacucggcgagccgcca

SEQ ID NO: 1613979 - RNA, 16 nt, Pseudomonas putida KT2440
gaacucuggcaacagc

SEQ ID NO: 1613980 - RNA, 15 nt, Pseudomonas putida KT2440
gaacucuuccagcuc

SEQ ID NO: 1613981 - RNA, 23 nt, Pseudomonas putida KT2440
gaacugcuugaacgagccagcca

SEQ ID NO: 1613982 - RNA, 15 nt, Pseudomonas putida KT2440
gaacugggcauccag

SEQ ID NO: 1613983 - RNA, 12 nt, Pseudomonas putida KT2440
gaacuggcugcc

SEQ ID NO: 1613984 - RNA, 13 nt, Pseudomonas putida KT2440
gaacuggcugccg

SEQ ID NO: 1613985 - RNA, 20 nt, Pseudomonas putida KT2440
gaacgagguuuugcagcgcu

SEQ ID NO: 1613986 - RNA, 23 nt, Pseudomonas putida KT2440
gaacgagguuuugcagcgcucga

SEQ ID NO: 1613987 - RNA, 20 nt, Pseudomonas putida KT2440
gaacgauucugccagcuccu

SEQ ID NO: 1613988 - RNA, 15 nt, Pseudomonas putida KT2440
gaacgcaagaaggcu

SEQ ID NO: 1613989 - RNA, 17 nt, Pseudomonas putida KT2440
gaacgcaagaaggcugc

SEQ ID NO: 1613990 - RNA, 12 nt, Pseudomonas putida KT2440
gaacgccccgaa

SEQ ID NO: 1613991 - RNA, 14 nt, Pseudomonas putida KT2440
gaacgccgccugcc

SEQ ID NO: 1613992 - RNA, 22 nt, Pseudomonas putida KT2440
gaacgccuuggccucgcugacc

SEQ ID NO: 1613993 - RNA, 24 nt, Pseudomonas putida KT2440
gaacggcuguuccucgccauggcc

SEQ ID NO: 1613994 - RNA, 13 nt, Pseudomonas putida KT2440
gaacgggcucacc

SEQ ID NO: 1613995 - RNA, 19 nt, Pseudomonas putida KT2440
gaacgggcugucgagcagg

SEQ ID NO: 1613996 - RNA, 13 nt, Pseudomonas putida KT2440
gaacgcugugccg

SEQ ID NO: 1613997 - RNA, 18 nt, Pseudomonas putida KT2440
gaacacgaaaaagccagc

SEQ ID NO: 1613998 - RNA, 16 nt, Pseudomonas putida KT2440
gaacaaucuucuucau

SEQ ID NO: 1613999 - RNA, 19 nt, Pseudomonas putida KT2440
gaacacgcucaugaacagc

SEQ ID NO: 1614000 - RNA, 22 nt, Pseudomonas putida KT2440
gaacacgcucaugaacagcgcc

SEQ ID NO: 1614001 - RNA, 13 nt, Pseudomonas putida KT2440
gaacaccugcagc

SEQ ID NO: 1614002 - RNA, 14 nt, Pseudomonas putida KT2440
gaacaccugcagcg

SEQ ID NO: 1614003 - RNA, 18 nt, Pseudomonas putida KT2440
gaacaccugccagccccg

SEQ ID NO: 1614004 - RNA, 16 nt, Pseudomonas putida KT2440
gaacacgggcgaagcc

SEQ ID NO: 1614005 - RNA, 14 nt, Pseudomonas putida KT2440
gaacacguccagcc

SEQ ID NO: 1614006 - RNA, 15 nt, Pseudomonas putida KT2440
gaacaauaaaacuac

SEQ ID NO: 1614007 - RNA, 11 nt, Pseudomonas putida KT2440
gaacagcagcg

SEQ ID NO: 1614008 - RNA, 21 nt, Pseudomonas putida KT2440
gaacagcagcgccgccaggcc

SEQ ID NO: 1614009 - RNA, 11 nt, Pseudomonas putida KT2440
gaacagcagca

SEQ ID NO: 1614010 - RNA, 15 nt, Pseudomonas putida KT2440
gaacagcacugccag

SEQ ID NO: 1614011 - RNA, 16 nt, Pseudomonas putida KT2440
gaacagcacugccagc

SEQ ID NO: 1614012 - RNA, 17 nt, Pseudomonas putida KT2440
gaacagcacugccagcc

SEQ ID NO: 1614013 - RNA, 13 nt, Pseudomonas putida KT2440
gaacagcaccgcc

SEQ ID NO: 1614014 - RNA, 18 nt, Pseudomonas putida KT2440
gaacagcacgcccaagcc

SEQ ID NO: 1614015 - RNA, 17 nt, Pseudomonas putida KT2440
gaacagcucgauggcca

SEQ ID NO: 1614016 - RNA, 20 nt, Pseudomonas putida KT2440
gaacagcucgauggccagga

SEQ ID NO: 1614017 - RNA, 22 nt, Pseudomonas putida KT2440
gaacagccacagcugcugcagg

SEQ ID NO: 1614018 - RNA, 17 nt, Pseudomonas putida KT2440
gaacagcgugccaugca

SEQ ID NO: 1614019 - RNA, 16 nt, Pseudomonas putida KT2440
gaacagcguggccagc

SEQ ID NO: 1614020 - RNA, 18 nt, Pseudomonas putida KT2440
gaacagcucuggcagcag

SEQ ID NO: 1614021 - RNA, 17 nt, Pseudomonas putida KT2440
gaacaggaucagcggcu

SEQ ID NO: 1614022 - RNA, 16 nt, Pseudomonas putida KT2440
gaaaugaacagccggc

SEQ ID NO: 1614023 - RNA, 22 nt, Pseudomonas putida KT2440
gaaauucaaguacaaacaccac

SEQ ID NO: 1614024 - RNA, 23 nt, Pseudomonas putida KT2440
gaaacugcgcugguacagcagga

SEQ ID NO: 1614025 - RNA, 18 nt, Pseudomonas putida KT2440
gaaacugaucagcuucga

SEQ ID NO: 1614026 - RNA, 18 nt, Pseudomonas putida KT2440
gaaacucguucagugccu

SEQ ID NO: 1614027 - RNA, 18 nt, Pseudomonas putida KT2440
gaaacucacgcgccaggg

SEQ ID NO: 1614028 - RNA, 17 nt, Pseudomonas putida KT2440
gaaaaucgacccaccua

SEQ ID NO: 1614029 - RNA, 20 nt, Pseudomonas putida KT2440
gaaaaucgacccaccuaccc

SEQ ID NO: 1614030 - RNA, 20 nt, Pseudomonas putida KT2440
gaaaaucgccuugcgucggc

SEQ ID NO: 1614031 - RNA, 15 nt, Pseudomonas putida KT2440
gaaagcgguugagau

SEQ ID NO: 1614032 - RNA, 18 nt, Pseudomonas putida KT2440
gacagguaggcgccacgc

SEQ ID NO: 1614033 - RNA, 22 nt, Pseudomonas putida KT2440
gacagguaguuggccgggccuu

SEQ ID NO: 1614034 - RNA, 15 nt, Pseudomonas putida KT2440
gacagguucgcccug

SEQ ID NO: 1614035 - RNA, 14 nt, Pseudomonas putida KT2440
gacaggggcgcaga

SEQ ID NO: 1614036 - RNA, 14 nt, Pseudomonas putida KT2440
gacagggcgcccgu

SEQ ID NO: 1614037 - RNA, 16 nt, Pseudomonas putida KT2440
gacaggccgugaacca

SEQ ID NO: 1614038 - RNA, 21 nt, Pseudomonas putida KT2440
gacaggcgucggggccggaga

SEQ ID NO: 1614039 - RNA, 18 nt, Pseudomonas putida KT2440
gacaggcuuacaucggcg

SEQ ID NO: 1614040 - RNA, 18 nt, Pseudomonas putida KT2440
gacaggccccagucuucg

SEQ ID NO: 1614041 - RNA, 19 nt, Pseudomonas putida KT2440
gacaccgcaaaucacugac

SEQ ID NO: 1614042 - RNA, 14 nt, Pseudomonas putida KT2440
gacagacagggccu

SEQ ID NO: 1614043 - RNA, 15 nt, Pseudomonas putida KT2440
gacagacagggccuu

SEQ ID NO: 1614044 - RNA, 22 nt, Pseudomonas putida KT2440
gacaccgcugccgggcaaagcg

SEQ ID NO: 1614045 - RNA, 19 nt, Pseudomonas putida KT2440
gacagccaccgcgagcugu

SEQ ID NO: 1614046 - RNA, 14 nt, Pseudomonas putida KT2440
gacagcaucggcag

SEQ ID NO: 1614047 - RNA, 22 nt, Pseudomonas putida KT2440
gacagcaucucggucgacaggg

SEQ ID NO: 1614048 - RNA, 16 nt, Pseudomonas putida KT2440
gacagcaucugcacca

SEQ ID NO: 1614049 - RNA, 18 nt, Pseudomonas putida KT2440
gacagcaucugcaccagg

SEQ ID NO: 1614050 - RNA, 20 nt, Pseudomonas putida KT2440
gacagcaucugcaccaggaa

SEQ ID NO: 1614051 - RNA, 17 nt, Pseudomonas putida KT2440
gacagcccaaggccugc

SEQ ID NO: 1614052 - RNA, 14 nt, Pseudomonas putida KT2440
gacagcaucaucag

SEQ ID NO: 1614053 - RNA, 17 nt, Pseudomonas putida KT2440
gacagcaucaucaggcc

SEQ ID NO: 1614054 - RNA, 20 nt, Pseudomonas putida KT2440
gacagcaucaucaggccgau

SEQ ID NO: 1614055 - RNA, 12 nt, Pseudomonas putida KT2440
gaccaccagcaa

SEQ ID NO: 1614056 - RNA, 19 nt, Pseudomonas putida KT2440
gaccaccagcaacaucgcc

SEQ ID NO: 1614057 - RNA, 20 nt, Pseudomonas putida KT2440
gaccaauugguuaaaagcca

SEQ ID NO: 1614058 - RNA, 14 nt, Pseudomonas putida KT2440
gaccacaaagccuu

SEQ ID NO: 1614059 - RNA, 16 nt, Pseudomonas putida KT2440
gaccaauccagcccuc

SEQ ID NO: 1614060 - RNA, 14 nt, Pseudomonas putida KT2440
gacagugcccgcug

SEQ ID NO: 1614061 - RNA, 20 nt, Pseudomonas putida KT2440
gacagugaauuccuugcugg

SEQ ID NO: 1614062 - RNA, 19 nt, Pseudomonas putida KT2440
gacaguggaaacgacaagg

SEQ ID NO: 1614063 - RNA, 17 nt, Pseudomonas putida KT2440
gaccagcugccauacag

SEQ ID NO: 1614064 - RNA, 15 nt, Pseudomonas putida KT2440
gaccagcggcagcaa

SEQ ID NO: 1614065 - RNA, 16 nt, Pseudomonas putida KT2440
gaccagcggcagcaag

SEQ ID NO: 1614066 - RNA, 13 nt, Pseudomonas putida KT2440
gaccaccucaucc

SEQ ID NO: 1614067 - RNA, 19 nt, Pseudomonas putida KT2440
gaccaccgcaggugcaggc

SEQ ID NO: 1614068 - RNA, 18 nt, Pseudomonas putida KT2440
gacccaugauugaauucu

SEQ ID NO: 1614069 - RNA, 18 nt, Pseudomonas putida KT2440
gaccaucggcaggcgguc

SEQ ID NO: 1614070 - RNA, 13 nt, Pseudomonas putida KT2440
gaccaucacggaa

SEQ ID NO: 1614071 - RNA, 17 nt, Pseudomonas putida KT2440
gaccgcggaaugaaccg

SEQ ID NO: 1614072 - RNA, 17 nt, Pseudomonas putida KT2440
gaccgccgggcccaggc

SEQ ID NO: 1614073 - RNA, 15 nt, Pseudomonas putida KT2440
gaccgccgcccaggu

SEQ ID NO: 1614074 - RNA, 14 nt, Pseudomonas putida KT2440
gaccgccgccacca

SEQ ID NO: 1614075 - RNA, 17 nt, Pseudomonas putida KT2440
gaccgccagcccgccac

SEQ ID NO: 1614076 - RNA, 18 nt, Pseudomonas putida KT2440
gaccgagaacaggcggcc

SEQ ID NO: 1614077 - RNA, 21 nt, Pseudomonas putida KT2440
gaccgagguaccaccggagga

SEQ ID NO: 1614078 - RNA, 16 nt, Pseudomonas putida KT2440
gaccgaagucgcccuu

SEQ ID NO: 1614079 - RNA, 14 nt, Pseudomonas putida KT2440
gaccgaccaccugc

SEQ ID NO: 1614080 - RNA, 17 nt, Pseudomonas putida KT2440
gacccccuugccagcau

SEQ ID NO: 1614081 - RNA, 16 nt, Pseudomonas putida KT2440
gaccccgccgcuggcu

SEQ ID NO: 1614082 - RNA, 22 nt, Pseudomonas putida KT2440
gaccccgaacuucccccucccc

SEQ ID NO: 1614083 - RNA, 15 nt, Pseudomonas putida KT2440
gacgccgcagccggg

SEQ ID NO: 1614084 - RNA, 18 nt, Pseudomonas putida KT2440
gacgauacccagcgcgcg

SEQ ID NO: 1614085 - RNA, 14 nt, Pseudomonas putida KT2440
gacgauaccgccca

SEQ ID NO: 1614086 - RNA, 18 nt, Pseudomonas putida KT2440
gacgcaggguagccccga

SEQ ID NO: 1614087 - RNA, 15 nt, Pseudomonas putida KT2440
gacgcagugcagccg

SEQ ID NO: 1614088 - RNA, 16 nt, Pseudomonas putida KT2440
gacgcagugcagccgc

SEQ ID NO: 1614089 - RNA, 14 nt, Pseudomonas putida KT2440
gaccuugccagcgc

SEQ ID NO: 1614090 - RNA, 18 nt, Pseudomonas putida KT2440
gaccuuggacagggugcg

SEQ ID NO: 1614091 - RNA, 13 nt, Pseudomonas putida KT2440
gacgaacagcgcc

SEQ ID NO: 1614092 - RNA, 17 nt, Pseudomonas putida KT2440
gacgaacagcgccgcga

SEQ ID NO: 1614093 - RNA, 14 nt, Pseudomonas putida KT2440
gacgaacagggccg

SEQ ID NO: 1614094 - RNA, 13 nt, Pseudomonas putida KT2440
gacgaaacccagu

SEQ ID NO: 1614095 - RNA, 17 nt, Pseudomonas putida KT2440
gacgaacucaacgcaac

SEQ ID NO: 1614096 - RNA, 21 nt, Pseudomonas putida KT2440
gacgaacucaacgcaacugcg

SEQ ID NO: 1614097 - RNA, 13 nt, Pseudomonas putida KT2440
gaccggccgggcu

SEQ ID NO: 1614098 - RNA, 16 nt, Pseudomonas putida KT2440
gaccugcuggcacugc

SEQ ID NO: 1614099 - RNA, 17 nt, Pseudomonas putida KT2440
gaccugcuggcacugcg

SEQ ID NO: 1614100 - RNA, 21 nt, Pseudomonas putida KT2440
gaccugcuggcacugcggcuc

SEQ ID NO: 1614101 - RNA, 21 nt, Pseudomonas putida KT2440
gaccuggcucuucaacaccag

SEQ ID NO: 1614102 - RNA, 19 nt, Pseudomonas putida KT2440
gaccuggcccgaacgcagc

SEQ ID NO: 1614103 - RNA, 15 nt, Pseudomonas putida KT2440
gaccuggaucgccag

SEQ ID NO: 1614104 - RNA, 16 nt, Pseudomonas putida KT2440
gaccuggaucgccagg

SEQ ID NO: 1614105 - RNA, 16 nt, Pseudomonas putida KT2440
gaccugccagccuucg

SEQ ID NO: 1614106 - RNA, 15 nt, Pseudomonas putida KT2440
gaccugauccaaauu

SEQ ID NO: 1614107 - RNA, 16 nt, Pseudomonas putida KT2440
gacgccggccugccgc

SEQ ID NO: 1614108 - RNA, 12 nt, Pseudomonas putida KT2440
gacggucaugcu

SEQ ID NO: 1614109 - RNA, 18 nt, Pseudomonas putida KT2440
gacggucugccggcaccg

SEQ ID NO: 1614110 - RNA, 15 nt, Pseudomonas putida KT2440
gacggugccgguggc

SEQ ID NO: 1614111 - RNA, 23 nt, Pseudomonas putida KT2440
gacggcggugauaugcguacccg

SEQ ID NO: 1614112 - RNA, 23 nt, Pseudomonas putida KT2440
gacggccuucgaagaacacggcu

SEQ ID NO: 1614113 - RNA, 24 nt, Pseudomonas putida KT2440
gacggccuucgaagaacacggcuu

SEQ ID NO: 1614114 - RNA, 22 nt, Pseudomonas putida KT2440
gacuagcagucccaucugguug

SEQ ID NO: 1614115 - RNA, 23 nt, Pseudomonas putida KT2440
gacuagauaaccaaccccugcgg

SEQ ID NO: 1614116 - RNA, 19 nt, Pseudomonas putida KT2440
gacacccagucgccccgcc

SEQ ID NO: 1614117 - RNA, 22 nt, Pseudomonas putida KT2440
gacacccagucgccccgccagc

SEQ ID NO: 1614118 - RNA, 12 nt, Pseudomonas putida KT2440
gacaccauggcc

SEQ ID NO: 1614119 - RNA, 13 nt, Pseudomonas putida KT2440
gacacccagcacc

SEQ ID NO: 1614120 - RNA, 17 nt, Pseudomonas putida KT2440
gacaccagacggccuuc

SEQ ID NO: 1614121 - RNA, 12 nt, Pseudomonas putida KT2440
gacaccagcgca

SEQ ID NO: 1614122 - RNA, 19 nt, Pseudomonas putida KT2440
gacaccagcgcaccacugu

SEQ ID NO: 1614123 - RNA, 21 nt, Pseudomonas putida KT2440
gacaccagcgcaccacuguuc

SEQ ID NO: 1614124 - RNA, 21 nt, Pseudomonas putida KT2440
gacaaugcgacugagcaacga

SEQ ID NO: 1614125 - RNA, 21 nt, Pseudomonas putida KT2440
gacaaccgaaaaggccaacca

SEQ ID NO: 1614126 - RNA, 15 nt, Pseudomonas putida KT2440
gacaacgcacccgcc

SEQ ID NO: 1614127 - RNA, 20 nt, Pseudomonas putida KT2440
gacaacgcgaaagcgaagaa

SEQ ID NO: 1614128 - RNA, 19 nt, Pseudomonas putida KT2440
gacaagguacucagcggcu

SEQ ID NO: 1614129 - RNA, 21 nt, Pseudomonas putida KT2440
gacaaccaacaggcucuccau

SEQ ID NO: 1614130 - RNA, 18 nt, Pseudomonas putida KT2440
gacaacauggucacaugu

SEQ ID NO: 1614131 - RNA, 20 nt, Pseudomonas putida KT2440
gacaaacgccagcaugcugg

SEQ ID NO: 1614132 - RNA, 12 nt, Pseudomonas putida KT2440
gacaaaccagcg

SEQ ID NO: 1614133 - RNA, 14 nt, Pseudomonas putida KT2440
gaauuggagcugaa

SEQ ID NO: 1614134 - RNA, 17 nt, Pseudomonas putida KT2440
gaauuauuggccagcaa

SEQ ID NO: 1614135 - RNA, 17 nt, Pseudomonas putida KT2440
gaaugcgcucauccagc

SEQ ID NO: 1614136 - RNA, 21 nt, Pseudomonas putida KT2440
gaaugcgcccggccaggucac

SEQ ID NO: 1614137 - RNA, 18 nt, Pseudomonas putida KT2440
gaauguugacgccgccuu

SEQ ID NO: 1614138 - RNA, 17 nt, Pseudomonas putida KT2440
gaaugcggauguaguuc

SEQ ID NO: 1614139 - RNA, 18 nt, Pseudomonas putida KT2440
gaaucuggcucugcagcg

SEQ ID NO: 1614140 - RNA, 19 nt, Pseudomonas putida KT2440
gaaugagaggcgggucagg

SEQ ID NO: 1614141 - RNA, 13 nt, Pseudomonas putida KT2440
gaaucaagccugc

SEQ ID NO: 1614142 - RNA, 22 nt, Pseudomonas putida KT2440
gaaucagccagccuucgccaac

SEQ ID NO: 1614143 - RNA, 14 nt, Pseudomonas putida KT2440
gaaucagcuugcca

SEQ ID NO: 1614144 - RNA, 18 nt, Pseudomonas putida KT2440
gaaucagcuugccauucu

SEQ ID NO: 1614145 - RNA, 23 nt, Pseudomonas putida KT2440
gaaucagcgccuccagggcggcc

SEQ ID NO: 1614146 - RNA, 21 nt, Pseudomonas putida KT2440
gaaucagcggcaggcuggcgu

SEQ ID NO: 1614147 - RNA, 17 nt, Pseudomonas putida KT2440
gaaucauccucgacacc

SEQ ID NO: 1614148 - RNA, 22 nt, Pseudomonas putida KT2440
gaauccagccggcccggcuggc

SEQ ID NO: 1614149 - RNA, 20 nt, Pseudomonas putida KT2440
gaauccccccuucaccgcca

SEQ ID NO: 1614150 - RNA, 14 nt, Pseudomonas putida KT2440
gaauccugcugagu

SEQ ID NO: 1614151 - RNA, 22 nt, Pseudomonas putida KT2440
gaauccagcaggcuugccagcu

SEQ ID NO: 1614152 - RNA, 22 nt, Pseudomonas putida KT2440
gaauagccggcacagugccaag

SEQ ID NO: 1614153 - RNA, 12 nt, Pseudomonas putida KT2440
gaauagcaucgc

SEQ ID NO: 1614154 - RNA, 18 nt, Pseudomonas putida KT2440
gaauaccaggcccgcuau

SEQ ID NO: 1614155 - RNA, 22 nt, Pseudomonas putida KT2440
gaauaccaguaaugcagccggc

SEQ ID NO: 1614156 - RNA, 17 nt, Pseudomonas putida KT2440
gaauacauagcgaucga

SEQ ID NO: 1614157 - RNA, 21 nt, Pseudomonas putida KT2440
gaagucuuccugguuuucgcg

SEQ ID NO: 1614158 - RNA, 16 nt, Pseudomonas putida KT2440
gaagucgcuuugcggg

SEQ ID NO: 1614159 - RNA, 21 nt, Pseudomonas putida KT2440
gaagucggccugggucagcug

SEQ ID NO: 1614160 - RNA, 23 nt, Pseudomonas putida KT2440
gaagucgccacaccacagcugca

SEQ ID NO: 1614161 - RNA, 15 nt, Pseudomonas putida KT2440
aaagaucgcccagcu

SEQ ID NO: 1614162 - RNA, 20 nt, Pseudomonas putida KT2440
gaagcuuggggccgcucugc

SEQ ID NO: 1614163 - RNA, 12 nt, Pseudomonas putida KT2440
gaaggccagcaa

SEQ ID NO: 1614164 - RNA, 17 nt, Pseudomonas putida KT2440
gaaggccguaggccagg

SEQ ID NO: 1614165 - RNA, 14 nt, Pseudomonas putida KT2440
gaaggccgccggca

SEQ ID NO: 1614166 - RNA, 20 nt, Pseudomonas putida KT2440
gaaggccgccggcaacuggc

SEQ ID NO: 1614167 - RNA, 21 nt, Pseudomonas putida KT2440
gaaggccgccggcaacuggca

SEQ ID NO: 1614168 - RNA, 20 nt, Pseudomonas putida KT2440
gaaggcaaucgcgcccggug

SEQ ID NO: 1614169 - RNA, 15 nt, Pseudomonas putida KT2440
gaaggcaggucagcg

SEQ ID NO: 1614170 - RNA, 23 nt, Pseudomonas putida KT2440
gaaggcaucguuguaagccauga

SEQ ID NO: 1614171 - RNA, 18 nt, Pseudomonas putida KT2440
gaaggucaccaguucacc

SEQ ID NO: 1614172 - RNA, 22 nt, Pseudomonas putida KT2440
gaaguagaacuggcgcagcagg

SEQ ID NO: 1614173 - RNA, 19 nt, Pseudomonas putida KT2440
gaagggugaugguugaaga

SEQ ID NO: 1614174 - RNA, 22 nt, Pseudomonas putida KT2440
gaagggcugcgguagcgcagcc

SEQ ID NO: 1614175 - RNA, 17 nt, Pseudomonas putida KT2440
gaagggcucaacaccag

SEQ ID NO: 1614176 - RNA, 21 nt, Pseudomonas putida KT2440
gaagggcucaacgccagggca

SEQ ID NO: 1614177 - RNA, 23 nt, Pseudomonas putida KT2440
gaagcgcacuuggccugcugauu

SEQ ID NO: 1614178 - RNA, 13 nt, Pseudomonas putida KT2440
gaagcccggccgc

SEQ ID NO: 1614179 - RNA, 20 nt, Pseudomonas putida KT2440
gaagcccguggcccucagcc

SEQ ID NO: 1614180 - RNA, 18 nt, Pseudomonas putida KT2440
gaagcgccuggagagccc

SEQ ID NO: 1614181 - RNA, 23 nt, Pseudomonas putida KT2440
gaagcgcgggucuuccaccaccu

SEQ ID NO: 1614182 - RNA, 21 nt, Pseudomonas putida KT2440
gaagcggccaccugccccagc

SEQ ID NO: 1614183 - RNA, 22 nt, Pseudomonas putida KT2440
gaagcgcuuggucccccacuuc

SEQ ID NO: 1614184 - RNA, 20 nt, Pseudomonas putida KT2440
gaagcgcugacugccaggcc

SEQ ID NO: 1614185 - RNA, 23 nt, Pseudomonas putida KT2440
gaagcggucguuacccagguaga

SEQ ID NO: 1614186 - RNA, 21 nt, Pseudomonas putida KT2440
gaagcgugcgaaguugguccc

SEQ ID NO: 1614187 - RNA, 12 nt, Pseudomonas putida KT2440
gaagaggccagg

SEQ ID NO: 1614188 - RNA, 14 nt, Pseudomonas putida KT2440
gaagcagaucauca

SEQ ID NO: 1614189 - RNA, 18 nt, Pseudomonas putida KT2440
gaagcagccgccgccugu

SEQ ID NO: 1614190 - RNA, 15 nt, Pseudomonas putida KT2440
gaagcagaacaucag

SEQ ID NO: 1614191 - RNA, 17 nt, Pseudomonas putida KT2440
gaagcaccacuggauga

SEQ ID NO: 1614192 - RNA, 17 nt, Pseudomonas putida KT2440
gaagcacgucgcgauug

SEQ ID NO: 1614193 - RNA, 19 nt, Pseudomonas putida KT2440
gaagccaguacgcaggcau

SEQ ID NO: 1614194 - RNA, 20 nt, Pseudomonas putida KT2440
gaagccauaucccgccaggu

SEQ ID NO: 1614195 - RNA, 15 nt, Pseudomonas putida KT2440
gaagccaugggcaga

SEQ ID NO: 1614196 - RNA, 15 nt, Pseudomonas putida KT2440
gaagccaugucuuca

SEQ ID NO: 1614197 - RNA, 14 nt, Pseudomonas putida KT2440
gaagacgcucgaca

SEQ ID NO: 1614198 - RNA, 17 nt, Pseudomonas putida KT2440
gaagacgcucgacagca

SEQ ID NO: 1614199 - RNA, 20 nt, Pseudomonas putida KT2440
gaagacgcucgacagcaacu

SEQ ID NO: 1614200 - RNA, 15 nt, Pseudomonas putida KT2440
gaagaacgcgagcgu

SEQ ID NO: 1614201 - RNA, 22 nt, Pseudomonas putida KT2440
gaacuugcccggggugcagauc

SEQ ID NO: 1614202 - RNA, 14 nt, Pseudomonas putida KT2440
cuguaggagcgggu

SEQ ID NO: 1614203 - RNA, 15 nt, Pseudomonas putida KT2440
cuguaggagcggguu

SEQ ID NO: 1614204 - RNA, 18 nt, Pseudomonas putida KT2440
cuguaggggcgggccugc

SEQ ID NO: 1614205 - RNA, 13 nt, Pseudomonas putida KT2440
cuguaggggggcc

SEQ ID NO: 1614206 - RNA, 21 nt, Pseudomonas putida KT2440
cuguaggcgcaacucagcgca

SEQ ID NO: 1614207 - RNA, 16 nt, Pseudomonas putida KT2440
cuguaggcgcggguuu

SEQ ID NO: 1614208 - RNA, 17 nt, Pseudomonas putida KT2440
cuguagauaugugaccg

SEQ ID NO: 1614209 - RNA, 16 nt, Pseudomonas putida KT2440
cuguacguccaaucgg

SEQ ID NO: 1614210 - RNA, 16 nt, Pseudomonas putida KT2440
cuguaucgaacaggca

SEQ ID NO: 1614211 - RNA, 16 nt, Pseudomonas putida KT2440
cuguaugauucgccuc

SEQ ID NO: 1614212 - RNA, 19 nt, Pseudomonas putida KT2440
cuguaugauucgccucccg

SEQ ID NO: 1614213 - RNA, 22 nt, Pseudomonas putida KT2440
cuguauguguguguccgccacc

SEQ ID NO: 1614214 - RNA, 14 nt, Pseudomonas putida KT2440
aaacucugcagguc

SEQ ID NO: 1614215 - RNA, 15 nt, Pseudomonas putida KT2440
aaacucugcagguca

SEQ ID NO: 1614216 - RNA, 22 nt, Pseudomonas putida KT2440
cugucagguguggcucagcucg

SEQ ID NO: 1614217 - RNA, 13 nt, Pseudomonas putida KT2440
cugucacgccuuc

SEQ ID NO: 1614218 - RNA, 13 nt, Pseudomonas putida KT2440
cugucacgacagg

SEQ ID NO: 1614219 - RNA, 17 nt, Pseudomonas putida KT2440
cugucaagcguuuuuug

SEQ ID NO: 1614220 - RNA, 16 nt, Pseudomonas putida KT2440
cuguccccccagggcg

SEQ ID NO: 1614221 - RNA, 13 nt, Pseudomonas putida KT2440
cugucccccagcc

SEQ ID NO: 1614222 - RNA, 20 nt, Pseudomonas putida KT2440
cugucccggcacaaccgaac

SEQ ID NO: 1614223 - RNA, 16 nt, Pseudomonas putida KT2440
cuguccccuuggcccu

SEQ ID NO: 1614224 - RNA, 21 nt, Pseudomonas putida KT2440
cuguccagcaagggccugugc

SEQ ID NO: 1614225 - RNA, 22 nt, Pseudomonas putida KT2440
cuguccacaccaaagucagcca

SEQ ID NO: 1614226 - RNA, 16 nt, Pseudomonas putida KT2440
cugucuagccgccugc

SEQ ID NO: 1614227 - RNA, 16 nt, Pseudomonas putida KT2440
cugucgguggggugcc

SEQ ID NO: 1614228 - RNA, 16 nt, Pseudomonas putida KT2440
cugucggucagccaga

SEQ ID NO: 1614229 - RNA, 17 nt, Pseudomonas putida KT2440
cugucggucagccagau

SEQ ID NO: 1614230 - RNA, 13 nt, Pseudomonas putida KT2440
cugucuuccaggg

SEQ ID NO: 1614231 - RNA, 14 nt, Pseudomonas putida KT2440
cugucuccauucca

SEQ ID NO: 1614232 - RNA, 12 nt, Pseudomonas putida KT2440
cugucugcagcu

SEQ ID NO: 1614233 - RNA, 13 nt, Pseudomonas putida KT2440
cuguccuccugcc

SEQ ID NO: 1614234 - RNA, 20 nt, Pseudomonas putida KT2440
cugucgaagcgcucccaggc

SEQ ID NO: 1614235 - RNA, 14 nt, Pseudomonas putida KT2440
cuguccuuggccaa

SEQ ID NO: 1614236 - RNA, 21 nt, Pseudomonas putida KT2440
cuguccuuggccaacugcagc

SEQ ID NO: 1614237 - RNA, 17 nt, Pseudomonas putida KT2440
cugucgaucacgggcaa

SEQ ID NO: 1614238 - RNA, 18 nt, Pseudomonas putida KT2440
cugucgauuuccagugcc

SEQ ID NO: 1614239 - RNA, 18 nt, Pseudomonas putida KT2440
cugucgagcuuggcgucc

SEQ ID NO: 1614240 - RNA, 14 nt, Pseudomonas putida KT2440
cugucgaacgcugc

SEQ ID NO: 1614241 - RNA, 15 nt, Pseudomonas putida KT2440
cugucggggccucuu

SEQ ID NO: 1614242 - RNA, 16 nt, Pseudomonas putida KT2440
cugucgcucuuaauuc

SEQ ID NO: 1614243 - RNA, 21 nt, Pseudomonas putida KT2440
cugugagaucgagcgccgccc

SEQ ID NO: 1614244 - RNA, 11 nt, Pseudomonas putida KT2440
cugugagaugu

SEQ ID NO: 1614245 - RNA, 19 nt, Pseudomonas putida KT2440
cugugagauuccgggcugc

SEQ ID NO: 1614246 - RNA, 16 nt, Pseudomonas putida KT2440
cugugcagcgcucgcu

SEQ ID NO: 1614247 - RNA, 20 nt, Pseudomonas putida KT2440
cugugcacugcgaagcccag

SEQ ID NO: 1614248 - RNA, 20 nt, Pseudomonas putida KT2440
cugugcacagccgugccuuc

SEQ ID NO: 1614249 - RNA, 20 nt, Pseudomonas putida KT2440
cugugcaacagcgccuggcg

SEQ ID NO: 1614250 - RNA, 17 nt, Pseudomonas putida KT2440
cugugcccggcgcgcgc

SEQ ID NO: 1614251 - RNA, 17 nt, Pseudomonas putida KT2440
cugugcccgccaggcgc

SEQ ID NO: 1614252 - RNA, 20 nt, Pseudomonas putida KT2440
cugugcccgccaggcgcaag

SEQ ID NO: 1614253 - RNA, 19 nt, Pseudomonas putida KT2440
cugugcccugaucgccucc

SEQ ID NO: 1614254 - RNA, 20 nt, Pseudomonas putida KT2440
cugugcccugaucgccucca

SEQ ID NO: 1614255 - RNA, 21 nt, Pseudomonas putida KT2440
cugugcccugaucgccuccag

SEQ ID NO: 1614256 - RNA, 16 nt, Pseudomonas putida KT2440
cuguggauuucaauua

SEQ ID NO: 1614257 - RNA, 16 nt, Pseudomonas putida KT2440
cuguggggcaacugcg

SEQ ID NO: 1614258 - RNA, 16 nt, Pseudomonas putida KT2440
cugugggagcgggcuu

SEQ ID NO: 1614259 - RNA, 16 nt, Pseudomonas putida KT2440
cuguggaaaaccgcuc

SEQ ID NO: 1614260 - RNA, 11 nt, Pseudomonas putida KT2440
cugugcugcca

SEQ ID NO: 1614261 - RNA, 20 nt, Pseudomonas putida KT2440
cugugcucgcccgggucccg

SEQ ID NO: 1614262 - RNA, 13 nt, Pseudomonas putida KT2440
cugugcggcuggc

SEQ ID NO: 1614263 - RNA, 13 nt, Pseudomonas putida KT2440
cugugccgggcca

SEQ ID NO: 1614264 - RNA, 18 nt, Pseudomonas putida KT2440
cugugccggccgcuucau

SEQ ID NO: 1614265 - RNA, 16 nt, Pseudomonas putida KT2440
cugugccggccucuuc

SEQ ID NO: 1614266 - RNA, 21 nt, Pseudomonas putida KT2440
cugugccgcuuuggcagcagc

SEQ ID NO: 1614267 - RNA, 19 nt, Pseudomonas putida KT2440
cuggugagcguccaucuug

SEQ ID NO: 1614268 - RNA, 19 nt, Pseudomonas putida KT2440
cuggugaaucagccccagc

SEQ ID NO: 1614269 - RNA, 22 nt, Pseudomonas putida KT2440
cuggugaaucagccccagccgg

SEQ ID NO: 1614270 - RNA, 17 nt, Pseudomonas putida KT2440
cuggucggccuugccgc

SEQ ID NO: 1614271 - RNA, 22 nt, Pseudomonas putida KT2440
cuggucgccgugcagcaccgcu

SEQ ID NO: 1614272 - RNA, 20 nt, Pseudomonas putida KT2440
cuggucgccucgacgcagac

SEQ ID NO: 1614273 - RNA, 20 nt, Pseudomonas putida KT2440
cuggucgccgccacccacca

SEQ ID NO: 1614274 - RNA, 18 nt, Pseudomonas putida KT2440
cugguccacgguucuggc

SEQ ID NO: 1614275 - RNA, 21 nt, Pseudomonas putida KT2440
cugguccacgguucuggcagc

SEQ ID NO: 1614276 - RNA, 13 nt, Pseudomonas putida KT2440
cugguccuccccu

SEQ ID NO: 1614277 - RNA, 19 nt, Pseudomonas putida KT2440
cugguacaugccgccgaug

SEQ ID NO: 1614278 - RNA, 22 nt, Pseudomonas putida KT2440
cugguaaugcucuccagcgaug

SEQ ID NO: 1614279 - RNA, 15 nt, Pseudomonas putida KT2440
cugguaacucaccac

SEQ ID NO: 1614280 - RNA, 18 nt, Pseudomonas putida KT2440
cuggucagucgagucgac

SEQ ID NO: 1614281 - RNA, 18 nt, Pseudomonas putida KT2440
cuggucaucguccaccca

SEQ ID NO: 1614282 - RNA, 18 nt, Pseudomonas putida KT2440
cuggucaucagauggccc

SEQ ID NO: 1614283 - RNA, 16 nt, Pseudomonas putida KT2440
cuggucacccagcgcu

SEQ ID NO: 1614284 - RNA, 13 nt, Pseudomonas putida KT2440
cuggucacccuga

SEQ ID NO: 1614285 - RNA, 21 nt, Pseudomonas putida KT2440
cuggucaaacaaugcacagcg

SEQ ID NO: 1614286 - RNA, 14 nt, Pseudomonas putida KT2440
cuggucacggccac

SEQ ID NO: 1614287 - RNA, 15 nt, Pseudomonas putida KT2440
cuggucacggccacc

SEQ ID NO: 1614288 - RNA, 21 nt, Pseudomonas putida KT2440
cugguaggucacuucagugcu

SEQ ID NO: 1614289 - RNA, 23 nt, Pseudomonas putida KT2440
cugggcgucaucacccgggaaca

SEQ ID NO: 1614290 - RNA, 16 nt, Pseudomonas putida KT2440
cugggcguccuucucc

SEQ ID NO: 1614291 - RNA, 20 nt, Pseudomonas putida KT2440
cugggcgugaaagcaggaug

SEQ ID NO: 1614292 - RNA, 13 nt, Pseudomonas putida KT2440
cugggcgcuuugc

SEQ ID NO: 1614293 - RNA, 20 nt, Pseudomonas putida KT2440
cugggcgaugaucgccuggc

SEQ ID NO: 1614294 - RNA, 21 nt, Pseudomonas putida KT2440
cugggcgaaggugucgaacuu

SEQ ID NO: 1614295 - RNA, 14 nt, Pseudomonas putida KT2440
cugggcgagcaggu

SEQ ID NO: 1614296 - RNA, 14 nt, Pseudomonas putida KT2440
cugggcgagccacu

SEQ ID NO: 1614297 - RNA, 23 nt, Pseudomonas putida KT2440
cugggggucgcccgcaacaccag

SEQ ID NO: 1614298 - RNA, 20 nt, Pseudomonas putida KT2440
cugggcuucaugcugcugca

SEQ ID NO: 1614299 - RNA, 20 nt, Pseudomonas putida KT2440
cuggggccaaguggcuggac

SEQ ID NO: 1614300 - RNA, 21 nt, Pseudomonas putida KT2440
cuggguuacggcggccugcug

SEQ ID NO: 1614301 - RNA, 14 nt, Pseudomonas putida KT2440
cuggguggugucga

SEQ ID NO: 1614302 - RNA, 19 nt, Pseudomonas putida KT2440
cugggugccaucagggcga

SEQ ID NO: 1614303 - RNA, 21 nt, Pseudomonas putida KT2440
cuggguuuuuuuaugggcagc

SEQ ID NO: 1614304 - RNA, 17 nt, Pseudomonas putida KT2440
cugguaaaguucuucuu

SEQ ID NO: 1614305 - RNA, 17 nt, Pseudomonas putida KT2440
cuggguaccgugcugca

SEQ ID NO: 1614306 - RNA, 14 nt, Pseudomonas putida KT2440
cuggggugggguac

SEQ ID NO: 1614307 - RNA, 17 nt, Pseudomonas putida KT2440
cuggguccaggcacacc

SEQ ID NO: 1614308 - RNA, 15 nt, Pseudomonas putida KT2440
cugggucacccaggu

SEQ ID NO: 1614309 - RNA, 18 nt, Pseudomonas putida KT2440
cuguacauccagcuccag

SEQ ID NO: 1614310 - RNA, 15 nt, Pseudomonas putida KT2440
cuguacacagcccaa

SEQ ID NO: 1614311 - RNA, 18 nt, Pseudomonas putida KT2440
cuguacaacgcagccggc

SEQ ID NO: 1614312 - RNA, 14 nt, Pseudomonas putida KT2440
cuguacccgcuggc

SEQ ID NO: 1614313 - RNA, 15 nt, Pseudomonas putida KT2440
cuguacccgcuggcu

SEQ ID NO: 1614314 - RNA, 16 nt, Pseudomonas putida KT2440
cuguacccgcuggcug

SEQ ID NO: 1614315 - RNA, 18 nt, Pseudomonas putida KT2440
cuguacgcuggccaaggc

SEQ ID NO: 1614316 - RNA, 15 nt, Pseudomonas putida KT2440
cuguaaccugguugu

SEQ ID NO: 1614317 - RNA, 14 nt, Pseudomonas putida KT2440
cugguucuccaggu

SEQ ID NO: 1614318 - RNA, 15 nt, Pseudomonas putida KT2440
cugguucuccagguu

SEQ ID NO: 1614319 - RNA, 19 nt, Pseudomonas putida KT2440
cugguucucuucacucaac

SEQ ID NO: 1614320 - RNA, 14 nt, Pseudomonas putida KT2440
cugguuauccaggu

SEQ ID NO: 1614321 - RNA, 23 nt, Pseudomonas putida KT2440
cugguuccugggaagcugcagca

SEQ ID NO: 1614322 - RNA, 22 nt, Pseudomonas putida KT2440
cugguuacccaacagaccaccu

SEQ ID NO: 1614323 - RNA, 18 nt, Pseudomonas putida KT2440
cugguuggugacaugcac

SEQ ID NO: 1614324 - RNA, 16 nt, Pseudomonas putida KT2440
cugguuuggcagcacc

SEQ ID NO: 1614325 - RNA, 17 nt, Pseudomonas putida KT2440
cugguuucagaaccagc

SEQ ID NO: 1614326 - RNA, 17 nt, Pseudomonas putida KT2440
cugguguguugaagucc

SEQ ID NO: 1614327 - RNA, 17 nt, Pseudomonas putida KT2440
cuggugguugaggcggg

SEQ ID NO: 1614328 - RNA, 13 nt, Pseudomonas putida KT2440
cugguggccacgc

SEQ ID NO: 1614329 - RNA, 15 nt, Pseudomonas putida KT2440
cugguggccacgccg

SEQ ID NO: 1614330 - RNA, 17 nt, Pseudomonas putida KT2440
cugguggcguggcugcg

SEQ ID NO: 1614331 - RNA, 17 nt, Pseudomonas putida KT2440
cuucgaucggcgcgccu

SEQ ID NO: 1614332 - RNA, 19 nt, Pseudomonas putida KT2440
cuucgaacagcgaaguguu

SEQ ID NO: 1614333 - RNA, 21 nt, Pseudomonas putida KT2440
cuucgaucuggaucacugcca

SEQ ID NO: 1614334 - RNA, 18 nt, Pseudomonas putida KT2440
cuucgaagugccacgccg

SEQ ID NO: 1614335 - RNA, 14 nt, Pseudomonas putida KT2440
cuucgccacugcca

SEQ ID NO: 1614336 - RNA, 13 nt, Pseudomonas putida KT2440
cuucgcaggcacg

SEQ ID NO: 1614337 - RNA, 15 nt, Pseudomonas putida KT2440
cuucgcaggcacgcc

SEQ ID NO: 1614338 - RNA, 21 nt, Pseudomonas putida KT2440
cuucgcccgaccgccagcccg

SEQ ID NO: 1614339 - RNA, 15 nt, Pseudomonas putida KT2440
cuucgcgggcucgcc

SEQ ID NO: 1614340 - RNA, 23 nt, Pseudomonas putida KT2440
cuucgcggguaaacccgcuccua

SEQ ID NO: 1614341 - RNA, 21 nt, Pseudomonas putida KT2440
cuucgcgugaacuggagguga

SEQ ID NO: 1614342 - RNA, 14 nt, Pseudomonas putida KT2440
cuucgcccugggcg

SEQ ID NO: 1614343 - RNA, 16 nt, Pseudomonas putida KT2440
cuuccucgacccagcc

SEQ ID NO: 1614344 - RNA, 20 nt, Pseudomonas putida KT2440
cuuccucgacccagccaccc

SEQ ID NO: 1614345 - RNA, 18 nt, Pseudomonas putida KT2440
cuuccuccgacagcgcag

SEQ ID NO: 1614346 - RNA, 15 nt, Pseudomonas putida KT2440
cuuccugaagacgcu

SEQ ID NO: 1614347 - RNA, 20 nt, Pseudomonas putida KT2440
cuuccuugaacucagugccu

SEQ ID NO: 1614348 - RNA, 23 nt, Pseudomonas putida KT2440
cuuccuugaacucagugccuggc

SEQ ID NO: 1614349 - RNA, 23 nt, Pseudomonas putida KT2440
cuuccuugaccauuuccgggucc

SEQ ID NO: 1614350 - RNA, 20 nt, Pseudomonas putida KT2440
cuucccccaaucuccagccc

SEQ ID NO: 1614351 - RNA, 12 nt, Pseudomonas putida KT2440
cuuccccagccu

SEQ ID NO: 1614352 - RNA, 16 nt, Pseudomonas putida KT2440
cuuccccgcccaagcg

SEQ ID NO: 1614353 - RNA, 13 nt, Pseudomonas putida KT2440
cuucccucugccu

SEQ ID NO: 1614354 - RNA, 14 nt, Pseudomonas putida KT2440
cuucccucugccug

SEQ ID NO: 1614355 - RNA, 18 nt, Pseudomonas putida KT2440
cuuccagccugcagcacc

SEQ ID NO: 1614356 - RNA, 18 nt, Pseudomonas putida KT2440
cuuccaugcgcgcgcggu

SEQ ID NO: 1614357 - RNA, 17 nt, Pseudomonas putida KT2440
cuuccagcccgccugcu

SEQ ID NO: 1614358 - RNA, 22 nt, Pseudomonas putida KT2440
cuuccagcaggacccggcugga

SEQ ID NO: 1614359 - RNA, 16 nt, Pseudomonas putida KT2440
cuuccaccaccuccau

SEQ ID NO: 1614360 - RNA, 14 nt, Pseudomonas putida KT2440
cuuccacacccagc

SEQ ID NO: 1614361 - RNA, 17 nt, Pseudomonas putida KT2440
cuuccacacccagcgcg

SEQ ID NO: 1614362 - RNA, 19 nt, Pseudomonas putida KT2440
cuucacagauacuggcgcu

SEQ ID NO: 1614363 - RNA, 13 nt, Pseudomonas putida KT2440
cuucaccuugccu

SEQ ID NO: 1614364 - RNA, 15 nt, Pseudomonas putida KT2440
cuucaccuugccuac

SEQ ID NO: 1614365 - RNA, 18 nt, Pseudomonas putida KT2440
cuucaccuugccuaccug

SEQ ID NO: 1614366 - RNA, 21 nt, Pseudomonas putida KT2440
cuucacugcucaucugcgcca

SEQ ID NO: 1614367 - RNA, 13 nt, Pseudomonas putida KT2440
cuucacuguccug

SEQ ID NO: 1614368 - RNA, 19 nt, Pseudomonas putida KT2440
cuucacagcguugcagaaa

SEQ ID NO: 1614369 - RNA, 19 nt, Pseudomonas putida KT2440
cuucacaccggccuuggcc

SEQ ID NO: 1614370 - RNA, 19 nt, Pseudomonas putida KT2440
cuuauucuucuggcuuucu

SEQ ID NO: 1614371 - RNA, 14 nt, Pseudomonas putida KT2440
cuucaacagcuucu

SEQ ID NO: 1614372 - RNA, 23 nt, Pseudomonas putida KT2440
cuucaacagcuucuugcaccgcu

SEQ ID NO: 1614373 - RNA, 15 nt, Pseudomonas putida KT2440
cuucaaggcugcucu

SEQ ID NO: 1614374 - RNA, 17 nt, Pseudomonas putida KT2440
cuucaaggccacgcggu

SEQ ID NO: 1614375 - RNA, 21 nt, Pseudomonas putida KT2440
cuucaaggccgccaccucgcu

SEQ ID NO: 1614376 - RNA, 15 nt, Pseudomonas putida KT2440
cuucaucggcuggca

SEQ ID NO: 1614377 - RNA, 16 nt, Pseudomonas putida KT2440
cuucaucgccaagccg

SEQ ID NO: 1614378 - RNA, 19 nt, Pseudomonas putida KT2440
cuucaucgcugacuuccag

SEQ ID NO: 1614379 - RNA, 22 nt, Pseudomonas putida KT2440
cuucaugcugcugcagcacugc

SEQ ID NO: 1614380 - RNA, 23 nt, Pseudomonas putida KT2440
cuucaugcaauaaccaaucaacg

SEQ ID NO: 1614381 - RNA, 15 nt, Pseudomonas putida KT2440
cuucagcgccccauc

SEQ ID NO: 1614382 - RNA, 23 nt, Pseudomonas putida KT2440
cuucagcgcggcaaccugcucgc

SEQ ID NO: 1614383 - RNA, 15 nt, Pseudomonas putida KT2440
cuucauacagcgccu

SEQ ID NO: 1614384 - RNA, 17 nt, Pseudomonas putida KT2440
cuucauaggcggccacg

SEQ ID NO: 1614385 - RNA, 14 nt, Pseudomonas putida KT2440
cuucauaggcuggc

SEQ ID NO: 1614386 - RNA, 13 nt, Pseudomonas putida KT2440
cuucauaucacaa

SEQ ID NO: 1614387 - RNA, 14 nt, Pseudomonas putida KT2440
cuucagccagggcg

SEQ ID NO: 1614388 - RNA, 17 nt, Pseudomonas putida KT2440
cuucagccagggcgaga

SEQ ID NO: 1614389 - RNA, 20 nt, Pseudomonas putida KT2440
cuucagccuuuuccagcucg

SEQ ID NO: 1614390 - RNA, 24 nt, Pseudomonas putida KT2440
cuucagccaccgcacucugcugcu

SEQ ID NO: 1614391 - RNA, 22 nt, Pseudomonas putida KT2440
cuucacuguggucauccaggcu

SEQ ID NO: 1614392 - RNA, 13 nt, Pseudomonas putida KT2440
cuuaagucuucuc

SEQ ID NO: 1614393 - RNA, 15 nt, Pseudomonas putida KT2440
cuuacguacagucuc

SEQ ID NO: 1614394 - RNA, 18 nt, Pseudomonas putida KT2440
cuuacaacugcuccaggc

SEQ ID NO: 1614395 - RNA, 17 nt, Pseudomonas putida KT2440
cuuacacgcaagccccc

SEQ ID NO: 1614396 - RNA, 23 nt, Pseudomonas putida KT2440
cuuaguauuuuuaccugcuccug

SEQ ID NO: 1614397 - RNA, 14 nt, Pseudomonas putida KT2440
cuguuuggccgcau

SEQ ID NO: 1614398 - RNA, 21 nt, Pseudomonas putida KT2440
aaacuguguaggaucugcgac

SEQ ID NO: 1614399 - RNA, 15 nt, Pseudomonas putida KT2440
cuguuggccuucccu

SEQ ID NO: 1614400 - RNA, 20 nt, Pseudomonas putida KT2440
cuguuugggcugcgcggcag

SEQ ID NO: 1614401 - RNA, 16 nt, Pseudomonas putida KT2440
cuguugcgcaccuugu

SEQ ID NO: 1614402 - RNA, 13 nt, Pseudomonas putida KT2440
cuguugcagcgcc

SEQ ID NO: 1614403 - RNA, 14 nt, Pseudomonas putida KT2440
cuguugcgcugggc

SEQ ID NO: 1614404 - RNA, 17 nt, Pseudomonas putida KT2440
cuguugcgucaacucau

SEQ ID NO: 1614405 - RNA, 22 nt, Pseudomonas putida KT2440
cuguugcgucaacucaucacuc

SEQ ID NO: 1614406 - RNA, 22 nt, Pseudomonas putida KT2440
cuguugcugcagguucugaauc

SEQ ID NO: 1614407 - RNA, 14 nt, Pseudomonas putida KT2440
cuguuggcacgugc

SEQ ID NO: 1614408 - RNA, 14 nt, Pseudomonas putida KT2440
cuguuggcagccac

SEQ ID NO: 1614409 - RNA, 15 nt, Pseudomonas putida KT2440
cuguguccaacaccc

SEQ ID NO: 1614410 - RNA, 19 nt, Pseudomonas putida KT2440
cuguguccacccccgcucc

SEQ ID NO: 1614411 - RNA, 23 nt, Pseudomonas putida KT2440
cuguguccacccccgcuccuacg

SEQ ID NO: 1614412 - RNA, 17 nt, Pseudomonas putida KT2440
cuguguucgcugcguga

SEQ ID NO: 1614413 - RNA, 22 nt, Pseudomonas putida KT2440
cuguucguguuccccgaccaaa

SEQ ID NO: 1614414 - RNA, 15 nt, Pseudomonas putida KT2440
cuguuccacagcagu

SEQ ID NO: 1614415 - RNA, 15 nt, Pseudomonas putida KT2440
cuguucugcccggcu

SEQ ID NO: 1614416 - RNA, 23 nt, Pseudomonas putida KT2440
cuguugaucagguuacuggccaa

SEQ ID NO: 1614417 - RNA, 21 nt, Pseudomonas putida KT2440
cuguugagcagcagcccuucg

SEQ ID NO: 1614418 - RNA, 12 nt, Pseudomonas putida KT2440
cuguuaaucauu

SEQ ID NO: 1614419 - RNA, 15 nt, Pseudomonas putida KT2440
cuguuccagcccggc

SEQ ID NO: 1614420 - RNA, 16 nt, Pseudomonas putida KT2440
cuggcgcgcugugcuc

SEQ ID NO: 1614421 - RNA, 21 nt, Pseudomonas putida KT2440
cuggcgccugcgccagugccu

SEQ ID NO: 1614422 - RNA, 15 nt, Pseudomonas putida KT2440
cuggcgccugcggca

SEQ ID NO: 1614423 - RNA, 18 nt, Pseudomonas putida KT2440
cuggcgcgaaaagcuguc

SEQ ID NO: 1614424 - RNA, 19 nt, Pseudomonas putida KT2440
cuggcgcaguucguccagg

SEQ ID NO: 1614425 - RNA, 20 nt, Pseudomonas putida KT2440
cuggcgcaggccgcuggccg

SEQ ID NO: 1614426 - RNA, 17 nt, Pseudomonas putida KT2440
cuggcgcaucuuccagc

SEQ ID NO: 1614427 - RNA, 13 nt, Pseudomonas putida KT2440
cuggcgcccggca

SEQ ID NO: 1614428 - RNA, 18 nt, Pseudomonas putida KT2440
cuggcgaugaagacgcuc

SEQ ID NO: 1614429 - RNA, 17 nt, Pseudomonas putida KT2440
cuggcgaucgaacaacu

SEQ ID NO: 1614430 - RNA, 16 nt, Pseudomonas putida KT2440
cuggcgaucggcuggu

SEQ ID NO: 1614431 - RNA, 12 nt, Pseudomonas putida KT2440
cuggcgcagcag

SEQ ID NO: 1614432 - RNA, 19 nt, Pseudomonas putida KT2440
cuggcggaucugacggcgc

SEQ ID NO: 1614433 - RNA, 17 nt, Pseudomonas putida KT2440
cuggcggccaaugcugc

SEQ ID NO: 1614434 - RNA, 19 nt, Pseudomonas putida KT2440
cuggcggccaaugcugccu

SEQ ID NO: 1614435 - RNA, 15 nt, Pseudomonas putida KT2440
cuggcggcccgccgg

SEQ ID NO: 1614436 - RNA, 17 nt, Pseudomonas putida KT2440
cuggcgcuugaucagcc

SEQ ID NO: 1614437 - RNA, 19 nt, Pseudomonas putida KT2440
cuggcgcuugaucagccug

SEQ ID NO: 1614438 - RNA, 21 nt, Pseudomonas putida KT2440
cuggcaggguucgcuguccug

SEQ ID NO: 1614439 - RNA, 16 nt, Pseudomonas putida KT2440
cuggcagcgggcugcc

SEQ ID NO: 1614440 - RNA, 14 nt, Pseudomonas putida KT2440
cuggcagcuccagc

SEQ ID NO: 1614441 - RNA, 15 nt, Pseudomonas putida KT2440
cuggcagcuccagcc

SEQ ID NO: 1614442 - RNA, 14 nt, Pseudomonas putida KT2440
cuggcaggccuugu

SEQ ID NO: 1614443 - RNA, 17 nt, Pseudomonas putida KT2440
cuggcagcuugcccugc

SEQ ID NO: 1614444 - RNA, 15 nt, Pseudomonas putida KT2440
cuggcagcuuggcca

SEQ ID NO: 1614445 - RNA, 21 nt, Pseudomonas putida KT2440
cuggcacgccuucagcagccg

SEQ ID NO: 1614446 - RNA, 17 nt, Pseudomonas putida KT2440
cuggcacuccacuugau

SEQ ID NO: 1614447 - RNA, 15 nt, Pseudomonas putida KT2440
cuggcacugcccaag

SEQ ID NO: 1614448 - RNA, 17 nt, Pseudomonas putida KT2440
cuggcagcacgaucagc

SEQ ID NO: 1614449 - RNA, 23 nt, Pseudomonas putida KT2440
cuggcagcacgaucagcgcggca

SEQ ID NO: 1614450 - RNA, 15 nt, Pseudomonas putida KT2440
cuggccgaugcccac

SEQ ID NO: 1614451 - RNA, 18 nt, Pseudomonas putida KT2440
cuggccgaugcccaccuu

SEQ ID NO: 1614452 - RNA, 22 nt, Pseudomonas putida KT2440
cuggccgaugcccaccuuggcg

SEQ ID NO: 1614453 - RNA, 14 nt, Pseudomonas putida KT2440
cuggccgcccgccu

SEQ ID NO: 1614454 - RNA, 15 nt, Pseudomonas putida KT2440
cuggccgcccgccuc

SEQ ID NO: 1614455 - RNA, 18 nt, Pseudomonas putida KT2440
cuggccgcaaccugggca

SEQ ID NO: 1614456 - RNA, 19 nt, Pseudomonas putida KT2440
cuggccgcugaaccucacc

SEQ ID NO: 1614457 - RNA, 15 nt, Pseudomonas putida KT2440
cuggccgccucccag

SEQ ID NO: 1614458 - RNA, 16 nt, Pseudomonas putida KT2440
cuggccgcgcaggaag

SEQ ID NO: 1614459 - RNA, 17 nt, Pseudomonas putida KT2440
cuggccgcgcaggaaga

SEQ ID NO: 1614460 - RNA, 17 nt, Pseudomonas putida KT2440
cuggccguccagcugag

SEQ ID NO: 1614461 - RNA, 22 nt, Pseudomonas putida KT2440
cuggccucuucucgggcaagcc

SEQ ID NO: 1614462 - RNA, 23 nt, Pseudomonas putida KT2440
cuggccucacaucgcgcagggcg

SEQ ID NO: 1614463 - RNA, 19 nt, Pseudomonas putida KT2440
cuggccggcuuggcaccuc

SEQ ID NO: 1614464 - RNA, 20 nt, Pseudomonas putida KT2440
cuggccgguguggccaaggc

SEQ ID NO: 1614465 - RNA, 16 nt, Pseudomonas putida KT2440
cuggccuuccuugccc

SEQ ID NO: 1614466 - RNA, 17 nt, Pseudomonas putida KT2440
cuggccugcaugcucau

SEQ ID NO: 1614467 - RNA, 13 nt, Pseudomonas putida KT2440
cuggccugcagcc

SEQ ID NO: 1614468 - RNA, 16 nt, Pseudomonas putida KT2440
cuggccuugcaggaag

SEQ ID NO: 1614469 - RNA, 21 nt, Pseudomonas putida KT2440
cuggccuuggacaccaggcug

SEQ ID NO: 1614470 - RNA, 22 nt, Pseudomonas putida KT2440
cuggccuuggacaccaggcugg

SEQ ID NO: 1614471 - RNA, 16 nt, Pseudomonas putida KT2440
cugggccgguccuuuc

SEQ ID NO: 1614472 - RNA, 15 nt, Pseudomonas putida KT2440
cugggccccaggcgg

SEQ ID NO: 1614473 - RNA, 17 nt, Pseudomonas putida KT2440
cugggcaccaaacacgc

SEQ ID NO: 1614474 - RNA, 19 nt, Pseudomonas putida KT2440
cugggcaugagccuggccg

SEQ ID NO: 1614475 - RNA, 12 nt, Pseudomonas putida KT2440
cuggcugggcuu

SEQ ID NO: 1614476 - RNA, 20 nt, Pseudomonas putida KT2440
cuggcuguaccggccucuuc

SEQ ID NO: 1614477 - RNA, 21 nt, Pseudomonas putida KT2440
cuggcuguaccggccucuucg

SEQ ID NO: 1614478 - RNA, 16 nt, Pseudomonas putida KT2440
cuggcuggucuccagc

SEQ ID NO: 1614479 - RNA, 22 nt, Pseudomonas putida KT2440
cuggcuggugacaacgcccgcc

SEQ ID NO: 1614480 - RNA, 14 nt, Pseudomonas putida KT2440
cuggcuuggcugcg

SEQ ID NO: 1614481 - RNA, 19 nt, Pseudomonas putida KT2440
cuggcuuacaucaugccgc

SEQ ID NO: 1614482 - RNA, 15 nt, Pseudomonas putida KT2440
cuggcuuuccagguc

SEQ ID NO: 1614483 - RNA, 15 nt, Pseudomonas putida KT2440
cuggcuuucccccag

SEQ ID NO: 1614484 - RNA, 15 nt, Pseudomonas putida KT2440
cuggcuuuggagccu

SEQ ID NO: 1614485 - RNA, 17 nt, Pseudomonas putida KT2440
cuggcuacagaucagcc

SEQ ID NO: 1614486 - RNA, 20 nt, Pseudomonas putida KT2440
cuggcuacagaucagccacg

SEQ ID NO: 1614487 - RNA, 22 nt, Pseudomonas putida KT2440
cuggcuacccgcucggccuugu

SEQ ID NO: 1614488 - RNA, 19 nt, Pseudomonas putida KT2440
cuggcugaucucacggcca

SEQ ID NO: 1614489 - RNA, 20 nt, Pseudomonas putida KT2440
cuggcugaccagugucugca

SEQ ID NO: 1614490 - RNA, 14 nt, Pseudomonas putida KT2440
cuggcugcuguggu

SEQ ID NO: 1614491 - RNA, 12 nt, Pseudomonas putida KT2440
cuggcugccgcu

SEQ ID NO: 1614492 - RNA, 20 nt, Pseudomonas putida KT2440
cuggcugaucagcauguccc

SEQ ID NO: 1614493 - RNA, 19 nt, Pseudomonas putida KT2440
cuggcugccuucgcucagg

SEQ ID NO: 1614494 - RNA, 14 nt, Pseudomonas putida KT2440
cuggcucggcuggg

SEQ ID NO: 1614495 - RNA, 15 nt, Pseudomonas putida KT2440
cuggcucggcugggc

SEQ ID NO: 1614496 - RNA, 17 nt, Pseudomonas putida KT2440
cuggcucggcugggcuu

SEQ ID NO: 1614497 - RNA, 15 nt, Pseudomonas putida KT2440
cuggcucgcugcccc

SEQ ID NO: 1614498 - RNA, 14 nt, Pseudomonas putida KT2440
aaacuccacugugc

SEQ ID NO: 1614499 - RNA, 13 nt, Pseudomonas putida KT2440
cuggcggcugagc

SEQ ID NO: 1614500 - RNA, 16 nt, Pseudomonas putida KT2440
aaacucggucaggcag

SEQ ID NO: 1614501 - RNA, 14 nt, Pseudomonas putida KT2440
aaacuccuugaaau

SEQ ID NO: 1614502 - RNA, 19 nt, Pseudomonas putida KT2440
cuggcgguugaccagggcg

SEQ ID NO: 1614503 - RNA, 23 nt, Pseudomonas putida KT2440
cuggagccguccaggaacgcugc

SEQ ID NO: 1614504 - RNA, 19 nt, Pseudomonas putida KT2440
cuggagcuauuuggcucca

SEQ ID NO: 1614505 - RNA, 19 nt, Pseudomonas putida KT2440
cuggaauuauuggccagca

SEQ ID NO: 1614506 - RNA, 15 nt, Pseudomonas putida KT2440
cuggauggugcgcuc

SEQ ID NO: 1614507 - RNA, 21 nt, Pseudomonas putida KT2440
cuggauguugugcgaaacccc

SEQ ID NO: 1614508 - RNA, 18 nt, Pseudomonas putida KT2440
cuggcaccggcugcgccg

SEQ ID NO: 1614509 - RNA, 17 nt, Pseudomonas putida KT2440
cuggcaccaccagggcg

SEQ ID NO: 1614510 - RNA, 21 nt, Pseudomonas putida KT2440
cuggcacaggcuacgcagcac

SEQ ID NO: 1614511 - RNA, 14 nt, Pseudomonas putida KT2440
cuggaugaugguau

SEQ ID NO: 1614512 - RNA, 17 nt, Pseudomonas putida KT2440
cuggaugauccagccca

SEQ ID NO: 1614513 - RNA, 15 nt, Pseudomonas putida KT2440
cuggauaagaucacu

SEQ ID NO: 1614514 - RNA, 19 nt, Pseudomonas putida KT2440
cugcuuguccauccccucc

SEQ ID NO: 1614515 - RNA, 14 nt, Pseudomonas putida KT2440
cuggaagagcagga

SEQ ID NO: 1614516 - RNA, 16 nt, Pseudomonas putida KT2440
cuggaagagcaggaag

SEQ ID NO: 1614517 - RNA, 17 nt, Pseudomonas putida KT2440
cugcuugaucaggcccg

SEQ ID NO: 1614518 - RNA, 20 nt, Pseudomonas putida KT2440
cugcuugccugucaguuccu

SEQ ID NO: 1614519 - RNA, 15 nt, Pseudomonas putida KT2440
cugcuucugccguuc

SEQ ID NO: 1614520 - RNA, 15 nt, Pseudomonas putida KT2440
cugcuugaccauggc

SEQ ID NO: 1614521 - RNA, 22 nt, Pseudomonas putida KT2440
cugcugguucaucgacuggaug

SEQ ID NO: 1614522 - RNA, 21 nt, Pseudomonas putida KT2440
cugcugggcaagggccugcag

SEQ ID NO: 1614523 - RNA, 15 nt, Pseudomonas putida KT2440
cugcugguccuugca

SEQ ID NO: 1614524 - RNA, 18 nt, Pseudomonas putida KT2440
cugcugggucagcacuug

SEQ ID NO: 1614525 - RNA, 22 nt, Pseudomonas putida KT2440
cugcugggcgaugaucgccugg

SEQ ID NO: 1614526 - RNA, 19 nt, Pseudomonas putida KT2440
cugcugacaccgcugccgg

SEQ ID NO: 1614527 - RNA, 14 nt, Pseudomonas putida KT2440
cugcuggccuugca

SEQ ID NO: 1614528 - RNA, 22 nt, Pseudomonas putida KT2440
cugcuggcggcugagccggcug

SEQ ID NO: 1614529 - RNA, 21 nt, Pseudomonas putida KT2440
cugcuucgcgggcacgcccgc

SEQ ID NO: 1614530 - RNA, 18 nt, Pseudomonas putida KT2440
cugcugucggucagggca

SEQ ID NO: 1614531 - RNA, 16 nt, Pseudomonas putida KT2440
cugcugacgcagggua

SEQ ID NO: 1614532 - RNA, 13 nt, Pseudomonas putida KT2440
cugcucgcccgcc

SEQ ID NO: 1614533 - RNA, 16 nt, Pseudomonas putida KT2440
cugcucgcucaggcuc

SEQ ID NO: 1614534 - RNA, 23 nt, Pseudomonas putida KT2440
cugcucgcugccacgcaugccua

SEQ ID NO: 1614535 - RNA, 14 nt, Pseudomonas putida KT2440
cugcucgcuggcuu

SEQ ID NO: 1614536 - RNA, 19 nt, Pseudomonas putida KT2440
cugcucgcuggcuuguucg

SEQ ID NO: 1614537 - RNA, 22 nt, Pseudomonas putida KT2440
cugcucuggcccgaacagcacg

SEQ ID NO: 1614538 - RNA, 15 nt, Pseudomonas putida KT2440
cugcucugcaaugcc

SEQ ID NO: 1614539 - RNA, 21 nt, Pseudomonas putida KT2440
cugcucugcaaugccgccaac

SEQ ID NO: 1614540 - RNA, 17 nt, Pseudomonas putida KT2440
cugcgugccugcugcuc

SEQ ID NO: 1614541 - RNA, 15 nt, Pseudomonas putida KT2440
cugcgugccuugccu

SEQ ID NO: 1614542 - RNA, 17 nt, Pseudomonas putida KT2440
cugcgugauggcagcua

SEQ ID NO: 1614543 - RNA, 15 nt, Pseudomonas putida KT2440
cugcgugaccgcccc

SEQ ID NO: 1614544 - RNA, 22 nt, Pseudomonas putida KT2440
cugcguggcggugaugcgcacc

SEQ ID NO: 1614545 - RNA, 14 nt, Pseudomonas putida KT2440
cugcuacgccgccg

SEQ ID NO: 1614546 - RNA, 12 nt, Pseudomonas putida KT2440
cugcuccacccg

SEQ ID NO: 1614547 - RNA, 22 nt, Pseudomonas putida KT2440
cugcuccacccgugcagggguc

SEQ ID NO: 1614548 - RNA, 12 nt, Pseudomonas putida KT2440
cugcuccaggca

SEQ ID NO: 1614549 - RNA, 17 nt, Pseudomonas putida KT2440
cugcuccccaaccaccu

SEQ ID NO: 1614550 - RNA, 18 nt, Pseudomonas putida KT2440
cugcucccccaggcugcc

SEQ ID NO: 1614551 - RNA, 14 nt, Pseudomonas putida KT2440
cugcuccaugaucu

SEQ ID NO: 1614552 - RNA, 20 nt, Pseudomonas putida KT2440
cugcuccaugaucucgcgcu

SEQ ID NO: 1614553 - RNA, 17 nt, Pseudomonas putida KT2440
cugcucauccuuuuuug

SEQ ID NO: 1614554 - RNA, 15 nt, Pseudomonas putida KT2440
cugcucauacugcug

SEQ ID NO: 1614555 - RNA, 14 nt, Pseudomonas putida KT2440
cugcggucaucacc

SEQ ID NO: 1614556 - RNA, 14 nt, Pseudomonas putida KT2440
cugcggucagccug

SEQ ID NO: 1614557 - RNA, 14 nt, Pseudomonas putida KT2440
cugcggggugcucu

SEQ ID NO: 1614558 - RNA, 20 nt, Pseudomonas putida KT2440
cugcggggugcucugccgca

SEQ ID NO: 1614559 - RNA, 13 nt, Pseudomonas putida KT2440
cugcggccccugg

SEQ ID NO: 1614560 - RNA, 15 nt, Pseudomonas putida KT2440
cugcggcagcacgau

SEQ ID NO: 1614561 - RNA, 22 nt, Pseudomonas putida KT2440
cugcggcagguaggcccagccc

SEQ ID NO: 1614562 - RNA, 19 nt, Pseudomonas putida KT2440
cugcggccaggccggcgca

SEQ ID NO: 1614563 - RNA, 14 nt, Pseudomonas putida KT2440
cugcgaacggacaa

SEQ ID NO: 1614564 - RNA, 23 nt, Pseudomonas putida KT2440
cugcgaagaggccccgacagcaa

SEQ ID NO: 1614565 - RNA, 14 nt, Pseudomonas putida KT2440
cugcgaaaggcgcu

SEQ ID NO: 1614566 - RNA, 18 nt, Pseudomonas putida KT2440
cugcgacugaauacagcc

SEQ ID NO: 1614567 - RNA, 20 nt, Pseudomonas putida KT2440
cugcgacugcagguaguuuu

SEQ ID NO: 1614568 - RNA, 17 nt, Pseudomonas putida KT2440
cugcgcuugagccuugu

SEQ ID NO: 1614569 - RNA, 18 nt, Pseudomonas putida KT2440
cugcggauacagcgccca

SEQ ID NO: 1614570 - RNA, 23 nt, Pseudomonas putida KT2440
cugcggcaccgucgccugcaacc

SEQ ID NO: 1614571 - RNA, 16 nt, Pseudomonas putida KT2440
cugccaggcuggcgcu

SEQ ID NO: 1614572 - RNA, 21 nt, Pseudomonas putida KT2440
cugccaggcaaaguugagcgc

SEQ ID NO: 1614573 - RNA, 23 nt, Pseudomonas putida KT2440
cugccaggcaaaguugagcgccg

SEQ ID NO: 1614574 - RNA, 15 nt, Pseudomonas putida KT2440
cugccaggcaccaca

SEQ ID NO: 1614575 - RNA, 14 nt, Pseudomonas putida KT2440
cugccaggccucaa

SEQ ID NO: 1614576 - RNA, 13 nt, Pseudomonas putida KT2440
cugccagcugcgc

SEQ ID NO: 1614577 - RNA, 20 nt, Pseudomonas putida KT2440
cugccagcugcgcugccugc

SEQ ID NO: 1614578 - RNA, 21 nt, Pseudomonas putida KT2440
cugccagcgccucaccgaccc

SEQ ID NO: 1614579 - RNA, 14 nt, Pseudomonas putida KT2440
cugccagcccggcg

SEQ ID NO: 1614580 - RNA, 12 nt, Pseudomonas putida KT2440
cugccacgcccg

SEQ ID NO: 1614581 - RNA, 15 nt, Pseudomonas putida KT2440
cugccacgcccgcug

SEQ ID NO: 1614582 - RNA, 20 nt, Pseudomonas putida KT2440
cugccaccaguucauggcuc

SEQ ID NO: 1614583 - RNA, 23 nt, Pseudomonas putida KT2440
cugccacccauucccacaucaaa

SEQ ID NO: 1614584 - RNA, 14 nt, Pseudomonas putida KT2440
cugccaccgugagc

SEQ ID NO: 1614585 - RNA, 22 nt, Pseudomonas putida KT2440
cugccaccgugagcauggcaaa

SEQ ID NO: 1614586 - RNA, 19 nt, Pseudomonas putida KT2440
cugcaucacuugcagcucg

SEQ ID NO: 1614587 - RNA, 22 nt, Pseudomonas putida KT2440
cugcccaccgaucacggggcga

SEQ ID NO: 1614588 - RNA, 16 nt, Pseudomonas putida KT2440
cugcccacccaaccgc

SEQ ID NO: 1614589 - RNA, 16 nt, Pseudomonas putida KT2440
cugcccaagccaucca

SEQ ID NO: 1614590 - RNA, 21 nt, Pseudomonas putida KT2440
cugcccaaguacaccggcagc

SEQ ID NO: 1614591 - RNA, 14 nt, Pseudomonas putida KT2440
cugcccacauagcg

SEQ ID NO: 1614592 - RNA, 16 nt, Pseudomonas putida KT2440
cugccauuucuucagc

SEQ ID NO: 1614593 - RNA, 13 nt, Pseudomonas putida KT2440
cugccccuggccc

SEQ ID NO: 1614594 - RNA, 21 nt, Pseudomonas putida KT2440
cugcccgggaacggcugccgu

SEQ ID NO: 1614595 - RNA, 16 nt, Pseudomonas putida KT2440
cugcccgggcaaagca

SEQ ID NO: 1614596 - RNA, 22 nt, Pseudomonas putida KT2440
cugcccguccggcaugcgccga

SEQ ID NO: 1614597 - RNA, 17 nt, Pseudomonas putida KT2440
cugcccucggccggggc

SEQ ID NO: 1614598 - RNA, 18 nt, Pseudomonas putida KT2440
cugcccucggccggggcc

SEQ ID NO: 1614599 - RNA, 15 nt, Pseudomonas putida KT2440
cugcccucgggcagc

SEQ ID NO: 1614600 - RNA, 22 nt, Pseudomonas putida KT2440
cugcccguugaggguggcaaug

SEQ ID NO: 1614601 - RNA, 20 nt, Pseudomonas putida KT2440
cugcccggcguucaggcgcg

SEQ ID NO: 1614602 - RNA, 14 nt, Pseudomonas putida KT2440
cugccgagaggauc

SEQ ID NO: 1614603 - RNA, 23 nt, Pseudomonas putida KT2440
cugccgacaaacguaccagccgc

SEQ ID NO: 1614604 - RNA, 13 nt, Pseudomonas putida KT2440
cugcccuuccugg

SEQ ID NO: 1614605 - RNA, 15 nt, Pseudomonas putida KT2440
cugccgcgccgccgc

SEQ ID NO: 1614606 - RNA, 13 nt, Pseudomonas putida KT2440
cugccgccuucuc

SEQ ID NO: 1614607 - RNA, 15 nt, Pseudomonas putida KT2440
cugccgccuucucca

SEQ ID NO: 1614608 - RNA, 16 nt, Pseudomonas putida KT2440
cugccgccuucuccag

SEQ ID NO: 1614609 - RNA, 20 nt, Pseudomonas putida KT2440
cugccgccuucuccagcucg

SEQ ID NO: 1614610 - RNA, 15 nt, Pseudomonas putida KT2440
cugccgaggccaugu

SEQ ID NO: 1614611 - RNA, 17 nt, Pseudomonas putida KT2440
cugccgaggccaugugc

SEQ ID NO: 1614612 - RNA, 15 nt, Pseudomonas putida KT2440
cugccgaucagcacg

SEQ ID NO: 1614613 - RNA, 21 nt, Pseudomonas putida KT2440
cugccgaucuucgcccugggc

SEQ ID NO: 1614614 - RNA, 15 nt, Pseudomonas putida KT2440
cugccgcccucuugc

SEQ ID NO: 1614615 - RNA, 22 nt, Pseudomonas putida KT2440
cugccgccgguguaccauccag

SEQ ID NO: 1614616 - RNA, 16 nt, Pseudomonas putida KT2440
cugccuuuuccugcug

SEQ ID NO: 1614617 - RNA, 21 nt, Pseudomonas putida KT2440
cugccuugcccugcagcuucc

SEQ ID NO: 1614618 - RNA, 20 nt, Pseudomonas putida KT2440
cugccuuggcauuggugcca

SEQ ID NO: 1614619 - RNA, 12 nt, Pseudomonas putida KT2440
cugccuugcagc

SEQ ID NO: 1614620 - RNA, 23 nt, Pseudomonas putida KT2440
cugccuugcagccccugcaauuu

SEQ ID NO: 1614621 - RNA, 19 nt, Pseudomonas putida KT2440
cugccuugcccagcuccag

SEQ ID NO: 1614622 - RNA, 23 nt, Pseudomonas putida KT2440
cugccuugcccagcuccagcacc

SEQ ID NO: 1614623 - RNA, 18 nt, Pseudomonas putida KT2440
cugccggcguggcgagcu

SEQ ID NO: 1614624 - RNA, 15 nt, Pseudomonas putida KT2440
cugccggaucuggca

SEQ ID NO: 1614625 - RNA, 18 nt, Pseudomonas putida KT2440
cugccgcugaccuggguc

SEQ ID NO: 1614626 - RNA, 16 nt, Pseudomonas putida KT2440
cugccggaccugccgc

SEQ ID NO: 1614627 - RNA, 21 nt, Pseudomonas putida KT2440
cugcaggcgcggugccggcag

SEQ ID NO: 1614628 - RNA, 22 nt, Pseudomonas putida KT2440
cugcaggcuggcaaucagcucu

SEQ ID NO: 1614629 - RNA, 14 nt, Pseudomonas putida KT2440
cugcaggcucugaa

SEQ ID NO: 1614630 - RNA, 17 nt, Pseudomonas putida KT2440
cugcagggcccagccac

SEQ ID NO: 1614631 - RNA, 19 nt, Pseudomonas putida KT2440
cugcagggcccagccaccg

SEQ ID NO: 1614632 - RNA, 15 nt, Pseudomonas putida KT2440
cugcagggcacgcca

SEQ ID NO: 1614633 - RNA, 22 nt, Pseudomonas putida KT2440
cugcagggcgagcacacccggc

SEQ ID NO: 1614634 - RNA, 12 nt, Pseudomonas putida KT2440
cugcagggccug

SEQ ID NO: 1614635 - RNA, 13 nt, Pseudomonas putida KT2440
cugcaggcagcau

SEQ ID NO: 1614636 - RNA, 22 nt, Pseudomonas putida KT2440
cugcaggaacuccugcugcagc

SEQ ID NO: 1614637 - RNA, 15 nt, Pseudomonas putida KT2440
cugcaggagcggguu

SEQ ID NO: 1614638 - RNA, 16 nt, Pseudomonas putida KT2440
cugcagcuucccggcc

SEQ ID NO: 1614639 - RNA, 17 nt, Pseudomonas putida KT2440
cugcagcuucccggccu

SEQ ID NO: 1614640 - RNA, 13 nt, Pseudomonas putida KT2440
cugcagcucagcc

SEQ ID NO: 1614641 - RNA, 22 nt, Pseudomonas putida KT2440
cugcagcggcaagguagccugc

SEQ ID NO: 1614642 - RNA, 19 nt, Pseudomonas putida KT2440
cugcagccugacgcgccgc

SEQ ID NO: 1614643 - RNA, 18 nt, Pseudomonas putida KT2440
cugcagccgcaccugccc

SEQ ID NO: 1614644 - RNA, 22 nt, Pseudomonas putida KT2440
cugcagccgcaccugcccgccc

SEQ ID NO: 1614645 - RNA, 16 nt, Pseudomonas putida KT2440
cugcagccauucaucc

SEQ ID NO: 1614646 - RNA, 13 nt, Pseudomonas putida KT2440
cugcagcaggcug

SEQ ID NO: 1614647 - RNA, 14 nt, Pseudomonas putida KT2440
cugcagcaggccgc

SEQ ID NO: 1614648 - RNA, 16 nt, Pseudomonas putida KT2440
cugcagcacugccugc

SEQ ID NO: 1614649 - RNA, 17 nt, Pseudomonas putida KT2440
cugcagagacaucucca

SEQ ID NO: 1614650 - RNA, 15 nt, Pseudomonas putida KT2440
cugcagcagcgcgcc

SEQ ID NO: 1614651 - RNA, 15 nt, Pseudomonas putida KT2440
cugcagaucaccagc

SEQ ID NO: 1614652 - RNA, 18 nt, Pseudomonas putida KT2440
cugcagaucaccagcucg

SEQ ID NO: 1614653 - RNA, 20 nt, Pseudomonas putida KT2440
cugcagaucaccagcucgcc

SEQ ID NO: 1614654 - RNA, 17 nt, Pseudomonas putida KT2440
cugcagagcucagcgug

SEQ ID NO: 1614655 - RNA, 15 nt, Pseudomonas putida KT2440
cugcagaacauggcc

SEQ ID NO: 1614656 - RNA, 18 nt, Pseudomonas putida KT2440
cugcacgucgcugucuuc

SEQ ID NO: 1614657 - RNA, 16 nt, Pseudomonas putida KT2440
cugcacuggccucuuc

SEQ ID NO: 1614658 - RNA, 13 nt, Pseudomonas putida KT2440
cugcacugcaaca

SEQ ID NO: 1614659 - RNA, 23 nt, Pseudomonas putida KT2440
cugcacugcaacaccggucaggu

SEQ ID NO: 1614660 - RNA, 16 nt, Pseudomonas putida KT2440
cugcacugccagcgcc

SEQ ID NO: 1614661 - RNA, 17 nt, Pseudomonas putida KT2440
cugcacugccagcgccu

SEQ ID NO: 1614662 - RNA, 16 nt, Pseudomonas putida KT2440
cugcacuuccacaccc

SEQ ID NO: 1614663 - RNA, 17 nt, Pseudomonas putida KT2440
cugcacaucgcuucugc

SEQ ID NO: 1614664 - RNA, 13 nt, Pseudomonas putida KT2440
cugcacaggccag

SEQ ID NO: 1614665 - RNA, 14 nt, Pseudomonas putida KT2440
cugcacaggccagc

SEQ ID NO: 1614666 - RNA, 16 nt, Pseudomonas putida KT2440
cugcacaggccagccc

SEQ ID NO: 1614667 - RNA, 17 nt, Pseudomonas putida KT2440
cugcacaggccagcccc

SEQ ID NO: 1614668 - RNA, 18 nt, Pseudomonas putida KT2440
cugcacaggccagcccca

SEQ ID NO: 1614669 - RNA, 19 nt, Pseudomonas putida KT2440
cugcacaggccagccccag

SEQ ID NO: 1614670 - RNA, 22 nt, Pseudomonas putida KT2440
cugcaccaccugcuccuggucc

SEQ ID NO: 1614671 - RNA, 13 nt, Pseudomonas putida KT2440
cugcaccaguucc

SEQ ID NO: 1614672 - RNA, 15 nt, Pseudomonas putida KT2440
cugcaccaguuccug

SEQ ID NO: 1614673 - RNA, 22 nt, Pseudomonas putida KT2440
cugcaccaguuccuggcgcucc

SEQ ID NO: 1614674 - RNA, 12 nt, Pseudomonas putida KT2440
cugcaacagcuc

SEQ ID NO: 1614675 - RNA, 17 nt, Pseudomonas putida KT2440
cugcaacagcucaucca

SEQ ID NO: 1614676 - RNA, 21 nt, Pseudomonas putida KT2440
cugcaacagcucauccaggcu

SEQ ID NO: 1614677 - RNA, 13 nt, Pseudomonas putida KT2440
cugcaacagcucc

SEQ ID NO: 1614678 - RNA, 22 nt, Pseudomonas putida KT2440
cugcaacacgucauacagcccg

SEQ ID NO: 1614679 - RNA, 23 nt, Pseudomonas putida KT2440
cugcaacaccggucagguccgcc

SEQ ID NO: 1614680 - RNA, 13 nt, Pseudomonas putida KT2440
cugcaacaccucc

SEQ ID NO: 1614681 - RNA, 17 nt, Pseudomonas putida KT2440
cugcaccgcagccccag

SEQ ID NO: 1614682 - RNA, 14 nt, Pseudomonas putida KT2440
cugcaccgccuugu

SEQ ID NO: 1614683 - RNA, 19 nt, Pseudomonas putida KT2440
cugcaccgaagcaccacug

SEQ ID NO: 1614684 - RNA, 16 nt, Pseudomonas putida KT2440
cugcaccgaaggccgc

SEQ ID NO: 1614685 - RNA, 18 nt, Pseudomonas putida KT2440
cugcaccgaaggccgccg

SEQ ID NO: 1614686 - RNA, 20 nt, Pseudomonas putida KT2440
cugcaccgaaggccgccggc

SEQ ID NO: 1614687 - RNA, 21 nt, Pseudomonas putida KT2440
cugcacccaggcucucagccc

SEQ ID NO: 1614688 - RNA, 22 nt, Pseudomonas putida KT2440
cugcacccagcguauagccacc

SEQ ID NO: 1614689 - RNA, 11 nt, Pseudomonas putida KT2440
cugcaccauga

SEQ ID NO: 1614690 - RNA, 16 nt, Pseudomonas putida KT2440
cugcaccaugaauucc

SEQ ID NO: 1614691 - RNA, 14 nt, Pseudomonas putida KT2440
cugcaccucccgcc

SEQ ID NO: 1614692 - RNA, 13 nt, Pseudomonas putida KT2440
cugcaccuugccc

SEQ ID NO: 1614693 - RNA, 22 nt, Pseudomonas putida KT2440
cugcaccugacgagcgaaauag

SEQ ID NO: 1614694 - RNA, 23 nt, Pseudomonas putida KT2440
cugcacgucgcgcagggccuugu

SEQ ID NO: 1614695 - RNA, 22 nt, Pseudomonas putida KT2440
cugcacgcuucgauccgcgccc

SEQ ID NO: 1614696 - RNA, 16 nt, Pseudomonas putida KT2440
cugcacgcucagugug

SEQ ID NO: 1614697 - RNA, 17 nt, Pseudomonas putida KT2440
cugaugaccggccuggu

SEQ ID NO: 1614698 - RNA, 14 nt, Pseudomonas putida KT2440
cugaugcuucugcu

SEQ ID NO: 1614699 - RNA, 19 nt, Pseudomonas putida KT2440
cugaugcuucugcuucagc

SEQ ID NO: 1614700 - RNA, 23 nt, Pseudomonas putida KT2440
cugauguccaaauugggcugggc

SEQ ID NO: 1614701 - RNA, 22 nt, Pseudomonas putida KT2440
cugauguucggugcucaggcuc

SEQ ID NO: 1614702 - RNA, 23 nt, Pseudomonas putida KT2440
cugauguucggugcucaggcuca

SEQ ID NO: 1614703 - RNA, 17 nt, Pseudomonas putida KT2440
cugauguuggccaucac

SEQ ID NO: 1614704 - RNA, 18 nt, Pseudomonas putida KT2440
cugauguuggccaucacu

SEQ ID NO: 1614705 - RNA, 21 nt, Pseudomonas putida KT2440
cugauguuggccaucacuucc

SEQ ID NO: 1614706 - RNA, 14 nt, Pseudomonas putida KT2440
cugauucagcacac

SEQ ID NO: 1614707 - RNA, 23 nt, Pseudomonas putida KT2440
cucuaccccuucauccgcggcau

SEQ ID NO: 1614708 - RNA, 16 nt, Pseudomonas putida KT2440
cucuaccaacugagcu

SEQ ID NO: 1614709 - RNA, 13 nt, Pseudomonas putida KT2440
cucuaccacgccg

SEQ ID NO: 1614710 - RNA, 20 nt, Pseudomonas putida KT2440
cugaauguacaaugcacuuc

SEQ ID NO: 1614711 - RNA, 19 nt, Pseudomonas putida KT2440
cugaaugucagcgcucggg

SEQ ID NO: 1614712 - RNA, 19 nt, Pseudomonas putida KT2440
cugaaucuugcgcgccagc

SEQ ID NO: 1614713 - RNA, 22 nt, Pseudomonas putida KT2440
cugaauggccuuggccaucacu

SEQ ID NO: 1614714 - RNA, 19 nt, Pseudomonas putida KT2440
cugacgccagcgcugggcg

SEQ ID NO: 1614715 - RNA, 19 nt, Pseudomonas putida KT2440
cugacgcagugcagccgcg

SEQ ID NO: 1614716 - RNA, 16 nt, Pseudomonas putida KT2440
cugacugucucgccca

SEQ ID NO: 1614717 - RNA, 16 nt, Pseudomonas putida KT2440
cugacugcggaucuug

SEQ ID NO: 1614718 - RNA, 16 nt, Pseudomonas putida KT2440
cugacuggcagcaagg

SEQ ID NO: 1614719 - RNA, 18 nt, Pseudomonas putida KT2440
cugacuggcagcaaggcc

SEQ ID NO: 1614720 - RNA, 15 nt, Pseudomonas putida KT2440
cugacguaguccuug

SEQ ID NO: 1614721 - RNA, 17 nt, Pseudomonas putida KT2440
cugaccggcacugcaca

SEQ ID NO: 1614722 - RNA, 22 nt, Pseudomonas putida KT2440
cugaccgaugaucugccgggcc

SEQ ID NO: 1614723 - RNA, 14 nt, Pseudomonas putida KT2440
cugaccgccugcgc

SEQ ID NO: 1614724 - RNA, 22 nt, Pseudomonas putida KT2440
cugacccgcuucgcucagaauc

SEQ ID NO: 1614725 - RNA, 14 nt, Pseudomonas putida KT2440
cugacauaacaaga

SEQ ID NO: 1614726 - RNA, 21 nt, Pseudomonas putida KT2440
cugacauaacaagaacaacac

SEQ ID NO: 1614727 - RNA, 14 nt, Pseudomonas putida KT2440
cugacagcaggaac

SEQ ID NO: 1614728 - RNA, 15 nt, Pseudomonas putida KT2440
cugacagcaggaaca

SEQ ID NO: 1614729 - RNA, 16 nt, Pseudomonas putida KT2440
cugacagcaggaacag

SEQ ID NO: 1614730 - RNA, 23 nt, Pseudomonas putida KT2440
cguugaggccgaacaccgccagc

SEQ ID NO: 1614731 - RNA, 18 nt, Pseudomonas putida KT2440
cguucgucaagcucgacc

SEQ ID NO: 1614732 - RNA, 18 nt, Pseudomonas putida KT2440
cguucuccagcuccuggc

SEQ ID NO: 1614733 - RNA, 14 nt, Pseudomonas putida KT2440
cguugagccgccaa

SEQ ID NO: 1614734 - RNA, 16 nt, Pseudomonas putida KT2440
cguucgguguccuugc

SEQ ID NO: 1614735 - RNA, 13 nt, Pseudomonas putida KT2440
cguucggcgcgcu

SEQ ID NO: 1614736 - RNA, 21 nt, Pseudomonas putida KT2440
cguucagccgaucacuuccug

SEQ ID NO: 1614737 - RNA, 12 nt, Pseudomonas putida KT2440
cguucagcaaga

SEQ ID NO: 1614738 - RNA, 22 nt, Pseudomonas putida KT2440
cguuauugcacuuccacuccag

SEQ ID NO: 1614739 - RNA, 14 nt, Pseudomonas putida KT2440
cguuauccugcagc

SEQ ID NO: 1614740 - RNA, 19 nt, Pseudomonas putida KT2440
cguuauggaaggcaaagau

SEQ ID NO: 1614741 - RNA, 21 nt, Pseudomonas putida KT2440
cguuauggaaggcaaagauuu

SEQ ID NO: 1614742 - RNA, 17 nt, Pseudomonas putida KT2440
cguuaguucgugcaccc

SEQ ID NO: 1614743 - RNA, 15 nt, Pseudomonas putida KT2440
cguuacuguuccagc

SEQ ID NO: 1614744 - RNA, 21 nt, Pseudomonas putida KT2440
cguggcaaucuucuugccggu

SEQ ID NO: 1614745 - RNA, 20 nt, Pseudomonas putida KT2440
cguggcagcaaucggcagcg

SEQ ID NO: 1614746 - RNA, 15 nt, Pseudomonas putida KT2440
cguggcagccccccc

SEQ ID NO: 1614747 - RNA, 18 nt, Pseudomonas putida KT2440
cguggcagcccccccagc

SEQ ID NO: 1614748 - RNA, 22 nt, Pseudomonas putida KT2440
cgugcuucaucgcugacuucca

SEQ ID NO: 1614749 - RNA, 17 nt, Pseudomonas putida KT2440
cgugcugguccuccccu

SEQ ID NO: 1614750 - RNA, 21 nt, Pseudomonas putida KT2440
cguggcaaacccggccagcag

SEQ ID NO: 1614751 - RNA, 14 nt, Pseudomonas putida KT2440
cguuacccaccagc

SEQ ID NO: 1614752 - RNA, 13 nt, Pseudomonas putida KT2440
cguuuuauaaaga

SEQ ID NO: 1614753 - RNA, 22 nt, Pseudomonas putida KT2440
cguuuuucucgaugaugcuggu

SEQ ID NO: 1614754 - RNA, 20 nt, Pseudomonas putida KT2440
cguuguucuucaggcgcgca

SEQ ID NO: 1614755 - RNA, 17 nt, Pseudomonas putida KT2440
cguuguguugcugggcg

SEQ ID NO: 1614756 - RNA, 14 nt, Pseudomonas putida KT2440
cguuguucagcagc

SEQ ID NO: 1614757 - RNA, 15 nt, Pseudomonas putida KT2440
cguuguucagcagcg

SEQ ID NO: 1614758 - RNA, 16 nt, Pseudomonas putida KT2440
cguuuccccuguuccc

SEQ ID NO: 1614759 - RNA, 18 nt, Pseudomonas putida KT2440
cguuucgucauccaccgc

SEQ ID NO: 1614760 - RNA, 20 nt, Pseudomonas putida KT2440
cguuucggcggccugcagcu

SEQ ID NO: 1614761 - RNA, 21 nt, Pseudomonas putida KT2440
cguuucggcggccugcagcuu

SEQ ID NO: 1614762 - RNA, 15 nt, Pseudomonas putida KT2440
cguugcaggauuugc

SEQ ID NO: 1614763 - RNA, 18 nt, Pseudomonas putida KT2440
cguugcagccccagccuc

SEQ ID NO: 1614764 - RNA, 20 nt, Pseudomonas putida KT2440
cguugaugcgcuugaaguga

SEQ ID NO: 1614765 - RNA, 17 nt, Pseudomonas putida KT2440
cguugcauuccaucauc

SEQ ID NO: 1614766 - RNA, 15 nt, Pseudomonas putida KT2440
cguugugcagcacuu

SEQ ID NO: 1614767 - RNA, 22 nt, Pseudomonas putida KT2440
cguugucggucucgaaccacag

SEQ ID NO: 1614768 - RNA, 17 nt, Pseudomonas putida KT2440
cguuguagcccaccacc

SEQ ID NO: 1614769 - RNA, 12 nt, Pseudomonas putida KT2440
cguugucagcaa

SEQ ID NO: 1614770 - RNA, 13 nt, Pseudomonas putida KT2440
cguuguccagcag

SEQ ID NO: 1614771 - RNA, 14 nt, Pseudomonas putida KT2440
cguuguccagcagc

SEQ ID NO: 1614772 - RNA, 15 nt, Pseudomonas putida KT2440
cguuguccagcagca

SEQ ID NO: 1614773 - RNA, 17 nt, Pseudomonas putida KT2440
cguuguccagcagcagc

SEQ ID NO: 1614774 - RNA, 19 nt, Pseudomonas putida KT2440
cuaauauuaagcggucucg

SEQ ID NO: 1614775 - RNA, 17 nt, Pseudomonas putida KT2440
cuacaagugguuaaccu

SEQ ID NO: 1614776 - RNA, 15 nt, Pseudomonas putida KT2440
cuacaacauaccgcu

SEQ ID NO: 1614777 - RNA, 19 nt, Pseudomonas putida KT2440
cuaaugugacugaugauga

SEQ ID NO: 1614778 - RNA, 17 nt, Pseudomonas putida KT2440
cuaagccuccagagaac

SEQ ID NO: 1614779 - RNA, 18 nt, Pseudomonas putida KT2440
cuaagggaguauaccuca

SEQ ID NO: 1614780 - RNA, 17 nt, Pseudomonas putida KT2440
cuaaguuugcccagcgc

SEQ ID NO: 1614781 - RNA, 16 nt, Pseudomonas putida KT2440
cuaaccucugcaugcc

SEQ ID NO: 1614782 - RNA, 16 nt, Pseudomonas putida KT2440
cgucgcggccccaggg

SEQ ID NO: 1614783 - RNA, 20 nt, Pseudomonas putida KT2440
cgucgcuucaucggcuggca

SEQ ID NO: 1614784 - RNA, 19 nt, Pseudomonas putida KT2440
cgucggccgcauccaugcc

SEQ ID NO: 1614785 - RNA, 18 nt, Pseudomonas putida KT2440
cgucggcauaggcccgcc

SEQ ID NO: 1614786 - RNA, 17 nt, Pseudomonas putida KT2440
cgucggcagagcgccag

SEQ ID NO: 1614787 - RNA, 18 nt, Pseudomonas putida KT2440
cgucggcagagcgccagc

SEQ ID NO: 1614788 - RNA, 19 nt, Pseudomonas putida KT2440
cgucggcagagcgccagca

SEQ ID NO: 1614789 - RNA, 16 nt, Pseudomonas putida KT2440
cgucgcgcuggccgcc

SEQ ID NO: 1614790 - RNA, 18 nt, Pseudomonas putida KT2440
cgucgcgcuggccgcccg

SEQ ID NO: 1614791 - RNA, 16 nt, Pseudomonas putida KT2440
cgucguguaggagcgg

SEQ ID NO: 1614792 - RNA, 14 nt, Pseudomonas putida KT2440
cgucgucacugccc

SEQ ID NO: 1614793 - RNA, 15 nt, Pseudomonas putida KT2440
cgucggggccggaga

SEQ ID NO: 1614794 - RNA, 21 nt, Pseudomonas putida KT2440
cgucggggaauggcccagcca

SEQ ID NO: 1614795 - RNA, 21 nt, Pseudomonas putida KT2440
cgucggugaugaucagggaca

SEQ ID NO: 1614796 - RNA, 19 nt, Pseudomonas putida KT2440
cgucgggcacgaucagcag

SEQ ID NO: 1614797 - RNA, 17 nt, Pseudomonas putida KT2440
cgucggcuggcagcuug

SEQ ID NO: 1614798 - RNA, 14 nt, Pseudomonas putida KT2440
cgucuggcgcggca

SEQ ID NO: 1614799 - RNA, 19 nt, Pseudomonas putida KT2440
cgucucgaacggcgccagc

SEQ ID NO: 1614800 - RNA, 22 nt, Pseudomonas putida KT2440
cgucucgaacggcgccagcagu

SEQ ID NO: 1614801 - RNA, 21 nt, Pseudomonas putida KT2440
cgucucgaugcaauccgccac

SEQ ID NO: 1614802 - RNA, 18 nt, Pseudomonas putida KT2440
cgugaauaugcucuuucc

SEQ ID NO: 1614803 - RNA, 21 nt, Pseudomonas putida KT2440
cgugcaggcggcgacaaccga

SEQ ID NO: 1614804 - RNA, 17 nt, Pseudomonas putida KT2440
cgugcaaacaacuccga

SEQ ID NO: 1614805 - RNA, 15 nt, Pseudomonas putida KT2440
cgugauggcagcuac

SEQ ID NO: 1614806 - RNA, 19 nt, Pseudomonas putida KT2440
cgugcccccccaacaacag

SEQ ID NO: 1614807 - RNA, 19 nt, Pseudomonas putida KT2440
cgugcccgcccacgccgcu

SEQ ID NO: 1614808 - RNA, 21 nt, Pseudomonas putida KT2440
cgugcccgcgaagggccgcga

SEQ ID NO: 1614809 - RNA, 16 nt, Pseudomonas putida KT2440
cgugcccugaacaggg

SEQ ID NO: 1614810 - RNA, 15 nt, Pseudomonas putida KT2440
cgugccggucacugg

SEQ ID NO: 1614811 - RNA, 20 nt, Pseudomonas putida KT2440
cgugccggucacuggcaacg

SEQ ID NO: 1614812 - RNA, 16 nt, Pseudomonas putida KT2440
cgugccggaacaaccc

SEQ ID NO: 1614813 - RNA, 21 nt, Pseudomonas putida KT2440
cgugccggaacaaccccuugc

SEQ ID NO: 1614814 - RNA, 16 nt, Pseudomonas putida KT2440
cgugccucgcccaggu

SEQ ID NO: 1614815 - RNA, 16 nt, Pseudomonas putida KT2440
cgugccucagccaggc

SEQ ID NO: 1614816 - RNA, 18 nt, Pseudomonas putida KT2440
cgugccuuccagcuucug

SEQ ID NO: 1614817 - RNA, 12 nt, Pseudomonas putida KT2440
cgucaccgugca

SEQ ID NO: 1614818 - RNA, 17 nt, Pseudomonas putida KT2440
cgucaccgccgccuggg

SEQ ID NO: 1614819 - RNA, 19 nt, Pseudomonas putida KT2440
cgucaccgccccagcgcgc

SEQ ID NO: 1614820 - RNA, 20 nt, Pseudomonas putida KT2440
cgucaccuuuuccacuugca

SEQ ID NO: 1614821 - RNA, 12 nt, Pseudomonas putida KT2440
cgucacugccca

SEQ ID NO: 1614822 - RNA, 18 nt, Pseudomonas putida KT2440
cguauucgcccagcgcuc

SEQ ID NO: 1614823 - RNA, 19 nt, Pseudomonas putida KT2440
cgucaggcuucaucaacgc

SEQ ID NO: 1614824 - RNA, 15 nt, Pseudomonas putida KT2440
cgucaggcucagcag

SEQ ID NO: 1614825 - RNA, 20 nt, Pseudomonas putida KT2440
cgucagggucuuccggcagg

SEQ ID NO: 1614826 - RNA, 13 nt, Pseudomonas putida KT2440
cgucacugacccu

SEQ ID NO: 1614827 - RNA, 19 nt, Pseudomonas putida KT2440
cgucagcucaagcgcuccc

SEQ ID NO: 1614828 - RNA, 18 nt, Pseudomonas putida KT2440
cguccacgcgcaggccac

SEQ ID NO: 1614829 - RNA, 20 nt, Pseudomonas putida KT2440
cgucaugcgguacagcacug

SEQ ID NO: 1614830 - RNA, 17 nt, Pseudomonas putida KT2440
cgucauugcucaccgug

SEQ ID NO: 1614831 - RNA, 12 nt, Pseudomonas putida KT2440
cguccaauagcc

SEQ ID NO: 1614832 - RNA, 20 nt, Pseudomonas putida KT2440
cguccaauagccauuccggc

SEQ ID NO: 1614833 - RNA, 19 nt, Pseudomonas putida KT2440
cguccagcaacagcugccg

SEQ ID NO: 1614834 - RNA, 23 nt, Pseudomonas putida KT2440
cguccagcaacagcugccgggcc

SEQ ID NO: 1614835 - RNA, 22 nt, Pseudomonas putida KT2440
cguccagccccgcaccgcggau

SEQ ID NO: 1614836 - RNA, 19 nt, Pseudomonas putida KT2440
cguccagcaggcuggcggc

SEQ ID NO: 1614837 - RNA, 15 nt, Pseudomonas putida KT2440
cguccgaccaacggu

SEQ ID NO: 1614838 - RNA, 21 nt, Pseudomonas putida KT2440
cguccgcagucccguuggccc

SEQ ID NO: 1614839 - RNA, 20 nt, Pseudomonas putida KT2440
cguagcuguuaggcuugacg

SEQ ID NO: 1614840 - RNA, 23 nt, Pseudomonas putida KT2440
cguagcccucgaugucuuccaga

SEQ ID NO: 1614841 - RNA, 14 nt, Pseudomonas putida KT2440
cguacuuuucucuc

SEQ ID NO: 1614842 - RNA, 13 nt, Pseudomonas putida KT2440
cguagaaaggaga

SEQ ID NO: 1614843 - RNA, 14 nt, Pseudomonas putida KT2440
cguaggcugcagcg

SEQ ID NO: 1614844 - RNA, 15 nt, Pseudomonas putida KT2440
cguaggugcgcggcc

SEQ ID NO: 1614845 - RNA, 18 nt, Pseudomonas putida KT2440
cguaggcgcaucgggccg

SEQ ID NO: 1614846 - RNA, 18 nt, Pseudomonas putida KT2440
cguaguacuccagcagcg

SEQ ID NO: 1614847 - RNA, 14 nt, Pseudomonas putida KT2440
cguauagccaccgg

SEQ ID NO: 1614848 - RNA, 13 nt, Pseudomonas putida KT2440
cguaguaacggcg

SEQ ID NO: 1614849 - RNA, 17 nt, Pseudomonas putida KT2440
cguaguaauccggcaac

SEQ ID NO: 1614850 - RNA, 15 nt, Pseudomonas putida KT2440
cguacacucaccgcg

SEQ ID NO: 1614851 - RNA, 12 nt, Pseudomonas putida KT2440
cguacacugcag

SEQ ID NO: 1614852 - RNA, 13 nt, Pseudomonas putida KT2440
cguaccagccgca

SEQ ID NO: 1614853 - RNA, 23 nt, Pseudomonas putida KT2440
cguacugguaaugcucuccagcg

SEQ ID NO: 1614854 - RNA, 21 nt, Pseudomonas putida KT2440
cguacugcugggucagcacuu

SEQ ID NO: 1614855 - RNA, 13 nt, Pseudomonas putida KT2440
cguacgcucuggu

SEQ ID NO: 1614856 - RNA, 24 nt, Pseudomonas putida KT2440
cguacccaggugaugcaggcaauc

SEQ ID NO: 1614857 - RNA, 22 nt, Pseudomonas putida KT2440
cguaccccuggcgcuuuccagc

SEQ ID NO: 1614858 - RNA, 22 nt, Pseudomonas putida KT2440
cguacccgccaccccaggccac

SEQ ID NO: 1614859 - RNA, 18 nt, Pseudomonas putida KT2440
cguacccuuccuggagac

SEQ ID NO: 1614860 - RNA, 15 nt, Pseudomonas putida KT2440
cuaccacgccgcugc

SEQ ID NO: 1614861 - RNA, 17 nt, Pseudomonas putida KT2440
cuaccacguuauccagc

SEQ ID NO: 1614862 - RNA, 21 nt, Pseudomonas putida KT2440
cuaccacguuauccagcugca

SEQ ID NO: 1614863 - RNA, 15 nt, Pseudomonas putida KT2440
cuaccaacugagcua

SEQ ID NO: 1614864 - RNA, 22 nt, Pseudomonas putida KT2440
cuaccaugaaaaacaacaacca

SEQ ID NO: 1614865 - RNA, 21 nt, Pseudomonas putida KT2440
cuacccagccgggcaugcagg

SEQ ID NO: 1614866 - RNA, 15 nt, Pseudomonas putida KT2440
cuaccgcccgcgcuu

SEQ ID NO: 1614867 - RNA, 20 nt, Pseudomonas putida KT2440
cuaccggcauaccaucuucu

SEQ ID NO: 1614868 - RNA, 14 nt, Pseudomonas putida KT2440
cuaccggcgccacu

SEQ ID NO: 1614869 - RNA, 23 nt, Pseudomonas putida KT2440
cuaccguuggcaucugcugggug

SEQ ID NO: 1614870 - RNA, 15 nt, Pseudomonas putida KT2440
cuacgccgccccacu

SEQ ID NO: 1614871 - RNA, 23 nt, Pseudomonas putida KT2440
cuaccuccagcccggcuucacag

SEQ ID NO: 1614872 - RNA, 16 nt, Pseudomonas putida KT2440
cuacacgacccaccau

SEQ ID NO: 1614873 - RNA, 22 nt, Pseudomonas putida KT2440
cuacaccuaacgcaaccaucag

SEQ ID NO: 1614874 - RNA, 17 nt, Pseudomonas putida KT2440
cuacaugaaccacacac

SEQ ID NO: 1614875 - RNA, 20 nt, Pseudomonas putida KT2440
cuacauggugggucguguag

SEQ ID NO: 1614876 - RNA, 19 nt, Pseudomonas putida KT2440
cuacagccccuuccccagg

SEQ ID NO: 1614877 - RNA, 14 nt, Pseudomonas putida KT2440
cuacagcggccugu

SEQ ID NO: 1614878 - RNA, 16 nt, Pseudomonas putida KT2440
cuacagcggccugugc

SEQ ID NO: 1614879 - RNA, 16 nt, Pseudomonas putida KT2440
cuacagguuucagucg

SEQ ID NO: 1614880 - RNA, 22 nt, Pseudomonas putida KT2440
cuacaggccccacaacggccgc

SEQ ID NO: 1614881 - RNA, 17 nt, Pseudomonas putida KT2440
cuacaggcaaccgcauc

SEQ ID NO: 1614882 - RNA, 14 nt, Pseudomonas putida KT2440
cuagcuuggucucg

SEQ ID NO: 1614883 - RNA, 15 nt, Pseudomonas putida KT2440
cuagccucaucagag

SEQ ID NO: 1614884 - RNA, 16 nt, Pseudomonas putida KT2440
cuagccggucaccgac

SEQ ID NO: 1614885 - RNA, 15 nt, Pseudomonas putida KT2440
cuacguggaccagag

SEQ ID NO: 1614886 - RNA, 16 nt, Pseudomonas putida KT2440
cuacgugauugacccg

SEQ ID NO: 1614887 - RNA, 20 nt, Pseudomonas putida KT2440
cuacggccgugcagggcgcc

SEQ ID NO: 1614888 - RNA, 20 nt, Pseudomonas putida KT2440
cuacgcuggacuugccuugg

SEQ ID NO: 1614889 - RNA, 18 nt, Pseudomonas putida KT2440
cuagcgcaacaccgccau

SEQ ID NO: 1614890 - RNA, 21 nt, Pseudomonas putida KT2440
cucagccaaccgccccaccca

SEQ ID NO: 1614891 - RNA, 20 nt, Pseudomonas putida KT2440
cucagcaccauuugucuuga

SEQ ID NO: 1614892 - RNA, 15 nt, Pseudomonas putida KT2440
cucacuuucugcgcu

SEQ ID NO: 1614893 - RNA, 21 nt, Pseudomonas putida KT2440
cucacgcucguuguccagcag

SEQ ID NO: 1614894 - RNA, 16 nt, Pseudomonas putida KT2440
cucagcgcgugcuugu

SEQ ID NO: 1614895 - RNA, 13 nt, Pseudomonas putida KT2440
cucagcggcaccu

SEQ ID NO: 1614896 - RNA, 20 nt, Pseudomonas putida KT2440
cucagcgggcguaccuggcu

SEQ ID NO: 1614897 - RNA, 13 nt, Pseudomonas putida KT2440
cucagcugcugcu

SEQ ID NO: 1614898 - RNA, 14 nt, Pseudomonas putida KT2440
cucagcgcccgcug

SEQ ID NO: 1614899 - RNA, 22 nt, Pseudomonas putida KT2440
cucagcgcccgcugcgccgcuc

SEQ ID NO: 1614900 - RNA, 21 nt, Pseudomonas putida KT2440
cucagccgcugcgccugccgg

SEQ ID NO: 1614901 - RNA, 12 nt, Pseudomonas putida KT2440
cucagccgccac

SEQ ID NO: 1614902 - RNA, 16 nt, Pseudomonas putida KT2440
cucagccgccacaugc

SEQ ID NO: 1614903 - RNA, 20 nt, Pseudomonas putida KT2440
cucagccacgcuggcaccca

SEQ ID NO: 1614904 - RNA, 14 nt, Pseudomonas putida KT2440
cucacacccaggcu

SEQ ID NO: 1614905 - RNA, 16 nt, Pseudomonas putida KT2440
cucacgcaucugcgcu

SEQ ID NO: 1614906 - RNA, 17 nt, Pseudomonas putida KT2440
cucacgccccgugaagu

SEQ ID NO: 1614907 - RNA, 13 nt, Pseudomonas putida KT2440
cucacgcgccagg

SEQ ID NO: 1614908 - RNA, 18 nt, Pseudomonas putida KT2440
cucacgcgccaggguuug

SEQ ID NO: 1614909 - RNA, 14 nt, Pseudomonas putida KT2440
cucaccccgccccu

SEQ ID NO: 1614910 - RNA, 20 nt, Pseudomonas putida KT2440
cucaaacaaaaacgccgccc

SEQ ID NO: 1614911 - RNA, 21 nt, Pseudomonas putida KT2440
cucaaacaaaaacgccgcccu

SEQ ID NO: 1614912 - RNA, 20 nt, Pseudomonas putida KT2440
cucaaagcgcaaaaccacca

SEQ ID NO: 1614913 - RNA, 21 nt, Pseudomonas putida KT2440
cucaaagcgcaaaaccaccag

SEQ ID NO: 1614914 - RNA, 24 nt, Pseudomonas putida KT2440
cucaaaccauuggugaaagcgcaa

SEQ ID NO: 1614915 - RNA, 18 nt, Pseudomonas putida KT2440
cuauggggugagcggcuu

SEQ ID NO: 1614916 - RNA, 22 nt, Pseudomonas putida KT2440
cuauggcuuuugcccuucuggu

SEQ ID NO: 1614917 - RNA, 19 nt, Pseudomonas putida KT2440
cuaugagacuagcaguccc

SEQ ID NO: 1614918 - RNA, 19 nt, Pseudomonas putida KT2440
cuaucucuccgccauacaa

SEQ ID NO: 1614919 - RNA, 12 nt, Pseudomonas putida KT2440
cucaaaaaaaua

SEQ ID NO: 1614920 - RNA, 24 nt, Pseudomonas putida KT2440
cucgugauagauaucaagcaugcg

SEQ ID NO: 1614921 - RNA, 20 nt, Pseudomonas putida KT2440
cucgguuucucaccccgugu

SEQ ID NO: 1614922 - RNA, 20 nt, Pseudomonas putida KT2440
cucgguugaugcagcgcccg

SEQ ID NO: 1614923 - RNA, 17 nt, Pseudomonas putida KT2440
cucguucaacaccuucu

SEQ ID NO: 1614924 - RNA, 19 nt, Pseudomonas putida KT2440
cucguuguccagcagcagc

SEQ ID NO: 1614925 - RNA, 23 nt, Pseudomonas putida KT2440
cucuaaaucgaccugcaggcccu

SEQ ID NO: 1614926 - RNA, 15 nt, Pseudomonas putida KT2440
cucggcgaucgccag

SEQ ID NO: 1614927 - RNA, 18 nt, Pseudomonas putida KT2440
cucggcgaucgccaggug

SEQ ID NO: 1614928 - RNA, 20 nt, Pseudomonas putida KT2440
cucggcgaugccgcgcgccc

SEQ ID NO: 1614929 - RNA, 19 nt, Pseudomonas putida KT2440
cucgcugucguccagcucg

SEQ ID NO: 1614930 - RNA, 22 nt, Pseudomonas putida KT2440
cucgcugucguccagcucgcgc

SEQ ID NO: 1614931 - RNA, 13 nt, Pseudomonas putida KT2440
cucgcugccggcg

SEQ ID NO: 1614932 - RNA, 18 nt, Pseudomonas putida KT2440
cucgcugaacacgcaggu

SEQ ID NO: 1614933 - RNA, 16 nt, Pseudomonas putida KT2440
cucgcugccacgcaug

SEQ ID NO: 1614934 - RNA, 21 nt, Pseudomonas putida KT2440
cucgcugccacgcaugccuau

SEQ ID NO: 1614935 - RNA, 12 nt, Pseudomonas putida KT2440
cucgcggcuggu

SEQ ID NO: 1614936 - RNA, 14 nt, Pseudomonas putida KT2440
cucggcguagcagg

SEQ ID NO: 1614937 - RNA, 15 nt, Pseudomonas putida KT2440
cucggcuagcgccug

SEQ ID NO: 1614938 - RNA, 17 nt, Pseudomonas putida KT2440
cucggcguucagcucgu

SEQ ID NO: 1614939 - RNA, 13 nt, Pseudomonas putida KT2440
cucgggcuuccag

SEQ ID NO: 1614940 - RNA, 15 nt, Pseudomonas putida KT2440
cucggcucacgcccc

SEQ ID NO: 1614941 - RNA, 22 nt, Pseudomonas putida KT2440
cucgggcgguugggcaagugcg

SEQ ID NO: 1614942 - RNA, 17 nt, Pseudomonas putida KT2440
cucggugcacgggccga

SEQ ID NO: 1614943 - RNA, 17 nt, Pseudomonas putida KT2440
cucgguacccgccagca

SEQ ID NO: 1614944 - RNA, 22 nt, Pseudomonas putida KT2440
cucgaagauauccgccugaauc

SEQ ID NO: 1614945 - RNA, 22 nt, Pseudomonas putida KT2440
cucgaacugaugaccggccugg

SEQ ID NO: 1614946 - RNA, 19 nt, Pseudomonas putida KT2440
cucgaaguagcgcucuuug

SEQ ID NO: 1614947 - RNA, 12 nt, Pseudomonas putida KT2440
cucgacccgccg

SEQ ID NO: 1614948 - RNA, 22 nt, Pseudomonas putida KT2440
cucgacccgcgucagcucaagc

SEQ ID NO: 1614949 - RNA, 20 nt, Pseudomonas putida KT2440
cucgacccgucgcugccaaa

SEQ ID NO: 1614950 - RNA, 14 nt, Pseudomonas putida KT2440
cucgaacagcgccg

SEQ ID NO: 1614951 - RNA, 21 nt, Pseudomonas putida KT2440
cucgaaccaguucgggaagug

SEQ ID NO: 1614952 - RNA, 21 nt, Pseudomonas putida KT2440
cuccucaucgaugcccguccc

SEQ ID NO: 1614953 - RNA, 16 nt, Pseudomonas putida KT2440
cucgacgccccggccu

SEQ ID NO: 1614954 - RNA, 18 nt, Pseudomonas putida KT2440
cucgacgccccggccugc

SEQ ID NO: 1614955 - RNA, 16 nt, Pseudomonas putida KT2440
cucgauucgccgggcc

SEQ ID NO: 1614956 - RNA, 20 nt, Pseudomonas putida KT2440
cucgcagccaaugcugauga

SEQ ID NO: 1614957 - RNA, 22 nt, Pseudomonas putida KT2440
cucgccaaauguaggaucaagu

SEQ ID NO: 1614958 - RNA, 17 nt, Pseudomonas putida KT2440
cucgccaacaccgcccc

SEQ ID NO: 1614959 - RNA, 13 nt, Pseudomonas putida KT2440
cucgccaagcauu

SEQ ID NO: 1614960 - RNA, 21 nt, Pseudomonas putida KT2440
cucgcccaugcgcgugcgugu

SEQ ID NO: 1614961 - RNA, 16 nt, Pseudomonas putida KT2440
cucgccauucaccagc

SEQ ID NO: 1614962 - RNA, 15 nt, Pseudomonas putida KT2440
cucgcccacacggca

SEQ ID NO: 1614963 - RNA, 12 nt, Pseudomonas putida KT2440
cucgcccagcag

SEQ ID NO: 1614964 - RNA, 14 nt, Pseudomonas putida KT2440
cucgcccaggccgc

SEQ ID NO: 1614965 - RNA, 12 nt, Pseudomonas putida KT2440
cucgccgcgcau

SEQ ID NO: 1614966 - RNA, 17 nt, Pseudomonas putida KT2440
cucgcccgggucagguc

SEQ ID NO: 1614967 - RNA, 21 nt, Pseudomonas putida KT2440
cucgcgcgcguauugcuccca

SEQ ID NO: 1614968 - RNA, 12 nt, Pseudomonas putida KT2440
cucgcgccgccg

SEQ ID NO: 1614969 - RNA, 14 nt, Pseudomonas putida KT2440
cucgcgcuuggcca

SEQ ID NO: 1614970 - RNA, 20 nt, Pseudomonas putida KT2440
cucgcggcgaaugcugcaga

SEQ ID NO: 1614971 - RNA, 13 nt, Pseudomonas putida KT2440
cucgcgcugccag

SEQ ID NO: 1614972 - RNA, 15 nt, Pseudomonas putida KT2440
cucgcgcaacaccgc

SEQ ID NO: 1614973 - RNA, 18 nt, Pseudomonas putida KT2440
cucgcgcaggaaccgcgu

SEQ ID NO: 1614974 - RNA, 17 nt, Pseudomonas putida KT2440
cucgccggguuccacca

SEQ ID NO: 1614975 - RNA, 14 nt, Pseudomonas putida KT2440
cucgccucaccgca

SEQ ID NO: 1614976 - RNA, 12 nt, Pseudomonas putida KT2440
cucgccucagcg

SEQ ID NO: 1614977 - RNA, 18 nt, Pseudomonas putida KT2440
cucgccugcuuggcaccu

SEQ ID NO: 1614978 - RNA, 23 nt, Pseudomonas putida KT2440
cuccggaauccgcacacgcucca

SEQ ID NO: 1614979 - RNA, 21 nt, Pseudomonas putida KT2440
cuccggcguguccagcagguu

SEQ ID NO: 1614980 - RNA, 19 nt, Pseudomonas putida KT2440
cuccgggaagguuuccagc

SEQ ID NO: 1614981 - RNA, 17 nt, Pseudomonas putida KT2440
cuccuacgacggccugc

SEQ ID NO: 1614982 - RNA, 22 nt, Pseudomonas putida KT2440
cuccuacgacggccuguguuca

SEQ ID NO: 1614983 - RNA, 22 nt, Pseudomonas putida KT2440
cuccuacgcggggcagcgcacg

SEQ ID NO: 1614984 - RNA, 16 nt, Pseudomonas putida KT2440
cuccuacgggcaaccg

SEQ ID NO: 1614985 - RNA, 20 nt, Pseudomonas putida KT2440
cuccuacgggcaaccgcauc

SEQ ID NO: 1614986 - RNA, 20 nt, Pseudomonas putida KT2440
cuccuacggggguucacagc

SEQ ID NO: 1614987 - RNA, 21 nt, Pseudomonas putida KT2440
cuccuacggggguucacagcc

SEQ ID NO: 1614988 - RNA, 21 nt, Pseudomonas putida KT2440
cuccuacaaagcggcgcggcc

SEQ ID NO: 1614989 - RNA, 22 nt, Pseudomonas putida KT2440
cuccuacacaggaaacgcaauc

SEQ ID NO: 1614990 - RNA, 15 nt, Pseudomonas putida KT2440
cuccuacaggccgcc

SEQ ID NO: 1614991 - RNA, 16 nt, Pseudomonas putida KT2440
cuccuacaggcgaccg

SEQ ID NO: 1614992 - RNA, 20 nt, Pseudomonas putida KT2440
cuccgggcgcccuggcaugc

SEQ ID NO: 1614993 - RNA, 21 nt, Pseudomonas putida KT2440
cucccccaggcugccaaaccg

SEQ ID NO: 1614994 - RNA, 13 nt, Pseudomonas putida KT2440
cucccccaucagu

SEQ ID NO: 1614995 - RNA, 19 nt, Pseudomonas putida KT2440
cuccccaaccaccucccca

SEQ ID NO: 1614996 - RNA, 14 nt, Pseudomonas putida KT2440
cuccccacccaggu

SEQ ID NO: 1614997 - RNA, 19 nt, Pseudomonas putida KT2440
cuccccaguccgucucuuc

SEQ ID NO: 1614998 - RNA, 17 nt, Pseudomonas putida KT2440
cucccgggaucaccgca

SEQ ID NO: 1614999 - RNA, 14 nt, Pseudomonas putida KT2440
cucccgggcaauca

SEQ ID NO: 1615000 - RNA, 21 nt, Pseudomonas putida KT2440
cucccggcuacgcacccgcac

SEQ ID NO: 1615001 - RNA, 14 nt, Pseudomonas putida KT2440
cucccgcugcugcg

SEQ ID NO: 1615002 - RNA, 12 nt, Pseudomonas putida KT2440
cuccagccagau

SEQ ID NO: 1615003 - RNA, 14 nt, Pseudomonas putida KT2440
cuccagcccagcgc

SEQ ID NO: 1615004 - RNA, 16 nt, Pseudomonas putida KT2440
cuccagcccagcgcca

SEQ ID NO: 1615005 - RNA, 13 nt, Pseudomonas putida KT2440
cuccagccgcugc

SEQ ID NO: 1615006 - RNA, 16 nt, Pseudomonas putida KT2440
cuccagcagugccgcc

SEQ ID NO: 1615007 - RNA, 21 nt, Pseudomonas putida KT2440
cuccagcccugcucgccaaau

SEQ ID NO: 1615008 - RNA, 22 nt, Pseudomonas putida KT2440
cuccauggcaauuggcuuccag

SEQ ID NO: 1615009 - RNA, 22 nt, Pseudomonas putida KT2440
cucccauguagaccaccagcgu

SEQ ID NO: 1615010 - RNA, 16 nt, Pseudomonas putida KT2440
cucaggcggcgcaggu

SEQ ID NO: 1615011 - RNA, 16 nt, Pseudomonas putida KT2440
cucaggccugcacugc

SEQ ID NO: 1615012 - RNA, 18 nt, Pseudomonas putida KT2440
cucaggccuucgccacug

SEQ ID NO: 1615013 - RNA, 20 nt, Pseudomonas putida KT2440
cucaggcgcgccgaucaucu

SEQ ID NO: 1615014 - RNA, 17 nt, Pseudomonas putida KT2440
cucaggcgcuggcgcca

SEQ ID NO: 1615015 - RNA, 20 nt, Pseudomonas putida KT2440
cucaggccaugcugcgccag

SEQ ID NO: 1615016 - RNA, 18 nt, Pseudomonas putida KT2440
cucaggcccaccagucug

SEQ ID NO: 1615017 - RNA, 20 nt, Pseudomonas putida KT2440
cuccaacuggcgcaucuucc

SEQ ID NO: 1615018 - RNA, 18 nt, Pseudomonas putida KT2440
cuccaacgucaaccgugc

SEQ ID NO: 1615019 - RNA, 21 nt, Pseudomonas putida KT2440
cuccaaccguacccuuccugg

SEQ ID NO: 1615020 - RNA, 24 nt, Pseudomonas putida KT2440
cuccaagccgcuucacuguccugg

SEQ ID NO: 1615021 - RNA, 23 nt, Pseudomonas putida KT2440
cuccaacaaucgcgucagcaccg

SEQ ID NO: 1615022 - RNA, 13 nt, Pseudomonas putida KT2440
cuccaacaaacuc

SEQ ID NO: 1615023 - RNA, 15 nt, Pseudomonas putida KT2440
cuccagagcccgcuc

SEQ ID NO: 1615024 - RNA, 19 nt, Pseudomonas putida KT2440
cuccagacgcuguacgucc

SEQ ID NO: 1615025 - RNA, 13 nt, Pseudomonas putida KT2440
cuccagcaacggu

SEQ ID NO: 1615026 - RNA, 13 nt, Pseudomonas putida KT2440
cuccagcaacaac

SEQ ID NO: 1615027 - RNA, 20 nt, Pseudomonas putida KT2440
cuccagcaacaacgccuugg

SEQ ID NO: 1615028 - RNA, 22 nt, Pseudomonas putida KT2440
cuccagcaccugacgcaagcgc

SEQ ID NO: 1615029 - RNA, 19 nt, Pseudomonas putida KT2440
cuccagcacuuuugccacc

SEQ ID NO: 1615030 - RNA, 14 nt, Pseudomonas putida KT2440
cuccagcagcucca

SEQ ID NO: 1615031 - RNA, 14 nt, Pseudomonas putida KT2440
cuccagcaggggca

SEQ ID NO: 1615032 - RNA, 19 nt, Pseudomonas putida KT2440
cuccacugugcccgccagg

SEQ ID NO: 1615033 - RNA, 16 nt, Pseudomonas putida KT2440
cuccacuguggucgaa

SEQ ID NO: 1615034 - RNA, 15 nt, Pseudomonas putida KT2440
cuccacguucccgcc

SEQ ID NO: 1615035 - RNA, 17 nt, Pseudomonas putida KT2440
cuccacguucccgccau

SEQ ID NO: 1615036 - RNA, 20 nt, Pseudomonas putida KT2440
cuccacggcaaucggcaggc

SEQ ID NO: 1615037 - RNA, 22 nt, Pseudomonas putida KT2440
cuccacggcaaucggcaggccg

SEQ ID NO: 1615038 - RNA, 17 nt, Pseudomonas putida KT2440
cuccacggucagcaucc

SEQ ID NO: 1615039 - RNA, 18 nt, Pseudomonas putida KT2440
cuccacggucagcaucca

SEQ ID NO: 1615040 - RNA, 13 nt, Pseudomonas putida KT2440
cuccaccccuucc

SEQ ID NO: 1615041 - RNA, 16 nt, Pseudomonas putida KT2440
cuccacccggucccgc

SEQ ID NO: 1615042 - RNA, 23 nt, Pseudomonas putida KT2440
cuccacccggucccgcccggccu

SEQ ID NO: 1615043 - RNA, 13 nt, Pseudomonas putida KT2440
cuccaccgccagg

SEQ ID NO: 1615044 - RNA, 19 nt, Pseudomonas putida KT2440
cuccaccuuccacucuucc

SEQ ID NO: 1615045 - RNA, 18 nt, Pseudomonas putida KT2440
cuccacaccccaagccau

SEQ ID NO: 1615046 - RNA, 20 nt, Pseudomonas putida KT2440
cuccacaaucucgcccuugu

SEQ ID NO: 1615047 - RNA, 19 nt, Pseudomonas putida KT2440
cuccacacucgacgcugcc

SEQ ID NO: 1615048 - RNA, 21 nt, Pseudomonas putida KT2440
cuccaccaaggcugacgccag

SEQ ID NO: 1615049 - RNA, 13 nt, Pseudomonas putida KT2440
cuccaccagccca

SEQ ID NO: 1615050 - RNA, 23 nt, Pseudomonas putida KT2440
cuccacaccgacauccacguccu

SEQ ID NO: 1615051 - RNA, 12 nt, Pseudomonas putida KT2440
aaaaaaagauuu

SEQ ID NO: 1615052 - RNA, 13 nt, Pseudomonas putida KT2440
aaaaaaagauuug

SEQ ID NO: 1615053 - RNA, 22 nt, Pseudomonas putida KT2440
aaaaaaagauuugcguuuuaaa

SEQ ID NO: 1615054 - RNA, 11 nt, Pseudomonas putida KT2440
aaaaaacuuca

SEQ ID NO: 1615055 - RNA, 17 nt, Pseudomonas putida KT2440
aaaaacaacaaccaauc

SEQ ID NO: 1615056 - RNA, 14 nt, Pseudomonas putida KT2440
aaaaacaacaauag

SEQ ID NO: 1615057 - RNA, 20 nt, Pseudomonas putida KT2440
aaaaaacgcgauacccaaua

SEQ ID NO: 1615058 - RNA, 12 nt, Pseudomonas putida KT2440
aaaaagcccagu

SEQ ID NO: 1615059 - RNA, 18 nt, Pseudomonas putida KT2440
aaaaacuggccagcagcc

SEQ ID NO: 1615060 - RNA, 16 nt, Pseudomonas putida KT2440
aaaaacgcgauaccca

SEQ ID NO: 1615061 - RNA, 18 nt, Pseudomonas putida KT2440
aaaaaccggccaagcgcc

SEQ ID NO: 1615062 - RNA, 20 nt, Pseudomonas putida KT2440
aaaaacgcgauacccaauaa

SEQ ID NO: 1615063 - RNA, 23 nt, Pseudomonas putida KT2440
aaaaacgcgauacccaauaaaaa

SEQ ID NO: 1615064 - RNA, 16 nt, Pseudomonas putida KT2440
aaaaccguacaaggca

SEQ ID NO: 1615065 - RNA, 13 nt, Pseudomonas putida KT2440
aaaaccggccaag

SEQ ID NO: 1615066 - RNA, 15 nt, Pseudomonas putida KT2440
aaaaccggccaagcg

SEQ ID NO: 1615067 - RNA, 13 nt, Pseudomonas putida KT2440
aaaacaacaauag

SEQ ID NO: 1615068 - RNA, 12 nt, Pseudomonas putida KT2440
aaaacagcgcgc

SEQ ID NO: 1615069 - RNA, 18 nt, Pseudomonas putida KT2440
aaaaaucggguaacaggg

SEQ ID NO: 1615070 - RNA, 19 nt, Pseudomonas putida KT2440
aaacccgacaacagcugca

SEQ ID NO: 1615071 - RNA, 19 nt, Pseudomonas putida KT2440
aaacccgcuccuacgggca

SEQ ID NO: 1615072 - RNA, 20 nt, Pseudomonas putida KT2440
aaacccgcuccuacgggcaa

SEQ ID NO: 1615073 - RNA, 13 nt, Pseudomonas putida KT2440
aaaccaugcaggu

SEQ ID NO: 1615074 - RNA, 12 nt, Pseudomonas putida KT2440
aaaccagccccu

SEQ ID NO: 1615075 - RNA, 14 nt, Pseudomonas putida KT2440
aaaccgacccugcu

SEQ ID NO: 1615076 - RNA, 17 nt, Pseudomonas putida KT2440
aaaccgcacccaggugc

SEQ ID NO: 1615077 - RNA, 17 nt, Pseudomonas putida KT2440
aaacccucacgcgccag

SEQ ID NO: 1615078 - RNA, 15 nt, Pseudomonas putida KT2440
aaacccucggccaca

SEQ ID NO: 1615079 - RNA, 17 nt, Pseudomonas putida KT2440
aaaccggguaggcccca

SEQ ID NO: 1615080 - RNA, 23 nt, Pseudomonas putida KT2440
aaaccggcaccggcgaacagcaa

SEQ ID NO: 1615081 - RNA, 21 nt, Pseudomonas putida KT2440
aaaccggaucgggcacaacuc

SEQ ID NO: 1615082 - RNA, 23 nt, Pseudomonas putida KT2440
aaaccggaucgggcacaacucca

SEQ ID NO: 1615083 - RNA, 14 nt, Pseudomonas putida KT2440
aaaccacagcggcc

SEQ ID NO: 1615084 - RNA, 19 nt, Pseudomonas putida KT2440
aaaccacagcggccacagc

SEQ ID NO: 1615085 - RNA, 22 nt, Pseudomonas putida KT2440
aaacaucagccggucucccagc

SEQ ID NO: 1615086 - RNA, 20 nt, Pseudomonas putida KT2440
aaacacauccacauccggug

SEQ ID NO: 1615087 - RNA, 13 nt, Pseudomonas putida KT2440
aaacaccagcaac

SEQ ID NO: 1615088 - RNA, 14 nt, Pseudomonas putida KT2440
aaacaccagcaaca

SEQ ID NO: 1615089 - RNA, 12 nt, Pseudomonas putida KT2440
aaacagcaguuu

SEQ ID NO: 1615090 - RNA, 13 nt, Pseudomonas putida KT2440
aaacagcaccagc

SEQ ID NO: 1615091 - RNA, 18 nt, Pseudomonas putida KT2440
aaaacgaagaauguagaa

SEQ ID NO: 1615092 - RNA, 18 nt, Pseudomonas putida KT2440
aaaacgccgggcacugcc

SEQ ID NO: 1615093 - RNA, 15 nt, Pseudomonas putida KT2440
aaaaggguugcaaag

SEQ ID NO: 1615094 - RNA, 13 nt, Pseudomonas putida KT2440
aaaaucaugcagu

SEQ ID NO: 1615095 - RNA, 20 nt, Pseudomonas putida KT2440
aaaaucucguucaugcccuu

SEQ ID NO: 1615096 - RNA, 21 nt, Pseudomonas putida KT2440
aaagcgccagacgcgcgcugg

SEQ ID NO: 1615097 - RNA, 14 nt, Pseudomonas putida KT2440
aaagcgcgccucca

SEQ ID NO: 1615098 - RNA, 16 nt, Pseudomonas putida KT2440
aaagcgauaauugugc

SEQ ID NO: 1615099 - RNA, 14 nt, Pseudomonas putida KT2440
aaagcgcagcgcag

SEQ ID NO: 1615100 - RNA, 23 nt, Pseudomonas putida KT2440
aaagcgcgucugauagccagggc

SEQ ID NO: 1615101 - RNA, 20 nt, Pseudomonas putida KT2440
aaagcggccccaguggcuua

SEQ ID NO: 1615102 - RNA, 22 nt, Pseudomonas putida KT2440
aaagcgguacgccgucuuccca

SEQ ID NO: 1615103 - RNA, 15 nt, Pseudomonas putida KT2440
aaagcaucaacucac

SEQ ID NO: 1615104 - RNA, 12 nt, Pseudomonas putida KT2440
aaagcaggaugg

SEQ ID NO: 1615105 - RNA, 17 nt, Pseudomonas putida KT2440
aaagccugcuccagcac

SEQ ID NO: 1615106 - RNA, 21 nt, Pseudomonas putida KT2440
aaaggcuugucaugccuuggc

SEQ ID NO: 1615107 - RNA, 18 nt, Pseudomonas putida KT2440
aaaggucugcugcggccg

SEQ ID NO: 1615108 - RNA, 21 nt, Pseudomonas putida KT2440
aaaggugcgaguauccuccag

SEQ ID NO: 1615109 - RNA, 16 nt, Pseudomonas putida KT2440
aaagaagcgaccgguu

SEQ ID NO: 1615110 - RNA, 18 nt, Pseudomonas putida KT2440
aaagaacccaaucauaua

SEQ ID NO: 1615111 - RNA, 22 nt, Pseudomonas putida KT2440
aaaccguuggucagcgacugcc

SEQ ID NO: 1615112 - RNA, 20 nt, Pseudomonas putida KT2440
aaaccgugcaaacaacuccg

SEQ ID NO: 1615113 - RNA, 12 nt, Pseudomonas putida KT2440
aaagcacacaac

SEQ ID NO: 1615114 - RNA, 22 nt, Pseudomonas putida KT2440
aaagaguccgaagcgaacacag

SEQ ID NO: 1615115 - RNA, 15 nt, Pseudomonas putida KT2440
aaauaccccaggcaa

SEQ ID NO: 1615116 - RNA, 19 nt, Pseudomonas putida KT2440
aaauaccccaggcaaaaaa

SEQ ID NO: 1615117 - RNA, 17 nt, Pseudomonas putida KT2440
aaauacccaacuccagc

SEQ ID NO: 1615118 - RNA, 13 nt, Pseudomonas putida KT2440
aaauaaagaucua

SEQ ID NO: 1615119 - RNA, 19 nt, Pseudomonas putida KT2440
aaagugguugacaagcaaa

SEQ ID NO: 1615120 - RNA, 20 nt, Pseudomonas putida KT2440
aaagucgucggcaagcuugc

SEQ ID NO: 1615121 - RNA, 21 nt, Pseudomonas putida KT2440
aaagucgucggcaagcuugcc

SEQ ID NO: 1615122 - RNA, 15 nt, Pseudomonas putida KT2440
aaaugguugaagauc

SEQ ID NO: 1615123 - RNA, 22 nt, Pseudomonas putida KT2440
aaauguccauugagcacucaac

SEQ ID NO: 1615124 - RNA, 14 nt, Pseudomonas putida KT2440
aaaugcaccacgcg

SEQ ID NO: 1615125 - RNA, 12 nt, Pseudomonas putida KT2440
aaaugcaccccu

SEQ ID NO: 1615126 - RNA, 22 nt, Pseudomonas putida KT2440
aaaugagggaugagaaagcccg

SEQ ID NO: 1615127 - RNA, 15 nt, Pseudomonas putida KT2440
aaauccgcuugaugg

SEQ ID NO: 1615128 - RNA, 13 nt, Pseudomonas putida KT2440
aacaagaacaaca

SEQ ID NO: 1615129 - RNA, 20 nt, Pseudomonas putida KT2440
aacaagcuggacaugcacgc

SEQ ID NO: 1615130 - RNA, 21 nt, Pseudomonas putida KT2440
aacaagccccuccuaagggcu

SEQ ID NO: 1615131 - RNA, 14 nt, Pseudomonas putida KT2440
aacaacaaaaaaaa

SEQ ID NO: 1615132 - RNA, 21 nt, Pseudomonas putida KT2440
caacuggugaaucagccccag

SEQ ID NO: 1615133 - RNA, 21 nt, Pseudomonas putida KT2440
caacuggucggccuugccgcu

SEQ ID NO: 1615134 - RNA, 15 nt, Pseudomonas putida KT2440
caacuguuucugcuc

SEQ ID NO: 1615135 - RNA, 19 nt, Pseudomonas putida KT2440
caacuucgguggcucacau

SEQ ID NO: 1615136 - RNA, 19 nt, Pseudomonas putida KT2440
caacugagcuaacgaccca

SEQ ID NO: 1615137 - RNA, 16 nt, Pseudomonas putida KT2440
caacugcauccgcccc

SEQ ID NO: 1615138 - RNA, 17 nt, Pseudomonas putida KT2440
caacugcauccgcccca

SEQ ID NO: 1615139 - RNA, 18 nt, Pseudomonas putida KT2440
caacugcauccgccccag

SEQ ID NO: 1615140 - RNA, 14 nt, Pseudomonas putida KT2440
caacugcacccgcc

SEQ ID NO: 1615141 - RNA, 16 nt, Pseudomonas putida KT2440
caacugcacccgccag

SEQ ID NO: 1615142 - RNA, 20 nt, Pseudomonas putida KT2440
caacugaugggucuugccgg

SEQ ID NO: 1615143 - RNA, 14 nt, Pseudomonas putida KT2440
caacuccuccagcc

SEQ ID NO: 1615144 - RNA, 16 nt, Pseudomonas putida KT2440
caacuccuucucgccc

SEQ ID NO: 1615145 - RNA, 23 nt, Pseudomonas putida KT2440
caacuccaugucggaagccugca

SEQ ID NO: 1615146 - RNA, 15 nt, Pseudomonas putida KT2440
caacuacccugaaau

SEQ ID NO: 1615147 - RNA, 17 nt, Pseudomonas putida KT2440
caacgcccccgccaccc

SEQ ID NO: 1615148 - RNA, 12 nt, Pseudomonas putida KT2440
caagaacaacac

SEQ ID NO: 1615149 - RNA, 18 nt, Pseudomonas putida KT2440
caagaacaacacggcaga

SEQ ID NO: 1615150 - RNA, 16 nt, Pseudomonas putida KT2440
caacuugcgcagcuug

SEQ ID NO: 1615151 - RNA, 13 nt, Pseudomonas putida KT2440
caacuuggcaccg

SEQ ID NO: 1615152 - RNA, 17 nt, Pseudomonas putida KT2440
caacuugugcaucaagu

SEQ ID NO: 1615153 - RNA, 16 nt, Pseudomonas putida KT2440
caagagcgacuggugu

SEQ ID NO: 1615154 - RNA, 14 nt, Pseudomonas putida KT2440
caagcccacacacc

SEQ ID NO: 1615155 - RNA, 12 nt, Pseudomonas putida KT2440
caagccccuccu

SEQ ID NO: 1615156 - RNA, 15 nt, Pseudomonas putida KT2440
caagcccgccuucgc

SEQ ID NO: 1615157 - RNA, 19 nt, Pseudomonas putida KT2440
caagcccgcgaagaggcca

SEQ ID NO: 1615158 - RNA, 12 nt, Pseudomonas putida KT2440
caagcccgcucc

SEQ ID NO: 1615159 - RNA, 15 nt, Pseudomonas putida KT2440
caagcccgcucgcca

SEQ ID NO: 1615160 - RNA, 17 nt, Pseudomonas putida KT2440
caagcccgcuugcugug

SEQ ID NO: 1615161 - RNA, 14 nt, Pseudomonas putida KT2440
caagcagccacccu

SEQ ID NO: 1615162 - RNA, 16 nt, Pseudomonas putida KT2440
caagccacgcaccucg

SEQ ID NO: 1615163 - RNA, 19 nt, Pseudomonas putida KT2440
caagcagcgaaugcagcuc

SEQ ID NO: 1615164 - RNA, 22 nt, Pseudomonas putida KT2440
caagcccauggcuggcagcacg

SEQ ID NO: 1615165 - RNA, 14 nt, Pseudomonas putida KT2440
caagcccggcgccu

SEQ ID NO: 1615166 - RNA, 15 nt, Pseudomonas putida KT2440
caagcgcuccccggu

SEQ ID NO: 1615167 - RNA, 15 nt, Pseudomonas putida KT2440
caagcgucggccacc

SEQ ID NO: 1615168 - RNA, 17 nt, Pseudomonas putida KT2440
caagcgggcagugcaau

SEQ ID NO: 1615169 - RNA, 14 nt, Pseudomonas putida KT2440
caagcgggccaagg

SEQ ID NO: 1615170 - RNA, 15 nt, Pseudomonas putida KT2440
caaggccggcagcca

SEQ ID NO: 1615171 - RNA, 15 nt, Pseudomonas putida KT2440
caaggccgcucccac

SEQ ID NO: 1615172 - RNA, 16 nt, Pseudomonas putida KT2440
caaggccagcccaugg

SEQ ID NO: 1615173 - RNA, 20 nt, Pseudomonas putida KT2440
caaggccagcccauggcgcu

SEQ ID NO: 1615174 - RNA, 14 nt, Pseudomonas putida KT2440
caaggccagcggaa

SEQ ID NO: 1615175 - RNA, 19 nt, Pseudomonas putida KT2440
caaggccagugccgcaagc

SEQ ID NO: 1615176 - RNA, 16 nt, Pseudomonas putida KT2440
caaggcccgcgccgac

SEQ ID NO: 1615177 - RNA, 18 nt, Pseudomonas putida KT2440
caaggcccaguucggaca

SEQ ID NO: 1615178 - RNA, 19 nt, Pseudomonas putida KT2440
caaggcccaguucggacag

SEQ ID NO: 1615179 - RNA, 19 nt, Pseudomonas putida KT2440
caaggaagaugaagaaacc

SEQ ID NO: 1615180 - RNA, 16 nt, Pseudomonas putida KT2440
caaggcuuuccaccug

SEQ ID NO: 1615181 - RNA, 17 nt, Pseudomonas putida KT2440
caaggcugcuucaauca

SEQ ID NO: 1615182 - RNA, 20 nt, Pseudomonas putida KT2440
caaggcuggcaacccgccuc

SEQ ID NO: 1615183 - RNA, 15 nt, Pseudomonas putida KT2440
caaggcuggccagac

SEQ ID NO: 1615184 - RNA, 13 nt, Pseudomonas putida KT2440
caaggcuguucca

SEQ ID NO: 1615185 - RNA, 18 nt, Pseudomonas putida KT2440
caaggcuguuccacagca

SEQ ID NO: 1615186 - RNA, 15 nt, Pseudomonas putida KT2440
caaggcgguggagua

SEQ ID NO: 1615187 - RNA, 14 nt, Pseudomonas putida KT2440
caaggcggcccaac

SEQ ID NO: 1615188 - RNA, 13 nt, Pseudomonas putida KT2440
caaggcgaacgau

SEQ ID NO: 1615189 - RNA, 21 nt, Pseudomonas putida KT2440
caaggccguugcuuucagcuc

SEQ ID NO: 1615190 - RNA, 14 nt, Pseudomonas putida KT2440
caaggccuccaggu

SEQ ID NO: 1615191 - RNA, 17 nt, Pseudomonas putida KT2440
caaggccucgaacagca

SEQ ID NO: 1615192 - RNA, 21 nt, Pseudomonas putida KT2440
caaggccucuaccgcugcucc

SEQ ID NO: 1615193 - RNA, 14 nt, Pseudomonas putida KT2440
caaggccugcacca

SEQ ID NO: 1615194 - RNA, 14 nt, Pseudomonas putida KT2440
caagggccugugcc

SEQ ID NO: 1615195 - RNA, 19 nt, Pseudomonas putida KT2440
caagggccguuacucccac

SEQ ID NO: 1615196 - RNA, 17 nt, Pseudomonas putida KT2440
caagggccugcaggcag

SEQ ID NO: 1615197 - RNA, 20 nt, Pseudomonas putida KT2440
caagggccugcaggcagcau

SEQ ID NO: 1615198 - RNA, 14 nt, Pseudomonas putida KT2440
caagggggcaaaga

SEQ ID NO: 1615199 - RNA, 13 nt, Pseudomonas putida KT2440
caagggucgacac

SEQ ID NO: 1615200 - RNA, 17 nt, Pseudomonas putida KT2440
caagguaaucuggcugu

SEQ ID NO: 1615201 - RNA, 14 nt, Pseudomonas putida KT2440
caagguagccugcu

SEQ ID NO: 1615202 - RNA, 19 nt, Pseudomonas putida KT2440
caagguagccugcugacgc

SEQ ID NO: 1615203 - RNA, 14 nt, Pseudomonas putida KT2440
caagguagcggcca

SEQ ID NO: 1615204 - RNA, 16 nt, Pseudomonas putida KT2440
caagguagcggccagc

SEQ ID NO: 1615205 - RNA, 16 nt, Pseudomonas putida KT2440
caagguagcggcggca

SEQ ID NO: 1615206 - RNA, 20 nt, Pseudomonas putida KT2440
caagguagcggcggcaaugg

SEQ ID NO: 1615207 - RNA, 22 nt, Pseudomonas putida KT2440
caaggucuccagcaccgccccg

SEQ ID NO: 1615208 - RNA, 21 nt, Pseudomonas putida KT2440
caaggugccaacaggcagcau

SEQ ID NO: 1615209 - RNA, 17 nt, Pseudomonas putida KT2440
caaggucagcuucuggg

SEQ ID NO: 1615210 - RNA, 21 nt, Pseudomonas putida KT2440
caagguugccaccagcaucaa

SEQ ID NO: 1615211 - RNA, 23 nt, Pseudomonas putida KT2440
caagguugcgcaagccucaggca

SEQ ID NO: 1615212 - RNA, 14 nt, Pseudomonas putida KT2440
caagguuggggcca

SEQ ID NO: 1615213 - RNA, 23 nt, Pseudomonas putida KT2440
caagguuguauuuagucagggug

SEQ ID NO: 1615214 - RNA, 22 nt, Pseudomonas putida KT2440
caauacauccgcguccccuuca

SEQ ID NO: 1615215 - RNA, 13 nt, Pseudomonas putida KT2440
caauagcccaccg

SEQ ID NO: 1615216 - RNA, 13 nt, Pseudomonas putida KT2440
caauaugcaccuu

SEQ ID NO: 1615217 - RNA, 18 nt, Pseudomonas putida KT2440
caauaugcaccuugagau

SEQ ID NO: 1615218 - RNA, 18 nt, Pseudomonas putida KT2440
caaguacaacugccaccc

SEQ ID NO: 1615219 - RNA, 16 nt, Pseudomonas putida KT2440
caaguacaccggcagc

SEQ ID NO: 1615220 - RNA, 15 nt, Pseudomonas putida KT2440
caaguacggccagca

SEQ ID NO: 1615221 - RNA, 16 nt, Pseudomonas putida KT2440
caaguugacccugaau

SEQ ID NO: 1615222 - RNA, 11 nt, Pseudomonas putida KT2440
caaugcccagc

SEQ ID NO: 1615223 - RNA, 15 nt, Pseudomonas putida KT2440
caaugccaguugauc

SEQ ID NO: 1615224 - RNA, 14 nt, Pseudomonas putida KT2440
caaugcacagcgcu

SEQ ID NO: 1615225 - RNA, 19 nt, Pseudomonas putida KT2440
caaugcagcuuugaggcuc

SEQ ID NO: 1615226 - RNA, 19 nt, Pseudomonas putida KT2440
caaugcaauguuuucauac

SEQ ID NO: 1615227 - RNA, 24 nt, Pseudomonas putida KT2440
caaugcacuucugcuaaucgcugc

SEQ ID NO: 1615228 - RNA, 14 nt, Pseudomonas putida KT2440
caaucuucuucauc

SEQ ID NO: 1615229 - RNA, 22 nt, Pseudomonas putida KT2440
caaucuucuucaucacuagauc

SEQ ID NO: 1615230 - RNA, 13 nt, Pseudomonas putida KT2440
caaucuucuugcc

SEQ ID NO: 1615231 - RNA, 21 nt, Pseudomonas putida KT2440
caaugaugcguacggccuugg

SEQ ID NO: 1615232 - RNA, 17 nt, Pseudomonas putida KT2440
caaugauccgguccagu

SEQ ID NO: 1615233 - RNA, 15 nt, Pseudomonas putida KT2440
caaugaucgggcaga

SEQ ID NO: 1615234 - RNA, 22 nt, Pseudomonas putida KT2440
caaugaucgggcagacgacccg

SEQ ID NO: 1615235 - RNA, 13 nt, Pseudomonas putida KT2440
caauccucugccc

SEQ ID NO: 1615236 - RNA, 15 nt, Pseudomonas putida KT2440
caaucgccgccugga

SEQ ID NO: 1615237 - RNA, 20 nt, Pseudomonas putida KT2440
caaucgccgggcgcaccaca

SEQ ID NO: 1615238 - RNA, 17 nt, Pseudomonas putida KT2440
caaucgcugugcaacag

SEQ ID NO: 1615239 - RNA, 23 nt, Pseudomonas putida KT2440
caaucggcgccaggaucgagacc

SEQ ID NO: 1615240 - RNA, 21 nt, Pseudomonas putida KT2440
caaucggugccggcgagugca

SEQ ID NO: 1615241 - RNA, 23 nt, Pseudomonas putida KT2440
caaucggugccggcgagugcauu

SEQ ID NO: 1615242 - RNA, 14 nt, Pseudomonas putida KT2440
caaucggguaaaac

SEQ ID NO: 1615243 - RNA, 14 nt, Pseudomonas putida KT2440
caaucauauacauc

SEQ ID NO: 1615244 - RNA, 19 nt, Pseudomonas putida KT2440
caaucaucggcaguagagc

SEQ ID NO: 1615245 - RNA, 18 nt, Pseudomonas putida KT2440
caacccgcauuccuucug

SEQ ID NO: 1615246 - RNA, 22 nt, Pseudomonas putida KT2440
caacccgauuucgcuggggcug

SEQ ID NO: 1615247 - RNA, 21 nt, Pseudomonas putida KT2440
caaccgacggguuacccuggu

SEQ ID NO: 1615248 - RNA, 19 nt, Pseudomonas putida KT2440
caacccggccuuggccgcu

SEQ ID NO: 1615249 - RNA, 17 nt, Pseudomonas putida KT2440
caaccgauagcgugaag

SEQ ID NO: 1615250 - RNA, 18 nt, Pseudomonas putida KT2440
caaccgaugcccaggccc

SEQ ID NO: 1615251 - RNA, 15 nt, Pseudomonas putida KT2440
caaccccagcgcauu

SEQ ID NO: 1615252 - RNA, 14 nt, Pseudomonas putida KT2440
caaccccaucaccu

SEQ ID NO: 1615253 - RNA, 22 nt, Pseudomonas putida KT2440
caaccccagcccgaagccggca

SEQ ID NO: 1615254 - RNA, 14 nt, Pseudomonas putida KT2440
caaccccgucgccu

SEQ ID NO: 1615255 - RNA, 12 nt, Pseudomonas putida KT2440
caaccccuggaa

SEQ ID NO: 1615256 - RNA, 14 nt, Pseudomonas putida KT2440
caaccccuggaaac

SEQ ID NO: 1615257 - RNA, 17 nt, Pseudomonas putida KT2440
caaccccuggaaacccu

SEQ ID NO: 1615258 - RNA, 12 nt, Pseudomonas putida KT2440
caaccacugcaa

SEQ ID NO: 1615259 - RNA, 18 nt, Pseudomonas putida KT2440
caaccaccaacagcaccg

SEQ ID NO: 1615260 - RNA, 17 nt, Pseudomonas putida KT2440
caaccacgccugcgccg

SEQ ID NO: 1615261 - RNA, 15 nt, Pseudomonas putida KT2440
caaccacgcuuggcu

SEQ ID NO: 1615262 - RNA, 20 nt, Pseudomonas putida KT2440
caaccacgguggugguuugu

SEQ ID NO: 1615263 - RNA, 21 nt, Pseudomonas putida KT2440
caaccaccgaccuguguccac

SEQ ID NO: 1615264 - RNA, 13 nt, Pseudomonas putida KT2440
caaccacagcccg

SEQ ID NO: 1615265 - RNA, 18 nt, Pseudomonas putida KT2440
caacagcuucuugcaccg

SEQ ID NO: 1615266 - RNA, 14 nt, Pseudomonas putida KT2440
caacaggaacagcg

SEQ ID NO: 1615267 - RNA, 15 nt, Pseudomonas putida KT2440
caacaggcucuccau

SEQ ID NO: 1615268 - RNA, 17 nt, Pseudomonas putida KT2440
caacauaaggugcaaag

SEQ ID NO: 1615269 - RNA, 16 nt, Pseudomonas putida KT2440
caaccaaaggaggcug

SEQ ID NO: 1615270 - RNA, 16 nt, Pseudomonas putida KT2440
caaccaagcgaacuau

SEQ ID NO: 1615271 - RNA, 15 nt, Pseudomonas putida KT2440
caaccaauccccccu

SEQ ID NO: 1615272 - RNA, 19 nt, Pseudomonas putida KT2440
caaccugaacaaggccugg

SEQ ID NO: 1615273 - RNA, 23 nt, Pseudomonas putida KT2440
caaccugaacaaggccuggccca

SEQ ID NO: 1615274 - RNA, 12 nt, Pseudomonas putida KT2440
caaccugccgau

SEQ ID NO: 1615275 - RNA, 16 nt, Pseudomonas putida KT2440
caaccgccccacccau

SEQ ID NO: 1615276 - RNA, 13 nt, Pseudomonas putida KT2440
caaccuugaccac

SEQ ID NO: 1615277 - RNA, 18 nt, Pseudomonas putida KT2440
caaccuugaccaccaggg

SEQ ID NO: 1615278 - RNA, 13 nt, Pseudomonas putida KT2440
caaccuuccagca

SEQ ID NO: 1615279 - RNA, 23 nt, Pseudomonas putida KT2440
caaccgcugcauggccuggcaaa

SEQ ID NO: 1615280 - RNA, 17 nt, Pseudomonas putida KT2440
caaccuguuccggccuc

SEQ ID NO: 1615281 - RNA, 16 nt, Pseudomonas putida KT2440
caaccugggugugccg

SEQ ID NO: 1615282 - RNA, 20 nt, Pseudomonas putida KT2440
caaccugggcaaccacaugg

SEQ ID NO: 1615283 - RNA, 13 nt, Pseudomonas putida KT2440
caaccugcucgcu

SEQ ID NO: 1615284 - RNA, 14 nt, Pseudomonas putida KT2440
caacgaacggaaca

SEQ ID NO: 1615285 - RNA, 12 nt, Pseudomonas putida KT2440
caacgaaaucau

SEQ ID NO: 1615286 - RNA, 14 nt, Pseudomonas putida KT2440
caacgcagccagga

SEQ ID NO: 1615287 - RNA, 14 nt, Pseudomonas putida KT2440
caacgcagccggca

SEQ ID NO: 1615288 - RNA, 15 nt, Pseudomonas putida KT2440
caacgcacccgccuc

SEQ ID NO: 1615289 - RNA, 19 nt, Pseudomonas putida KT2440
caacgauuggcaguccuga

SEQ ID NO: 1615290 - RNA, 18 nt, Pseudomonas putida KT2440
caacgcaaauccuccugc

SEQ ID NO: 1615291 - RNA, 14 nt, Pseudomonas putida KT2440
caacgcaaugggca

SEQ ID NO: 1615292 - RNA, 18 nt, Pseudomonas putida KT2440
caacgaaucagccagccu

SEQ ID NO: 1615293 - RNA, 15 nt, Pseudomonas putida KT2440
caacaccgccagcgg

SEQ ID NO: 1615294 - RNA, 22 nt, Pseudomonas putida KT2440
caacaccgcccccaaaccgcug

SEQ ID NO: 1615295 - RNA, 21 nt, Pseudomonas putida KT2440
caacaccuccacgccaccgcg

SEQ ID NO: 1615296 - RNA, 17 nt, Pseudomonas putida KT2440
caacaccugccgcagcu

SEQ ID NO: 1615297 - RNA, 16 nt, Pseudomonas putida KT2440
caacaccuucucggcc

SEQ ID NO: 1615298 - RNA, 16 nt, Pseudomonas putida KT2440
caacacggcagaggcg

SEQ ID NO: 1615299 - RNA, 15 nt, Pseudomonas putida KT2440
caacagcucaacccg

SEQ ID NO: 1615300 - RNA, 13 nt, Pseudomonas putida KT2440
caacagcucaucc

SEQ ID NO: 1615301 - RNA, 13 nt, Pseudomonas putida KT2440
caacagaccaccu

SEQ ID NO: 1615302 - RNA, 14 nt, Pseudomonas putida KT2440
caacagaccaccug

SEQ ID NO: 1615303 - RNA, 18 nt, Pseudomonas putida KT2440
caacagaccaccugccaa

SEQ ID NO: 1615304 - RNA, 19 nt, Pseudomonas putida KT2440
caacacggugaugcgcccu

SEQ ID NO: 1615305 - RNA, 23 nt, Pseudomonas putida KT2440
caacacugucccgaucagguuca

SEQ ID NO: 1615306 - RNA, 21 nt, Pseudomonas putida KT2440
caacaauuuucgaccaaggcu

SEQ ID NO: 1615307 - RNA, 20 nt, Pseudomonas putida KT2440
caacaaucgcgucagcaccg

SEQ ID NO: 1615308 - RNA, 22 nt, Pseudomonas putida KT2440
caacaacguggcgcggcccccu

SEQ ID NO: 1615309 - RNA, 22 nt, Pseudomonas putida KT2440
caacaacuggaucuucucuucc

SEQ ID NO: 1615310 - RNA, 19 nt, Pseudomonas putida KT2440
caacaaggccaaccacgcc

SEQ ID NO: 1615311 - RNA, 15 nt, Pseudomonas putida KT2440
caacaaggacugccu

SEQ ID NO: 1615312 - RNA, 17 nt, Pseudomonas putida KT2440
caacaaggacugccuga

SEQ ID NO: 1615313 - RNA, 22 nt, Pseudomonas putida KT2440
caacaaggacugccugaucacc

SEQ ID NO: 1615314 - RNA, 19 nt, Pseudomonas putida KT2440
caacaagucuuccccuugg

SEQ ID NO: 1615315 - RNA, 19 nt, Pseudomonas putida KT2440
caacaacccgcccaauuug

SEQ ID NO: 1615316 - RNA, 16 nt, Pseudomonas putida KT2440
caacaacagucaacaa

SEQ ID NO: 1615317 - RNA, 11 nt, Pseudomonas putida KT2440
caacaaccugg

SEQ ID NO: 1615318 - RNA, 18 nt, Pseudomonas putida KT2440
caacaaccuggccgggcu

SEQ ID NO: 1615319 - RNA, 22 nt, Pseudomonas putida KT2440
caacaacgacuggucauacucc

SEQ ID NO: 1615320 - RNA, 19 nt, Pseudomonas putida KT2440
caacaaccaauccccccuc

SEQ ID NO: 1615321 - RNA, 12 nt, Pseudomonas putida KT2440
caaaugcuggca

SEQ ID NO: 1615322 - RNA, 15 nt, Pseudomonas putida KT2440
caaaugcgcccugcu

SEQ ID NO: 1615323 - RNA, 17 nt, Pseudomonas putida KT2440
caaaugcgcccugcugc

SEQ ID NO: 1615324 - RNA, 18 nt, Pseudomonas putida KT2440
caaaugcgcccugcugcc

SEQ ID NO: 1615325 - RNA, 21 nt, Pseudomonas putida KT2440
caaauagaugcaggugggauu

SEQ ID NO: 1615326 - RNA, 16 nt, Pseudomonas putida KT2440
caaagcagccccaggg

SEQ ID NO: 1615327 - RNA, 23 nt, Pseudomonas putida KT2440
caaagcagacagcugugcugcca

SEQ ID NO: 1615328 - RNA, 11 nt, Pseudomonas putida KT2440
caaagcaccau

SEQ ID NO: 1615329 - RNA, 14 nt, Pseudomonas putida KT2440
caaagcucaaaugc

SEQ ID NO: 1615330 - RNA, 17 nt, Pseudomonas putida KT2440
caaagcucaaaugcugg

SEQ ID NO: 1615331 - RNA, 19 nt, Pseudomonas putida KT2440
caaacugcugagucagcuu

SEQ ID NO: 1615332 - RNA, 14 nt, Pseudomonas putida KT2440
caaacuccacugug

SEQ ID NO: 1615333 - RNA, 14 nt, Pseudomonas putida KT2440
caaauaccccaggc

SEQ ID NO: 1615334 - RNA, 15 nt, Pseudomonas putida KT2440
caaagguggcaccgc

SEQ ID NO: 1615335 - RNA, 17 nt, Pseudomonas putida KT2440
caaagguggcaccgccg

SEQ ID NO: 1615336 - RNA, 17 nt, Pseudomonas putida KT2440
caaaguggaaggcaucg

SEQ ID NO: 1615337 - RNA, 18 nt, Pseudomonas putida KT2440
caaaaccaccagccgugg

SEQ ID NO: 1615338 - RNA, 16 nt, Pseudomonas putida KT2440
caaaacccuucucuuc

SEQ ID NO: 1615339 - RNA, 15 nt, Pseudomonas putida KT2440
caaaaucacaggcca

SEQ ID NO: 1615340 - RNA, 16 nt, Pseudomonas putida KT2440
caaaaucacaggccau

SEQ ID NO: 1615341 - RNA, 15 nt, Pseudomonas putida KT2440
caaacacauccagcg

SEQ ID NO: 1615342 - RNA, 18 nt, Pseudomonas putida KT2440
caaacacauccagcgccg

SEQ ID NO: 1615343 - RNA, 23 nt, Pseudomonas putida KT2440
caaacgaugcgggcuuucucauc

SEQ ID NO: 1615344 - RNA, 22 nt, Pseudomonas putida KT2440
caaacgccgggcacaucaccag

SEQ ID NO: 1615345 - RNA, 12 nt, Pseudomonas putida KT2440
caaacgccgcuc

SEQ ID NO: 1615346 - RNA, 23 nt, Pseudomonas putida KT2440
caaaccccuucauagaacuuaaa

SEQ ID NO: 1615347 - RNA, 14 nt, Pseudomonas putida KT2440
caaacccgacaaca

SEQ ID NO: 1615348 - RNA, 20 nt, Pseudomonas putida KT2440
caaacccgcgccuacaggca

SEQ ID NO: 1615349 - RNA, 20 nt, Pseudomonas putida KT2440
caaacccggccagcagguca

SEQ ID NO: 1615350 - RNA, 15 nt, Pseudomonas putida KT2440
caaacagcaccagcc

SEQ ID NO: 1615351 - RNA, 16 nt, Pseudomonas putida KT2440
caaacagcaccagccc

SEQ ID NO: 1615352 - RNA, 11 nt, Pseudomonas putida KT2440
caaacagcauc

SEQ ID NO: 1615353 - RNA, 14 nt, Pseudomonas putida KT2440
caaacagccgccca

SEQ ID NO: 1615354 - RNA, 19 nt, Pseudomonas putida KT2440
caaacagccgcccaguucc

SEQ ID NO: 1615355 - RNA, 20 nt, Pseudomonas putida KT2440
caaacaggcugauguugaug

SEQ ID NO: 1615356 - RNA, 16 nt, Pseudomonas putida KT2440
cacgguccaucaggug

SEQ ID NO: 1615357 - RNA, 21 nt, Pseudomonas putida KT2440
cacggugacaaaggccggcac

SEQ ID NO: 1615358 - RNA, 23 nt, Pseudomonas putida KT2440
cacggucggccugcgcuccagca

SEQ ID NO: 1615359 - RNA, 19 nt, Pseudomonas putida KT2440
cacgguguccgccgccguc

SEQ ID NO: 1615360 - RNA, 15 nt, Pseudomonas putida KT2440
cacguagugcuucug

SEQ ID NO: 1615361 - RNA, 18 nt, Pseudomonas putida KT2440
cacguaccuggcugcagu

SEQ ID NO: 1615362 - RNA, 14 nt, Pseudomonas putida KT2440
cacguagaacaggc

SEQ ID NO: 1615363 - RNA, 19 nt, Pseudomonas putida KT2440
cacgguuuuauaccggcuc

SEQ ID NO: 1615364 - RNA, 16 nt, Pseudomonas putida KT2440
cacgguuggcgaucca

SEQ ID NO: 1615365 - RNA, 17 nt, Pseudomonas putida KT2440
cacggugucggacaggu

SEQ ID NO: 1615366 - RNA, 12 nt, Pseudomonas putida KT2440
cacgucacccac

SEQ ID NO: 1615367 - RNA, 21 nt, Pseudomonas putida KT2440
cacgcucuguaucgaacaggc

SEQ ID NO: 1615368 - RNA, 20 nt, Pseudomonas putida KT2440
cacgcucguuguccagcagc

SEQ ID NO: 1615369 - RNA, 23 nt, Pseudomonas putida KT2440
cacgcugcggcgaaagccagcag

SEQ ID NO: 1615370 - RNA, 22 nt, Pseudomonas putida KT2440
cacgcugaucugaaaguucagc

SEQ ID NO: 1615371 - RNA, 16 nt, Pseudomonas putida KT2440
cacgcugccaggaccg

SEQ ID NO: 1615372 - RNA, 14 nt, Pseudomonas putida KT2440
cacgcuugagcgcg

SEQ ID NO: 1615373 - RNA, 17 nt, Pseudomonas putida KT2440
cacgcuugagcgcgccg

SEQ ID NO: 1615374 - RNA, 19 nt, Pseudomonas putida KT2440
cacgcuugagcgcgccgcc

SEQ ID NO: 1615375 - RNA, 16 nt, Pseudomonas putida KT2440
cacgcuugccaaggcu

SEQ ID NO: 1615376 - RNA, 14 nt, Pseudomonas putida KT2440
cacgcuuucacaaa

SEQ ID NO: 1615377 - RNA, 19 nt, Pseudomonas putida KT2440
cacgcuugucuuccagcug

SEQ ID NO: 1615378 - RNA, 22 nt, Pseudomonas putida KT2440
cacgcuuuucagggguucgccc

SEQ ID NO: 1615379 - RNA, 23 nt, Pseudomonas putida KT2440
cacggaagaucaccuggucgacc

SEQ ID NO: 1615380 - RNA, 20 nt, Pseudomonas putida KT2440
cacggcagcaaucgccgccu

SEQ ID NO: 1615381 - RNA, 17 nt, Pseudomonas putida KT2440
cacggccauccugcugu

SEQ ID NO: 1615382 - RNA, 17 nt, Pseudomonas putida KT2440
cacggccaccauguacu

SEQ ID NO: 1615383 - RNA, 17 nt, Pseudomonas putida KT2440
cacggcgugcuccacaa

SEQ ID NO: 1615384 - RNA, 18 nt, Pseudomonas putida KT2440
cacggcuaaagccgcacc

SEQ ID NO: 1615385 - RNA, 21 nt, Pseudomonas putida KT2440
cacggcugcccugcauggcau

SEQ ID NO: 1615386 - RNA, 13 nt, Pseudomonas putida KT2440
cacgacgauggcc

SEQ ID NO: 1615387 - RNA, 19 nt, Pseudomonas putida KT2440
cacgauaccggcgccgccc

SEQ ID NO: 1615388 - RNA, 14 nt, Pseudomonas putida KT2440
cacgaaggccagca

SEQ ID NO: 1615389 - RNA, 20 nt, Pseudomonas putida KT2440
cacgaacuuguuggccacca

SEQ ID NO: 1615390 - RNA, 23 nt, Pseudomonas putida KT2440
cacgaacuuguuggccaccaucg

SEQ ID NO: 1615391 - RNA, 13 nt, Pseudomonas putida KT2440
caccuucgccagg

SEQ ID NO: 1615392 - RNA, 14 nt, Pseudomonas putida KT2440
caccugccgcagcu

SEQ ID NO: 1615393 - RNA, 20 nt, Pseudomonas putida KT2440
caccugccgcgauaagcgcg

SEQ ID NO: 1615394 - RNA, 15 nt, Pseudomonas putida KT2440
caccugcccgcccuc

SEQ ID NO: 1615395 - RNA, 14 nt, Pseudomonas putida KT2440
caccugccagcccc

SEQ ID NO: 1615396 - RNA, 15 nt, Pseudomonas putida KT2440
caccugccagccccg

SEQ ID NO: 1615397 - RNA, 18 nt, Pseudomonas putida KT2440
caccugcggcaggugggu

SEQ ID NO: 1615398 - RNA, 14 nt, Pseudomonas putida KT2440
caccuuggcccuuc

SEQ ID NO: 1615399 - RNA, 16 nt, Pseudomonas putida KT2440
caccuuguccagcagg

SEQ ID NO: 1615400 - RNA, 20 nt, Pseudomonas putida KT2440
caccuugaugcgcgagcugg

SEQ ID NO: 1615401 - RNA, 21 nt, Pseudomonas putida KT2440
caccuugcuggaacugcugca

SEQ ID NO: 1615402 - RNA, 13 nt, Pseudomonas putida KT2440
caccuugccuggg

SEQ ID NO: 1615403 - RNA, 13 nt, Pseudomonas putida KT2440
caccuugugcacg

SEQ ID NO: 1615404 - RNA, 17 nt, Pseudomonas putida KT2440
caccuuuuccacuugca

SEQ ID NO: 1615405 - RNA, 18 nt, Pseudomonas putida KT2440
cacgccgcugguacaggg

SEQ ID NO: 1615406 - RNA, 22 nt, Pseudomonas putida KT2440
cacgcccgcgugcuucaagcca

SEQ ID NO: 1615407 - RNA, 17 nt, Pseudomonas putida KT2440
cacgcccgcucccacag

SEQ ID NO: 1615408 - RNA, 19 nt, Pseudomonas putida KT2440
cacgcccgcucccacaggc

SEQ ID NO: 1615409 - RNA, 18 nt, Pseudomonas putida KT2440
cacgcccgcugcaugcuc

SEQ ID NO: 1615410 - RNA, 17 nt, Pseudomonas putida KT2440
cacgcccaucaggaaca

SEQ ID NO: 1615411 - RNA, 12 nt, Pseudomonas putida KT2440
cacgcccaggcg

SEQ ID NO: 1615412 - RNA, 20 nt, Pseudomonas putida KT2440
cacgcccgaccggucggcca

SEQ ID NO: 1615413 - RNA, 15 nt, Pseudomonas putida KT2440
cacgcccaaccccag

SEQ ID NO: 1615414 - RNA, 19 nt, Pseudomonas putida KT2440
cacgccaaucaccugcaca

SEQ ID NO: 1615415 - RNA, 13 nt, Pseudomonas putida KT2440
cacgccagccguu

SEQ ID NO: 1615416 - RNA, 13 nt, Pseudomonas putida KT2440
cacgaucagcagc

SEQ ID NO: 1615417 - RNA, 17 nt, Pseudomonas putida KT2440
cacgcaugcgcgacagc

SEQ ID NO: 1615418 - RNA, 19 nt, Pseudomonas putida KT2440
cacgcauguccuuggccca

SEQ ID NO: 1615419 - RNA, 20 nt, Pseudomonas putida KT2440
cacgcauguccuuggcccag

SEQ ID NO: 1615420 - RNA, 19 nt, Pseudomonas putida KT2440
cacgcaggcccagcaggua

SEQ ID NO: 1615421 - RNA, 15 nt, Pseudomonas putida KT2440
caccgguuuguccug

SEQ ID NO: 1615422 - RNA, 15 nt, Pseudomonas putida KT2440
caccgguuacaccca

SEQ ID NO: 1615423 - RNA, 21 nt, Pseudomonas putida KT2440
caccguaaggaaaaucagcua

SEQ ID NO: 1615424 - RNA, 18 nt, Pseudomonas putida KT2440
caccgguaucgaugcaca

SEQ ID NO: 1615425 - RNA, 23 nt, Pseudomonas putida KT2440
caccgggcuggcauaguccagga

SEQ ID NO: 1615426 - RNA, 16 nt, Pseudomonas putida KT2440
caccggccacgcgcag

SEQ ID NO: 1615427 - RNA, 16 nt, Pseudomonas putida KT2440
caccggccgccgccag

SEQ ID NO: 1615428 - RNA, 20 nt, Pseudomonas putida KT2440
caccggccgccgccagacca

SEQ ID NO: 1615429 - RNA, 13 nt, Pseudomonas putida KT2440
caccggccgaccc

SEQ ID NO: 1615430 - RNA, 21 nt, Pseudomonas putida KT2440
caccggccgacccgccuggug

SEQ ID NO: 1615431 - RNA, 12 nt, Pseudomonas putida KT2440
caccggccgcca

SEQ ID NO: 1615432 - RNA, 19 nt, Pseudomonas putida KT2440
caccggcgaguccugccuu

SEQ ID NO: 1615433 - RNA, 20 nt, Pseudomonas putida KT2440
caccggcgaguccugccuuc

SEQ ID NO: 1615434 - RNA, 17 nt, Pseudomonas putida KT2440
caccggcgaacagcaau

SEQ ID NO: 1615435 - RNA, 15 nt, Pseudomonas putida KT2440
caccggaguccccac

SEQ ID NO: 1615436 - RNA, 21 nt, Pseudomonas putida KT2440
caccggcaaucgacucaagga

SEQ ID NO: 1615437 - RNA, 16 nt, Pseudomonas putida KT2440
caccggccccccagcc

SEQ ID NO: 1615438 - RNA, 12 nt, Pseudomonas putida KT2440
caccggccagca

SEQ ID NO: 1615439 - RNA, 12 nt, Pseudomonas putida KT2440
caccggccaggc

SEQ ID NO: 1615440 - RNA, 15 nt, Pseudomonas putida KT2440
caccugcaacaccuc

SEQ ID NO: 1615441 - RNA, 17 nt, Pseudomonas putida KT2440
caccugcaacaccucca

SEQ ID NO: 1615442 - RNA, 19 nt, Pseudomonas putida KT2440
caccugcacaucggccacc

SEQ ID NO: 1615443 - RNA, 14 nt, Pseudomonas putida KT2440
caccugaugcacca

SEQ ID NO: 1615444 - RNA, 14 nt, Pseudomonas putida KT2440
caccugacgcgcca

SEQ ID NO: 1615445 - RNA, 18 nt, Pseudomonas putida KT2440
caccugacacauaggcag

SEQ ID NO: 1615446 - RNA, 20 nt, Pseudomonas putida KT2440
caccugacacauaggcagcc

SEQ ID NO: 1615447 - RNA, 22 nt, Pseudomonas putida KT2440
caccugacacauaggcagccac

SEQ ID NO: 1615448 - RNA, 24 nt, Pseudomonas putida KT2440
caccugacacauaggcagccaccu

SEQ ID NO: 1615449 - RNA, 16 nt, Pseudomonas putida KT2440
caccugaccaucagcc

SEQ ID NO: 1615450 - RNA, 18 nt, Pseudomonas putida KT2440
caccugaccaucagccug

SEQ ID NO: 1615451 - RNA, 16 nt, Pseudomonas putida KT2440
caccugaccauuggcc

SEQ ID NO: 1615452 - RNA, 16 nt, Pseudomonas putida KT2440
caccucguaaggccug

SEQ ID NO: 1615453 - RNA, 15 nt, Pseudomonas putida KT2440
caccucgucaugcag

SEQ ID NO: 1615454 - RNA, 18 nt, Pseudomonas putida KT2440
caccucuaucaccuguuc

SEQ ID NO: 1615455 - RNA, 19 nt, Pseudomonas putida KT2440
caccucuaucaccuguucc

SEQ ID NO: 1615456 - RNA, 22 nt, Pseudomonas putida KT2440
caccucuaucaccuguuccccc

SEQ ID NO: 1615457 - RNA, 15 nt, Pseudomonas putida KT2440
caccucggcaccgca

SEQ ID NO: 1615458 - RNA, 21 nt, Pseudomonas putida KT2440
caccucgggcuuggcacgcug

SEQ ID NO: 1615459 - RNA, 15 nt, Pseudomonas putida KT2440
caccuccugcacaua

SEQ ID NO: 1615460 - RNA, 18 nt, Pseudomonas putida KT2440
caccucgaccgcacccgc

SEQ ID NO: 1615461 - RNA, 18 nt, Pseudomonas putida KT2440
caccucgacccccuugcc

SEQ ID NO: 1615462 - RNA, 14 nt, Pseudomonas putida KT2440
caccucgacccgcc

SEQ ID NO: 1615463 - RNA, 15 nt, Pseudomonas putida KT2440
caccgugcaccagca

SEQ ID NO: 1615464 - RNA, 16 nt, Pseudomonas putida KT2440
caccgugcaccagcac

SEQ ID NO: 1615465 - RNA, 20 nt, Pseudomonas putida KT2440
caccgugcaccagcaccacc

SEQ ID NO: 1615466 - RNA, 14 nt, Pseudomonas putida KT2440
caccgugcuguguu

SEQ ID NO: 1615467 - RNA, 16 nt, Pseudomonas putida KT2440
caccgaagcuugcagu

SEQ ID NO: 1615468 - RNA, 20 nt, Pseudomonas putida KT2440
caccgaaguucagcacgggc

SEQ ID NO: 1615469 - RNA, 24 nt, Pseudomonas putida KT2440
caccgaaguucagcacgggcagcu

SEQ ID NO: 1615470 - RNA, 18 nt, Pseudomonas putida KT2440
caccgaucagcggcgcca

SEQ ID NO: 1615471 - RNA, 16 nt, Pseudomonas putida KT2440
caccgaugcugugccg

SEQ ID NO: 1615472 - RNA, 15 nt, Pseudomonas putida KT2440
caccgauggaauagg

SEQ ID NO: 1615473 - RNA, 16 nt, Pseudomonas putida KT2440
caccgcaaaucacuga

SEQ ID NO: 1615474 - RNA, 23 nt, Pseudomonas putida KT2440
caccgcaaaucacugacccgcuu

SEQ ID NO: 1615475 - RNA, 18 nt, Pseudomonas putida KT2440
caccgcaagcugcaccgc

SEQ ID NO: 1615476 - RNA, 22 nt, Pseudomonas putida KT2440
caccgcacaggcauaccgcaac

SEQ ID NO: 1615477 - RNA, 21 nt, Pseudomonas putida KT2440
caccgccagaaaauucucccg

SEQ ID NO: 1615478 - RNA, 12 nt, Pseudomonas putida KT2440
caccgccagccc

SEQ ID NO: 1615479 - RNA, 16 nt, Pseudomonas putida KT2440
caccgccagcccgcca

SEQ ID NO: 1615480 - RNA, 16 nt, Pseudomonas putida KT2440
caccgccgccccgcac

SEQ ID NO: 1615481 - RNA, 19 nt, Pseudomonas putida KT2440
caccgccgcccacgccggc

SEQ ID NO: 1615482 - RNA, 14 nt, Pseudomonas putida KT2440
caccgccccagcgc

SEQ ID NO: 1615483 - RNA, 18 nt, Pseudomonas putida KT2440
caccgccccagcgcgcca

SEQ ID NO: 1615484 - RNA, 21 nt, Pseudomonas putida KT2440
caccgcccccaaaccgcugcc

SEQ ID NO: 1615485 - RNA, 12 nt, Pseudomonas putida KT2440
caccgccagggu

SEQ ID NO: 1615486 - RNA, 17 nt, Pseudomonas putida KT2440
caccgcgcaacgcgcca

SEQ ID NO: 1615487 - RNA, 15 nt, Pseudomonas putida KT2440
cacccaccagccaaa

SEQ ID NO: 1615488 - RNA, 13 nt, Pseudomonas putida KT2440
cacccacacccgc

SEQ ID NO: 1615489 - RNA, 12 nt, Pseudomonas putida KT2440
cacccacaccuc

SEQ ID NO: 1615490 - RNA, 16 nt, Pseudomonas putida KT2440
cacccacaccucgacc

SEQ ID NO: 1615491 - RNA, 18 nt, Pseudomonas putida KT2440
cacccacagagacaccgc

SEQ ID NO: 1615492 - RNA, 20 nt, Pseudomonas putida KT2440
cacccacagagacaccgcag

SEQ ID NO: 1615493 - RNA, 16 nt, Pseudomonas putida KT2440
cacccacagcgccugc

SEQ ID NO: 1615494 - RNA, 19 nt, Pseudomonas putida KT2440
cacccacaggcacgacuga

SEQ ID NO: 1615495 - RNA, 23 nt, Pseudomonas putida KT2440
caccccuuuacuggccauccagu

SEQ ID NO: 1615496 - RNA, 23 nt, Pseudomonas putida KT2440
caccccucggcucacgccccgug

SEQ ID NO: 1615497 - RNA, 13 nt, Pseudomonas putida KT2440
caccccugccacc

SEQ ID NO: 1615498 - RNA, 15 nt, Pseudomonas putida KT2440
caccccguggccccg

SEQ ID NO: 1615499 - RNA, 16 nt, Pseudomonas putida KT2440
cacccgaacaaaaccc

SEQ ID NO: 1615500 - RNA, 18 nt, Pseudomonas putida KT2440
cacccgaacaaaacccuu

SEQ ID NO: 1615501 - RNA, 22 nt, Pseudomonas putida KT2440
cacccgaccagaucaggccgcu

SEQ ID NO: 1615502 - RNA, 18 nt, Pseudomonas putida KT2440
cacccgacgccaccuucg

SEQ ID NO: 1615503 - RNA, 17 nt, Pseudomonas putida KT2440
cacccaaggcauccagc

SEQ ID NO: 1615504 - RNA, 15 nt, Pseudomonas putida KT2440
cacccggcgcgcagc

SEQ ID NO: 1615505 - RNA, 16 nt, Pseudomonas putida KT2440
cacccggaccagcgcc

SEQ ID NO: 1615506 - RNA, 14 nt, Pseudomonas putida KT2440
cacccgcuuguagc

SEQ ID NO: 1615507 - RNA, 24 nt, Pseudomonas putida KT2440
cacccgcguuugcaacuggcgcag

SEQ ID NO: 1615508 - RNA, 12 nt, Pseudomonas putida KT2440
caccccuuccag

SEQ ID NO: 1615509 - RNA, 17 nt, Pseudomonas putida KT2440
cacccgcaagcgccgau

SEQ ID NO: 1615510 - RNA, 17 nt, Pseudomonas putida KT2440
cacccgcgcguugcgga

SEQ ID NO: 1615511 - RNA, 18 nt, Pseudomonas putida KT2440
cacccucguaacgagccu

SEQ ID NO: 1615512 - RNA, 17 nt, Pseudomonas putida KT2440
cacccuuggucaggauc

SEQ ID NO: 1615513 - RNA, 14 nt, Pseudomonas putida KT2440
cacccucgcgcagc

SEQ ID NO: 1615514 - RNA, 15 nt, Pseudomonas putida KT2440
cacccucgcaccaca

SEQ ID NO: 1615515 - RNA, 18 nt, Pseudomonas putida KT2440
cacccucgcacuccgccc

SEQ ID NO: 1615516 - RNA, 13 nt, Pseudomonas putida KT2440
cacccucgccccg

SEQ ID NO: 1615517 - RNA, 16 nt, Pseudomonas putida KT2440
cacccucgccccgcgc

SEQ ID NO: 1615518 - RNA, 14 nt, Pseudomonas putida KT2440
cacccucaccaacu

SEQ ID NO: 1615519 - RNA, 19 nt, Pseudomonas putida KT2440
cacccucaccaacugccug

SEQ ID NO: 1615520 - RNA, 16 nt, Pseudomonas putida KT2440
caccagaccagcagca

SEQ ID NO: 1615521 - RNA, 12 nt, Pseudomonas putida KT2440
caccagcccguc

SEQ ID NO: 1615522 - RNA, 14 nt, Pseudomonas putida KT2440
caccagccguggca

SEQ ID NO: 1615523 - RNA, 15 nt, Pseudomonas putida KT2440
caccagccguggcaa

SEQ ID NO: 1615524 - RNA, 15 nt, Pseudomonas putida KT2440
caccagccccccuuc

SEQ ID NO: 1615525 - RNA, 18 nt, Pseudomonas putida KT2440
caccagcccgaagcgcag

SEQ ID NO: 1615526 - RNA, 19 nt, Pseudomonas putida KT2440
caccagcccgaagcgcagg

SEQ ID NO: 1615527 - RNA, 20 nt, Pseudomonas putida KT2440
caccagcucguucaacaccu

SEQ ID NO: 1615528 - RNA, 23 nt, Pseudomonas putida KT2440
caccagcucgcccggcacggcgu

SEQ ID NO: 1615529 - RNA, 15 nt, Pseudomonas putida KT2440
caccagcuugaugcu

SEQ ID NO: 1615530 - RNA, 16 nt, Pseudomonas putida KT2440
caccagcuugaugcug

SEQ ID NO: 1615531 - RNA, 15 nt, Pseudomonas putida KT2440
caccagcgcaccacu

SEQ ID NO: 1615532 - RNA, 17 nt, Pseudomonas putida KT2440
caccagcgcaccacugu

SEQ ID NO: 1615533 - RNA, 20 nt, Pseudomonas putida KT2440
caccaggaacaucgccguca

SEQ ID NO: 1615534 - RNA, 14 nt, Pseudomonas putida KT2440
caccaggcccagcc

SEQ ID NO: 1615535 - RNA, 18 nt, Pseudomonas putida KT2440
caccaggauugccgggcu

SEQ ID NO: 1615536 - RNA, 21 nt, Pseudomonas putida KT2440
caccaggcaccgaguaccguc

SEQ ID NO: 1615537 - RNA, 22 nt, Pseudomonas putida KT2440
caccaggacaagccgacaaaaa

SEQ ID NO: 1615538 - RNA, 14 nt, Pseudomonas putida KT2440
caccaggcgcggca

SEQ ID NO: 1615539 - RNA, 21 nt, Pseudomonas putida KT2440
caccaggcggucggccagcgg

SEQ ID NO: 1615540 - RNA, 18 nt, Pseudomonas putida KT2440
caccaggccgaucaccag

SEQ ID NO: 1615541 - RNA, 14 nt, Pseudomonas putida KT2440
caccaggccuuuga

SEQ ID NO: 1615542 - RNA, 21 nt, Pseudomonas putida KT2440
caccaggucgcggugcagcgg

SEQ ID NO: 1615543 - RNA, 20 nt, Pseudomonas putida KT2440
caccaguguagugaacaggc

SEQ ID NO: 1615544 - RNA, 22 nt, Pseudomonas putida KT2440
caccaguucguccucgacccac

SEQ ID NO: 1615545 - RNA, 15 nt, Pseudomonas putida KT2440
caccaguugcagguc

SEQ ID NO: 1615546 - RNA, 17 nt, Pseudomonas putida KT2440
caccaguuccuggcgcu

SEQ ID NO: 1615547 - RNA, 15 nt, Pseudomonas putida KT2440
caccaguucgccauc

SEQ ID NO: 1615548 - RNA, 23 nt, Pseudomonas putida KT2440
caccaguucauggcucacaccca

SEQ ID NO: 1615549 - RNA, 14 nt, Pseudomonas putida KT2440
caccaguuccaggg

SEQ ID NO: 1615550 - RNA, 16 nt, Pseudomonas putida KT2440
caccaucagagcgcca

SEQ ID NO: 1615551 - RNA, 15 nt, Pseudomonas putida KT2440
caccaucaggcacag

SEQ ID NO: 1615552 - RNA, 21 nt, Pseudomonas putida KT2440
caccaucaggcacaggccagc

SEQ ID NO: 1615553 - RNA, 18 nt, Pseudomonas putida KT2440
caccaucagccgcgggcu

SEQ ID NO: 1615554 - RNA, 21 nt, Pseudomonas putida KT2440
caccaucaucagacagaagcc

SEQ ID NO: 1615555 - RNA, 18 nt, Pseudomonas putida KT2440
caccaucgccaggccuuc

SEQ ID NO: 1615556 - RNA, 14 nt, Pseudomonas putida KT2440
caccaucggcucca

SEQ ID NO: 1615557 - RNA, 17 nt, Pseudomonas putida KT2440
caccaucggcuccagcg

SEQ ID NO: 1615558 - RNA, 18 nt, Pseudomonas putida KT2440
caccaucggcuccagcgc

SEQ ID NO: 1615559 - RNA, 23 nt, Pseudomonas putida KT2440
caccaucggugcggcccccuggu

SEQ ID NO: 1615560 - RNA, 20 nt, Pseudomonas putida KT2440
caccauggcuaagccaagcc

SEQ ID NO: 1615561 - RNA, 19 nt, Pseudomonas putida KT2440
caccaugcccacaggggcu

SEQ ID NO: 1615562 - RNA, 15 nt, Pseudomonas putida KT2440
caccaugcucggcca

SEQ ID NO: 1615563 - RNA, 23 nt, Pseudomonas putida KT2440
caccaugcucggccagcucgcca

SEQ ID NO: 1615564 - RNA, 20 nt, Pseudomonas putida KT2440
caccauguacugcagacagu

SEQ ID NO: 1615565 - RNA, 18 nt, Pseudomonas putida KT2440
caccaugaacagcacgcc

SEQ ID NO: 1615566 - RNA, 21 nt, Pseudomonas putida KT2440
caccaugaacucuuccccgcc

SEQ ID NO: 1615567 - RNA, 15 nt, Pseudomonas putida KT2440
caccaucuugcccag

SEQ ID NO: 1615568 - RNA, 14 nt, Pseudomonas putida KT2440
caccaucuccagcu

SEQ ID NO: 1615569 - RNA, 15 nt, Pseudomonas putida KT2440
caccacggcggcgau

SEQ ID NO: 1615570 - RNA, 22 nt, Pseudomonas putida KT2440
caccacggcggcgaucagcgcg

SEQ ID NO: 1615571 - RNA, 23 nt, Pseudomonas putida KT2440
caccacggucggccugcgcucca

SEQ ID NO: 1615572 - RNA, 22 nt, Pseudomonas putida KT2440
caccacgguggcugccacgggc

SEQ ID NO: 1615573 - RNA, 23 nt, Pseudomonas putida KT2440
caccaccggccgacccgccuggu

SEQ ID NO: 1615574 - RNA, 20 nt, Pseudomonas putida KT2440
caccacccuggcaugccccu

SEQ ID NO: 1615575 - RNA, 19 nt, Pseudomonas putida KT2440
caccacccggucggccagc

SEQ ID NO: 1615576 - RNA, 16 nt, Pseudomonas putida KT2440
caccacccccagcgcc

SEQ ID NO: 1615577 - RNA, 17 nt, Pseudomonas putida KT2440
caccaccgaccgcaccg

SEQ ID NO: 1615578 - RNA, 14 nt, Pseudomonas putida KT2440
caccaaucugugua

SEQ ID NO: 1615579 - RNA, 13 nt, Pseudomonas putida KT2440
cacauucuccagu

SEQ ID NO: 1615580 - RNA, 21 nt, Pseudomonas putida KT2440
caccaagcccuucucgcucag

SEQ ID NO: 1615581 - RNA, 13 nt, Pseudomonas putida KT2440
caccaacugccug

SEQ ID NO: 1615582 - RNA, 21 nt, Pseudomonas putida KT2440
caccaagucgauuuucacgcc

SEQ ID NO: 1615583 - RNA, 16 nt, Pseudomonas putida KT2440
cacaugcgccacaccc

SEQ ID NO: 1615584 - RNA, 20 nt, Pseudomonas putida KT2440
cacaugcgccacacccgcua

SEQ ID NO: 1615585 - RNA, 13 nt, Pseudomonas putida KT2440
cacaugcccgcgg

SEQ ID NO: 1615586 - RNA, 20 nt, Pseudomonas putida KT2440
cacaugcccgcggcucaccc

SEQ ID NO: 1615587 - RNA, 21 nt, Pseudomonas putida KT2440
cacaugcaaacccuggcccug

SEQ ID NO: 1615588 - RNA, 22 nt, Pseudomonas putida KT2440
cacaucuccacugcgccaaacc

SEQ ID NO: 1615589 - RNA, 15 nt, Pseudomonas putida KT2440
cacaugaagccgcgc

SEQ ID NO: 1615590 - RNA, 21 nt, Pseudomonas putida KT2440
cacaucggucggccccucgac

SEQ ID NO: 1615591 - RNA, 22 nt, Pseudomonas putida KT2440
cacaguucgaaaaccugcugac

SEQ ID NO: 1615592 - RNA, 21 nt, Pseudomonas putida KT2440
cacaguucauuguucuggcca

SEQ ID NO: 1615593 - RNA, 13 nt, Pseudomonas putida KT2440
cacaaagccuucc

SEQ ID NO: 1615594 - RNA, 16 nt, Pseudomonas putida KT2440
cacaaaccacagcggc

SEQ ID NO: 1615595 - RNA, 21 nt, Pseudomonas putida KT2440
cacaaaaccucaguuuuucuc

SEQ ID NO: 1615596 - RNA, 13 nt, Pseudomonas putida KT2440
cacaaaaccuucc

SEQ ID NO: 1615597 - RNA, 20 nt, Pseudomonas putida KT2440
cacaaaaaagcagggccgcg

SEQ ID NO: 1615598 - RNA, 19 nt, Pseudomonas putida KT2440
cacaggcuacgcagcaccc

SEQ ID NO: 1615599 - RNA, 20 nt, Pseudomonas putida KT2440
cacaggcuacgcagcacccg

SEQ ID NO: 1615600 - RNA, 15 nt, Pseudomonas putida KT2440
cacaggcgcacacgc

SEQ ID NO: 1615601 - RNA, 16 nt, Pseudomonas putida KT2440
cacaggcgcagcagcu

SEQ ID NO: 1615602 - RNA, 15 nt, Pseudomonas putida KT2440
cacaggcgccccggc

SEQ ID NO: 1615603 - RNA, 17 nt, Pseudomonas putida KT2440
cacaggcgcugaaacug

SEQ ID NO: 1615604 - RNA, 17 nt, Pseudomonas putida KT2440
cacaggcgcuugaagaa

SEQ ID NO: 1615605 - RNA, 18 nt, Pseudomonas putida KT2440
cacaggcgcuugaagaag

SEQ ID NO: 1615606 - RNA, 13 nt, Pseudomonas putida KT2440
cacaggcccagca

SEQ ID NO: 1615607 - RNA, 22 nt, Pseudomonas putida KT2440
cacaggcccagcaugaacgcag

SEQ ID NO: 1615608 - RNA, 16 nt, Pseudomonas putida KT2440
cacaggccgcgcauga

SEQ ID NO: 1615609 - RNA, 18 nt, Pseudomonas putida KT2440
cacaggggccgcgcagcc

SEQ ID NO: 1615610 - RNA, 19 nt, Pseudomonas putida KT2440
cacaggggaucgcgcaagc

SEQ ID NO: 1615611 - RNA, 21 nt, Pseudomonas putida KT2440
cacaggggaucgcgcaagccu

SEQ ID NO: 1615612 - RNA, 23 nt, Pseudomonas putida KT2440
cacagggcaaacaccuugccccg

SEQ ID NO: 1615613 - RNA, 17 nt, Pseudomonas putida KT2440
cacaggcuggccaccau

SEQ ID NO: 1615614 - RNA, 17 nt, Pseudomonas putida KT2440
cacagguaccaggcugc

SEQ ID NO: 1615615 - RNA, 15 nt, Pseudomonas putida KT2440
cacagguacugcgca

SEQ ID NO: 1615616 - RNA, 16 nt, Pseudomonas putida KT2440
cacagguaucgccgcc

SEQ ID NO: 1615617 - RNA, 23 nt, Pseudomonas putida KT2440
cacaggggcuguauagcccugcc

SEQ ID NO: 1615618 - RNA, 20 nt, Pseudomonas putida KT2440
cacagguaagucacaggcuu

SEQ ID NO: 1615619 - RNA, 21 nt, Pseudomonas putida KT2440
cacagguaagucacaggcuuc

SEQ ID NO: 1615620 - RNA, 22 nt, Pseudomonas putida KT2440
cacagugguguacagcaacacc

SEQ ID NO: 1615621 - RNA, 19 nt, Pseudomonas putida KT2440
cacaggugcagcacagguc

SEQ ID NO: 1615622 - RNA, 19 nt, Pseudomonas putida KT2440
cacagguccagcgcaggcu

SEQ ID NO: 1615623 - RNA, 20 nt, Pseudomonas putida KT2440
cacaggucucgaacgcugug

SEQ ID NO: 1615624 - RNA, 22 nt, Pseudomonas putida KT2440
cacaggucucgaacgcugugcc

SEQ ID NO: 1615625 - RNA, 16 nt, Pseudomonas putida KT2440
cacaggugacaagcug

SEQ ID NO: 1615626 - RNA, 19 nt, Pseudomonas putida KT2440
cacagguuuagcgcuggcu

SEQ ID NO: 1615627 - RNA, 21 nt, Pseudomonas putida KT2440
cacagguuuagcgcuggcuuu

SEQ ID NO: 1615628 - RNA, 14 nt, Pseudomonas putida KT2440
cacagcgccgcggc

SEQ ID NO: 1615629 - RNA, 16 nt, Pseudomonas putida KT2440
cacagcgccgcggcca

SEQ ID NO: 1615630 - RNA, 19 nt, Pseudomonas putida KT2440
cacagcgccugcugcugga

SEQ ID NO: 1615631 - RNA, 19 nt, Pseudomonas putida KT2440
cacagccuucaggguugug

SEQ ID NO: 1615632 - RNA, 12 nt, Pseudomonas putida KT2440
cacagccgugcc

SEQ ID NO: 1615633 - RNA, 14 nt, Pseudomonas putida KT2440
cacagcgagcagcc

SEQ ID NO: 1615634 - RNA, 15 nt, Pseudomonas putida KT2440
cacaggcacaggccc

SEQ ID NO: 1615635 - RNA, 18 nt, Pseudomonas putida KT2440
cacaggcacaggcccagc

SEQ ID NO: 1615636 - RNA, 17 nt, Pseudomonas putida KT2440
cacaggaaucaccagac

SEQ ID NO: 1615637 - RNA, 13 nt, Pseudomonas putida KT2440
cacaggaauggca

SEQ ID NO: 1615638 - RNA, 16 nt, Pseudomonas putida KT2440
cacaggaauggcacca

SEQ ID NO: 1615639 - RNA, 21 nt, Pseudomonas putida KT2440
cacagcgcggaacacacgcuc

SEQ ID NO: 1615640 - RNA, 22 nt, Pseudomonas putida KT2440
cacagcgcggaacacacgcucc

SEQ ID NO: 1615641 - RNA, 15 nt, Pseudomonas putida KT2440
cacagacaccacaaa

SEQ ID NO: 1615642 - RNA, 21 nt, Pseudomonas putida KT2440
cacagacaccacaaaaccuca

SEQ ID NO: 1615643 - RNA, 12 nt, Pseudomonas putida KT2440
cacaccacagcu

SEQ ID NO: 1615644 - RNA, 13 nt, Pseudomonas putida KT2440
cacaccacagcug

SEQ ID NO: 1615645 - RNA, 20 nt, Pseudomonas putida KT2440
cacaccacagcugcacaucu

SEQ ID NO: 1615646 - RNA, 15 nt, Pseudomonas putida KT2440
cacacaagccccccu

SEQ ID NO: 1615647 - RNA, 20 nt, Pseudomonas putida KT2440
cacaaauccaggacaaacca

SEQ ID NO: 1615648 - RNA, 17 nt, Pseudomonas putida KT2440
cacaauggcgcacaggg

SEQ ID NO: 1615649 - RNA, 18 nt, Pseudomonas putida KT2440
cacaccgcaacccagccc

SEQ ID NO: 1615650 - RNA, 13 nt, Pseudomonas putida KT2440
cacaccggcaauc

SEQ ID NO: 1615651 - RNA, 16 nt, Pseudomonas putida KT2440
cacaccggccgccagg

SEQ ID NO: 1615652 - RNA, 16 nt, Pseudomonas putida KT2440
cacacccagcgcggca

SEQ ID NO: 1615653 - RNA, 14 nt, Pseudomonas putida KT2440
cacacccggacccu

SEQ ID NO: 1615654 - RNA, 13 nt, Pseudomonas putida KT2440
cacacccgggccc

SEQ ID NO: 1615655 - RNA, 16 nt, Pseudomonas putida KT2440
cacaccacgccaaccu

SEQ ID NO: 1615656 - RNA, 15 nt, Pseudomonas putida KT2440
cacacccgccacgcu

SEQ ID NO: 1615657 - RNA, 17 nt, Pseudomonas putida KT2440
cacaccuggugcgccuu

SEQ ID NO: 1615658 - RNA, 15 nt, Pseudomonas putida KT2440
cacacucagccgcug

SEQ ID NO: 1615659 - RNA, 19 nt, Pseudomonas putida KT2440
cacacucuuugaggggcua

SEQ ID NO: 1615660 - RNA, 13 nt, Pseudomonas putida KT2440
cacacucgccccc

SEQ ID NO: 1615661 - RNA, 22 nt, Pseudomonas putida KT2440
cacacugcucgucaaaccggca

SEQ ID NO: 1615662 - RNA, 13 nt, Pseudomonas putida KT2440
cacacugcccagc

SEQ ID NO: 1615663 - RNA, 14 nt, Pseudomonas putida KT2440
auuucuacccgccg

SEQ ID NO: 1615664 - RNA, 16 nt, Pseudomonas putida KT2440
auuucgacgcagaggu

SEQ ID NO: 1615665 - RNA, 20 nt, Pseudomonas putida KT2440
auuucgaagggauguuggaa

SEQ ID NO: 1615666 - RNA, 20 nt, Pseudomonas putida KT2440
auuuccuucuuguuguucau

SEQ ID NO: 1615667 - RNA, 14 nt, Pseudomonas putida KT2440
auuuccucuucacc

SEQ ID NO: 1615668 - RNA, 12 nt, Pseudomonas putida KT2440
auuucacuggcu

SEQ ID NO: 1615669 - RNA, 23 nt, Pseudomonas putida KT2440
auuugcagcacaaggcuguucca

SEQ ID NO: 1615670 - RNA, 17 nt, Pseudomonas putida KT2440
auuucuuucagcucggc

SEQ ID NO: 1615671 - RNA, 22 nt, Pseudomonas putida KT2440
auuuguacgggugcuccaccaa

SEQ ID NO: 1615672 - RNA, 12 nt, Pseudomonas putida KT2440
caaaaacaacaa

SEQ ID NO: 1615673 - RNA, 13 nt, Pseudomonas putida KT2440
caaaaacaacaau

SEQ ID NO: 1615674 - RNA, 17 nt, Pseudomonas putida KT2440
auuuucuugaaaacauu

SEQ ID NO: 1615675 - RNA, 21 nt, Pseudomonas putida KT2440
auuuucuugaaaacauugcua

SEQ ID NO: 1615676 - RNA, 23 nt, Pseudomonas putida KT2440
auuccgcacgucagacuuuccug

SEQ ID NO: 1615677 - RNA, 19 nt, Pseudomonas putida KT2440
auuccugugggagcgggcg

SEQ ID NO: 1615678 - RNA, 21 nt, Pseudomonas putida KT2440
auucgagaaugugcuucuggc

SEQ ID NO: 1615679 - RNA, 23 nt, Pseudomonas putida KT2440
auucgccgggccuugaccagcaa

SEQ ID NO: 1615680 - RNA, 18 nt, Pseudomonas putida KT2440
auucgcccgcaccgccgc

SEQ ID NO: 1615681 - RNA, 12 nt, Pseudomonas putida KT2440
auucgccucccg

SEQ ID NO: 1615682 - RNA, 14 nt, Pseudomonas putida KT2440
auucguuuucggua

SEQ ID NO: 1615683 - RNA, 18 nt, Pseudomonas putida KT2440
auugagguaaaggucaca

SEQ ID NO: 1615684 - RNA, 22 nt, Pseudomonas putida KT2440
auugaguuggugagguguugaa

SEQ ID NO: 1615685 - RNA, 18 nt, Pseudomonas putida KT2440
auugagagcagaugacuc

SEQ ID NO: 1615686 - RNA, 10 nt, Pseudomonas putida KT2440
auugagagga

SEQ ID NO: 1615687 - RNA, 19 nt, Pseudomonas putida KT2440
auugacccgacggcucuug

SEQ ID NO: 1615688 - RNA, 22 nt, Pseudomonas putida KT2440
auugcgccagccgcucagccac

SEQ ID NO: 1615689 - RNA, 20 nt, Pseudomonas putida KT2440
auugcucacugaccaccugg

SEQ ID NO: 1615690 - RNA, 23 nt, Pseudomonas putida KT2440
auugcucgauuagcuccaccagc

SEQ ID NO: 1615691 - RNA, 21 nt, Pseudomonas putida KT2440
auugcuugacuauuucuagua

SEQ ID NO: 1615692 - RNA, 13 nt, Pseudomonas putida KT2440
auugggcugggcg

SEQ ID NO: 1615693 - RNA, 14 nt, Pseudomonas putida KT2440
auuggccaggucuu

SEQ ID NO: 1615694 - RNA, 17 nt, Pseudomonas putida KT2440
auuggagcguugcaggc

SEQ ID NO: 1615695 - RNA, 19 nt, Pseudomonas putida KT2440
auuuaacguagaaaggaga

SEQ ID NO: 1615696 - RNA, 14 nt, Pseudomonas putida KT2440
auugugcgcccccc

SEQ ID NO: 1615697 - RNA, 21 nt, Pseudomonas putida KT2440
auugugcgccccccuguagga

SEQ ID NO: 1615698 - RNA, 19 nt, Pseudomonas putida KT2440
auuuagcaggcacccugag

SEQ ID NO: 1615699 - RNA, 17 nt, Pseudomonas putida KT2440
augccggaguggucgaa

SEQ ID NO: 1615700 - RNA, 12 nt, Pseudomonas putida KT2440
augccggccacc

SEQ ID NO: 1615701 - RNA, 17 nt, Pseudomonas putida KT2440
augccggucagcagcau

SEQ ID NO: 1615702 - RNA, 23 nt, Pseudomonas putida KT2440
augcccgcuguugagcagcagcc

SEQ ID NO: 1615703 - RNA, 17 nt, Pseudomonas putida KT2440
augcccggcucaccgca

SEQ ID NO: 1615704 - RNA, 19 nt, Pseudomonas putida KT2440
augcccgcucccacaggga

SEQ ID NO: 1615705 - RNA, 17 nt, Pseudomonas putida KT2440
augcccgcucucacagg

SEQ ID NO: 1615706 - RNA, 23 nt, Pseudomonas putida KT2440
augcccgaucggguacuccacca

SEQ ID NO: 1615707 - RNA, 14 nt, Pseudomonas putida KT2440
augccccuaccgcc

SEQ ID NO: 1615708 - RNA, 19 nt, Pseudomonas putida KT2440
augccccucaaugcugccu

SEQ ID NO: 1615709 - RNA, 20 nt, Pseudomonas putida KT2440
augccccgaccaccgccucg

SEQ ID NO: 1615710 - RNA, 12 nt, Pseudomonas putida KT2440
augcccaaacgc

SEQ ID NO: 1615711 - RNA, 23 nt, Pseudomonas putida KT2440
augcccaguucgcgugccaccuc

SEQ ID NO: 1615712 - RNA, 17 nt, Pseudomonas putida KT2440
augcccagguaucgcac

SEQ ID NO: 1615713 - RNA, 15 nt, Pseudomonas putida KT2440
augcccauuccugaa

SEQ ID NO: 1615714 - RNA, 14 nt, Pseudomonas putida KT2440
augcccauggccag

SEQ ID NO: 1615715 - RNA, 16 nt, Pseudomonas putida KT2440
augcccauggccaggc

SEQ ID NO: 1615716 - RNA, 17 nt, Pseudomonas putida KT2440
augcccauggccaggcu

SEQ ID NO: 1615717 - RNA, 17 nt, Pseudomonas putida KT2440
augccagcagcuggcuu

SEQ ID NO: 1615718 - RNA, 16 nt, Pseudomonas putida KT2440
augccacgcugaacac

SEQ ID NO: 1615719 - RNA, 20 nt, Pseudomonas putida KT2440
augcagguucgaccagaaca

SEQ ID NO: 1615720 - RNA, 23 nt, Pseudomonas putida KT2440
augcaguagccaucgaggaagug

SEQ ID NO: 1615721 - RNA, 24 nt, Pseudomonas putida KT2440
augcaguucuaccagcagcucaug

SEQ ID NO: 1615722 - RNA, 17 nt, Pseudomonas putida KT2440
augcaguugagcccucg

SEQ ID NO: 1615723 - RNA, 20 nt, Pseudomonas putida KT2440
augcaucugcgccccgcucg

SEQ ID NO: 1615724 - RNA, 17 nt, Pseudomonas putida KT2440
augcaucagggucugag

SEQ ID NO: 1615725 - RNA, 17 nt, Pseudomonas putida KT2440
augaucgccuggccggc

SEQ ID NO: 1615726 - RNA, 22 nt, Pseudomonas putida KT2440
augaucgccuggccggccgggc

SEQ ID NO: 1615727 - RNA, 17 nt, Pseudomonas putida KT2440
augaucggguucuucca

SEQ ID NO: 1615728 - RNA, 13 nt, Pseudomonas putida KT2440
augcacgcagcaa

SEQ ID NO: 1615729 - RNA, 15 nt, Pseudomonas putida KT2440
augcacgcagcaauu

SEQ ID NO: 1615730 - RNA, 16 nt, Pseudomonas putida KT2440
augcacuuccaggaag

SEQ ID NO: 1615731 - RNA, 12 nt, Pseudomonas putida KT2440
augcagcucgac

SEQ ID NO: 1615732 - RNA, 20 nt, Pseudomonas putida KT2440
augcucaccagcuucugggc

SEQ ID NO: 1615733 - RNA, 21 nt, Pseudomonas putida KT2440
augcucaccagcuucugggca

SEQ ID NO: 1615734 - RNA, 17 nt, Pseudomonas putida KT2440
augcuccaaccccagcg

SEQ ID NO: 1615735 - RNA, 19 nt, Pseudomonas putida KT2440
augcuccaaccccagcgca

SEQ ID NO: 1615736 - RNA, 19 nt, Pseudomonas putida KT2440
augcugaagcucuccagca

SEQ ID NO: 1615737 - RNA, 19 nt, Pseudomonas putida KT2440
augcucaagcgccagggca

SEQ ID NO: 1615738 - RNA, 22 nt, Pseudomonas putida KT2440
augcuacagaagccucaccgcc

SEQ ID NO: 1615739 - RNA, 21 nt, Pseudomonas putida KT2440
augcguuguucgaucagccgu

SEQ ID NO: 1615740 - RNA, 13 nt, Pseudomonas putida KT2440
augcggacccagc

SEQ ID NO: 1615741 - RNA, 15 nt, Pseudomonas putida KT2440
augcgcuugaggcuu

SEQ ID NO: 1615742 - RNA, 22 nt, Pseudomonas putida KT2440
augcgcaccggaguccccaccg

SEQ ID NO: 1615743 - RNA, 13 nt, Pseudomonas putida KT2440
augcgcacaccgc

SEQ ID NO: 1615744 - RNA, 21 nt, Pseudomonas putida KT2440
augcggcuacccagccgggca

SEQ ID NO: 1615745 - RNA, 14 nt, Pseudomonas putida KT2440
augcgggcccuggu

SEQ ID NO: 1615746 - RNA, 16 nt, Pseudomonas putida KT2440
augcggcugaccccac

SEQ ID NO: 1615747 - RNA, 15 nt, Pseudomonas putida KT2440
augcgguagcggcug

SEQ ID NO: 1615748 - RNA, 22 nt, Pseudomonas putida KT2440
augcggugguugucgcacccac

SEQ ID NO: 1615749 - RNA, 24 nt, Pseudomonas putida KT2440
augcguucggcaucugccgggucg

SEQ ID NO: 1615750 - RNA, 15 nt, Pseudomonas putida KT2440
augcgugaugguggu

SEQ ID NO: 1615751 - RNA, 23 nt, Pseudomonas putida KT2440
augcgugcauguccugaagcagg

SEQ ID NO: 1615752 - RNA, 21 nt, Pseudomonas putida KT2440
auguccaaauugggcugggcg

SEQ ID NO: 1615753 - RNA, 18 nt, Pseudomonas putida KT2440
augucaggggugccuucg

SEQ ID NO: 1615754 - RNA, 21 nt, Pseudomonas putida KT2440
augucaucaauauccagccuu

SEQ ID NO: 1615755 - RNA, 19 nt, Pseudomonas putida KT2440
aaaagauuugcguuuuaaa

SEQ ID NO: 1615756 - RNA, 19 nt, Pseudomonas putida KT2440
auguagcgggucacugcgc

SEQ ID NO: 1615757 - RNA, 15 nt, Pseudomonas putida KT2440
auguagccacgcugc

SEQ ID NO: 1615758 - RNA, 23 nt, Pseudomonas putida KT2440
auguagaauagccggccucagca

SEQ ID NO: 1615759 - RNA, 19 nt, Pseudomonas putida KT2440
auguacgucaaguaggcac

SEQ ID NO: 1615760 - RNA, 19 nt, Pseudomonas putida KT2440
auguacucaggggcauugc

SEQ ID NO: 1615761 - RNA, 22 nt, Pseudomonas putida KT2440
auggucgcguuguucagcagcg

SEQ ID NO: 1615762 - RNA, 22 nt, Pseudomonas putida KT2440
auggucacgccauccccccagc

SEQ ID NO: 1615763 - RNA, 21 nt, Pseudomonas putida KT2440
auggucggggugaggggauuc

SEQ ID NO: 1615764 - RNA, 16 nt, Pseudomonas putida KT2440
augguugucgaacagc

SEQ ID NO: 1615765 - RNA, 23 nt, Pseudomonas putida KT2440
auggucacccgcgaccacaggcg

SEQ ID NO: 1615766 - RNA, 22 nt, Pseudomonas putida KT2440
auggucacaugucgaggcuuga

SEQ ID NO: 1615767 - RNA, 19 nt, Pseudomonas putida KT2440
augggugucggcauacagc

SEQ ID NO: 1615768 - RNA, 22 nt, Pseudomonas putida KT2440
augggcaggccauucaccuguu

SEQ ID NO: 1615769 - RNA, 16 nt, Pseudomonas putida KT2440
augggccaugcccacc

SEQ ID NO: 1615770 - RNA, 23 nt, Pseudomonas putida KT2440
auggggcugcauugcagccccaa

SEQ ID NO: 1615771 - RNA, 18 nt, Pseudomonas putida KT2440
auggggccgcugugggag

SEQ ID NO: 1615772 - RNA, 22 nt, Pseudomonas putida KT2440
augggcaccggccaccaggcgc

SEQ ID NO: 1615773 - RNA, 22 nt, Pseudomonas putida KT2440
augggaccgcuguuaccagaga

SEQ ID NO: 1615774 - RNA, 19 nt, Pseudomonas putida KT2440
auggcguauccacauacug

SEQ ID NO: 1615775 - RNA, 17 nt, Pseudomonas putida KT2440
auggcuugagcuuagcg

SEQ ID NO: 1615776 - RNA, 16 nt, Pseudomonas putida KT2440
auggcggcccagccag

SEQ ID NO: 1615777 - RNA, 15 nt, Pseudomonas putida KT2440
augcuggccaucccg

SEQ ID NO: 1615778 - RNA, 18 nt, Pseudomonas putida KT2440
augcugguguguugaagu

SEQ ID NO: 1615779 - RNA, 19 nt, Pseudomonas putida KT2440
augcugguguguugaaguc

SEQ ID NO: 1615780 - RNA, 19 nt, Pseudomonas putida KT2440
auggcacccucaccaacug

SEQ ID NO: 1615781 - RNA, 17 nt, Pseudomonas putida KT2440
auggcaccgaucaccug

SEQ ID NO: 1615782 - RNA, 21 nt, Pseudomonas putida KT2440
auggcaaucacgaacagccag

SEQ ID NO: 1615783 - RNA, 18 nt, Pseudomonas putida KT2440
auggcaaucgccuggcgc

SEQ ID NO: 1615784 - RNA, 16 nt, Pseudomonas putida KT2440
auggcaaagcgcagca

SEQ ID NO: 1615785 - RNA, 15 nt, Pseudomonas putida KT2440
auggcaaacagcacc

SEQ ID NO: 1615786 - RNA, 18 nt, Pseudomonas putida KT2440
auggcaaacagcaccagc

SEQ ID NO: 1615787 - RNA, 21 nt, Pseudomonas putida KT2440
auggcaaacagcaccagcccg

SEQ ID NO: 1615788 - RNA, 18 nt, Pseudomonas putida KT2440
auggccucgucgcggucc

SEQ ID NO: 1615789 - RNA, 22 nt, Pseudomonas putida KT2440
auggccugagggucgugagccu

SEQ ID NO: 1615790 - RNA, 13 nt, Pseudomonas putida KT2440
auggccaccagca

SEQ ID NO: 1615791 - RNA, 22 nt, Pseudomonas putida KT2440
auggccacggugucggacaggu

SEQ ID NO: 1615792 - RNA, 13 nt, Pseudomonas putida KT2440
auggcgcaaaccc

SEQ ID NO: 1615793 - RNA, 20 nt, Pseudomonas putida KT2440
auggcgaagaccgccgccca

SEQ ID NO: 1615794 - RNA, 20 nt, Pseudomonas putida KT2440
auggccuuuacaccgaugcc

SEQ ID NO: 1615795 - RNA, 17 nt, Pseudomonas putida KT2440
auggcgaaucagcaugc

SEQ ID NO: 1615796 - RNA, 23 nt, Pseudomonas putida KT2440
auucaggaugcuucggcugaucu

SEQ ID NO: 1615797 - RNA, 17 nt, Pseudomonas putida KT2440
auucagcucggccaccc

SEQ ID NO: 1615798 - RNA, 15 nt, Pseudomonas putida KT2440
auucaggcacggcac

SEQ ID NO: 1615799 - RNA, 21 nt, Pseudomonas putida KT2440
auucaggcuuugcugcagguc

SEQ ID NO: 1615800 - RNA, 17 nt, Pseudomonas putida KT2440
auucagugcgcagguac

SEQ ID NO: 1615801 - RNA, 15 nt, Pseudomonas putida KT2440
auucaccagccaggc

SEQ ID NO: 1615802 - RNA, 16 nt, Pseudomonas putida KT2440
auucaccagccaggca

SEQ ID NO: 1615803 - RNA, 18 nt, Pseudomonas putida KT2440
auucaccagccaggcaca

SEQ ID NO: 1615804 - RNA, 23 nt, Pseudomonas putida KT2440
auuacgcggcagcagcagcccca

SEQ ID NO: 1615805 - RNA, 14 nt, Pseudomonas putida KT2440
auguugucacccag

SEQ ID NO: 1615806 - RNA, 15 nt, Pseudomonas putida KT2440
auguuggucaccacg

SEQ ID NO: 1615807 - RNA, 18 nt, Pseudomonas putida KT2440
auguccggggucaucagg

SEQ ID NO: 1615808 - RNA, 14 nt, Pseudomonas putida KT2440
auguucaacagccg

SEQ ID NO: 1615809 - RNA, 22 nt, Pseudomonas putida KT2440
auuaaagguugacacccucuug

SEQ ID NO: 1615810 - RNA, 17 nt, Pseudomonas putida KT2440
auuaaugcacgccugga

SEQ ID NO: 1615811 - RNA, 15 nt, Pseudomonas putida KT2440
auuaauuugaacaau

SEQ ID NO: 1615812 - RNA, 15 nt, Pseudomonas putida KT2440
auuaccagaauagca

SEQ ID NO: 1615813 - RNA, 19 nt, Pseudomonas putida KT2440
auuaccauccaucaccaug

SEQ ID NO: 1615814 - RNA, 22 nt, Pseudomonas putida KT2440
auauuucacuuucuugaaauua

SEQ ID NO: 1615815 - RNA, 15 nt, Pseudomonas putida KT2440
aucaagcggcuggua

SEQ ID NO: 1615816 - RNA, 22 nt, Pseudomonas putida KT2440
aucaauacgcuggaucaccacc

SEQ ID NO: 1615817 - RNA, 22 nt, Pseudomonas putida KT2440
aucaaucaacucggcagugaac

SEQ ID NO: 1615818 - RNA, 15 nt, Pseudomonas putida KT2440
aucaacgaaaucaug

SEQ ID NO: 1615819 - RNA, 14 nt, Pseudomonas putida KT2440
aucaacaggucgcc

SEQ ID NO: 1615820 - RNA, 22 nt, Pseudomonas putida KT2440
aucaaacggucccgaucucccc

SEQ ID NO: 1615821 - RNA, 17 nt, Pseudomonas putida KT2440
aucaccggcaggugaaa

SEQ ID NO: 1615822 - RNA, 16 nt, Pseudomonas putida KT2440
aucaccggcaccggga

SEQ ID NO: 1615823 - RNA, 15 nt, Pseudomonas putida KT2440
aucaccgccagcaug

SEQ ID NO: 1615824 - RNA, 17 nt, Pseudomonas putida KT2440
aucaccgccagcggcaa

SEQ ID NO: 1615825 - RNA, 17 nt, Pseudomonas putida KT2440
aucaauggcugggggcg

SEQ ID NO: 1615826 - RNA, 19 nt, Pseudomonas putida KT2440
aucaccucguaaggccuga

SEQ ID NO: 1615827 - RNA, 23 nt, Pseudomonas putida KT2440
aucaccucguaaggccugaggcc

SEQ ID NO: 1615828 - RNA, 13 nt, Pseudomonas putida KT2440
aucacgaucacuc

SEQ ID NO: 1615829 - RNA, 21 nt, Pseudomonas putida KT2440
aucacgaucaugcuggccagg

SEQ ID NO: 1615830 - RNA, 22 nt, Pseudomonas putida KT2440
aucacgaucaugcuggccagga

SEQ ID NO: 1615831 - RNA, 12 nt, Pseudomonas putida KT2440
aucacgcacugg

SEQ ID NO: 1615832 - RNA, 15 nt, Pseudomonas putida KT2440
aucacuuccaggccc

SEQ ID NO: 1615833 - RNA, 20 nt, Pseudomonas putida KT2440
aucacgcuccugcaugccuu

SEQ ID NO: 1615834 - RNA, 15 nt, Pseudomonas putida KT2440
aucacuugcucaucu

SEQ ID NO: 1615835 - RNA, 15 nt, Pseudomonas putida KT2440
aucacuugcagcucg

SEQ ID NO: 1615836 - RNA, 13 nt, Pseudomonas putida KT2440
aucagcgcagcau

SEQ ID NO: 1615837 - RNA, 16 nt, Pseudomonas putida KT2440
aucagcaugcccagcg

SEQ ID NO: 1615838 - RNA, 17 nt, Pseudomonas putida KT2440
aucagcaugcccagcgc

SEQ ID NO: 1615839 - RNA, 18 nt, Pseudomonas putida KT2440
aucagccaacacccucac

SEQ ID NO: 1615840 - RNA, 13 nt, Pseudomonas putida KT2440
aucagccaaugca

SEQ ID NO: 1615841 - RNA, 17 nt, Pseudomonas putida KT2440
aucagcaucagugcagg

SEQ ID NO: 1615842 - RNA, 14 nt, Pseudomonas putida KT2440
aucagcgccagcac

SEQ ID NO: 1615843 - RNA, 22 nt, Pseudomonas putida KT2440
aucagcgccagcacgcaggcca

SEQ ID NO: 1615844 - RNA, 18 nt, Pseudomonas putida KT2440
aucagcgccugcucaucc

SEQ ID NO: 1615845 - RNA, 20 nt, Pseudomonas putida KT2440
aucagcgccgaaccagcaga

SEQ ID NO: 1615846 - RNA, 15 nt, Pseudomonas putida KT2440
aucagcgccgccaau

SEQ ID NO: 1615847 - RNA, 23 nt, Pseudomonas putida KT2440
aucagcgcggugaccagcggcag

SEQ ID NO: 1615848 - RNA, 18 nt, Pseudomonas putida KT2440
aucagcgcguccagcaac

SEQ ID NO: 1615849 - RNA, 20 nt, Pseudomonas putida KT2440
aucagcgcguccagcaacag

SEQ ID NO: 1615850 - RNA, 22 nt, Pseudomonas putida KT2440
aucagcuugugaaccccacccc

SEQ ID NO: 1615851 - RNA, 13 nt, Pseudomonas putida KT2440
aucagcuucugcu

SEQ ID NO: 1615852 - RNA, 20 nt, Pseudomonas putida KT2440
aucagcuuaacgcuuggcca

SEQ ID NO: 1615853 - RNA, 13 nt, Pseudomonas putida KT2440
aucagcuggucga

SEQ ID NO: 1615854 - RNA, 19 nt, Pseudomonas putida KT2440
aucagcaacccggccaggc

SEQ ID NO: 1615855 - RNA, 20 nt, Pseudomonas putida KT2440
aucagcaacccggccaggcc

SEQ ID NO: 1615856 - RNA, 16 nt, Pseudomonas putida KT2440
aucagcaaccugcugg

SEQ ID NO: 1615857 - RNA, 21 nt, Pseudomonas putida KT2440
aucagugcggucaggccaagu

SEQ ID NO: 1615858 - RNA, 24 nt, Pseudomonas putida KT2440
aucagugaccgguuuuggcaggcc

SEQ ID NO: 1615859 - RNA, 17 nt, Pseudomonas putida KT2440
aucagugucugcgccug

SEQ ID NO: 1615860 - RNA, 19 nt, Pseudomonas putida KT2440
aucaggccgaaggccagcc

SEQ ID NO: 1615861 - RNA, 22 nt, Pseudomonas putida KT2440
aucaggccgaugccaagcaccg

SEQ ID NO: 1615862 - RNA, 12 nt, Pseudomonas putida KT2440
aucaggcccugc

SEQ ID NO: 1615863 - RNA, 16 nt, Pseudomonas putida KT2440
aucaggcccugcugcu

SEQ ID NO: 1615864 - RNA, 11 nt, Pseudomonas putida KT2440
aucaggaacaa

SEQ ID NO: 1615865 - RNA, 18 nt, Pseudomonas putida KT2440
aucaggcaugccagcagc

SEQ ID NO: 1615866 - RNA, 19 nt, Pseudomonas putida KT2440
aucauccacaaucagcacu

SEQ ID NO: 1615867 - RNA, 13 nt, Pseudomonas putida KT2440
aucaucaugccca

SEQ ID NO: 1615868 - RNA, 14 nt, Pseudomonas putida KT2440
aucaucgccagcag

SEQ ID NO: 1615869 - RNA, 17 nt, Pseudomonas putida KT2440
aucauaucgaaccagca

SEQ ID NO: 1615870 - RNA, 19 nt, Pseudomonas putida KT2440
aucaucaggccgaugccaa

SEQ ID NO: 1615871 - RNA, 23 nt, Pseudomonas putida KT2440
aucaucaggccgaugccaagcac

SEQ ID NO: 1615872 - RNA, 17 nt, Pseudomonas putida KT2440
auaucuggaccccgccc

SEQ ID NO: 1615873 - RNA, 19 nt, Pseudomonas putida KT2440
auaucucugguacaacaac

SEQ ID NO: 1615874 - RNA, 21 nt, Pseudomonas putida KT2440
auaucucugguacaacaacaa

SEQ ID NO: 1615875 - RNA, 22 nt, Pseudomonas putida KT2440
auaucucugguacaacaacaaa

SEQ ID NO: 1615876 - RNA, 19 nt, Pseudomonas putida KT2440
auaucgcauucgccggcac

SEQ ID NO: 1615877 - RNA, 21 nt, Pseudomonas putida KT2440
auaucggccguggguaccuuc

SEQ ID NO: 1615878 - RNA, 20 nt, Pseudomonas putida KT2440
auaucgaaccagcagcaccu

SEQ ID NO: 1615879 - RNA, 22 nt, Pseudomonas putida KT2440
auaucgaaccagcagcaccugc

SEQ ID NO: 1615880 - RNA, 20 nt, Pseudomonas putida KT2440
auaucgacuucggccauuug

SEQ ID NO: 1615881 - RNA, 19 nt, Pseudomonas putida KT2440
auaucgagcguuuuucucg

SEQ ID NO: 1615882 - RNA, 14 nt, Pseudomonas putida KT2440
auauauuuuccuga

SEQ ID NO: 1615883 - RNA, 21 nt, Pseudomonas putida KT2440
auaucaggcaugccagcagcu

SEQ ID NO: 1615884 - RNA, 17 nt, Pseudomonas putida KT2440
auagcucagucgguaga

SEQ ID NO: 1615885 - RNA, 17 nt, Pseudomonas putida KT2440
auaguggcuagccucau

SEQ ID NO: 1615886 - RNA, 13 nt, Pseudomonas putida KT2440
auaguuguggcaa

SEQ ID NO: 1615887 - RNA, 15 nt, Pseudomonas putida KT2440
auaguugaccagcac

SEQ ID NO: 1615888 - RNA, 13 nt, Pseudomonas putida KT2440
auagccugcugcu

SEQ ID NO: 1615889 - RNA, 23 nt, Pseudomonas putida KT2440
auagccacaauggcgcacagggc

SEQ ID NO: 1615890 - RNA, 21 nt, Pseudomonas putida KT2440
auagcgacaggcuugaagcug

SEQ ID NO: 1615891 - RNA, 18 nt, Pseudomonas putida KT2440
auagcaucgcuagaaaac

SEQ ID NO: 1615892 - RNA, 15 nt, Pseudomonas putida KT2440
auagcaacacaugua

SEQ ID NO: 1615893 - RNA, 16 nt, Pseudomonas putida KT2440
auacgcugcugguccu

SEQ ID NO: 1615894 - RNA, 18 nt, Pseudomonas putida KT2440
auacgcucgaccagauca

SEQ ID NO: 1615895 - RNA, 20 nt, Pseudomonas putida KT2440
auacuccagcgucaccacca

SEQ ID NO: 1615896 - RNA, 12 nt, Pseudomonas putida KT2440
auacugcugacc

SEQ ID NO: 1615897 - RNA, 20 nt, Pseudomonas putida KT2440
auacuggcccggcgggagga

SEQ ID NO: 1615898 - RNA, 16 nt, Pseudomonas putida KT2440
auacuucugaccaauc

SEQ ID NO: 1615899 - RNA, 19 nt, Pseudomonas putida KT2440
auacagcgccuccagcagg

SEQ ID NO: 1615900 - RNA, 21 nt, Pseudomonas putida KT2440
auacagcucccgcgcaugcug

SEQ ID NO: 1615901 - RNA, 20 nt, Pseudomonas putida KT2440
auacagcuugcccaucaccu

SEQ ID NO: 1615902 - RNA, 13 nt, Pseudomonas putida KT2440
auaccgcugggca

SEQ ID NO: 1615903 - RNA, 17 nt, Pseudomonas putida KT2440
auaccucccgcacugcu

SEQ ID NO: 1615904 - RNA, 21 nt, Pseudomonas putida KT2440
auaccucccgcacugcugccg

SEQ ID NO: 1615905 - RNA, 18 nt, Pseudomonas putida KT2440
auaccggcgcuucggcac

SEQ ID NO: 1615906 - RNA, 16 nt, Pseudomonas putida KT2440
auaccugcuugcugac

SEQ ID NO: 1615907 - RNA, 17 nt, Pseudomonas putida KT2440
auaccugcuugcugacu

SEQ ID NO: 1615908 - RNA, 17 nt, Pseudomonas putida KT2440
auacgccgcuugauguc

SEQ ID NO: 1615909 - RNA, 21 nt, Pseudomonas putida KT2440
auacgauagcggcggcagcgg

SEQ ID NO: 1615910 - RNA, 18 nt, Pseudomonas putida KT2440
auacgcacacgaccuugg

SEQ ID NO: 1615911 - RNA, 14 nt, Pseudomonas putida KT2440
auacgcacauagcc

SEQ ID NO: 1615912 - RNA, 18 nt, Pseudomonas putida KT2440
aucgacaaccccagcccg

SEQ ID NO: 1615913 - RNA, 23 nt, Pseudomonas putida KT2440
aucgaagcgacagcggccagcuc

SEQ ID NO: 1615914 - RNA, 13 nt, Pseudomonas putida KT2440
aucgacucaagga

SEQ ID NO: 1615915 - RNA, 23 nt, Pseudomonas putida KT2440
aucgaccggguaaucgccaggcc

SEQ ID NO: 1615916 - RNA, 16 nt, Pseudomonas putida KT2440
aucgccacaacggcgc

SEQ ID NO: 1615917 - RNA, 23 nt, Pseudomonas putida KT2440
aucgccacaacggcgcgcccggc

SEQ ID NO: 1615918 - RNA, 15 nt, Pseudomonas putida KT2440
aucgccagcaggccg

SEQ ID NO: 1615919 - RNA, 12 nt, Pseudomonas putida KT2440
aucgccagcccc

SEQ ID NO: 1615920 - RNA, 13 nt, Pseudomonas putida KT2440
aucgccagcccca

SEQ ID NO: 1615921 - RNA, 16 nt, Pseudomonas putida KT2440
aucgccagccccagcc

SEQ ID NO: 1615922 - RNA, 18 nt, Pseudomonas putida KT2440
aucgaucacuuccaggcc

SEQ ID NO: 1615923 - RNA, 15 nt, Pseudomonas putida KT2440
aucgcauugccccug

SEQ ID NO: 1615924 - RNA, 21 nt, Pseudomonas putida KT2440
auccugcgugcugugcacugc

SEQ ID NO: 1615925 - RNA, 21 nt, Pseudomonas putida KT2440
auccugccggcuucacuagcc

SEQ ID NO: 1615926 - RNA, 14 nt, Pseudomonas putida KT2440
auccugcagcacca

SEQ ID NO: 1615927 - RNA, 16 nt, Pseudomonas putida KT2440
auccugcagcaccagc

SEQ ID NO: 1615928 - RNA, 18 nt, Pseudomonas putida KT2440
auccugcagcaccagcuu

SEQ ID NO: 1615929 - RNA, 15 nt, Pseudomonas putida KT2440
auccgcgcuacggcg

SEQ ID NO: 1615930 - RNA, 20 nt, Pseudomonas putida KT2440
auccgcgaguaaagccagca

SEQ ID NO: 1615931 - RNA, 19 nt, Pseudomonas putida KT2440
auccgcgccaucagcugcg

SEQ ID NO: 1615932 - RNA, 16 nt, Pseudomonas putida KT2440
auccgcgcccagucac

SEQ ID NO: 1615933 - RNA, 18 nt, Pseudomonas putida KT2440
auccuggugaucaacaaa

SEQ ID NO: 1615934 - RNA, 23 nt, Pseudomonas putida KT2440
auccugguaaggcucgcccucgc

SEQ ID NO: 1615935 - RNA, 22 nt, Pseudomonas putida KT2440
auccuuggugcaugcaagcagc

SEQ ID NO: 1615936 - RNA, 15 nt, Pseudomonas putida KT2440
aucgaaaucagccuu

SEQ ID NO: 1615937 - RNA, 15 nt, Pseudomonas putida KT2440
auccuugcccaccag

SEQ ID NO: 1615938 - RNA, 18 nt, Pseudomonas putida KT2440
aucgaaccagcagcaccu

SEQ ID NO: 1615939 - RNA, 19 nt, Pseudomonas putida KT2440
aucgaacaguuugcuuuuu

SEQ ID NO: 1615940 - RNA, 22 nt, Pseudomonas putida KT2440
aucgaagccaguacgcaggcau

SEQ ID NO: 1615941 - RNA, 14 nt, Pseudomonas putida KT2440
aucggcgccccgca

SEQ ID NO: 1615942 - RNA, 17 nt, Pseudomonas putida KT2440
aucggccgccagaucau

SEQ ID NO: 1615943 - RNA, 22 nt, Pseudomonas putida KT2440
aucggcggcagcacgaucucgu

SEQ ID NO: 1615944 - RNA, 16 nt, Pseudomonas putida KT2440
aucgggauuacaugau

SEQ ID NO: 1615945 - RNA, 20 nt, Pseudomonas putida KT2440
aucggcuccaggcacaggcg

SEQ ID NO: 1615946 - RNA, 19 nt, Pseudomonas putida KT2440
aucgggcagacgacccgga

SEQ ID NO: 1615947 - RNA, 16 nt, Pseudomonas putida KT2440
aucggugcuuucugcu

SEQ ID NO: 1615948 - RNA, 19 nt, Pseudomonas putida KT2440
aucgggugaaaucaguuca

SEQ ID NO: 1615949 - RNA, 14 nt, Pseudomonas putida KT2440
aucgggucacgcuc

SEQ ID NO: 1615950 - RNA, 18 nt, Pseudomonas putida KT2440
aucggguucuuccaaguu

SEQ ID NO: 1615951 - RNA, 15 nt, Pseudomonas putida KT2440
aucgguuuuuccaug

SEQ ID NO: 1615952 - RNA, 16 nt, Pseudomonas putida KT2440
aucgcuaucugaaaga

SEQ ID NO: 1615953 - RNA, 17 nt, Pseudomonas putida KT2440
aucgcucaugccccgca

SEQ ID NO: 1615954 - RNA, 14 nt, Pseudomonas putida KT2440
aucggccagcaaac

SEQ ID NO: 1615955 - RNA, 16 nt, Pseudomonas putida KT2440
aucggcauugcugaag

SEQ ID NO: 1615956 - RNA, 19 nt, Pseudomonas putida KT2440
aucgccaggcccagccccg

SEQ ID NO: 1615957 - RNA, 11 nt, Pseudomonas putida KT2440
aucgccaggug

SEQ ID NO: 1615958 - RNA, 13 nt, Pseudomonas putida KT2440
aucgcgcccggug

SEQ ID NO: 1615959 - RNA, 22 nt, Pseudomonas putida KT2440
aucccuacccccuccuccagca

SEQ ID NO: 1615960 - RNA, 16 nt, Pseudomonas putida KT2440
auccgcaacaugaagc

SEQ ID NO: 1615961 - RNA, 19 nt, Pseudomonas putida KT2440
auccgcaacaugaagccau

SEQ ID NO: 1615962 - RNA, 16 nt, Pseudomonas putida KT2440
auccgcagccccgccg

SEQ ID NO: 1615963 - RNA, 23 nt, Pseudomonas putida KT2440
auccgccaggcucuccagccgcu

SEQ ID NO: 1615964 - RNA, 14 nt, Pseudomonas putida KT2440
auccgccucauccu

SEQ ID NO: 1615965 - RNA, 22 nt, Pseudomonas putida KT2440
auccgccuggccgcugcgcccg

SEQ ID NO: 1615966 - RNA, 18 nt, Pseudomonas putida KT2440
auccccccuccucaccgc

SEQ ID NO: 1615967 - RNA, 19 nt, Pseudomonas putida KT2440
aucccccgcucaugguucu

SEQ ID NO: 1615968 - RNA, 19 nt, Pseudomonas putida KT2440
aucccccggcccagccccg

SEQ ID NO: 1615969 - RNA, 18 nt, Pseudomonas putida KT2440
aucccgcugugcagcgcu

SEQ ID NO: 1615970 - RNA, 21 nt, Pseudomonas putida KT2440
aucccgcucgguaucggccag

SEQ ID NO: 1615971 - RNA, 19 nt, Pseudomonas putida KT2440
auccccgccgccagcagcg

SEQ ID NO: 1615972 - RNA, 13 nt, Pseudomonas putida KT2440
auccaggcgggcg

SEQ ID NO: 1615973 - RNA, 16 nt, Pseudomonas putida KT2440
auccagggcuuccugc

SEQ ID NO: 1615974 - RNA, 21 nt, Pseudomonas putida KT2440
auccagguuaucuagcaggug

SEQ ID NO: 1615975 - RNA, 19 nt, Pseudomonas putida KT2440
auccaggcugcacuggcau

SEQ ID NO: 1615976 - RNA, 14 nt, Pseudomonas putida KT2440
auccaggcccguga

SEQ ID NO: 1615977 - RNA, 18 nt, Pseudomonas putida KT2440
auccaggcccgugacgaa

SEQ ID NO: 1615978 - RNA, 13 nt, Pseudomonas putida KT2440
auccauuugugga

SEQ ID NO: 1615979 - RNA, 21 nt, Pseudomonas putida KT2440
auccaccugugaggccuucag

SEQ ID NO: 1615980 - RNA, 22 nt, Pseudomonas putida KT2440
auccaccugugaggccuucagc

SEQ ID NO: 1615981 - RNA, 12 nt, Pseudomonas putida KT2440
auccaccaggcu

SEQ ID NO: 1615982 - RNA, 14 nt, Pseudomonas putida KT2440
auccacuugaagac

SEQ ID NO: 1615983 - RNA, 20 nt, Pseudomonas putida KT2440
auccacuugucccggcccag

SEQ ID NO: 1615984 - RNA, 15 nt, Pseudomonas putida KT2440
auccagcgccgcgcc

SEQ ID NO: 1615985 - RNA, 14 nt, Pseudomonas putida KT2440
auccagcgccuccc

SEQ ID NO: 1615986 - RNA, 18 nt, Pseudomonas putida KT2440
auccagcaggcuugccag

SEQ ID NO: 1615987 - RNA, 21 nt, Pseudomonas putida KT2440
auccaccacccuggcaugccc

SEQ ID NO: 1615988 - RNA, 16 nt, Pseudomonas putida KT2440
auccaccagccccagc

SEQ ID NO: 1615989 - RNA, 19 nt, Pseudomonas putida KT2440
auccaccagccccagcgcc

SEQ ID NO: 1615990 - RNA, 16 nt, Pseudomonas putida KT2440
auccaccagccgccgu

SEQ ID NO: 1615991 - RNA, 14 nt, Pseudomonas putida KT2440
auccaauguuagcc

SEQ ID NO: 1615992 - RNA, 16 nt, Pseudomonas putida KT2440
aucauuucaucgccaa

SEQ ID NO: 1615993 - RNA, 18 nt, Pseudomonas putida KT2440
aaaagaaaaagggcaucu

SEQ ID NO: 1615994 - RNA, 13 nt, Pseudomonas putida KT2440
aucuggcucugca

SEQ ID NO: 1615995 - RNA, 14 nt, Pseudomonas putida KT2440
aucugggguggggu

SEQ ID NO: 1615996 - RNA, 23 nt, Pseudomonas putida KT2440
aucuggggccgcgucgcggcccc

SEQ ID NO: 1615997 - RNA, 21 nt, Pseudomonas putida KT2440
aucuggggcgcuuugcuuuug

SEQ ID NO: 1615998 - RNA, 18 nt, Pseudomonas putida KT2440
aucuguaccuugcuaugg

SEQ ID NO: 1615999 - RNA, 16 nt, Pseudomonas putida KT2440
aucugcgacugcaggu

SEQ ID NO: 1616000 - RNA, 13 nt, Pseudomonas putida KT2440
aucugccugccuc

SEQ ID NO: 1616001 - RNA, 18 nt, Pseudomonas putida KT2440
aucugccugcugcaacag

SEQ ID NO: 1616002 - RNA, 13 nt, Pseudomonas putida KT2440
aucugcuccccca

SEQ ID NO: 1616003 - RNA, 16 nt, Pseudomonas putida KT2440
aucugcucccccaggc

SEQ ID NO: 1616004 - RNA, 21 nt, Pseudomonas putida KT2440
aucugcucgacgaaggucuug

SEQ ID NO: 1616005 - RNA, 16 nt, Pseudomonas putida KT2440
aucuucaggcaucacg

SEQ ID NO: 1616006 - RNA, 19 nt, Pseudomonas putida KT2440
aucuucaugccauuggugc

SEQ ID NO: 1616007 - RNA, 13 nt, Pseudomonas putida KT2440
aucuuccagccug

SEQ ID NO: 1616008 - RNA, 14 nt, Pseudomonas putida KT2440
aucuuccagccugc

SEQ ID NO: 1616009 - RNA, 19 nt, Pseudomonas putida KT2440
aucuuccagccugcagcac

SEQ ID NO: 1616010 - RNA, 14 nt, Pseudomonas putida KT2440
aucuagcaggugcu

SEQ ID NO: 1616011 - RNA, 15 nt, Pseudomonas putida KT2440
aucucacgcgccaca

SEQ ID NO: 1616012 - RNA, 16 nt, Pseudomonas putida KT2440
aucucaggcccaccag

SEQ ID NO: 1616013 - RNA, 20 nt, Pseudomonas putida KT2440
aucucaggcccaccagucug

SEQ ID NO: 1616014 - RNA, 14 nt, Pseudomonas putida KT2440
aucuaugcccggcu

SEQ ID NO: 1616015 - RNA, 16 nt, Pseudomonas putida KT2440
aucuaugcccggcuca

SEQ ID NO: 1616016 - RNA, 20 nt, Pseudomonas putida KT2440
aucuaugcccggcucaccgc

SEQ ID NO: 1616017 - RNA, 17 nt, Pseudomonas putida KT2440
aucguauugccccggcc

SEQ ID NO: 1616018 - RNA, 19 nt, Pseudomonas putida KT2440
aucgucacguuuuuuggga

SEQ ID NO: 1616019 - RNA, 18 nt, Pseudomonas putida KT2440
aucucgcgcuggcgcugg

SEQ ID NO: 1616020 - RNA, 13 nt, Pseudomonas putida KT2440
aucucgcacuuga

SEQ ID NO: 1616021 - RNA, 23 nt, Pseudomonas putida KT2440
aucucgccaaucaaccgcuuggc

SEQ ID NO: 1616022 - RNA, 17 nt, Pseudomonas putida KT2440
aucucugguacaacaac

SEQ ID NO: 1616023 - RNA, 20 nt, Pseudomonas putida KT2440
aucucugguacaacaacaaa

SEQ ID NO: 1616024 - RNA, 13 nt, Pseudomonas putida KT2440
aucuccucggcca

SEQ ID NO: 1616025 - RNA, 22 nt, Pseudomonas putida KT2440
aucuccuguaguacacgaggau

SEQ ID NO: 1616026 - RNA, 21 nt, Pseudomonas putida KT2440
augaucgagccgaucaggaag

SEQ ID NO: 1616027 - RNA, 19 nt, Pseudomonas putida KT2440
augauauuugccacucagg

SEQ ID NO: 1616028 - RNA, 21 nt, Pseudomonas putida KT2440
augaguuccguugcuacugcu

SEQ ID NO: 1616029 - RNA, 12 nt, Pseudomonas putida KT2440
augagccuucac

SEQ ID NO: 1616030 - RNA, 17 nt, Pseudomonas putida KT2440
augagcgagcucaacca

SEQ ID NO: 1616031 - RNA, 14 nt, Pseudomonas putida KT2440
augagguuugccaa

SEQ ID NO: 1616032 - RNA, 19 nt, Pseudomonas putida KT2440
augagggugaccuuuucua

SEQ ID NO: 1616033 - RNA, 15 nt, Pseudomonas putida KT2440
augagguagaucaca

SEQ ID NO: 1616034 - RNA, 13 nt, Pseudomonas putida KT2440
augaggcccuccc

SEQ ID NO: 1616035 - RNA, 15 nt, Pseudomonas putida KT2440
augagugagcuaaac

SEQ ID NO: 1616036 - RNA, 23 nt, Pseudomonas putida KT2440
augacuguuaaucauuggguccc

SEQ ID NO: 1616037 - RNA, 14 nt, Pseudomonas putida KT2440
augaaggcccagcu

SEQ ID NO: 1616038 - RNA, 14 nt, Pseudomonas putida KT2440
augaagccaugggc

SEQ ID NO: 1616039 - RNA, 14 nt, Pseudomonas putida KT2440
augaacuggaugau

SEQ ID NO: 1616040 - RNA, 22 nt, Pseudomonas putida KT2440
augaacgaaaacgaaacgccag

SEQ ID NO: 1616041 - RNA, 16 nt, Pseudomonas putida KT2440
augaacagcgcccaga

SEQ ID NO: 1616042 - RNA, 13 nt, Pseudomonas putida KT2440
augaacccggcaa

SEQ ID NO: 1616043 - RNA, 15 nt, Pseudomonas putida KT2440
augaaaaagccccgc

SEQ ID NO: 1616044 - RNA, 17 nt, Pseudomonas putida KT2440
augaaaaagccccgcca

SEQ ID NO: 1616045 - RNA, 21 nt, Pseudomonas putida KT2440
augaaaaagccccgccagugc

SEQ ID NO: 1616046 - RNA, 16 nt, Pseudomonas putida KT2440
augaaaaggcccugca

SEQ ID NO: 1616047 - RNA, 20 nt, Pseudomonas putida KT2440
aucuucgcccugggcgagca

SEQ ID NO: 1616048 - RNA, 16 nt, Pseudomonas putida KT2440
aucuucggugcccacu

SEQ ID NO: 1616049 - RNA, 19 nt, Pseudomonas putida KT2440
aucuucggugcccacugca

SEQ ID NO: 1616050 - RNA, 15 nt, Pseudomonas putida KT2440
aguucaccauccgcc

SEQ ID NO: 1616051 - RNA, 17 nt, Pseudomonas putida KT2440
aguuagacauuagaaaa

SEQ ID NO: 1616052 - RNA, 19 nt, Pseudomonas putida KT2440
agugucccggccagggcug

SEQ ID NO: 1616053 - RNA, 20 nt, Pseudomonas putida KT2440
agugucaguuuuuuugugua

SEQ ID NO: 1616054 - RNA, 20 nt, Pseudomonas putida KT2440
agugucagcccauccagaaa

SEQ ID NO: 1616055 - RNA, 22 nt, Pseudomonas putida KT2440
aguucggacaggcgcuugaccc

SEQ ID NO: 1616056 - RNA, 14 nt, Pseudomonas putida KT2440
aguucauucccggc

SEQ ID NO: 1616057 - RNA, 21 nt, Pseudomonas putida KT2440
aguucauuaccauccaucacc

SEQ ID NO: 1616058 - RNA, 23 nt, Pseudomonas putida KT2440
aguucggcggccccggcgccgcc

SEQ ID NO: 1616059 - RNA, 18 nt, Pseudomonas putida KT2440
aguucgggaagugguggu

SEQ ID NO: 1616060 - RNA, 14 nt, Pseudomonas putida KT2440
aguucgucgagcau

SEQ ID NO: 1616061 - RNA, 15 nt, Pseudomonas putida KT2440
aguucguccaggcuu

SEQ ID NO: 1616062 - RNA, 13 nt, Pseudomonas putida KT2440
aguucugcucagc

SEQ ID NO: 1616063 - RNA, 16 nt, Pseudomonas putida KT2440
aguucuugcgcaucuu

SEQ ID NO: 1616064 - RNA, 14 nt, Pseudomonas putida KT2440
aguugaucaccguc

SEQ ID NO: 1616065 - RNA, 21 nt, Pseudomonas putida KT2440
aguuuccggcaaagagugccc

SEQ ID NO: 1616066 - RNA, 20 nt, Pseudomonas putida KT2440
aguuucagggguugccccug

SEQ ID NO: 1616067 - RNA, 21 nt, Pseudomonas putida KT2440
aguuugacggugaauuccuug

SEQ ID NO: 1616068 - RNA, 17 nt, Pseudomonas putida KT2440
aguuucuugccuuccac

SEQ ID NO: 1616069 - RNA, 19 nt, Pseudomonas putida KT2440
aguuuuaacuaucgggauu

SEQ ID NO: 1616070 - RNA, 12 nt, Pseudomonas putida KT2440
aguuuggccagc

SEQ ID NO: 1616071 - RNA, 15 nt, Pseudomonas putida KT2440
aguugccggugguga

SEQ ID NO: 1616072 - RNA, 19 nt, Pseudomonas putida KT2440
aguugcccggguacagccc

SEQ ID NO: 1616073 - RNA, 22 nt, Pseudomonas putida KT2440
aguugugacuagaggaucugaa

SEQ ID NO: 1616074 - RNA, 12 nt, Pseudomonas putida KT2440
aguuguccaggc

SEQ ID NO: 1616075 - RNA, 16 nt, Pseudomonas putida KT2440
agugccgccugguugc

SEQ ID NO: 1616076 - RNA, 23 nt, Pseudomonas putida KT2440
agugccucacgcaugccgauguc

SEQ ID NO: 1616077 - RNA, 16 nt, Pseudomonas putida KT2440
agugccgggggugcuu

SEQ ID NO: 1616078 - RNA, 17 nt, Pseudomonas putida KT2440
agugccggguccaguuc

SEQ ID NO: 1616079 - RNA, 15 nt, Pseudomonas putida KT2440
agugccgucagaaag

SEQ ID NO: 1616080 - RNA, 23 nt, Pseudomonas putida KT2440
agugccgucagaaagaauggaaa

SEQ ID NO: 1616081 - RNA, 21 nt, Pseudomonas putida KT2440
agugccugcuccaugggcagg

SEQ ID NO: 1616082 - RNA, 22 nt, Pseudomonas putida KT2440
agugccugcuccaugggcaggc

SEQ ID NO: 1616083 - RNA, 13 nt, Pseudomonas putida KT2440
agugccuggaugc

SEQ ID NO: 1616084 - RNA, 23 nt, Pseudomonas putida KT2440
agugcugccacguuuucgcggcc

SEQ ID NO: 1616085 - RNA, 13 nt, Pseudomonas putida KT2440
agugcuggcgugu

SEQ ID NO: 1616086 - RNA, 19 nt, Pseudomonas putida KT2440
agugcugggcaugagccug

SEQ ID NO: 1616087 - RNA, 13 nt, Pseudomonas putida KT2440
agugcugagaggg

SEQ ID NO: 1616088 - RNA, 14 nt, Pseudomonas putida KT2440
agugcugagagggu

SEQ ID NO: 1616089 - RNA, 21 nt, Pseudomonas putida KT2440
agugcgcugaucgaaagcugc

SEQ ID NO: 1616090 - RNA, 17 nt, Pseudomonas putida KT2440
aguggugcccgccaggc

SEQ ID NO: 1616091 - RNA, 18 nt, Pseudomonas putida KT2440
aguggugcccgccaggca

SEQ ID NO: 1616092 - RNA, 17 nt, Pseudomonas putida KT2440
aguggccucgaacaugg

SEQ ID NO: 1616093 - RNA, 12 nt, Pseudomonas putida KT2440
aguggccuuggu

SEQ ID NO: 1616094 - RNA, 18 nt, Pseudomonas putida KT2440
aguggccgaguuggcuuc

SEQ ID NO: 1616095 - RNA, 15 nt, Pseudomonas putida KT2440
aguggguuauugaac

SEQ ID NO: 1616096 - RNA, 17 nt, Pseudomonas putida KT2440
agugguaaugaaagucc

SEQ ID NO: 1616097 - RNA, 14 nt, Pseudomonas putida KT2440
agugcuucugccag

SEQ ID NO: 1616098 - RNA, 14 nt, Pseudomonas putida KT2440
agugcuucuggaua

SEQ ID NO: 1616099 - RNA, 19 nt, Pseudomonas putida KT2440
agugcuucgcccagugccu

SEQ ID NO: 1616100 - RNA, 22 nt, Pseudomonas putida KT2440
aguggcagguucgaccacugca

SEQ ID NO: 1616101 - RNA, 22 nt, Pseudomonas putida KT2440
aguggcacccacagcgccugcu

SEQ ID NO: 1616102 - RNA, 18 nt, Pseudomonas putida KT2440
agugcacccgcgaguuca

SEQ ID NO: 1616103 - RNA, 17 nt, Pseudomonas putida KT2440
agugcaauaccagccug

SEQ ID NO: 1616104 - RNA, 22 nt, Pseudomonas putida KT2440
agugcaggcgcaggcucuccac

SEQ ID NO: 1616105 - RNA, 22 nt, Pseudomonas putida KT2440
agugcccccgccacaggugaca

SEQ ID NO: 1616106 - RNA, 20 nt, Pseudomonas putida KT2440
agugcccccgucagcggcaa

SEQ ID NO: 1616107 - RNA, 23 nt, Pseudomonas putida KT2440
agugccgcaagcagucccagcac

SEQ ID NO: 1616108 - RNA, 21 nt, Pseudomonas putida KT2440
agugcauuucgucgagcucga

SEQ ID NO: 1616109 - RNA, 21 nt, Pseudomonas putida KT2440
agugccagcaacaagcuggac

SEQ ID NO: 1616110 - RNA, 19 nt, Pseudomonas putida KT2440
agugauuguuaucugugaa

SEQ ID NO: 1616111 - RNA, 13 nt, Pseudomonas putida KT2440
agugaucaucaca

SEQ ID NO: 1616112 - RNA, 22 nt, Pseudomonas putida KT2440
agugaucaucacacucgccccc

SEQ ID NO: 1616113 - RNA, 16 nt, Pseudomonas putida KT2440
aguccggcgaagcacu

SEQ ID NO: 1616114 - RNA, 14 nt, Pseudomonas putida KT2440
aguccgggguuuuu

SEQ ID NO: 1616115 - RNA, 20 nt, Pseudomonas putida KT2440
aguauuuuuaccugcuccug

SEQ ID NO: 1616116 - RNA, 17 nt, Pseudomonas putida KT2440
agucgaucagcgacacc

SEQ ID NO: 1616117 - RNA, 19 nt, Pseudomonas putida KT2440
agucgaccagaagggcgca

SEQ ID NO: 1616118 - RNA, 17 nt, Pseudomonas putida KT2440
agucgcgcaccaccuga

SEQ ID NO: 1616119 - RNA, 23 nt, Pseudomonas putida KT2440
agucgcgcaccaccugaugcacc

SEQ ID NO: 1616120 - RNA, 17 nt, Pseudomonas putida KT2440
aguccugauagcgcuuu

SEQ ID NO: 1616121 - RNA, 12 nt, Pseudomonas putida KT2440
aguccugcaaag

SEQ ID NO: 1616122 - RNA, 18 nt, Pseudomonas putida KT2440
aguccugcaacucggccu

SEQ ID NO: 1616123 - RNA, 20 nt, Pseudomonas putida KT2440
agucggcucuucuuucaggu

SEQ ID NO: 1616124 - RNA, 19 nt, Pseudomonas putida KT2440
agucggccugaugccucau

SEQ ID NO: 1616125 - RNA, 15 nt, Pseudomonas putida KT2440
agucggccuggguca

SEQ ID NO: 1616126 - RNA, 21 nt, Pseudomonas putida KT2440
agucucgacccgucgcugcca

SEQ ID NO: 1616127 - RNA, 20 nt, Pseudomonas putida KT2440
agugaagcucgaucugccug

SEQ ID NO: 1616128 - RNA, 15 nt, Pseudomonas putida KT2440
agucugcuccaccgc

SEQ ID NO: 1616129 - RNA, 18 nt, Pseudomonas putida KT2440
auacagccagaaagccac

SEQ ID NO: 1616130 - RNA, 11 nt, Pseudomonas putida KT2440
auacaccaacg

SEQ ID NO: 1616131 - RNA, 22 nt, Pseudomonas putida KT2440
auacaccaacgcauuuucauca

SEQ ID NO: 1616132 - RNA, 21 nt, Pseudomonas putida KT2440
auacaacgaucagcgccgaac

SEQ ID NO: 1616133 - RNA, 17 nt, Pseudomonas putida KT2440
auaauucuuauuaccag

SEQ ID NO: 1616134 - RNA, 12 nt, Pseudomonas putida KT2440
auaaugggucaa

SEQ ID NO: 1616135 - RNA, 17 nt, Pseudomonas putida KT2440
auaauaaaaaaagagca

SEQ ID NO: 1616136 - RNA, 18 nt, Pseudomonas putida KT2440
auaauaaaaaaagagcag

SEQ ID NO: 1616137 - RNA, 11 nt, Pseudomonas putida KT2440
auaauaaaaaa

SEQ ID NO: 1616138 - RNA, 13 nt, Pseudomonas putida KT2440
auaaaccagcagc

SEQ ID NO: 1616139 - RNA, 15 nt, Pseudomonas putida KT2440
auaaaccccagccuu

SEQ ID NO: 1616140 - RNA, 18 nt, Pseudomonas putida KT2440
auaaccaaccccugcggc

SEQ ID NO: 1616141 - RNA, 16 nt, Pseudomonas putida KT2440
auaacaccccccagca

SEQ ID NO: 1616142 - RNA, 19 nt, Pseudomonas putida KT2440
aggaaccuccguugcugcg

SEQ ID NO: 1616143 - RNA, 13 nt, Pseudomonas putida KT2440
aggaacgcugccu

SEQ ID NO: 1616144 - RNA, 21 nt, Pseudomonas putida KT2440
aggaacagcucgauggccagg

SEQ ID NO: 1616145 - RNA, 20 nt, Pseudomonas putida KT2440
aggaacaggcugaugcgcug

SEQ ID NO: 1616146 - RNA, 23 nt, Pseudomonas putida KT2440
aggaacaucgccgucaucaccac

SEQ ID NO: 1616147 - RNA, 18 nt, Pseudomonas putida KT2440
aggaagaugaagaaacca

SEQ ID NO: 1616148 - RNA, 14 nt, Pseudomonas putida KT2440
aggaagcagaugaa

SEQ ID NO: 1616149 - RNA, 15 nt, Pseudomonas putida KT2440
agcuuuggcugcagg

SEQ ID NO: 1616150 - RNA, 16 nt, Pseudomonas putida KT2440
agcuuuggcugcaggu

SEQ ID NO: 1616151 - RNA, 23 nt, Pseudomonas putida KT2440
aggaacaaccugaacaaggccug

SEQ ID NO: 1616152 - RNA, 22 nt, Pseudomonas putida KT2440
aggaacacuucgcuuucaccuu

SEQ ID NO: 1616153 - RNA, 22 nt, Pseudomonas putida KT2440
aggagcaacuaccaugaaaaac

SEQ ID NO: 1616154 - RNA, 20 nt, Pseudomonas putida KT2440
aggagagccucggcucuccu

SEQ ID NO: 1616155 - RNA, 19 nt, Pseudomonas putida KT2440
aggagaacacccagcgcau

SEQ ID NO: 1616156 - RNA, 16 nt, Pseudomonas putida KT2440
aggacugcuucaggcc

SEQ ID NO: 1616157 - RNA, 23 nt, Pseudomonas putida KT2440
aggacauaccacacaccccagaa

SEQ ID NO: 1616158 - RNA, 18 nt, Pseudomonas putida KT2440
aggacaacaaggacugcc

SEQ ID NO: 1616159 - RNA, 14 nt, Pseudomonas putida KT2440
aggacaucaccagg

SEQ ID NO: 1616160 - RNA, 22 nt, Pseudomonas putida KT2440
aggacagugcgacccgcuggcc

SEQ ID NO: 1616161 - RNA, 15 nt, Pseudomonas putida KT2440
aggaauuacgcaggc

SEQ ID NO: 1616162 - RNA, 16 nt, Pseudomonas putida KT2440
aggaauuacgcaggcu

SEQ ID NO: 1616163 - RNA, 13 nt, Pseudomonas putida KT2440
aggaaguggcaga

SEQ ID NO: 1616164 - RNA, 18 nt, Pseudomonas putida KT2440
aggaagcucgcacgcaug

SEQ ID NO: 1616165 - RNA, 23 nt, Pseudomonas putida KT2440
aggacaaaccagcggucugcugc

SEQ ID NO: 1616166 - RNA, 20 nt, Pseudomonas putida KT2440
agcuucugcugguccuugca

SEQ ID NO: 1616167 - RNA, 18 nt, Pseudomonas putida KT2440
agcuucugcuugcucugu

SEQ ID NO: 1616168 - RNA, 18 nt, Pseudomonas putida KT2440
agcuucugguuguaagcg

SEQ ID NO: 1616169 - RNA, 13 nt, Pseudomonas putida KT2440
agcuucugcaacu

SEQ ID NO: 1616170 - RNA, 18 nt, Pseudomonas putida KT2440
agcuucucgagcggccug

SEQ ID NO: 1616171 - RNA, 13 nt, Pseudomonas putida KT2440
agcuugagcucga

SEQ ID NO: 1616172 - RNA, 19 nt, Pseudomonas putida KT2440
agcuugagcucgaucuugc

SEQ ID NO: 1616173 - RNA, 18 nt, Pseudomonas putida KT2440
agcuugccauucuugucc

SEQ ID NO: 1616174 - RNA, 16 nt, Pseudomonas putida KT2440
agcuugcccagcugcg

SEQ ID NO: 1616175 - RNA, 13 nt, Pseudomonas putida KT2440
agcuugcccauca

SEQ ID NO: 1616176 - RNA, 21 nt, Pseudomonas putida KT2440
agcuugccgucgcuggagcgg

SEQ ID NO: 1616177 - RNA, 14 nt, Pseudomonas putida KT2440
agcuuggucagggc

SEQ ID NO: 1616178 - RNA, 15 nt, Pseudomonas putida KT2440
agcuuggucagggca

SEQ ID NO: 1616179 - RNA, 20 nt, Pseudomonas putida KT2440
agcuuggcuuucggcgcacc

SEQ ID NO: 1616180 - RNA, 17 nt, Pseudomonas putida KT2440
agcuucauguacagguu

SEQ ID NO: 1616181 - RNA, 14 nt, Pseudomonas putida KT2440
agcuucuagcaaug

SEQ ID NO: 1616182 - RNA, 16 nt, Pseudomonas putida KT2440
agcuuccaccauuccc

SEQ ID NO: 1616183 - RNA, 21 nt, Pseudomonas putida KT2440
agcuuccaccauucccugcac

SEQ ID NO: 1616184 - RNA, 21 nt, Pseudomonas putida KT2440
agcuuccaguuggccggcaug

SEQ ID NO: 1616185 - RNA, 21 nt, Pseudomonas putida KT2440
agcuucccggccuggcgcagg

SEQ ID NO: 1616186 - RNA, 23 nt, Pseudomonas putida KT2440
agcuucccggccuggcgcaggua

SEQ ID NO: 1616187 - RNA, 19 nt, Pseudomonas putida KT2440
agcugucgaacgcugccug

SEQ ID NO: 1616188 - RNA, 18 nt, Pseudomonas putida KT2440
agcuguggggcugacugc

SEQ ID NO: 1616189 - RNA, 16 nt, Pseudomonas putida KT2440
agcuguacgcuggcca

SEQ ID NO: 1616190 - RNA, 17 nt, Pseudomonas putida KT2440
agcuguacgcuggccaa

SEQ ID NO: 1616191 - RNA, 23 nt, Pseudomonas putida KT2440
agcuguacgcuggccaaggccuc

SEQ ID NO: 1616192 - RNA, 23 nt, Pseudomonas putida KT2440
agcugucauuacccggcagaauc

SEQ ID NO: 1616193 - RNA, 18 nt, Pseudomonas putida KT2440
agcuggucaucguccacc

SEQ ID NO: 1616194 - RNA, 18 nt, Pseudomonas putida KT2440
agcuggucgagcaaggca

SEQ ID NO: 1616195 - RNA, 13 nt, Pseudomonas putida KT2440
agcuguacaacgc

SEQ ID NO: 1616196 - RNA, 21 nt, Pseudomonas putida KT2440
agcuguacaacgcagccggca

SEQ ID NO: 1616197 - RNA, 14 nt, Pseudomonas putida KT2440
agcuguacagcgca

SEQ ID NO: 1616198 - RNA, 14 nt, Pseudomonas putida KT2440
agcugccggccagc

SEQ ID NO: 1616199 - RNA, 19 nt, Pseudomonas putida KT2440
agcugccgcguucacaucg

SEQ ID NO: 1616200 - RNA, 17 nt, Pseudomonas putida KT2440
agcugcuuaccagcuug

SEQ ID NO: 1616201 - RNA, 16 nt, Pseudomonas putida KT2440
agcugcugcggcaccu

SEQ ID NO: 1616202 - RNA, 11 nt, Pseudomonas putida KT2440
agcuccaggcg

SEQ ID NO: 1616203 - RNA, 21 nt, Pseudomonas putida KT2440
agcuccaccaguugguaaaac

SEQ ID NO: 1616204 - RNA, 10 nt, Pseudomonas putida KT2440
agcuccagca

SEQ ID NO: 1616205 - RNA, 12 nt, Pseudomonas putida KT2440
agcuccagcacc

SEQ ID NO: 1616206 - RNA, 14 nt, Pseudomonas putida KT2440
agcuccagcaccuc

SEQ ID NO: 1616207 - RNA, 17 nt, Pseudomonas putida KT2440
agcuccacaucuugccc

SEQ ID NO: 1616208 - RNA, 17 nt, Pseudomonas putida KT2440
agcugccauacagccag

SEQ ID NO: 1616209 - RNA, 22 nt, Pseudomonas putida KT2440
agcugccauuucuucagcagga

SEQ ID NO: 1616210 - RNA, 19 nt, Pseudomonas putida KT2440
agcugcauuggcggcaggc

SEQ ID NO: 1616211 - RNA, 13 nt, Pseudomonas putida KT2440
agcuccccagcaa

SEQ ID NO: 1616212 - RNA, 15 nt, Pseudomonas putida KT2440
agcugcagugcuggg

SEQ ID NO: 1616213 - RNA, 17 nt, Pseudomonas putida KT2440
agcuccaugcggcuacc

SEQ ID NO: 1616214 - RNA, 16 nt, Pseudomonas putida KT2440
aggcaccacggaaggc

SEQ ID NO: 1616215 - RNA, 18 nt, Pseudomonas putida KT2440
aggcacaggccagccagg

SEQ ID NO: 1616216 - RNA, 15 nt, Pseudomonas putida KT2440
aggcacaggcccagc

SEQ ID NO: 1616217 - RNA, 16 nt, Pseudomonas putida KT2440
aggcacaggcccagca

SEQ ID NO: 1616218 - RNA, 22 nt, Pseudomonas putida KT2440
aggcacacaaacaccggccccc

SEQ ID NO: 1616219 - RNA, 22 nt, Pseudomonas putida KT2440
aggcaacgucaucggcccacgg

SEQ ID NO: 1616220 - RNA, 17 nt, Pseudomonas putida KT2440
aggauucagcacgcugg

SEQ ID NO: 1616221 - RNA, 20 nt, Pseudomonas putida KT2440
aggauucgaaccuacgacca

SEQ ID NO: 1616222 - RNA, 22 nt, Pseudomonas putida KT2440
aggagcggguucacccgcgaag

SEQ ID NO: 1616223 - RNA, 22 nt, Pseudomonas putida KT2440
aggagcggguuuacccgcgaag

SEQ ID NO: 1616224 - RNA, 14 nt, Pseudomonas putida KT2440
aggagcgggcacgu

SEQ ID NO: 1616225 - RNA, 19 nt, Pseudomonas putida KT2440
aggagcgggcuuacccgcg

SEQ ID NO: 1616226 - RNA, 13 nt, Pseudomonas putida KT2440
aggagcugauuca

SEQ ID NO: 1616227 - RNA, 17 nt, Pseudomonas putida KT2440
aggagcugauucagcac

SEQ ID NO: 1616228 - RNA, 17 nt, Pseudomonas putida KT2440
aggcacggcaccagcac

SEQ ID NO: 1616229 - RNA, 18 nt, Pseudomonas putida KT2440
aggcacggcaccagcacc

SEQ ID NO: 1616230 - RNA, 15 nt, Pseudomonas putida KT2440
aggcacgaugaccgu

SEQ ID NO: 1616231 - RNA, 18 nt, Pseudomonas putida KT2440
aggcacgcccgcucccac

SEQ ID NO: 1616232 - RNA, 21 nt, Pseudomonas putida KT2440
aggcacccagccagcgauuca

SEQ ID NO: 1616233 - RNA, 14 nt, Pseudomonas putida KT2440
aggcacgugauacc

SEQ ID NO: 1616234 - RNA, 18 nt, Pseudomonas putida KT2440
aggcauucagcucggcca

SEQ ID NO: 1616235 - RNA, 18 nt, Pseudomonas putida KT2440
aggccaagguugccacca

SEQ ID NO: 1616236 - RNA, 17 nt, Pseudomonas putida KT2440
aggccaaguacggccag

SEQ ID NO: 1616237 - RNA, 19 nt, Pseudomonas putida KT2440
aggccaaguacggccagca

SEQ ID NO: 1616238 - RNA, 17 nt, Pseudomonas putida KT2440
aggcauuuucaaugcuu

SEQ ID NO: 1616239 - RNA, 23 nt, Pseudomonas putida KT2440
aggcauugcucgauuagcuccac

SEQ ID NO: 1616240 - RNA, 22 nt, Pseudomonas putida KT2440
aggccaacugcgcccgccccuc

SEQ ID NO: 1616241 - RNA, 20 nt, Pseudomonas putida KT2440
aggccaaugcagcuuugagg

SEQ ID NO: 1616242 - RNA, 14 nt, Pseudomonas putida KT2440
aggccacguuugag

SEQ ID NO: 1616243 - RNA, 16 nt, Pseudomonas putida KT2440
aggccagcacggccag

SEQ ID NO: 1616244 - RNA, 23 nt, Pseudomonas putida KT2440
aggcccaaacauugugcgccccc

SEQ ID NO: 1616245 - RNA, 23 nt, Pseudomonas putida KT2440
aggcccauuucgcgggucagggg

SEQ ID NO: 1616246 - RNA, 12 nt, Pseudomonas putida KT2440
aggcccagcccc

SEQ ID NO: 1616247 - RNA, 23 nt, Pseudomonas putida KT2440
aggcccaguucggacaggcgcuu

SEQ ID NO: 1616248 - RNA, 12 nt, Pseudomonas putida KT2440
aggcgccugccg

SEQ ID NO: 1616249 - RNA, 19 nt, Pseudomonas putida KT2440
aggcgccgacgauaccgcc

SEQ ID NO: 1616250 - RNA, 22 nt, Pseudomonas putida KT2440
aggcgccgacgauaccgcccag

SEQ ID NO: 1616251 - RNA, 23 nt, Pseudomonas putida KT2440
aggcgccgacgauaccgcccagg

SEQ ID NO: 1616252 - RNA, 13 nt, Pseudomonas putida KT2440
aggcgcucacccc

SEQ ID NO: 1616253 - RNA, 20 nt, Pseudomonas putida KT2440
aggcgcucaccccgccccug

SEQ ID NO: 1616254 - RNA, 21 nt, Pseudomonas putida KT2440
aggcgcucaccccgccccugc

SEQ ID NO: 1616255 - RNA, 17 nt, Pseudomonas putida KT2440
aggcgcugaaacugucg

SEQ ID NO: 1616256 - RNA, 19 nt, Pseudomonas putida KT2440
aggcgcggcagcaugaaca

SEQ ID NO: 1616257 - RNA, 14 nt, Pseudomonas putida KT2440
aggcgcgcgccugg

SEQ ID NO: 1616258 - RNA, 16 nt, Pseudomonas putida KT2440
aggcgcggugccggca

SEQ ID NO: 1616259 - RNA, 12 nt, Pseudomonas putida KT2440
aggcgcacauac

SEQ ID NO: 1616260 - RNA, 17 nt, Pseudomonas putida KT2440
aggcgcaggugcagcca

SEQ ID NO: 1616261 - RNA, 21 nt, Pseudomonas putida KT2440
aggcgaccuucgggucgccuu

SEQ ID NO: 1616262 - RNA, 21 nt, Pseudomonas putida KT2440
aggcgacgaucaucgcgccga

SEQ ID NO: 1616263 - RNA, 15 nt, Pseudomonas putida KT2440
aggcgaauggcaggu

SEQ ID NO: 1616264 - RNA, 23 nt, Pseudomonas putida KT2440
aggccguugaucagcgacaccgc

SEQ ID NO: 1616265 - RNA, 17 nt, Pseudomonas putida KT2440
aggccucuaccgcugcu

SEQ ID NO: 1616266 - RNA, 21 nt, Pseudomonas putida KT2440
aggccugaaacccauccacgg

SEQ ID NO: 1616267 - RNA, 21 nt, Pseudomonas putida KT2440
aggccugcacuaagggcaggc

SEQ ID NO: 1616268 - RNA, 15 nt, Pseudomonas putida KT2440
aggccugcacugcac

SEQ ID NO: 1616269 - RNA, 22 nt, Pseudomonas putida KT2440
aggccugcacugcacccucuuc

SEQ ID NO: 1616270 - RNA, 23 nt, Pseudomonas putida KT2440
aggccugcacugcacccucuucc

SEQ ID NO: 1616271 - RNA, 21 nt, Pseudomonas putida KT2440
aggccugcgaaaggcgcucga

SEQ ID NO: 1616272 - RNA, 16 nt, Pseudomonas putida KT2440
aggccugcggccaggc

SEQ ID NO: 1616273 - RNA, 17 nt, Pseudomonas putida KT2440
aggccugcggccaggcc

SEQ ID NO: 1616274 - RNA, 15 nt, Pseudomonas putida KT2440
aggccuuuucacaca

SEQ ID NO: 1616275 - RNA, 16 nt, Pseudomonas putida KT2440
aggccgaugccaagca

SEQ ID NO: 1616276 - RNA, 16 nt, Pseudomonas putida KT2440
aggccgauuuggcccg

SEQ ID NO: 1616277 - RNA, 14 nt, Pseudomonas putida KT2440
aggccgcagccucu

SEQ ID NO: 1616278 - RNA, 19 nt, Pseudomonas putida KT2440
aggcccgcgccgacagccu

SEQ ID NO: 1616279 - RNA, 16 nt, Pseudomonas putida KT2440
aggccccugcaacagg

SEQ ID NO: 1616280 - RNA, 17 nt, Pseudomonas putida KT2440
aggcccgaacagacaac

SEQ ID NO: 1616281 - RNA, 20 nt, Pseudomonas putida KT2440
aggcccgaacagacaacauc

SEQ ID NO: 1616282 - RNA, 15 nt, Pseudomonas putida KT2440
aggccggguccugca

SEQ ID NO: 1616283 - RNA, 13 nt, Pseudomonas putida KT2440
aggccggguuuuu

SEQ ID NO: 1616284 - RNA, 14 nt, Pseudomonas putida KT2440
aggccggguuuuuc

SEQ ID NO: 1616285 - RNA, 16 nt, Pseudomonas putida KT2440
aggccgguacugccca

SEQ ID NO: 1616286 - RNA, 23 nt, Pseudomonas putida KT2440
aggccguaggccagguacaggca

SEQ ID NO: 1616287 - RNA, 18 nt, Pseudomonas putida KT2440
aggccgucagcagcaggc

SEQ ID NO: 1616288 - RNA, 20 nt, Pseudomonas putida KT2440
aggccgucguguaggagcgg

SEQ ID NO: 1616289 - RNA, 18 nt, Pseudomonas putida KT2440
aggccgugaaccauccca

SEQ ID NO: 1616290 - RNA, 19 nt, Pseudomonas putida KT2440
aggccguggcaaggcccgc

SEQ ID NO: 1616291 - RNA, 22 nt, Pseudomonas putida KT2440
aggguggcaaugcucgccugcu

SEQ ID NO: 1616292 - RNA, 21 nt, Pseudomonas putida KT2440
agggugaaguacucggcacgc

SEQ ID NO: 1616293 - RNA, 18 nt, Pseudomonas putida KT2440
agggugcaaucaggucuc

SEQ ID NO: 1616294 - RNA, 17 nt, Pseudomonas putida KT2440
aggguaucggggguucg

SEQ ID NO: 1616295 - RNA, 16 nt, Pseudomonas putida KT2440
agguacagcagcugca

SEQ ID NO: 1616296 - RNA, 16 nt, Pseudomonas putida KT2440
agguacacccccaggu

SEQ ID NO: 1616297 - RNA, 18 nt, Pseudomonas putida KT2440
agguacucgcaagcucca

SEQ ID NO: 1616298 - RNA, 11 nt, Pseudomonas putida KT2440
agguaccccuc

SEQ ID NO: 1616299 - RNA, 21 nt, Pseudomonas putida KT2440
agguacgagucagcgugccag

SEQ ID NO: 1616300 - RNA, 21 nt, Pseudomonas putida KT2440
agguacgccaugugcgcccga

SEQ ID NO: 1616301 - RNA, 19 nt, Pseudomonas putida KT2440
agguagugcaccaacgccg

SEQ ID NO: 1616302 - RNA, 22 nt, Pseudomonas putida KT2440
agguagguuuucggcuggagcu

SEQ ID NO: 1616303 - RNA, 10 nt, Pseudomonas putida KT2440
agguaguaaa

SEQ ID NO: 1616304 - RNA, 18 nt, Pseudomonas putida KT2440
agguagucgaaguacacc

SEQ ID NO: 1616305 - RNA, 18 nt, Pseudomonas putida KT2440
agguagucgauccaggug

SEQ ID NO: 1616306 - RNA, 14 nt, Pseudomonas putida KT2440
agguagacgaucga

SEQ ID NO: 1616307 - RNA, 13 nt, Pseudomonas putida KT2440
agguagaucacac

SEQ ID NO: 1616308 - RNA, 20 nt, Pseudomonas putida KT2440
agguagcgguaaacgucggc

SEQ ID NO: 1616309 - RNA, 19 nt, Pseudomonas putida KT2440
agguagccguggcugggga

SEQ ID NO: 1616310 - RNA, 17 nt, Pseudomonas putida KT2440
aggucaugaugcccguc

SEQ ID NO: 1616311 - RNA, 17 nt, Pseudomonas putida KT2440
aggucauguagcgccug

SEQ ID NO: 1616312 - RNA, 18 nt, Pseudomonas putida KT2440
aggucauccgcacgcaug

SEQ ID NO: 1616313 - RNA, 24 nt, Pseudomonas putida KT2440
aggucauccgcacgcaugucaggg

SEQ ID NO: 1616314 - RNA, 21 nt, Pseudomonas putida KT2440
aggucaucgaagaucagcuca

SEQ ID NO: 1616315 - RNA, 23 nt, Pseudomonas putida KT2440
aggucaucgcugcggucaucacc

SEQ ID NO: 1616316 - RNA, 21 nt, Pseudomonas putida KT2440
aggucaucgggaucagcacgc

SEQ ID NO: 1616317 - RNA, 15 nt, Pseudomonas putida KT2440
agguaugugagcugc

SEQ ID NO: 1616318 - RNA, 13 nt, Pseudomonas putida KT2440
agguccagcuccg

SEQ ID NO: 1616319 - RNA, 20 nt, Pseudomonas putida KT2440
agguccagcucuggucaccu

SEQ ID NO: 1616320 - RNA, 16 nt, Pseudomonas putida KT2440
agguccaccgcuuuca

SEQ ID NO: 1616321 - RNA, 14 nt, Pseudomonas putida KT2440
agguccagccgcca

SEQ ID NO: 1616322 - RNA, 15 nt, Pseudomonas putida KT2440
agguccagccgccau

SEQ ID NO: 1616323 - RNA, 20 nt, Pseudomonas putida KT2440
aggucauuggcgccaucgcc

SEQ ID NO: 1616324 - RNA, 19 nt, Pseudomonas putida KT2440
agguccauguugugcuggc

SEQ ID NO: 1616325 - RNA, 13 nt, Pseudomonas putida KT2440
aggucgccaggcu

SEQ ID NO: 1616326 - RNA, 22 nt, Pseudomonas putida KT2440
aggucgccgcuguucagcccuu

SEQ ID NO: 1616327 - RNA, 13 nt, Pseudomonas putida KT2440
aggucgccuugaa

SEQ ID NO: 1616328 - RNA, 20 nt, Pseudomonas putida KT2440
aggucggcacgcaccuguuu

SEQ ID NO: 1616329 - RNA, 23 nt, Pseudomonas putida KT2440
aggucggcggggcccggacaggg

SEQ ID NO: 1616330 - RNA, 19 nt, Pseudomonas putida KT2440
aggucgugcuugacccccu

SEQ ID NO: 1616331 - RNA, 17 nt, Pseudomonas putida KT2440
aggucuccagcaccgcc

SEQ ID NO: 1616332 - RNA, 17 nt, Pseudomonas putida KT2440
aggucucccgcccccuc

SEQ ID NO: 1616333 - RNA, 20 nt, Pseudomonas putida KT2440
aggugauguugcccggcaug

SEQ ID NO: 1616334 - RNA, 19 nt, Pseudomonas putida KT2440
aggugcaccaacacuucca

SEQ ID NO: 1616335 - RNA, 15 nt, Pseudomonas putida KT2440
aggugcagcaacagg

SEQ ID NO: 1616336 - RNA, 15 nt, Pseudomonas putida KT2440
aggugcaggguaggg

SEQ ID NO: 1616337 - RNA, 20 nt, Pseudomonas putida KT2440
aggugcaggguaggggugga

SEQ ID NO: 1616338 - RNA, 19 nt, Pseudomonas putida KT2440
aggugcuuuuuugugccug

SEQ ID NO: 1616339 - RNA, 14 nt, Pseudomonas putida KT2440
aggugcugaugccc

SEQ ID NO: 1616340 - RNA, 18 nt, Pseudomonas putida KT2440
aggugcugcagacccgcg

SEQ ID NO: 1616341 - RNA, 18 nt, Pseudomonas putida KT2440
aggugcagguucgaccac

SEQ ID NO: 1616342 - RNA, 14 nt, Pseudomonas putida KT2440
aggugcuaccggcg

SEQ ID NO: 1616343 - RNA, 15 nt, Pseudomonas putida KT2440
agggccgcgcaggcg

SEQ ID NO: 1616344 - RNA, 20 nt, Pseudomonas putida KT2440
agggccgcgcaggcggcuga

SEQ ID NO: 1616345 - RNA, 14 nt, Pseudomonas putida KT2440
agggcggcgcccag

SEQ ID NO: 1616346 - RNA, 12 nt, Pseudomonas putida KT2440
agggcguucagc

SEQ ID NO: 1616347 - RNA, 14 nt, Pseudomonas putida KT2440
agggcguucagcaa

SEQ ID NO: 1616348 - RNA, 19 nt, Pseudomonas putida KT2440
agggcguuccagccaggcg

SEQ ID NO: 1616349 - RNA, 15 nt, Pseudomonas putida KT2440
agggcguugggcacg

SEQ ID NO: 1616350 - RNA, 14 nt, Pseudomonas putida KT2440
agggcgucaugcuc

SEQ ID NO: 1616351 - RNA, 14 nt, Pseudomonas putida KT2440
agggcgucgaacac

SEQ ID NO: 1616352 - RNA, 14 nt, Pseudomonas putida KT2440
agggccgcaaagcg

SEQ ID NO: 1616353 - RNA, 14 nt, Pseudomonas putida KT2440
agggcccagccacc

SEQ ID NO: 1616354 - RNA, 18 nt, Pseudomonas putida KT2440
agggcaaugaucagcccu

SEQ ID NO: 1616355 - RNA, 22 nt, Pseudomonas putida KT2440
agggcaauggcgucacagacau

SEQ ID NO: 1616356 - RNA, 12 nt, Pseudomonas putida KT2440
aggggcuguaua

SEQ ID NO: 1616357 - RNA, 22 nt, Pseudomonas putida KT2440
aggggcuguauagcccugcccu

SEQ ID NO: 1616358 - RNA, 18 nt, Pseudomonas putida KT2440
agggguggaucaggaaca

SEQ ID NO: 1616359 - RNA, 17 nt, Pseudomonas putida KT2440
agggguuuccuuugggu

SEQ ID NO: 1616360 - RNA, 20 nt, Pseudomonas putida KT2440
aggggcagaugcuccaaccc

SEQ ID NO: 1616361 - RNA, 14 nt, Pseudomonas putida KT2440
agggcugcggggca

SEQ ID NO: 1616362 - RNA, 18 nt, Pseudomonas putida KT2440
agggcugguuaugagccu

SEQ ID NO: 1616363 - RNA, 23 nt, Pseudomonas putida KT2440
agggcugcgauagaacuccacca

SEQ ID NO: 1616364 - RNA, 19 nt, Pseudomonas putida KT2440
agggcucaacgccagggca

SEQ ID NO: 1616365 - RNA, 21 nt, Pseudomonas putida KT2440
agggcucaacgccagggcaau

SEQ ID NO: 1616366 - RNA, 16 nt, Pseudomonas putida KT2440
agggcucauccacccc

SEQ ID NO: 1616367 - RNA, 18 nt, Pseudomonas putida KT2440
agggcaaaaugcagcaag

SEQ ID NO: 1616368 - RNA, 16 nt, Pseudomonas putida KT2440
agggcaaacacaucca

SEQ ID NO: 1616369 - RNA, 22 nt, Pseudomonas putida KT2440
agggcaaacaccuugccccgca

SEQ ID NO: 1616370 - RNA, 20 nt, Pseudomonas putida KT2440
agggaccgugcagggaaggg

SEQ ID NO: 1616371 - RNA, 19 nt, Pseudomonas putida KT2440
agggaaggcuacauccagg

SEQ ID NO: 1616372 - RNA, 19 nt, Pseudomonas putida KT2440
agggaagcggaugagccuu

SEQ ID NO: 1616373 - RNA, 14 nt, Pseudomonas putida KT2440
agggaagcucugau

SEQ ID NO: 1616374 - RNA, 16 nt, Pseudomonas putida KT2440
agggaagaauugcugg

SEQ ID NO: 1616375 - RNA, 22 nt, Pseudomonas putida KT2440
aggcuuuggccguagccaggca

SEQ ID NO: 1616376 - RNA, 14 nt, Pseudomonas putida KT2440
agggaaauuggcca

SEQ ID NO: 1616377 - RNA, 15 nt, Pseudomonas putida KT2440
agggaacagggcaga

SEQ ID NO: 1616378 - RNA, 18 nt, Pseudomonas putida KT2440
aggcgcuugagcucggca

SEQ ID NO: 1616379 - RNA, 20 nt, Pseudomonas putida KT2440
aguagcuuaaucccgcaagu

SEQ ID NO: 1616380 - RNA, 18 nt, Pseudomonas putida KT2440
aguagcuccagcccagcg

SEQ ID NO: 1616381 - RNA, 12 nt, Pseudomonas putida KT2440
aguaggugcagg

SEQ ID NO: 1616382 - RNA, 12 nt, Pseudomonas putida KT2440
aguagcggguga

SEQ ID NO: 1616383 - RNA, 21 nt, Pseudomonas putida KT2440
aguagcgcucuuugccacuca

SEQ ID NO: 1616384 - RNA, 16 nt, Pseudomonas putida KT2440
aguagcgccaccaucu

SEQ ID NO: 1616385 - RNA, 19 nt, Pseudomonas putida KT2440
aguagccuucuucggucag

SEQ ID NO: 1616386 - RNA, 20 nt, Pseudomonas putida KT2440
aguaccaggucgccagcacc

SEQ ID NO: 1616387 - RNA, 21 nt, Pseudomonas putida KT2440
aguaccaggucgccagcacca

SEQ ID NO: 1616388 - RNA, 16 nt, Pseudomonas putida KT2440
aguagauaucggccgu

SEQ ID NO: 1616389 - RNA, 23 nt, Pseudomonas putida KT2440
aguaucgccccggucagcaggaa

SEQ ID NO: 1616390 - RNA, 14 nt, Pseudomonas putida KT2440
aguauuaauuugaa

SEQ ID NO: 1616391 - RNA, 20 nt, Pseudomonas putida KT2440
aguauucgcuaaccucugca

SEQ ID NO: 1616392 - RNA, 13 nt, Pseudomonas putida KT2440
aguaccagcagca

SEQ ID NO: 1616393 - RNA, 15 nt, Pseudomonas putida KT2440
aguaccagcagcaca

SEQ ID NO: 1616394 - RNA, 14 nt, Pseudomonas putida KT2440
aguacaaacaccac

SEQ ID NO: 1616395 - RNA, 14 nt, Pseudomonas putida KT2440
aguaaagccagcag

SEQ ID NO: 1616396 - RNA, 15 nt, Pseudomonas putida KT2440
aguaaagccagcagc

SEQ ID NO: 1616397 - RNA, 18 nt, Pseudomonas putida KT2440
aguaaagcccccagaaug

SEQ ID NO: 1616398 - RNA, 22 nt, Pseudomonas putida KT2440
agguggccggcaacggccacgc

SEQ ID NO: 1616399 - RNA, 14 nt, Pseudomonas putida KT2440
agguggccgccacc

SEQ ID NO: 1616400 - RNA, 13 nt, Pseudomonas putida KT2440
agguugcccggcg

SEQ ID NO: 1616401 - RNA, 18 nt, Pseudomonas putida KT2440
agguugcccucggccacc

SEQ ID NO: 1616402 - RNA, 23 nt, Pseudomonas putida KT2440
agguugacguuguagcggccauc

SEQ ID NO: 1616403 - RNA, 16 nt, Pseudomonas putida KT2440
agguugccaccagcau

SEQ ID NO: 1616404 - RNA, 16 nt, Pseudomonas putida KT2440
agguugaugugcaggu

SEQ ID NO: 1616405 - RNA, 19 nt, Pseudomonas putida KT2440
agguugcuggccuuggaca

SEQ ID NO: 1616406 - RNA, 12 nt, Pseudomonas putida KT2440
agguugcugccg

SEQ ID NO: 1616407 - RNA, 12 nt, Pseudomonas putida KT2440
agguugcucagg

SEQ ID NO: 1616408 - RNA, 17 nt, Pseudomonas putida KT2440
agguugcucagggcggc

SEQ ID NO: 1616409 - RNA, 17 nt, Pseudomonas putida KT2440
agguugcgcuccaucca

SEQ ID NO: 1616410 - RNA, 16 nt, Pseudomonas putida KT2440
agguugcgcgccgcca

SEQ ID NO: 1616411 - RNA, 20 nt, Pseudomonas putida KT2440
agguugcgcgccgccaggcg

SEQ ID NO: 1616412 - RNA, 15 nt, Pseudomonas putida KT2440
agguuuggguuggcu

SEQ ID NO: 1616413 - RNA, 14 nt, Pseudomonas putida KT2440
agguuuccagcccu

SEQ ID NO: 1616414 - RNA, 15 nt, Pseudomonas putida KT2440
agguuuccagcccuu

SEQ ID NO: 1616415 - RNA, 18 nt, Pseudomonas putida KT2440
agcuacgagacgguggcu

SEQ ID NO: 1616416 - RNA, 22 nt, Pseudomonas putida KT2440
agcuacagccccuuccccaggc

SEQ ID NO: 1616417 - RNA, 17 nt, Pseudomonas putida KT2440
agcguucggccagcacu

SEQ ID NO: 1616418 - RNA, 18 nt, Pseudomonas putida KT2440
agcguucggccagcacua

SEQ ID NO: 1616419 - RNA, 15 nt, Pseudomonas putida KT2440
agcguugcuccagcu

SEQ ID NO: 1616420 - RNA, 16 nt, Pseudomonas putida KT2440
agcuaucgccagcagg

SEQ ID NO: 1616421 - RNA, 14 nt, Pseudomonas putida KT2440
agcucaaccagcug

SEQ ID NO: 1616422 - RNA, 15 nt, Pseudomonas putida KT2440
agcucaaccauugcu

SEQ ID NO: 1616423 - RNA, 13 nt, Pseudomonas putida KT2440
agcucaaaugcug

SEQ ID NO: 1616424 - RNA, 20 nt, Pseudomonas putida KT2440
agcucagcugggagagcgcc

SEQ ID NO: 1616425 - RNA, 22 nt, Pseudomonas putida KT2440
agcucagguuacgcaccagcuc

SEQ ID NO: 1616426 - RNA, 12 nt, Pseudomonas putida KT2440
agcucaggccuu

SEQ ID NO: 1616427 - RNA, 13 nt, Pseudomonas putida KT2440
agcucagccagca

SEQ ID NO: 1616428 - RNA, 15 nt, Pseudomonas putida KT2440
agcucagccagcaag

SEQ ID NO: 1616429 - RNA, 21 nt, Pseudomonas putida KT2440
agcucacugaacgcaauaugc

SEQ ID NO: 1616430 - RNA, 14 nt, Pseudomonas putida KT2440
agcucacuggccaa

SEQ ID NO: 1616431 - RNA, 20 nt, Pseudomonas putida KT2440
agcucacguuugggcggcgu

SEQ ID NO: 1616432 - RNA, 19 nt, Pseudomonas putida KT2440
agcucagucgguagagcaa

SEQ ID NO: 1616433 - RNA, 23 nt, Pseudomonas putida KT2440
agcucagcuggauagaguacucg

SEQ ID NO: 1616434 - RNA, 16 nt, Pseudomonas putida KT2440
agcucauaucgcucgg

SEQ ID NO: 1616435 - RNA, 15 nt, Pseudomonas putida KT2440
agcucauccaggcug

SEQ ID NO: 1616436 - RNA, 17 nt, Pseudomonas putida KT2440
agcucauccaggcugca

SEQ ID NO: 1616437 - RNA, 18 nt, Pseudomonas putida KT2440
agcucauccaggcugcac

SEQ ID NO: 1616438 - RNA, 20 nt, Pseudomonas putida KT2440
agcucauccaggcugcacug

SEQ ID NO: 1616439 - RNA, 16 nt, Pseudomonas putida KT2440
agcggcuggcgcucgu

SEQ ID NO: 1616440 - RNA, 13 nt, Pseudomonas putida KT2440
agcggcuuggccg

SEQ ID NO: 1616441 - RNA, 12 nt, Pseudomonas putida KT2440
agcggcuucuac

SEQ ID NO: 1616442 - RNA, 16 nt, Pseudomonas putida KT2440
agcgguugcccgcugc

SEQ ID NO: 1616443 - RNA, 16 nt, Pseudomonas putida KT2440
agcgguugaccgccgc

SEQ ID NO: 1616444 - RNA, 19 nt, Pseudomonas putida KT2440
agcgguugaccgccgccac

SEQ ID NO: 1616445 - RNA, 17 nt, Pseudomonas putida KT2440
agcgguugcacggcccc

SEQ ID NO: 1616446 - RNA, 21 nt, Pseudomonas putida KT2440
agcgggcucgcccacacggca

SEQ ID NO: 1616447 - RNA, 16 nt, Pseudomonas putida KT2440
agcgggcuacacgcgc

SEQ ID NO: 1616448 - RNA, 21 nt, Pseudomonas putida KT2440
agcgggagucgaaccugcccg

SEQ ID NO: 1616449 - RNA, 18 nt, Pseudomonas putida KT2440
agcgggcaacugcgccug

SEQ ID NO: 1616450 - RNA, 17 nt, Pseudomonas putida KT2440
agcggcgucaccuuccu

SEQ ID NO: 1616451 - RNA, 22 nt, Pseudomonas putida KT2440
agcggcguguaguagcuccagc

SEQ ID NO: 1616452 - RNA, 23 nt, Pseudomonas putida KT2440
agcggccgcuugaucuuguccug

SEQ ID NO: 1616453 - RNA, 13 nt, Pseudomonas putida KT2440
agcggccggcccc

SEQ ID NO: 1616454 - RNA, 21 nt, Pseudomonas putida KT2440
agcggccggcccccccaucau

SEQ ID NO: 1616455 - RNA, 15 nt, Pseudomonas putida KT2440
agcggcccugagccu

SEQ ID NO: 1616456 - RNA, 22 nt, Pseudomonas putida KT2440
agcggccgaaggggcgggugga

SEQ ID NO: 1616457 - RNA, 15 nt, Pseudomonas putida KT2440
agcgcucaaaaaaau

SEQ ID NO: 1616458 - RNA, 16 nt, Pseudomonas putida KT2440
agcggccagcccgcca

SEQ ID NO: 1616459 - RNA, 16 nt, Pseudomonas putida KT2440
agcggcccccacgccg

SEQ ID NO: 1616460 - RNA, 17 nt, Pseudomonas putida KT2440
agcggccccaucacccc

SEQ ID NO: 1616461 - RNA, 22 nt, Pseudomonas putida KT2440
agcgucccugcccgaucgccuc

SEQ ID NO: 1616462 - RNA, 17 nt, Pseudomonas putida KT2440
agcgucgaugcggccac

SEQ ID NO: 1616463 - RNA, 16 nt, Pseudomonas putida KT2440
agcgugaaugcauggu

SEQ ID NO: 1616464 - RNA, 14 nt, Pseudomonas putida KT2440
agcgugaccugggc

SEQ ID NO: 1616465 - RNA, 20 nt, Pseudomonas putida KT2440
agcgugaccugggccggguc

SEQ ID NO: 1616466 - RNA, 22 nt, Pseudomonas putida KT2440
agcgucaugcgguacagcacug

SEQ ID NO: 1616467 - RNA, 21 nt, Pseudomonas putida KT2440
agcgucaugaacucaguuaca

SEQ ID NO: 1616468 - RNA, 17 nt, Pseudomonas putida KT2440
agcguggccgccaacag

SEQ ID NO: 1616469 - RNA, 21 nt, Pseudomonas putida KT2440
agcguggcaaacccggccagc

SEQ ID NO: 1616470 - RNA, 15 nt, Pseudomonas putida KT2440
agcgugggccgugca

SEQ ID NO: 1616471 - RNA, 21 nt, Pseudomonas putida KT2440
agcgugggccgugcaggcggc

SEQ ID NO: 1616472 - RNA, 22 nt, Pseudomonas putida KT2440
agcgccgaugcucgucagcccc

SEQ ID NO: 1616473 - RNA, 16 nt, Pseudomonas putida KT2440
agcgcccuucacgcuc

SEQ ID NO: 1616474 - RNA, 19 nt, Pseudomonas putida KT2440
agcgccuccagcaggggca

SEQ ID NO: 1616475 - RNA, 18 nt, Pseudomonas putida KT2440
agcgccgcauccagcacu

SEQ ID NO: 1616476 - RNA, 16 nt, Pseudomonas putida KT2440
agcgccgccaacucgc

SEQ ID NO: 1616477 - RNA, 11 nt, Pseudomonas putida KT2440
agcgccuccac

SEQ ID NO: 1616478 - RNA, 13 nt, Pseudomonas putida KT2440
agcgccugcagcg

SEQ ID NO: 1616479 - RNA, 22 nt, Pseudomonas putida KT2440
agcgccugcauggcaugcagga

SEQ ID NO: 1616480 - RNA, 17 nt, Pseudomonas putida KT2440
agcgccugccuggcccu

SEQ ID NO: 1616481 - RNA, 22 nt, Pseudomonas putida KT2440
agcgccugauuacccugcgcca

SEQ ID NO: 1616482 - RNA, 12 nt, Pseudomonas putida KT2440
agcgccuucuug

SEQ ID NO: 1616483 - RNA, 23 nt, Pseudomonas putida KT2440
agcgccuuggccugcucacccga

SEQ ID NO: 1616484 - RNA, 24 nt, Pseudomonas putida KT2440
agcgccuuggccugcucacccgac

SEQ ID NO: 1616485 - RNA, 21 nt, Pseudomonas putida KT2440
agcgcgaagcccagcuugccc

SEQ ID NO: 1616486 - RNA, 13 nt, Pseudomonas putida KT2440
agcgcgccuccag

SEQ ID NO: 1616487 - RNA, 15 nt, Pseudomonas putida KT2440
agcgcgccuccagcu

SEQ ID NO: 1616488 - RNA, 12 nt, Pseudomonas putida KT2440
agcgcgccggcg

SEQ ID NO: 1616489 - RNA, 16 nt, Pseudomonas putida KT2440
agcgcgccggcgucga

SEQ ID NO: 1616490 - RNA, 14 nt, Pseudomonas putida KT2440
agcgcauccaccuc

SEQ ID NO: 1616491 - RNA, 21 nt, Pseudomonas putida KT2440
agcgccagcaucgaggaaggc

SEQ ID NO: 1616492 - RNA, 20 nt, Pseudomonas putida KT2440
agcgccagaucucgcgcuuu

SEQ ID NO: 1616493 - RNA, 14 nt, Pseudomonas putida KT2440
agcgcacagcugcc

SEQ ID NO: 1616494 - RNA, 19 nt, Pseudomonas putida KT2440
agcgcaagggggcaaagaa

SEQ ID NO: 1616495 - RNA, 20 nt, Pseudomonas putida KT2440
agcgcaucgaccggcaggcg

SEQ ID NO: 1616496 - RNA, 16 nt, Pseudomonas putida KT2440
agcgcauaggcaauga

SEQ ID NO: 1616497 - RNA, 21 nt, Pseudomonas putida KT2440
agcgcaucaacgccucgcugc

SEQ ID NO: 1616498 - RNA, 23 nt, Pseudomonas putida KT2440
agcgauugcccagcguucggguc

SEQ ID NO: 1616499 - RNA, 17 nt, Pseudomonas putida KT2440
agcgcaaaaccaccagc

SEQ ID NO: 1616500 - RNA, 20 nt, Pseudomonas putida KT2440
agcgcaaaaccaccagccgu

SEQ ID NO: 1616501 - RNA, 13 nt, Pseudomonas putida KT2440
agcgaugccgggg

SEQ ID NO: 1616502 - RNA, 15 nt, Pseudomonas putida KT2440
agcgaugccggggcu

SEQ ID NO: 1616503 - RNA, 14 nt, Pseudomonas putida KT2440
agcgaugcacgcca

SEQ ID NO: 1616504 - RNA, 22 nt, Pseudomonas putida KT2440
agcgaucgaaaggcgacuccug

SEQ ID NO: 1616505 - RNA, 21 nt, Pseudomonas putida KT2440
agcgauaauugugcccuugaa

SEQ ID NO: 1616506 - RNA, 23 nt, Pseudomonas putida KT2440
agcgaguggccacggaucaccac

SEQ ID NO: 1616507 - RNA, 16 nt, Pseudomonas putida KT2440
agcgauaaaccagcag

SEQ ID NO: 1616508 - RNA, 17 nt, Pseudomonas putida KT2440
agcgauaaaccagcagc

SEQ ID NO: 1616509 - RNA, 18 nt, Pseudomonas putida KT2440
agcgauaaggcuugcccu

SEQ ID NO: 1616510 - RNA, 14 nt, Pseudomonas putida KT2440
agcgagugaccuug

SEQ ID NO: 1616511 - RNA, 16 nt, Pseudomonas putida KT2440
agcgagugaccuuggc

SEQ ID NO: 1616512 - RNA, 21 nt, Pseudomonas putida KT2440
agcgagguacggcaagguacu

SEQ ID NO: 1616513 - RNA, 18 nt, Pseudomonas putida KT2440
agcgaggguuccaggcca

SEQ ID NO: 1616514 - RNA, 22 nt, Pseudomonas putida KT2440
agcgacgugcaaggaucaccaa

SEQ ID NO: 1616515 - RNA, 15 nt, Pseudomonas putida KT2440
agcgacaccagcgca

SEQ ID NO: 1616516 - RNA, 17 nt, Pseudomonas putida KT2440
agcgagcccgcgcgcga

SEQ ID NO: 1616517 - RNA, 14 nt, Pseudomonas putida KT2440
agcgagcaccggca

SEQ ID NO: 1616518 - RNA, 15 nt, Pseudomonas putida KT2440
agcgacuucgaccac

SEQ ID NO: 1616519 - RNA, 16 nt, Pseudomonas putida KT2440
agcgagcagccuggca

SEQ ID NO: 1616520 - RNA, 20 nt, Pseudomonas putida KT2440
agccgcaggccaaugcagcu

SEQ ID NO: 1616521 - RNA, 16 nt, Pseudomonas putida KT2440
agccgcaggcgccccc

SEQ ID NO: 1616522 - RNA, 23 nt, Pseudomonas putida KT2440
agccgcaggcgcccccugggcgu

SEQ ID NO: 1616523 - RNA, 13 nt, Pseudomonas putida KT2440
agccgccagacuu

SEQ ID NO: 1616524 - RNA, 14 nt, Pseudomonas putida KT2440
agccgccacaugcc

SEQ ID NO: 1616525 - RNA, 20 nt, Pseudomonas putida KT2440
agccugacgcgccgccaacc

SEQ ID NO: 1616526 - RNA, 17 nt, Pseudomonas putida KT2440
agccugcaaggaaaacc

SEQ ID NO: 1616527 - RNA, 14 nt, Pseudomonas putida KT2440
agccugcacccagc

SEQ ID NO: 1616528 - RNA, 14 nt, Pseudomonas putida KT2440
agccugcagggccu

SEQ ID NO: 1616529 - RNA, 22 nt, Pseudomonas putida KT2440
agccugcacgcucagugugggg

SEQ ID NO: 1616530 - RNA, 16 nt, Pseudomonas putida KT2440
agccugcacuggccuc

SEQ ID NO: 1616531 - RNA, 19 nt, Pseudomonas putida KT2440
agccugcacuggccucuuc

SEQ ID NO: 1616532 - RNA, 15 nt, Pseudomonas putida KT2440
agccugcuccagcac

SEQ ID NO: 1616533 - RNA, 24 nt, Pseudomonas putida KT2440
agccuggccgguguggccaaggcg

SEQ ID NO: 1616534 - RNA, 19 nt, Pseudomonas putida KT2440
agcgaaacaccagcaacau

SEQ ID NO: 1616535 - RNA, 15 nt, Pseudomonas putida KT2440
agcgaauagcaacac

SEQ ID NO: 1616536 - RNA, 20 nt, Pseudomonas putida KT2440
agcgaauaguagaagcagau

SEQ ID NO: 1616537 - RNA, 20 nt, Pseudomonas putida KT2440
agccuuucgagagccgggca

SEQ ID NO: 1616538 - RNA, 14 nt, Pseudomonas putida KT2440
agccuuugcgccuu

SEQ ID NO: 1616539 - RNA, 16 nt, Pseudomonas putida KT2440
agcagucccaucuggu

SEQ ID NO: 1616540 - RNA, 15 nt, Pseudomonas putida KT2440
agcagugccagcaac

SEQ ID NO: 1616541 - RNA, 22 nt, Pseudomonas putida KT2440
agcagugcggcaaccaccaaca

SEQ ID NO: 1616542 - RNA, 15 nt, Pseudomonas putida KT2440
agcagugaucaucac

SEQ ID NO: 1616543 - RNA, 19 nt, Pseudomonas putida KT2440
agcagucuugugcugcgag

SEQ ID NO: 1616544 - RNA, 18 nt, Pseudomonas putida KT2440
agcauagccaaacuugug

SEQ ID NO: 1616545 - RNA, 17 nt, Pseudomonas putida KT2440
agcaucagcacacccag

SEQ ID NO: 1616546 - RNA, 21 nt, Pseudomonas putida KT2440
agcaucagcacacccagcacg

SEQ ID NO: 1616547 - RNA, 15 nt, Pseudomonas putida KT2440
agcaucaccgcgucg

SEQ ID NO: 1616548 - RNA, 16 nt, Pseudomonas putida KT2440
agcaucaccgcgucga

SEQ ID NO: 1616549 - RNA, 13 nt, Pseudomonas putida KT2440
agcaucacgccgc

SEQ ID NO: 1616550 - RNA, 18 nt, Pseudomonas putida KT2440
agcaucaccacgcccugg

SEQ ID NO: 1616551 - RNA, 13 nt, Pseudomonas putida KT2440
agcaucacccgcg

SEQ ID NO: 1616552 - RNA, 17 nt, Pseudomonas putida KT2440
agcaucaccgcgccggu

SEQ ID NO: 1616553 - RNA, 21 nt, Pseudomonas putida KT2440
agcaugacccuaugcgugaaa

SEQ ID NO: 1616554 - RNA, 16 nt, Pseudomonas putida KT2440
agcaugaacagcgcug

SEQ ID NO: 1616555 - RNA, 10 nt, Pseudomonas putida KT2440
agcaugaacg

SEQ ID NO: 1616556 - RNA, 15 nt, Pseudomonas putida KT2440
agcagcgcuccgcca

SEQ ID NO: 1616557 - RNA, 21 nt, Pseudomonas putida KT2440
agcagcgccgccaggcccacc

SEQ ID NO: 1616558 - RNA, 22 nt, Pseudomonas putida KT2440
agcagcgccgccaggcccacca

SEQ ID NO: 1616559 - RNA, 23 nt, Pseudomonas putida KT2440
agcagcgggcacaggccgcgcau

SEQ ID NO: 1616560 - RNA, 16 nt, Pseudomonas putida KT2440
agcaggagcugaacug

SEQ ID NO: 1616561 - RNA, 17 nt, Pseudomonas putida KT2440
agcagcguacccagcuc

SEQ ID NO: 1616562 - RNA, 19 nt, Pseudomonas putida KT2440
agcaggcccgccaccgccu

SEQ ID NO: 1616563 - RNA, 20 nt, Pseudomonas putida KT2440
agcaggcccggcccauucgc

SEQ ID NO: 1616564 - RNA, 22 nt, Pseudomonas putida KT2440
agcaggccauacagggccuggc

SEQ ID NO: 1616565 - RNA, 20 nt, Pseudomonas putida KT2440
agcaggcaagcccgcuugcu

SEQ ID NO: 1616566 - RNA, 22 nt, Pseudomonas putida KT2440
agcaggauggugacugccagca

SEQ ID NO: 1616567 - RNA, 16 nt, Pseudomonas putida KT2440
agcaggaugucaggag

SEQ ID NO: 1616568 - RNA, 21 nt, Pseudomonas putida KT2440
agcaggaucugcugcagcaug

SEQ ID NO: 1616569 - RNA, 15 nt, Pseudomonas putida KT2440
agcaggcgcggcgug

SEQ ID NO: 1616570 - RNA, 14 nt, Pseudomonas putida KT2440
agcaggcugcgcuu

SEQ ID NO: 1616571 - RNA, 19 nt, Pseudomonas putida KT2440
agcaggcugcgugccugcu

SEQ ID NO: 1616572 - RNA, 17 nt, Pseudomonas putida KT2440
agcagggaaaugaccug

SEQ ID NO: 1616573 - RNA, 18 nt, Pseudomonas putida KT2440
agcagguuuuccagcccg

SEQ ID NO: 1616574 - RNA, 21 nt, Pseudomonas putida KT2440
agcagguuuuccagcccguca

SEQ ID NO: 1616575 - RNA, 21 nt, Pseudomonas putida KT2440
agcagcacaucccgucagccg

SEQ ID NO: 1616576 - RNA, 13 nt, Pseudomonas putida KT2440
agcagcagagaga

SEQ ID NO: 1616577 - RNA, 14 nt, Pseudomonas putida KT2440
agcagcagccccag

SEQ ID NO: 1616578 - RNA, 16 nt, Pseudomonas putida KT2440
agcagcagccccagcg

SEQ ID NO: 1616579 - RNA, 19 nt, Pseudomonas putida KT2440
agcagcaccgccaccaugc

SEQ ID NO: 1616580 - RNA, 21 nt, Pseudomonas putida KT2440
agcagcaccgccaccaugcuc

SEQ ID NO: 1616581 - RNA, 18 nt, Pseudomonas putida KT2440
agcagccccacgcccagg

SEQ ID NO: 1616582 - RNA, 19 nt, Pseudomonas putida KT2440
agcagcaguucggcaacau

SEQ ID NO: 1616583 - RNA, 19 nt, Pseudomonas putida KT2440
agcagcaugaauagcgcac

SEQ ID NO: 1616584 - RNA, 17 nt, Pseudomonas putida KT2440
agcagaugaacccggca

SEQ ID NO: 1616585 - RNA, 16 nt, Pseudomonas putida KT2440
agcacgucggcgccga

SEQ ID NO: 1616586 - RNA, 16 nt, Pseudomonas putida KT2440
agcacgaaggccagca

SEQ ID NO: 1616587 - RNA, 16 nt, Pseudomonas putida KT2440
agcaccuucuugccca

SEQ ID NO: 1616588 - RNA, 23 nt, Pseudomonas putida KT2440
agcacgaaacugcgcugguacag

SEQ ID NO: 1616589 - RNA, 23 nt, Pseudomonas putida KT2440
agcaaccucgagguacgagucag

SEQ ID NO: 1616590 - RNA, 22 nt, Pseudomonas putida KT2440
agcaaccacgcuuggcucauca

SEQ ID NO: 1616591 - RNA, 21 nt, Pseudomonas putida KT2440
agcaccucgcucagcuugaac

SEQ ID NO: 1616592 - RNA, 12 nt, Pseudomonas putida KT2440
agcaccuccacc

SEQ ID NO: 1616593 - RNA, 18 nt, Pseudomonas putida KT2440
agcaccugcagguacagc

SEQ ID NO: 1616594 - RNA, 22 nt, Pseudomonas putida KT2440
agcaccugcagguacagcagcu

SEQ ID NO: 1616595 - RNA, 17 nt, Pseudomonas putida KT2440
agcaccugccagccgca

SEQ ID NO: 1616596 - RNA, 15 nt, Pseudomonas putida KT2440
agccaggcacagauc

SEQ ID NO: 1616597 - RNA, 19 nt, Pseudomonas putida KT2440
agccagucugcuccaccgc

SEQ ID NO: 1616598 - RNA, 16 nt, Pseudomonas putida KT2440
agccagcuggccaccu

SEQ ID NO: 1616599 - RNA, 15 nt, Pseudomonas putida KT2440
agccaugcaccgucu

SEQ ID NO: 1616600 - RNA, 16 nt, Pseudomonas putida KT2440
agccaugaaaaagccc

SEQ ID NO: 1616601 - RNA, 19 nt, Pseudomonas putida KT2440
agccauaguuuugugccac

SEQ ID NO: 1616602 - RNA, 21 nt, Pseudomonas putida KT2440
agccaugccguaagccgcagg

SEQ ID NO: 1616603 - RNA, 17 nt, Pseudomonas putida KT2440
agccaugaucagcgccu

SEQ ID NO: 1616604 - RNA, 21 nt, Pseudomonas putida KT2440
agccaugcgcaggcagcgaug

SEQ ID NO: 1616605 - RNA, 16 nt, Pseudomonas putida KT2440
agccaugggcaggucg

SEQ ID NO: 1616606 - RNA, 15 nt, Pseudomonas putida KT2440
agcccaaacagcauc

SEQ ID NO: 1616607 - RNA, 19 nt, Pseudomonas putida KT2440
agccauugacccgcuugca

SEQ ID NO: 1616608 - RNA, 18 nt, Pseudomonas putida KT2440
agcccacacaccgcaacc

SEQ ID NO: 1616609 - RNA, 12 nt, Pseudomonas putida KT2440
agcccaaggcug

SEQ ID NO: 1616610 - RNA, 12 nt, Pseudomonas putida KT2440
agcccaagggcu

SEQ ID NO: 1616611 - RNA, 18 nt, Pseudomonas putida KT2440
agcccaaccucugaugug

SEQ ID NO: 1616612 - RNA, 14 nt, Pseudomonas putida KT2440
agcccaaagggcug

SEQ ID NO: 1616613 - RNA, 22 nt, Pseudomonas putida KT2440
agcauggcaaacagcaccagcc

SEQ ID NO: 1616614 - RNA, 21 nt, Pseudomonas putida KT2440
agcaugcccagcgccaccggc

SEQ ID NO: 1616615 - RNA, 23 nt, Pseudomonas putida KT2440
agcaugccccgggugcagccgca

SEQ ID NO: 1616616 - RNA, 16 nt, Pseudomonas putida KT2440
agcaugcgggggcccc

SEQ ID NO: 1616617 - RNA, 16 nt, Pseudomonas putida KT2440
agccaaccgagucaac

SEQ ID NO: 1616618 - RNA, 20 nt, Pseudomonas putida KT2440
agccaaccgccccacccauu

SEQ ID NO: 1616619 - RNA, 17 nt, Pseudomonas putida KT2440
agcauggcgaucucuuc

SEQ ID NO: 1616620 - RNA, 21 nt, Pseudomonas putida KT2440
agccaacugcucuaccaacug

SEQ ID NO: 1616621 - RNA, 14 nt, Pseudomonas putida KT2440
agccaacgccccac

SEQ ID NO: 1616622 - RNA, 17 nt, Pseudomonas putida KT2440
agccaacgccccacccg

SEQ ID NO: 1616623 - RNA, 20 nt, Pseudomonas putida KT2440
agccaacgccccacccgcuc

SEQ ID NO: 1616624 - RNA, 19 nt, Pseudomonas putida KT2440
agccagacauugaagaagc

SEQ ID NO: 1616625 - RNA, 16 nt, Pseudomonas putida KT2440
agccagacgaccagca

SEQ ID NO: 1616626 - RNA, 18 nt, Pseudomonas putida KT2440
agccagacgaccagcaug

SEQ ID NO: 1616627 - RNA, 18 nt, Pseudomonas putida KT2440
agccagcgcuaaaccugu

SEQ ID NO: 1616628 - RNA, 20 nt, Pseudomonas putida KT2440
agccagccuucgccaacugc

SEQ ID NO: 1616629 - RNA, 15 nt, Pseudomonas putida KT2440
agccagcgugggccg

SEQ ID NO: 1616630 - RNA, 22 nt, Pseudomonas putida KT2440
agccagcgugggccgugcaggc

SEQ ID NO: 1616631 - RNA, 14 nt, Pseudomonas putida KT2440
agccacccuccgca

SEQ ID NO: 1616632 - RNA, 21 nt, Pseudomonas putida KT2440
agccaccucgacccccuugcc

SEQ ID NO: 1616633 - RNA, 13 nt, Pseudomonas putida KT2440
agccaccgcgagc

SEQ ID NO: 1616634 - RNA, 18 nt, Pseudomonas putida KT2440
agccacgcaucugcaccu

SEQ ID NO: 1616635 - RNA, 19 nt, Pseudomonas putida KT2440
agccacgcaucugcaccug

SEQ ID NO: 1616636 - RNA, 12 nt, Pseudomonas putida KT2440
agccacgcugcc

SEQ ID NO: 1616637 - RNA, 17 nt, Pseudomonas putida KT2440
agccacgcugccaggac

SEQ ID NO: 1616638 - RNA, 19 nt, Pseudomonas putida KT2440
agcccgaaaccgccagcca

SEQ ID NO: 1616639 - RNA, 15 nt, Pseudomonas putida KT2440
agccccuccuaaggg

SEQ ID NO: 1616640 - RNA, 17 nt, Pseudomonas putida KT2440
agccccugcaauuucuu

SEQ ID NO: 1616641 - RNA, 14 nt, Pseudomonas putida KT2440
agccccugcauccg

SEQ ID NO: 1616642 - RNA, 22 nt, Pseudomonas putida KT2440
agccccggcuuucucaagccug

SEQ ID NO: 1616643 - RNA, 20 nt, Pseudomonas putida KT2440
agccccucauucaaagccug

SEQ ID NO: 1616644 - RNA, 16 nt, Pseudomonas putida KT2440
agccccuagcgcaucc

SEQ ID NO: 1616645 - RNA, 15 nt, Pseudomonas putida KT2440
agccccgccgccccc

SEQ ID NO: 1616646 - RNA, 13 nt, Pseudomonas putida KT2440
agcccccccagca

SEQ ID NO: 1616647 - RNA, 12 nt, Pseudomonas putida KT2440
agccccgccagu

SEQ ID NO: 1616648 - RNA, 22 nt, Pseudomonas putida KT2440
agccccgcgcguccauggcgcc

SEQ ID NO: 1616649 - RNA, 15 nt, Pseudomonas putida KT2440
agccccgcacaucac

SEQ ID NO: 1616650 - RNA, 13 nt, Pseudomonas putida KT2440
agccccccugccg

SEQ ID NO: 1616651 - RNA, 18 nt, Pseudomonas putida KT2440
agcccccgcugcucgagg

SEQ ID NO: 1616652 - RNA, 22 nt, Pseudomonas putida KT2440
agcccccgcugcucgaggaagc

SEQ ID NO: 1616653 - RNA, 17 nt, Pseudomonas putida KT2440
agccccaucaccagccc

SEQ ID NO: 1616654 - RNA, 18 nt, Pseudomonas putida KT2440
agccccaucaccagcccg

SEQ ID NO: 1616655 - RNA, 22 nt, Pseudomonas putida KT2440
agcccccagaauguugcaagga

SEQ ID NO: 1616656 - RNA, 13 nt, Pseudomonas putida KT2440
agcccccagcaca

SEQ ID NO: 1616657 - RNA, 11 nt, Pseudomonas putida KT2440
agccccagccg

SEQ ID NO: 1616658 - RNA, 16 nt, Pseudomonas putida KT2440
agccccaccaggaagc

SEQ ID NO: 1616659 - RNA, 19 nt, Pseudomonas putida KT2440
agcccaguucuuggcggcu

SEQ ID NO: 1616660 - RNA, 13 nt, Pseudomonas putida KT2440
agcccaguugcug

SEQ ID NO: 1616661 - RNA, 16 nt, Pseudomonas putida KT2440
agcccauaaaccccag

SEQ ID NO: 1616662 - RNA, 19 nt, Pseudomonas putida KT2440
agcccauaaaccccagccu

SEQ ID NO: 1616663 - RNA, 23 nt, Pseudomonas putida KT2440
agcccauaaaccccagccuucag

SEQ ID NO: 1616664 - RNA, 21 nt, Pseudomonas putida KT2440
agccccaaccuuccagcaaag

SEQ ID NO: 1616665 - RNA, 15 nt, Pseudomonas putida KT2440
agcccauuucaccug

SEQ ID NO: 1616666 - RNA, 16 nt, Pseudomonas putida KT2440
agcccauuucaccugc

SEQ ID NO: 1616667 - RNA, 11 nt, Pseudomonas putida KT2440
agcccauuucg

SEQ ID NO: 1616668 - RNA, 21 nt, Pseudomonas putida KT2440
agcccauuucgugggucacgc

SEQ ID NO: 1616669 - RNA, 22 nt, Pseudomonas putida KT2440
agcccauggcgcugaccgggac

SEQ ID NO: 1616670 - RNA, 14 nt, Pseudomonas putida KT2440
agcccagcgccagu

SEQ ID NO: 1616671 - RNA, 15 nt, Pseudomonas putida KT2440
agcccugccucagcu

SEQ ID NO: 1616672 - RNA, 23 nt, Pseudomonas putida KT2440
agcccguggcccucagcccagua

SEQ ID NO: 1616673 - RNA, 19 nt, Pseudomonas putida KT2440
agcccgugccgcaucagcc

SEQ ID NO: 1616674 - RNA, 21 nt, Pseudomonas putida KT2440
agcccuucucgcucagcaacu

SEQ ID NO: 1616675 - RNA, 12 nt, Pseudomonas putida KT2440
agcccuucugaa

SEQ ID NO: 1616676 - RNA, 19 nt, Pseudomonas putida KT2440
agcccuucgaugcuccuau

SEQ ID NO: 1616677 - RNA, 18 nt, Pseudomonas putida KT2440
agcccuugcucggccagc

SEQ ID NO: 1616678 - RNA, 20 nt, Pseudomonas putida KT2440
agcccuugcucggccagccg

SEQ ID NO: 1616679 - RNA, 18 nt, Pseudomonas putida KT2440
agcccuugcugcagcagg

SEQ ID NO: 1616680 - RNA, 19 nt, Pseudomonas putida KT2440
agcccuugcugcagcaggc

SEQ ID NO: 1616681 - RNA, 14 nt, Pseudomonas putida KT2440
agcccgccugcuca

SEQ ID NO: 1616682 - RNA, 18 nt, Pseudomonas putida KT2440
agcccggcggccagcacg

SEQ ID NO: 1616683 - RNA, 13 nt, Pseudomonas putida KT2440
agcccggcgccua

SEQ ID NO: 1616684 - RNA, 16 nt, Pseudomonas putida KT2440
agcccggcuugcacca

SEQ ID NO: 1616685 - RNA, 14 nt, Pseudomonas putida KT2440
agcccgggcagccg

SEQ ID NO: 1616686 - RNA, 17 nt, Pseudomonas putida KT2440
agcccggugcccuugcc

SEQ ID NO: 1616687 - RNA, 13 nt, Pseudomonas putida KT2440
agcccgguccaug

SEQ ID NO: 1616688 - RNA, 20 nt, Pseudomonas putida KT2440
agcccgagcaaggcgcagcc

SEQ ID NO: 1616689 - RNA, 18 nt, Pseudomonas putida KT2440
agcccgauggccuugauc

SEQ ID NO: 1616690 - RNA, 16 nt, Pseudomonas putida KT2440
agcccgcacugcaaug

SEQ ID NO: 1616691 - RNA, 21 nt, Pseudomonas putida KT2440
agcccgcccacaugcgagccg

SEQ ID NO: 1616692 - RNA, 15 nt, Pseudomonas putida KT2440
agcccgccagcaggc

SEQ ID NO: 1616693 - RNA, 12 nt, Pseudomonas putida KT2440
agcccgccgcca

SEQ ID NO: 1616694 - RNA, 14 nt, Pseudomonas putida KT2440
agcccgccgccagu

SEQ ID NO: 1616695 - RNA, 12 nt, Pseudomonas putida KT2440
agcaaacgccag

SEQ ID NO: 1616696 - RNA, 23 nt, Pseudomonas putida KT2440
agcaaacccgacaacagcugcau

SEQ ID NO: 1616697 - RNA, 15 nt, Pseudomonas putida KT2440
agcaaaggcgaccuu

SEQ ID NO: 1616698 - RNA, 14 nt, Pseudomonas putida KT2440
agcaaagcccgccc

SEQ ID NO: 1616699 - RNA, 22 nt, Pseudomonas putida KT2440
agcaacaccguagcgagcaccg

SEQ ID NO: 1616700 - RNA, 21 nt, Pseudomonas putida KT2440
agcaacacgacgauggccacc

SEQ ID NO: 1616701 - RNA, 19 nt, Pseudomonas putida KT2440
agcaacaacgccuuggccu

SEQ ID NO: 1616702 - RNA, 16 nt, Pseudomonas putida KT2440
agcaaaugcccacugc

SEQ ID NO: 1616703 - RNA, 23 nt, Pseudomonas putida KT2440
agcaaagguuugucgcccgccuc

SEQ ID NO: 1616704 - RNA, 17 nt, Pseudomonas putida KT2440
agauuucucagcuggaa

SEQ ID NO: 1616705 - RNA, 13 nt, Pseudomonas putida KT2440
agauuggccagca

SEQ ID NO: 1616706 - RNA, 13 nt, Pseudomonas putida KT2440
agauugcaucacu

SEQ ID NO: 1616707 - RNA, 13 nt, Pseudomonas putida KT2440
agauuccgggcug

SEQ ID NO: 1616708 - RNA, 17 nt, Pseudomonas putida KT2440
agauugagaggacuuua

SEQ ID NO: 1616709 - RNA, 14 nt, Pseudomonas putida KT2440
agauugaaggggca

SEQ ID NO: 1616710 - RNA, 18 nt, Pseudomonas putida KT2440
agauugcccuguggcugu

SEQ ID NO: 1616711 - RNA, 17 nt, Pseudomonas putida KT2440
agauucaagcccggcgc

SEQ ID NO: 1616712 - RNA, 13 nt, Pseudomonas putida KT2440
agauguucaccag

SEQ ID NO: 1616713 - RNA, 22 nt, Pseudomonas putida KT2440
agauggcccggucccgcugccg

SEQ ID NO: 1616714 - RNA, 17 nt, Pseudomonas putida KT2440
agauggcucaucgccgu

SEQ ID NO: 1616715 - RNA, 21 nt, Pseudomonas putida KT2440
agauguacagaaugcgcucga

SEQ ID NO: 1616716 - RNA, 23 nt, Pseudomonas putida KT2440
agaugaguuccguugcuacugcu

SEQ ID NO: 1616717 - RNA, 22 nt, Pseudomonas putida KT2440
agauacgcgaggcauccacacc

SEQ ID NO: 1616718 - RNA, 21 nt, Pseudomonas putida KT2440
agauacgcuucgaacacccgc

SEQ ID NO: 1616719 - RNA, 12 nt, Pseudomonas putida KT2440
agauccugcagc

SEQ ID NO: 1616720 - RNA, 12 nt, Pseudomonas putida KT2440
agaucaucaucg

SEQ ID NO: 1616721 - RNA, 22 nt, Pseudomonas putida KT2440
agaucaggcaaucacgaucacu

SEQ ID NO: 1616722 - RNA, 12 nt, Pseudomonas putida KT2440
agaucagcagca

SEQ ID NO: 1616723 - RNA, 22 nt, Pseudomonas putida KT2440
agaucacuguugucggccagau

SEQ ID NO: 1616724 - RNA, 21 nt, Pseudomonas putida KT2440
agaucacuuccaccugcgccu

SEQ ID NO: 1616725 - RNA, 17 nt, Pseudomonas putida KT2440
agaucagcaaccugcug

SEQ ID NO: 1616726 - RNA, 15 nt, Pseudomonas putida KT2440
agauaucuggacccc

SEQ ID NO: 1616727 - RNA, 15 nt, Pseudomonas putida KT2440
agauaucgcauuucu

SEQ ID NO: 1616728 - RNA, 18 nt, Pseudomonas putida KT2440
agauauugguccagccac

SEQ ID NO: 1616729 - RNA, 22 nt, Pseudomonas putida KT2440
agaggccagcacaggcggccga

SEQ ID NO: 1616730 - RNA, 22 nt, Pseudomonas putida KT2440
agaggccagugagccucacaca

SEQ ID NO: 1616731 - RNA, 17 nt, Pseudomonas putida KT2440
agaggcguagcaagcag

SEQ ID NO: 1616732 - RNA, 16 nt, Pseudomonas putida KT2440
aaaacauugcuaauuu

SEQ ID NO: 1616733 - RNA, 22 nt, Pseudomonas putida KT2440
agaggugccuaucgcucuggca

SEQ ID NO: 1616734 - RNA, 16 nt, Pseudomonas putida KT2440
agagaucugcaggggu

SEQ ID NO: 1616735 - RNA, 13 nt, Pseudomonas putida KT2440
agagccugcaccc

SEQ ID NO: 1616736 - RNA, 16 nt, Pseudomonas putida KT2440
agagccggugccaucc

SEQ ID NO: 1616737 - RNA, 13 nt, Pseudomonas putida KT2440
agagcgcccacca

SEQ ID NO: 1616738 - RNA, 16 nt, Pseudomonas putida KT2440
agagccuuuggcugga

SEQ ID NO: 1616739 - RNA, 12 nt, Pseudomonas putida KT2440
agaccagcagca

SEQ ID NO: 1616740 - RNA, 13 nt, Pseudomonas putida KT2440
agaccagcagcag

SEQ ID NO: 1616741 - RNA, 15 nt, Pseudomonas putida KT2440
agaccacgcgcucgu

SEQ ID NO: 1616742 - RNA, 16 nt, Pseudomonas putida KT2440
agacauugaagaagcc

SEQ ID NO: 1616743 - RNA, 23 nt, Pseudomonas putida KT2440
agacauccgcaacaugaagccau

SEQ ID NO: 1616744 - RNA, 22 nt, Pseudomonas putida KT2440
agacaucgauuucgccaucgcc

SEQ ID NO: 1616745 - RNA, 18 nt, Pseudomonas putida KT2440
agacggucuccccuuccc

SEQ ID NO: 1616746 - RNA, 20 nt, Pseudomonas putida KT2440
agacggucuccccuuccccc

SEQ ID NO: 1616747 - RNA, 16 nt, Pseudomonas putida KT2440
agaccugugggagcgg

SEQ ID NO: 1616748 - RNA, 19 nt, Pseudomonas putida KT2440
agaccuucuggcagccgcc

SEQ ID NO: 1616749 - RNA, 18 nt, Pseudomonas putida KT2440
agaccgauuucaacccua

SEQ ID NO: 1616750 - RNA, 19 nt, Pseudomonas putida KT2440
agaaggcguggugcagacg

SEQ ID NO: 1616751 - RNA, 19 nt, Pseudomonas putida KT2440
agaaggcugcguaaggccg

SEQ ID NO: 1616752 - RNA, 15 nt, Pseudomonas putida KT2440
agaagguaucggcca

SEQ ID NO: 1616753 - RNA, 19 nt, Pseudomonas putida KT2440
agaagguaucggccauggc

SEQ ID NO: 1616754 - RNA, 21 nt, Pseudomonas putida KT2440
agaagguaucggccauggccg

SEQ ID NO: 1616755 - RNA, 15 nt, Pseudomonas putida KT2440
agaauccucuaugcc

SEQ ID NO: 1616756 - RNA, 24 nt, Pseudomonas putida KT2440
agaaugacuucgcugcccgagcgu

SEQ ID NO: 1616757 - RNA, 20 nt, Pseudomonas putida KT2440
agaaugugcucggccugggc

SEQ ID NO: 1616758 - RNA, 22 nt, Pseudomonas putida KT2440
agaaugugcucggccugggcag

SEQ ID NO: 1616759 - RNA, 16 nt, Pseudomonas putida KT2440
agacacaggcgcucgu

SEQ ID NO: 1616760 - RNA, 22 nt, Pseudomonas putida KT2440
agacagaagccuguacacagcc

SEQ ID NO: 1616761 - RNA, 20 nt, Pseudomonas putida KT2440
agaacaagccccuccuaagg

SEQ ID NO: 1616762 - RNA, 13 nt, Pseudomonas putida KT2440
agaacacuggcag

SEQ ID NO: 1616763 - RNA, 15 nt, Pseudomonas putida KT2440
agaacacuggcaggc

SEQ ID NO: 1616764 - RNA, 17 nt, Pseudomonas putida KT2440
agaacagccacagcugc

SEQ ID NO: 1616765 - RNA, 18 nt, Pseudomonas putida KT2440
agaacaggcggcccggca

SEQ ID NO: 1616766 - RNA, 22 nt, Pseudomonas putida KT2440
agaacaggcggcuguccggcgu

SEQ ID NO: 1616767 - RNA, 16 nt, Pseudomonas putida KT2440
agaacagcgugccaug

SEQ ID NO: 1616768 - RNA, 19 nt, Pseudomonas putida KT2440
agaacaucaggucugccag

SEQ ID NO: 1616769 - RNA, 17 nt, Pseudomonas putida KT2440
agaacuggcgcagcagg

SEQ ID NO: 1616770 - RNA, 22 nt, Pseudomonas putida KT2440
agaacuggcgcagcagguccag

SEQ ID NO: 1616771 - RNA, 19 nt, Pseudomonas putida KT2440
agaacuccaccagcccacc

SEQ ID NO: 1616772 - RNA, 14 nt, Pseudomonas putida KT2440
agaagcuaccccac

SEQ ID NO: 1616773 - RNA, 17 nt, Pseudomonas putida KT2440
agaaggcauccagggcg

SEQ ID NO: 1616774 - RNA, 21 nt, Pseudomonas putida KT2440
agaagcggcuaccgcugcgca

SEQ ID NO: 1616775 - RNA, 16 nt, Pseudomonas putida KT2440
agaagcagaucaucau

SEQ ID NO: 1616776 - RNA, 20 nt, Pseudomonas putida KT2440
acuuuugccacccgaacaaa

SEQ ID NO: 1616777 - RNA, 24 nt, Pseudomonas putida KT2440
acuuuugcuggcuguaccggccuc

SEQ ID NO: 1616778 - RNA, 15 nt, Pseudomonas putida KT2440
agaaagaauggaaag

SEQ ID NO: 1616779 - RNA, 18 nt, Pseudomonas putida KT2440
acccgggcgcaggggucu

SEQ ID NO: 1616780 - RNA, 19 nt, Pseudomonas putida KT2440
acccggccagcaggucagc

SEQ ID NO: 1616781 - RNA, 16 nt, Pseudomonas putida KT2440
acccgggaaacucuug

SEQ ID NO: 1616782 - RNA, 17 nt, Pseudomonas putida KT2440
acccgggaacagcagca

SEQ ID NO: 1616783 - RNA, 20 nt, Pseudomonas putida KT2440
acccgggcagcgggcucgcc

SEQ ID NO: 1616784 - RNA, 16 nt, Pseudomonas putida KT2440
acccggccgcuccagc

SEQ ID NO: 1616785 - RNA, 15 nt, Pseudomonas putida KT2440
acccggaccagcgcc

SEQ ID NO: 1616786 - RNA, 23 nt, Pseudomonas putida KT2440
acccggccaaguacaaacgccag

SEQ ID NO: 1616787 - RNA, 17 nt, Pseudomonas putida KT2440
acccgcugcccguccgg

SEQ ID NO: 1616788 - RNA, 22 nt, Pseudomonas putida KT2440
acccgcucccacagaaggcugc

SEQ ID NO: 1616789 - RNA, 16 nt, Pseudomonas putida KT2440
acccgcuggaccuggc

SEQ ID NO: 1616790 - RNA, 13 nt, Pseudomonas putida KT2440
acccgcuucgccg

SEQ ID NO: 1616791 - RNA, 23 nt, Pseudomonas putida KT2440
acccgcuucgcucagaaucagcu

SEQ ID NO: 1616792 - RNA, 17 nt, Pseudomonas putida KT2440
acccgcuugccacggcg

SEQ ID NO: 1616793 - RNA, 15 nt, Pseudomonas putida KT2440
acccgcgacgugacc

SEQ ID NO: 1616794 - RNA, 16 nt, Pseudomonas putida KT2440
acccgcgcgcccgcgg

SEQ ID NO: 1616795 - RNA, 15 nt, Pseudomonas putida KT2440
acccgcgccuacagc

SEQ ID NO: 1616796 - RNA, 18 nt, Pseudomonas putida KT2440
acccgcgccaccagcccc

SEQ ID NO: 1616797 - RNA, 16 nt, Pseudomonas putida KT2440
acccgcuccuacagga

SEQ ID NO: 1616798 - RNA, 19 nt, Pseudomonas putida KT2440
acccgcuccuacaggccgc

SEQ ID NO: 1616799 - RNA, 20 nt, Pseudomonas putida KT2440
acccgcuccuacaggccgcc

SEQ ID NO: 1616800 - RNA, 16 nt, Pseudomonas putida KT2440
acccgcucggccuugu

SEQ ID NO: 1616801 - RNA, 23 nt, Pseudomonas putida KT2440
acccgcucggccuugucuggcac

SEQ ID NO: 1616802 - RNA, 20 nt, Pseudomonas putida KT2440
acccgcguuggcagcaccac

SEQ ID NO: 1616803 - RNA, 15 nt, Pseudomonas putida KT2440
acccgcguuugcaac

SEQ ID NO: 1616804 - RNA, 19 nt, Pseudomonas putida KT2440
acccgcgaaagggccggcc

SEQ ID NO: 1616805 - RNA, 21 nt, Pseudomonas putida KT2440
acccgcgaaagggccgggccu

SEQ ID NO: 1616806 - RNA, 15 nt, Pseudomonas putida KT2440
acccgcgaagaagcc

SEQ ID NO: 1616807 - RNA, 13 nt, Pseudomonas putida KT2440
acccgcgaagagg

SEQ ID NO: 1616808 - RNA, 14 nt, Pseudomonas putida KT2440
acccgcgaaugcgg

SEQ ID NO: 1616809 - RNA, 17 nt, Pseudomonas putida KT2440
accccuuuacuggccau

SEQ ID NO: 1616810 - RNA, 20 nt, Pseudomonas putida KT2440
accccuggaaacccuugcgc

SEQ ID NO: 1616811 - RNA, 19 nt, Pseudomonas putida KT2440
accccugcaaggccagcgg

SEQ ID NO: 1616812 - RNA, 15 nt, Pseudomonas putida KT2440
acccaccacggccug

SEQ ID NO: 1616813 - RNA, 16 nt, Pseudomonas putida KT2440
acccaccacggccugg

SEQ ID NO: 1616814 - RNA, 13 nt, Pseudomonas putida KT2440
acccaucugcucg

SEQ ID NO: 1616815 - RNA, 17 nt, Pseudomonas putida KT2440
acccaugauugaauucu

SEQ ID NO: 1616816 - RNA, 11 nt, Pseudomonas putida KT2440
accccagcccg

SEQ ID NO: 1616817 - RNA, 15 nt, Pseudomonas putida KT2440
accccagcccgaagc

SEQ ID NO: 1616818 - RNA, 12 nt, Pseudomonas putida KT2440
accccagcaagg

SEQ ID NO: 1616819 - RNA, 18 nt, Pseudomonas putida KT2440
accccaccggccuggaac

SEQ ID NO: 1616820 - RNA, 12 nt, Pseudomonas putida KT2440
accccaccgcgg

SEQ ID NO: 1616821 - RNA, 23 nt, Pseudomonas putida KT2440
accccacaaccccugcaaggcca

SEQ ID NO: 1616822 - RNA, 11 nt, Pseudomonas putida KT2440
accccgcagac

SEQ ID NO: 1616823 - RNA, 17 nt, Pseudomonas putida KT2440
accccgcaggccgcagc

SEQ ID NO: 1616824 - RNA, 12 nt, Pseudomonas putida KT2440
acccccagcgcc

SEQ ID NO: 1616825 - RNA, 23 nt, Pseudomonas putida KT2440
acccccagguuauccacagggcc

SEQ ID NO: 1616826 - RNA, 17 nt, Pseudomonas putida KT2440
accccgcaaagcccugc

SEQ ID NO: 1616827 - RNA, 12 nt, Pseudomonas putida KT2440
accccccugcac

SEQ ID NO: 1616828 - RNA, 14 nt, Pseudomonas putida KT2440
acccccacgaacac

SEQ ID NO: 1616829 - RNA, 20 nt, Pseudomonas putida KT2440
accccauaccucuucacugc

SEQ ID NO: 1616830 - RNA, 18 nt, Pseudomonas putida KT2440
accccaucaccuuggccg

SEQ ID NO: 1616831 - RNA, 22 nt, Pseudomonas putida KT2440
accccagggcaucgaucccugg

SEQ ID NO: 1616832 - RNA, 15 nt, Pseudomonas putida KT2440
acccaaggcauccag

SEQ ID NO: 1616833 - RNA, 15 nt, Pseudomonas putida KT2440
acccaauaaaaacaa

SEQ ID NO: 1616834 - RNA, 18 nt, Pseudomonas putida KT2440
acccaauaaaaacaacag

SEQ ID NO: 1616835 - RNA, 14 nt, Pseudomonas putida KT2440
acccaacuccagcg

SEQ ID NO: 1616836 - RNA, 17 nt, Pseudomonas putida KT2440
acccaagcacaaggcca

SEQ ID NO: 1616837 - RNA, 19 nt, Pseudomonas putida KT2440
acccaagcacaaggccacu

SEQ ID NO: 1616838 - RNA, 18 nt, Pseudomonas putida KT2440
accauuugucuugaagau

SEQ ID NO: 1616839 - RNA, 22 nt, Pseudomonas putida KT2440
acccaacagcauccaaagccaa

SEQ ID NO: 1616840 - RNA, 19 nt, Pseudomonas putida KT2440
acccaaccgcgccagcucc

SEQ ID NO: 1616841 - RNA, 14 nt, Pseudomonas putida KT2440
acccaaccgcgcca

SEQ ID NO: 1616842 - RNA, 23 nt, Pseudomonas putida KT2440
accaugggcaaugcgagacgcca

SEQ ID NO: 1616843 - RNA, 19 nt, Pseudomonas putida KT2440
accauuggugaaagcgcaa

SEQ ID NO: 1616844 - RNA, 20 nt, Pseudomonas putida KT2440
accauuggccaaccagccgg

SEQ ID NO: 1616845 - RNA, 22 nt, Pseudomonas putida KT2440
accauuggccaaccagccggca

SEQ ID NO: 1616846 - RNA, 22 nt, Pseudomonas putida KT2440
accaucaucagacagaagccug

SEQ ID NO: 1616847 - RNA, 11 nt, Pseudomonas putida KT2440
accauccauca

SEQ ID NO: 1616848 - RNA, 16 nt, Pseudomonas putida KT2440
accaucagagcgccag

SEQ ID NO: 1616849 - RNA, 18 nt, Pseudomonas putida KT2440
accauggccuucgccggu

SEQ ID NO: 1616850 - RNA, 17 nt, Pseudomonas putida KT2440
accauggcgaugaacug

SEQ ID NO: 1616851 - RNA, 15 nt, Pseudomonas putida KT2440
accauguacugcaga

SEQ ID NO: 1616852 - RNA, 14 nt, Pseudomonas putida KT2440
accaugcuggccaa

SEQ ID NO: 1616853 - RNA, 23 nt, Pseudomonas putida KT2440
accaugcgaugguacagcucacu

SEQ ID NO: 1616854 - RNA, 17 nt, Pseudomonas putida KT2440
accaugcggcucuguuu

SEQ ID NO: 1616855 - RNA, 17 nt, Pseudomonas putida KT2440
accagaaccccggcccu

SEQ ID NO: 1616856 - RNA, 23 nt, Pseudomonas putida KT2440
accauaagcggugugggcgaagu

SEQ ID NO: 1616857 - RNA, 18 nt, Pseudomonas putida KT2440
accagaaacccagggcag

SEQ ID NO: 1616858 - RNA, 14 nt, Pseudomonas putida KT2440
accaucaccgccag

SEQ ID NO: 1616859 - RNA, 15 nt, Pseudomonas putida KT2440
accaucaccgccagc

SEQ ID NO: 1616860 - RNA, 21 nt, Pseudomonas putida KT2440
accaucaaaaagccccgguuc

SEQ ID NO: 1616861 - RNA, 20 nt, Pseudomonas putida KT2440
accaucaagucauccgccag

SEQ ID NO: 1616862 - RNA, 19 nt, Pseudomonas putida KT2440
accgccgcgaugaugauca

SEQ ID NO: 1616863 - RNA, 15 nt, Pseudomonas putida KT2440
accgccgccuggcuc

SEQ ID NO: 1616864 - RNA, 20 nt, Pseudomonas putida KT2440
accgccgugccggucacugg

SEQ ID NO: 1616865 - RNA, 18 nt, Pseudomonas putida KT2440
accgccucgaccuggccc

SEQ ID NO: 1616866 - RNA, 17 nt, Pseudomonas putida KT2440
accgcgaaacacagcag

SEQ ID NO: 1616867 - RNA, 19 nt, Pseudomonas putida KT2440
accgcgauaucagcgccag

SEQ ID NO: 1616868 - RNA, 15 nt, Pseudomonas putida KT2440
accgcgccaucaagg

SEQ ID NO: 1616869 - RNA, 19 nt, Pseudomonas putida KT2440
accgcgcacgcaucugcac

SEQ ID NO: 1616870 - RNA, 21 nt, Pseudomonas putida KT2440
accgcgcgguuaagcgccacc

SEQ ID NO: 1616871 - RNA, 18 nt, Pseudomonas putida KT2440
accgcgauggauggcacc

SEQ ID NO: 1616872 - RNA, 17 nt, Pseudomonas putida KT2440
accgcgccagccugggc

SEQ ID NO: 1616873 - RNA, 18 nt, Pseudomonas putida KT2440
accgcgccagccugggcu

SEQ ID NO: 1616874 - RNA, 16 nt, Pseudomonas putida KT2440
accgcggaugcgccug

SEQ ID NO: 1616875 - RNA, 19 nt, Pseudomonas putida KT2440
accggccuugcgcaaggca

SEQ ID NO: 1616876 - RNA, 14 nt, Pseudomonas putida KT2440
accggccuggaacc

SEQ ID NO: 1616877 - RNA, 21 nt, Pseudomonas putida KT2440
accggcgccaaucaucgccag

SEQ ID NO: 1616878 - RNA, 15 nt, Pseudomonas putida KT2440
accggcgccgcccag

SEQ ID NO: 1616879 - RNA, 15 nt, Pseudomonas putida KT2440
accggcgcuuggccg

SEQ ID NO: 1616880 - RNA, 12 nt, Pseudomonas putida KT2440
accggcucugcc

SEQ ID NO: 1616881 - RNA, 19 nt, Pseudomonas putida KT2440
accggcucaacagcaggug

SEQ ID NO: 1616882 - RNA, 22 nt, Pseudomonas putida KT2440
accggcguguugccgcugugcu

SEQ ID NO: 1616883 - RNA, 21 nt, Pseudomonas putida KT2440
accgggcgcgauugccuuccu

SEQ ID NO: 1616884 - RNA, 14 nt, Pseudomonas putida KT2440
accgggcggccacc

SEQ ID NO: 1616885 - RNA, 16 nt, Pseudomonas putida KT2440
accggcuuccagcuug

SEQ ID NO: 1616886 - RNA, 17 nt, Pseudomonas putida KT2440
accgcuggccgccacgg

SEQ ID NO: 1616887 - RNA, 14 nt, Pseudomonas putida KT2440
accgcugcgcacca

SEQ ID NO: 1616888 - RNA, 14 nt, Pseudomonas putida KT2440
accgcugcccagcg

SEQ ID NO: 1616889 - RNA, 17 nt, Pseudomonas putida KT2440
accgcugcaaucgagcc

SEQ ID NO: 1616890 - RNA, 16 nt, Pseudomonas putida KT2440
accgcugcauggccug

SEQ ID NO: 1616891 - RNA, 16 nt, Pseudomonas putida KT2440
accgcugccagcugcg

SEQ ID NO: 1616892 - RNA, 18 nt, Pseudomonas putida KT2440
accgcugccgaucagcac

SEQ ID NO: 1616893 - RNA, 11 nt, Pseudomonas putida KT2440
accggccagcu

SEQ ID NO: 1616894 - RNA, 22 nt, Pseudomonas putida KT2440
accggccgacccgccuggugcc

SEQ ID NO: 1616895 - RNA, 22 nt, Pseudomonas putida KT2440
accggccccccagccagcagau

SEQ ID NO: 1616896 - RNA, 21 nt, Pseudomonas putida KT2440
accggcaagcccauggcuggc

SEQ ID NO: 1616897 - RNA, 16 nt, Pseudomonas putida KT2440
acccguggcagccccc

SEQ ID NO: 1616898 - RNA, 16 nt, Pseudomonas putida KT2440
acccgugcccggcauc

SEQ ID NO: 1616899 - RNA, 22 nt, Pseudomonas putida KT2440
acccgugcccggcauccgccuc

SEQ ID NO: 1616900 - RNA, 19 nt, Pseudomonas putida KT2440
acccgugcaucugcucccc

SEQ ID NO: 1616901 - RNA, 16 nt, Pseudomonas putida KT2440
acccucccguuugaca

SEQ ID NO: 1616902 - RNA, 23 nt, Pseudomonas putida KT2440
accgagaacaggcggcccggcac

SEQ ID NO: 1616903 - RNA, 20 nt, Pseudomonas putida KT2440
acccugaaucagcaaaccga

SEQ ID NO: 1616904 - RNA, 24 nt, Pseudomonas putida KT2440
acccugaaauggacgccacguccu

SEQ ID NO: 1616905 - RNA, 15 nt, Pseudomonas putida KT2440
acccugaagcccugg

SEQ ID NO: 1616906 - RNA, 15 nt, Pseudomonas putida KT2440
acccucuuccuugug

SEQ ID NO: 1616907 - RNA, 22 nt, Pseudomonas putida KT2440
accgagcacucggcggcgaaga

SEQ ID NO: 1616908 - RNA, 18 nt, Pseudomonas putida KT2440
accgagccuuccgggcac

SEQ ID NO: 1616909 - RNA, 20 nt, Pseudomonas putida KT2440
accgaucacggggcgacgca

SEQ ID NO: 1616910 - RNA, 12 nt, Pseudomonas putida KT2440
accgcaacuggc

SEQ ID NO: 1616911 - RNA, 20 nt, Pseudomonas putida KT2440
accgcaacuggcccgcgcca

SEQ ID NO: 1616912 - RNA, 16 nt, Pseudomonas putida KT2440
accgcaacccagcccc

SEQ ID NO: 1616913 - RNA, 15 nt, Pseudomonas putida KT2440
accgcaacaccugcc

SEQ ID NO: 1616914 - RNA, 15 nt, Pseudomonas putida KT2440
accgcaaaucacuga

SEQ ID NO: 1616915 - RNA, 23 nt, Pseudomonas putida KT2440
accgcaaaucacugacccgcuuc

SEQ ID NO: 1616916 - RNA, 16 nt, Pseudomonas putida KT2440
accgcaagcugcaccg

SEQ ID NO: 1616917 - RNA, 14 nt, Pseudomonas putida KT2440
accgcacccggcua

SEQ ID NO: 1616918 - RNA, 15 nt, Pseudomonas putida KT2440
accgcacccggcuac

SEQ ID NO: 1616919 - RNA, 20 nt, Pseudomonas putida KT2440
accgcacccgcaagcgccga

SEQ ID NO: 1616920 - RNA, 13 nt, Pseudomonas putida KT2440
accgcacccaggu

SEQ ID NO: 1616921 - RNA, 17 nt, Pseudomonas putida KT2440
accgcauccgcacccca

SEQ ID NO: 1616922 - RNA, 20 nt, Pseudomonas putida KT2440
accgcaucuccaaaaggugc

SEQ ID NO: 1616923 - RNA, 14 nt, Pseudomonas putida KT2440
accgccaaggcacg

SEQ ID NO: 1616924 - RNA, 14 nt, Pseudomonas putida KT2440
accgcaggugcagg

SEQ ID NO: 1616925 - RNA, 19 nt, Pseudomonas putida KT2440
accgcaggugcaggcucgg

SEQ ID NO: 1616926 - RNA, 15 nt, Pseudomonas putida KT2440
accgcagcccagcgc

SEQ ID NO: 1616927 - RNA, 16 nt, Pseudomonas putida KT2440
accgcacucugcugcu

SEQ ID NO: 1616928 - RNA, 19 nt, Pseudomonas putida KT2440
accgcacucugcugcucug

SEQ ID NO: 1616929 - RNA, 20 nt, Pseudomonas putida KT2440
accgcacugugcuggggcca

SEQ ID NO: 1616930 - RNA, 20 nt, Pseudomonas putida KT2440
accgccaggguuaccugcgc

SEQ ID NO: 1616931 - RNA, 16 nt, Pseudomonas putida KT2440
accgccagcuccacca

SEQ ID NO: 1616932 - RNA, 17 nt, Pseudomonas putida KT2440
accgccauggccagguc

SEQ ID NO: 1616933 - RNA, 15 nt, Pseudomonas putida KT2440
accgccagcccgcca

SEQ ID NO: 1616934 - RNA, 12 nt, Pseudomonas putida KT2440
accgccagcacc

SEQ ID NO: 1616935 - RNA, 21 nt, Pseudomonas putida KT2440
accgccaccaucggccaggaa

SEQ ID NO: 1616936 - RNA, 19 nt, Pseudomonas putida KT2440
accgccacugaccagcccg

SEQ ID NO: 1616937 - RNA, 16 nt, Pseudomonas putida KT2440
accgccccaagcgccu

SEQ ID NO: 1616938 - RNA, 13 nt, Pseudomonas putida KT2440
accgccccugcgu

SEQ ID NO: 1616939 - RNA, 15 nt, Pseudomonas putida KT2440
acgccacggcggcau

SEQ ID NO: 1616940 - RNA, 22 nt, Pseudomonas putida KT2440
acgccaccccggugcagguugg

SEQ ID NO: 1616941 - RNA, 21 nt, Pseudomonas putida KT2440
acgccagcaucacccucacga

SEQ ID NO: 1616942 - RNA, 20 nt, Pseudomonas putida KT2440
acgccaggaaggucaccagu

SEQ ID NO: 1616943 - RNA, 14 nt, Pseudomonas putida KT2440
acgccagcagcgca

SEQ ID NO: 1616944 - RNA, 19 nt, Pseudomonas putida KT2440
acgccagaagguaucggcc

SEQ ID NO: 1616945 - RNA, 17 nt, Pseudomonas putida KT2440
acgcauguccuuggccc

SEQ ID NO: 1616946 - RNA, 20 nt, Pseudomonas putida KT2440
acgcaugccuaucucuucca

SEQ ID NO: 1616947 - RNA, 18 nt, Pseudomonas putida KT2440
acgcauggccgaggucug

SEQ ID NO: 1616948 - RNA, 23 nt, Pseudomonas putida KT2440
acgcauggccgaggucugguacu

SEQ ID NO: 1616949 - RNA, 22 nt, Pseudomonas putida KT2440
acgcaucugcacuuucaccccu

SEQ ID NO: 1616950 - RNA, 13 nt, Pseudomonas putida KT2440
acgcauccaggcg

SEQ ID NO: 1616951 - RNA, 19 nt, Pseudomonas putida KT2440
acgcaggugcgcacgcugc

SEQ ID NO: 1616952 - RNA, 20 nt, Pseudomonas putida KT2440
acgcaguacgugaaagcccg

SEQ ID NO: 1616953 - RNA, 18 nt, Pseudomonas putida KT2440
acgcacccgccuccggcg

SEQ ID NO: 1616954 - RNA, 19 nt, Pseudomonas putida KT2440
acgcacgaucucccggcuc

SEQ ID NO: 1616955 - RNA, 21 nt, Pseudomonas putida KT2440
acgcaaugggcacaauugugc

SEQ ID NO: 1616956 - RNA, 21 nt, Pseudomonas putida KT2440
acgcaccagggcuggcagcgg

SEQ ID NO: 1616957 - RNA, 20 nt, Pseudomonas putida KT2440
acgcaccaacuggucggccu

SEQ ID NO: 1616958 - RNA, 13 nt, Pseudomonas putida KT2440
acgcacagcugug

SEQ ID NO: 1616959 - RNA, 18 nt, Pseudomonas putida KT2440
acgcacaggcgcagcagc

SEQ ID NO: 1616960 - RNA, 13 nt, Pseudomonas putida KT2440
acgcacaguggug

SEQ ID NO: 1616961 - RNA, 13 nt, Pseudomonas putida KT2440
acgcaacaacccc

SEQ ID NO: 1616962 - RNA, 14 nt, Pseudomonas putida KT2440
acgcaggcaccgca

SEQ ID NO: 1616963 - RNA, 23 nt, Pseudomonas putida KT2440
acgcagcucggugaacagguugc

SEQ ID NO: 1616964 - RNA, 14 nt, Pseudomonas putida KT2440
acgcaggcccagca

SEQ ID NO: 1616965 - RNA, 16 nt, Pseudomonas putida KT2440
acgcaggcccagcagg

SEQ ID NO: 1616966 - RNA, 20 nt, Pseudomonas putida KT2440
acgcaggcucugcgccagca

SEQ ID NO: 1616967 - RNA, 17 nt, Pseudomonas putida KT2440
acgcaggcgcaggugca

SEQ ID NO: 1616968 - RNA, 13 nt, Pseudomonas putida KT2440
acgcagccggcac

SEQ ID NO: 1616969 - RNA, 18 nt, Pseudomonas putida KT2440
acgcagccggcaccgcca

SEQ ID NO: 1616970 - RNA, 12 nt, Pseudomonas putida KT2440
acgcagcccuuu

SEQ ID NO: 1616971 - RNA, 15 nt, Pseudomonas putida KT2440
acgcagcacccgguc

SEQ ID NO: 1616972 - RNA, 13 nt, Pseudomonas putida KT2440
acgcagagcaugg

SEQ ID NO: 1616973 - RNA, 21 nt, Pseudomonas putida KT2440
acgcagagcauggucaugcca

SEQ ID NO: 1616974 - RNA, 18 nt, Pseudomonas putida KT2440
acgcagacaaaacgcugc

SEQ ID NO: 1616975 - RNA, 19 nt, Pseudomonas putida KT2440
acgcagacaaaacgcugcg

SEQ ID NO: 1616976 - RNA, 15 nt, Pseudomonas putida KT2440
acgaggacugcacca

SEQ ID NO: 1616977 - RNA, 21 nt, Pseudomonas putida KT2440
acgagguggucgaggcaaaga

SEQ ID NO: 1616978 - RNA, 16 nt, Pseudomonas putida KT2440
acgauacuccggcaac

SEQ ID NO: 1616979 - RNA, 13 nt, Pseudomonas putida KT2440
acgauaauuaccg

SEQ ID NO: 1616980 - RNA, 21 nt, Pseudomonas putida KT2440
acgauacccagcgcgcgcaga

SEQ ID NO: 1616981 - RNA, 22 nt, Pseudomonas putida KT2440
acgacuuugaugccaacuucca

SEQ ID NO: 1616982 - RNA, 21 nt, Pseudomonas putida KT2440
acgaaguugagcaccggcagg

SEQ ID NO: 1616983 - RNA, 18 nt, Pseudomonas putida KT2440
acgaaccugugcacagcc

SEQ ID NO: 1616984 - RNA, 16 nt, Pseudomonas putida KT2440
acgaacuacgcgccag

SEQ ID NO: 1616985 - RNA, 23 nt, Pseudomonas putida KT2440
acgaaggccgguuuuuucaugca

SEQ ID NO: 1616986 - RNA, 12 nt, Pseudomonas putida KT2440
acgaagaucacc

SEQ ID NO: 1616987 - RNA, 12 nt, Pseudomonas putida KT2440
acgaagccaugu

SEQ ID NO: 1616988 - RNA, 19 nt, Pseudomonas putida KT2440
acgaugcccgggccuucaa

SEQ ID NO: 1616989 - RNA, 18 nt, Pseudomonas putida KT2440
acgaugaggcgaugcagg

SEQ ID NO: 1616990 - RNA, 21 nt, Pseudomonas putida KT2440
acgauggcggucgaacccagc

SEQ ID NO: 1616991 - RNA, 18 nt, Pseudomonas putida KT2440
acgauggugaaggccagg

SEQ ID NO: 1616992 - RNA, 18 nt, Pseudomonas putida KT2440
acgaugaaauacagcucg

SEQ ID NO: 1616993 - RNA, 16 nt, Pseudomonas putida KT2440
acgaucgccagcccca

SEQ ID NO: 1616994 - RNA, 17 nt, Pseudomonas putida KT2440
acgauccccaccagcau

SEQ ID NO: 1616995 - RNA, 22 nt, Pseudomonas putida KT2440
acgaucaugcuggccaggaugc

SEQ ID NO: 1616996 - RNA, 12 nt, Pseudomonas putida KT2440
acgauugcguuu

SEQ ID NO: 1616997 - RNA, 13 nt, Pseudomonas putida KT2440
accugggccaggu

SEQ ID NO: 1616998 - RNA, 22 nt, Pseudomonas putida KT2440
accugggcgaucacauaaggca

SEQ ID NO: 1616999 - RNA, 17 nt, Pseudomonas putida KT2440
accugauacacccgcuc

SEQ ID NO: 1617000 - RNA, 15 nt, Pseudomonas putida KT2440
accuggguccaggca

SEQ ID NO: 1617001 - RNA, 17 nt, Pseudomonas putida KT2440
accugguccagcuucac

SEQ ID NO: 1617002 - RNA, 20 nt, Pseudomonas putida KT2440
accugguccagcuucaccuc

SEQ ID NO: 1617003 - RNA, 17 nt, Pseudomonas putida KT2440
accuguuccggccucuu

SEQ ID NO: 1617004 - RNA, 14 nt, Pseudomonas putida KT2440
accuucaacaccaa

SEQ ID NO: 1617005 - RNA, 21 nt, Pseudomonas putida KT2440
accuucaacaccaacuugcca

SEQ ID NO: 1617006 - RNA, 18 nt, Pseudomonas putida KT2440
accuuaucggccggcagc

SEQ ID NO: 1617007 - RNA, 19 nt, Pseudomonas putida KT2440
accuugcgcacggccucca

SEQ ID NO: 1617008 - RNA, 23 nt, Pseudomonas putida KT2440
accuugccuaccugaucaccgau

SEQ ID NO: 1617009 - RNA, 22 nt, Pseudomonas putida KT2440
accuugccuuccggcccggcau

SEQ ID NO: 1617010 - RNA, 23 nt, Pseudomonas putida KT2440
accuugcuccaccaggccacguu

SEQ ID NO: 1617011 - RNA, 20 nt, Pseudomonas putida KT2440
accuugcugaaauccagccg

SEQ ID NO: 1617012 - RNA, 20 nt, Pseudomonas putida KT2440
accuucgauuagacccagau

SEQ ID NO: 1617013 - RNA, 15 nt, Pseudomonas putida KT2440
accuucgagccaccg

SEQ ID NO: 1617014 - RNA, 18 nt, Pseudomonas putida KT2440
accuugauuucgucgcua

SEQ ID NO: 1617015 - RNA, 19 nt, Pseudomonas putida KT2440
accuugaucuguccuccug

SEQ ID NO: 1617016 - RNA, 18 nt, Pseudomonas putida KT2440
accuugaugcgcgagcug

SEQ ID NO: 1617017 - RNA, 14 nt, Pseudomonas putida KT2440
acgaacaucagcag

SEQ ID NO: 1617018 - RNA, 12 nt, Pseudomonas putida KT2440
acgaacaggcgc

SEQ ID NO: 1617019 - RNA, 23 nt, Pseudomonas putida KT2440
acgaacagauggugaugccccug

SEQ ID NO: 1617020 - RNA, 16 nt, Pseudomonas putida KT2440
acgaacagccagaugc

SEQ ID NO: 1617021 - RNA, 17 nt, Pseudomonas putida KT2440
acgaacaccagccccag

SEQ ID NO: 1617022 - RNA, 22 nt, Pseudomonas putida KT2440
acgaaaaaaagggcaccuccag

SEQ ID NO: 1617023 - RNA, 17 nt, Pseudomonas putida KT2440
accucauaguaaggcug

SEQ ID NO: 1617024 - RNA, 16 nt, Pseudomonas putida KT2440
accucaggccugcacu

SEQ ID NO: 1617025 - RNA, 19 nt, Pseudomonas putida KT2440
accucccgcacauuucaca

SEQ ID NO: 1617026 - RNA, 18 nt, Pseudomonas putida KT2440
accucccgcacugcugcc

SEQ ID NO: 1617027 - RNA, 22 nt, Pseudomonas putida KT2440
accucccgcacugcugccgccc

SEQ ID NO: 1617028 - RNA, 13 nt, Pseudomonas putida KT2440
accucagccgugg

SEQ ID NO: 1617029 - RNA, 14 nt, Pseudomonas putida KT2440
accucacacuggua

SEQ ID NO: 1617030 - RNA, 15 nt, Pseudomonas putida KT2440
accucgacccgcccg

SEQ ID NO: 1617031 - RNA, 17 nt, Pseudomonas putida KT2440
accucgacccgcccgcc

SEQ ID NO: 1617032 - RNA, 15 nt, Pseudomonas putida KT2440
accucgaccgucgcu

SEQ ID NO: 1617033 - RNA, 14 nt, Pseudomonas putida KT2440
accucgaacuugcc

SEQ ID NO: 1617034 - RNA, 15 nt, Pseudomonas putida KT2440
accggggcaccuuga

SEQ ID NO: 1617035 - RNA, 16 nt, Pseudomonas putida KT2440
accggucgccuguagg

SEQ ID NO: 1617036 - RNA, 23 nt, Pseudomonas putida KT2440
accggggcuccggcgaauccagc

SEQ ID NO: 1617037 - RNA, 22 nt, Pseudomonas putida KT2440
accggugcguacucgaccacug

SEQ ID NO: 1617038 - RNA, 21 nt, Pseudomonas putida KT2440
accggugccccgguccagcac

SEQ ID NO: 1617039 - RNA, 21 nt, Pseudomonas putida KT2440
accgguucgcccccacgggca

SEQ ID NO: 1617040 - RNA, 15 nt, Pseudomonas putida KT2440
accgguggccugagc

SEQ ID NO: 1617041 - RNA, 11 nt, Pseudomonas putida KT2440
accucugcaug

SEQ ID NO: 1617042 - RNA, 12 nt, Pseudomonas putida KT2440
accucugcggcc

SEQ ID NO: 1617043 - RNA, 16 nt, Pseudomonas putida KT2440
accugaccaucagccu

SEQ ID NO: 1617044 - RNA, 16 nt, Pseudomonas putida KT2440
accugaccauuggcca

SEQ ID NO: 1617045 - RNA, 22 nt, Pseudomonas putida KT2440
accugacgcaagcgcgccgcca

SEQ ID NO: 1617046 - RNA, 15 nt, Pseudomonas putida KT2440
accugaacaaggccu

SEQ ID NO: 1617047 - RNA, 22 nt, Pseudomonas putida KT2440
accugaacaaggccuggcccag

SEQ ID NO: 1617048 - RNA, 20 nt, Pseudomonas putida KT2440
accucgggcuuggcacgcug

SEQ ID NO: 1617049 - RNA, 16 nt, Pseudomonas putida KT2440
accucgucaugcagcg

SEQ ID NO: 1617050 - RNA, 13 nt, Pseudomonas putida KT2440
accucggcaccgc

SEQ ID NO: 1617051 - RNA, 14 nt, Pseudomonas putida KT2440
accucggccagguc

SEQ ID NO: 1617052 - RNA, 17 nt, Pseudomonas putida KT2440
accucggccgcauccug

SEQ ID NO: 1617053 - RNA, 18 nt, Pseudomonas putida KT2440
acggcgcugucggucagc

SEQ ID NO: 1617054 - RNA, 14 nt, Pseudomonas putida KT2440
acggcuaccagcag

SEQ ID NO: 1617055 - RNA, 23 nt, Pseudomonas putida KT2440
acggcgcaggccgacaacagcau

SEQ ID NO: 1617056 - RNA, 22 nt, Pseudomonas putida KT2440
acggcaaugaccaagcaacgca

SEQ ID NO: 1617057 - RNA, 12 nt, Pseudomonas putida KT2440
acggcaagccug

SEQ ID NO: 1617058 - RNA, 18 nt, Pseudomonas putida KT2440
acggcaaaguccagcauc

SEQ ID NO: 1617059 - RNA, 16 nt, Pseudomonas putida KT2440
acggcugucagugguc

SEQ ID NO: 1617060 - RNA, 20 nt, Pseudomonas putida KT2440
acggcugaacuuccaggucg

SEQ ID NO: 1617061 - RNA, 13 nt, Pseudomonas putida KT2440
acggcugaagaag

SEQ ID NO: 1617062 - RNA, 15 nt, Pseudomonas putida KT2440
acggcugaagaagcu

SEQ ID NO: 1617063 - RNA, 16 nt, Pseudomonas putida KT2440
acggcugcccugcaug

SEQ ID NO: 1617064 - RNA, 21 nt, Pseudomonas putida KT2440
acggcugaugguggucggcag

SEQ ID NO: 1617065 - RNA, 23 nt, Pseudomonas putida KT2440
acgggcgagcgcgcaggcgguuc

SEQ ID NO: 1617066 - RNA, 18 nt, Pseudomonas putida KT2440
acgggccagccgcgccag

SEQ ID NO: 1617067 - RNA, 19 nt, Pseudomonas putida KT2440
acgggcccuuucgcgggua

SEQ ID NO: 1617068 - RNA, 15 nt, Pseudomonas putida KT2440
acgggucuuuucuuc

SEQ ID NO: 1617069 - RNA, 21 nt, Pseudomonas putida KT2440
acggguuucggaaaaagggcg

SEQ ID NO: 1617070 - RNA, 12 nt, Pseudomonas putida KT2440
acggugcgccug

SEQ ID NO: 1617071 - RNA, 18 nt, Pseudomonas putida KT2440
acgguggcguggccacgc

SEQ ID NO: 1617072 - RNA, 11 nt, Pseudomonas putida KT2440
acgguggcugc

SEQ ID NO: 1617073 - RNA, 19 nt, Pseudomonas putida KT2440
acguaccuggcugcaguga

SEQ ID NO: 1617074 - RNA, 14 nt, Pseudomonas putida KT2440
acgguuuccaggcg

SEQ ID NO: 1617075 - RNA, 20 nt, Pseudomonas putida KT2440
acgcuuggcguaauccagcu

SEQ ID NO: 1617076 - RNA, 24 nt, Pseudomonas putida KT2440
acgcuuggcguaauccagcugcug

SEQ ID NO: 1617077 - RNA, 17 nt, Pseudomonas putida KT2440
acgcuuucacaaauaga

SEQ ID NO: 1617078 - RNA, 19 nt, Pseudomonas putida KT2440
acggacucauagcucagcu

SEQ ID NO: 1617079 - RNA, 12 nt, Pseudomonas putida KT2440
acggaucaccug

SEQ ID NO: 1617080 - RNA, 15 nt, Pseudomonas putida KT2440
acggauacaccagaa

SEQ ID NO: 1617081 - RNA, 18 nt, Pseudomonas putida KT2440
acggauacaccagaaagc

SEQ ID NO: 1617082 - RNA, 14 nt, Pseudomonas putida KT2440
acgcugcacuucca

SEQ ID NO: 1617083 - RNA, 15 nt, Pseudomonas putida KT2440
acgcugucagaccuc

SEQ ID NO: 1617084 - RNA, 18 nt, Pseudomonas putida KT2440
acgcucagugugggggcg

SEQ ID NO: 1617085 - RNA, 17 nt, Pseudomonas putida KT2440
acgcucgugcaggcugu

SEQ ID NO: 1617086 - RNA, 20 nt, Pseudomonas putida KT2440
acgcucguuguccagcagca

SEQ ID NO: 1617087 - RNA, 17 nt, Pseudomonas putida KT2440
acgcucaugaacagcgc

SEQ ID NO: 1617088 - RNA, 13 nt, Pseudomonas putida KT2440
acgcucaacccca

SEQ ID NO: 1617089 - RNA, 17 nt, Pseudomonas putida KT2440
acgccaucagugccccc

SEQ ID NO: 1617090 - RNA, 20 nt, Pseudomonas putida KT2440
acgccaucagugcccccgcc

SEQ ID NO: 1617091 - RNA, 14 nt, Pseudomonas putida KT2440
acguugcugccugu

SEQ ID NO: 1617092 - RNA, 14 nt, Pseudomonas putida KT2440
acguugcccgacac

SEQ ID NO: 1617093 - RNA, 21 nt, Pseudomonas putida KT2440
acguuucgucauccaccgccc

SEQ ID NO: 1617094 - RNA, 15 nt, Pseudomonas putida KT2440
acguggacagcagcu

SEQ ID NO: 1617095 - RNA, 17 nt, Pseudomonas putida KT2440
acguggacagcagcuug

SEQ ID NO: 1617096 - RNA, 17 nt, Pseudomonas putida KT2440
acguuauccagcugcaa

SEQ ID NO: 1617097 - RNA, 15 nt, Pseudomonas putida KT2440
acguugagccaggcu

SEQ ID NO: 1617098 - RNA, 21 nt, Pseudomonas putida KT2440
acguagcuguugcgcugggcg

SEQ ID NO: 1617099 - RNA, 18 nt, Pseudomonas putida KT2440
acguaguaauccggcaac

SEQ ID NO: 1617100 - RNA, 22 nt, Pseudomonas putida KT2440
acguaguccuugugcaguucgc

SEQ ID NO: 1617101 - RNA, 17 nt, Pseudomonas putida KT2440
acgugcccagaucacuu

SEQ ID NO: 1617102 - RNA, 21 nt, Pseudomonas putida KT2440
acgugcccugaacagggccag

SEQ ID NO: 1617103 - RNA, 21 nt, Pseudomonas putida KT2440
acuaccaugaaaaacaacaac

SEQ ID NO: 1617104 - RNA, 13 nt, Pseudomonas putida KT2440
acuacaugcggcc

SEQ ID NO: 1617105 - RNA, 14 nt, Pseudomonas putida KT2440
acuaagggcaggcc

SEQ ID NO: 1617106 - RNA, 17 nt, Pseudomonas putida KT2440
acuaagcgaaacaccag

SEQ ID NO: 1617107 - RNA, 19 nt, Pseudomonas putida KT2440
acuaacaggugcucaccag

SEQ ID NO: 1617108 - RNA, 14 nt, Pseudomonas putida KT2440
acuguugucggcca

SEQ ID NO: 1617109 - RNA, 18 nt, Pseudomonas putida KT2440
acuggaugauccagccca

SEQ ID NO: 1617110 - RNA, 22 nt, Pseudomonas putida KT2440
acuggaugauccagcccaccac

SEQ ID NO: 1617111 - RNA, 16 nt, Pseudomonas putida KT2440
acuggaugaugguauc

SEQ ID NO: 1617112 - RNA, 13 nt, Pseudomonas putida KT2440
acuguugcagcgc

SEQ ID NO: 1617113 - RNA, 22 nt, Pseudomonas putida KT2440
acuguucagguguuccagcacg

SEQ ID NO: 1617114 - RNA, 17 nt, Pseudomonas putida KT2440
acuucaaccgcacccgc

SEQ ID NO: 1617115 - RNA, 14 nt, Pseudomonas putida KT2440
acuucaaugcccag

SEQ ID NO: 1617116 - RNA, 16 nt, Pseudomonas putida KT2440
acuucaauggcacccu

SEQ ID NO: 1617117 - RNA, 23 nt, Pseudomonas putida KT2440
acuucacccaaugcaugcaucag

SEQ ID NO: 1617118 - RNA, 21 nt, Pseudomonas putida KT2440
acuucucgaccagcgccagcc

SEQ ID NO: 1617119 - RNA, 22 nt, Pseudomonas putida KT2440
acuucucgaccagcgccagcca

SEQ ID NO: 1617120 - RNA, 13 nt, Pseudomonas putida KT2440
acuuccaggccca

SEQ ID NO: 1617121 - RNA, 17 nt, Pseudomonas putida KT2440
acuuccaggcccauuuc

SEQ ID NO: 1617122 - RNA, 16 nt, Pseudomonas putida KT2440
acuuccagcagcuuca

SEQ ID NO: 1617123 - RNA, 16 nt, Pseudomonas putida KT2440
acuucccccuccccau

SEQ ID NO: 1617124 - RNA, 17 nt, Pseudomonas putida KT2440
acuuccccggcgccgcc

SEQ ID NO: 1617125 - RNA, 13 nt, Pseudomonas putida KT2440
acuucccguucgc

SEQ ID NO: 1617126 - RNA, 15 nt, Pseudomonas putida KT2440
acuucccucugccug

SEQ ID NO: 1617127 - RNA, 17 nt, Pseudomonas putida KT2440
acuuccuggccgccucc

SEQ ID NO: 1617128 - RNA, 18 nt, Pseudomonas putida KT2440
acuuccuugaccauuucc

SEQ ID NO: 1617129 - RNA, 23 nt, Pseudomonas putida KT2440
acuucgggcuguccucaaucaca

SEQ ID NO: 1617130 - RNA, 21 nt, Pseudomonas putida KT2440
acuucgcugucuuccagggca

SEQ ID NO: 1617131 - RNA, 21 nt, Pseudomonas putida KT2440
acucuuguguugccacccggc

SEQ ID NO: 1617132 - RNA, 22 nt, Pseudomonas putida KT2440
acucuuguguugccacccggcu

SEQ ID NO: 1617133 - RNA, 15 nt, Pseudomonas putida KT2440
acucuuccugccgca

SEQ ID NO: 1617134 - RNA, 18 nt, Pseudomonas putida KT2440
acucuucccaccaccagc

SEQ ID NO: 1617135 - RNA, 14 nt, Pseudomonas putida KT2440
acucugcugcucug

SEQ ID NO: 1617136 - RNA, 15 nt, Pseudomonas putida KT2440
acucugcugcucugc

SEQ ID NO: 1617137 - RNA, 12 nt, Pseudomonas putida KT2440
acucuucaccag

SEQ ID NO: 1617138 - RNA, 14 nt, Pseudomonas putida KT2440
acucuucaccagcu

SEQ ID NO: 1617139 - RNA, 16 nt, Pseudomonas putida KT2440
acucuucaccagcucg

SEQ ID NO: 1617140 - RNA, 14 nt, Pseudomonas putida KT2440
acucuccuugcguu

SEQ ID NO: 1617141 - RNA, 21 nt, Pseudomonas putida KT2440
acucguugaagcgguugaccg

SEQ ID NO: 1617142 - RNA, 22 nt, Pseudomonas putida KT2440
acucggccgggcguagcaggau

SEQ ID NO: 1617143 - RNA, 17 nt, Pseudomonas putida KT2440
acucggcguagcaggua

SEQ ID NO: 1617144 - RNA, 14 nt, Pseudomonas putida KT2440
acucggacaaccaa

SEQ ID NO: 1617145 - RNA, 19 nt, Pseudomonas putida KT2440
acucgcuuucgaucgagcc

SEQ ID NO: 1617146 - RNA, 13 nt, Pseudomonas putida KT2440
acucgaccgccgc

SEQ ID NO: 1617147 - RNA, 16 nt, Pseudomonas putida KT2440
acucgacgccccggcc

SEQ ID NO: 1617148 - RNA, 21 nt, Pseudomonas putida KT2440
acucgacgccccggccugcac

SEQ ID NO: 1617149 - RNA, 20 nt, Pseudomonas putida KT2440
acuccucgaucaccugcggc

SEQ ID NO: 1617150 - RNA, 23 nt, Pseudomonas putida KT2440
acuccucgaucaccugcggccug

SEQ ID NO: 1617151 - RNA, 14 nt, Pseudomonas putida KT2440
acucgaacagcuug

SEQ ID NO: 1617152 - RNA, 15 nt, Pseudomonas putida KT2440
acucccgcugcugcg

SEQ ID NO: 1617153 - RNA, 12 nt, Pseudomonas putida KT2440
acuccccaucag

SEQ ID NO: 1617154 - RNA, 17 nt, Pseudomonas putida KT2440
acuccccaucagcagcu

SEQ ID NO: 1617155 - RNA, 16 nt, Pseudomonas putida KT2440
acugcugggucagcac

SEQ ID NO: 1617156 - RNA, 23 nt, Pseudomonas putida KT2440
acugcucgcugccacgcaugccu

SEQ ID NO: 1617157 - RNA, 22 nt, Pseudomonas putida KT2440
acugcucuucgaguuuggccag

SEQ ID NO: 1617158 - RNA, 14 nt, Pseudomonas putida KT2440
acuggaucuucucu

SEQ ID NO: 1617159 - RNA, 20 nt, Pseudomonas putida KT2440
acuggaggugauggucaccu

SEQ ID NO: 1617160 - RNA, 18 nt, Pseudomonas putida KT2440
acugcgcccgccccucgu

SEQ ID NO: 1617161 - RNA, 18 nt, Pseudomonas putida KT2440
acugcgcgauagccugug

SEQ ID NO: 1617162 - RNA, 15 nt, Pseudomonas putida KT2440
acugccugcacggca

SEQ ID NO: 1617163 - RNA, 17 nt, Pseudomonas putida KT2440
acugcgaagcccaguuc

SEQ ID NO: 1617164 - RNA, 19 nt, Pseudomonas putida KT2440
acugccugcaugcgugccu

SEQ ID NO: 1617165 - RNA, 16 nt, Pseudomonas putida KT2440
acugccaacgggauac

SEQ ID NO: 1617166 - RNA, 21 nt, Pseudomonas putida KT2440
acugccaaguaccaauaccag

SEQ ID NO: 1617167 - RNA, 21 nt, Pseudomonas putida KT2440
acugcauuggccacgcccaac

SEQ ID NO: 1617168 - RNA, 16 nt, Pseudomonas putida KT2440
acugcauccgccccag

SEQ ID NO: 1617169 - RNA, 13 nt, Pseudomonas putida KT2440
acugagccaggcc

SEQ ID NO: 1617170 - RNA, 14 nt, Pseudomonas putida KT2440
aaucgacccaccua

SEQ ID NO: 1617171 - RNA, 23 nt, Pseudomonas putida KT2440
aaucgccgcaucguuauccagca

SEQ ID NO: 1617172 - RNA, 14 nt, Pseudomonas putida KT2440
aaucccggucaccu

SEQ ID NO: 1617173 - RNA, 17 nt, Pseudomonas putida KT2440
aaucgcuccaggcggcc

SEQ ID NO: 1617174 - RNA, 16 nt, Pseudomonas putida KT2440
aaucgcugcgcaugaa

SEQ ID NO: 1617175 - RNA, 23 nt, Pseudomonas putida KT2440
aaucggcuucagguucacuucca

SEQ ID NO: 1617176 - RNA, 15 nt, Pseudomonas putida KT2440
aaucggguccaccca

SEQ ID NO: 1617177 - RNA, 21 nt, Pseudomonas putida KT2440
aaucggguccacccacccucg

SEQ ID NO: 1617178 - RNA, 11 nt, Pseudomonas putida KT2440
aaucuccagcc

SEQ ID NO: 1617179 - RNA, 21 nt, Pseudomonas putida KT2440
aaucauaucgaaccagcagca

SEQ ID NO: 1617180 - RNA, 16 nt, Pseudomonas putida KT2440
aaucagcucgucagcc

SEQ ID NO: 1617181 - RNA, 18 nt, Pseudomonas putida KT2440
aaucagcucgucagccac

SEQ ID NO: 1617182 - RNA, 20 nt, Pseudomonas putida KT2440
aaucagcucgucagccacca

SEQ ID NO: 1617183 - RNA, 15 nt, Pseudomonas putida KT2440
aaucagcuauugaga

SEQ ID NO: 1617184 - RNA, 16 nt, Pseudomonas putida KT2440
aaucagcucacaggcu

SEQ ID NO: 1617185 - RNA, 16 nt, Pseudomonas putida KT2440
aaucagcggcaggcug

SEQ ID NO: 1617186 - RNA, 11 nt, Pseudomonas putida KT2440
aaucagccuuc

SEQ ID NO: 1617187 - RNA, 20 nt, Pseudomonas putida KT2440
aaucagcaucagugcaggug

SEQ ID NO: 1617188 - RNA, 21 nt, Pseudomonas putida KT2440
aaucagcaucagugcaggugc

SEQ ID NO: 1617189 - RNA, 15 nt, Pseudomonas putida KT2440
aaucagcaugcccag

SEQ ID NO: 1617190 - RNA, 13 nt, Pseudomonas putida KT2440
aaucaucgccagc

SEQ ID NO: 1617191 - RNA, 17 nt, Pseudomonas putida KT2440
aaucaucgccagcagcg

SEQ ID NO: 1617192 - RNA, 21 nt, Pseudomonas putida KT2440
aaucaucguauuacccuucau

SEQ ID NO: 1617193 - RNA, 22 nt, Pseudomonas putida KT2440
aaucaucguauuacccuucauc

SEQ ID NO: 1617194 - RNA, 13 nt, Pseudomonas putida KT2440
aauccaaucucca

SEQ ID NO: 1617195 - RNA, 19 nt, Pseudomonas putida KT2440
aaugcugccaugcaaggca

SEQ ID NO: 1617196 - RNA, 22 nt, Pseudomonas putida KT2440
aauggcgucuucgccaggugcg

SEQ ID NO: 1617197 - RNA, 21 nt, Pseudomonas putida KT2440
aaugggcugcaaagcagcccc

SEQ ID NO: 1617198 - RNA, 20 nt, Pseudomonas putida KT2440
aaugggaugagugcaugcug

SEQ ID NO: 1617199 - RNA, 22 nt, Pseudomonas putida KT2440
aaugcugccuuuuccugcugca

SEQ ID NO: 1617200 - RNA, 14 nt, Pseudomonas putida KT2440
aauggcaauccccc

SEQ ID NO: 1617201 - RNA, 19 nt, Pseudomonas putida KT2440
aauggcaaucgccuggcgc

SEQ ID NO: 1617202 - RNA, 17 nt, Pseudomonas putida KT2440
aaugcaggcaguaggcc

SEQ ID NO: 1617203 - RNA, 22 nt, Pseudomonas putida KT2440
aaugccgccuugcagaaagugc

SEQ ID NO: 1617204 - RNA, 18 nt, Pseudomonas putida KT2440
aaugcccauggccaggcu

SEQ ID NO: 1617205 - RNA, 14 nt, Pseudomonas putida KT2440
aaugauggcaauca

SEQ ID NO: 1617206 - RNA, 18 nt, Pseudomonas putida KT2440
aaugauggcaaucacgaa

SEQ ID NO: 1617207 - RNA, 22 nt, Pseudomonas putida KT2440
aaugaucgaaagcgguugagau

SEQ ID NO: 1617208 - RNA, 17 nt, Pseudomonas putida KT2440
aaugacuccgccccaaa

SEQ ID NO: 1617209 - RNA, 16 nt, Pseudomonas putida KT2440
aaugacuucgcugccc

SEQ ID NO: 1617210 - RNA, 16 nt, Pseudomonas putida KT2440
aaugaaaguccaucac

SEQ ID NO: 1617211 - RNA, 14 nt, Pseudomonas putida KT2440
aauucgugaaccaa

SEQ ID NO: 1617212 - RNA, 13 nt, Pseudomonas putida KT2440
aauugcacccgcg

SEQ ID NO: 1617213 - RNA, 19 nt, Pseudomonas putida KT2440
aauuaugagugccaagaau

SEQ ID NO: 1617214 - RNA, 16 nt, Pseudomonas putida KT2440
aauuaguuugacagcc

SEQ ID NO: 1617215 - RNA, 19 nt, Pseudomonas putida KT2440
aauuugccccuuccuugua

SEQ ID NO: 1617216 - RNA, 18 nt, Pseudomonas putida KT2440
aauuuucuugaaaacauu

SEQ ID NO: 1617217 - RNA, 21 nt, Pseudomonas putida KT2440
aauuucauccacauaggccag

SEQ ID NO: 1617218 - RNA, 19 nt, Pseudomonas putida KT2440
accaccgcguacagcugcu

SEQ ID NO: 1617219 - RNA, 17 nt, Pseudomonas putida KT2440
accaccgccaaggcacg

SEQ ID NO: 1617220 - RNA, 13 nt, Pseudomonas putida KT2440
accaccucauccc

SEQ ID NO: 1617221 - RNA, 14 nt, Pseudomonas putida KT2440
accaccucaucccc

SEQ ID NO: 1617222 - RNA, 17 nt, Pseudomonas putida KT2440
accaccuccaccccgca

SEQ ID NO: 1617223 - RNA, 19 nt, Pseudomonas putida KT2440
accaccuccaccccgcagg

SEQ ID NO: 1617224 - RNA, 19 nt, Pseudomonas putida KT2440
accaccugccaacgcaccg

SEQ ID NO: 1617225 - RNA, 13 nt, Pseudomonas putida KT2440
accaccugcucgg

SEQ ID NO: 1617226 - RNA, 18 nt, Pseudomonas putida KT2440
accaccucuaucaccugu

SEQ ID NO: 1617227 - RNA, 12 nt, Pseudomonas putida KT2440
accaccugggcg

SEQ ID NO: 1617228 - RNA, 20 nt, Pseudomonas putida KT2440
accaccugggcgcuuugcac

SEQ ID NO: 1617229 - RNA, 20 nt, Pseudomonas putida KT2440
accacgaacgcccccagccc

SEQ ID NO: 1617230 - RNA, 21 nt, Pseudomonas putida KT2440
accaccaucgccaggccuuca

SEQ ID NO: 1617231 - RNA, 16 nt, Pseudomonas putida KT2440
accacccaccagcagu

SEQ ID NO: 1617232 - RNA, 14 nt, Pseudomonas putida KT2440
accaccagcaacau

SEQ ID NO: 1617233 - RNA, 22 nt, Pseudomonas putida KT2440
accacccggucggccagcugcu

SEQ ID NO: 1617234 - RNA, 20 nt, Pseudomonas putida KT2440
accacccugaugcagcagug

SEQ ID NO: 1617235 - RNA, 22 nt, Pseudomonas putida KT2440
accacccugaugcagcagugcc

SEQ ID NO: 1617236 - RNA, 13 nt, Pseudomonas putida KT2440
accaccgaccugu

SEQ ID NO: 1617237 - RNA, 21 nt, Pseudomonas putida KT2440
accaccgauguguguccacca

SEQ ID NO: 1617238 - RNA, 18 nt, Pseudomonas putida KT2440
accaccccuugcaguauc

SEQ ID NO: 1617239 - RNA, 12 nt, Pseudomonas putida KT2440
accacuccaggg

SEQ ID NO: 1617240 - RNA, 23 nt, Pseudomonas putida KT2440
accacuccagggucugcgcuuca

SEQ ID NO: 1617241 - RNA, 18 nt, Pseudomonas putida KT2440
accacguugcgcuugagc

SEQ ID NO: 1617242 - RNA, 23 nt, Pseudomonas putida KT2440
accacguugcgcuugagcagguc

SEQ ID NO: 1617243 - RNA, 22 nt, Pseudomonas putida KT2440
accacugaugcgcguccagccc

SEQ ID NO: 1617244 - RNA, 17 nt, Pseudomonas putida KT2440
accacugcaggugcagg

SEQ ID NO: 1617245 - RNA, 15 nt, Pseudomonas putida KT2440
accacuggggcuucu

SEQ ID NO: 1617246 - RNA, 14 nt, Pseudomonas putida KT2440
accacgccugcgcc

SEQ ID NO: 1617247 - RNA, 13 nt, Pseudomonas putida KT2440
accacgccgaagc

SEQ ID NO: 1617248 - RNA, 15 nt, Pseudomonas putida KT2440
accacgccgcugcca

SEQ ID NO: 1617249 - RNA, 21 nt, Pseudomonas putida KT2440
accacguccggccagcaacag

SEQ ID NO: 1617250 - RNA, 22 nt, Pseudomonas putida KT2440
accacguuauccagcugcaaca

SEQ ID NO: 1617251 - RNA, 18 nt, Pseudomonas putida KT2440
accacguagugcuucugc

SEQ ID NO: 1617252 - RNA, 16 nt, Pseudomonas putida KT2440
accacguacacacauc

SEQ ID NO: 1617253 - RNA, 18 nt, Pseudomonas putida KT2440
accacgguggugguuugu

SEQ ID NO: 1617254 - RNA, 20 nt, Pseudomonas putida KT2440
accacggccggggccuguuc

SEQ ID NO: 1617255 - RNA, 14 nt, Pseudomonas putida KT2440
accacggccuggcc

SEQ ID NO: 1617256 - RNA, 17 nt, Pseudomonas putida KT2440
accacagcacgccucgg

SEQ ID NO: 1617257 - RNA, 18 nt, Pseudomonas putida KT2440
accacagccauuggccca

SEQ ID NO: 1617258 - RNA, 14 nt, Pseudomonas putida KT2440
accacagcugcaca

SEQ ID NO: 1617259 - RNA, 15 nt, Pseudomonas putida KT2440
accacagcugcgcca

SEQ ID NO: 1617260 - RNA, 15 nt, Pseudomonas putida KT2440
accacagcggccaca

SEQ ID NO: 1617261 - RNA, 15 nt, Pseudomonas putida KT2440
accacaggcgcuuga

SEQ ID NO: 1617262 - RNA, 21 nt, Pseudomonas putida KT2440
accacaggcgcuugaagaagc

SEQ ID NO: 1617263 - RNA, 22 nt, Pseudomonas putida KT2440
accacaggcgcuugaagaagcc

SEQ ID NO: 1617264 - RNA, 22 nt, Pseudomonas putida KT2440
accacacuggucacgcucggcc

SEQ ID NO: 1617265 - RNA, 20 nt, Pseudomonas putida KT2440
accacacggcagccccaacc

SEQ ID NO: 1617266 - RNA, 23 nt, Pseudomonas putida KT2440
accacauccccgccgccagcagc

SEQ ID NO: 1617267 - RNA, 14 nt, Pseudomonas putida KT2440
accacacaccccag

SEQ ID NO: 1617268 - RNA, 17 nt, Pseudomonas putida KT2440
accacacaccccagaac

SEQ ID NO: 1617269 - RNA, 17 nt, Pseudomonas putida KT2440
accaauugguuaaaagc

SEQ ID NO: 1617270 - RNA, 20 nt, Pseudomonas putida KT2440
accaauugguuaaaagccaa

SEQ ID NO: 1617271 - RNA, 21 nt, Pseudomonas putida KT2440
accaauugguuaaaagccaac

SEQ ID NO: 1617272 - RNA, 14 nt, Pseudomonas putida KT2440
accaauccccccuc

SEQ ID NO: 1617273 - RNA, 13 nt, Pseudomonas putida KT2440
accaauccagccc

SEQ ID NO: 1617274 - RNA, 16 nt, Pseudomonas putida KT2440
accaauccagcccuca

SEQ ID NO: 1617275 - RNA, 14 nt, Pseudomonas putida KT2440
accaaggcuuccgc

SEQ ID NO: 1617276 - RNA, 23 nt, Pseudomonas putida KT2440
accaaggcuugagugguuuucuu

SEQ ID NO: 1617277 - RNA, 20 nt, Pseudomonas putida KT2440
accaacgcauuuucaucaaa

SEQ ID NO: 1617278 - RNA, 19 nt, Pseudomonas putida KT2440
accaacgguaacguggaca

SEQ ID NO: 1617279 - RNA, 15 nt, Pseudomonas putida KT2440
acaucgaagcagugc

SEQ ID NO: 1617280 - RNA, 16 nt, Pseudomonas putida KT2440
acauccuuggucaugg

SEQ ID NO: 1617281 - RNA, 22 nt, Pseudomonas putida KT2440
acaucgcccccgcugcacaggc

SEQ ID NO: 1617282 - RNA, 20 nt, Pseudomonas putida KT2440
acaugccacggccuucuuca

SEQ ID NO: 1617283 - RNA, 21 nt, Pseudomonas putida KT2440
acaugcugcgccccagguugc

SEQ ID NO: 1617284 - RNA, 17 nt, Pseudomonas putida KT2440
acaugaucggguucuuc

SEQ ID NO: 1617285 - RNA, 20 nt, Pseudomonas putida KT2440
acauucagcagcgccugguc

SEQ ID NO: 1617286 - RNA, 15 nt, Pseudomonas putida KT2440
acauucaggaugcuu

SEQ ID NO: 1617287 - RNA, 18 nt, Pseudomonas putida KT2440
acauucaccagccaggca

SEQ ID NO: 1617288 - RNA, 21 nt, Pseudomonas putida KT2440
acauucaccagccaggcacag

SEQ ID NO: 1617289 - RNA, 22 nt, Pseudomonas putida KT2440
acauucaccagccaggcacaga

SEQ ID NO: 1617290 - RNA, 19 nt, Pseudomonas putida KT2440
acauucaccgccuaugaaa

SEQ ID NO: 1617291 - RNA, 19 nt, Pseudomonas putida KT2440
acauuucacagcaaaaaau

SEQ ID NO: 1617292 - RNA, 17 nt, Pseudomonas putida KT2440
acauugcuaauuucagg

SEQ ID NO: 1617293 - RNA, 12 nt, Pseudomonas putida KT2440
acaggcccagca

SEQ ID NO: 1617294 - RNA, 14 nt, Pseudomonas putida KT2440
acaggcccagcaug

SEQ ID NO: 1617295 - RNA, 15 nt, Pseudomonas putida KT2440
acaggcccagcauga

SEQ ID NO: 1617296 - RNA, 15 nt, Pseudomonas putida KT2440
acaggcagucauggg

SEQ ID NO: 1617297 - RNA, 13 nt, Pseudomonas putida KT2440
acaggcacaggcc

SEQ ID NO: 1617298 - RNA, 20 nt, Pseudomonas putida KT2440
acaggcacaggcccagcaac

SEQ ID NO: 1617299 - RNA, 17 nt, Pseudomonas putida KT2440
acaggcacgacugaaca

SEQ ID NO: 1617300 - RNA, 19 nt, Pseudomonas putida KT2440
acauacuccaccgccaggg

SEQ ID NO: 1617301 - RNA, 16 nt, Pseudomonas putida KT2440
acauaggcagccaccu

SEQ ID NO: 1617302 - RNA, 22 nt, Pseudomonas putida KT2440
acaucagccucggucagguacu

SEQ ID NO: 1617303 - RNA, 13 nt, Pseudomonas putida KT2440
acaucagccgguc

SEQ ID NO: 1617304 - RNA, 16 nt, Pseudomonas putida KT2440
acauccacagccucca

SEQ ID NO: 1617305 - RNA, 21 nt, Pseudomonas putida KT2440
acauccaccaggcuggccacc

SEQ ID NO: 1617306 - RNA, 20 nt, Pseudomonas putida KT2440
acauccagcgccgcgccacc

SEQ ID NO: 1617307 - RNA, 14 nt, Pseudomonas putida KT2440
acagaaacagauuc

SEQ ID NO: 1617308 - RNA, 15 nt, Pseudomonas putida KT2440
acagaacaauaaaac

SEQ ID NO: 1617309 - RNA, 14 nt, Pseudomonas putida KT2440
acagaaaagcauca

SEQ ID NO: 1617310 - RNA, 23 nt, Pseudomonas putida KT2440
acagaaaagcugcacgcuuucac

SEQ ID NO: 1617311 - RNA, 15 nt, Pseudomonas putida KT2440
acagaccgccgggcc

SEQ ID NO: 1617312 - RNA, 13 nt, Pseudomonas putida KT2440
acagacaacauca

SEQ ID NO: 1617313 - RNA, 17 nt, Pseudomonas putida KT2440
acacccucugccaucuc

SEQ ID NO: 1617314 - RNA, 14 nt, Pseudomonas putida KT2440
acacccucuugaau

SEQ ID NO: 1617315 - RNA, 18 nt, Pseudomonas putida KT2440
acaccgacauccacgucc

SEQ ID NO: 1617316 - RNA, 23 nt, Pseudomonas putida KT2440
acacccggugugugcccaccgca

SEQ ID NO: 1617317 - RNA, 13 nt, Pseudomonas putida KT2440
acacugagcacca

SEQ ID NO: 1617318 - RNA, 19 nt, Pseudomonas putida KT2440
acacucagccgcugcgccu

SEQ ID NO: 1617319 - RNA, 12 nt, Pseudomonas putida KT2440
acacucgccagg

SEQ ID NO: 1617320 - RNA, 20 nt, Pseudomonas putida KT2440
acacugucccggcacaaccg

SEQ ID NO: 1617321 - RNA, 19 nt, Pseudomonas putida KT2440
acacuggcuuucccccagc

SEQ ID NO: 1617322 - RNA, 13 nt, Pseudomonas putida KT2440
acacugcccagca

SEQ ID NO: 1617323 - RNA, 23 nt, Pseudomonas putida KT2440
acagcaccgccauggccaggucg

SEQ ID NO: 1617324 - RNA, 13 nt, Pseudomonas putida KT2440
acagcaccaugcg

SEQ ID NO: 1617325 - RNA, 15 nt, Pseudomonas putida KT2440
acagaugcugcugca

SEQ ID NO: 1617326 - RNA, 14 nt, Pseudomonas putida KT2440
acagauggugaugc

SEQ ID NO: 1617327 - RNA, 20 nt, Pseudomonas putida KT2440
acagcaucaaucgcuccagg

SEQ ID NO: 1617328 - RNA, 13 nt, Pseudomonas putida KT2440
acagcaucaucag

SEQ ID NO: 1617329 - RNA, 20 nt, Pseudomonas putida KT2440
acagcaucugcaccaggaag

SEQ ID NO: 1617330 - RNA, 22 nt, Pseudomonas putida KT2440
acagcaugaucuugggcuucau

SEQ ID NO: 1617331 - RNA, 16 nt, Pseudomonas putida KT2440
acagcaguugcugcug

SEQ ID NO: 1617332 - RNA, 16 nt, Pseudomonas putida KT2440
acagcaccggccaggc

SEQ ID NO: 1617333 - RNA, 18 nt, Pseudomonas putida KT2440
acagcaccggccaggcuc

SEQ ID NO: 1617334 - RNA, 22 nt, Pseudomonas putida KT2440
acagcacgggcacacuggccac

SEQ ID NO: 1617335 - RNA, 19 nt, Pseudomonas putida KT2440
acagcacgauggcggucga

SEQ ID NO: 1617336 - RNA, 13 nt, Pseudomonas putida KT2440
acagcacugccag

SEQ ID NO: 1617337 - RNA, 16 nt, Pseudomonas putida KT2440
acagaggccucaauca

SEQ ID NO: 1617338 - RNA, 21 nt, Pseudomonas putida KT2440
acagcgucaugcgguacagca

SEQ ID NO: 1617339 - RNA, 15 nt, Pseudomonas putida KT2440
acagcucgcgcugcc

SEQ ID NO: 1617340 - RNA, 19 nt, Pseudomonas putida KT2440
acagcucgcgcugccaggc

SEQ ID NO: 1617341 - RNA, 20 nt, Pseudomonas putida KT2440
acagcucucaacguucaucc

SEQ ID NO: 1617342 - RNA, 18 nt, Pseudomonas putida KT2440
acagcugccggccagcgc

SEQ ID NO: 1617343 - RNA, 14 nt, Pseudomonas putida KT2440
acagcugcggcaug

SEQ ID NO: 1617344 - RNA, 19 nt, Pseudomonas putida KT2440
acagcugcggcaugaaggc

SEQ ID NO: 1617345 - RNA, 19 nt, Pseudomonas putida KT2440
acagcccugcaauccgaac

SEQ ID NO: 1617346 - RNA, 19 nt, Pseudomonas putida KT2440
acagcccaaggcuggccag

SEQ ID NO: 1617347 - RNA, 23 nt, Pseudomonas putida KT2440
acagcggcgaaggauggaccgac

SEQ ID NO: 1617348 - RNA, 12 nt, Pseudomonas putida KT2440
acagcggcccca

SEQ ID NO: 1617349 - RNA, 14 nt, Pseudomonas putida KT2440
acagcggccacagc

SEQ ID NO: 1617350 - RNA, 15 nt, Pseudomonas putida KT2440
acaccaguucaccau

SEQ ID NO: 1617351 - RNA, 17 nt, Pseudomonas putida KT2440
acaccaguucaccaucc

SEQ ID NO: 1617352 - RNA, 16 nt, Pseudomonas putida KT2440
acaccaucggccggcu

SEQ ID NO: 1617353 - RNA, 19 nt, Pseudomonas putida KT2440
acaccaggccuucugcgcg

SEQ ID NO: 1617354 - RNA, 11 nt, Pseudomonas putida KT2440
acaccaggcug

SEQ ID NO: 1617355 - RNA, 23 nt, Pseudomonas putida KT2440
acaccaggacaagccgacaaaaa

SEQ ID NO: 1617356 - RNA, 19 nt, Pseudomonas putida KT2440
acaccagcauguccugcug

SEQ ID NO: 1617357 - RNA, 12 nt, Pseudomonas putida KT2440
acaccagcagcc

SEQ ID NO: 1617358 - RNA, 21 nt, Pseudomonas putida KT2440
acacaugcaaacccuggcccu

SEQ ID NO: 1617359 - RNA, 16 nt, Pseudomonas putida KT2440
acaccacugucagcca

SEQ ID NO: 1617360 - RNA, 17 nt, Pseudomonas putida KT2440
acaccacugucagccag

SEQ ID NO: 1617361 - RNA, 16 nt, Pseudomonas putida KT2440
acacaucggucggccc

SEQ ID NO: 1617362 - RNA, 14 nt, Pseudomonas putida KT2440
acacauccagcgcc

SEQ ID NO: 1617363 - RNA, 14 nt, Pseudomonas putida KT2440
acacaucacgcaca

SEQ ID NO: 1617364 - RNA, 14 nt, Pseudomonas putida KT2440
acacauaucagcca

SEQ ID NO: 1617365 - RNA, 20 nt, Pseudomonas putida KT2440
acacagcauuacgcggcagc

SEQ ID NO: 1617366 - RNA, 20 nt, Pseudomonas putida KT2440
acacaggcugucggcaugca

SEQ ID NO: 1617367 - RNA, 24 nt, Pseudomonas putida KT2440
acacagaugccgccgcugccagca

SEQ ID NO: 1617368 - RNA, 16 nt, Pseudomonas putida KT2440
acaaucuucuucauca

SEQ ID NO: 1617369 - RNA, 23 nt, Pseudomonas putida KT2440
acaauguaccgggcuacaugaac

SEQ ID NO: 1617370 - RNA, 13 nt, Pseudomonas putida KT2440
acaagaacaacac

SEQ ID NO: 1617371 - RNA, 16 nt, Pseudomonas putida KT2440
acaagaucaagccccu

SEQ ID NO: 1617372 - RNA, 14 nt, Pseudomonas putida KT2440
acaagauaacaccc

SEQ ID NO: 1617373 - RNA, 19 nt, Pseudomonas putida KT2440
acaagccguaaagcacaca

SEQ ID NO: 1617374 - RNA, 22 nt, Pseudomonas putida KT2440
acaacuccgggugcuccuuauc

SEQ ID NO: 1617375 - RNA, 17 nt, Pseudomonas putida KT2440
acaacuccaccccuucc

SEQ ID NO: 1617376 - RNA, 16 nt, Pseudomonas putida KT2440
acaacucaauuucccc

SEQ ID NO: 1617377 - RNA, 16 nt, Pseudomonas putida KT2440
acaacuaucgagcaug

SEQ ID NO: 1617378 - RNA, 16 nt, Pseudomonas putida KT2440
acaacugcuccaggca

SEQ ID NO: 1617379 - RNA, 20 nt, Pseudomonas putida KT2440
acaacuguccugugcgcauu

SEQ ID NO: 1617380 - RNA, 23 nt, Pseudomonas putida KT2440
acaacuguccugugcgcauuuca

SEQ ID NO: 1617381 - RNA, 20 nt, Pseudomonas putida KT2440
acaacuuacaaaucaguaag

SEQ ID NO: 1617382 - RNA, 15 nt, Pseudomonas putida KT2440
acaacgguguggcca

SEQ ID NO: 1617383 - RNA, 16 nt, Pseudomonas putida KT2440
acaacggcucacugcu

SEQ ID NO: 1617384 - RNA, 17 nt, Pseudomonas putida KT2440
acaacgcgccaccgccg

SEQ ID NO: 1617385 - RNA, 16 nt, Pseudomonas putida KT2440
aagccugccagguccg

SEQ ID NO: 1617386 - RNA, 16 nt, Pseudomonas putida KT2440
aagccugcuccagcac

SEQ ID NO: 1617387 - RNA, 17 nt, Pseudomonas putida KT2440
aagccugccguuucaug

SEQ ID NO: 1617388 - RNA, 15 nt, Pseudomonas putida KT2440
aagccuugcugauca

SEQ ID NO: 1617389 - RNA, 14 nt, Pseudomonas putida KT2440
aagaucagcaccga

SEQ ID NO: 1617390 - RNA, 22 nt, Pseudomonas putida KT2440
aagccggcuuugcgucaucauc

SEQ ID NO: 1617391 - RNA, 17 nt, Pseudomonas putida KT2440
aagccggcgaacagcac

SEQ ID NO: 1617392 - RNA, 14 nt, Pseudomonas putida KT2440
aagccuaaaggcau

SEQ ID NO: 1617393 - RNA, 17 nt, Pseudomonas putida KT2440
aagccgugccugggugg

SEQ ID NO: 1617394 - RNA, 17 nt, Pseudomonas putida KT2440
aagcgcagguccaggcg

SEQ ID NO: 1617395 - RNA, 19 nt, Pseudomonas putida KT2440
aagcgccgcagguccaccu

SEQ ID NO: 1617396 - RNA, 16 nt, Pseudomonas putida KT2440
aagcgccagggcaucg

SEQ ID NO: 1617397 - RNA, 21 nt, Pseudomonas putida KT2440
aagcgccagggcaucgaccag

SEQ ID NO: 1617398 - RNA, 20 nt, Pseudomonas putida KT2440
aagcgcgccuccagcugaaa

SEQ ID NO: 1617399 - RNA, 20 nt, Pseudomonas putida KT2440
aagcggccaccugccccagc

SEQ ID NO: 1617400 - RNA, 13 nt, Pseudomonas putida KT2440
aagcucaaaugcu

SEQ ID NO: 1617401 - RNA, 14 nt, Pseudomonas putida KT2440
aagcucaaaugcug

SEQ ID NO: 1617402 - RNA, 21 nt, Pseudomonas putida KT2440
aagcuaucgccagcaggccgc

SEQ ID NO: 1617403 - RNA, 20 nt, Pseudomonas putida KT2440
aagcggcucgucaaccacag

SEQ ID NO: 1617404 - RNA, 21 nt, Pseudomonas putida KT2440
aagcggcucgucaaccacagc

SEQ ID NO: 1617405 - RNA, 23 nt, Pseudomonas putida KT2440
aagcgggcagugcaauaccagcc

SEQ ID NO: 1617406 - RNA, 18 nt, Pseudomonas putida KT2440
aagcggucguuacccagg

SEQ ID NO: 1617407 - RNA, 17 nt, Pseudomonas putida KT2440
aagcggucgaaaagccg

SEQ ID NO: 1617408 - RNA, 19 nt, Pseudomonas putida KT2440
aagcuggcacgugcaggag

SEQ ID NO: 1617409 - RNA, 15 nt, Pseudomonas putida KT2440
aagcuggucaggugc

SEQ ID NO: 1617410 - RNA, 13 nt, Pseudomonas putida KT2440
aaggaccucaagu

SEQ ID NO: 1617411 - RNA, 14 nt, Pseudomonas putida KT2440
aaggacaucaccag

SEQ ID NO: 1617412 - RNA, 20 nt, Pseudomonas putida KT2440
aaggaacugcgcugccccaa

SEQ ID NO: 1617413 - RNA, 18 nt, Pseudomonas putida KT2440
aaggccgcucccacgagg

SEQ ID NO: 1617414 - RNA, 21 nt, Pseudomonas putida KT2440
aaggccgguuuuuucaugcac

SEQ ID NO: 1617415 - RNA, 15 nt, Pseudomonas putida KT2440
aaggccggcagccag

SEQ ID NO: 1617416 - RNA, 17 nt, Pseudomonas putida KT2440
aaggccggcagccaggg

SEQ ID NO: 1617417 - RNA, 13 nt, Pseudomonas putida KT2440
aaggccgccaccu

SEQ ID NO: 1617418 - RNA, 20 nt, Pseudomonas putida KT2440
aaggcccaguucggacaggc

SEQ ID NO: 1617419 - RNA, 22 nt, Pseudomonas putida KT2440
aaggcccaguucggacaggcgc

SEQ ID NO: 1617420 - RNA, 20 nt, Pseudomonas putida KT2440
aaggccucuaccgcugcucc

SEQ ID NO: 1617421 - RNA, 20 nt, Pseudomonas putida KT2440
aaggcucaggccuugccgcu

SEQ ID NO: 1617422 - RNA, 23 nt, Pseudomonas putida KT2440
aaggcuugcccucauucgcccgc

SEQ ID NO: 1617423 - RNA, 16 nt, Pseudomonas putida KT2440
aaggcuggucgcugcc

SEQ ID NO: 1617424 - RNA, 23 nt, Pseudomonas putida KT2440
aaggcuggccagacgaugauggc

SEQ ID NO: 1617425 - RNA, 19 nt, Pseudomonas putida KT2440
aaggccaggaacagcgcag

SEQ ID NO: 1617426 - RNA, 17 nt, Pseudomonas putida KT2440
aaggccagccgagccaa

SEQ ID NO: 1617427 - RNA, 15 nt, Pseudomonas putida KT2440
aaggcccgugguugg

SEQ ID NO: 1617428 - RNA, 13 nt, Pseudomonas putida KT2440
aaggcaugggcca

SEQ ID NO: 1617429 - RNA, 23 nt, Pseudomonas putida KT2440
aaggcauccagcucggcaaggcg

SEQ ID NO: 1617430 - RNA, 15 nt, Pseudomonas putida KT2440
aaggcauccagggcg

SEQ ID NO: 1617431 - RNA, 12 nt, Pseudomonas putida KT2440
aaggcaccaacu

SEQ ID NO: 1617432 - RNA, 15 nt, Pseudomonas putida KT2440
aaggcaccaacugca

SEQ ID NO: 1617433 - RNA, 22 nt, Pseudomonas putida KT2440
aaggcaaugcccauggccaggc

SEQ ID NO: 1617434 - RNA, 23 nt, Pseudomonas putida KT2440
aaguucagcgccucuuugcccug

SEQ ID NO: 1617435 - RNA, 23 nt, Pseudomonas putida KT2440
aaguguuugaagcuaaacgaguu

SEQ ID NO: 1617436 - RNA, 16 nt, Pseudomonas putida KT2440
aagucgcgcaccaccu

SEQ ID NO: 1617437 - RNA, 16 nt, Pseudomonas putida KT2440
aagucgaacuccuugu

SEQ ID NO: 1617438 - RNA, 17 nt, Pseudomonas putida KT2440
aagucauggcuauucuc

SEQ ID NO: 1617439 - RNA, 18 nt, Pseudomonas putida KT2440
aagucagguaggugcuga

SEQ ID NO: 1617440 - RNA, 22 nt, Pseudomonas putida KT2440
aagucccccaucggcacccgca

SEQ ID NO: 1617441 - RNA, 23 nt, Pseudomonas putida KT2440
aaguccccguugguguccuuguc

SEQ ID NO: 1617442 - RNA, 13 nt, Pseudomonas putida KT2440
aagucaaccaacu

SEQ ID NO: 1617443 - RNA, 17 nt, Pseudomonas putida KT2440
aaguauuaauuugaaca

SEQ ID NO: 1617444 - RNA, 19 nt, Pseudomonas putida KT2440
aagggccgcaaggccgcuc

SEQ ID NO: 1617445 - RNA, 13 nt, Pseudomonas putida KT2440
aagggccugugcc

SEQ ID NO: 1617446 - RNA, 15 nt, Pseudomonas putida KT2440
aagggcgaccgaagu

SEQ ID NO: 1617447 - RNA, 22 nt, Pseudomonas putida KT2440
aaggggcggguggaggugcagg

SEQ ID NO: 1617448 - RNA, 12 nt, Pseudomonas putida KT2440
aagggcugguag

SEQ ID NO: 1617449 - RNA, 14 nt, Pseudomonas putida KT2440
aaguagaaccacac

SEQ ID NO: 1617450 - RNA, 13 nt, Pseudomonas putida KT2440
aaguacgccggcg

SEQ ID NO: 1617451 - RNA, 22 nt, Pseudomonas putida KT2440
aauaggccggucccaauaauaa

SEQ ID NO: 1617452 - RNA, 14 nt, Pseudomonas putida KT2440
aauagguaaagcca

SEQ ID NO: 1617453 - RNA, 13 nt, Pseudomonas putida KT2440
aauagcaacacau

SEQ ID NO: 1617454 - RNA, 19 nt, Pseudomonas putida KT2440
aauagccggccucagcagc

SEQ ID NO: 1617455 - RNA, 16 nt, Pseudomonas putida KT2440
aauagcggcgguucuu

SEQ ID NO: 1617456 - RNA, 21 nt, Pseudomonas putida KT2440
aauagcggcgguucuucaacu

SEQ ID NO: 1617457 - RNA, 16 nt, Pseudomonas putida KT2440
aauagcgcuuucuggu

SEQ ID NO: 1617458 - RNA, 23 nt, Pseudomonas putida KT2440
aauaccaguaaagcuuucauuuu

SEQ ID NO: 1617459 - RNA, 18 nt, Pseudomonas putida KT2440
aauaccaccucacacugg

SEQ ID NO: 1617460 - RNA, 15 nt, Pseudomonas putida KT2440
aaaaaucuuaacuca

SEQ ID NO: 1617461 - RNA, 14 nt, Pseudomonas putida KT2440
aauaauaaaaaaag

SEQ ID NO: 1617462 - RNA, 15 nt, Pseudomonas putida KT2440
aauaauaaaaaaaga

SEQ ID NO: 1617463 - RNA, 11 nt, Pseudomonas putida KT2440
aauaauaaaaa

SEQ ID NO: 1617464 - RNA, 17 nt, Pseudomonas putida KT2440
aaguugagcgccgcgau

SEQ ID NO: 1617465 - RNA, 12 nt, Pseudomonas putida KT2440
aagagcaggaag

SEQ ID NO: 1617466 - RNA, 13 nt, Pseudomonas putida KT2440
aagagcaggaaga

SEQ ID NO: 1617467 - RNA, 14 nt, Pseudomonas putida KT2440
aagaggccggcccc

SEQ ID NO: 1617468 - RNA, 14 nt, Pseudomonas putida KT2440
aagaggccgguacu

SEQ ID NO: 1617469 - RNA, 14 nt, Pseudomonas putida KT2440
aagauaguaggcac

SEQ ID NO: 1617470 - RNA, 22 nt, Pseudomonas putida KT2440
aagacaguggaaacgacaaggu

SEQ ID NO: 1617471 - RNA, 20 nt, Pseudomonas putida KT2440
aagacgaaguacggcuugcc

SEQ ID NO: 1617472 - RNA, 20 nt, Pseudomonas putida KT2440
aagagaagcugcagcuucag

SEQ ID NO: 1617473 - RNA, 13 nt, Pseudomonas putida KT2440
aacuccugcugca

SEQ ID NO: 1617474 - RNA, 20 nt, Pseudomonas putida KT2440
aacucgcgcauccagccaga

SEQ ID NO: 1617475 - RNA, 13 nt, Pseudomonas putida KT2440
aacucggcgagcc

SEQ ID NO: 1617476 - RNA, 15 nt, Pseudomonas putida KT2440
aacucguucagugcc

SEQ ID NO: 1617477 - RNA, 17 nt, Pseudomonas putida KT2440
aacucguugaccacgaa

SEQ ID NO: 1617478 - RNA, 17 nt, Pseudomonas putida KT2440
aacucuaccucacugac

SEQ ID NO: 1617479 - RNA, 12 nt, Pseudomonas putida KT2440
aacucuccuugc

SEQ ID NO: 1617480 - RNA, 21 nt, Pseudomonas putida KT2440
aacuauccuacgcgccaguca

SEQ ID NO: 1617481 - RNA, 18 nt, Pseudomonas putida KT2440
aacuccaccaucaaguca

SEQ ID NO: 1617482 - RNA, 12 nt, Pseudomonas putida KT2440
aacucaggcuga

SEQ ID NO: 1617483 - RNA, 17 nt, Pseudomonas putida KT2440
aacucacgcgccagggu

SEQ ID NO: 1617484 - RNA, 15 nt, Pseudomonas putida KT2440
aacuugucuguacug

SEQ ID NO: 1617485 - RNA, 23 nt, Pseudomonas putida KT2440
aacuucucgccucagcgccaaua

SEQ ID NO: 1617486 - RNA, 13 nt, Pseudomonas putida KT2440
aacugccaggcug

SEQ ID NO: 1617487 - RNA, 15 nt, Pseudomonas putida KT2440
aacuucgggcugucc

SEQ ID NO: 1617488 - RNA, 16 nt, Pseudomonas putida KT2440
aacuucgguggcucac

SEQ ID NO: 1617489 - RNA, 11 nt, Pseudomonas putida KT2440
aacuucuccag

SEQ ID NO: 1617490 - RNA, 18 nt, Pseudomonas putida KT2440
aacggccgcaccucauuc

SEQ ID NO: 1617491 - RNA, 13 nt, Pseudomonas putida KT2440
aacggcgcaucca

SEQ ID NO: 1617492 - RNA, 15 nt, Pseudomonas putida KT2440
aacggcgccagcagu

SEQ ID NO: 1617493 - RNA, 18 nt, Pseudomonas putida KT2440
aacggcaccuuugcaggu

SEQ ID NO: 1617494 - RNA, 17 nt, Pseudomonas putida KT2440
aacggcacacgcaccac

SEQ ID NO: 1617495 - RNA, 16 nt, Pseudomonas putida KT2440
aacggcaacgccagca

SEQ ID NO: 1617496 - RNA, 12 nt, Pseudomonas putida KT2440
aacgccacgccc

SEQ ID NO: 1617497 - RNA, 24 nt, Pseudomonas putida KT2440
aacgccacgcccaacccagccagc

SEQ ID NO: 1617498 - RNA, 18 nt, Pseudomonas putida KT2440
aacgccuuggccuggcga

SEQ ID NO: 1617499 - RNA, 19 nt, Pseudomonas putida KT2440
aacgccuuguuccgcccag

SEQ ID NO: 1617500 - RNA, 17 nt, Pseudomonas putida KT2440
aacgcgguaagcaccac

SEQ ID NO: 1617501 - RNA, 19 nt, Pseudomonas putida KT2440
aacgcgguggcuggcaccg

SEQ ID NO: 1617502 - RNA, 15 nt, Pseudomonas putida KT2440
aacgcggcccugggu

SEQ ID NO: 1617503 - RNA, 19 nt, Pseudomonas putida KT2440
aacgcgauacccaauaaaa

SEQ ID NO: 1617504 - RNA, 13 nt, Pseudomonas putida KT2440
aacgacagcugca

SEQ ID NO: 1617505 - RNA, 12 nt, Pseudomonas putida KT2440
aacgacaaggua

SEQ ID NO: 1617506 - RNA, 13 nt, Pseudomonas putida KT2440
aacgacaagguac

SEQ ID NO: 1617507 - RNA, 13 nt, Pseudomonas putida KT2440
aacgacaaacucc

SEQ ID NO: 1617508 - RNA, 20 nt, Pseudomonas putida KT2440
aacgacuuguaauugaaguu

SEQ ID NO: 1617509 - RNA, 14 nt, Pseudomonas putida KT2440
aacgcaggcucugc

SEQ ID NO: 1617510 - RNA, 16 nt, Pseudomonas putida KT2440
aacgcagccggcaccg

SEQ ID NO: 1617511 - RNA, 23 nt, Pseudomonas putida KT2440
aacgcauggcguuguccagcagg

SEQ ID NO: 1617512 - RNA, 19 nt, Pseudomonas putida KT2440
aaccguucacguucaacgc

SEQ ID NO: 1617513 - RNA, 14 nt, Pseudomonas putida KT2440
aacccgcgcugccu

SEQ ID NO: 1617514 - RNA, 12 nt, Pseudomonas putida KT2440
aacccgcaucau

SEQ ID NO: 1617515 - RNA, 21 nt, Pseudomonas putida KT2440
aacccgauuccuugcagcgcc

SEQ ID NO: 1617516 - RNA, 20 nt, Pseudomonas putida KT2440
aaccgggucggcgccaggcc

SEQ ID NO: 1617517 - RNA, 15 nt, Pseudomonas putida KT2440
aaccgggucuugaag

SEQ ID NO: 1617518 - RNA, 12 nt, Pseudomonas putida KT2440
aaccguacccuu

SEQ ID NO: 1617519 - RNA, 22 nt, Pseudomonas putida KT2440
aaccucacuggcauccggcagc

SEQ ID NO: 1617520 - RNA, 17 nt, Pseudomonas putida KT2440
aaccucugcaugccagu

SEQ ID NO: 1617521 - RNA, 19 nt, Pseudomonas putida KT2440
aaccugacccgcgccucga

SEQ ID NO: 1617522 - RNA, 16 nt, Pseudomonas putida KT2440
aaccuucaacaccaac

SEQ ID NO: 1617523 - RNA, 18 nt, Pseudomonas putida KT2440
aaccugcucgcucaggcu

SEQ ID NO: 1617524 - RNA, 19 nt, Pseudomonas putida KT2440
aaccugcgcuugcaccagg

SEQ ID NO: 1617525 - RNA, 17 nt, Pseudomonas putida KT2440
aaccuguaacucagcuu

SEQ ID NO: 1617526 - RNA, 13 nt, Pseudomonas putida KT2440
aaccuuccagcaa

SEQ ID NO: 1617527 - RNA, 16 nt, Pseudomonas putida KT2440
aaccuugaccaccagg

SEQ ID NO: 1617528 - RNA, 19 nt, Pseudomonas putida KT2440
aacgaaaaaaagggcaccu

SEQ ID NO: 1617529 - RNA, 22 nt, Pseudomonas putida KT2440
aacgaaaaaaagggcaccucca

SEQ ID NO: 1617530 - RNA, 21 nt, Pseudomonas putida KT2440
aaccagaugcuugguaccguc

SEQ ID NO: 1617531 - RNA, 19 nt, Pseudomonas putida KT2440
aaccagcagaaccccacuc

SEQ ID NO: 1617532 - RNA, 21 nt, Pseudomonas putida KT2440
aaccaggugcgguccggcucc

SEQ ID NO: 1617533 - RNA, 12 nt, Pseudomonas putida KT2440
aaccagcucacc

SEQ ID NO: 1617534 - RNA, 20 nt, Pseudomonas putida KT2440
aaccccagccuucagcaggc

SEQ ID NO: 1617535 - RNA, 13 nt, Pseudomonas putida KT2440
aaccccagcgcgu

SEQ ID NO: 1617536 - RNA, 21 nt, Pseudomonas putida KT2440
aaccccagcgcguacagcgac

SEQ ID NO: 1617537 - RNA, 18 nt, Pseudomonas putida KT2440
aaccccgucgccucaccu

SEQ ID NO: 1617538 - RNA, 21 nt, Pseudomonas putida KT2440
aaccaguacugggcguccuuc

SEQ ID NO: 1617539 - RNA, 21 nt, Pseudomonas putida KT2440
aaccaccgcucaaacccggca

SEQ ID NO: 1617540 - RNA, 21 nt, Pseudomonas putida KT2440
aaccacaucacgaucaugcug

SEQ ID NO: 1617541 - RNA, 19 nt, Pseudomonas putida KT2440
aacaguugaccaaggaacu

SEQ ID NO: 1617542 - RNA, 23 nt, Pseudomonas putida KT2440
aacaguuugcuuuuucgagcagc

SEQ ID NO: 1617543 - RNA, 12 nt, Pseudomonas putida KT2440
aacaguuuucaa

SEQ ID NO: 1617544 - RNA, 21 nt, Pseudomonas putida KT2440
aacaucgcccccgcugcacag

SEQ ID NO: 1617545 - RNA, 20 nt, Pseudomonas putida KT2440
aacaucgaauuucugcaaca

SEQ ID NO: 1617546 - RNA, 22 nt, Pseudomonas putida KT2440
aacaucaggucugccaguguca

SEQ ID NO: 1617547 - RNA, 22 nt, Pseudomonas putida KT2440
aacagcggcaauucggccggcc

SEQ ID NO: 1617548 - RNA, 11 nt, Pseudomonas putida KT2440
aacagcggcag

SEQ ID NO: 1617549 - RNA, 14 nt, Pseudomonas putida KT2440
aacagcggcagcaa

SEQ ID NO: 1617550 - RNA, 18 nt, Pseudomonas putida KT2440
aacagcgcgcgaaucacc

SEQ ID NO: 1617551 - RNA, 20 nt, Pseudomonas putida KT2440
aacagcgcgacgcagcagcg

SEQ ID NO: 1617552 - RNA, 22 nt, Pseudomonas putida KT2440
aacagcgcugcgaggccccaga

SEQ ID NO: 1617553 - RNA, 23 nt, Pseudomonas putida KT2440
aacagcgcugcgaggccccagac

SEQ ID NO: 1617554 - RNA, 14 nt, Pseudomonas putida KT2440
aacagcgccgcgau

SEQ ID NO: 1617555 - RNA, 23 nt, Pseudomonas putida KT2440
aacaaggcaaaggucugcugcgg

SEQ ID NO: 1617556 - RNA, 20 nt, Pseudomonas putida KT2440
aacagcuugccauccuugaa

SEQ ID NO: 1617557 - RNA, 18 nt, Pseudomonas putida KT2440
aacagcuucaacaagguc

SEQ ID NO: 1617558 - RNA, 22 nt, Pseudomonas putida KT2440
aacagcugcgcgaaguggauau

SEQ ID NO: 1617559 - RNA, 19 nt, Pseudomonas putida KT2440
aacagcuccagcaacugcg

SEQ ID NO: 1617560 - RNA, 20 nt, Pseudomonas putida KT2440
aacagcuccagcaacugcgc

SEQ ID NO: 1617561 - RNA, 19 nt, Pseudomonas putida KT2440
aacagcucgauggccagga

SEQ ID NO: 1617562 - RNA, 21 nt, Pseudomonas putida KT2440
aacagggguucgaguccccua

SEQ ID NO: 1617563 - RNA, 22 nt, Pseudomonas putida KT2440
aacaggcgcuugcccgccgaau

SEQ ID NO: 1617564 - RNA, 13 nt, Pseudomonas putida KT2440
aacaggcggcccg

SEQ ID NO: 1617565 - RNA, 22 nt, Pseudomonas putida KT2440
aacaggcguacaucagccucgg

SEQ ID NO: 1617566 - RNA, 11 nt, Pseudomonas putida KT2440
aacaggaucag

SEQ ID NO: 1617567 - RNA, 14 nt, Pseudomonas putida KT2440
cgccuggcgccugc

SEQ ID NO: 1617568 - RNA, 15 nt, Pseudomonas putida KT2440
cgccuggcccgcagc

SEQ ID NO: 1617569 - RNA, 14 nt, Pseudomonas putida KT2440
cgccugcuuuggga

SEQ ID NO: 1617570 - RNA, 16 nt, Pseudomonas putida KT2440
cgccugccuggcccuc

SEQ ID NO: 1617571 - RNA, 17 nt, Pseudomonas putida KT2440
cgccugccgggccaggg

SEQ ID NO: 1617572 - RNA, 16 nt, Pseudomonas putida KT2440
cgccugcgccagugcc

SEQ ID NO: 1617573 - RNA, 16 nt, Pseudomonas putida KT2440
cgccugcaccuggcug

SEQ ID NO: 1617574 - RNA, 17 nt, Pseudomonas putida KT2440
cgccugacgccgccagc

SEQ ID NO: 1617575 - RNA, 16 nt, Pseudomonas putida KT2440
cgccugaacagcauca

SEQ ID NO: 1617576 - RNA, 22 nt, Pseudomonas putida KT2440
cgccugaaccaccgggaucuug

SEQ ID NO: 1617577 - RNA, 20 nt, Pseudomonas putida KT2440
cgccugaaucuugcgcgcca

SEQ ID NO: 1617578 - RNA, 22 nt, Pseudomonas putida KT2440
cgccugaaucuugcgcgccagc

SEQ ID NO: 1617579 - RNA, 19 nt, Pseudomonas putida KT2440
cgccucuuugcccugggcg

SEQ ID NO: 1617580 - RNA, 16 nt, Pseudomonas putida KT2440
cgccucggcacugcac

SEQ ID NO: 1617581 - RNA, 15 nt, Pseudomonas putida KT2440
cgcgaaugcuacaga

SEQ ID NO: 1617582 - RNA, 22 nt, Pseudomonas putida KT2440
cgcgaaucgccuucagcgcccc

SEQ ID NO: 1617583 - RNA, 19 nt, Pseudomonas putida KT2440
cgcgaacgacuucggcaac

SEQ ID NO: 1617584 - RNA, 17 nt, Pseudomonas putida KT2440
cgccugggucaacccca

SEQ ID NO: 1617585 - RNA, 19 nt, Pseudomonas putida KT2440
cgccuucacugcgcggugc

SEQ ID NO: 1617586 - RNA, 17 nt, Pseudomonas putida KT2440
cgccuucgcccgaccgc

SEQ ID NO: 1617587 - RNA, 21 nt, Pseudomonas putida KT2440
cgccuucgcccgaccgccagc

SEQ ID NO: 1617588 - RNA, 18 nt, Pseudomonas putida KT2440
cgcgacagcguugcucca

SEQ ID NO: 1617589 - RNA, 17 nt, Pseudomonas putida KT2440
cgcgacaugaucagcgg

SEQ ID NO: 1617590 - RNA, 15 nt, Pseudomonas putida KT2440
cgcgaauggccuuua

SEQ ID NO: 1617591 - RNA, 15 nt, Pseudomonas putida KT2440
cgcgaaugggccgcc

SEQ ID NO: 1617592 - RNA, 16 nt, Pseudomonas putida KT2440
cgcgaaugggccgcca

SEQ ID NO: 1617593 - RNA, 19 nt, Pseudomonas putida KT2440
cgcgacugaagcgcggguc

SEQ ID NO: 1617594 - RNA, 21 nt, Pseudomonas putida KT2440
cgcgacggucauaccucgacc

SEQ ID NO: 1617595 - RNA, 21 nt, Pseudomonas putida KT2440
cgcgacgguugacagcacggc

SEQ ID NO: 1617596 - RNA, 23 nt, Pseudomonas putida KT2440
cgcgacgguugacagcacggccu

SEQ ID NO: 1617597 - RNA, 13 nt, Pseudomonas putida KT2440
cgcgacgcggccc

SEQ ID NO: 1617598 - RNA, 17 nt, Pseudomonas putida KT2440
cgcgacgaugaucaggu

SEQ ID NO: 1617599 - RNA, 14 nt, Pseudomonas putida KT2440
cgcgacgcagcagc

SEQ ID NO: 1617600 - RNA, 19 nt, Pseudomonas putida KT2440
cgccgccgaugcgcuucca

SEQ ID NO: 1617601 - RNA, 21 nt, Pseudomonas putida KT2440
cgccgccgcugauuuccgccg

SEQ ID NO: 1617602 - RNA, 21 nt, Pseudomonas putida KT2440
cgccgguugcgcagccggccu

SEQ ID NO: 1617603 - RNA, 15 nt, Pseudomonas putida KT2440
cgccgucaccgccgc

SEQ ID NO: 1617604 - RNA, 13 nt, Pseudomonas putida KT2440
cgccgguggcggc

SEQ ID NO: 1617605 - RNA, 13 nt, Pseudomonas putida KT2440
cgccgugcuugug

SEQ ID NO: 1617606 - RNA, 19 nt, Pseudomonas putida KT2440
cgccguguucccagcaccc

SEQ ID NO: 1617607 - RNA, 22 nt, Pseudomonas putida KT2440
cgccguucaccguugccgccac

SEQ ID NO: 1617608 - RNA, 14 nt, Pseudomonas putida KT2440
cgccguugccgccc

SEQ ID NO: 1617609 - RNA, 18 nt, Pseudomonas putida KT2440
cgccguugucgcccgccc

SEQ ID NO: 1617610 - RNA, 18 nt, Pseudomonas putida KT2440
cgccuaucagaucgagcg

SEQ ID NO: 1617611 - RNA, 14 nt, Pseudomonas putida KT2440
cgccguuucagcca

SEQ ID NO: 1617612 - RNA, 19 nt, Pseudomonas putida KT2440
cgccguuucagccacauug

SEQ ID NO: 1617613 - RNA, 19 nt, Pseudomonas putida KT2440
cgccuacagcggccugugc

SEQ ID NO: 1617614 - RNA, 22 nt, Pseudomonas putida KT2440
cgccuacagcggccugugcaug

SEQ ID NO: 1617615 - RNA, 23 nt, Pseudomonas putida KT2440
cgccuacaggaaucugucagccu

SEQ ID NO: 1617616 - RNA, 13 nt, Pseudomonas putida KT2440
cgccuacaggcaa

SEQ ID NO: 1617617 - RNA, 16 nt, Pseudomonas putida KT2440
cgccuacaggcaaccg

SEQ ID NO: 1617618 - RNA, 22 nt, Pseudomonas putida KT2440
cgccucgaugugcgugaacacu

SEQ ID NO: 1617619 - RNA, 15 nt, Pseudomonas putida KT2440
cgccucgaucccgcc

SEQ ID NO: 1617620 - RNA, 17 nt, Pseudomonas putida KT2440
cgccucgaucccgccgc

SEQ ID NO: 1617621 - RNA, 23 nt, Pseudomonas putida KT2440
cgccucgcccuugucagccgccg

SEQ ID NO: 1617622 - RNA, 20 nt, Pseudomonas putida KT2440
cgccucgcccaggccgccga

SEQ ID NO: 1617623 - RNA, 13 nt, Pseudomonas putida KT2440
cgccuccggcgcu

SEQ ID NO: 1617624 - RNA, 21 nt, Pseudomonas putida KT2440
cgccucgaacaccugcgcccc

SEQ ID NO: 1617625 - RNA, 15 nt, Pseudomonas putida KT2440
cgccuccugcugcug

SEQ ID NO: 1617626 - RNA, 18 nt, Pseudomonas putida KT2440
cgccuaugaaaccgagcg

SEQ ID NO: 1617627 - RNA, 17 nt, Pseudomonas putida KT2440
cgccucaccgacccaca

SEQ ID NO: 1617628 - RNA, 21 nt, Pseudomonas putida KT2440
cgccuccacggucagcaucca

SEQ ID NO: 1617629 - RNA, 17 nt, Pseudomonas putida KT2440
cgccuccagcaacaucu

SEQ ID NO: 1617630 - RNA, 17 nt, Pseudomonas putida KT2440
cgccucauccucgccca

SEQ ID NO: 1617631 - RNA, 19 nt, Pseudomonas putida KT2440
cgccucauccucgcccacc

SEQ ID NO: 1617632 - RNA, 18 nt, Pseudomonas putida KT2440
cgccucaugcagcaccuc

SEQ ID NO: 1617633 - RNA, 18 nt, Pseudomonas putida KT2440
cgccucccccacccccgc

SEQ ID NO: 1617634 - RNA, 22 nt, Pseudomonas putida KT2440
cgccucccccacccccgcccca

SEQ ID NO: 1617635 - RNA, 14 nt, Pseudomonas putida KT2440
cgcgccgcugccug

SEQ ID NO: 1617636 - RNA, 21 nt, Pseudomonas putida KT2440
cgcgccgccacauccagcgcc

SEQ ID NO: 1617637 - RNA, 19 nt, Pseudomonas putida KT2440
cgcgccaggucggcggggc

SEQ ID NO: 1617638 - RNA, 18 nt, Pseudomonas putida KT2440
cgcgccaguucgcggcgc

SEQ ID NO: 1617639 - RNA, 14 nt, Pseudomonas putida KT2440
cgcgccauccgcca

SEQ ID NO: 1617640 - RNA, 17 nt, Pseudomonas putida KT2440
cgcgccaugccccuacc

SEQ ID NO: 1617641 - RNA, 22 nt, Pseudomonas putida KT2440
cgcgcgacagcacgggcacacu

SEQ ID NO: 1617642 - RNA, 23 nt, Pseudomonas putida KT2440
cgcgccuggucgccgccacccac

SEQ ID NO: 1617643 - RNA, 13 nt, Pseudomonas putida KT2440
cgcgcgaaggccc

SEQ ID NO: 1617644 - RNA, 22 nt, Pseudomonas putida KT2440
cgcgaggcauccacacccugcg

SEQ ID NO: 1617645 - RNA, 21 nt, Pseudomonas putida KT2440
cgcgagggcaucagcgcaccc

SEQ ID NO: 1617646 - RNA, 15 nt, Pseudomonas putida KT2440
cgcgcaagccgcugu

SEQ ID NO: 1617647 - RNA, 18 nt, Pseudomonas putida KT2440
cgcgaguaaagccagcag

SEQ ID NO: 1617648 - RNA, 19 nt, Pseudomonas putida KT2440
cgcgcaccaucggcuccag

SEQ ID NO: 1617649 - RNA, 21 nt, Pseudomonas putida KT2440
cgcgcaccaucggcuccagcg

SEQ ID NO: 1617650 - RNA, 12 nt, Pseudomonas putida KT2440
cgcgccagcagc

SEQ ID NO: 1617651 - RNA, 17 nt, Pseudomonas putida KT2440
cgcgccagccugggcug

SEQ ID NO: 1617652 - RNA, 23 nt, Pseudomonas putida KT2440
cgcgccagcgcaugcaucugcgc

SEQ ID NO: 1617653 - RNA, 14 nt, Pseudomonas putida KT2440
cgcgccaccagccc

SEQ ID NO: 1617654 - RNA, 15 nt, Pseudomonas putida KT2440
cgcgccaccagcccc

SEQ ID NO: 1617655 - RNA, 17 nt, Pseudomonas putida KT2440
cgcgccacccgcugggc

SEQ ID NO: 1617656 - RNA, 14 nt, Pseudomonas putida KT2440
cgcgccacucccau

SEQ ID NO: 1617657 - RNA, 13 nt, Pseudomonas putida KT2440
cgcgccaccgccg

SEQ ID NO: 1617658 - RNA, 18 nt, Pseudomonas putida KT2440
cgcgccaccgccgugccg

SEQ ID NO: 1617659 - RNA, 22 nt, Pseudomonas putida KT2440
cgcgcaugaugaaguggcgcag

SEQ ID NO: 1617660 - RNA, 16 nt, Pseudomonas putida KT2440
cgcgcaucagccgcgc

SEQ ID NO: 1617661 - RNA, 19 nt, Pseudomonas putida KT2440
cgcgcaucagccgcgcccu

SEQ ID NO: 1617662 - RNA, 17 nt, Pseudomonas putida KT2440
cgcgcaucauccaccac

SEQ ID NO: 1617663 - RNA, 19 nt, Pseudomonas putida KT2440
cgcgcauccuccgcccugc

SEQ ID NO: 1617664 - RNA, 16 nt, Pseudomonas putida KT2440
cgcgcauccagccaga

SEQ ID NO: 1617665 - RNA, 17 nt, Pseudomonas putida KT2440
cgcgcauccagccagau

SEQ ID NO: 1617666 - RNA, 15 nt, Pseudomonas putida KT2440
cgcgcguugcggaac

SEQ ID NO: 1617667 - RNA, 21 nt, Pseudomonas putida KT2440
cgcgcgggugcgagaggcgcu

SEQ ID NO: 1617668 - RNA, 18 nt, Pseudomonas putida KT2440
cgcgcuggcgcuggucaa

SEQ ID NO: 1617669 - RNA, 14 nt, Pseudomonas putida KT2440
cgcgcuggccgccc

SEQ ID NO: 1617670 - RNA, 16 nt, Pseudomonas putida KT2440
cgcgcugacgcagggc

SEQ ID NO: 1617671 - RNA, 18 nt, Pseudomonas putida KT2440
cgcgcugaaguagcgcag

SEQ ID NO: 1617672 - RNA, 16 nt, Pseudomonas putida KT2440
cgcgggcaagcccgcu

SEQ ID NO: 1617673 - RNA, 17 nt, Pseudomonas putida KT2440
cgcggcucggccaccac

SEQ ID NO: 1617674 - RNA, 12 nt, Pseudomonas putida KT2440
cgcgggcacccu

SEQ ID NO: 1617675 - RNA, 13 nt, Pseudomonas putida KT2440
cgcgggcacgccc

SEQ ID NO: 1617676 - RNA, 16 nt, Pseudomonas putida KT2440
cgcgggcacgcccgcu

SEQ ID NO: 1617677 - RNA, 18 nt, Pseudomonas putida KT2440
cgcggcucacccaccagc

SEQ ID NO: 1617678 - RNA, 15 nt, Pseudomonas putida KT2440
cgcggcgucaccggc

SEQ ID NO: 1617679 - RNA, 14 nt, Pseudomonas putida KT2440
cgcggcgcagggug

SEQ ID NO: 1617680 - RNA, 16 nt, Pseudomonas putida KT2440
cgcggcgcaucgcgag

SEQ ID NO: 1617681 - RNA, 14 nt, Pseudomonas putida KT2440
cgcggcgcaccgcu

SEQ ID NO: 1617682 - RNA, 20 nt, Pseudomonas putida KT2440
cgcggccgccuccugcugcu

SEQ ID NO: 1617683 - RNA, 18 nt, Pseudomonas putida KT2440
cgcggccgaaguggcggc

SEQ ID NO: 1617684 - RNA, 23 nt, Pseudomonas putida KT2440
cgcggaucgugacggucugccgg

SEQ ID NO: 1617685 - RNA, 15 nt, Pseudomonas putida KT2440
cgcggaugugacgcu

SEQ ID NO: 1617686 - RNA, 18 nt, Pseudomonas putida KT2440
cgcggcccgaucagccag

SEQ ID NO: 1617687 - RNA, 13 nt, Pseudomonas putida KT2440
cgcggcccagccc

SEQ ID NO: 1617688 - RNA, 12 nt, Pseudomonas putida KT2440
cgcuugaagaag

SEQ ID NO: 1617689 - RNA, 16 nt, Pseudomonas putida KT2440
cgcuucggcgcgggca

SEQ ID NO: 1617690 - RNA, 22 nt, Pseudomonas putida KT2440
cgcuucggcgcgggcacccugg

SEQ ID NO: 1617691 - RNA, 14 nt, Pseudomonas putida KT2440
cgcuucggcaugca

SEQ ID NO: 1617692 - RNA, 19 nt, Pseudomonas putida KT2440
cgcuucggugugcuccagc

SEQ ID NO: 1617693 - RNA, 20 nt, Pseudomonas putida KT2440
cgcuucgaucagcgccugcu

SEQ ID NO: 1617694 - RNA, 19 nt, Pseudomonas putida KT2440
cgcuucgaucgccggcagc

SEQ ID NO: 1617695 - RNA, 17 nt, Pseudomonas putida KT2440
cgcuuccuuguccgcca

SEQ ID NO: 1617696 - RNA, 22 nt, Pseudomonas putida KT2440
cgcuucgaacacccgcuugccu

SEQ ID NO: 1617697 - RNA, 15 nt, Pseudomonas putida KT2440
cgcuucgcgcacuga

SEQ ID NO: 1617698 - RNA, 20 nt, Pseudomonas putida KT2440
cgcuuccaagugcuguauga

SEQ ID NO: 1617699 - RNA, 15 nt, Pseudomonas putida KT2440
cgcuucauaucacaa

SEQ ID NO: 1617700 - RNA, 14 nt, Pseudomonas putida KT2440
cgcuucauccagcg

SEQ ID NO: 1617701 - RNA, 21 nt, Pseudomonas putida KT2440
cgcuucagggucgggcacagg

SEQ ID NO: 1617702 - RNA, 22 nt, Pseudomonas putida KT2440
cgcuucagggucgggcacaggc

SEQ ID NO: 1617703 - RNA, 12 nt, Pseudomonas putida KT2440
cgcuguucugcc

SEQ ID NO: 1617704 - RNA, 12 nt, Pseudomonas putida KT2440
cgcuuacagaug

SEQ ID NO: 1617705 - RNA, 22 nt, Pseudomonas putida KT2440
cgcugggcuuacggucuccggu

SEQ ID NO: 1617706 - RNA, 20 nt, Pseudomonas putida KT2440
cgcuggggcugacgcgccgu

SEQ ID NO: 1617707 - RNA, 16 nt, Pseudomonas putida KT2440
cgcuggcgggcaaacu

SEQ ID NO: 1617708 - RNA, 16 nt, Pseudomonas putida KT2440
cgcuggcugccgcggg

SEQ ID NO: 1617709 - RNA, 13 nt, Pseudomonas putida KT2440
cgcuggcccuucg

SEQ ID NO: 1617710 - RNA, 16 nt, Pseudomonas putida KT2440
cgcuggcccuugccau

SEQ ID NO: 1617711 - RNA, 16 nt, Pseudomonas putida KT2440
cgcuggccgguggccc

SEQ ID NO: 1617712 - RNA, 13 nt, Pseudomonas putida KT2440
cgcuggccugccc

SEQ ID NO: 1617713 - RNA, 16 nt, Pseudomonas putida KT2440
cgcuggcgccagccgc

SEQ ID NO: 1617714 - RNA, 17 nt, Pseudomonas putida KT2440
cgcuggcgccagccgcc

SEQ ID NO: 1617715 - RNA, 13 nt, Pseudomonas putida KT2440
cgcuggcgacgaa

SEQ ID NO: 1617716 - RNA, 12 nt, Pseudomonas putida KT2440
cgcuggcgcgcu

SEQ ID NO: 1617717 - RNA, 23 nt, Pseudomonas putida KT2440
cgcugguucauugccaacagcag

SEQ ID NO: 1617718 - RNA, 15 nt, Pseudomonas putida KT2440
cgcugguacaggguc

SEQ ID NO: 1617719 - RNA, 17 nt, Pseudomonas putida KT2440
cgcuggucaaucuguga

SEQ ID NO: 1617720 - RNA, 17 nt, Pseudomonas putida KT2440
cgcugugcaacagcgcc

SEQ ID NO: 1617721 - RNA, 13 nt, Pseudomonas putida KT2440
cgcugugcucugg

SEQ ID NO: 1617722 - RNA, 20 nt, Pseudomonas putida KT2440
cgcuguacaccaggacuucc

SEQ ID NO: 1617723 - RNA, 21 nt, Pseudomonas putida KT2440
cgcuguacaccaggacuuccc

SEQ ID NO: 1617724 - RNA, 20 nt, Pseudomonas putida KT2440
cgcuguacagcacaccuucc

SEQ ID NO: 1617725 - RNA, 16 nt, Pseudomonas putida KT2440
cgcugccccaagugcc

SEQ ID NO: 1617726 - RNA, 14 nt, Pseudomonas putida KT2440
cgcugccaugcgcu

SEQ ID NO: 1617727 - RNA, 18 nt, Pseudomonas putida KT2440
cgcugccauagcgcugca

SEQ ID NO: 1617728 - RNA, 21 nt, Pseudomonas putida KT2440
cgcugccauagcgcugcaccg

SEQ ID NO: 1617729 - RNA, 24 nt, Pseudomonas putida KT2440
cgcugccauagcgcugcaccgaag

SEQ ID NO: 1617730 - RNA, 15 nt, Pseudomonas putida KT2440
cgcugccagcugcgc

SEQ ID NO: 1617731 - RNA, 21 nt, Pseudomonas putida KT2440
cgcugccagcugcgcugccug

SEQ ID NO: 1617732 - RNA, 13 nt, Pseudomonas putida KT2440
cgcugccacccac

SEQ ID NO: 1617733 - RNA, 16 nt, Pseudomonas putida KT2440
cgcugccacccacagg

SEQ ID NO: 1617734 - RNA, 21 nt, Pseudomonas putida KT2440
cgcugcaagcgcaccugcagg

SEQ ID NO: 1617735 - RNA, 20 nt, Pseudomonas putida KT2440
cgcugcacgucgcgcagggc

SEQ ID NO: 1617736 - RNA, 20 nt, Pseudomonas putida KT2440
cgcugcaccgaaggccgccg

SEQ ID NO: 1617737 - RNA, 18 nt, Pseudomonas putida KT2440
cgcugauucaacgcccca

SEQ ID NO: 1617738 - RNA, 14 nt, Pseudomonas putida KT2440
cgcugaucagcugg

SEQ ID NO: 1617739 - RNA, 15 nt, Pseudomonas putida KT2440
cgcugaucagcuggu

SEQ ID NO: 1617740 - RNA, 16 nt, Pseudomonas putida KT2440
cgcugauaaccugcau

SEQ ID NO: 1617741 - RNA, 21 nt, Pseudomonas putida KT2440
cgcugagaccgaggggccgcu

SEQ ID NO: 1617742 - RNA, 15 nt, Pseudomonas putida KT2440
cgcugaccgggacgc

SEQ ID NO: 1617743 - RNA, 21 nt, Pseudomonas putida KT2440
cgcugaccgaugaucugccgg

SEQ ID NO: 1617744 - RNA, 15 nt, Pseudomonas putida KT2440
cgcugcgucaggcca

SEQ ID NO: 1617745 - RNA, 20 nt, Pseudomonas putida KT2440
cgcugcggcgaaagccagca

SEQ ID NO: 1617746 - RNA, 19 nt, Pseudomonas putida KT2440
cgcugcucggccucgacca

SEQ ID NO: 1617747 - RNA, 22 nt, Pseudomonas putida KT2440
cgcugcuguccagacgccgcag

SEQ ID NO: 1617748 - RNA, 18 nt, Pseudomonas putida KT2440
cgcugcugugcggcuggc

SEQ ID NO: 1617749 - RNA, 19 nt, Pseudomonas putida KT2440
cgcuggaauuauuggccag

SEQ ID NO: 1617750 - RNA, 22 nt, Pseudomonas putida KT2440
cgcugcuuccggcugguacucc

SEQ ID NO: 1617751 - RNA, 20 nt, Pseudomonas putida KT2440
cgcuggaagugcugagaggg

SEQ ID NO: 1617752 - RNA, 17 nt, Pseudomonas putida KT2440
cgcuggcauccaccagg

SEQ ID NO: 1617753 - RNA, 14 nt, Pseudomonas putida KT2440
cgcuggccaccagc

SEQ ID NO: 1617754 - RNA, 15 nt, Pseudomonas putida KT2440
cgcuggcacaggcua

SEQ ID NO: 1617755 - RNA, 17 nt, Pseudomonas putida KT2440
cgcuggcagcuuggcca

SEQ ID NO: 1617756 - RNA, 19 nt, Pseudomonas putida KT2440
cgcugcgccgcucugcccg

SEQ ID NO: 1617757 - RNA, 16 nt, Pseudomonas putida KT2440
cgcugcgcuggccaau

SEQ ID NO: 1617758 - RNA, 15 nt, Pseudomonas putida KT2440
cgcugcggcacacca

SEQ ID NO: 1617759 - RNA, 20 nt, Pseudomonas putida KT2440
cgcugccuuuggccgccagc

SEQ ID NO: 1617760 - RNA, 22 nt, Pseudomonas putida KT2440
cgcugccuuuggccgccagcgg

SEQ ID NO: 1617761 - RNA, 14 nt, Pseudomonas putida KT2440
cgcugccugcgcuu

SEQ ID NO: 1617762 - RNA, 15 nt, Pseudomonas putida KT2440
cgcugccuuccgcca

SEQ ID NO: 1617763 - RNA, 13 nt, Pseudomonas putida KT2440
cgcugcgcccgcc

SEQ ID NO: 1617764 - RNA, 15 nt, Pseudomonas putida KT2440
cgcugcgcccgccuu

SEQ ID NO: 1617765 - RNA, 18 nt, Pseudomonas putida KT2440
cgcugccgugcaggucag

SEQ ID NO: 1617766 - RNA, 16 nt, Pseudomonas putida KT2440
cgcugccgcaccugcc

SEQ ID NO: 1617767 - RNA, 17 nt, Pseudomonas putida KT2440
cgcugcccguccggcau

SEQ ID NO: 1617768 - RNA, 16 nt, Pseudomonas putida KT2440
cgcugcccucggccgg

SEQ ID NO: 1617769 - RNA, 20 nt, Pseudomonas putida KT2440
cgcugcccucggccggggcc

SEQ ID NO: 1617770 - RNA, 17 nt, Pseudomonas putida KT2440
cgcgugccgccaguucg

SEQ ID NO: 1617771 - RNA, 18 nt, Pseudomonas putida KT2440
cgcgugccgccaguucgc

SEQ ID NO: 1617772 - RNA, 19 nt, Pseudomonas putida KT2440
cgcgugcugguccuccccu

SEQ ID NO: 1617773 - RNA, 21 nt, Pseudomonas putida KT2440
cgcgugcuugugcucccacag

SEQ ID NO: 1617774 - RNA, 21 nt, Pseudomonas putida KT2440
cgcguugauuuagcaggcacc

SEQ ID NO: 1617775 - RNA, 13 nt, Pseudomonas putida KT2440
cgcuaccugguuc

SEQ ID NO: 1617776 - RNA, 19 nt, Pseudomonas putida KT2440
cgcuaccugugggagcggg

SEQ ID NO: 1617777 - RNA, 13 nt, Pseudomonas putida KT2440
cgcguccccuuca

SEQ ID NO: 1617778 - RNA, 16 nt, Pseudomonas putida KT2440
cgcgggccuucugcug

SEQ ID NO: 1617779 - RNA, 13 nt, Pseudomonas putida KT2440
cgcgggccagccc

SEQ ID NO: 1617780 - RNA, 23 nt, Pseudomonas putida KT2440
cgcgucagcaccggcaguagaaa

SEQ ID NO: 1617781 - RNA, 18 nt, Pseudomonas putida KT2440
cgcuacgagagaucgcag

SEQ ID NO: 1617782 - RNA, 15 nt, Pseudomonas putida KT2440
cgcuacugccgucgu

SEQ ID NO: 1617783 - RNA, 13 nt, Pseudomonas putida KT2440
cgcuagaaacaga

SEQ ID NO: 1617784 - RNA, 13 nt, Pseudomonas putida KT2440
cgcuaggcggccc

SEQ ID NO: 1617785 - RNA, 15 nt, Pseudomonas putida KT2440
cgcucaggcucuuga

SEQ ID NO: 1617786 - RNA, 17 nt, Pseudomonas putida KT2440
cgcucaauggcaccguc

SEQ ID NO: 1617787 - RNA, 15 nt, Pseudomonas putida KT2440
cgcucaccccgcccc

SEQ ID NO: 1617788 - RNA, 17 nt, Pseudomonas putida KT2440
cgcuccagcucggcugg

SEQ ID NO: 1617789 - RNA, 13 nt, Pseudomonas putida KT2440
cgcuccaguggug

SEQ ID NO: 1617790 - RNA, 11 nt, Pseudomonas putida KT2440
cgcuccaugua

SEQ ID NO: 1617791 - RNA, 18 nt, Pseudomonas putida KT2440
cgcuccagggcaggcuga

SEQ ID NO: 1617792 - RNA, 22 nt, Pseudomonas putida KT2440
cgcuccagacgcuguacgucca

SEQ ID NO: 1617793 - RNA, 17 nt, Pseudomonas putida KT2440
cgcuccaggcggccagc

SEQ ID NO: 1617794 - RNA, 21 nt, Pseudomonas putida KT2440
cgcucaugcugguuuggcagc

SEQ ID NO: 1617795 - RNA, 23 nt, Pseudomonas putida KT2440
cgcucauggaaauaacgcgggca

SEQ ID NO: 1617796 - RNA, 16 nt, Pseudomonas putida KT2440
cgcucauguccagguc

SEQ ID NO: 1617797 - RNA, 21 nt, Pseudomonas putida KT2440
cgcucaugcaacaacccgccc

SEQ ID NO: 1617798 - RNA, 16 nt, Pseudomonas putida KT2440
cgcucaugccccgcac

SEQ ID NO: 1617799 - RNA, 17 nt, Pseudomonas putida KT2440
cgcucaugccccgcacc

SEQ ID NO: 1617800 - RNA, 19 nt, Pseudomonas putida KT2440
cgcucauccagcguggccu

SEQ ID NO: 1617801 - RNA, 14 nt, Pseudomonas putida KT2440
cgcucagguagcgc

SEQ ID NO: 1617802 - RNA, 17 nt, Pseudomonas putida KT2440
cgcucagguaggcagca

SEQ ID NO: 1617803 - RNA, 15 nt, Pseudomonas putida KT2440
cgcucaggugcaccu

SEQ ID NO: 1617804 - RNA, 23 nt, Pseudomonas putida KT2440
cgcucaggugcaccuccgcccgg

SEQ ID NO: 1617805 - RNA, 12 nt, Pseudomonas putida KT2440
cgcucgccacac

SEQ ID NO: 1617806 - RNA, 19 nt, Pseudomonas putida KT2440
cgcucgacgcgcgcagccu

SEQ ID NO: 1617807 - RNA, 17 nt, Pseudomonas putida KT2440
cgcucgagaaacgccag

SEQ ID NO: 1617808 - RNA, 18 nt, Pseudomonas putida KT2440
cgcucgagaaacgccagc

SEQ ID NO: 1617809 - RNA, 19 nt, Pseudomonas putida KT2440
cgcucgacagcaacuucuc

SEQ ID NO: 1617810 - RNA, 17 nt, Pseudomonas putida KT2440
cgcucgaacaacgccuc

SEQ ID NO: 1617811 - RNA, 14 nt, Pseudomonas putida KT2440
cgcuccgccaaacc

SEQ ID NO: 1617812 - RNA, 19 nt, Pseudomonas putida KT2440
cgcuccgccaaaccccagc

SEQ ID NO: 1617813 - RNA, 23 nt, Pseudomonas putida KT2440
cgcuccgccaaaccccagcaagg

SEQ ID NO: 1617814 - RNA, 21 nt, Pseudomonas putida KT2440
cgcuccgccaauugcgccagc

SEQ ID NO: 1617815 - RNA, 13 nt, Pseudomonas putida KT2440
cgcucccaggccu

SEQ ID NO: 1617816 - RNA, 16 nt, Pseudomonas putida KT2440
cgcucccacaaaggcc

SEQ ID NO: 1617817 - RNA, 16 nt, Pseudomonas putida KT2440
cgcucccacaggaaug

SEQ ID NO: 1617818 - RNA, 24 nt, Pseudomonas putida KT2440
cgcucccacagggaucgcgccagc

SEQ ID NO: 1617819 - RNA, 14 nt, Pseudomonas putida KT2440
cgcuccucggccgu

SEQ ID NO: 1617820 - RNA, 22 nt, Pseudomonas putida KT2440
cgcuccuacaggggacgcauau

SEQ ID NO: 1617821 - RNA, 15 nt, Pseudomonas putida KT2440
cgcuccuacgaaagc

SEQ ID NO: 1617822 - RNA, 23 nt, Pseudomonas putida KT2440
cgcuccuacgcucuaucccccuu

SEQ ID NO: 1617823 - RNA, 23 nt, Pseudomonas putida KT2440
cgcuccuacggggguucacagcc

SEQ ID NO: 1617824 - RNA, 14 nt, Pseudomonas putida KT2440
cgcugaaacaucag

SEQ ID NO: 1617825 - RNA, 13 nt, Pseudomonas putida KT2440
cgcugaacacgcc

SEQ ID NO: 1617826 - RNA, 20 nt, Pseudomonas putida KT2440
cgcugaccaacaggcuggca

SEQ ID NO: 1617827 - RNA, 21 nt, Pseudomonas putida KT2440
cgcugaccaacaggcuggcau

SEQ ID NO: 1617828 - RNA, 21 nt, Pseudomonas putida KT2440
cgcucuaucccccuuuggccu

SEQ ID NO: 1617829 - RNA, 21 nt, Pseudomonas putida KT2440
cgcucucgcuuuugcuugcag

SEQ ID NO: 1617830 - RNA, 13 nt, Pseudomonas putida KT2440
cgcucugcgccug

SEQ ID NO: 1617831 - RNA, 14 nt, Pseudomonas putida KT2440
cgcucugcccgcgc

SEQ ID NO: 1617832 - RNA, 15 nt, Pseudomonas putida KT2440
cgcucgguugaugca

SEQ ID NO: 1617833 - RNA, 21 nt, Pseudomonas putida KT2440
cgcucgguugaugcagcgccc

SEQ ID NO: 1617834 - RNA, 13 nt, Pseudomonas putida KT2440
cgcucguugucca

SEQ ID NO: 1617835 - RNA, 15 nt, Pseudomonas putida KT2440
cgcucgcgccgccgc

SEQ ID NO: 1617836 - RNA, 12 nt, Pseudomonas putida KT2440
cgaugcccaggc

SEQ ID NO: 1617837 - RNA, 18 nt, Pseudomonas putida KT2440
cgaugcccauggcgcagc

SEQ ID NO: 1617838 - RNA, 17 nt, Pseudomonas putida KT2440
cgauggccaggaacagc

SEQ ID NO: 1617839 - RNA, 14 nt, Pseudomonas putida KT2440
cgauggccaccagc

SEQ ID NO: 1617840 - RNA, 15 nt, Pseudomonas putida KT2440
cgauggccaccagca

SEQ ID NO: 1617841 - RNA, 16 nt, Pseudomonas putida KT2440
cgauggccaccagcac

SEQ ID NO: 1617842 - RNA, 19 nt, Pseudomonas putida KT2440
cgauggacagcccaaggcc

SEQ ID NO: 1617843 - RNA, 17 nt, Pseudomonas putida KT2440
cgauguacuuguucagg

SEQ ID NO: 1617844 - RNA, 23 nt, Pseudomonas putida KT2440
cgauguacuuguucaggaucucg

SEQ ID NO: 1617845 - RNA, 16 nt, Pseudomonas putida KT2440
cgauuccuugcagcgc

SEQ ID NO: 1617846 - RNA, 15 nt, Pseudomonas putida KT2440
cgauucgccgggccu

SEQ ID NO: 1617847 - RNA, 18 nt, Pseudomonas putida KT2440
cgauuccagcaggggacg

SEQ ID NO: 1617848 - RNA, 21 nt, Pseudomonas putida KT2440
cgauucaaagccauaccgcau

SEQ ID NO: 1617849 - RNA, 16 nt, Pseudomonas putida KT2440
cgauguuggucaccac

SEQ ID NO: 1617850 - RNA, 15 nt, Pseudomonas putida KT2440
cgauuagacccagau

SEQ ID NO: 1617851 - RNA, 20 nt, Pseudomonas putida KT2440
cgaucucgccagccugcagc

SEQ ID NO: 1617852 - RNA, 17 nt, Pseudomonas putida KT2440
cgaucucggccagcagg

SEQ ID NO: 1617853 - RNA, 18 nt, Pseudomonas putida KT2440
cgaucucgauccggccgu

SEQ ID NO: 1617854 - RNA, 16 nt, Pseudomonas putida KT2440
cgaucuccugcaggga

SEQ ID NO: 1617855 - RNA, 19 nt, Pseudomonas putida KT2440
cgaucggguacuccaccac

SEQ ID NO: 1617856 - RNA, 21 nt, Pseudomonas putida KT2440
cgaucggguacuccaccacca

SEQ ID NO: 1617857 - RNA, 15 nt, Pseudomonas putida KT2440
cgaucuucgcccugg

SEQ ID NO: 1617858 - RNA, 12 nt, Pseudomonas putida KT2440
cgaucuuggcca

SEQ ID NO: 1617859 - RNA, 17 nt, Pseudomonas putida KT2440
cgaugagcgagcccgcg

SEQ ID NO: 1617860 - RNA, 21 nt, Pseudomonas putida KT2440
cgaugcacgccagcaucaccc

SEQ ID NO: 1617861 - RNA, 13 nt, Pseudomonas putida KT2440
cgaugcagggcug

SEQ ID NO: 1617862 - RNA, 23 nt, Pseudomonas putida KT2440
cgauccacucgucgaucuggaug

SEQ ID NO: 1617863 - RNA, 18 nt, Pseudomonas putida KT2440
cgaucagguuugccgcgc

SEQ ID NO: 1617864 - RNA, 15 nt, Pseudomonas putida KT2440
cgaucaguaaucugc

SEQ ID NO: 1617865 - RNA, 22 nt, Pseudomonas putida KT2440
cgaucaggucgacacccagcac

SEQ ID NO: 1617866 - RNA, 13 nt, Pseudomonas putida KT2440
cgaucaggcaggc

SEQ ID NO: 1617867 - RNA, 21 nt, Pseudomonas putida KT2440
cgaucaggaagccccgcgcgu

SEQ ID NO: 1617868 - RNA, 12 nt, Pseudomonas putida KT2440
cgaucagccaga

SEQ ID NO: 1617869 - RNA, 13 nt, Pseudomonas putida KT2440
cgaucagcgccug

SEQ ID NO: 1617870 - RNA, 18 nt, Pseudomonas putida KT2440
cgauccauuuguaggagc

SEQ ID NO: 1617871 - RNA, 15 nt, Pseudomonas putida KT2440
cgauccccugcaaua

SEQ ID NO: 1617872 - RNA, 15 nt, Pseudomonas putida KT2440
cgaucccuggggcca

SEQ ID NO: 1617873 - RNA, 17 nt, Pseudomonas putida KT2440
cgauccgguggccuugc

SEQ ID NO: 1617874 - RNA, 16 nt, Pseudomonas putida KT2440
cgaucgccagccccag

SEQ ID NO: 1617875 - RNA, 17 nt, Pseudomonas putida KT2440
cgaucgccagccccagc

SEQ ID NO: 1617876 - RNA, 15 nt, Pseudomonas putida KT2440
cgaucgaagcagcag

SEQ ID NO: 1617877 - RNA, 21 nt, Pseudomonas putida KT2440
cgaucgaaaaaccgcucccgc

SEQ ID NO: 1617878 - RNA, 21 nt, Pseudomonas putida KT2440
cgaucgaaaggcgacuccuga

SEQ ID NO: 1617879 - RNA, 19 nt, Pseudomonas putida KT2440
cgaucgacaaccccagccc

SEQ ID NO: 1617880 - RNA, 18 nt, Pseudomonas putida KT2440
cgauaccuggguccaggc

SEQ ID NO: 1617881 - RNA, 15 nt, Pseudomonas putida KT2440
cgauaccgcccaggu

SEQ ID NO: 1617882 - RNA, 14 nt, Pseudomonas putida KT2440
cgaucagacgcucc

SEQ ID NO: 1617883 - RNA, 15 nt, Pseudomonas putida KT2440
cgaucacuuccaggc

SEQ ID NO: 1617884 - RNA, 17 nt, Pseudomonas putida KT2440
cgaucacuuccaggccc

SEQ ID NO: 1617885 - RNA, 16 nt, Pseudomonas putida KT2440
cgaucacuuccuggcc

SEQ ID NO: 1617886 - RNA, 22 nt, Pseudomonas putida KT2440
cgaucaccgacgugugcccacu

SEQ ID NO: 1617887 - RNA, 14 nt, Pseudomonas putida KT2440
cgaucaccgcgaau

SEQ ID NO: 1617888 - RNA, 13 nt, Pseudomonas putida KT2440
cgaucaccagccc

SEQ ID NO: 1617889 - RNA, 22 nt, Pseudomonas putida KT2440
cgaucacaugcggcaccgccag

SEQ ID NO: 1617890 - RNA, 20 nt, Pseudomonas putida KT2440
cgauagggaacagggcagac

SEQ ID NO: 1617891 - RNA, 16 nt, Pseudomonas putida KT2440
cgauagggcgguggca

SEQ ID NO: 1617892 - RNA, 15 nt, Pseudomonas putida KT2440
cgauacuccggcaac

SEQ ID NO: 1617893 - RNA, 13 nt, Pseudomonas putida KT2440
cgcagcuuguuga

SEQ ID NO: 1617894 - RNA, 14 nt, Pseudomonas putida KT2440
cgcaggguagcccc

SEQ ID NO: 1617895 - RNA, 15 nt, Pseudomonas putida KT2440
cgcaggguagccccg

SEQ ID NO: 1617896 - RNA, 22 nt, Pseudomonas putida KT2440
cgcagguacgccaugugcgccc

SEQ ID NO: 1617897 - RNA, 18 nt, Pseudomonas putida KT2440
cgcagggucgcgccccaa

SEQ ID NO: 1617898 - RNA, 20 nt, Pseudomonas putida KT2440
cgcagggucgcgccccaagc

SEQ ID NO: 1617899 - RNA, 13 nt, Pseudomonas putida KT2440
cgcaggucggggc

SEQ ID NO: 1617900 - RNA, 22 nt, Pseudomonas putida KT2440
cgcaggucgugcuugacccccu

SEQ ID NO: 1617901 - RNA, 18 nt, Pseudomonas putida KT2440
cgcaggucuugcccacuu

SEQ ID NO: 1617902 - RNA, 18 nt, Pseudomonas putida KT2440
cgcaggugcagccagccc

SEQ ID NO: 1617903 - RNA, 19 nt, Pseudomonas putida KT2440
cgcaggugcaggcucggcc

SEQ ID NO: 1617904 - RNA, 21 nt, Pseudomonas putida KT2440
aaacggugcagaccuguggga

SEQ ID NO: 1617905 - RNA, 16 nt, Pseudomonas putida KT2440
cgcagucagccacauc

SEQ ID NO: 1617906 - RNA, 13 nt, Pseudomonas putida KT2440
cgcagucaccaca

SEQ ID NO: 1617907 - RNA, 22 nt, Pseudomonas putida KT2440
cgcagucccguuggcccgccag

SEQ ID NO: 1617908 - RNA, 17 nt, Pseudomonas putida KT2440
cgcagguuguucggcag

SEQ ID NO: 1617909 - RNA, 21 nt, Pseudomonas putida KT2440
cgcagguuguucggcaggcuc

SEQ ID NO: 1617910 - RNA, 22 nt, Pseudomonas putida KT2440
cgcagugccgugaguggccucg

SEQ ID NO: 1617911 - RNA, 12 nt, Pseudomonas putida KT2440
cgcagcagcucg

SEQ ID NO: 1617912 - RNA, 18 nt, Pseudomonas putida KT2440
cgcagcagcuugaccccu

SEQ ID NO: 1617913 - RNA, 23 nt, Pseudomonas putida KT2440
cgcagcagcaggcccgccaccgc

SEQ ID NO: 1617914 - RNA, 19 nt, Pseudomonas putida KT2440
cgcagcacgccguugcggu

SEQ ID NO: 1617915 - RNA, 13 nt, Pseudomonas putida KT2440
cgcagccaaucgg

SEQ ID NO: 1617916 - RNA, 18 nt, Pseudomonas putida KT2440
cgcagcagguccagcucc

SEQ ID NO: 1617917 - RNA, 22 nt, Pseudomonas putida KT2440
cgcagccaggauuuucagcgcg

SEQ ID NO: 1617918 - RNA, 18 nt, Pseudomonas putida KT2440
cgcagcccacggccgcca

SEQ ID NO: 1617919 - RNA, 19 nt, Pseudomonas putida KT2440
cgcagcccacggccgccaa

SEQ ID NO: 1617920 - RNA, 14 nt, Pseudomonas putida KT2440
cgcagcgccgccaa

SEQ ID NO: 1617921 - RNA, 13 nt, Pseudomonas putida KT2440
cgcagcgcgugcu

SEQ ID NO: 1617922 - RNA, 11 nt, Pseudomonas putida KT2440
cgcagccccgc

SEQ ID NO: 1617923 - RNA, 17 nt, Pseudomonas putida KT2440
cgcaagccgugccuggg

SEQ ID NO: 1617924 - RNA, 11 nt, Pseudomonas putida KT2440
cgcaagcccgc

SEQ ID NO: 1617925 - RNA, 14 nt, Pseudomonas putida KT2440
cgcaaggccgcggc

SEQ ID NO: 1617926 - RNA, 20 nt, Pseudomonas putida KT2440
cgcaaggcaaagaagucgcc

SEQ ID NO: 1617927 - RNA, 13 nt, Pseudomonas putida KT2440
cgcaaggcauuca

SEQ ID NO: 1617928 - RNA, 23 nt, Pseudomonas putida KT2440
cgcaagcguucgagcaucggcuc

SEQ ID NO: 1617929 - RNA, 12 nt, Pseudomonas putida KT2440
cgcaagcggcuc

SEQ ID NO: 1617930 - RNA, 14 nt, Pseudomonas putida KT2440
cgauuuccagugcc

SEQ ID NO: 1617931 - RNA, 17 nt, Pseudomonas putida KT2440
cgauuucaccggcuucu

SEQ ID NO: 1617932 - RNA, 18 nt, Pseudomonas putida KT2440
cgcaagcagucccagcac

SEQ ID NO: 1617933 - RNA, 20 nt, Pseudomonas putida KT2440
cgcaaggugccaacaggcag

SEQ ID NO: 1617934 - RNA, 19 nt, Pseudomonas putida KT2440
cgcaaguagaaccacacag

SEQ ID NO: 1617935 - RNA, 19 nt, Pseudomonas putida KT2440
cgcaaucaaagcagacagc

SEQ ID NO: 1617936 - RNA, 14 nt, Pseudomonas putida KT2440
cgcaccaucggcuc

SEQ ID NO: 1617937 - RNA, 21 nt, Pseudomonas putida KT2440
cgcaccagguccaccagcagg

SEQ ID NO: 1617938 - RNA, 15 nt, Pseudomonas putida KT2440
cgcacccagcaggcc

SEQ ID NO: 1617939 - RNA, 16 nt, Pseudomonas putida KT2440
cgcacccgccuccggc

SEQ ID NO: 1617940 - RNA, 14 nt, Pseudomonas putida KT2440
cgcaccccuugcca

SEQ ID NO: 1617941 - RNA, 13 nt, Pseudomonas putida KT2440
cgcacccggcugg

SEQ ID NO: 1617942 - RNA, 17 nt, Pseudomonas putida KT2440
cgcacccggcuggucga

SEQ ID NO: 1617943 - RNA, 19 nt, Pseudomonas putida KT2440
cgcaaugcccagcgcgccg

SEQ ID NO: 1617944 - RNA, 16 nt, Pseudomonas putida KT2440
cgcaauccccuccgcc

SEQ ID NO: 1617945 - RNA, 13 nt, Pseudomonas putida KT2440
cgcaaucuugcca

SEQ ID NO: 1617946 - RNA, 22 nt, Pseudomonas putida KT2440
cgcaccggaguccccaccggca

SEQ ID NO: 1617947 - RNA, 13 nt, Pseudomonas putida KT2440
cgcaccgcugacc

SEQ ID NO: 1617948 - RNA, 21 nt, Pseudomonas putida KT2440
cgcaccgcggaugcgccuggc

SEQ ID NO: 1617949 - RNA, 17 nt, Pseudomonas putida KT2440
cgcacggcuucgcgcau

SEQ ID NO: 1617950 - RNA, 17 nt, Pseudomonas putida KT2440
cgcacggcaucggccga

SEQ ID NO: 1617951 - RNA, 19 nt, Pseudomonas putida KT2440
cgcaccgugcaccagcacc

SEQ ID NO: 1617952 - RNA, 19 nt, Pseudomonas putida KT2440
cgcacuuacuaucacgccu

SEQ ID NO: 1617953 - RNA, 18 nt, Pseudomonas putida KT2440
cgcagacaaaacgcugcg

SEQ ID NO: 1617954 - RNA, 17 nt, Pseudomonas putida KT2440
cgcacuggucaaccccu

SEQ ID NO: 1617955 - RNA, 16 nt, Pseudomonas putida KT2440
cgcacugcugccgccc

SEQ ID NO: 1617956 - RNA, 14 nt, Pseudomonas putida KT2440
cgcacucugcugcu

SEQ ID NO: 1617957 - RNA, 17 nt, Pseudomonas putida KT2440
cgcacucugcugcucug

SEQ ID NO: 1617958 - RNA, 18 nt, Pseudomonas putida KT2440
cgcacugaacagcgccuu

SEQ ID NO: 1617959 - RNA, 13 nt, Pseudomonas putida KT2440
cgcagagcgccca

SEQ ID NO: 1617960 - RNA, 16 nt, Pseudomonas putida KT2440
cgcagagcgcccacca

SEQ ID NO: 1617961 - RNA, 14 nt, Pseudomonas putida KT2440
cgcagagcgccccg

SEQ ID NO: 1617962 - RNA, 14 nt, Pseudomonas putida KT2440
cgcagagcaugguc

SEQ ID NO: 1617963 - RNA, 14 nt, Pseudomonas putida KT2440
cgcagagggccgcg

SEQ ID NO: 1617964 - RNA, 13 nt, Pseudomonas putida KT2440
cgccagaccaccu

SEQ ID NO: 1617965 - RNA, 16 nt, Pseudomonas putida KT2440
cgccagaaccugacaa

SEQ ID NO: 1617966 - RNA, 17 nt, Pseudomonas putida KT2440
cgccagaagcguaccgc

SEQ ID NO: 1617967 - RNA, 19 nt, Pseudomonas putida KT2440
cgccagauccgcagggucu

SEQ ID NO: 1617968 - RNA, 20 nt, Pseudomonas putida KT2440
cgccagcaagcgcauaggca

SEQ ID NO: 1617969 - RNA, 19 nt, Pseudomonas putida KT2440
cgccagcaggccaccggca

SEQ ID NO: 1617970 - RNA, 13 nt, Pseudomonas putida KT2440
cgccagcaggccg

SEQ ID NO: 1617971 - RNA, 16 nt, Pseudomonas putida KT2440
cgccagcaucacccuc

SEQ ID NO: 1617972 - RNA, 14 nt, Pseudomonas putida KT2440
cgccagcagcgcau

SEQ ID NO: 1617973 - RNA, 19 nt, Pseudomonas putida KT2440
cgccagcagcgcauggcuc

SEQ ID NO: 1617974 - RNA, 14 nt, Pseudomonas putida KT2440
cgccagcagcgcuc

SEQ ID NO: 1617975 - RNA, 15 nt, Pseudomonas putida KT2440
cgccagcagcugguc

SEQ ID NO: 1617976 - RNA, 18 nt, Pseudomonas putida KT2440
cgccagcaccaucaggca

SEQ ID NO: 1617977 - RNA, 15 nt, Pseudomonas putida KT2440
cgccagcacgcaggc

SEQ ID NO: 1617978 - RNA, 19 nt, Pseudomonas putida KT2440
cgccagcacgcaggccagc

SEQ ID NO: 1617979 - RNA, 19 nt, Pseudomonas putida KT2440
cgccagccaaccgcgugcu

SEQ ID NO: 1617980 - RNA, 14 nt, Pseudomonas putida KT2440
cgccagcaugcugg

SEQ ID NO: 1617981 - RNA, 12 nt, Pseudomonas putida KT2440
cgccagccccgc

SEQ ID NO: 1617982 - RNA, 12 nt, Pseudomonas putida KT2440
cgccagcccgcc

SEQ ID NO: 1617983 - RNA, 14 nt, Pseudomonas putida KT2440
cgccagcccgccac

SEQ ID NO: 1617984 - RNA, 17 nt, Pseudomonas putida KT2440
cgccacgcaccagggcu

SEQ ID NO: 1617985 - RNA, 19 nt, Pseudomonas putida KT2440
cgccacccaccacggccug

SEQ ID NO: 1617986 - RNA, 21 nt, Pseudomonas putida KT2440
cgccacccagaugcgggcccu

SEQ ID NO: 1617987 - RNA, 13 nt, Pseudomonas putida KT2440
cgccaccaugcuc

SEQ ID NO: 1617988 - RNA, 20 nt, Pseudomonas putida KT2440
cgccaccaugcucggccagc

SEQ ID NO: 1617989 - RNA, 23 nt, Pseudomonas putida KT2440
cgccaccugccacacacccgggc

SEQ ID NO: 1617990 - RNA, 11 nt, Pseudomonas putida KT2440
cgccaccuucg

SEQ ID NO: 1617991 - RNA, 15 nt, Pseudomonas putida KT2440
cgccaccuucgccag

SEQ ID NO: 1617992 - RNA, 13 nt, Pseudomonas putida KT2440
cgccacgggcggu

SEQ ID NO: 1617993 - RNA, 20 nt, Pseudomonas putida KT2440
cgccacgguacgggcaaagc

SEQ ID NO: 1617994 - RNA, 22 nt, Pseudomonas putida KT2440
cgccacgggcgugaccguagcg

SEQ ID NO: 1617995 - RNA, 23 nt, Pseudomonas putida KT2440
cgccacucccauguagaccacca

SEQ ID NO: 1617996 - RNA, 17 nt, Pseudomonas putida KT2440
cgccacugaccagcccg

SEQ ID NO: 1617997 - RNA, 14 nt, Pseudomonas putida KT2440
cgcauccuccgccc

SEQ ID NO: 1617998 - RNA, 18 nt, Pseudomonas putida KT2440
cgcauccucggugcgcgg

SEQ ID NO: 1617999 - RNA, 16 nt, Pseudomonas putida KT2440
cgccaccaucggccag

SEQ ID NO: 1618000 - RNA, 14 nt, Pseudomonas putida KT2440
cgccaccagcgccg

SEQ ID NO: 1618001 - RNA, 15 nt, Pseudomonas putida KT2440
cgccaccagcgccgc

SEQ ID NO: 1618002 - RNA, 14 nt, Pseudomonas putida KT2440
cgcauacagcuugc

SEQ ID NO: 1618003 - RNA, 13 nt, Pseudomonas putida KT2440
cgcauccagcacu

SEQ ID NO: 1618004 - RNA, 15 nt, Pseudomonas putida KT2440
cgccaggaguucugc

SEQ ID NO: 1618005 - RNA, 19 nt, Pseudomonas putida KT2440
cgccaggcacccagccagc

SEQ ID NO: 1618006 - RNA, 20 nt, Pseudomonas putida KT2440
cgccaggccuuucagcgccc

SEQ ID NO: 1618007 - RNA, 21 nt, Pseudomonas putida KT2440
cgccaggccuuucagcgccca

SEQ ID NO: 1618008 - RNA, 16 nt, Pseudomonas putida KT2440
cgccaggcauuccccg

SEQ ID NO: 1618009 - RNA, 16 nt, Pseudomonas putida KT2440
cgccaggcccagcccc

SEQ ID NO: 1618010 - RNA, 20 nt, Pseudomonas putida KT2440
cgccaggcccagccccgcau

SEQ ID NO: 1618011 - RNA, 17 nt, Pseudomonas putida KT2440
cgccaggaucaccucgg

SEQ ID NO: 1618012 - RNA, 16 nt, Pseudomonas putida KT2440
cgccagcgguugagau

SEQ ID NO: 1618013 - RNA, 18 nt, Pseudomonas putida KT2440
cgccagcgugcccgccac

SEQ ID NO: 1618014 - RNA, 20 nt, Pseudomonas putida KT2440
cgccagcuccgacaggcugu

SEQ ID NO: 1618015 - RNA, 13 nt, Pseudomonas putida KT2440
cgccagcuccaca

SEQ ID NO: 1618016 - RNA, 15 nt, Pseudomonas putida KT2440
cgccagcgcuccagc

SEQ ID NO: 1618017 - RNA, 16 nt, Pseudomonas putida KT2440
cgccagcggcucgacc

SEQ ID NO: 1618018 - RNA, 23 nt, Pseudomonas putida KT2440
cgccagcggguggucgcugcggc

SEQ ID NO: 1618019 - RNA, 12 nt, Pseudomonas putida KT2440
cgccaggcuuca

SEQ ID NO: 1618020 - RNA, 15 nt, Pseudomonas putida KT2440
cgccaggcgcaagcc

SEQ ID NO: 1618021 - RNA, 19 nt, Pseudomonas putida KT2440
cgccaggcgcaccgccggg

SEQ ID NO: 1618022 - RNA, 15 nt, Pseudomonas putida KT2440
cgccaggcccaccac

SEQ ID NO: 1618023 - RNA, 16 nt, Pseudomonas putida KT2440
cgccaggguguccugu

SEQ ID NO: 1618024 - RNA, 21 nt, Pseudomonas putida KT2440
cgccaggguugcaucgcgcac

SEQ ID NO: 1618025 - RNA, 20 nt, Pseudomonas putida KT2440
cgccaggguuugcaagcggc

SEQ ID NO: 1618026 - RNA, 21 nt, Pseudomonas putida KT2440
cgccaggguuugcaagcggcg

SEQ ID NO: 1618027 - RNA, 19 nt, Pseudomonas putida KT2440
cgccagguggaagcgcgca

SEQ ID NO: 1618028 - RNA, 20 nt, Pseudomonas putida KT2440
cgccagguggaagcgcgcau

SEQ ID NO: 1618029 - RNA, 10 nt, Pseudomonas putida KT2440
cgccagguga

SEQ ID NO: 1618030 - RNA, 22 nt, Pseudomonas putida KT2440
cgccagguccaggcugcgcgcc

SEQ ID NO: 1618031 - RNA, 19 nt, Pseudomonas putida KT2440
cgccaggugcucagccacg

SEQ ID NO: 1618032 - RNA, 20 nt, Pseudomonas putida KT2440
cgccaggugcucagccacgc

SEQ ID NO: 1618033 - RNA, 21 nt, Pseudomonas putida KT2440
cgccaggugcucagccacgcu

SEQ ID NO: 1618034 - RNA, 24 nt, Pseudomonas putida KT2440
cgccaggugcucagccacgcuggc

SEQ ID NO: 1618035 - RNA, 14 nt, Pseudomonas putida KT2440
cgccagguccaggc

SEQ ID NO: 1618036 - RNA, 21 nt, Pseudomonas putida KT2440
cgccaguagcaaucaggucau

SEQ ID NO: 1618037 - RNA, 18 nt, Pseudomonas putida KT2440
cgccaguacgccagcagc

SEQ ID NO: 1618038 - RNA, 21 nt, Pseudomonas putida KT2440
cgccaguuguaguucccgcgc

SEQ ID NO: 1618039 - RNA, 23 nt, Pseudomonas putida KT2440
cgccaguuguaguucccgcgcaa

SEQ ID NO: 1618040 - RNA, 16 nt, Pseudomonas putida KT2440
cgccaguucgcggcgc

SEQ ID NO: 1618041 - RNA, 22 nt, Pseudomonas putida KT2440
cgccaguuugcacuggcggggc

SEQ ID NO: 1618042 - RNA, 21 nt, Pseudomonas putida KT2440
cgccauaagcugucagcaccu

SEQ ID NO: 1618043 - RNA, 18 nt, Pseudomonas putida KT2440
cgccauccccccagcccu

SEQ ID NO: 1618044 - RNA, 16 nt, Pseudomonas putida KT2440
cgccaucggcacgcca

SEQ ID NO: 1618045 - RNA, 19 nt, Pseudomonas putida KT2440
cgccaucgccccgcgccgc

SEQ ID NO: 1618046 - RNA, 21 nt, Pseudomonas putida KT2440
cgccaucagugcccccgccac

SEQ ID NO: 1618047 - RNA, 19 nt, Pseudomonas putida KT2440
cgcccaaggucagccagac

SEQ ID NO: 1618048 - RNA, 13 nt, Pseudomonas putida KT2440
cgcccaagcggca

SEQ ID NO: 1618049 - RNA, 20 nt, Pseudomonas putida KT2440
cgcccaaugcagccgcccgc

SEQ ID NO: 1618050 - RNA, 22 nt, Pseudomonas putida KT2440
cgcccacggcgauggucugcuc

SEQ ID NO: 1618051 - RNA, 12 nt, Pseudomonas putida KT2440
cgcccacgcggg

SEQ ID NO: 1618052 - RNA, 22 nt, Pseudomonas putida KT2440
cgcccagaaucucaaccaccuc

SEQ ID NO: 1618053 - RNA, 21 nt, Pseudomonas putida KT2440
cgcccaaagaaaagcccgcac

SEQ ID NO: 1618054 - RNA, 20 nt, Pseudomonas putida KT2440
cgccccugccagcaccagcg

SEQ ID NO: 1618055 - RNA, 18 nt, Pseudomonas putida KT2440
cgccccuuggcacggcca

SEQ ID NO: 1618056 - RNA, 12 nt, Pseudomonas putida KT2440
cgcccgcgcagc

SEQ ID NO: 1618057 - RNA, 14 nt, Pseudomonas putida KT2440
cgcccgcgccgccc

SEQ ID NO: 1618058 - RNA, 12 nt, Pseudomonas putida KT2440
cgcccgcggcga

SEQ ID NO: 1618059 - RNA, 19 nt, Pseudomonas putida KT2440
cgccccccaccuggcccug

SEQ ID NO: 1618060 - RNA, 12 nt, Pseudomonas putida KT2440
cgcccccagccc

SEQ ID NO: 1618061 - RNA, 11 nt, Pseudomonas putida KT2440
cgccccgucca

SEQ ID NO: 1618062 - RNA, 12 nt, Pseudomonas putida KT2440
cgcccagcuucu

SEQ ID NO: 1618063 - RNA, 16 nt, Pseudomonas putida KT2440
cgcccagcucuggagg

SEQ ID NO: 1618064 - RNA, 21 nt, Pseudomonas putida KT2440
cgcccagcaacaugccggccc

SEQ ID NO: 1618065 - RNA, 17 nt, Pseudomonas putida KT2440
cgccccagcgcgccagc

SEQ ID NO: 1618066 - RNA, 19 nt, Pseudomonas putida KT2440
cgccccaggccgcggccga

SEQ ID NO: 1618067 - RNA, 14 nt, Pseudomonas putida KT2440
cgcccaugaugugg

SEQ ID NO: 1618068 - RNA, 20 nt, Pseudomonas putida KT2440
cgcccaugccacccaugcca

SEQ ID NO: 1618069 - RNA, 22 nt, Pseudomonas putida KT2440
cgcccauccaacgcauccaggc

SEQ ID NO: 1618070 - RNA, 17 nt, Pseudomonas putida KT2440
cgcccaucgcacacccu

SEQ ID NO: 1618071 - RNA, 20 nt, Pseudomonas putida KT2440
cgcccaucaccggcaccggg

SEQ ID NO: 1618072 - RNA, 16 nt, Pseudomonas putida KT2440
cgcccgugcucacgca

SEQ ID NO: 1618073 - RNA, 14 nt, Pseudomonas putida KT2440
cgcccgucuggcug

SEQ ID NO: 1618074 - RNA, 23 nt, Pseudomonas putida KT2440
cgcccugagccaaggccgcccag

SEQ ID NO: 1618075 - RNA, 18 nt, Pseudomonas putida KT2440
cgcccgguuuggccugac

SEQ ID NO: 1618076 - RNA, 13 nt, Pseudomonas putida KT2440
cgcccggcgcuga

SEQ ID NO: 1618077 - RNA, 18 nt, Pseudomonas putida KT2440
cgcccgguuccagcgcac

SEQ ID NO: 1618078 - RNA, 15 nt, Pseudomonas putida KT2440
cgcccggcgcagcau

SEQ ID NO: 1618079 - RNA, 12 nt, Pseudomonas putida KT2440
cgcccgcuccca

SEQ ID NO: 1618080 - RNA, 20 nt, Pseudomonas putida KT2440
cgcccgcucccacaggaaug

SEQ ID NO: 1618081 - RNA, 14 nt, Pseudomonas putida KT2440
cgcccgcucacgca

SEQ ID NO: 1618082 - RNA, 16 nt, Pseudomonas putida KT2440
cgcccgcucacgcagc

SEQ ID NO: 1618083 - RNA, 19 nt, Pseudomonas putida KT2440
cgcccuucauacagcgccu

SEQ ID NO: 1618084 - RNA, 22 nt, Pseudomonas putida KT2440
cgcccuucauacagcgccucca

SEQ ID NO: 1618085 - RNA, 22 nt, Pseudomonas putida KT2440
cgcccugcaaaggcaugggcca

SEQ ID NO: 1618086 - RNA, 17 nt, Pseudomonas putida KT2440
cgcccugcgccaaaacc

SEQ ID NO: 1618087 - RNA, 18 nt, Pseudomonas putida KT2440
cgcccuugcggaccaccu

SEQ ID NO: 1618088 - RNA, 21 nt, Pseudomonas putida KT2440
cgcccuugcggaccaccuggg

SEQ ID NO: 1618089 - RNA, 22 nt, Pseudomonas putida KT2440
cgcccuugucagccgccgcugc

SEQ ID NO: 1618090 - RNA, 19 nt, Pseudomonas putida KT2440
cgcccuuggugcaccagcu

SEQ ID NO: 1618091 - RNA, 22 nt, Pseudomonas putida KT2440
cgccgaacgggccaccaaaggc

SEQ ID NO: 1618092 - RNA, 21 nt, Pseudomonas putida KT2440
cgccgaacauggugcuuuugu

SEQ ID NO: 1618093 - RNA, 13 nt, Pseudomonas putida KT2440
cgccgccagcagc

SEQ ID NO: 1618094 - RNA, 14 nt, Pseudomonas putida KT2440
cgccgccagcugcu

SEQ ID NO: 1618095 - RNA, 14 nt, Pseudomonas putida KT2440
cgccgcccuggaug

SEQ ID NO: 1618096 - RNA, 19 nt, Pseudomonas putida KT2440
cgccgcccuggaugcucug

SEQ ID NO: 1618097 - RNA, 18 nt, Pseudomonas putida KT2440
cgccgccaggcagcagac

SEQ ID NO: 1618098 - RNA, 15 nt, Pseudomonas putida KT2440
cgccgcaacggccga

SEQ ID NO: 1618099 - RNA, 23 nt, Pseudomonas putida KT2440
cgccgauguagucguccugcccc

SEQ ID NO: 1618100 - RNA, 19 nt, Pseudomonas putida KT2440
cgccgagaggcgcugcggg

SEQ ID NO: 1618101 - RNA, 19 nt, Pseudomonas putida KT2440
cgccgaugaagcaggccga

SEQ ID NO: 1618102 - RNA, 19 nt, Pseudomonas putida KT2440
cgccgaucgaagcagcagc

SEQ ID NO: 1618103 - RNA, 18 nt, Pseudomonas putida KT2440
cgccgaccaagcgcccca

SEQ ID NO: 1618104 - RNA, 23 nt, Pseudomonas putida KT2440
cgccgaccaagcgccccacaagc

SEQ ID NO: 1618105 - RNA, 15 nt, Pseudomonas putida KT2440
cggccagcccgccac

SEQ ID NO: 1618106 - RNA, 13 nt, Pseudomonas putida KT2440
cggccagcggcac

SEQ ID NO: 1618107 - RNA, 15 nt, Pseudomonas putida KT2440
cggccagcugcugcg

SEQ ID NO: 1618108 - RNA, 17 nt, Pseudomonas putida KT2440
cggccagcugcugcggc

SEQ ID NO: 1618109 - RNA, 16 nt, Pseudomonas putida KT2440
cggccagcucgccaaa

SEQ ID NO: 1618110 - RNA, 20 nt, Pseudomonas putida KT2440
cggccaccaggcgcggcagc

SEQ ID NO: 1618111 - RNA, 13 nt, Pseudomonas putida KT2440
cggccacccgcgu

SEQ ID NO: 1618112 - RNA, 15 nt, Pseudomonas putida KT2440
cggccacccuccggg

SEQ ID NO: 1618113 - RNA, 12 nt, Pseudomonas putida KT2440
cggccagcaggc

SEQ ID NO: 1618114 - RNA, 12 nt, Pseudomonas putida KT2440
cggccagcagga

SEQ ID NO: 1618115 - RNA, 22 nt, Pseudomonas putida KT2440
cggccaguuucagcgccuucuu

SEQ ID NO: 1618116 - RNA, 21 nt, Pseudomonas putida KT2440
cggccaguugccccaggccca

SEQ ID NO: 1618117 - RNA, 15 nt, Pseudomonas putida KT2440
cggccaguggccuug

SEQ ID NO: 1618118 - RNA, 16 nt, Pseudomonas putida KT2440
cggccaguggccuugg

SEQ ID NO: 1618119 - RNA, 11 nt, Pseudomonas putida KT2440
cggccaggcuc

SEQ ID NO: 1618120 - RNA, 22 nt, Pseudomonas putida KT2440
cggccagggcccgccgcgcggc

SEQ ID NO: 1618121 - RNA, 15 nt, Pseudomonas putida KT2440
cggccaggccggcgc

SEQ ID NO: 1618122 - RNA, 15 nt, Pseudomonas putida KT2440
cggccaugccacccc

SEQ ID NO: 1618123 - RNA, 14 nt, Pseudomonas putida KT2440
cggccauccugcug

SEQ ID NO: 1618124 - RNA, 21 nt, Pseudomonas putida KT2440
cggccauaccgguagccucga

SEQ ID NO: 1618125 - RNA, 16 nt, Pseudomonas putida KT2440
cggccaucagcaagcc

SEQ ID NO: 1618126 - RNA, 22 nt, Pseudomonas putida KT2440
cggccaaucgaucugcucgccc

SEQ ID NO: 1618127 - RNA, 20 nt, Pseudomonas putida KT2440
cggccaacgcugcucggccu

SEQ ID NO: 1618128 - RNA, 15 nt, Pseudomonas putida KT2440
cggcaugcccgcccc

SEQ ID NO: 1618129 - RNA, 16 nt, Pseudomonas putida KT2440
cggcaugcagcggcca

SEQ ID NO: 1618130 - RNA, 16 nt, Pseudomonas putida KT2440
cggcaugcacggcagc

SEQ ID NO: 1618131 - RNA, 15 nt, Pseudomonas putida KT2440
cggcaugcacuucca

SEQ ID NO: 1618132 - RNA, 14 nt, Pseudomonas putida KT2440
cggcauccgccuca

SEQ ID NO: 1618133 - RNA, 17 nt, Pseudomonas putida KT2440
cggcauccgccucaucc

SEQ ID NO: 1618134 - RNA, 14 nt, Pseudomonas putida KT2440
cggcaucagggccc

SEQ ID NO: 1618135 - RNA, 13 nt, Pseudomonas putida KT2440
cggcauccuuggg

SEQ ID NO: 1618136 - RNA, 14 nt, Pseudomonas putida KT2440
cggcauccaggcgg

SEQ ID NO: 1618137 - RNA, 18 nt, Pseudomonas putida KT2440
cggcauccaggcgggcga

SEQ ID NO: 1618138 - RNA, 13 nt, Pseudomonas putida KT2440
cggcaucgcugcc

SEQ ID NO: 1618139 - RNA, 20 nt, Pseudomonas putida KT2440
cggcaucggugcuuucugcu

SEQ ID NO: 1618140 - RNA, 16 nt, Pseudomonas putida KT2440
cggcaucgccuccagc

SEQ ID NO: 1618141 - RNA, 12 nt, Pseudomonas putida KT2440
cgcuuggccacc

SEQ ID NO: 1618142 - RNA, 23 nt, Pseudomonas putida KT2440
cgcuuggccagaaacggcggcag

SEQ ID NO: 1618143 - RNA, 17 nt, Pseudomonas putida KT2440
cgcuuggcggcccuauc

SEQ ID NO: 1618144 - RNA, 14 nt, Pseudomonas putida KT2440
cggcacgcccgcuc

SEQ ID NO: 1618145 - RNA, 14 nt, Pseudomonas putida KT2440
cggcacgcgcccgg

SEQ ID NO: 1618146 - RNA, 20 nt, Pseudomonas putida KT2440
cgcuugagcgaaacccggcg

SEQ ID NO: 1618147 - RNA, 14 nt, Pseudomonas putida KT2440
cgcuugaucagccu

SEQ ID NO: 1618148 - RNA, 13 nt, Pseudomonas putida KT2440
cgcuugccacggc

SEQ ID NO: 1618149 - RNA, 22 nt, Pseudomonas putida KT2440
cgcuugcaguuguccaggcugc

SEQ ID NO: 1618150 - RNA, 13 nt, Pseudomonas putida KT2440
cggcagccaccgc

SEQ ID NO: 1618151 - RNA, 20 nt, Pseudomonas putida KT2440
cggcagaucacgcaaccucg

SEQ ID NO: 1618152 - RNA, 17 nt, Pseudomonas putida KT2440
cggcagaucaggcaauc

SEQ ID NO: 1618153 - RNA, 19 nt, Pseudomonas putida KT2440
cggcagaucaggcaaucac

SEQ ID NO: 1618154 - RNA, 22 nt, Pseudomonas putida KT2440
cggcagcgacgauaccggcgcu

SEQ ID NO: 1618155 - RNA, 13 nt, Pseudomonas putida KT2440
cggcagcgcaauc

SEQ ID NO: 1618156 - RNA, 22 nt, Pseudomonas putida KT2440
cggcagcgacagcugcggcaug

SEQ ID NO: 1618157 - RNA, 19 nt, Pseudomonas putida KT2440
cggcacuguaggcaaacag

SEQ ID NO: 1618158 - RNA, 23 nt, Pseudomonas putida KT2440
cggcagaaauguuuggguugacg

SEQ ID NO: 1618159 - RNA, 17 nt, Pseudomonas putida KT2440
cggcagacacaggcgcu

SEQ ID NO: 1618160 - RNA, 18 nt, Pseudomonas putida KT2440
cggcagagcgccagcauc

SEQ ID NO: 1618161 - RNA, 20 nt, Pseudomonas putida KT2440
cggcagauacaaccccagau

SEQ ID NO: 1618162 - RNA, 17 nt, Pseudomonas putida KT2440
cggcaggccggccacca

SEQ ID NO: 1618163 - RNA, 13 nt, Pseudomonas putida KT2440
cggcagcgcggcc

SEQ ID NO: 1618164 - RNA, 17 nt, Pseudomonas putida KT2440
cggcagcucgcgcugcg

SEQ ID NO: 1618165 - RNA, 21 nt, Pseudomonas putida KT2440
cggcagggugaaguugaucac

SEQ ID NO: 1618166 - RNA, 20 nt, Pseudomonas putida KT2440
cggcaggcgguccagcaagc

SEQ ID NO: 1618167 - RNA, 12 nt, Pseudomonas putida KT2440
cggcaggcuggc

SEQ ID NO: 1618168 - RNA, 18 nt, Pseudomonas putida KT2440
cggcaguagagcccccag

SEQ ID NO: 1618169 - RNA, 17 nt, Pseudomonas putida KT2440
cggcauacagcucccgc

SEQ ID NO: 1618170 - RNA, 20 nt, Pseudomonas putida KT2440
cggcaguucauacaccccgc

SEQ ID NO: 1618171 - RNA, 15 nt, Pseudomonas putida KT2440
cggcaguugccugcc

SEQ ID NO: 1618172 - RNA, 14 nt, Pseudomonas putida KT2440
cggcagucaggguc

SEQ ID NO: 1618173 - RNA, 17 nt, Pseudomonas putida KT2440
cggcagugaacuccaac

SEQ ID NO: 1618174 - RNA, 21 nt, Pseudomonas putida KT2440
cggcccccacgccgaccgcgc

SEQ ID NO: 1618175 - RNA, 15 nt, Pseudomonas putida KT2440
cggcccccccaucau

SEQ ID NO: 1618176 - RNA, 20 nt, Pseudomonas putida KT2440
cggcccaggggcaggucguu

SEQ ID NO: 1618177 - RNA, 18 nt, Pseudomonas putida KT2440
cggccccaguggcuuaca

SEQ ID NO: 1618178 - RNA, 16 nt, Pseudomonas putida KT2440
cggcccauucgcgggu

SEQ ID NO: 1618179 - RNA, 18 nt, Pseudomonas putida KT2440
cggccccaauugcuucaa

SEQ ID NO: 1618180 - RNA, 11 nt, Pseudomonas putida KT2440
cggccgcuucu

SEQ ID NO: 1618181 - RNA, 18 nt, Pseudomonas putida KT2440
cggccgccuccugcugcu

SEQ ID NO: 1618182 - RNA, 23 nt, Pseudomonas putida KT2440
cggccgucaugcgaucaguaauc

SEQ ID NO: 1618183 - RNA, 12 nt, Pseudomonas putida KT2440
cggccggcagcg

SEQ ID NO: 1618184 - RNA, 16 nt, Pseudomonas putida KT2440
cggcgacagcucaagc

SEQ ID NO: 1618185 - RNA, 23 nt, Pseudomonas putida KT2440
cggcgaacagcacugccagcccg

SEQ ID NO: 1618186 - RNA, 16 nt, Pseudomonas putida KT2440
cggcgaaagccagcag

SEQ ID NO: 1618187 - RNA, 23 nt, Pseudomonas putida KT2440
cggcgaaauacccaacuccagcg

SEQ ID NO: 1618188 - RNA, 18 nt, Pseudomonas putida KT2440
cggccugcgcccaaucac

SEQ ID NO: 1618189 - RNA, 15 nt, Pseudomonas putida KT2440
cggccguggguccug

SEQ ID NO: 1618190 - RNA, 12 nt, Pseudomonas putida KT2440
cggccucguguc

SEQ ID NO: 1618191 - RNA, 20 nt, Pseudomonas putida KT2440
cggccucucucagcaaccuc

SEQ ID NO: 1618192 - RNA, 17 nt, Pseudomonas putida KT2440
cggccugaugccucauc

SEQ ID NO: 1618193 - RNA, 14 nt, Pseudomonas putida KT2440
cggcgccuccagca

SEQ ID NO: 1618194 - RNA, 13 nt, Pseudomonas putida KT2440
cggcgccggccgc

SEQ ID NO: 1618195 - RNA, 14 nt, Pseudomonas putida KT2440
cggcgccggccgca

SEQ ID NO: 1618196 - RNA, 21 nt, Pseudomonas putida KT2440
cggcgccaaucaucgccagca

SEQ ID NO: 1618197 - RNA, 18 nt, Pseudomonas putida KT2440
cggcgcgcaacagcaagg

SEQ ID NO: 1618198 - RNA, 13 nt, Pseudomonas putida KT2440
cggcgcgcgcauc

SEQ ID NO: 1618199 - RNA, 15 nt, Pseudomonas putida KT2440
cggcgcagcgcugag

SEQ ID NO: 1618200 - RNA, 14 nt, Pseudomonas putida KT2440
cggcgaugccgcgc

SEQ ID NO: 1618201 - RNA, 18 nt, Pseudomonas putida KT2440
cggcgaugccgcgcgccc

SEQ ID NO: 1618202 - RNA, 14 nt, Pseudomonas putida KT2440
cggcgaugcgcccc

SEQ ID NO: 1618203 - RNA, 18 nt, Pseudomonas putida KT2440
cggcgaugcgccccccag

SEQ ID NO: 1618204 - RNA, 13 nt, Pseudomonas putida KT2440
cggcgcacccggc

SEQ ID NO: 1618205 - RNA, 16 nt, Pseudomonas putida KT2440
cggcgcacccggcugg

SEQ ID NO: 1618206 - RNA, 13 nt, Pseudomonas putida KT2440
cggcgccacccag

SEQ ID NO: 1618207 - RNA, 21 nt, Pseudomonas putida KT2440
cggcgcauugauagcggcagc

SEQ ID NO: 1618208 - RNA, 16 nt, Pseudomonas putida KT2440
cggcgcauccaccacg

SEQ ID NO: 1618209 - RNA, 13 nt, Pseudomonas putida KT2440
cggcgaugcauca

SEQ ID NO: 1618210 - RNA, 15 nt, Pseudomonas putida KT2440
cggcgaucgccaggu

SEQ ID NO: 1618211 - RNA, 19 nt, Pseudomonas putida KT2440
cggcgauauggcuccacca

SEQ ID NO: 1618212 - RNA, 22 nt, Pseudomonas putida KT2440
cggcgauauggcuccaccacag

SEQ ID NO: 1618213 - RNA, 21 nt, Pseudomonas putida KT2440
cggcgauagggaacagggcag

SEQ ID NO: 1618214 - RNA, 12 nt, Pseudomonas putida KT2440
cggcgagcgcgu

SEQ ID NO: 1618215 - RNA, 22 nt, Pseudomonas putida KT2440
cggcgagcgcaggaacaggcug

SEQ ID NO: 1618216 - RNA, 15 nt, Pseudomonas putida KT2440
cggcgagccgccaga

SEQ ID NO: 1618217 - RNA, 16 nt, Pseudomonas putida KT2440
cggcgguaccccgccu

SEQ ID NO: 1618218 - RNA, 17 nt, Pseudomonas putida KT2440
cggcggugacacugcca

SEQ ID NO: 1618219 - RNA, 22 nt, Pseudomonas putida KT2440
cggcgguugcaccguggcagca

SEQ ID NO: 1618220 - RNA, 18 nt, Pseudomonas putida KT2440
cggcgguugucgucgacc

SEQ ID NO: 1618221 - RNA, 14 nt, Pseudomonas putida KT2440
cggcggugacccgu

SEQ ID NO: 1618222 - RNA, 17 nt, Pseudomonas putida KT2440
cggcgcuugaucugcca

SEQ ID NO: 1618223 - RNA, 18 nt, Pseudomonas putida KT2440
cggcgcugucggucagca

SEQ ID NO: 1618224 - RNA, 13 nt, Pseudomonas putida KT2440
cggcgcuuggccg

SEQ ID NO: 1618225 - RNA, 21 nt, Pseudomonas putida KT2440
cggcggauagccccgcccagc

SEQ ID NO: 1618226 - RNA, 23 nt, Pseudomonas putida KT2440
cggcggauagccccgcccagcag

SEQ ID NO: 1618227 - RNA, 18 nt, Pseudomonas putida KT2440
cggcggcauccaggcggg

SEQ ID NO: 1618228 - RNA, 21 nt, Pseudomonas putida KT2440
cggcggcauccaggcgggcga

SEQ ID NO: 1618229 - RNA, 21 nt, Pseudomonas putida KT2440
cggcgcuggacagcggcagca

SEQ ID NO: 1618230 - RNA, 23 nt, Pseudomonas putida KT2440
cggcgcugacgaacaacgccacc

SEQ ID NO: 1618231 - RNA, 17 nt, Pseudomonas putida KT2440
cggcgcugagcgacagc

SEQ ID NO: 1618232 - RNA, 18 nt, Pseudomonas putida KT2440
cggcgcugagcgacagca

SEQ ID NO: 1618233 - RNA, 24 nt, Pseudomonas putida KT2440
cggcgcucgaucucacaggcgaug

SEQ ID NO: 1618234 - RNA, 14 nt, Pseudomonas putida KT2440
cggcgcgugccgca

SEQ ID NO: 1618235 - RNA, 14 nt, Pseudomonas putida KT2440
cggcgcggcccugu

SEQ ID NO: 1618236 - RNA, 14 nt, Pseudomonas putida KT2440
cggcgcgggcaccc

SEQ ID NO: 1618237 - RNA, 19 nt, Pseudomonas putida KT2440
cggcggggcccggacaggg

SEQ ID NO: 1618238 - RNA, 18 nt, Pseudomonas putida KT2440
cggcggcuuccagggcug

SEQ ID NO: 1618239 - RNA, 20 nt, Pseudomonas putida KT2440
cggcggcuuucagcgccgcu

SEQ ID NO: 1618240 - RNA, 15 nt, Pseudomonas putida KT2440
cggcggccugcugcc

SEQ ID NO: 1618241 - RNA, 13 nt, Pseudomonas putida KT2440
cggcggccccggc

SEQ ID NO: 1618242 - RNA, 14 nt, Pseudomonas putida KT2440
cggcggccccggcg

SEQ ID NO: 1618243 - RNA, 18 nt, Pseudomonas putida KT2440
cggcggccccggcgccgc

SEQ ID NO: 1618244 - RNA, 18 nt, Pseudomonas putida KT2440
cggcggcgaucagcgcgg

SEQ ID NO: 1618245 - RNA, 22 nt, Pseudomonas putida KT2440
cggcggcgaacaucugcucggg

SEQ ID NO: 1618246 - RNA, 16 nt, Pseudomonas putida KT2440
ccagggugccagacca

SEQ ID NO: 1618247 - RNA, 13 nt, Pseudomonas putida KT2440
ccagguaaugcgc

SEQ ID NO: 1618248 - RNA, 19 nt, Pseudomonas putida KT2440
ccagguacaguucccggug

SEQ ID NO: 1618249 - RNA, 21 nt, Pseudomonas putida KT2440
ccagguacaguucccggugcu

SEQ ID NO: 1618250 - RNA, 15 nt, Pseudomonas putida KT2440
ccagccgcucagcca

SEQ ID NO: 1618251 - RNA, 18 nt, Pseudomonas putida KT2440
ccagggguuuccuuuggg

SEQ ID NO: 1618252 - RNA, 14 nt, Pseudomonas putida KT2440
ccagccggcagcaa

SEQ ID NO: 1618253 - RNA, 14 nt, Pseudomonas putida KT2440
ccagccgcccaagc

SEQ ID NO: 1618254 - RNA, 20 nt, Pseudomonas putida KT2440
ccagccgccacgaccacgac

SEQ ID NO: 1618255 - RNA, 13 nt, Pseudomonas putida KT2440
ccagccgccgccg

SEQ ID NO: 1618256 - RNA, 16 nt, Pseudomonas putida KT2440
ccagccgccuuugccc

SEQ ID NO: 1618257 - RNA, 15 nt, Pseudomonas putida KT2440
ccagccgcgccacuc

SEQ ID NO: 1618258 - RNA, 22 nt, Pseudomonas putida KT2440
ccaggugcucgaugaucauccc

SEQ ID NO: 1618259 - RNA, 14 nt, Pseudomonas putida KT2440
ccaggugccgggcu

SEQ ID NO: 1618260 - RNA, 13 nt, Pseudomonas putida KT2440
ccagguggccgcc

SEQ ID NO: 1618261 - RNA, 17 nt, Pseudomonas putida KT2440
ccagguggccgccaccg

SEQ ID NO: 1618262 - RNA, 19 nt, Pseudomonas putida KT2440
ccagguaucgcaccgugcu

SEQ ID NO: 1618263 - RNA, 21 nt, Pseudomonas putida KT2440
ccaggugcaccaacacuucca

SEQ ID NO: 1618264 - RNA, 18 nt, Pseudomonas putida KT2440
ccaggugaucgccacaac

SEQ ID NO: 1618265 - RNA, 16 nt, Pseudomonas putida KT2440
ccaggugaugcaggca

SEQ ID NO: 1618266 - RNA, 21 nt, Pseudomonas putida KT2440
ccaggugcgcgucgacaauac

SEQ ID NO: 1618267 - RNA, 14 nt, Pseudomonas putida KT2440
ccagguucggauca

SEQ ID NO: 1618268 - RNA, 14 nt, Pseudomonas putida KT2440
ccagguuauccaca

SEQ ID NO: 1618269 - RNA, 16 nt, Pseudomonas putida KT2440
ccagguugagcacacg

SEQ ID NO: 1618270 - RNA, 18 nt, Pseudomonas putida KT2440
ccagguucuguagcgcaa

SEQ ID NO: 1618271 - RNA, 19 nt, Pseudomonas putida KT2440
ccagguucucgcuccagug

SEQ ID NO: 1618272 - RNA, 15 nt, Pseudomonas putida KT2440
ccaggugugccacuu

SEQ ID NO: 1618273 - RNA, 16 nt, Pseudomonas putida KT2440
ccaguaggcugcagcc

SEQ ID NO: 1618274 - RNA, 17 nt, Pseudomonas putida KT2440
ccaguaggcugcagccu

SEQ ID NO: 1618275 - RNA, 18 nt, Pseudomonas putida KT2440
ccaguaggcugcagccuu

SEQ ID NO: 1618276 - RNA, 17 nt, Pseudomonas putida KT2440
ccaguacugggcguccu

SEQ ID NO: 1618277 - RNA, 17 nt, Pseudomonas putida KT2440
ccaguacgcgccugcac

SEQ ID NO: 1618278 - RNA, 12 nt, Pseudomonas putida KT2440
ccaguccaggcc

SEQ ID NO: 1618279 - RNA, 23 nt, Pseudomonas putida KT2440
ccagucaccuugcuccaccaggc

SEQ ID NO: 1618280 - RNA, 22 nt, Pseudomonas putida KT2440
ccagucagaagcagcugaauug

SEQ ID NO: 1618281 - RNA, 15 nt, Pseudomonas putida KT2440
ccaguaccagcagca

SEQ ID NO: 1618282 - RNA, 16 nt, Pseudomonas putida KT2440
ccaguaccagcagcac

SEQ ID NO: 1618283 - RNA, 13 nt, Pseudomonas putida KT2440
ccaguacgccucg

SEQ ID NO: 1618284 - RNA, 15 nt, Pseudomonas putida KT2440
ccaguacgcaggcau

SEQ ID NO: 1618285 - RNA, 15 nt, Pseudomonas putida KT2440
ccaguacgccaccca

SEQ ID NO: 1618286 - RNA, 22 nt, Pseudomonas putida KT2440
ccagguugcguugaccugcugg

SEQ ID NO: 1618287 - RNA, 23 nt, Pseudomonas putida KT2440
ccagguugcguugaccugcuggg

SEQ ID NO: 1618288 - RNA, 16 nt, Pseudomonas putida KT2440
ccagguuggccgccgc

SEQ ID NO: 1618289 - RNA, 22 nt, Pseudomonas putida KT2440
ccagguuuucucgucuggcgcg

SEQ ID NO: 1618290 - RNA, 18 nt, Pseudomonas putida KT2440
ccagguuuaccggccgcu

SEQ ID NO: 1618291 - RNA, 17 nt, Pseudomonas putida KT2440
ccaguaaaggcgugccg

SEQ ID NO: 1618292 - RNA, 12 nt, Pseudomonas putida KT2440
ccagucugcuca

SEQ ID NO: 1618293 - RNA, 15 nt, Pseudomonas putida KT2440
ccagucugcucagcc

SEQ ID NO: 1618294 - RNA, 19 nt, Pseudomonas putida KT2440
ccagucugcucagccaacc

SEQ ID NO: 1618295 - RNA, 19 nt, Pseudomonas putida KT2440
ccagucugcuccaccgcau

SEQ ID NO: 1618296 - RNA, 15 nt, Pseudomonas putida KT2440
ccaguccuuggccaa

SEQ ID NO: 1618297 - RNA, 14 nt, Pseudomonas putida KT2440
ccagucgccccgcc

SEQ ID NO: 1618298 - RNA, 20 nt, Pseudomonas putida KT2440
ccagucgcacagguccagcc

SEQ ID NO: 1618299 - RNA, 15 nt, Pseudomonas putida KT2440
ccagucgaucagcga

SEQ ID NO: 1618300 - RNA, 16 nt, Pseudomonas putida KT2440
ccaguucagcgcccgc

SEQ ID NO: 1618301 - RNA, 17 nt, Pseudomonas putida KT2440
ccaguucauucccggcc

SEQ ID NO: 1618302 - RNA, 18 nt, Pseudomonas putida KT2440
ccaguucauucccggcca

SEQ ID NO: 1618303 - RNA, 13 nt, Pseudomonas putida KT2440
ccagugccuucag

SEQ ID NO: 1618304 - RNA, 21 nt, Pseudomonas putida KT2440
ccaguuacccuguacccgcug

SEQ ID NO: 1618305 - RNA, 18 nt, Pseudomonas putida KT2440
ccagugcaggucuacccc

SEQ ID NO: 1618306 - RNA, 16 nt, Pseudomonas putida KT2440
ccauagguuauccaca

SEQ ID NO: 1618307 - RNA, 20 nt, Pseudomonas putida KT2440
ccauagccugcugcucccca

SEQ ID NO: 1618308 - RNA, 21 nt, Pseudomonas putida KT2440
ccauacgcaugaagucauggg

SEQ ID NO: 1618309 - RNA, 15 nt, Pseudomonas putida KT2440
ccauaccucuucacu

SEQ ID NO: 1618310 - RNA, 15 nt, Pseudomonas putida KT2440
ccaguugcuccaccu

SEQ ID NO: 1618311 - RNA, 14 nt, Pseudomonas putida KT2440
ccaguugcuucugc

SEQ ID NO: 1618312 - RNA, 20 nt, Pseudomonas putida KT2440
ccaguuggcggcgcagcgca

SEQ ID NO: 1618313 - RNA, 21 nt, Pseudomonas putida KT2440
ccaguuggcggcgcagcgcac

SEQ ID NO: 1618314 - RNA, 14 nt, Pseudomonas putida KT2440
ccaguuggcagggc

SEQ ID NO: 1618315 - RNA, 16 nt, Pseudomonas putida KT2440
ccauaaaccccagccu

SEQ ID NO: 1618316 - RNA, 23 nt, Pseudomonas putida KT2440
ccauucggugacgaucaccaggg

SEQ ID NO: 1618317 - RNA, 22 nt, Pseudomonas putida KT2440
ccauucgcgggcaagcccgcuc

SEQ ID NO: 1618318 - RNA, 17 nt, Pseudomonas putida KT2440
ccauuucuucagcagga

SEQ ID NO: 1618319 - RNA, 17 nt, Pseudomonas putida KT2440
cccaacgaaaaaggccc

SEQ ID NO: 1618320 - RNA, 20 nt, Pseudomonas putida KT2440
cccaacgaaaaaggcccugc

SEQ ID NO: 1618321 - RNA, 19 nt, Pseudomonas putida KT2440
cccaaccucaacgccuccc

SEQ ID NO: 1618322 - RNA, 21 nt, Pseudomonas putida KT2440
cccaacccucacucgcggcca

SEQ ID NO: 1618323 - RNA, 15 nt, Pseudomonas putida KT2440
cccaacgccugaagc

SEQ ID NO: 1618324 - RNA, 18 nt, Pseudomonas putida KT2440
cccaacgcaaauccuccu

SEQ ID NO: 1618325 - RNA, 19 nt, Pseudomonas putida KT2440
cccaaggccugcaccauuu

SEQ ID NO: 1618326 - RNA, 12 nt, Pseudomonas putida KT2440
ccauuccuugcg

SEQ ID NO: 1618327 - RNA, 14 nt, Pseudomonas putida KT2440
ccauuccggcugca

SEQ ID NO: 1618328 - RNA, 21 nt, Pseudomonas putida KT2440
ccaugggcaggucgacccgcg

SEQ ID NO: 1618329 - RNA, 22 nt, Pseudomonas putida KT2440
ccauguaacgcuccacauauga

SEQ ID NO: 1618330 - RNA, 21 nt, Pseudomonas putida KT2440
ccauggcgguauucacaccug

SEQ ID NO: 1618331 - RNA, 16 nt, Pseudomonas putida KT2440
ccauggcgacaauggc

SEQ ID NO: 1618332 - RNA, 19 nt, Pseudomonas putida KT2440
ccaugugccuggcccggcc

SEQ ID NO: 1618333 - RNA, 21 nt, Pseudomonas putida KT2440
ccauguggcgcagcaucaucu

SEQ ID NO: 1618334 - RNA, 16 nt, Pseudomonas putida KT2440
ccauguacugcagaca

SEQ ID NO: 1618335 - RNA, 14 nt, Pseudomonas putida KT2440
ccauguagaccacc

SEQ ID NO: 1618336 - RNA, 15 nt, Pseudomonas putida KT2440
ccaucuucugcagcc

SEQ ID NO: 1618337 - RNA, 21 nt, Pseudomonas putida KT2440
ccaucuucgacaguucaagca

SEQ ID NO: 1618338 - RNA, 13 nt, Pseudomonas putida KT2440
ccaucggccggcu

SEQ ID NO: 1618339 - RNA, 23 nt, Pseudomonas putida KT2440
ccaucgcucaccguucuucucca

SEQ ID NO: 1618340 - RNA, 23 nt, Pseudomonas putida KT2440
ccaugaauucccuacugcgaaug

SEQ ID NO: 1618341 - RNA, 14 nt, Pseudomonas putida KT2440
ccaugaacaccacc

SEQ ID NO: 1618342 - RNA, 14 nt, Pseudomonas putida KT2440
ccaugaacagcaag

SEQ ID NO: 1618343 - RNA, 22 nt, Pseudomonas putida KT2440
ccaugaaaaagcccggccaggu

SEQ ID NO: 1618344 - RNA, 14 nt, Pseudomonas putida KT2440
ccaucuugcccagg

SEQ ID NO: 1618345 - RNA, 14 nt, Pseudomonas putida KT2440
ccaucuugcugcuc

SEQ ID NO: 1618346 - RNA, 15 nt, Pseudomonas putida KT2440
ccaucuugcugcucu

SEQ ID NO: 1618347 - RNA, 12 nt, Pseudomonas putida KT2440
ccauggccagcg

SEQ ID NO: 1618348 - RNA, 12 nt, Pseudomonas putida KT2440
ccauggccaggu

SEQ ID NO: 1618349 - RNA, 21 nt, Pseudomonas putida KT2440
ccauggcccugaucugccccu

SEQ ID NO: 1618350 - RNA, 21 nt, Pseudomonas putida KT2440
ccauggccgaucaguacgaug

SEQ ID NO: 1618351 - RNA, 13 nt, Pseudomonas putida KT2440
ccauggccuggcg

SEQ ID NO: 1618352 - RNA, 16 nt, Pseudomonas putida KT2440
ccaugccccccgccag

SEQ ID NO: 1618353 - RNA, 18 nt, Pseudomonas putida KT2440
ccaugccccuaccgccaa

SEQ ID NO: 1618354 - RNA, 19 nt, Pseudomonas putida KT2440
ccaugccccucaaugcugc

SEQ ID NO: 1618355 - RNA, 13 nt, Pseudomonas putida KT2440
ccaugcaccgucu

SEQ ID NO: 1618356 - RNA, 16 nt, Pseudomonas putida KT2440
ccaugccacccauauc

SEQ ID NO: 1618357 - RNA, 20 nt, Pseudomonas putida KT2440
ccaucaguugcagcaacgcc

SEQ ID NO: 1618358 - RNA, 18 nt, Pseudomonas putida KT2440
ccaucagugcccccgcca

SEQ ID NO: 1618359 - RNA, 22 nt, Pseudomonas putida KT2440
ccaucagugcccccgccacagg

SEQ ID NO: 1618360 - RNA, 20 nt, Pseudomonas putida KT2440
ccaucauuuccugaaccaug

SEQ ID NO: 1618361 - RNA, 15 nt, Pseudomonas putida KT2440
ccauauucagcuuca

SEQ ID NO: 1618362 - RNA, 18 nt, Pseudomonas putida KT2440
ccauccagggcuuccugc

SEQ ID NO: 1618363 - RNA, 15 nt, Pseudomonas putida KT2440
ccauccaccgcgcca

SEQ ID NO: 1618364 - RNA, 17 nt, Pseudomonas putida KT2440
ccauccaccgcgccagc

SEQ ID NO: 1618365 - RNA, 19 nt, Pseudomonas putida KT2440
ccauccguuacaauaccga

SEQ ID NO: 1618366 - RNA, 15 nt, Pseudomonas putida KT2440
ccauccucggccagg

SEQ ID NO: 1618367 - RNA, 18 nt, Pseudomonas putida KT2440
ccauccucggccaggccc

SEQ ID NO: 1618368 - RNA, 12 nt, Pseudomonas putida KT2440
cccagcgaggcc

SEQ ID NO: 1618369 - RNA, 13 nt, Pseudomonas putida KT2440
cccagcgccaccg

SEQ ID NO: 1618370 - RNA, 16 nt, Pseudomonas putida KT2440
cccagcgcauugcccg

SEQ ID NO: 1618371 - RNA, 13 nt, Pseudomonas putida KT2440
cccagcgccucca

SEQ ID NO: 1618372 - RNA, 22 nt, Pseudomonas putida KT2440
cccagcgcugucccccagcccu

SEQ ID NO: 1618373 - RNA, 14 nt, Pseudomonas putida KT2440
cccagcggcaaccu

SEQ ID NO: 1618374 - RNA, 19 nt, Pseudomonas putida KT2440
cccagcgcgccagcagguc

SEQ ID NO: 1618375 - RNA, 21 nt, Pseudomonas putida KT2440
cccagcgccuuggccugcuca

SEQ ID NO: 1618376 - RNA, 17 nt, Pseudomonas putida KT2440
cccagcgcgaagcccag

SEQ ID NO: 1618377 - RNA, 14 nt, Pseudomonas putida KT2440
cccagcgcgcgcag

SEQ ID NO: 1618378 - RNA, 17 nt, Pseudomonas putida KT2440
cccagcgcgcgcagacg

SEQ ID NO: 1618379 - RNA, 23 nt, Pseudomonas putida KT2440
cccagcugaagugccaaggcuuu

SEQ ID NO: 1618380 - RNA, 22 nt, Pseudomonas putida KT2440
cccagcucgcuggccaccagca

SEQ ID NO: 1618381 - RNA, 16 nt, Pseudomonas putida KT2440
cccagcucgaucagcu

SEQ ID NO: 1618382 - RNA, 21 nt, Pseudomonas putida KT2440
cccagcucgccaacaccgccc

SEQ ID NO: 1618383 - RNA, 17 nt, Pseudomonas putida KT2440
cccagcuacgcgagcca

SEQ ID NO: 1618384 - RNA, 22 nt, Pseudomonas putida KT2440
cccagcuacgcgagccaccguc

SEQ ID NO: 1618385 - RNA, 18 nt, Pseudomonas putida KT2440
cccagcguauagccaccg

SEQ ID NO: 1618386 - RNA, 23 nt, Pseudomonas putida KT2440
cccagcguauagccaccgggcga

SEQ ID NO: 1618387 - RNA, 18 nt, Pseudomonas putida KT2440
cccagcgucgucugcgug

SEQ ID NO: 1618388 - RNA, 17 nt, Pseudomonas putida KT2440
cccaggccauccagcgg

SEQ ID NO: 1618389 - RNA, 16 nt, Pseudomonas putida KT2440
cccaggcccaacgggc

SEQ ID NO: 1618390 - RNA, 16 nt, Pseudomonas putida KT2440
cccaggcccugacgcc

SEQ ID NO: 1618391 - RNA, 12 nt, Pseudomonas putida KT2440
cccaggcagccu

SEQ ID NO: 1618392 - RNA, 22 nt, Pseudomonas putida KT2440
cccagcuucuccagcaagcgcu

SEQ ID NO: 1618393 - RNA, 17 nt, Pseudomonas putida KT2440
cccagcuugaagcggcc

SEQ ID NO: 1618394 - RNA, 14 nt, Pseudomonas putida KT2440
cccaggacuucagc

SEQ ID NO: 1618395 - RNA, 16 nt, Pseudomonas putida KT2440
cccaggaucacuggcc

SEQ ID NO: 1618396 - RNA, 20 nt, Pseudomonas putida KT2440
cccagcagccaacgccccag

SEQ ID NO: 1618397 - RNA, 19 nt, Pseudomonas putida KT2440
cccagcagccccacgccca

SEQ ID NO: 1618398 - RNA, 18 nt, Pseudomonas putida KT2440
cccagcacuucguccagg

SEQ ID NO: 1618399 - RNA, 15 nt, Pseudomonas putida KT2440
cccagcccgaagccg

SEQ ID NO: 1618400 - RNA, 18 nt, Pseudomonas putida KT2440
cccagcccaugaacagca

SEQ ID NO: 1618401 - RNA, 14 nt, Pseudomonas putida KT2440
cccagccccgagca

SEQ ID NO: 1618402 - RNA, 23 nt, Pseudomonas putida KT2440
cccagcccggcgccgagccauag

SEQ ID NO: 1618403 - RNA, 23 nt, Pseudomonas putida KT2440
cccagcccaguagaucgcgccag

SEQ ID NO: 1618404 - RNA, 22 nt, Pseudomonas putida KT2440
cccagcgaauagcaacacaugu

SEQ ID NO: 1618405 - RNA, 21 nt, Pseudomonas putida KT2440
cccagccggucauccagcagc

SEQ ID NO: 1618406 - RNA, 23 nt, Pseudomonas putida KT2440
cccagccggucauccagcagcuc

SEQ ID NO: 1618407 - RNA, 16 nt, Pseudomonas putida KT2440
cccagccucagcuggc

SEQ ID NO: 1618408 - RNA, 12 nt, Pseudomonas putida KT2440
cccagccuucag

SEQ ID NO: 1618409 - RNA, 22 nt, Pseudomonas putida KT2440
cccagcaccgcgacgaccgcac

SEQ ID NO: 1618410 - RNA, 18 nt, Pseudomonas putida KT2440
cccagcacccgcaggcga

SEQ ID NO: 1618411 - RNA, 15 nt, Pseudomonas putida KT2440
cccagcaacugcgcc

SEQ ID NO: 1618412 - RNA, 17 nt, Pseudomonas putida KT2440
cccagcaacugcgccca

SEQ ID NO: 1618413 - RNA, 12 nt, Pseudomonas putida KT2440
cccagcaacagc

SEQ ID NO: 1618414 - RNA, 16 nt, Pseudomonas putida KT2440
cccagcaacagcccca

SEQ ID NO: 1618415 - RNA, 18 nt, Pseudomonas putida KT2440
cccagcaacagccccauc

SEQ ID NO: 1618416 - RNA, 21 nt, Pseudomonas putida KT2440
cccagcacagauaaaccugcc

SEQ ID NO: 1618417 - RNA, 20 nt, Pseudomonas putida KT2440
cccagcaauucagaagucca

SEQ ID NO: 1618418 - RNA, 15 nt, Pseudomonas putida KT2440
cccagaaaggccgcu

SEQ ID NO: 1618419 - RNA, 17 nt, Pseudomonas putida KT2440
cccagaacagccacagc

SEQ ID NO: 1618420 - RNA, 21 nt, Pseudomonas putida KT2440
cccagaacagccacagcugcu

SEQ ID NO: 1618421 - RNA, 15 nt, Pseudomonas putida KT2440
cccaaguacaccggc

SEQ ID NO: 1618422 - RNA, 19 nt, Pseudomonas putida KT2440
cccaaguacaccggcagca

SEQ ID NO: 1618423 - RNA, 13 nt, Pseudomonas putida KT2440
cccaggccgcggc

SEQ ID NO: 1618424 - RNA, 19 nt, Pseudomonas putida KT2440
cccaggcgcgccugcaccu

SEQ ID NO: 1618425 - RNA, 15 nt, Pseudomonas putida KT2440
cccaggcggugagug

SEQ ID NO: 1618426 - RNA, 13 nt, Pseudomonas putida KT2440
cccaggcucgccc

SEQ ID NO: 1618427 - RNA, 20 nt, Pseudomonas putida KT2440
cccaggcucucagcccauuu

SEQ ID NO: 1618428 - RNA, 13 nt, Pseudomonas putida KT2440
cccaggcugccaa

SEQ ID NO: 1618429 - RNA, 15 nt, Pseudomonas putida KT2440
cccagggcucuaccc

SEQ ID NO: 1618430 - RNA, 15 nt, Pseudomonas putida KT2440
cccagggcugcuuca

SEQ ID NO: 1618431 - RNA, 16 nt, Pseudomonas putida KT2440
cccagguaucgcaccg

SEQ ID NO: 1618432 - RNA, 17 nt, Pseudomonas putida KT2440
cccaggugccaggcuca

SEQ ID NO: 1618433 - RNA, 16 nt, Pseudomonas putida KT2440
cccaggugaucgccac

SEQ ID NO: 1618434 - RNA, 19 nt, Pseudomonas putida KT2440
cccaggugcaacccggccu

SEQ ID NO: 1618435 - RNA, 15 nt, Pseudomonas putida KT2440
cccaggugcugaugc

SEQ ID NO: 1618436 - RNA, 18 nt, Pseudomonas putida KT2440
cccaguggcuuacagcgu

SEQ ID NO: 1618437 - RNA, 18 nt, Pseudomonas putida KT2440
cccaguggcacaccaugg

SEQ ID NO: 1618438 - RNA, 22 nt, Pseudomonas putida KT2440
cccaguggcacaccaugggcaa

SEQ ID NO: 1618439 - RNA, 21 nt, Pseudomonas putida KT2440
cccagugugcaaacacccagc

SEQ ID NO: 1618440 - RNA, 19 nt, Pseudomonas putida KT2440
cccaguucacgcaggcgca

SEQ ID NO: 1618441 - RNA, 18 nt, Pseudomonas putida KT2440
cccaguuccaguucgcca

SEQ ID NO: 1618442 - RNA, 15 nt, Pseudomonas putida KT2440
cccaguuccaugucg

SEQ ID NO: 1618443 - RNA, 21 nt, Pseudomonas putida KT2440
cccaguucgcggaucugcugc

SEQ ID NO: 1618444 - RNA, 19 nt, Pseudomonas putida KT2440
cccaguucguccaccgacg

SEQ ID NO: 1618445 - RNA, 17 nt, Pseudomonas putida KT2440
cccaguccgucucuuca

SEQ ID NO: 1618446 - RNA, 22 nt, Pseudomonas putida KT2440
cccagucgaugggcccgagccc

SEQ ID NO: 1618447 - RNA, 23 nt, Pseudomonas putida KT2440
cccagucgccccgccagcgccug

SEQ ID NO: 1618448 - RNA, 15 nt, Pseudomonas putida KT2440
cccaguacgccaccc

SEQ ID NO: 1618449 - RNA, 18 nt, Pseudomonas putida KT2440
cccaguagcgccaccauc

SEQ ID NO: 1618450 - RNA, 18 nt, Pseudomonas putida KT2440
cccaguagaucgcgccag

SEQ ID NO: 1618451 - RNA, 15 nt, Pseudomonas putida KT2440
cccaguacggcgcca

SEQ ID NO: 1618452 - RNA, 19 nt, Pseudomonas putida KT2440
cccagucauccgggccguc

SEQ ID NO: 1618453 - RNA, 19 nt, Pseudomonas putida KT2440
cccagguuauacgccgccg

SEQ ID NO: 1618454 - RNA, 19 nt, Pseudomonas putida KT2440
cccagguugcaccucggau

SEQ ID NO: 1618455 - RNA, 13 nt, Pseudomonas putida KT2440
cccaucagcgccg

SEQ ID NO: 1618456 - RNA, 19 nt, Pseudomonas putida KT2440
cccaucaccagcccgaagc

SEQ ID NO: 1618457 - RNA, 21 nt, Pseudomonas putida KT2440
cccauaccucuucacugcuca

SEQ ID NO: 1618458 - RNA, 12 nt, Pseudomonas putida KT2440
cccauagccugc

SEQ ID NO: 1618459 - RNA, 19 nt, Pseudomonas putida KT2440
cccaucaguugcagcaacg

SEQ ID NO: 1618460 - RNA, 18 nt, Pseudomonas putida KT2440
cccauccaacgcauccag

SEQ ID NO: 1618461 - RNA, 20 nt, Pseudomonas putida KT2440
cccaucauucgauagccugc

SEQ ID NO: 1618462 - RNA, 15 nt, Pseudomonas putida KT2440
cccaucgcacacccu

SEQ ID NO: 1618463 - RNA, 10 nt, Pseudomonas putida KT2440
aaacacaucc

SEQ ID NO: 1618464 - RNA, 15 nt, Pseudomonas putida KT2440
ccccguccagcccca

SEQ ID NO: 1618465 - RNA, 14 nt, Pseudomonas putida KT2440
ccccguccacagcg

SEQ ID NO: 1618466 - RNA, 12 nt, Pseudomonas putida KT2440
ccccguccagcc

SEQ ID NO: 1618467 - RNA, 12 nt, Pseudomonas putida KT2440
ccccgcucaugg

SEQ ID NO: 1618468 - RNA, 19 nt, Pseudomonas putida KT2440
ccccggugcagguuggagc

SEQ ID NO: 1618469 - RNA, 14 nt, Pseudomonas putida KT2440
ccccggugcaucca

SEQ ID NO: 1618470 - RNA, 13 nt, Pseudomonas putida KT2440
ccccugcgccgcc

SEQ ID NO: 1618471 - RNA, 14 nt, Pseudomonas putida KT2440
ccccugcgccgcca

SEQ ID NO: 1618472 - RNA, 17 nt, Pseudomonas putida KT2440
ccccugcgccgccaccu

SEQ ID NO: 1618473 - RNA, 21 nt, Pseudomonas putida KT2440
ccccugauaggacugcuucag

SEQ ID NO: 1618474 - RNA, 14 nt, Pseudomonas putida KT2440
ccccuccucaccgc

SEQ ID NO: 1618475 - RNA, 19 nt, Pseudomonas putida KT2440
ccccgucgccucaccucca

SEQ ID NO: 1618476 - RNA, 12 nt, Pseudomonas putida KT2440
ccccgucuuccu

SEQ ID NO: 1618477 - RNA, 11 nt, Pseudomonas putida KT2440
ccccuccaccc

SEQ ID NO: 1618478 - RNA, 16 nt, Pseudomonas putida KT2440
ccccuccacccaccuu

SEQ ID NO: 1618479 - RNA, 14 nt, Pseudomonas putida KT2440
ccccuccacccggu

SEQ ID NO: 1618480 - RNA, 12 nt, Pseudomonas putida KT2440
ccccuccacugu

SEQ ID NO: 1618481 - RNA, 20 nt, Pseudomonas putida KT2440
cccgagcguucgaugcgcag

SEQ ID NO: 1618482 - RNA, 15 nt, Pseudomonas putida KT2440
cccgaccgccagccc

SEQ ID NO: 1618483 - RNA, 19 nt, Pseudomonas putida KT2440
cccgacgauuucuccccag

SEQ ID NO: 1618484 - RNA, 20 nt, Pseudomonas putida KT2440
cccgacgauuucuccccagu

SEQ ID NO: 1618485 - RNA, 19 nt, Pseudomonas putida KT2440
ccccuuuagcaggcaagcc

SEQ ID NO: 1618486 - RNA, 19 nt, Pseudomonas putida KT2440
ccccuuuuuuuugccuggg

SEQ ID NO: 1618487 - RNA, 23 nt, Pseudomonas putida KT2440
ccccuuuggccuaccgcccgcgc

SEQ ID NO: 1618488 - RNA, 19 nt, Pseudomonas putida KT2440
ccccuuucuccagcaacaa

SEQ ID NO: 1618489 - RNA, 15 nt, Pseudomonas putida KT2440
cccgcaaagcccugc

SEQ ID NO: 1618490 - RNA, 17 nt, Pseudomonas putida KT2440
cccgcaaagcccugccu

SEQ ID NO: 1618491 - RNA, 13 nt, Pseudomonas putida KT2440
cccgcaacaaccu

SEQ ID NO: 1618492 - RNA, 16 nt, Pseudomonas putida KT2440
cccgcaacaccaggac

SEQ ID NO: 1618493 - RNA, 23 nt, Pseudomonas putida KT2440
cccgcacaucacggcgcaggccg

SEQ ID NO: 1618494 - RNA, 18 nt, Pseudomonas putida KT2440
cccgcacaugccugcacu

SEQ ID NO: 1618495 - RNA, 22 nt, Pseudomonas putida KT2440
cccgcacaugccugcacugggc

SEQ ID NO: 1618496 - RNA, 18 nt, Pseudomonas putida KT2440
cccgcaccuccuuggccg

SEQ ID NO: 1618497 - RNA, 16 nt, Pseudomonas putida KT2440
cccgccaaccccuccu

SEQ ID NO: 1618498 - RNA, 20 nt, Pseudomonas putida KT2440
cccgccaacaacaagcgcug

SEQ ID NO: 1618499 - RNA, 15 nt, Pseudomonas putida KT2440
cccgccaccccaggc

SEQ ID NO: 1618500 - RNA, 18 nt, Pseudomonas putida KT2440
cccgccacccccgccgcc

SEQ ID NO: 1618501 - RNA, 20 nt, Pseudomonas putida KT2440
cccgccacccccgccgccag

SEQ ID NO: 1618502 - RNA, 12 nt, Pseudomonas putida KT2440
cccgccagcagg

SEQ ID NO: 1618503 - RNA, 17 nt, Pseudomonas putida KT2440
cccgcccaccaccagcc

SEQ ID NO: 1618504 - RNA, 18 nt, Pseudomonas putida KT2440
cccgccauguugcgcagc

SEQ ID NO: 1618505 - RNA, 17 nt, Pseudomonas putida KT2440
cccgccauucuucucca

SEQ ID NO: 1618506 - RNA, 17 nt, Pseudomonas putida KT2440
cccgccauugcaccacg

SEQ ID NO: 1618507 - RNA, 14 nt, Pseudomonas putida KT2440
cccgccaggcaguu

SEQ ID NO: 1618508 - RNA, 21 nt, Pseudomonas putida KT2440
ccccaacccggucccgcccuc

SEQ ID NO: 1618509 - RNA, 13 nt, Pseudomonas putida KT2440
ccccaaccaugcu

SEQ ID NO: 1618510 - RNA, 13 nt, Pseudomonas putida KT2440
ccccaacccacca

SEQ ID NO: 1618511 - RNA, 11 nt, Pseudomonas putida KT2440
ccccaacaaca

SEQ ID NO: 1618512 - RNA, 13 nt, Pseudomonas putida KT2440
ccccaacaacagu

SEQ ID NO: 1618513 - RNA, 14 nt, Pseudomonas putida KT2440
ccccaccggccgcc

SEQ ID NO: 1618514 - RNA, 19 nt, Pseudomonas putida KT2440
ccccaccggccuggaaccg

SEQ ID NO: 1618515 - RNA, 12 nt, Pseudomonas putida KT2440
ccccaccaggca

SEQ ID NO: 1618516 - RNA, 17 nt, Pseudomonas putida KT2440
ccccaccggcaccaucu

SEQ ID NO: 1618517 - RNA, 14 nt, Pseudomonas putida KT2440
ccccacgcccaggc

SEQ ID NO: 1618518 - RNA, 20 nt, Pseudomonas putida KT2440
ccccagauuucucagcugga

SEQ ID NO: 1618519 - RNA, 11 nt, Pseudomonas putida KT2440
ccccagcaacg

SEQ ID NO: 1618520 - RNA, 13 nt, Pseudomonas putida KT2440
ccccagcaaggca

SEQ ID NO: 1618521 - RNA, 21 nt, Pseudomonas putida KT2440
ccccagcauuggauacugccc

SEQ ID NO: 1618522 - RNA, 15 nt, Pseudomonas putida KT2440
cccaucugcucgcca

SEQ ID NO: 1618523 - RNA, 19 nt, Pseudomonas putida KT2440
cccaucugcucgccaucug

SEQ ID NO: 1618524 - RNA, 19 nt, Pseudomonas putida KT2440
cccaugccaagcccacaca

SEQ ID NO: 1618525 - RNA, 23 nt, Pseudomonas putida KT2440
cccaugcgaacugcagagccugc

SEQ ID NO: 1618526 - RNA, 16 nt, Pseudomonas putida KT2440
cccaugaugaccacca

SEQ ID NO: 1618527 - RNA, 22 nt, Pseudomonas putida KT2440
cccauggcgguauucacaccug

SEQ ID NO: 1618528 - RNA, 15 nt, Pseudomonas putida KT2440
cccauggcuggcagc

SEQ ID NO: 1618529 - RNA, 12 nt, Pseudomonas putida KT2440
cccauggccagc

SEQ ID NO: 1618530 - RNA, 13 nt, Pseudomonas putida KT2440
cccauggccaggc

SEQ ID NO: 1618531 - RNA, 16 nt, Pseudomonas putida KT2440
ccccauagccugcugc

SEQ ID NO: 1618532 - RNA, 23 nt, Pseudomonas putida KT2440
ccccauagccugcugcuccccaa

SEQ ID NO: 1618533 - RNA, 19 nt, Pseudomonas putida KT2440
ccccauagggccagcggcu

SEQ ID NO: 1618534 - RNA, 17 nt, Pseudomonas putida KT2440
ccccagugugcaaacac

SEQ ID NO: 1618535 - RNA, 22 nt, Pseudomonas putida KT2440
ccccaguucacgcaggcgcagg

SEQ ID NO: 1618536 - RNA, 12 nt, Pseudomonas putida KT2440
ccccagcgccuc

SEQ ID NO: 1618537 - RNA, 20 nt, Pseudomonas putida KT2440
ccccagcgccuccaccugga

SEQ ID NO: 1618538 - RNA, 23 nt, Pseudomonas putida KT2440
ccccagccggucauccagcagcu

SEQ ID NO: 1618539 - RNA, 18 nt, Pseudomonas putida KT2440
cccccagguuauccacag

SEQ ID NO: 1618540 - RNA, 15 nt, Pseudomonas putida KT2440
cccccagcgccucca

SEQ ID NO: 1618541 - RNA, 15 nt, Pseudomonas putida KT2440
cccccagcagcgggc

SEQ ID NO: 1618542 - RNA, 18 nt, Pseudomonas putida KT2440
cccccaugaugaccacca

SEQ ID NO: 1618543 - RNA, 17 nt, Pseudomonas putida KT2440
cccccggcccagccccg

SEQ ID NO: 1618544 - RNA, 15 nt, Pseudomonas putida KT2440
cccccaucagcgggc

SEQ ID NO: 1618545 - RNA, 17 nt, Pseudomonas putida KT2440
cccccaucaguugcagc

SEQ ID NO: 1618546 - RNA, 14 nt, Pseudomonas putida KT2440
cccccaccggccgc

SEQ ID NO: 1618547 - RNA, 17 nt, Pseudomonas putida KT2440
cccccacccccgcccca

SEQ ID NO: 1618548 - RNA, 19 nt, Pseudomonas putida KT2440
ccccgccugcuggccgcgc

SEQ ID NO: 1618549 - RNA, 22 nt, Pseudomonas putida KT2440
ccccgaucuauucgacccgcgu

SEQ ID NO: 1618550 - RNA, 15 nt, Pseudomonas putida KT2440
ccccgcaccagacca

SEQ ID NO: 1618551 - RNA, 17 nt, Pseudomonas putida KT2440
ccccgcaccuccuuggc

SEQ ID NO: 1618552 - RNA, 12 nt, Pseudomonas putida KT2440
ccccgaugcgcu

SEQ ID NO: 1618553 - RNA, 14 nt, Pseudomonas putida KT2440
ccccgacugacgcu

SEQ ID NO: 1618554 - RNA, 13 nt, Pseudomonas putida KT2440
cccccgucagcgg

SEQ ID NO: 1618555 - RNA, 14 nt, Pseudomonas putida KT2440
cccccuccacccgg

SEQ ID NO: 1618556 - RNA, 12 nt, Pseudomonas putida KT2440
cccccuccugau

SEQ ID NO: 1618557 - RNA, 15 nt, Pseudomonas putida KT2440
cccccggugccggcc

SEQ ID NO: 1618558 - RNA, 16 nt, Pseudomonas putida KT2440
cccccguaggagcggg

SEQ ID NO: 1618559 - RNA, 14 nt, Pseudomonas putida KT2440
ccccgagcaaagcc

SEQ ID NO: 1618560 - RNA, 18 nt, Pseudomonas putida KT2440
ccccgagcaaagcccgcc

SEQ ID NO: 1618561 - RNA, 21 nt, Pseudomonas putida KT2440
ccccgagcaaagcccgcccca

SEQ ID NO: 1618562 - RNA, 19 nt, Pseudomonas putida KT2440
cccugcuggccaaucucca

SEQ ID NO: 1618563 - RNA, 18 nt, Pseudomonas putida KT2440
cccugcugcuggcacgcc

SEQ ID NO: 1618564 - RNA, 20 nt, Pseudomonas putida KT2440
cccugggccuucgcccgccg

SEQ ID NO: 1618565 - RNA, 13 nt, Pseudomonas putida KT2440
cccugggcgagca

SEQ ID NO: 1618566 - RNA, 22 nt, Pseudomonas putida KT2440
cccugcucuucgauccgcgcca

SEQ ID NO: 1618567 - RNA, 21 nt, Pseudomonas putida KT2440
cccugcucguccaucaccgcc

SEQ ID NO: 1618568 - RNA, 14 nt, Pseudomonas putida KT2440
cccugcucauccag

SEQ ID NO: 1618569 - RNA, 14 nt, Pseudomonas putida KT2440
cccugcggcugccc

SEQ ID NO: 1618570 - RNA, 24 nt, Pseudomonas putida KT2440
cccugcgggagcgggcgugcccgc

SEQ ID NO: 1618571 - RNA, 11 nt, Pseudomonas putida KT2440
cccugcggcug

SEQ ID NO: 1618572 - RNA, 13 nt, Pseudomonas putida KT2440
cccugcaacaggg

SEQ ID NO: 1618573 - RNA, 21 nt, Pseudomonas putida KT2440
cccugcauggcauucgccacu

SEQ ID NO: 1618574 - RNA, 15 nt, Pseudomonas putida KT2440
cccugccagcaccag

SEQ ID NO: 1618575 - RNA, 22 nt, Pseudomonas putida KT2440
cccugcccgaucgccucgcugg

SEQ ID NO: 1618576 - RNA, 18 nt, Pseudomonas putida KT2440
cccugccgccuucuccag

SEQ ID NO: 1618577 - RNA, 22 nt, Pseudomonas putida KT2440
cccugccgccuucuccagcucg

SEQ ID NO: 1618578 - RNA, 16 nt, Pseudomonas putida KT2440
cccugccgcugaccug

SEQ ID NO: 1618579 - RNA, 17 nt, Pseudomonas putida KT2440
cccugccgcugaccugg

SEQ ID NO: 1618580 - RNA, 21 nt, Pseudomonas putida KT2440
cccugccggccucaauuccag

SEQ ID NO: 1618581 - RNA, 16 nt, Pseudomonas putida KT2440
cccugagucuggcgcc

SEQ ID NO: 1618582 - RNA, 23 nt, Pseudomonas putida KT2440
cccugaucgaugagcgagcccgc

SEQ ID NO: 1618583 - RNA, 14 nt, Pseudomonas putida KT2440
cccugaucgccucc

SEQ ID NO: 1618584 - RNA, 22 nt, Pseudomonas putida KT2440
cccugauaggacugcuucaggc

SEQ ID NO: 1618585 - RNA, 15 nt, Pseudomonas putida KT2440
cccugaucauacgca

SEQ ID NO: 1618586 - RNA, 15 nt, Pseudomonas putida KT2440
cccugaucauccaca

SEQ ID NO: 1618587 - RNA, 11 nt, Pseudomonas putida KT2440
cccucuugaau

SEQ ID NO: 1618588 - RNA, 18 nt, Pseudomonas putida KT2440
cccugaacagggccaggu

SEQ ID NO: 1618589 - RNA, 20 nt, Pseudomonas putida KT2440
cccugaaggccgcuccugcg

SEQ ID NO: 1618590 - RNA, 21 nt, Pseudomonas putida KT2440
cccucgcccagaaucucaacc

SEQ ID NO: 1618591 - RNA, 14 nt, Pseudomonas putida KT2440
cccucgaccacgca

SEQ ID NO: 1618592 - RNA, 21 nt, Pseudomonas putida KT2440
cccuccugaacgaugcccggg

SEQ ID NO: 1618593 - RNA, 13 nt, Pseudomonas putida KT2440
cccuccuccagca

SEQ ID NO: 1618594 - RNA, 12 nt, Pseudomonas putida KT2440
cccuccggcccc

SEQ ID NO: 1618595 - RNA, 13 nt, Pseudomonas putida KT2440
cccuccggccccg

SEQ ID NO: 1618596 - RNA, 22 nt, Pseudomonas putida KT2440
cccuccuucagguaauccacca

SEQ ID NO: 1618597 - RNA, 20 nt, Pseudomonas putida KT2440
cccucgaacagcgccggcag

SEQ ID NO: 1618598 - RNA, 18 nt, Pseudomonas putida KT2440
cccucgguuucucacccc

SEQ ID NO: 1618599 - RNA, 21 nt, Pseudomonas putida KT2440
cccucgcggcggcuaagcgcc

SEQ ID NO: 1618600 - RNA, 15 nt, Pseudomonas putida KT2440
cccucgcugcccaac

SEQ ID NO: 1618601 - RNA, 20 nt, Pseudomonas putida KT2440
cccucgcugcccaacgccug

SEQ ID NO: 1618602 - RNA, 15 nt, Pseudomonas putida KT2440
cccucauucaaagcc

SEQ ID NO: 1618603 - RNA, 17 nt, Pseudomonas putida KT2440
cccucauucgcccgcac

SEQ ID NO: 1618604 - RNA, 21 nt, Pseudomonas putida KT2440
cccucauucgcccgcaccgcc

SEQ ID NO: 1618605 - RNA, 22 nt, Pseudomonas putida KT2440
cccuccccauacgaaguccggg

SEQ ID NO: 1618606 - RNA, 16 nt, Pseudomonas putida KT2440
cccuccccgcgccgcc

SEQ ID NO: 1618607 - RNA, 17 nt, Pseudomonas putida KT2440
cccuccgccugcggcac

SEQ ID NO: 1618608 - RNA, 15 nt, Pseudomonas putida KT2440
cccucacgcgccagg

SEQ ID NO: 1618609 - RNA, 19 nt, Pseudomonas putida KT2440
cccucacgcgccaggucgg

SEQ ID NO: 1618610 - RNA, 17 nt, Pseudomonas putida KT2440
cccucaccaacugccug

SEQ ID NO: 1618611 - RNA, 11 nt, Pseudomonas putida KT2440
cccucacccac

SEQ ID NO: 1618612 - RNA, 15 nt, Pseudomonas putida KT2440
cccucagcccaguac

SEQ ID NO: 1618613 - RNA, 16 nt, Pseudomonas putida KT2440
cccucagcccaguacc

SEQ ID NO: 1618614 - RNA, 17 nt, Pseudomonas putida KT2440
cccucaacccucgccca

SEQ ID NO: 1618615 - RNA, 18 nt, Pseudomonas putida KT2440
cccucaacccucgcccag

SEQ ID NO: 1618616 - RNA, 19 nt, Pseudomonas putida KT2440
cccucaacccucgcccaga

SEQ ID NO: 1618617 - RNA, 21 nt, Pseudomonas putida KT2440
cccgucugcgugcacccaacc

SEQ ID NO: 1618618 - RNA, 19 nt, Pseudomonas putida KT2440
cccgugaagcgcacuuggc

SEQ ID NO: 1618619 - RNA, 16 nt, Pseudomonas putida KT2440
cccgugcaucugcucc

SEQ ID NO: 1618620 - RNA, 21 nt, Pseudomonas putida KT2440
cccgugcaucugcucccccag

SEQ ID NO: 1618621 - RNA, 15 nt, Pseudomonas putida KT2440
cccguggcagccccc

SEQ ID NO: 1618622 - RNA, 15 nt, Pseudomonas putida KT2440
cccgugccugccugc

SEQ ID NO: 1618623 - RNA, 16 nt, Pseudomonas putida KT2440
cccgugccugccugca

SEQ ID NO: 1618624 - RNA, 20 nt, Pseudomonas putida KT2440
cccguguacgacugccgccc

SEQ ID NO: 1618625 - RNA, 21 nt, Pseudomonas putida KT2440
cccguguacgacugccgcccu

SEQ ID NO: 1618626 - RNA, 23 nt, Pseudomonas putida KT2440
cccuacgaacaaauccgcgccga

SEQ ID NO: 1618627 - RNA, 14 nt, Pseudomonas putida KT2440
cccuacccccuccu

SEQ ID NO: 1618628 - RNA, 20 nt, Pseudomonas putida KT2440
cccuaugcgugaaacgcagc

SEQ ID NO: 1618629 - RNA, 23 nt, Pseudomonas putida KT2440
cccuaugcgugaaacgcagcuuu

SEQ ID NO: 1618630 - RNA, 16 nt, Pseudomonas putida KT2440
cccuaucucuccgcca

SEQ ID NO: 1618631 - RNA, 22 nt, Pseudomonas putida KT2440
cccguucuggccuuggcgugca

SEQ ID NO: 1618632 - RNA, 14 nt, Pseudomonas putida KT2440
cccgccgcccccca

SEQ ID NO: 1618633 - RNA, 15 nt, Pseudomonas putida KT2440
cccggcucaccgcag

SEQ ID NO: 1618634 - RNA, 17 nt, Pseudomonas putida KT2440
cccgccgguugcgcagc

SEQ ID NO: 1618635 - RNA, 19 nt, Pseudomonas putida KT2440
cccgccgguugcgcagccg

SEQ ID NO: 1618636 - RNA, 19 nt, Pseudomonas putida KT2440
cccggcuuucucaagccug

SEQ ID NO: 1618637 - RNA, 20 nt, Pseudomonas putida KT2440
cccggcuuucucaagccugc

SEQ ID NO: 1618638 - RNA, 19 nt, Pseudomonas putida KT2440
cccgggcagcgggcucgcc

SEQ ID NO: 1618639 - RNA, 22 nt, Pseudomonas putida KT2440
cccgggcagcgggcucgcccac

SEQ ID NO: 1618640 - RNA, 20 nt, Pseudomonas putida KT2440
cccgggaucaccgcaagcug

SEQ ID NO: 1618641 - RNA, 17 nt, Pseudomonas putida KT2440
cccggcuccgcgcaagc

SEQ ID NO: 1618642 - RNA, 15 nt, Pseudomonas putida KT2440
cccggcuaucucagg

SEQ ID NO: 1618643 - RNA, 15 nt, Pseudomonas putida KT2440
cccggcugaaauggc

SEQ ID NO: 1618644 - RNA, 20 nt, Pseudomonas putida KT2440
cccggcuccacaccccaagc

SEQ ID NO: 1618645 - RNA, 12 nt, Pseudomonas putida KT2440
cccggcuucaca

SEQ ID NO: 1618646 - RNA, 15 nt, Pseudomonas putida KT2440
cccgggccagccacu

SEQ ID NO: 1618647 - RNA, 16 nt, Pseudomonas putida KT2440
cccgguggcgcggccg

SEQ ID NO: 1618648 - RNA, 20 nt, Pseudomonas putida KT2440
cccgguggcgcggccgggcu

SEQ ID NO: 1618649 - RNA, 21 nt, Pseudomonas putida KT2440
cccggugcccuugccgccccg

SEQ ID NO: 1618650 - RNA, 13 nt, Pseudomonas putida KT2440
cccggugcaagcc

SEQ ID NO: 1618651 - RNA, 20 nt, Pseudomonas putida KT2440
cccggugcaaggucaaacuc

SEQ ID NO: 1618652 - RNA, 21 nt, Pseudomonas putida KT2440
cccggugcauccaacgcugcc

SEQ ID NO: 1618653 - RNA, 16 nt, Pseudomonas putida KT2440
cccggugccggccaau

SEQ ID NO: 1618654 - RNA, 18 nt, Pseudomonas putida KT2440
cccggugguacagacaau

SEQ ID NO: 1618655 - RNA, 16 nt, Pseudomonas putida KT2440
cccguaugcauccgcc

SEQ ID NO: 1618656 - RNA, 12 nt, Pseudomonas putida KT2440
ccgacccugcug

SEQ ID NO: 1618657 - RNA, 11 nt, Pseudomonas putida KT2440
ccgacccggcc

SEQ ID NO: 1618658 - RNA, 23 nt, Pseudomonas putida KT2440
ccgacccgccuggugccagcggc

SEQ ID NO: 1618659 - RNA, 13 nt, Pseudomonas putida KT2440
ccgaccaccgccu

SEQ ID NO: 1618660 - RNA, 19 nt, Pseudomonas putida KT2440
ccgacauugaucggcgucg

SEQ ID NO: 1618661 - RNA, 18 nt, Pseudomonas putida KT2440
ccgacacgggguguugcu

SEQ ID NO: 1618662 - RNA, 23 nt, Pseudomonas putida KT2440
ccgacagccucaaggccggcagc

SEQ ID NO: 1618663 - RNA, 12 nt, Pseudomonas putida KT2440
ccgacagcaacg

SEQ ID NO: 1618664 - RNA, 20 nt, Pseudomonas putida KT2440
ccgacaggccgugaaccauc

SEQ ID NO: 1618665 - RNA, 17 nt, Pseudomonas putida KT2440
ccgacagcuugcccagc

SEQ ID NO: 1618666 - RNA, 21 nt, Pseudomonas putida KT2440
ccgacaguucgaaaccacccu

SEQ ID NO: 1618667 - RNA, 14 nt, Pseudomonas putida KT2440
ccgaccggucggcc

SEQ ID NO: 1618668 - RNA, 16 nt, Pseudomonas putida KT2440
ccgaccuugggccggc

SEQ ID NO: 1618669 - RNA, 19 nt, Pseudomonas putida KT2440
ccgacgauuucuccccagu

SEQ ID NO: 1618670 - RNA, 16 nt, Pseudomonas putida KT2440
ccgacgauuucugccg

SEQ ID NO: 1618671 - RNA, 17 nt, Pseudomonas putida KT2440
ccgacgcgacccgucca

SEQ ID NO: 1618672 - RNA, 15 nt, Pseudomonas putida KT2440
ccgagaaugaaacuc

SEQ ID NO: 1618673 - RNA, 15 nt, Pseudomonas putida KT2440
ccgagaacaggcggc

SEQ ID NO: 1618674 - RNA, 17 nt, Pseudomonas putida KT2440
ccgagaacaggcggccc

SEQ ID NO: 1618675 - RNA, 23 nt, Pseudomonas putida KT2440
ccgagccaaccgcuucaccgcgc

SEQ ID NO: 1618676 - RNA, 16 nt, Pseudomonas putida KT2440
ccgagcccccgcugcu

SEQ ID NO: 1618677 - RNA, 19 nt, Pseudomonas putida KT2440
ccgaacgggccaccaaagg

SEQ ID NO: 1618678 - RNA, 21 nt, Pseudomonas putida KT2440
ccgaaaccgccagccaaccgc

SEQ ID NO: 1618679 - RNA, 21 nt, Pseudomonas putida KT2440
ccgaaacugcgcucaaccagc

SEQ ID NO: 1618680 - RNA, 22 nt, Pseudomonas putida KT2440
ccgaaacugcgcucaaccagcc

SEQ ID NO: 1618681 - RNA, 19 nt, Pseudomonas putida KT2440
ccgaaacguagucgaccag

SEQ ID NO: 1618682 - RNA, 14 nt, Pseudomonas putida KT2440
ccgaaaccacugcu

SEQ ID NO: 1618683 - RNA, 15 nt, Pseudomonas putida KT2440
ccgaaaccagccccu

SEQ ID NO: 1618684 - RNA, 13 nt, Pseudomonas putida KT2440
ccgaaaccaugca

SEQ ID NO: 1618685 - RNA, 15 nt, Pseudomonas putida KT2440
ccgaaaggugcagca

SEQ ID NO: 1618686 - RNA, 17 nt, Pseudomonas putida KT2440
ccgaagcgcagguccag

SEQ ID NO: 1618687 - RNA, 18 nt, Pseudomonas putida KT2440
ccgaagcagccgccgccu

SEQ ID NO: 1618688 - RNA, 9 nt, Pseudomonas putida KT2440
aaacagcau

SEQ ID NO: 1618689 - RNA, 17 nt, Pseudomonas putida KT2440
ccgaaaaagccuacacc

SEQ ID NO: 1618690 - RNA, 12 nt, Pseudomonas putida KT2440
cccuggguuuau

SEQ ID NO: 1618691 - RNA, 21 nt, Pseudomonas putida KT2440
cccugguacagauggcacccc

SEQ ID NO: 1618692 - RNA, 23 nt, Pseudomonas putida KT2440
cccuggucauccaguggcgugug

SEQ ID NO: 1618693 - RNA, 16 nt, Pseudomonas putida KT2440
cccuucacgcucaugc

SEQ ID NO: 1618694 - RNA, 13 nt, Pseudomonas putida KT2440
cccuucacggcuu

SEQ ID NO: 1618695 - RNA, 20 nt, Pseudomonas putida KT2440
cccuucauacagcgccucca

SEQ ID NO: 1618696 - RNA, 22 nt, Pseudomonas putida KT2440
cccuucauacagcgccuccagc

SEQ ID NO: 1618697 - RNA, 20 nt, Pseudomonas putida KT2440
ccgcauggcaaucgggccgg

SEQ ID NO: 1618698 - RNA, 21 nt, Pseudomonas putida KT2440
ccgcauauacgccggcgucgg

SEQ ID NO: 1618699 - RNA, 16 nt, Pseudomonas putida KT2440
ccgcauaaccaccacc

SEQ ID NO: 1618700 - RNA, 14 nt, Pseudomonas putida KT2440
ccgcauccaugccg

SEQ ID NO: 1618701 - RNA, 14 nt, Pseudomonas putida KT2440
ccgcauccagcacu

SEQ ID NO: 1618702 - RNA, 20 nt, Pseudomonas putida KT2440
ccgcaggcgcccccugggcg

SEQ ID NO: 1618703 - RNA, 19 nt, Pseudomonas putida KT2440
ccgcagguuucagauacug

SEQ ID NO: 1618704 - RNA, 22 nt, Pseudomonas putida KT2440
ccgcaggccaaugcagcuuuga

SEQ ID NO: 1618705 - RNA, 14 nt, Pseudomonas putida KT2440
ccgcaggccgcagc

SEQ ID NO: 1618706 - RNA, 15 nt, Pseudomonas putida KT2440
ccgcaggccgcagcc

SEQ ID NO: 1618707 - RNA, 18 nt, Pseudomonas putida KT2440
ccgcaggaauaacuggcc

SEQ ID NO: 1618708 - RNA, 17 nt, Pseudomonas putida KT2440
ccgcaggcgacgagcca

SEQ ID NO: 1618709 - RNA, 20 nt, Pseudomonas putida KT2440
ccgcagcuucaacuccacca

SEQ ID NO: 1618710 - RNA, 13 nt, Pseudomonas putida KT2440
ccgcagagcggcc

SEQ ID NO: 1618711 - RNA, 15 nt, Pseudomonas putida KT2440
ccgcagagcggcccu

SEQ ID NO: 1618712 - RNA, 16 nt, Pseudomonas putida KT2440
ccgauguuggucacca

SEQ ID NO: 1618713 - RNA, 20 nt, Pseudomonas putida KT2440
ccgauugccucaggccccag

SEQ ID NO: 1618714 - RNA, 19 nt, Pseudomonas putida KT2440
ccgauugccugggcgagcc

SEQ ID NO: 1618715 - RNA, 16 nt, Pseudomonas putida KT2440
ccgauugcgaguugau

SEQ ID NO: 1618716 - RNA, 16 nt, Pseudomonas putida KT2440
ccgaugucggcgugca

SEQ ID NO: 1618717 - RNA, 19 nt, Pseudomonas putida KT2440
ccgaugucggcgugcacca

SEQ ID NO: 1618718 - RNA, 21 nt, Pseudomonas putida KT2440
ccgagcugauccgccuggccc

SEQ ID NO: 1618719 - RNA, 13 nt, Pseudomonas putida KT2440
ccgcaauggcgcc

SEQ ID NO: 1618720 - RNA, 20 nt, Pseudomonas putida KT2440
ccgcacaaggccgcucccac

SEQ ID NO: 1618721 - RNA, 20 nt, Pseudomonas putida KT2440
ccgcacuccccaucagcagc

SEQ ID NO: 1618722 - RNA, 14 nt, Pseudomonas putida KT2440
ccgcacugcaaugc

SEQ ID NO: 1618723 - RNA, 14 nt, Pseudomonas putida KT2440
ccgcaccaaagaaa

SEQ ID NO: 1618724 - RNA, 22 nt, Pseudomonas putida KT2440
ccgcacaucacggcgcaggccg

SEQ ID NO: 1618725 - RNA, 21 nt, Pseudomonas putida KT2440
ccgcacaggcauaccgcaaca

SEQ ID NO: 1618726 - RNA, 17 nt, Pseudomonas putida KT2440
ccgccaggcggucgccc

SEQ ID NO: 1618727 - RNA, 20 nt, Pseudomonas putida KT2440
ccgccaggcucuccagccgc

SEQ ID NO: 1618728 - RNA, 21 nt, Pseudomonas putida KT2440
ccgccagguccgguaacuggc

SEQ ID NO: 1618729 - RNA, 22 nt, Pseudomonas putida KT2440
ccgccagguccgguaacuggcc

SEQ ID NO: 1618730 - RNA, 16 nt, Pseudomonas putida KT2440
ccgccaguagcaauca

SEQ ID NO: 1618731 - RNA, 21 nt, Pseudomonas putida KT2440
ccgccaguaggcugcagccuu

SEQ ID NO: 1618732 - RNA, 17 nt, Pseudomonas putida KT2440
ccgccaggcagcagacu

SEQ ID NO: 1618733 - RNA, 16 nt, Pseudomonas putida KT2440
ccgccaggcccaccac

SEQ ID NO: 1618734 - RNA, 18 nt, Pseudomonas putida KT2440
ccgccaggauggcaccga

SEQ ID NO: 1618735 - RNA, 23 nt, Pseudomonas putida KT2440
ccgccagcggcaguugcaggcgc

SEQ ID NO: 1618736 - RNA, 11 nt, Pseudomonas putida KT2440
ccgccagcggc

SEQ ID NO: 1618737 - RNA, 20 nt, Pseudomonas putida KT2440
aaaccagcagcgccugcagc

SEQ ID NO: 1618738 - RNA, 15 nt, Pseudomonas putida KT2440
ccgccaccccaggcc

SEQ ID NO: 1618739 - RNA, 12 nt, Pseudomonas putida KT2440
ccgccacccccg

SEQ ID NO: 1618740 - RNA, 12 nt, Pseudomonas putida KT2440
ccgccaccagcg

SEQ ID NO: 1618741 - RNA, 13 nt, Pseudomonas putida KT2440
ccgccaccccggc

SEQ ID NO: 1618742 - RNA, 13 nt, Pseudomonas putida KT2440
ccgccaaggcacg

SEQ ID NO: 1618743 - RNA, 20 nt, Pseudomonas putida KT2440
ccgccaacuguuucugcucu

SEQ ID NO: 1618744 - RNA, 23 nt, Pseudomonas putida KT2440
ccgccaaaaaauccgccuggccg

SEQ ID NO: 1618745 - RNA, 21 nt, Pseudomonas putida KT2440
ccgccacaccugccaggccaa

SEQ ID NO: 1618746 - RNA, 14 nt, Pseudomonas putida KT2440
ccgcauuggguggc

SEQ ID NO: 1618747 - RNA, 21 nt, Pseudomonas putida KT2440
ccgcauuggguggccccggcc

SEQ ID NO: 1618748 - RNA, 17 nt, Pseudomonas putida KT2440
ccgccaaaccccagcaa

SEQ ID NO: 1618749 - RNA, 21 nt, Pseudomonas putida KT2440
ccgccaaaccccagcaaggca

SEQ ID NO: 1618750 - RNA, 20 nt, Pseudomonas putida KT2440
ccgccaacaccaccuccacc

SEQ ID NO: 1618751 - RNA, 14 nt, Pseudomonas putida KT2440
ccgccaaccccucc

SEQ ID NO: 1618752 - RNA, 16 nt, Pseudomonas putida KT2440
ccgccaacccgauccc

SEQ ID NO: 1618753 - RNA, 20 nt, Pseudomonas putida KT2440
ccgccaacgaaucagccagc

SEQ ID NO: 1618754 - RNA, 21 nt, Pseudomonas putida KT2440
ccgccaacgaaucagccagcc

SEQ ID NO: 1618755 - RNA, 21 nt, Pseudomonas putida KT2440
ccgccagccaacgcugguaga

SEQ ID NO: 1618756 - RNA, 14 nt, Pseudomonas putida KT2440
ccgccagcaggcca

SEQ ID NO: 1618757 - RNA, 16 nt, Pseudomonas putida KT2440
ccgccagcccgccaca

SEQ ID NO: 1618758 - RNA, 12 nt, Pseudomonas putida KT2440
ccgccagccccg

SEQ ID NO: 1618759 - RNA, 18 nt, Pseudomonas putida KT2440
ccgccagccccgccaaca

SEQ ID NO: 1618760 - RNA, 16 nt, Pseudomonas putida KT2440
ccgccagcagcugguc

SEQ ID NO: 1618761 - RNA, 14 nt, Pseudomonas putida KT2440
ccgccaccucgcua

SEQ ID NO: 1618762 - RNA, 17 nt, Pseudomonas putida KT2440
ccgccacgaucgacaac

SEQ ID NO: 1618763 - RNA, 14 nt, Pseudomonas putida KT2440
ccgccagaccaccu

SEQ ID NO: 1618764 - RNA, 17 nt, Pseudomonas putida KT2440
ccgccagaccaccucau

SEQ ID NO: 1618765 - RNA, 20 nt, Pseudomonas putida KT2440
aaacccagguacgaagccau

SEQ ID NO: 1618766 - RNA, 18 nt, Pseudomonas putida KT2440
aaacccggccagcagguc

SEQ ID NO: 1618767 - RNA, 14 nt, Pseudomonas putida KT2440
aaaccccagcaagg

SEQ ID NO: 1618768 - RNA, 16 nt, Pseudomonas putida KT2440
aaaccccagcaaggca

SEQ ID NO: 1618769 - RNA, 15 nt, Pseudomonas putida KT2440
aaacccgacaacagc

SEQ ID NO: 1618770 - RNA, 11 nt, Pseudomonas putida KT2440
aaacccgcucc

SEQ ID NO: 1618771 - RNA, 20 nt, Pseudomonas putida KT2440
aaacccgcuccuacaaggua

SEQ ID NO: 1618772 - RNA, 20 nt, Pseudomonas putida KT2440
aaacccgcgccuacaaaaca

SEQ ID NO: 1618773 - RNA, 14 nt, Pseudomonas putida KT2440
ccgccgaccaggug

SEQ ID NO: 1618774 - RNA, 19 nt, Pseudomonas putida KT2440
ccgcccuugagcuucagcg

SEQ ID NO: 1618775 - RNA, 15 nt, Pseudomonas putida KT2440
ccgccgaacaggccg

SEQ ID NO: 1618776 - RNA, 21 nt, Pseudomonas putida KT2440
ccgcccggucauacagcccua

SEQ ID NO: 1618777 - RNA, 20 nt, Pseudomonas putida KT2440
ccgcccugagccaaggccgc

SEQ ID NO: 1618778 - RNA, 21 nt, Pseudomonas putida KT2440
ccgcccugagccaaggccgcc

SEQ ID NO: 1618779 - RNA, 20 nt, Pseudomonas putida KT2440
ccgcccugguccgugagaaa

SEQ ID NO: 1618780 - RNA, 13 nt, Pseudomonas putida KT2440
ccgcccuccagcc

SEQ ID NO: 1618781 - RNA, 18 nt, Pseudomonas putida KT2440
ccgccauugcccagccug

SEQ ID NO: 1618782 - RNA, 23 nt, Pseudomonas putida KT2440
ccgccauugcccagccugcccgc

SEQ ID NO: 1618783 - RNA, 18 nt, Pseudomonas putida KT2440
ccgccauucuucuccagg

SEQ ID NO: 1618784 - RNA, 18 nt, Pseudomonas putida KT2440
ccgccauugacuaccagg

SEQ ID NO: 1618785 - RNA, 21 nt, Pseudomonas putida KT2440
ccgccauugacuaccagguag

SEQ ID NO: 1618786 - RNA, 22 nt, Pseudomonas putida KT2440
ccgccauugcuugacuauuucu

SEQ ID NO: 1618787 - RNA, 12 nt, Pseudomonas putida KT2440
ccgcccagcagc

SEQ ID NO: 1618788 - RNA, 13 nt, Pseudomonas putida KT2440
ccgcccacgccgc

SEQ ID NO: 1618789 - RNA, 13 nt, Pseudomonas putida KT2440
ccgcccaggucau

SEQ ID NO: 1618790 - RNA, 13 nt, Pseudomonas putida KT2440
ccgcccagcuggc

SEQ ID NO: 1618791 - RNA, 18 nt, Pseudomonas putida KT2440
ccgccccccaccuggccc

SEQ ID NO: 1618792 - RNA, 13 nt, Pseudomonas putida KT2440
ccgccccuccacc

SEQ ID NO: 1618793 - RNA, 13 nt, Pseudomonas putida KT2440
ccgccccgcccga

SEQ ID NO: 1618794 - RNA, 17 nt, Pseudomonas putida KT2440
ccgcccgcgccgcccag

SEQ ID NO: 1618795 - RNA, 22 nt, Pseudomonas putida KT2440
ccgcccgcguccggcuugagac

SEQ ID NO: 1618796 - RNA, 21 nt, Pseudomonas putida KT2440
ccgcccgggcuuuguguugau

SEQ ID NO: 1618797 - RNA, 19 nt, Pseudomonas putida KT2440
ccgccgcuuuguuugcugg

SEQ ID NO: 1618798 - RNA, 21 nt, Pseudomonas putida KT2440
ccgccggcaacuccuccagcc

SEQ ID NO: 1618799 - RNA, 15 nt, Pseudomonas putida KT2440
ccgccgcccagguca

SEQ ID NO: 1618800 - RNA, 15 nt, Pseudomonas putida KT2440
ccgccgccaccagcg

SEQ ID NO: 1618801 - RNA, 22 nt, Pseudomonas putida KT2440
ccgccgccagaccaccucaucc

SEQ ID NO: 1618802 - RNA, 18 nt, Pseudomonas putida KT2440
ccgccgcaaugucagcgg

SEQ ID NO: 1618803 - RNA, 20 nt, Pseudomonas putida KT2440
ccgccggcucgucacugccg

SEQ ID NO: 1618804 - RNA, 21 nt, Pseudomonas putida KT2440
ccgccgguuucucgcagcagc

SEQ ID NO: 1618805 - RNA, 14 nt, Pseudomonas putida KT2440
ccgccucccaggac

SEQ ID NO: 1618806 - RNA, 20 nt, Pseudomonas putida KT2440
ccgccucccaggacuucagc

SEQ ID NO: 1618807 - RNA, 20 nt, Pseudomonas putida KT2440
ccgccuccggcgcuuugcgc

SEQ ID NO: 1618808 - RNA, 21 nt, Pseudomonas putida KT2440
ccgccguugaaagacugcucc

SEQ ID NO: 1618809 - RNA, 21 nt, Pseudomonas putida KT2440
ccgccguucaggcgccugccg

SEQ ID NO: 1618810 - RNA, 18 nt, Pseudomonas putida KT2440
ccgccgucaucgaaccgu

SEQ ID NO: 1618811 - RNA, 16 nt, Pseudomonas putida KT2440
ccgccgucaccgccgc

SEQ ID NO: 1618812 - RNA, 14 nt, Pseudomonas putida KT2440
ccgugcagcaccgc

SEQ ID NO: 1618813 - RNA, 22 nt, Pseudomonas putida KT2440
ccgugcaaaugccccgggcagg

SEQ ID NO: 1618814 - RNA, 15 nt, Pseudomonas putida KT2440
ccgugcccaccagcg

SEQ ID NO: 1618815 - RNA, 17 nt, Pseudomonas putida KT2440
ccgugcccaccagcgcu

SEQ ID NO: 1618816 - RNA, 12 nt, Pseudomonas putida KT2440
ccgugcccggca

SEQ ID NO: 1618817 - RNA, 13 nt, Pseudomonas putida KT2440
ccgugcccggcau

SEQ ID NO: 1618818 - RNA, 18 nt, Pseudomonas putida KT2440
ccgugcccggcauccgcc

SEQ ID NO: 1618819 - RNA, 14 nt, Pseudomonas putida KT2440
ccgugcuugcgggc

SEQ ID NO: 1618820 - RNA, 18 nt, Pseudomonas putida KT2440
ccguggcaacgccacacu

SEQ ID NO: 1618821 - RNA, 14 nt, Pseudomonas putida KT2440
ccguggcaaggccc

SEQ ID NO: 1618822 - RNA, 16 nt, Pseudomonas putida KT2440
ccguggcaaggcccgc

SEQ ID NO: 1618823 - RNA, 13 nt, Pseudomonas putida KT2440
ccguggcagcccc

SEQ ID NO: 1618824 - RNA, 14 nt, Pseudomonas putida KT2440
ccgugcucaggcgg

SEQ ID NO: 1618825 - RNA, 17 nt, Pseudomonas putida KT2440
ccguggcguauugcugg

SEQ ID NO: 1618826 - RNA, 17 nt, Pseudomonas putida KT2440
ccguggcgaucccugua

SEQ ID NO: 1618827 - RNA, 17 nt, Pseudomonas putida KT2440
ccguggucgugaggugc

SEQ ID NO: 1618828 - RNA, 17 nt, Pseudomonas putida KT2440
ccguggguugaacaggu

SEQ ID NO: 1618829 - RNA, 16 nt, Pseudomonas putida KT2440
ccgucgccucaccucc

SEQ ID NO: 1618830 - RNA, 13 nt, Pseudomonas putida KT2440
ccgucgccucccc

SEQ ID NO: 1618831 - RNA, 15 nt, Pseudomonas putida KT2440
ccgucgcgcccaccg

SEQ ID NO: 1618832 - RNA, 18 nt, Pseudomonas putida KT2440
ccggugugugcccaccgc

SEQ ID NO: 1618833 - RNA, 15 nt, Pseudomonas putida KT2440
ccgguguucgcgggc

SEQ ID NO: 1618834 - RNA, 17 nt, Pseudomonas putida KT2440
ccgguguucuucaggca

SEQ ID NO: 1618835 - RNA, 23 nt, Pseudomonas putida KT2440
ccgguugcgcagccggccuugcu

SEQ ID NO: 1618836 - RNA, 15 nt, Pseudomonas putida KT2440
ccgguucgccgccgg

SEQ ID NO: 1618837 - RNA, 14 nt, Pseudomonas putida KT2440
ccgguucgccccca

SEQ ID NO: 1618838 - RNA, 18 nt, Pseudomonas putida KT2440
ccgguucgcccccacggg

SEQ ID NO: 1618839 - RNA, 21 nt, Pseudomonas putida KT2440
ccgucgaaugcgacugaggca

SEQ ID NO: 1618840 - RNA, 12 nt, Pseudomonas putida KT2440
ccgucgaccagg

SEQ ID NO: 1618841 - RNA, 19 nt, Pseudomonas putida KT2440
ccgguuggggacggcagcc

SEQ ID NO: 1618842 - RNA, 14 nt, Pseudomonas putida KT2440
ccguuugaagccaa

SEQ ID NO: 1618843 - RNA, 23 nt, Pseudomonas putida KT2440
ccuaacggggggcucagcccgcc

SEQ ID NO: 1618844 - RNA, 19 nt, Pseudomonas putida KT2440
ccuaagggcuagaugcugg

SEQ ID NO: 1618845 - RNA, 24 nt, Pseudomonas putida KT2440
ccuaagggcuagaugcugguucga

SEQ ID NO: 1618846 - RNA, 16 nt, Pseudomonas putida KT2440
ccguguucccagcacc

SEQ ID NO: 1618847 - RNA, 17 nt, Pseudomonas putida KT2440
ccguuacauccaugccu

SEQ ID NO: 1618848 - RNA, 18 nt, Pseudomonas putida KT2440
ccguuagguuuucggcgc

SEQ ID NO: 1618849 - RNA, 18 nt, Pseudomonas putida KT2440
ccguuaguucgugcaccc

SEQ ID NO: 1618850 - RNA, 18 nt, Pseudomonas putida KT2440
ccguuccuacgcaggcac

SEQ ID NO: 1618851 - RNA, 22 nt, Pseudomonas putida KT2440
ccguucgcggucggucagcacc

SEQ ID NO: 1618852 - RNA, 20 nt, Pseudomonas putida KT2440
ccguucaccguugccgccac

SEQ ID NO: 1618853 - RNA, 21 nt, Pseudomonas putida KT2440
ccguugaaagacugcuccggc

SEQ ID NO: 1618854 - RNA, 21 nt, Pseudomonas putida KT2440
ccguucuggccuuggcgugca

SEQ ID NO: 1618855 - RNA, 21 nt, Pseudomonas putida KT2440
ccguugaggguggcaaugcuc

SEQ ID NO: 1618856 - RNA, 22 nt, Pseudomonas putida KT2440
ccguugaccagguuuaccggcc

SEQ ID NO: 1618857 - RNA, 23 nt, Pseudomonas putida KT2440
ccguugaucagcgacaccgccaa

SEQ ID NO: 1618858 - RNA, 18 nt, Pseudomonas putida KT2440
ccguuguucacggucagg

SEQ ID NO: 1618859 - RNA, 19 nt, Pseudomonas putida KT2440
ccguuucauugccgugcuc

SEQ ID NO: 1618860 - RNA, 17 nt, Pseudomonas putida KT2440
ccguuggcaucugcugg

SEQ ID NO: 1618861 - RNA, 20 nt, Pseudomonas putida KT2440
ccguugcggucgguggucag

SEQ ID NO: 1618862 - RNA, 17 nt, Pseudomonas putida KT2440
ccucgagcgcuuucagc

SEQ ID NO: 1618863 - RNA, 22 nt, Pseudomonas putida KT2440
ccucgagguacgagucagcgug

SEQ ID NO: 1618864 - RNA, 14 nt, Pseudomonas putida KT2440
ccucgagugcgcug

SEQ ID NO: 1618865 - RNA, 20 nt, Pseudomonas putida KT2440
ccucgacgccuuggcgcagc

SEQ ID NO: 1618866 - RNA, 16 nt, Pseudomonas putida KT2440
ccucgacgcagacaaa

SEQ ID NO: 1618867 - RNA, 18 nt, Pseudomonas putida KT2440
ccucgaacgacagcugca

SEQ ID NO: 1618868 - RNA, 15 nt, Pseudomonas putida KT2440
ccucgaaguaggcaa

SEQ ID NO: 1618869 - RNA, 16 nt, Pseudomonas putida KT2440
ccucgacaaucgccag

SEQ ID NO: 1618870 - RNA, 14 nt, Pseudomonas putida KT2440
ccucgaccuggccc

SEQ ID NO: 1618871 - RNA, 15 nt, Pseudomonas putida KT2440
ccucgaccuggcccg

SEQ ID NO: 1618872 - RNA, 18 nt, Pseudomonas putida KT2440
ccucgacccgcccgccau

SEQ ID NO: 1618873 - RNA, 16 nt, Pseudomonas putida KT2440
ccucgacccagccacc

SEQ ID NO: 1618874 - RNA, 21 nt, Pseudomonas putida KT2440
ccucgaccacgaucuuggcca

SEQ ID NO: 1618875 - RNA, 22 nt, Pseudomonas putida KT2440
ccucgaccaggcgcucgcucca

SEQ ID NO: 1618876 - RNA, 19 nt, Pseudomonas putida KT2440
ccucgaugcccuccagccc

SEQ ID NO: 1618877 - RNA, 21 nt, Pseudomonas putida KT2440
ccucgaugucuuccagaccag

SEQ ID NO: 1618878 - RNA, 22 nt, Pseudomonas putida KT2440
ccucgaugucuuccagaccaga

SEQ ID NO: 1618879 - RNA, 19 nt, Pseudomonas putida KT2440
ccucgaugguuaucuucuc

SEQ ID NO: 1618880 - RNA, 21 nt, Pseudomonas putida KT2440
ccucgaucgucgacaacgcac

SEQ ID NO: 1618881 - RNA, 23 nt, Pseudomonas putida KT2440
ccucgcccuugucagccgccgcu

SEQ ID NO: 1618882 - RNA, 17 nt, Pseudomonas putida KT2440
ccucggccacaucggca

SEQ ID NO: 1618883 - RNA, 13 nt, Pseudomonas putida KT2440
ccucggccaccug

SEQ ID NO: 1618884 - RNA, 16 nt, Pseudomonas putida KT2440
ccucggcaaucugcag

SEQ ID NO: 1618885 - RNA, 20 nt, Pseudomonas putida KT2440
ccucggcaaucugcagcagc

SEQ ID NO: 1618886 - RNA, 23 nt, Pseudomonas putida KT2440
ccucgcgcaacaccgccagcggg

SEQ ID NO: 1618887 - RNA, 12 nt, Pseudomonas putida KT2440
ccuccugcugcu

SEQ ID NO: 1618888 - RNA, 21 nt, Pseudomonas putida KT2440
ccuccgggucaggccgaugcg

SEQ ID NO: 1618889 - RNA, 22 nt, Pseudomonas putida KT2440
ccuccggccccggugcauccaa

SEQ ID NO: 1618890 - RNA, 23 nt, Pseudomonas putida KT2440
ccuccugcggcagauccugcagc

SEQ ID NO: 1618891 - RNA, 21 nt, Pseudomonas putida KT2440
ccuccaggucauccgcacgca

SEQ ID NO: 1618892 - RNA, 23 nt, Pseudomonas putida KT2440
ccuccaggucauccgcacgcaug

SEQ ID NO: 1618893 - RNA, 14 nt, Pseudomonas putida KT2440
ccuccagcaacauc

SEQ ID NO: 1618894 - RNA, 23 nt, Pseudomonas putida KT2440
ccuccagcuggccaucgacccgc

SEQ ID NO: 1618895 - RNA, 15 nt, Pseudomonas putida KT2440
ccuccacggucagca

SEQ ID NO: 1618896 - RNA, 13 nt, Pseudomonas putida KT2440
ccuccacgccacc

SEQ ID NO: 1618897 - RNA, 16 nt, Pseudomonas putida KT2440
ccuccaacucgcgcau

SEQ ID NO: 1618898 - RNA, 22 nt, Pseudomonas putida KT2440
ccuccaacaaucgcgucagcac

SEQ ID NO: 1618899 - RNA, 14 nt, Pseudomonas putida KT2440
ccucaucaaaccag

SEQ ID NO: 1618900 - RNA, 16 nt, Pseudomonas putida KT2440
ccucagcgcccgcugc

SEQ ID NO: 1618901 - RNA, 14 nt, Pseudomonas putida KT2440
ccucaucaguuccg

SEQ ID NO: 1618902 - RNA, 14 nt, Pseudomonas putida KT2440
ccucauccucgccc

SEQ ID NO: 1618903 - RNA, 18 nt, Pseudomonas putida KT2440
ccucaucgacccuggcau

SEQ ID NO: 1618904 - RNA, 15 nt, Pseudomonas putida KT2440
ccucaucccccggcc

SEQ ID NO: 1618905 - RNA, 20 nt, Pseudomonas putida KT2440
ccucaucccccggcccagcc

SEQ ID NO: 1618906 - RNA, 18 nt, Pseudomonas putida KT2440
ccucaucuacgugcagcu

SEQ ID NO: 1618907 - RNA, 16 nt, Pseudomonas putida KT2440
ccucaucgaugcccgu

SEQ ID NO: 1618908 - RNA, 17 nt, Pseudomonas putida KT2440
ccucaucgaugcccguc

SEQ ID NO: 1618909 - RNA, 19 nt, Pseudomonas putida KT2440
ccucaucgaugcccguccc

SEQ ID NO: 1618910 - RNA, 19 nt, Pseudomonas putida KT2440
ccucaccgacccacaggca

SEQ ID NO: 1618911 - RNA, 14 nt, Pseudomonas putida KT2440
ccucaccaacugcc

SEQ ID NO: 1618912 - RNA, 12 nt, Pseudomonas putida KT2440
ccucaagugccg

SEQ ID NO: 1618913 - RNA, 24 nt, Pseudomonas putida KT2440
ccucaaucacauccacagccucca

SEQ ID NO: 1618914 - RNA, 12 nt, Pseudomonas putida KT2440
ccucaaucacug

SEQ ID NO: 1618915 - RNA, 21 nt, Pseudomonas putida KT2440
ccucaagguaggggcagccag

SEQ ID NO: 1618916 - RNA, 19 nt, Pseudomonas putida KT2440
ccucaaugggcuuccccag

SEQ ID NO: 1618917 - RNA, 21 nt, Pseudomonas putida KT2440
ccuagguaguaaagcccccag

SEQ ID NO: 1618918 - RNA, 15 nt, Pseudomonas putida KT2440
ccuacgcagucagcc

SEQ ID NO: 1618919 - RNA, 16 nt, Pseudomonas putida KT2440
ccuacgcccccagccu

SEQ ID NO: 1618920 - RNA, 17 nt, Pseudomonas putida KT2440
ccuacgcccccagccuu

SEQ ID NO: 1618921 - RNA, 16 nt, Pseudomonas putida KT2440
ccuacgggggggcgca

SEQ ID NO: 1618922 - RNA, 19 nt, Pseudomonas putida KT2440
ccuacggggguucacagcc

SEQ ID NO: 1618923 - RNA, 22 nt, Pseudomonas putida KT2440
ccuacggggguucacagccggc

SEQ ID NO: 1618924 - RNA, 16 nt, Pseudomonas putida KT2440
ccuacgggcaaccgca

SEQ ID NO: 1618925 - RNA, 14 nt, Pseudomonas putida KT2440
ccuacgggcgagcg

SEQ ID NO: 1618926 - RNA, 18 nt, Pseudomonas putida KT2440
ccuacgggcgagcgcgca

SEQ ID NO: 1618927 - RNA, 16 nt, Pseudomonas putida KT2440
ccuaccgccaacgaau

SEQ ID NO: 1618928 - RNA, 21 nt, Pseudomonas putida KT2440
ccuacuccgcucauuggaaaa

SEQ ID NO: 1618929 - RNA, 14 nt, Pseudomonas putida KT2440
ccuacugccgucuu

SEQ ID NO: 1618930 - RNA, 12 nt, Pseudomonas putida KT2440
ccuacagcaacc

SEQ ID NO: 1618931 - RNA, 12 nt, Pseudomonas putida KT2440
ccuacaggcaac

SEQ ID NO: 1618932 - RNA, 13 nt, Pseudomonas putida KT2440
ccuacaggcaacc

SEQ ID NO: 1618933 - RNA, 23 nt, Pseudomonas putida KT2440
ccuacaagguugcgcaagccuca

SEQ ID NO: 1618934 - RNA, 22 nt, Pseudomonas putida KT2440
ccggcaagcccauggcuggcag

SEQ ID NO: 1618935 - RNA, 14 nt, Pseudomonas putida KT2440
ccggcaagcugguc

SEQ ID NO: 1618936 - RNA, 17 nt, Pseudomonas putida KT2440
ccggcaagcuggucagg

SEQ ID NO: 1618937 - RNA, 23 nt, Pseudomonas putida KT2440
ccggcaaggcauccagaaacggc

SEQ ID NO: 1618938 - RNA, 13 nt, Pseudomonas putida KT2440
ccggcaacccggc

SEQ ID NO: 1618939 - RNA, 20 nt, Pseudomonas putida KT2440
ccggcaacuggcacaacccg

SEQ ID NO: 1618940 - RNA, 19 nt, Pseudomonas putida KT2440
ccggcaaacaaaaagcacc

SEQ ID NO: 1618941 - RNA, 14 nt, Pseudomonas putida KT2440
ccggcaaacacauc

SEQ ID NO: 1618942 - RNA, 18 nt, Pseudomonas putida KT2440
ccggauucaacuugggug

SEQ ID NO: 1618943 - RNA, 22 nt, Pseudomonas putida KT2440
ccggaucguugcgggucagcuc

SEQ ID NO: 1618944 - RNA, 17 nt, Pseudomonas putida KT2440
ccggauagagcccggcg

SEQ ID NO: 1618945 - RNA, 22 nt, Pseudomonas putida KT2440
ccgcugugcagcgcucgcugcc

SEQ ID NO: 1618946 - RNA, 14 nt, Pseudomonas putida KT2440
ccgcuucaacagcu

SEQ ID NO: 1618947 - RNA, 21 nt, Pseudomonas putida KT2440
ccgcuucacccucgcgcagca

SEQ ID NO: 1618948 - RNA, 15 nt, Pseudomonas putida KT2440
ccgcuucaccgcgca

SEQ ID NO: 1618949 - RNA, 22 nt, Pseudomonas putida KT2440
ccgccuaugaaaccgagcgccg

SEQ ID NO: 1618950 - RNA, 12 nt, Pseudomonas putida KT2440
ccgccucgguac

SEQ ID NO: 1618951 - RNA, 18 nt, Pseudomonas putida KT2440
ccgccucuaccacgccgc

SEQ ID NO: 1618952 - RNA, 17 nt, Pseudomonas putida KT2440
ccgccucgaccuggccc

SEQ ID NO: 1618953 - RNA, 13 nt, Pseudomonas putida KT2440
ccgcuguacacca

SEQ ID NO: 1618954 - RNA, 16 nt, Pseudomonas putida KT2440
ccgcuguacaccagga

SEQ ID NO: 1618955 - RNA, 15 nt, Pseudomonas putida KT2440
ccgcuguucugcccg

SEQ ID NO: 1618956 - RNA, 17 nt, Pseudomonas putida KT2440
ccgcuguucugcccggc

SEQ ID NO: 1618957 - RNA, 21 nt, Pseudomonas putida KT2440
ccgcuguucugcccggcugga

SEQ ID NO: 1618958 - RNA, 20 nt, Pseudomonas putida KT2440
ccgcuguugagcagcagccc

SEQ ID NO: 1618959 - RNA, 20 nt, Pseudomonas putida KT2440
ccggacccugguucuccacg

SEQ ID NO: 1618960 - RNA, 11 nt, Pseudomonas putida KT2440
ccggacagggg

SEQ ID NO: 1618961 - RNA, 18 nt, Pseudomonas putida KT2440
ccgcuucgcggccaagcc

SEQ ID NO: 1618962 - RNA, 15 nt, Pseudomonas putida KT2440
ccggcacgcccgcuc

SEQ ID NO: 1618963 - RNA, 17 nt, Pseudomonas putida KT2440
ccggcacgcccgcuccc

SEQ ID NO: 1618964 - RNA, 14 nt, Pseudomonas putida KT2440
ccggcaccgacagc

SEQ ID NO: 1618965 - RNA, 16 nt, Pseudomonas putida KT2440
ccggcacgcuaccacc

SEQ ID NO: 1618966 - RNA, 14 nt, Pseudomonas putida KT2440
ccggcacuccagcg

SEQ ID NO: 1618967 - RNA, 17 nt, Pseudomonas putida KT2440
ccggcacuccagcgagu

SEQ ID NO: 1618968 - RNA, 13 nt, Pseudomonas putida KT2440
ccggcaccaucuu

SEQ ID NO: 1618969 - RNA, 14 nt, Pseudomonas putida KT2440
ccggcaccaucuuc

SEQ ID NO: 1618970 - RNA, 15 nt, Pseudomonas putida KT2440
ccggcaccgccucua

SEQ ID NO: 1618971 - RNA, 20 nt, Pseudomonas putida KT2440
ccggcaccccuuucuccagc

SEQ ID NO: 1618972 - RNA, 15 nt, Pseudomonas putida KT2440
ccggcaauaccggcc

SEQ ID NO: 1618973 - RNA, 17 nt, Pseudomonas putida KT2440
ccggcaauccuggguga

SEQ ID NO: 1618974 - RNA, 23 nt, Pseudomonas putida KT2440
ccggcaaucucacuuucugcgcu

SEQ ID NO: 1618975 - RNA, 16 nt, Pseudomonas putida KT2440
ccggcaauuucaucca

SEQ ID NO: 1618976 - RNA, 15 nt, Pseudomonas putida KT2440
ccggcacaggaaggc

SEQ ID NO: 1618977 - RNA, 21 nt, Pseudomonas putida KT2440
ccggcacaagcgucccugccc

SEQ ID NO: 1618978 - RNA, 18 nt, Pseudomonas putida KT2440
ccggcagcacgucggcgc

SEQ ID NO: 1618979 - RNA, 13 nt, Pseudomonas putida KT2440
ccggcagcagcaa

SEQ ID NO: 1618980 - RNA, 24 nt, Pseudomonas putida KT2440
ccggcagagccggugccauccacc

SEQ ID NO: 1618981 - RNA, 16 nt, Pseudomonas putida KT2440
ccggcaggucggcaac

SEQ ID NO: 1618982 - RNA, 17 nt, Pseudomonas putida KT2440
ccggcagguugcuggcc

SEQ ID NO: 1618983 - RNA, 18 nt, Pseudomonas putida KT2440
ccggcagguugcuggccu

SEQ ID NO: 1618984 - RNA, 19 nt, Pseudomonas putida KT2440
ccggcagguaagucggcuc

SEQ ID NO: 1618985 - RNA, 16 nt, Pseudomonas putida KT2440
ccggcauaccaucuuc

SEQ ID NO: 1618986 - RNA, 18 nt, Pseudomonas putida KT2440
ccggcaguacauagaaca

SEQ ID NO: 1618987 - RNA, 22 nt, Pseudomonas putida KT2440
ccggcgauacucaccgccgccc

SEQ ID NO: 1618988 - RNA, 20 nt, Pseudomonas putida KT2440
ccggcgaaaugauccccggc

SEQ ID NO: 1618989 - RNA, 22 nt, Pseudomonas putida KT2440
ccggccuguugcgcacugccgc

SEQ ID NO: 1618990 - RNA, 23 nt, Pseudomonas putida KT2440
ccggccuguugcgcacugccgcc

SEQ ID NO: 1618991 - RNA, 15 nt, Pseudomonas putida KT2440
ccggccuuggccagc

SEQ ID NO: 1618992 - RNA, 20 nt, Pseudomonas putida KT2440
ccggccuugccgcuggcgau

SEQ ID NO: 1618993 - RNA, 15 nt, Pseudomonas putida KT2440
ccggccuugcuccag

SEQ ID NO: 1618994 - RNA, 20 nt, Pseudomonas putida KT2440
ccggccuugcuccaguucau

SEQ ID NO: 1618995 - RNA, 21 nt, Pseudomonas putida KT2440
ccggccuuucgcgccaguucg

SEQ ID NO: 1618996 - RNA, 20 nt, Pseudomonas putida KT2440
ccggccggucguuacccacc

SEQ ID NO: 1618997 - RNA, 16 nt, Pseudomonas putida KT2440
ccggccgggcucuggg

SEQ ID NO: 1618998 - RNA, 23 nt, Pseudomonas putida KT2440
ccggccgacacaccaauggccau

SEQ ID NO: 1618999 - RNA, 17 nt, Pseudomonas putida KT2440
ccggcccugcuggccaa

SEQ ID NO: 1619000 - RNA, 14 nt, Pseudomonas putida KT2440
ccggcccugugccg

SEQ ID NO: 1619001 - RNA, 17 nt, Pseudomonas putida KT2440
ccggcccuucugcugcu

SEQ ID NO: 1619002 - RNA, 18 nt, Pseudomonas putida KT2440
ccggcccuuucgcgggua

SEQ ID NO: 1619003 - RNA, 13 nt, Pseudomonas putida KT2440
ccggcccugaagg

SEQ ID NO: 1619004 - RNA, 17 nt, Pseudomonas putida KT2440
ccggcccugaaggccgc

SEQ ID NO: 1619005 - RNA, 23 nt, Pseudomonas putida KT2440
ccggccccugcucguugcugagc

SEQ ID NO: 1619006 - RNA, 20 nt, Pseudomonas putida KT2440
ccggccccggugcauccaac

SEQ ID NO: 1619007 - RNA, 17 nt, Pseudomonas putida KT2440
ccggccaggccggcggu

SEQ ID NO: 1619008 - RNA, 13 nt, Pseudomonas putida KT2440
ccggccagggcug

SEQ ID NO: 1619009 - RNA, 21 nt, Pseudomonas putida KT2440
ccggccagcugcgcaccggcu

SEQ ID NO: 1619010 - RNA, 14 nt, Pseudomonas putida KT2440
ccggccaggccggc

SEQ ID NO: 1619011 - RNA, 15 nt, Pseudomonas putida KT2440
ccggccagcggcaug

SEQ ID NO: 1619012 - RNA, 23 nt, Pseudomonas putida KT2440
ccggcaugcgcguauccuugccc

SEQ ID NO: 1619013 - RNA, 16 nt, Pseudomonas putida KT2440
ccggcaugaacacaua

SEQ ID NO: 1619014 - RNA, 22 nt, Pseudomonas putida KT2440
ccggcaugaucagcuugaucug

SEQ ID NO: 1619015 - RNA, 15 nt, Pseudomonas putida KT2440
ccggccaacgacagg

SEQ ID NO: 1619016 - RNA, 21 nt, Pseudomonas putida KT2440
ccggccagcgccugcaggccc

SEQ ID NO: 1619017 - RNA, 15 nt, Pseudomonas putida KT2440
ccggccagcgcgcug

SEQ ID NO: 1619018 - RNA, 23 nt, Pseudomonas putida KT2440
ccggcauugcccaacucugccgg

SEQ ID NO: 1619019 - RNA, 20 nt, Pseudomonas putida KT2440
ccggcauggcgugcccggca

SEQ ID NO: 1619020 - RNA, 15 nt, Pseudomonas putida KT2440
aaaccgugcaaacaa

SEQ ID NO: 1619021 - RNA, 13 nt, Pseudomonas putida KT2440
aaaccguccaggu

SEQ ID NO: 1619022 - RNA, 17 nt, Pseudomonas putida KT2440
ccggcguucgaaagccc

SEQ ID NO: 1619023 - RNA, 17 nt, Pseudomonas putida KT2440
aaaccgucaugcagaug

SEQ ID NO: 1619024 - RNA, 14 nt, Pseudomonas putida KT2440
ccggcgcagauggu

SEQ ID NO: 1619025 - RNA, 15 nt, Pseudomonas putida KT2440
ccgggcagagucguu

SEQ ID NO: 1619026 - RNA, 15 nt, Pseudomonas putida KT2440
ccgggcagaccugcu

SEQ ID NO: 1619027 - RNA, 16 nt, Pseudomonas putida KT2440
ccgggcagcgggcucg

SEQ ID NO: 1619028 - RNA, 19 nt, Pseudomonas putida KT2440
ccgggcagcgggcucgccc

SEQ ID NO: 1619029 - RNA, 20 nt, Pseudomonas putida KT2440
ccgggcagguucgacucccg

SEQ ID NO: 1619030 - RNA, 21 nt, Pseudomonas putida KT2440
ccgggcauguucaacgcaaug

SEQ ID NO: 1619031 - RNA, 12 nt, Pseudomonas putida KT2440
ccgggccaccac

SEQ ID NO: 1619032 - RNA, 15 nt, Pseudomonas putida KT2440
ccggcuccagguacu

SEQ ID NO: 1619033 - RNA, 15 nt, Pseudomonas putida KT2440
ccggcucccccucca

SEQ ID NO: 1619034 - RNA, 19 nt, Pseudomonas putida KT2440
ccggcuccgcgcaagcggu

SEQ ID NO: 1619035 - RNA, 16 nt, Pseudomonas putida KT2440
ccggcuggacaccucc

SEQ ID NO: 1619036 - RNA, 18 nt, Pseudomonas putida KT2440
ccggcuggacaccucccg

SEQ ID NO: 1619037 - RNA, 19 nt, Pseudomonas putida KT2440
ccggcuggacaccucccgc

SEQ ID NO: 1619038 - RNA, 21 nt, Pseudomonas putida KT2440
ccgggcaaugauccgguccag

SEQ ID NO: 1619039 - RNA, 20 nt, Pseudomonas putida KT2440
aaaccguuacauccaugccu

SEQ ID NO: 1619040 - RNA, 20 nt, Pseudomonas putida KT2440
ccggcuggucgaaccaguac

SEQ ID NO: 1619041 - RNA, 22 nt, Pseudomonas putida KT2440
ccggcuggucgaaccaguacug

SEQ ID NO: 1619042 - RNA, 15 nt, Pseudomonas putida KT2440
ccgguaccggauagc

SEQ ID NO: 1619043 - RNA, 16 nt, Pseudomonas putida KT2440
ccgguacauugcgcac

SEQ ID NO: 1619044 - RNA, 18 nt, Pseudomonas putida KT2440
ccgguaccgccaccaauc

SEQ ID NO: 1619045 - RNA, 17 nt, Pseudomonas putida KT2440
ccgguaacgggccagcc

SEQ ID NO: 1619046 - RNA, 20 nt, Pseudomonas putida KT2440
ccgguaacuggcccacccgg

SEQ ID NO: 1619047 - RNA, 23 nt, Pseudomonas putida KT2440
ccggguuugaagcccggccgcgc

SEQ ID NO: 1619048 - RNA, 20 nt, Pseudomonas putida KT2440
ccggguugcccucgcaugcg

SEQ ID NO: 1619049 - RNA, 19 nt, Pseudomonas putida KT2440
ccgggugaucauucaggca

SEQ ID NO: 1619050 - RNA, 16 nt, Pseudomonas putida KT2440
ccgggucggccugcuc

SEQ ID NO: 1619051 - RNA, 21 nt, Pseudomonas putida KT2440
ccgggucggccugcucgcugg

SEQ ID NO: 1619052 - RNA, 14 nt, Pseudomonas putida KT2440
ccgggucggcgcca

SEQ ID NO: 1619053 - RNA, 20 nt, Pseudomonas putida KT2440
ccggguuacccaucugcucg

SEQ ID NO: 1619054 - RNA, 14 nt, Pseudomonas putida KT2440
ccgggugugagaac

SEQ ID NO: 1619055 - RNA, 13 nt, Pseudomonas putida KT2440
ccgggucauccgg

SEQ ID NO: 1619056 - RNA, 12 nt, Pseudomonas putida KT2440
ccggguccagug

SEQ ID NO: 1619057 - RNA, 16 nt, Pseudomonas putida KT2440
ccggguccaccucugc

SEQ ID NO: 1619058 - RNA, 20 nt, Pseudomonas putida KT2440
ccgggucgccguugucgccc

SEQ ID NO: 1619059 - RNA, 19 nt, Pseudomonas putida KT2440
ccggugcaacugccacgcc

SEQ ID NO: 1619060 - RNA, 19 nt, Pseudomonas putida KT2440
ccggugugcauuuucggca

SEQ ID NO: 1619061 - RNA, 13 nt, Pseudomonas putida KT2440
ccggugcuggcug

SEQ ID NO: 1619062 - RNA, 23 nt, Pseudomonas putida KT2440
ccggugccgaagucauccauggc

SEQ ID NO: 1619063 - RNA, 19 nt, Pseudomonas putida KT2440
ccggucaccgaccaucggc

SEQ ID NO: 1619064 - RNA, 19 nt, Pseudomonas putida KT2440
ccggucacgauccccacca

SEQ ID NO: 1619065 - RNA, 14 nt, Pseudomonas putida KT2440
ccggucauccagca

SEQ ID NO: 1619066 - RNA, 14 nt, Pseudomonas putida KT2440
ccggucgccgacgg

SEQ ID NO: 1619067 - RNA, 17 nt, Pseudomonas putida KT2440
ccggucauggcgcgcca

SEQ ID NO: 1619068 - RNA, 21 nt, Pseudomonas putida KT2440
ccgguacugcccauaaaagcc

SEQ ID NO: 1619069 - RNA, 19 nt, Pseudomonas putida KT2440
ccgguagccucgacccgcu

SEQ ID NO: 1619070 - RNA, 17 nt, Pseudomonas putida KT2440
ccgguaucacccaguaa

SEQ ID NO: 1619071 - RNA, 13 nt, Pseudomonas putida KT2440
ccgguaugcccau

SEQ ID NO: 1619072 - RNA, 23 nt, Pseudomonas putida KT2440
ccgguaucgaugcacagcucgcg

SEQ ID NO: 1619073 - RNA, 20 nt, Pseudomonas putida KT2440
cgacacaccgaucacuucca

SEQ ID NO: 1619074 - RNA, 23 nt, Pseudomonas putida KT2440
cgacacauaaccccccacccagc

SEQ ID NO: 1619075 - RNA, 16 nt, Pseudomonas putida KT2440
cgacacaaggccgcuc

SEQ ID NO: 1619076 - RNA, 23 nt, Pseudomonas putida KT2440
cgacacaaggccgcucccacagg

SEQ ID NO: 1619077 - RNA, 17 nt, Pseudomonas putida KT2440
cgacaacgguguggcca

SEQ ID NO: 1619078 - RNA, 16 nt, Pseudomonas putida KT2440
cgacaaguucauuacc

SEQ ID NO: 1619079 - RNA, 20 nt, Pseudomonas putida KT2440
cgacaccgggauacugcgca

SEQ ID NO: 1619080 - RNA, 19 nt, Pseudomonas putida KT2440
cgacaccagcgcaccacug

SEQ ID NO: 1619081 - RNA, 18 nt, Pseudomonas putida KT2440
cgacacaugcaaacccug

SEQ ID NO: 1619082 - RNA, 14 nt, Pseudomonas putida KT2440
cgacaaaaacaaca

SEQ ID NO: 1619083 - RNA, 21 nt, Pseudomonas putida KT2440
cgacaaacguaccagccgcac

SEQ ID NO: 1619084 - RNA, 15 nt, Pseudomonas putida KT2440
cgacaaacccgugcu

SEQ ID NO: 1619085 - RNA, 17 nt, Pseudomonas putida KT2440
cgacaacgcacccgccu

SEQ ID NO: 1619086 - RNA, 17 nt, Pseudomonas putida KT2440
cgacaaaugcaccacgc

SEQ ID NO: 1619087 - RNA, 15 nt, Pseudomonas putida KT2440
cgacaaccccagccc

SEQ ID NO: 1619088 - RNA, 19 nt, Pseudomonas putida KT2440
cgacacggcugccgacagg

SEQ ID NO: 1619089 - RNA, 21 nt, Pseudomonas putida KT2440
cgacagcacgggcacacuggc

SEQ ID NO: 1619090 - RNA, 14 nt, Pseudomonas putida KT2440
cgacagacagggcc

SEQ ID NO: 1619091 - RNA, 15 nt, Pseudomonas putida KT2440
cgacagacagggccu

SEQ ID NO: 1619092 - RNA, 17 nt, Pseudomonas putida KT2440
cgacagcaucugcacca

SEQ ID NO: 1619093 - RNA, 20 nt, Pseudomonas putida KT2440
cgacagcaucugcaccagga

SEQ ID NO: 1619094 - RNA, 13 nt, Pseudomonas putida KT2440
cgacagccaccgc

SEQ ID NO: 1619095 - RNA, 17 nt, Pseudomonas putida KT2440
cgacagccaccgcgagc

SEQ ID NO: 1619096 - RNA, 20 nt, Pseudomonas putida KT2440
cgacagcaucaucaggccga

SEQ ID NO: 1619097 - RNA, 15 nt, Pseudomonas putida KT2440
cgacagccucaaggc

SEQ ID NO: 1619098 - RNA, 15 nt, Pseudomonas putida KT2440
cgacagcggccagcu

SEQ ID NO: 1619099 - RNA, 19 nt, Pseudomonas putida KT2440
cgacagcucaagcccugcc

SEQ ID NO: 1619100 - RNA, 23 nt, Pseudomonas putida KT2440
cgacagcguugcuccagcucaca

SEQ ID NO: 1619101 - RNA, 24 nt, Pseudomonas putida KT2440
cgacagcguugcuccagcucacag

SEQ ID NO: 1619102 - RNA, 16 nt, Pseudomonas putida KT2440
cgacauccacguccug

SEQ ID NO: 1619103 - RNA, 16 nt, Pseudomonas putida KT2440
cgacaguucgccaccc

SEQ ID NO: 1619104 - RNA, 21 nt, Pseudomonas putida KT2440
cgacaguucgccacccgacgc

SEQ ID NO: 1619105 - RNA, 15 nt, Pseudomonas putida KT2440
cgacaggggcacggg

SEQ ID NO: 1619106 - RNA, 23 nt, Pseudomonas putida KT2440
cgacagcuugcccagcugcggga

SEQ ID NO: 1619107 - RNA, 16 nt, Pseudomonas putida KT2440
cgaaugcgacugaggc

SEQ ID NO: 1619108 - RNA, 12 nt, Pseudomonas putida KT2440
cgaaugagaggc

SEQ ID NO: 1619109 - RNA, 19 nt, Pseudomonas putida KT2440
cgaaucgcucaugccccgc

SEQ ID NO: 1619110 - RNA, 14 nt, Pseudomonas putida KT2440
cgaauccugcugag

SEQ ID NO: 1619111 - RNA, 14 nt, Pseudomonas putida KT2440
cgaaucaagccugc

SEQ ID NO: 1619112 - RNA, 19 nt, Pseudomonas putida KT2440
cgaauccagccggcccggc

SEQ ID NO: 1619113 - RNA, 23 nt, Pseudomonas putida KT2440
cgaauccagccggcccggcuggc

SEQ ID NO: 1619114 - RNA, 17 nt, Pseudomonas putida KT2440
cgaaucagcaugcccag

SEQ ID NO: 1619115 - RNA, 19 nt, Pseudomonas putida KT2440
cgaaguggauauccagcga

SEQ ID NO: 1619116 - RNA, 21 nt, Pseudomonas putida KT2440
cgaaguggcggcucgcugaac

SEQ ID NO: 1619117 - RNA, 23 nt, Pseudomonas putida KT2440
cgaacuccgcgagggcaucagcg

SEQ ID NO: 1619118 - RNA, 16 nt, Pseudomonas putida KT2440
cgaacucaugcuccug

SEQ ID NO: 1619119 - RNA, 20 nt, Pseudomonas putida KT2440
cgaacggguuggcauggccc

SEQ ID NO: 1619120 - RNA, 16 nt, Pseudomonas putida KT2440
cgaacgcccccagccc

SEQ ID NO: 1619121 - RNA, 20 nt, Pseudomonas putida KT2440
cgaacgcccccagcccggcg

SEQ ID NO: 1619122 - RNA, 16 nt, Pseudomonas putida KT2440
cgaacgcagcgccgcc

SEQ ID NO: 1619123 - RNA, 14 nt, Pseudomonas putida KT2440
cgaaccugcccggg

SEQ ID NO: 1619124 - RNA, 19 nt, Pseudomonas putida KT2440
cgaaccuggaucgcucucg

SEQ ID NO: 1619125 - RNA, 16 nt, Pseudomonas putida KT2440
cgaaccuugcuugacc

SEQ ID NO: 1619126 - RNA, 22 nt, Pseudomonas putida KT2440
cgaaccuugcuugaccuuguca

SEQ ID NO: 1619127 - RNA, 19 nt, Pseudomonas putida KT2440
cgaacgacacggcaggguu

SEQ ID NO: 1619128 - RNA, 18 nt, Pseudomonas putida KT2440
cgaacgaguccgggcggu

SEQ ID NO: 1619129 - RNA, 19 nt, Pseudomonas putida KT2440
cgaagaugucgauguacuu

SEQ ID NO: 1619130 - RNA, 15 nt, Pseudomonas putida KT2440
cgaagcaccacugga

SEQ ID NO: 1619131 - RNA, 23 nt, Pseudomonas putida KT2440
cgaagaagucauccggcgcggcc

SEQ ID NO: 1619132 - RNA, 15 nt, Pseudomonas putida KT2440
cgaagaagccaccgc

SEQ ID NO: 1619133 - RNA, 15 nt, Pseudomonas putida KT2440
cgaagaaggcgagcu

SEQ ID NO: 1619134 - RNA, 15 nt, Pseudomonas putida KT2440
cgaagcaggcgacgc

SEQ ID NO: 1619135 - RNA, 14 nt, Pseudomonas putida KT2440
cgaagcaggcugcg

SEQ ID NO: 1619136 - RNA, 15 nt, Pseudomonas putida KT2440
cgaagcaggcugcgc

SEQ ID NO: 1619137 - RNA, 19 nt, Pseudomonas putida KT2440
cgaagcuaucgccagcagg

SEQ ID NO: 1619138 - RNA, 19 nt, Pseudomonas putida KT2440
cgaagcguuuacugcugau

SEQ ID NO: 1619139 - RNA, 17 nt, Pseudomonas putida KT2440
cgaccgggcagaccugc

SEQ ID NO: 1619140 - RNA, 14 nt, Pseudomonas putida KT2440
cgaccgucgcugga

SEQ ID NO: 1619141 - RNA, 19 nt, Pseudomonas putida KT2440
cgaccgauaaagagaagcu

SEQ ID NO: 1619142 - RNA, 15 nt, Pseudomonas putida KT2440
cgaccgaaccggcgc

SEQ ID NO: 1619143 - RNA, 16 nt, Pseudomonas putida KT2440
cgaccgaaccggcgcu

SEQ ID NO: 1619144 - RNA, 15 nt, Pseudomonas putida KT2440
cgaccgcacccgcga

SEQ ID NO: 1619145 - RNA, 19 nt, Pseudomonas putida KT2440
cgacccuguagccccgcug

SEQ ID NO: 1619146 - RNA, 17 nt, Pseudomonas putida KT2440
cgacccgggccagccac

SEQ ID NO: 1619147 - RNA, 17 nt, Pseudomonas putida KT2440
cgacccacaggcacagg

SEQ ID NO: 1619148 - RNA, 23 nt, Pseudomonas putida KT2440
cgaccccagcaugaaccgcuccg

SEQ ID NO: 1619149 - RNA, 14 nt, Pseudomonas putida KT2440
cgacccccuugcca

SEQ ID NO: 1619150 - RNA, 14 nt, Pseudomonas putida KT2440
cgacccgcccgcca

SEQ ID NO: 1619151 - RNA, 11 nt, Pseudomonas putida KT2440
cgacccgccgg

SEQ ID NO: 1619152 - RNA, 15 nt, Pseudomonas putida KT2440
cgacccgccuggugc

SEQ ID NO: 1619153 - RNA, 23 nt, Pseudomonas putida KT2440
cgaccagaacaugccacggccuu

SEQ ID NO: 1619154 - RNA, 13 nt, Pseudomonas putida KT2440
cgaccaucggcag

SEQ ID NO: 1619155 - RNA, 18 nt, Pseudomonas putida KT2440
cgaccaguaccacagcca

SEQ ID NO: 1619156 - RNA, 23 nt, Pseudomonas putida KT2440
cgaccaguaccgcgccuccagcu

SEQ ID NO: 1619157 - RNA, 21 nt, Pseudomonas putida KT2440
cgaccaggcgcucgcuccagg

SEQ ID NO: 1619158 - RNA, 15 nt, Pseudomonas putida KT2440
cgaccagggccuugg

SEQ ID NO: 1619159 - RNA, 18 nt, Pseudomonas putida KT2440
cgaccacgaucuuggcca

SEQ ID NO: 1619160 - RNA, 21 nt, Pseudomonas putida KT2440
cgaccaauugguuaaaagcca

SEQ ID NO: 1619161 - RNA, 19 nt, Pseudomonas putida KT2440
cgaccaaggcuuccgccgg

SEQ ID NO: 1619162 - RNA, 21 nt, Pseudomonas putida KT2440
cgacaugcaguugagcccucg

SEQ ID NO: 1619163 - RNA, 13 nt, Pseudomonas putida KT2440
cgaccaagcgccc

SEQ ID NO: 1619164 - RNA, 21 nt, Pseudomonas putida KT2440
cgaccaagcgccccacaagcc

SEQ ID NO: 1619165 - RNA, 15 nt, Pseudomonas putida KT2440
cgaccaaggccaacu

SEQ ID NO: 1619166 - RNA, 21 nt, Pseudomonas putida KT2440
cgaccaaggccaacugcgccc

SEQ ID NO: 1619167 - RNA, 12 nt, Pseudomonas putida KT2440
cgaccugccagu

SEQ ID NO: 1619168 - RNA, 14 nt, Pseudomonas putida KT2440
cgacgaacagggcc

SEQ ID NO: 1619169 - RNA, 18 nt, Pseudomonas putida KT2440
cgacgaagcugcuggcgu

SEQ ID NO: 1619170 - RNA, 14 nt, Pseudomonas putida KT2440
cgacgcaguuacuc

SEQ ID NO: 1619171 - RNA, 12 nt, Pseudomonas putida KT2440
cgacgccacccc

SEQ ID NO: 1619172 - RNA, 14 nt, Pseudomonas putida KT2440
cgacgauggacagc

SEQ ID NO: 1619173 - RNA, 15 nt, Pseudomonas putida KT2440
cgacgcagcagcgcg

SEQ ID NO: 1619174 - RNA, 23 nt, Pseudomonas putida KT2440
cgacgcaccagguuggccgccgc

SEQ ID NO: 1619175 - RNA, 21 nt, Pseudomonas putida KT2440
cgacgacgaucucguccaggg

SEQ ID NO: 1619176 - RNA, 23 nt, Pseudomonas putida KT2440
cgacgauacccagcgcgcgcaga

SEQ ID NO: 1619177 - RNA, 19 nt, Pseudomonas putida KT2440
cgacgccuuggcgcagcaa

SEQ ID NO: 1619178 - RNA, 12 nt, Pseudomonas putida KT2440
cgacgcgggcca

SEQ ID NO: 1619179 - RNA, 14 nt, Pseudomonas putida KT2440
cgacgcgguggagg

SEQ ID NO: 1619180 - RNA, 17 nt, Pseudomonas putida KT2440
cgacgcugcccagcaac

SEQ ID NO: 1619181 - RNA, 16 nt, Pseudomonas putida KT2440
cgacggaucggcacac

SEQ ID NO: 1619182 - RNA, 17 nt, Pseudomonas putida KT2440
cgacgcuuuccugguua

SEQ ID NO: 1619183 - RNA, 16 nt, Pseudomonas putida KT2440
cgacggaacggccgca

SEQ ID NO: 1619184 - RNA, 21 nt, Pseudomonas putida KT2440
cgacggaacggccgcaccuca

SEQ ID NO: 1619185 - RNA, 23 nt, Pseudomonas putida KT2440
cgacggucugcguacaacaaccc

SEQ ID NO: 1619186 - RNA, 15 nt, Pseudomonas putida KT2440
ccuugaccucgacca

SEQ ID NO: 1619187 - RNA, 15 nt, Pseudomonas putida KT2440
ccuugaccagcaacg

SEQ ID NO: 1619188 - RNA, 13 nt, Pseudomonas putida KT2440
ccuugagcacccc

SEQ ID NO: 1619189 - RNA, 20 nt, Pseudomonas putida KT2440
ccuugacggggcacaacccg

SEQ ID NO: 1619190 - RNA, 16 nt, Pseudomonas putida KT2440
ccuuggacgcuggcag

SEQ ID NO: 1619191 - RNA, 19 nt, Pseudomonas putida KT2440
ccuuggacgcuggcagcuu

SEQ ID NO: 1619192 - RNA, 19 nt, Pseudomonas putida KT2440
ccuugcucaauuucuaaaa

SEQ ID NO: 1619193 - RNA, 18 nt, Pseudomonas putida KT2440
ccuugcuccaccaggcca

SEQ ID NO: 1619194 - RNA, 19 nt, Pseudomonas putida KT2440
ccuugcuccaccaggccac

SEQ ID NO: 1619195 - RNA, 18 nt, Pseudomonas putida KT2440
ccuuggagcgcgcccccg

SEQ ID NO: 1619196 - RNA, 14 nt, Pseudomonas putida KT2440
ccuuggccaaugcc

SEQ ID NO: 1619197 - RNA, 11 nt, Pseudomonas putida KT2440
ccuuggccacc

SEQ ID NO: 1619198 - RNA, 19 nt, Pseudomonas putida KT2440
ccuuggccagcucauccag

SEQ ID NO: 1619199 - RNA, 22 nt, Pseudomonas putida KT2440
ccuuggccagcucauccagccg

SEQ ID NO: 1619200 - RNA, 19 nt, Pseudomonas putida KT2440
ccuugucggcacgcgccag

SEQ ID NO: 1619201 - RNA, 16 nt, Pseudomonas putida KT2440
ccuugucgaguuucag

SEQ ID NO: 1619202 - RNA, 18 nt, Pseudomonas putida KT2440
ccuugucgaguuucaggg

SEQ ID NO: 1619203 - RNA, 14 nt, Pseudomonas putida KT2440
ccuugucagcaacc

SEQ ID NO: 1619204 - RNA, 17 nt, Pseudomonas putida KT2440
ccuugucagccgccgcu

SEQ ID NO: 1619205 - RNA, 20 nt, Pseudomonas putida KT2440
ccuuggccucacauucaccg

SEQ ID NO: 1619206 - RNA, 13 nt, Pseudomonas putida KT2440
ccuuggccugcuc

SEQ ID NO: 1619207 - RNA, 18 nt, Pseudomonas putida KT2440
ccuuggccugcucacccg

SEQ ID NO: 1619208 - RNA, 19 nt, Pseudomonas putida KT2440
ccuuggccgccaguaccaa

SEQ ID NO: 1619209 - RNA, 17 nt, Pseudomonas putida KT2440
ccuuggccgcuggcccu

SEQ ID NO: 1619210 - RNA, 23 nt, Pseudomonas putida KT2440
ccuuggccgguuucagucagcca

SEQ ID NO: 1619211 - RNA, 23 nt, Pseudomonas putida KT2440
ccuuggcgaaugcgcucauccag

SEQ ID NO: 1619212 - RNA, 20 nt, Pseudomonas putida KT2440
ccuugguguaauccaucacc

SEQ ID NO: 1619213 - RNA, 20 nt, Pseudomonas putida KT2440
ccuuguugccacccagauca

SEQ ID NO: 1619214 - RNA, 16 nt, Pseudomonas putida KT2440
ccuuguucgagcgcca

SEQ ID NO: 1619215 - RNA, 20 nt, Pseudomonas putida KT2440
ccuuguuccgcccagcucug

SEQ ID NO: 1619216 - RNA, 22 nt, Pseudomonas putida KT2440
ccuuguuccgcccagcucugga

SEQ ID NO: 1619217 - RNA, 15 nt, Pseudomonas putida KT2440
ccuuguucaacacug

SEQ ID NO: 1619218 - RNA, 16 nt, Pseudomonas putida KT2440
ccuuguucaacacugu

SEQ ID NO: 1619219 - RNA, 20 nt, Pseudomonas putida KT2440
ccuugugcgccaccgacucc

SEQ ID NO: 1619220 - RNA, 14 nt, Pseudomonas putida KT2440
ccuugugcaguucg

SEQ ID NO: 1619221 - RNA, 14 nt, Pseudomonas putida KT2440
ccuuuacuggccau

SEQ ID NO: 1619222 - RNA, 18 nt, Pseudomonas putida KT2440
ccuuucgcgacacaaggc

SEQ ID NO: 1619223 - RNA, 13 nt, Pseudomonas putida KT2440
ccuuucgcgccag

SEQ ID NO: 1619224 - RNA, 13 nt, Pseudomonas putida KT2440
ccuuugcaaagcg

SEQ ID NO: 1619225 - RNA, 13 nt, Pseudomonas putida KT2440
ccuuugccaucca

SEQ ID NO: 1619226 - RNA, 22 nt, Pseudomonas putida KT2440
ccuuugccccugaucauccaca

SEQ ID NO: 1619227 - RNA, 21 nt, Pseudomonas putida KT2440
ccuuuguacgucucaucgugu

SEQ ID NO: 1619228 - RNA, 20 nt, Pseudomonas putida KT2440
ccuuccucgacguugagcca

SEQ ID NO: 1619229 - RNA, 13 nt, Pseudomonas putida KT2440
ccuuccucggcca

SEQ ID NO: 1619230 - RNA, 19 nt, Pseudomonas putida KT2440
ccuucauacagcgccucca

SEQ ID NO: 1619231 - RNA, 13 nt, Pseudomonas putida KT2440
ccuuccgcgugcc

SEQ ID NO: 1619232 - RNA, 18 nt, Pseudomonas putida KT2440
ccuucaggcgcugguuga

SEQ ID NO: 1619233 - RNA, 22 nt, Pseudomonas putida KT2440
ccuucagggccgguuaaaaccc

SEQ ID NO: 1619234 - RNA, 18 nt, Pseudomonas putida KT2440
ccuucaggcgcucacccc

SEQ ID NO: 1619235 - RNA, 22 nt, Pseudomonas putida KT2440
ccuucagguuuggggugagcga

SEQ ID NO: 1619236 - RNA, 22 nt, Pseudomonas putida KT2440
ccuucagguaauccaccagccg

SEQ ID NO: 1619237 - RNA, 23 nt, Pseudomonas putida KT2440
ccuucagcgggucgagccaggcg

SEQ ID NO: 1619238 - RNA, 17 nt, Pseudomonas putida KT2440
ccuucagcgccccauca

SEQ ID NO: 1619239 - RNA, 18 nt, Pseudomonas putida KT2440
ccuucaggcacaccucgg

SEQ ID NO: 1619240 - RNA, 14 nt, Pseudomonas putida KT2440
ccuucaggccccag

SEQ ID NO: 1619241 - RNA, 19 nt, Pseudomonas putida KT2440
ccuucaggccccagucauc

SEQ ID NO: 1619242 - RNA, 13 nt, Pseudomonas putida KT2440
ccuucgauucagg

SEQ ID NO: 1619243 - RNA, 14 nt, Pseudomonas putida KT2440
ccuucgauucaggc

SEQ ID NO: 1619244 - RNA, 23 nt, Pseudomonas putida KT2440
ccuucgcaggcacgcccgcuccc

SEQ ID NO: 1619245 - RNA, 15 nt, Pseudomonas putida KT2440
ccuucgccaacugca

SEQ ID NO: 1619246 - RNA, 15 nt, Pseudomonas putida KT2440
ccuucgccaaggucc

SEQ ID NO: 1619247 - RNA, 18 nt, Pseudomonas putida KT2440
ccuucgccaagguccagc

SEQ ID NO: 1619248 - RNA, 17 nt, Pseudomonas putida KT2440
ccuucgccacgaacagg

SEQ ID NO: 1619249 - RNA, 18 nt, Pseudomonas putida KT2440
ccuucgcccgaccgccag

SEQ ID NO: 1619250 - RNA, 21 nt, Pseudomonas putida KT2440
ccuuccuugaacucagugccu

SEQ ID NO: 1619251 - RNA, 16 nt, Pseudomonas putida KT2440
ccuugaagcuggccgu

SEQ ID NO: 1619252 - RNA, 14 nt, Pseudomonas putida KT2440
ccuucuuguuguuc

SEQ ID NO: 1619253 - RNA, 16 nt, Pseudomonas putida KT2440
ccuucggccacacggg

SEQ ID NO: 1619254 - RNA, 23 nt, Pseudomonas putida KT2440
ccuucgcuggcgacgaagcugcu

SEQ ID NO: 1619255 - RNA, 23 nt, Pseudomonas putida KT2440
ccuucgcgggcacgcccgcuccc

SEQ ID NO: 1619256 - RNA, 22 nt, Pseudomonas putida KT2440
ccuucgcggaagauacccgcca

SEQ ID NO: 1619257 - RNA, 17 nt, Pseudomonas putida KT2440
ccuguacacagcccaag

SEQ ID NO: 1619258 - RNA, 20 nt, Pseudomonas putida KT2440
ccuguacacagcccaaggcu

SEQ ID NO: 1619259 - RNA, 22 nt, Pseudomonas putida KT2440
ccuguacauccagcuccagcac

SEQ ID NO: 1619260 - RNA, 11 nt, Pseudomonas putida KT2440
ccuguaccgac

SEQ ID NO: 1619261 - RNA, 18 nt, Pseudomonas putida KT2440
ccuuacgcagccuucugu

SEQ ID NO: 1619262 - RNA, 13 nt, Pseudomonas putida KT2440
ccuucaacccuuc

SEQ ID NO: 1619263 - RNA, 14 nt, Pseudomonas putida KT2440
ccuucaaccucacu

SEQ ID NO: 1619264 - RNA, 14 nt, Pseudomonas putida KT2440
ccuucaagcucccc

SEQ ID NO: 1619265 - RNA, 16 nt, Pseudomonas putida KT2440
ccuucaagcuccccag

SEQ ID NO: 1619266 - RNA, 15 nt, Pseudomonas putida KT2440
ccuucaauagcggcc

SEQ ID NO: 1619267 - RNA, 16 nt, Pseudomonas putida KT2440
ccuucaauagcggcca

SEQ ID NO: 1619268 - RNA, 19 nt, Pseudomonas putida KT2440
ccuucacggauggcagcga

SEQ ID NO: 1619269 - RNA, 16 nt, Pseudomonas putida KT2440
ccugguuauccaggua

SEQ ID NO: 1619270 - RNA, 22 nt, Pseudomonas putida KT2440
ccugguuauccagguaaaccug

SEQ ID NO: 1619271 - RNA, 14 nt, Pseudomonas putida KT2440
ccuggucgccgcca

SEQ ID NO: 1619272 - RNA, 18 nt, Pseudomonas putida KT2440
ccuggucgcgggccagcc

SEQ ID NO: 1619273 - RNA, 13 nt, Pseudomonas putida KT2440
ccugggucagcuc

SEQ ID NO: 1619274 - RNA, 17 nt, Pseudomonas putida KT2440
ccugggccuucgcccgc

SEQ ID NO: 1619275 - RNA, 24 nt, Pseudomonas putida KT2440
ccugggccaguaccuucuggcugg

SEQ ID NO: 1619276 - RNA, 16 nt, Pseudomonas putida KT2440
ccugggccggugggca

SEQ ID NO: 1619277 - RNA, 13 nt, Pseudomonas putida KT2440
ccugggcguucug

SEQ ID NO: 1619278 - RNA, 16 nt, Pseudomonas putida KT2440
ccugggcgucaaaguu

SEQ ID NO: 1619279 - RNA, 13 nt, Pseudomonas putida KT2440
ccugggggucgcc

SEQ ID NO: 1619280 - RNA, 16 nt, Pseudomonas putida KT2440
ccuggcuuuccagguc

SEQ ID NO: 1619281 - RNA, 20 nt, Pseudomonas putida KT2440
ccugggaaaccgugucgggc

SEQ ID NO: 1619282 - RNA, 16 nt, Pseudomonas putida KT2440
ccuggcugucccaugc

SEQ ID NO: 1619283 - RNA, 14 nt, Pseudomonas putida KT2440
ccuggcuggcagcc

SEQ ID NO: 1619284 - RNA, 15 nt, Pseudomonas putida KT2440
ccuggcuggcagccg

SEQ ID NO: 1619285 - RNA, 19 nt, Pseudomonas putida KT2440
ccuggcucuucaacaccag

SEQ ID NO: 1619286 - RNA, 22 nt, Pseudomonas putida KT2440
ccuggcugcagugaagaauuca

SEQ ID NO: 1619287 - RNA, 21 nt, Pseudomonas putida KT2440
ccuggcugagguucagcgcac

SEQ ID NO: 1619288 - RNA, 20 nt, Pseudomonas putida KT2440
ccuggcgguugaccagggcg

SEQ ID NO: 1619289 - RNA, 15 nt, Pseudomonas putida KT2440
ccuggcucggcuggg

SEQ ID NO: 1619290 - RNA, 17 nt, Pseudomonas putida KT2440
ccuggcucgaucacgaa

SEQ ID NO: 1619291 - RNA, 23 nt, Pseudomonas putida KT2440
ccuggcucgaucacgaacacauc

SEQ ID NO: 1619292 - RNA, 21 nt, Pseudomonas putida KT2440
ccuggcgcaguucguccaggc

SEQ ID NO: 1619293 - RNA, 12 nt, Pseudomonas putida KT2440
ccuggcgacacu

SEQ ID NO: 1619294 - RNA, 13 nt, Pseudomonas putida KT2440
ccuggccugcaga

SEQ ID NO: 1619295 - RNA, 15 nt, Pseudomonas putida KT2440
ccuggccugcaugcu

SEQ ID NO: 1619296 - RNA, 17 nt, Pseudomonas putida KT2440
ccuggccuuccuugccc

SEQ ID NO: 1619297 - RNA, 17 nt, Pseudomonas putida KT2440
ccuggccgcguucgccc

SEQ ID NO: 1619298 - RNA, 15 nt, Pseudomonas putida KT2440
ccuggcccgccgcca

SEQ ID NO: 1619299 - RNA, 16 nt, Pseudomonas putida KT2440
ccuggcccgccgccac

SEQ ID NO: 1619300 - RNA, 17 nt, Pseudomonas putida KT2440
ccuggcccgccgccacc

SEQ ID NO: 1619301 - RNA, 13 nt, Pseudomonas putida KT2440
ccuggcccggccc

SEQ ID NO: 1619302 - RNA, 15 nt, Pseudomonas putida KT2440
ccuggcccugcucac

SEQ ID NO: 1619303 - RNA, 16 nt, Pseudomonas putida KT2440
ccuggcccugcucacg

SEQ ID NO: 1619304 - RNA, 16 nt, Pseudomonas putida KT2440
ccuggcccgaacgcag

SEQ ID NO: 1619305 - RNA, 18 nt, Pseudomonas putida KT2440
ccuggcccgaacgcagcg

SEQ ID NO: 1619306 - RNA, 20 nt, Pseudomonas putida KT2440
ccuggcccgaacgcagcgcc

SEQ ID NO: 1619307 - RNA, 22 nt, Pseudomonas putida KT2440
ccuggcccaguacgccacccag

SEQ ID NO: 1619308 - RNA, 23 nt, Pseudomonas putida KT2440
ccuggccauaguugaccagcacc

SEQ ID NO: 1619309 - RNA, 17 nt, Pseudomonas putida KT2440
ccuggcaugccccucga

SEQ ID NO: 1619310 - RNA, 17 nt, Pseudomonas putida KT2440
ccuggcacgcccggcac

SEQ ID NO: 1619311 - RNA, 20 nt, Pseudomonas putida KT2440
ccuggaugacgauaugcccg

SEQ ID NO: 1619312 - RNA, 17 nt, Pseudomonas putida KT2440
ccuggaucgccaggcug

SEQ ID NO: 1619313 - RNA, 17 nt, Pseudomonas putida KT2440
ccuggaucgcucucgcu

SEQ ID NO: 1619314 - RNA, 14 nt, Pseudomonas putida KT2440
ccuggaucagccgc

SEQ ID NO: 1619315 - RNA, 17 nt, Pseudomonas putida KT2440
ccuggaucagccgcgcc

SEQ ID NO: 1619316 - RNA, 23 nt, Pseudomonas putida KT2440
ccuggacgguauaggccccgaau

SEQ ID NO: 1619317 - RNA, 16 nt, Pseudomonas putida KT2440
ccugcuuggcaccuau

SEQ ID NO: 1619318 - RNA, 23 nt, Pseudomonas putida KT2440
ccuggaauuccugccggggcgcc

SEQ ID NO: 1619319 - RNA, 20 nt, Pseudomonas putida KT2440
ccugcuucgcgggcacgccc

SEQ ID NO: 1619320 - RNA, 16 nt, Pseudomonas putida KT2440
ccugcuggccgcgcag

SEQ ID NO: 1619321 - RNA, 15 nt, Pseudomonas putida KT2440
ccugcuggcacugcg

SEQ ID NO: 1619322 - RNA, 19 nt, Pseudomonas putida KT2440
ccugcuggccaaucuccac

SEQ ID NO: 1619323 - RNA, 11 nt, Pseudomonas putida KT2440
ccugcugggcg

SEQ ID NO: 1619324 - RNA, 19 nt, Pseudomonas putida KT2440
ccugcugguacagccggcu

SEQ ID NO: 1619325 - RNA, 17 nt, Pseudomonas putida KT2440
ccugcugccgcaccucg

SEQ ID NO: 1619326 - RNA, 16 nt, Pseudomonas putida KT2440
ccugcugccguuuauu

SEQ ID NO: 1619327 - RNA, 17 nt, Pseudomonas putida KT2440
ccugcugcuggcacgcc

SEQ ID NO: 1619328 - RNA, 23 nt, Pseudomonas putida KT2440
ccugcugcugucgguaccuggcc

SEQ ID NO: 1619329 - RNA, 12 nt, Pseudomonas putida KT2440
ccugcugcuccc

SEQ ID NO: 1619330 - RNA, 14 nt, Pseudomonas putida KT2440
ccugcugcucccca

SEQ ID NO: 1619331 - RNA, 12 nt, Pseudomonas putida KT2440
ccugcucaucca

SEQ ID NO: 1619332 - RNA, 14 nt, Pseudomonas putida KT2440
ccugcucauccagc

SEQ ID NO: 1619333 - RNA, 16 nt, Pseudomonas putida KT2440
ccugcuccugauaguu

SEQ ID NO: 1619334 - RNA, 17 nt, Pseudomonas putida KT2440
ccugcuccagcacccgc

SEQ ID NO: 1619335 - RNA, 17 nt, Pseudomonas putida KT2440
ccugcucgacaagccgc

SEQ ID NO: 1619336 - RNA, 22 nt, Pseudomonas putida KT2440
ccugcggcagauccugcagccg

SEQ ID NO: 1619337 - RNA, 16 nt, Pseudomonas putida KT2440
ccugcggcugccccaa

SEQ ID NO: 1619338 - RNA, 12 nt, Pseudomonas putida KT2440
ccugcucacccg

SEQ ID NO: 1619339 - RNA, 20 nt, Pseudomonas putida KT2440
ccugccuugcgauaccccgc

SEQ ID NO: 1619340 - RNA, 13 nt, Pseudomonas putida KT2440
ccugccagccccg

SEQ ID NO: 1619341 - RNA, 14 nt, Pseudomonas putida KT2440
ccugccagccccgc

SEQ ID NO: 1619342 - RNA, 12 nt, Pseudomonas putida KT2440
ccugccagguca

SEQ ID NO: 1619343 - RNA, 13 nt, Pseudomonas putida KT2440
ccugcccgccccc

SEQ ID NO: 1619344 - RNA, 22 nt, Pseudomonas putida KT2440
ccugcccgccccccaccuggcc

SEQ ID NO: 1619345 - RNA, 24 nt, Pseudomonas putida KT2440
ccugcccgaucgccucgcuggcgg

SEQ ID NO: 1619346 - RNA, 13 nt, Pseudomonas putida KT2440
ccugccccagcgu

SEQ ID NO: 1619347 - RNA, 22 nt, Pseudomonas putida KT2440
ccugccagucgcacagguccag

SEQ ID NO: 1619348 - RNA, 23 nt, Pseudomonas putida KT2440
ccugccagucgcacagguccagc

SEQ ID NO: 1619349 - RNA, 12 nt, Pseudomonas putida KT2440
ccucgggcagcc

SEQ ID NO: 1619350 - RNA, 13 nt, Pseudomonas putida KT2440
ccucgggacugug

SEQ ID NO: 1619351 - RNA, 17 nt, Pseudomonas putida KT2440
ccucggcuacgccgccg

SEQ ID NO: 1619352 - RNA, 17 nt, Pseudomonas putida KT2440
ccucgggcuuggcacgc

SEQ ID NO: 1619353 - RNA, 22 nt, Pseudomonas putida KT2440
ccucgggcuuggcacgcuggcu

SEQ ID NO: 1619354 - RNA, 13 nt, Pseudomonas putida KT2440
ccugcaccacaug

SEQ ID NO: 1619355 - RNA, 13 nt, Pseudomonas putida KT2440
ccugcacacugcc

SEQ ID NO: 1619356 - RNA, 18 nt, Pseudomonas putida KT2440
ccugcacugcacccucuu

SEQ ID NO: 1619357 - RNA, 19 nt, Pseudomonas putida KT2440
ccugcacugcacccucuuc

SEQ ID NO: 1619358 - RNA, 20 nt, Pseudomonas putida KT2440
ccugcaccuuguuacccgca

SEQ ID NO: 1619359 - RNA, 15 nt, Pseudomonas putida KT2440
ccugcaccaguuccu

SEQ ID NO: 1619360 - RNA, 16 nt, Pseudomonas putida KT2440
ccugcaccaguuccug

SEQ ID NO: 1619361 - RNA, 18 nt, Pseudomonas putida KT2440
ccugcagguacagcagcu

SEQ ID NO: 1619362 - RNA, 23 nt, Pseudomonas putida KT2440
ccugcagggcgagcacacccggc

SEQ ID NO: 1619363 - RNA, 18 nt, Pseudomonas putida KT2440
cauuccauucggugcagc

SEQ ID NO: 1619364 - RNA, 14 nt, Pseudomonas putida KT2440
cauuccccggucag

SEQ ID NO: 1619365 - RNA, 15 nt, Pseudomonas putida KT2440
cauugacagcuuuug

SEQ ID NO: 1619366 - RNA, 20 nt, Pseudomonas putida KT2440
cauucacggcgucgagcagg

SEQ ID NO: 1619367 - RNA, 19 nt, Pseudomonas putida KT2440
cauucaccagccaggcaca

SEQ ID NO: 1619368 - RNA, 12 nt, Pseudomonas putida KT2440
cauucaccagcu

SEQ ID NO: 1619369 - RNA, 19 nt, Pseudomonas putida KT2440
cauuaauuuuaaaggguuu

SEQ ID NO: 1619370 - RNA, 22 nt, Pseudomonas putida KT2440
cauuacaggcagaucgaaagac

SEQ ID NO: 1619371 - RNA, 19 nt, Pseudomonas putida KT2440
cauguuggaaaugaacagc

SEQ ID NO: 1619372 - RNA, 15 nt, Pseudomonas putida KT2440
cauguugcgcagcaa

SEQ ID NO: 1619373 - RNA, 14 nt, Pseudomonas putida KT2440
cauguucaucaccg

SEQ ID NO: 1619374 - RNA, 19 nt, Pseudomonas putida KT2440
cauggugggucguguagga

SEQ ID NO: 1619375 - RNA, 16 nt, Pseudomonas putida KT2440
caugguggauggucag

SEQ ID NO: 1619376 - RNA, 20 nt, Pseudomonas putida KT2440
caugcggcauagcgugcuuc

SEQ ID NO: 1619377 - RNA, 18 nt, Pseudomonas putida KT2440
caugcgggccggcacgac

SEQ ID NO: 1619378 - RNA, 24 nt, Pseudomonas putida KT2440
caugcgggccggcacgacuucgca

SEQ ID NO: 1619379 - RNA, 13 nt, Pseudomonas putida KT2440
caugcggcccuug

SEQ ID NO: 1619380 - RNA, 21 nt, Pseudomonas putida KT2440
caugcggccgugaacacgugg

SEQ ID NO: 1619381 - RNA, 16 nt, Pseudomonas putida KT2440
caugcgcgaaugaaug

SEQ ID NO: 1619382 - RNA, 13 nt, Pseudomonas putida KT2440
caugcgcgcagcg

SEQ ID NO: 1619383 - RNA, 17 nt, Pseudomonas putida KT2440
caugcgggggccccacc

SEQ ID NO: 1619384 - RNA, 17 nt, Pseudomonas putida KT2440
cauggcgaucucuuccc

SEQ ID NO: 1619385 - RNA, 23 nt, Pseudomonas putida KT2440
cauggcgaucucuucccuucugg

SEQ ID NO: 1619386 - RNA, 16 nt, Pseudomonas putida KT2440
caugauuacgcugaaa

SEQ ID NO: 1619387 - RNA, 15 nt, Pseudomonas putida KT2440
caugauguucugcuu

SEQ ID NO: 1619388 - RNA, 23 nt, Pseudomonas putida KT2440
caugaucaagcuguacaacgcag

SEQ ID NO: 1619389 - RNA, 14 nt, Pseudomonas putida KT2440
caugaucagcgccu

SEQ ID NO: 1619390 - RNA, 15 nt, Pseudomonas putida KT2440
caugaugaccaccag

SEQ ID NO: 1619391 - RNA, 17 nt, Pseudomonas putida KT2440
caugaugaccaccagga

SEQ ID NO: 1619392 - RNA, 20 nt, Pseudomonas putida KT2440
caugaugaccaccaggaaca

SEQ ID NO: 1619393 - RNA, 18 nt, Pseudomonas putida KT2440
caugauugcgggcuuucu

SEQ ID NO: 1619394 - RNA, 13 nt, Pseudomonas putida KT2440
caugcaacccgca

SEQ ID NO: 1619395 - RNA, 20 nt, Pseudomonas putida KT2440
caugcaacccgcauuccuuc

SEQ ID NO: 1619396 - RNA, 17 nt, Pseudomonas putida KT2440
caugcaccacgccacca

SEQ ID NO: 1619397 - RNA, 15 nt, Pseudomonas putida KT2440
caugcaagcagccac

SEQ ID NO: 1619398 - RNA, 16 nt, Pseudomonas putida KT2440
caugcaagcagccacc

SEQ ID NO: 1619399 - RNA, 16 nt, Pseudomonas putida KT2440
caugcaacugcaugau

SEQ ID NO: 1619400 - RNA, 16 nt, Pseudomonas putida KT2440
caugcaauaaccaauc

SEQ ID NO: 1619401 - RNA, 22 nt, Pseudomonas putida KT2440
caugcaauaaccaaucaacggu

SEQ ID NO: 1619402 - RNA, 13 nt, Pseudomonas putida KT2440
caugcaguugagc

SEQ ID NO: 1619403 - RNA, 22 nt, Pseudomonas putida KT2440
caugcaggucgacgauacccag

SEQ ID NO: 1619404 - RNA, 20 nt, Pseudomonas putida KT2440
caugcagguucgaccagaac

SEQ ID NO: 1619405 - RNA, 18 nt, Pseudomonas putida KT2440
caugcaucugcgccccgc

SEQ ID NO: 1619406 - RNA, 23 nt, Pseudomonas putida KT2440
caugccaaagaaggacucggcgu

SEQ ID NO: 1619407 - RNA, 14 nt, Pseudomonas putida KT2440
caugcagcccgcac

SEQ ID NO: 1619408 - RNA, 22 nt, Pseudomonas putida KT2440
caugcagcgucggcagagcgcc

SEQ ID NO: 1619409 - RNA, 19 nt, Pseudomonas putida KT2440
caugcagcguggccuucuc

SEQ ID NO: 1619410 - RNA, 16 nt, Pseudomonas putida KT2440
caugcagcaccuccug

SEQ ID NO: 1619411 - RNA, 17 nt, Pseudomonas putida KT2440
caugcagcaccuccugc

SEQ ID NO: 1619412 - RNA, 14 nt, Pseudomonas putida KT2440
caugcacgcagcaa

SEQ ID NO: 1619413 - RNA, 18 nt, Pseudomonas putida KT2440
caugccccgggugcagcc

SEQ ID NO: 1619414 - RNA, 13 nt, Pseudomonas putida KT2440
caugccccuaccg

SEQ ID NO: 1619415 - RNA, 13 nt, Pseudomonas putida KT2440
caugccccccgcc

SEQ ID NO: 1619416 - RNA, 14 nt, Pseudomonas putida KT2440
caugccccgcaccu

SEQ ID NO: 1619417 - RNA, 14 nt, Pseudomonas putida KT2440
caugcccgccccug

SEQ ID NO: 1619418 - RNA, 15 nt, Pseudomonas putida KT2440
caugcccgccccugc

SEQ ID NO: 1619419 - RNA, 23 nt, Pseudomonas putida KT2440
caugcccgccccugccagcacca

SEQ ID NO: 1619420 - RNA, 18 nt, Pseudomonas putida KT2440
caugcccagcucgcuggc

SEQ ID NO: 1619421 - RNA, 14 nt, Pseudomonas putida KT2440
caugcccagcgcca

SEQ ID NO: 1619422 - RNA, 24 nt, Pseudomonas putida KT2440
caugcccaguucgcgugccaccuc

SEQ ID NO: 1619423 - RNA, 22 nt, Pseudomonas putida KT2440
caugcccgcggcucacccacca

SEQ ID NO: 1619424 - RNA, 22 nt, Pseudomonas putida KT2440
caugcccgcucucacagggacc

SEQ ID NO: 1619425 - RNA, 23 nt, Pseudomonas putida KT2440
caugcccgcgaagggcucaacac

SEQ ID NO: 1619426 - RNA, 14 nt, Pseudomonas putida KT2440
caugcccaccgcug

SEQ ID NO: 1619427 - RNA, 22 nt, Pseudomonas putida KT2440
caugccauugcaccacccccag

SEQ ID NO: 1619428 - RNA, 17 nt, Pseudomonas putida KT2440
caugccauccucggcca

SEQ ID NO: 1619429 - RNA, 20 nt, Pseudomonas putida KT2440
caugccauccucggccaggc

SEQ ID NO: 1619430 - RNA, 21 nt, Pseudomonas putida KT2440
caugccagcuaucucccagcc

SEQ ID NO: 1619431 - RNA, 22 nt, Pseudomonas putida KT2440
caugccagcuaucucccagccu

SEQ ID NO: 1619432 - RNA, 19 nt, Pseudomonas putida KT2440
caugccacggccuucuuca

SEQ ID NO: 1619433 - RNA, 13 nt, Pseudomonas putida KT2440
caugccagcagcu

SEQ ID NO: 1619434 - RNA, 17 nt, Pseudomonas putida KT2440
caugccagcagcuggcu

SEQ ID NO: 1619435 - RNA, 21 nt, Pseudomonas putida KT2440
caugcgaagccgccagcgugc

SEQ ID NO: 1619436 - RNA, 17 nt, Pseudomonas putida KT2440
caugccuaucucuucca

SEQ ID NO: 1619437 - RNA, 13 nt, Pseudomonas putida KT2440
caugccuggcucg

SEQ ID NO: 1619438 - RNA, 23 nt, Pseudomonas putida KT2440
caugccugugauuuacgcugggc

SEQ ID NO: 1619439 - RNA, 15 nt, Pseudomonas putida KT2440
caugccggccccaga

SEQ ID NO: 1619440 - RNA, 21 nt, Pseudomonas putida KT2440
caugacuuugccggagguguc

SEQ ID NO: 1619441 - RNA, 16 nt, Pseudomonas putida KT2440
caugagugcaggcaua

SEQ ID NO: 1619442 - RNA, 14 nt, Pseudomonas putida KT2440
caugacaaacgcca

SEQ ID NO: 1619443 - RNA, 14 nt, Pseudomonas putida KT2440
caugaaggcccagc

SEQ ID NO: 1619444 - RNA, 12 nt, Pseudomonas putida KT2440
caugaagccaug

SEQ ID NO: 1619445 - RNA, 13 nt, Pseudomonas putida KT2440
caugaagccaugg

SEQ ID NO: 1619446 - RNA, 18 nt, Pseudomonas putida KT2440
caugaagccaugggcaga

SEQ ID NO: 1619447 - RNA, 16 nt, Pseudomonas putida KT2440
caugaagcuaagcagg

SEQ ID NO: 1619448 - RNA, 22 nt, Pseudomonas putida KT2440
caugaagggacuuaaucaaugc

SEQ ID NO: 1619449 - RNA, 17 nt, Pseudomonas putida KT2440
caugaagucagccaggu

SEQ ID NO: 1619450 - RNA, 15 nt, Pseudomonas putida KT2440
caugacaaagcggau

SEQ ID NO: 1619451 - RNA, 16 nt, Pseudomonas putida KT2440
caugaaaccgcgugcc

SEQ ID NO: 1619452 - RNA, 21 nt, Pseudomonas putida KT2440
caugaaaccgcgugccgaauu

SEQ ID NO: 1619453 - RNA, 14 nt, Pseudomonas putida KT2440
caugaacagcacgc

SEQ ID NO: 1619454 - RNA, 16 nt, Pseudomonas putida KT2440
caugaacagcacgccc

SEQ ID NO: 1619455 - RNA, 24 nt, Pseudomonas putida KT2440
caugaacagcgcccagaucagcag

SEQ ID NO: 1619456 - RNA, 19 nt, Pseudomonas putida KT2440
caugaacgaggacugcacc

SEQ ID NO: 1619457 - RNA, 16 nt, Pseudomonas putida KT2440
caucuucugcagccac

SEQ ID NO: 1619458 - RNA, 19 nt, Pseudomonas putida KT2440
caucuucugcagccaccac

SEQ ID NO: 1619459 - RNA, 16 nt, Pseudomonas putida KT2440
caucuucuugcaguuc

SEQ ID NO: 1619460 - RNA, 21 nt, Pseudomonas putida KT2440
caucuugcccagggcugcuuc

SEQ ID NO: 1619461 - RNA, 20 nt, Pseudomonas putida KT2440
caucuugccccggugcccau

SEQ ID NO: 1619462 - RNA, 14 nt, Pseudomonas putida KT2440
caucuugcugcucu

SEQ ID NO: 1619463 - RNA, 17 nt, Pseudomonas putida KT2440
caucuugcugcucugca

SEQ ID NO: 1619464 - RNA, 12 nt, Pseudomonas putida KT2440
cauccagcagcu

SEQ ID NO: 1619465 - RNA, 16 nt, Pseudomonas putida KT2440
cauccagcaggguggc

SEQ ID NO: 1619466 - RNA, 15 nt, Pseudomonas putida KT2440
cauccagcacugccu

SEQ ID NO: 1619467 - RNA, 17 nt, Pseudomonas putida KT2440
cauccaccgccccaagc

SEQ ID NO: 1619468 - RNA, 15 nt, Pseudomonas putida KT2440
cauccaccgcggugu

SEQ ID NO: 1619469 - RNA, 13 nt, Pseudomonas putida KT2440
cauccaccuguga

SEQ ID NO: 1619470 - RNA, 16 nt, Pseudomonas putida KT2440
cauccacacgcugcug

SEQ ID NO: 1619471 - RNA, 15 nt, Pseudomonas putida KT2440
cauccacaccagcgg

SEQ ID NO: 1619472 - RNA, 16 nt, Pseudomonas putida KT2440
cauccacaccagcggc

SEQ ID NO: 1619473 - RNA, 17 nt, Pseudomonas putida KT2440
cauccacaccagcggcg

SEQ ID NO: 1619474 - RNA, 12 nt, Pseudomonas putida KT2440
cauccacacccu

SEQ ID NO: 1619475 - RNA, 15 nt, Pseudomonas putida KT2440
cauccaccagcccca

SEQ ID NO: 1619476 - RNA, 16 nt, Pseudomonas putida KT2440
cauccaccagccccag

SEQ ID NO: 1619477 - RNA, 21 nt, Pseudomonas putida KT2440
cauccaccagccccagcgccu

SEQ ID NO: 1619478 - RNA, 16 nt, Pseudomonas putida KT2440
cauccaccacccuggc

SEQ ID NO: 1619479 - RNA, 16 nt, Pseudomonas putida KT2440
cauccacaggcgcccc

SEQ ID NO: 1619480 - RNA, 17 nt, Pseudomonas putida KT2440
cauccacaggcgccccg

SEQ ID NO: 1619481 - RNA, 19 nt, Pseudomonas putida KT2440
cauccacaggcgccccggc

SEQ ID NO: 1619482 - RNA, 21 nt, Pseudomonas putida KT2440
cauccacaucacugcuguaau

SEQ ID NO: 1619483 - RNA, 17 nt, Pseudomonas putida KT2440
cauccacauccgguggc

SEQ ID NO: 1619484 - RNA, 18 nt, Pseudomonas putida KT2440
caucagcagcuguugcug

SEQ ID NO: 1619485 - RNA, 23 nt, Pseudomonas putida KT2440
caucaugauggucacgcggccgu

SEQ ID NO: 1619486 - RNA, 17 nt, Pseudomonas putida KT2440
cauccaaagccaauuug

SEQ ID NO: 1619487 - RNA, 19 nt, Pseudomonas putida KT2440
cauccaacgcugccuugcc

SEQ ID NO: 1619488 - RNA, 18 nt, Pseudomonas putida KT2440
cauccaacccugcgccca

SEQ ID NO: 1619489 - RNA, 18 nt, Pseudomonas putida KT2440
cauccaguccgccagcac

SEQ ID NO: 1619490 - RNA, 22 nt, Pseudomonas putida KT2440
cauccagguuaucuagcaggug

SEQ ID NO: 1619491 - RNA, 12 nt, Pseudomonas putida KT2440
cauccagggcuu

SEQ ID NO: 1619492 - RNA, 19 nt, Pseudomonas putida KT2440
cauccaggcccgugacgaa

SEQ ID NO: 1619493 - RNA, 22 nt, Pseudomonas putida KT2440
cauccaggcguucaucgaaggc

SEQ ID NO: 1619494 - RNA, 18 nt, Pseudomonas putida KT2440
cauccaggcugcacuggc

SEQ ID NO: 1619495 - RNA, 12 nt, Pseudomonas putida KT2440
cauccaggcugg

SEQ ID NO: 1619496 - RNA, 15 nt, Pseudomonas putida KT2440
cauccagcuccagca

SEQ ID NO: 1619497 - RNA, 17 nt, Pseudomonas putida KT2440
cauccaucaccauggcu

SEQ ID NO: 1619498 - RNA, 17 nt, Pseudomonas putida KT2440
cauccaugcaaucacca

SEQ ID NO: 1619499 - RNA, 17 nt, Pseudomonas putida KT2440
cauccauguccauggca

SEQ ID NO: 1619500 - RNA, 21 nt, Pseudomonas putida KT2440
caucccgcuucgccagcgcca

SEQ ID NO: 1619501 - RNA, 17 nt, Pseudomonas putida KT2440
cauccgcaacaugaagc

SEQ ID NO: 1619502 - RNA, 23 nt, Pseudomonas putida KT2440
cauccccgcacgcggugggucga

SEQ ID NO: 1619503 - RNA, 14 nt, Pseudomonas putida KT2440
caucccccggccca

SEQ ID NO: 1619504 - RNA, 19 nt, Pseudomonas putida KT2440
caucccccggcccagcccc

SEQ ID NO: 1619505 - RNA, 12 nt, Pseudomonas putida KT2440
cauccccagcau

SEQ ID NO: 1619506 - RNA, 13 nt, Pseudomonas putida KT2440
cauccccccagcc

SEQ ID NO: 1619507 - RNA, 20 nt, Pseudomonas putida KT2440
caucccagaacuucaccccg

SEQ ID NO: 1619508 - RNA, 18 nt, Pseudomonas putida KT2440
cauccgccaggcucucca

SEQ ID NO: 1619509 - RNA, 14 nt, Pseudomonas putida KT2440
cauccgccucaucc

SEQ ID NO: 1619510 - RNA, 17 nt, Pseudomonas putida KT2440
cauccgccucauccucg

SEQ ID NO: 1619511 - RNA, 20 nt, Pseudomonas putida KT2440
cauccgccucauccucgccc

SEQ ID NO: 1619512 - RNA, 21 nt, Pseudomonas putida KT2440
cauccggcgcggccugcucca

SEQ ID NO: 1619513 - RNA, 15 nt, Pseudomonas putida KT2440
caucgaacgccgccu

SEQ ID NO: 1619514 - RNA, 16 nt, Pseudomonas putida KT2440
caucgaagcagugcug

SEQ ID NO: 1619515 - RNA, 18 nt, Pseudomonas putida KT2440
caucgaagcagugcugcc

SEQ ID NO: 1619516 - RNA, 15 nt, Pseudomonas putida KT2440
caucgacuggaugcu

SEQ ID NO: 1619517 - RNA, 20 nt, Pseudomonas putida KT2440
caucgagauguggcccggga

SEQ ID NO: 1619518 - RNA, 17 nt, Pseudomonas putida KT2440
caucgaggcgcgcgccu

SEQ ID NO: 1619519 - RNA, 20 nt, Pseudomonas putida KT2440
caucgaggcgcgcgccuggg

SEQ ID NO: 1619520 - RNA, 16 nt, Pseudomonas putida KT2440
caucgccaggugcuca

SEQ ID NO: 1619521 - RNA, 14 nt, Pseudomonas putida KT2440
caucgccagcagcg

SEQ ID NO: 1619522 - RNA, 18 nt, Pseudomonas putida KT2440
caucgccaaagccugagc

SEQ ID NO: 1619523 - RNA, 17 nt, Pseudomonas putida KT2440
caucgccaagccgccau

SEQ ID NO: 1619524 - RNA, 15 nt, Pseudomonas putida KT2440
caucggcauugcuga

SEQ ID NO: 1619525 - RNA, 15 nt, Pseudomonas putida KT2440
caucggcacccgcac

SEQ ID NO: 1619526 - RNA, 17 nt, Pseudomonas putida KT2440
caucggcacgcccagca

SEQ ID NO: 1619527 - RNA, 19 nt, Pseudomonas putida KT2440
caucggcaaacacauccag

SEQ ID NO: 1619528 - RNA, 17 nt, Pseudomonas putida KT2440
caucggccgagccgguc

SEQ ID NO: 1619529 - RNA, 14 nt, Pseudomonas putida KT2440
caucggccucucuc

SEQ ID NO: 1619530 - RNA, 17 nt, Pseudomonas putida KT2440
caucggccggcucgaac

SEQ ID NO: 1619531 - RNA, 11 nt, Pseudomonas putida KT2440
caucggcgccu

SEQ ID NO: 1619532 - RNA, 21 nt, Pseudomonas putida KT2440
caucggcgccuucgcccgacc

SEQ ID NO: 1619533 - RNA, 17 nt, Pseudomonas putida KT2440
caucggcgcgcccuccu

SEQ ID NO: 1619534 - RNA, 20 nt, Pseudomonas putida KT2440
caucgcuucugcacucccgc

SEQ ID NO: 1619535 - RNA, 22 nt, Pseudomonas putida KT2440
caucgccgaggaauugcgccag

SEQ ID NO: 1619536 - RNA, 16 nt, Pseudomonas putida KT2440
caucgcccccgcugca

SEQ ID NO: 1619537 - RNA, 18 nt, Pseudomonas putida KT2440
caucgcccccgcugcaca

SEQ ID NO: 1619538 - RNA, 18 nt, Pseudomonas putida KT2440
caucggucggccccucga

SEQ ID NO: 1619539 - RNA, 15 nt, Pseudomonas putida KT2440
caucggugcuuucug

SEQ ID NO: 1619540 - RNA, 18 nt, Pseudomonas putida KT2440
caucggugcuuucugcug

SEQ ID NO: 1619541 - RNA, 19 nt, Pseudomonas putida KT2440
caucggugcuuucugcugu

SEQ ID NO: 1619542 - RNA, 22 nt, Pseudomonas putida KT2440
caucgugaagcaccgccacaau

SEQ ID NO: 1619543 - RNA, 13 nt, Pseudomonas putida KT2440
caucggcgucgcu

SEQ ID NO: 1619544 - RNA, 17 nt, Pseudomonas putida KT2440
caucggcggcaaugucg

SEQ ID NO: 1619545 - RNA, 14 nt, Pseudomonas putida KT2440
caucacccgccccu

SEQ ID NO: 1619546 - RNA, 17 nt, Pseudomonas putida KT2440
caucacccgcgaaugcu

SEQ ID NO: 1619547 - RNA, 13 nt, Pseudomonas putida KT2440
caucaccauggcu

SEQ ID NO: 1619548 - RNA, 12 nt, Pseudomonas putida KT2440
caucaccaggcc

SEQ ID NO: 1619549 - RNA, 14 nt, Pseudomonas putida KT2440
caucaccagccccc

SEQ ID NO: 1619550 - RNA, 13 nt, Pseudomonas putida KT2440
caucaccagcccg

SEQ ID NO: 1619551 - RNA, 18 nt, Pseudomonas putida KT2440
caucaccagcccgaagcg

SEQ ID NO: 1619552 - RNA, 16 nt, Pseudomonas putida KT2440
caucacacucgccccc

SEQ ID NO: 1619553 - RNA, 21 nt, Pseudomonas putida KT2440
caucaccacaaaaccuuccau

SEQ ID NO: 1619554 - RNA, 21 nt, Pseudomonas putida KT2440
caucaccaccauuugaagcac

SEQ ID NO: 1619555 - RNA, 14 nt, Pseudomonas putida KT2440
caucaccaccccca

SEQ ID NO: 1619556 - RNA, 20 nt, Pseudomonas putida KT2440
caucaauggcugggggcgcu

SEQ ID NO: 1619557 - RNA, 14 nt, Pseudomonas putida KT2440
caucaauauccagc

SEQ ID NO: 1619558 - RNA, 14 nt, Pseudomonas putida KT2440
caucaccuuggccg

SEQ ID NO: 1619559 - RNA, 20 nt, Pseudomonas putida KT2440
caucacguuuggcagugcca

SEQ ID NO: 1619560 - RNA, 16 nt, Pseudomonas putida KT2440
caucaccgccagcaug

SEQ ID NO: 1619561 - RNA, 21 nt, Pseudomonas putida KT2440
caucaccgcgucgauacgcug

SEQ ID NO: 1619562 - RNA, 18 nt, Pseudomonas putida KT2440
caucaccggccagcacuu

SEQ ID NO: 1619563 - RNA, 21 nt, Pseudomonas putida KT2440
caucaccggcgaguccugccu

SEQ ID NO: 1619564 - RNA, 22 nt, Pseudomonas putida KT2440
caucaccggcgaguccugccuu

SEQ ID NO: 1619565 - RNA, 20 nt, Pseudomonas putida KT2440
caucacuagaucucgcuuca

SEQ ID NO: 1619566 - RNA, 16 nt, Pseudomonas putida KT2440
cauaucgcugaucacg

SEQ ID NO: 1619567 - RNA, 22 nt, Pseudomonas putida KT2440
cauaucgaaccagcagcaccug

SEQ ID NO: 1619568 - RNA, 14 nt, Pseudomonas putida KT2440
caucaagucauccg

SEQ ID NO: 1619569 - RNA, 15 nt, Pseudomonas putida KT2440
caucaagucauccgc

SEQ ID NO: 1619570 - RNA, 19 nt, Pseudomonas putida KT2440
caucaaauacucagaccaa

SEQ ID NO: 1619571 - RNA, 18 nt, Pseudomonas putida KT2440
caucaaagacuccgcuuc

SEQ ID NO: 1619572 - RNA, 23 nt, Pseudomonas putida KT2440
caucaaagacuccgcuucaucag

SEQ ID NO: 1619573 - RNA, 23 nt, Pseudomonas putida KT2440
cauaggagcggguucacccgcga

SEQ ID NO: 1619574 - RNA, 20 nt, Pseudomonas putida KT2440
cauaggcagccaccucgacc

SEQ ID NO: 1619575 - RNA, 15 nt, Pseudomonas putida KT2440
cauagcuuucaggcg

SEQ ID NO: 1619576 - RNA, 16 nt, Pseudomonas putida KT2440
cauagcucagcuggau

SEQ ID NO: 1619577 - RNA, 13 nt, Pseudomonas putida KT2440
cauagcucagcug

SEQ ID NO: 1619578 - RNA, 17 nt, Pseudomonas putida KT2440
cauagcccugcucgucc

SEQ ID NO: 1619579 - RNA, 13 nt, Pseudomonas putida KT2440
cauagcaguccug

SEQ ID NO: 1619580 - RNA, 20 nt, Pseudomonas putida KT2440
cauagcgguacagcacccag

SEQ ID NO: 1619581 - RNA, 23 nt, Pseudomonas putida KT2440
cauaggccaagguugccaccagc

SEQ ID NO: 1619582 - RNA, 18 nt, Pseudomonas putida KT2440
cauaggggcgguguggca

SEQ ID NO: 1619583 - RNA, 13 nt, Pseudomonas putida KT2440
cauaggcugucac

SEQ ID NO: 1619584 - RNA, 22 nt, Pseudomonas putida KT2440
cauaggcugucacgaugaugcu

SEQ ID NO: 1619585 - RNA, 22 nt, Pseudomonas putida KT2440
cauaguaaggcuggucgcugcc

SEQ ID NO: 1619586 - RNA, 22 nt, Pseudomonas putida KT2440
cagugcauuggcaaacgccugu

SEQ ID NO: 1619587 - RNA, 22 nt, Pseudomonas putida KT2440
cagugccaaggaccagacccgc

SEQ ID NO: 1619588 - RNA, 22 nt, Pseudomonas putida KT2440
cauacucuucgcgggcucgccc

SEQ ID NO: 1619589 - RNA, 12 nt, Pseudomonas putida KT2440
cauacugcugac

SEQ ID NO: 1619590 - RNA, 22 nt, Pseudomonas putida KT2440
cauacuuggccgacauggcgcu

SEQ ID NO: 1619591 - RNA, 18 nt, Pseudomonas putida KT2440
ccagcaucacgccgcgcu

SEQ ID NO: 1619592 - RNA, 18 nt, Pseudomonas putida KT2440
ccagcaucagcacaccca

SEQ ID NO: 1619593 - RNA, 19 nt, Pseudomonas putida KT2440
ccagcaucagcacacccag

SEQ ID NO: 1619594 - RNA, 21 nt, Pseudomonas putida KT2440
ccagcaucagcacacccagca

SEQ ID NO: 1619595 - RNA, 19 nt, Pseudomonas putida KT2440
ccagcaucgccccaggagg

SEQ ID NO: 1619596 - RNA, 21 nt, Pseudomonas putida KT2440
ccagcauguccugcugcaggc

SEQ ID NO: 1619597 - RNA, 14 nt, Pseudomonas putida KT2440
ccagcauggugcag

SEQ ID NO: 1619598 - RNA, 13 nt, Pseudomonas putida KT2440
ccagcauggccga

SEQ ID NO: 1619599 - RNA, 16 nt, Pseudomonas putida KT2440
ccagcaugcgcuugag

SEQ ID NO: 1619600 - RNA, 15 nt, Pseudomonas putida KT2440
ccagcauggaccauc

SEQ ID NO: 1619601 - RNA, 21 nt, Pseudomonas putida KT2440
ccagcauuggauacugcccgu

SEQ ID NO: 1619602 - RNA, 22 nt, Pseudomonas putida KT2440
ccagcagggccaucaucugcug

SEQ ID NO: 1619603 - RNA, 13 nt, Pseudomonas putida KT2440
ccagcagggcagg

SEQ ID NO: 1619604 - RNA, 16 nt, Pseudomonas putida KT2440
ccagcaggcugcgugc

SEQ ID NO: 1619605 - RNA, 20 nt, Pseudomonas putida KT2440
ccagcaggcuugccagcuug

SEQ ID NO: 1619606 - RNA, 17 nt, Pseudomonas putida KT2440
ccagcaggguggccagc

SEQ ID NO: 1619607 - RNA, 15 nt, Pseudomonas putida KT2440
ccagcagggccggcc

SEQ ID NO: 1619608 - RNA, 17 nt, Pseudomonas putida KT2440
ccagcagggccggccca

SEQ ID NO: 1619609 - RNA, 19 nt, Pseudomonas putida KT2440
ccagcaggccaccggcagc

SEQ ID NO: 1619610 - RNA, 14 nt, Pseudomonas putida KT2440
ccagcaggcccggc

SEQ ID NO: 1619611 - RNA, 13 nt, Pseudomonas putida KT2440
ccagcagcuggcu

SEQ ID NO: 1619612 - RNA, 18 nt, Pseudomonas putida KT2440
ccagcagcuggcuugucu

SEQ ID NO: 1619613 - RNA, 15 nt, Pseudomonas putida KT2440
ccagcagcuucuuca

SEQ ID NO: 1619614 - RNA, 19 nt, Pseudomonas putida KT2440
ccagcagguacaccgccuc

SEQ ID NO: 1619615 - RNA, 16 nt, Pseudomonas putida KT2440
ccagcagguacagcac

SEQ ID NO: 1619616 - RNA, 17 nt, Pseudomonas putida KT2440
ccagcaggucaggcccu

SEQ ID NO: 1619617 - RNA, 14 nt, Pseudomonas putida KT2440
ccagcagguccagu

SEQ ID NO: 1619618 - RNA, 15 nt, Pseudomonas putida KT2440
ccagcaggucggcac

SEQ ID NO: 1619619 - RNA, 23 nt, Pseudomonas putida KT2440
ccagcaggucggcacgcaccugu

SEQ ID NO: 1619620 - RNA, 12 nt, Pseudomonas putida KT2440
ccagcagugcca

SEQ ID NO: 1619621 - RNA, 12 nt, Pseudomonas putida KT2440
ccagcagugccg

SEQ ID NO: 1619622 - RNA, 16 nt, Pseudomonas putida KT2440
ccagccccagcccgcc

SEQ ID NO: 1619623 - RNA, 21 nt, Pseudomonas putida KT2440
ccagccccagcggcagcagca

SEQ ID NO: 1619624 - RNA, 12 nt, Pseudomonas putida KT2440
ccagcccgccgc

SEQ ID NO: 1619625 - RNA, 15 nt, Pseudomonas putida KT2440
ccagcccgccgccag

SEQ ID NO: 1619626 - RNA, 17 nt, Pseudomonas putida KT2440
ccagcccgaagccggca

SEQ ID NO: 1619627 - RNA, 13 nt, Pseudomonas putida KT2440
ccagccccagccc

SEQ ID NO: 1619628 - RNA, 16 nt, Pseudomonas putida KT2440
ccagccccaacccacc

SEQ ID NO: 1619629 - RNA, 17 nt, Pseudomonas putida KT2440
ccagcccauccagggcu

SEQ ID NO: 1619630 - RNA, 20 nt, Pseudomonas putida KT2440
ccagcccaugaacagcaagu

SEQ ID NO: 1619631 - RNA, 22 nt, Pseudomonas putida KT2440
ccagcccaggcuggcacccgca

SEQ ID NO: 1619632 - RNA, 17 nt, Pseudomonas putida KT2440
ccagcccgccacaccga

SEQ ID NO: 1619633 - RNA, 18 nt, Pseudomonas putida KT2440
ccagcccgguauuggcca

SEQ ID NO: 1619634 - RNA, 14 nt, Pseudomonas putida KT2440
ccagcccggacugc

SEQ ID NO: 1619635 - RNA, 22 nt, Pseudomonas putida KT2440
ccagcccgucacgugccuucac

SEQ ID NO: 1619636 - RNA, 23 nt, Pseudomonas putida KT2440
ccagcccuucugaaaggcguagg

SEQ ID NO: 1619637 - RNA, 17 nt, Pseudomonas putida KT2440
ccagcccggcggccagc

SEQ ID NO: 1619638 - RNA, 22 nt, Pseudomonas putida KT2440
ccagccagguuguucaguggcg

SEQ ID NO: 1619639 - RNA, 24 nt, Pseudomonas putida KT2440
ccagccagucgcgcaacugcccag

SEQ ID NO: 1619640 - RNA, 21 nt, Pseudomonas putida KT2440
ccagccagguauggccagagc

SEQ ID NO: 1619641 - RNA, 20 nt, Pseudomonas putida KT2440
ccagccaucgagcaccggcu

SEQ ID NO: 1619642 - RNA, 14 nt, Pseudomonas putida KT2440
ccagccauuccagg

SEQ ID NO: 1619643 - RNA, 14 nt, Pseudomonas putida KT2440
ccagccaggcacag

SEQ ID NO: 1619644 - RNA, 20 nt, Pseudomonas putida KT2440
ccagccaggcacagaucaac

SEQ ID NO: 1619645 - RNA, 15 nt, Pseudomonas putida KT2440
ccagccagcgacagc

SEQ ID NO: 1619646 - RNA, 13 nt, Pseudomonas putida KT2440
ccagccagcagcg

SEQ ID NO: 1619647 - RNA, 22 nt, Pseudomonas putida KT2440
ccagccagauauggaagcugug

SEQ ID NO: 1619648 - RNA, 16 nt, Pseudomonas putida KT2440
ccagccaaacccggcc

SEQ ID NO: 1619649 - RNA, 19 nt, Pseudomonas putida KT2440
ccagccaaacccggccgcg

SEQ ID NO: 1619650 - RNA, 20 nt, Pseudomonas putida KT2440
ccagccaacgccccacccgc

SEQ ID NO: 1619651 - RNA, 22 nt, Pseudomonas putida KT2440
ccagccaacgccccacccgcuc

SEQ ID NO: 1619652 - RNA, 23 nt, Pseudomonas putida KT2440
ccagccaccgacgaacagggccg

SEQ ID NO: 1619653 - RNA, 13 nt, Pseudomonas putida KT2440
ccagcacacugag

SEQ ID NO: 1619654 - RNA, 16 nt, Pseudomonas putida KT2440
ccagcaagcgcucaua

SEQ ID NO: 1619655 - RNA, 12 nt, Pseudomonas putida KT2440
ccagcaaggcaa

SEQ ID NO: 1619656 - RNA, 14 nt, Pseudomonas putida KT2440
ccagcaagggccug

SEQ ID NO: 1619657 - RNA, 17 nt, Pseudomonas putida KT2440
ccagcaccaccugugcc

SEQ ID NO: 1619658 - RNA, 21 nt, Pseudomonas putida KT2440
ccagcaccagcgcgaucacca

SEQ ID NO: 1619659 - RNA, 23 nt, Pseudomonas putida KT2440
ccagcaccaucaggcacaggcca

SEQ ID NO: 1619660 - RNA, 18 nt, Pseudomonas putida KT2440
ccagcaccacccaccagc

SEQ ID NO: 1619661 - RNA, 19 nt, Pseudomonas putida KT2440
ccagcaccacccaccagca

SEQ ID NO: 1619662 - RNA, 21 nt, Pseudomonas putida KT2440
ccagcaccacccaccagcagu

SEQ ID NO: 1619663 - RNA, 16 nt, Pseudomonas putida KT2440
ccagcaacaacgccuu

SEQ ID NO: 1619664 - RNA, 17 nt, Pseudomonas putida KT2440
ccagcaacaagcuggac

SEQ ID NO: 1619665 - RNA, 21 nt, Pseudomonas putida KT2440
ccagcaacggacgucccagca

SEQ ID NO: 1619666 - RNA, 14 nt, Pseudomonas putida KT2440
ccagcaacggccgc

SEQ ID NO: 1619667 - RNA, 15 nt, Pseudomonas putida KT2440
ccagcaacgcagcca

SEQ ID NO: 1619668 - RNA, 22 nt, Pseudomonas putida KT2440
ccagcaacuggugaaucagccc

SEQ ID NO: 1619669 - RNA, 17 nt, Pseudomonas putida KT2440
ccagcaacaucgccccc

SEQ ID NO: 1619670 - RNA, 14 nt, Pseudomonas putida KT2440
ccagcaacaugccg

SEQ ID NO: 1619671 - RNA, 15 nt, Pseudomonas putida KT2440
ccagcaacagcugcc

SEQ ID NO: 1619672 - RNA, 22 nt, Pseudomonas putida KT2440
ccagcaacagcugccgggccgg

SEQ ID NO: 1619673 - RNA, 20 nt, Pseudomonas putida KT2440
ccagcaacagccccaucacc

SEQ ID NO: 1619674 - RNA, 18 nt, Pseudomonas putida KT2440
ccagcacuucguccaggg

SEQ ID NO: 1619675 - RNA, 18 nt, Pseudomonas putida KT2440
ccagcacugcugcgcagu

SEQ ID NO: 1619676 - RNA, 19 nt, Pseudomonas putida KT2440
ccagcacuuuugccaccac

SEQ ID NO: 1619677 - RNA, 20 nt, Pseudomonas putida KT2440
ccagcacuuuugccaccacc

SEQ ID NO: 1619678 - RNA, 20 nt, Pseudomonas putida KT2440
ccagcacgucacccacuuca

SEQ ID NO: 1619679 - RNA, 17 nt, Pseudomonas putida KT2440
ccagcacgcaggccagc

SEQ ID NO: 1619680 - RNA, 19 nt, Pseudomonas putida KT2440
ccagcaccgaaccggcgau

SEQ ID NO: 1619681 - RNA, 14 nt, Pseudomonas putida KT2440
ccagcacccgcuug

SEQ ID NO: 1619682 - RNA, 16 nt, Pseudomonas putida KT2440
ccagcacgaaggccag

SEQ ID NO: 1619683 - RNA, 17 nt, Pseudomonas putida KT2440
ccagcacgaaggccagc

SEQ ID NO: 1619684 - RNA, 12 nt, Pseudomonas putida KT2440
ccagcagcgccu

SEQ ID NO: 1619685 - RNA, 12 nt, Pseudomonas putida KT2440
ccagcagccccc

SEQ ID NO: 1619686 - RNA, 14 nt, Pseudomonas putida KT2440
ccagcagccccccu

SEQ ID NO: 1619687 - RNA, 14 nt, Pseudomonas putida KT2440
ccagcagccgggcc

SEQ ID NO: 1619688 - RNA, 15 nt, Pseudomonas putida KT2440
ccagcagccgggccu

SEQ ID NO: 1619689 - RNA, 16 nt, Pseudomonas putida KT2440
ccagcagcgacacuga

SEQ ID NO: 1619690 - RNA, 23 nt, Pseudomonas putida KT2440
ccagcagcgcuccgccaaacccc

SEQ ID NO: 1619691 - RNA, 17 nt, Pseudomonas putida KT2440
ccagcagcgggcacagg

SEQ ID NO: 1619692 - RNA, 20 nt, Pseudomonas putida KT2440
ccagcagcgggcacaggccg

SEQ ID NO: 1619693 - RNA, 14 nt, Pseudomonas putida KT2440
ccagcagcgccugc

SEQ ID NO: 1619694 - RNA, 18 nt, Pseudomonas putida KT2440
ccagcagcgccugcagcg

SEQ ID NO: 1619695 - RNA, 20 nt, Pseudomonas putida KT2440
ccagcagcagcgcaccgugc

SEQ ID NO: 1619696 - RNA, 19 nt, Pseudomonas putida KT2440
ccagcagcaguggcaagcc

SEQ ID NO: 1619697 - RNA, 23 nt, Pseudomonas putida KT2440
ccagcagccaacgccccaggccg

SEQ ID NO: 1619698 - RNA, 15 nt, Pseudomonas putida KT2440
ccagcagcaccugcc

SEQ ID NO: 1619699 - RNA, 19 nt, Pseudomonas putida KT2440
ccagagaauuucuccccag

SEQ ID NO: 1619700 - RNA, 18 nt, Pseudomonas putida KT2440
ccagacucagcugcugcu

SEQ ID NO: 1619701 - RNA, 20 nt, Pseudomonas putida KT2440
ccagagcccgcucggucagg

SEQ ID NO: 1619702 - RNA, 16 nt, Pseudomonas putida KT2440
ccagaccaccucaucc

SEQ ID NO: 1619703 - RNA, 14 nt, Pseudomonas putida KT2440
ccagaccagcagca

SEQ ID NO: 1619704 - RNA, 18 nt, Pseudomonas putida KT2440
ccagacaacuggccaggg

SEQ ID NO: 1619705 - RNA, 19 nt, Pseudomonas putida KT2440
ccagacauugaagaagccc

SEQ ID NO: 1619706 - RNA, 22 nt, Pseudomonas putida KT2440
ccagaccuugcgcacggccucc

SEQ ID NO: 1619707 - RNA, 19 nt, Pseudomonas putida KT2440
ccagaccgguuacgcaacu

SEQ ID NO: 1619708 - RNA, 22 nt, Pseudomonas putida KT2440
ccagaccgguuacgcaacucca

SEQ ID NO: 1619709 - RNA, 18 nt, Pseudomonas putida KT2440
ccagacgccgcagugaca

SEQ ID NO: 1619710 - RNA, 14 nt, Pseudomonas putida KT2440
ccagaucauuuucu

SEQ ID NO: 1619711 - RNA, 15 nt, Pseudomonas putida KT2440
ccagaucggccagcu

SEQ ID NO: 1619712 - RNA, 14 nt, Pseudomonas putida KT2440
ccagaucggccagc

SEQ ID NO: 1619713 - RNA, 12 nt, Pseudomonas putida KT2440
ccagaucggcag

SEQ ID NO: 1619714 - RNA, 15 nt, Pseudomonas putida KT2440
ccagauucaagcccg

SEQ ID NO: 1619715 - RNA, 17 nt, Pseudomonas putida KT2440
ccagaacagccacagcu

SEQ ID NO: 1619716 - RNA, 19 nt, Pseudomonas putida KT2440
ccagaacagcucgaucagu

SEQ ID NO: 1619717 - RNA, 16 nt, Pseudomonas putida KT2440
ccagaaccccggcccu

SEQ ID NO: 1619718 - RNA, 16 nt, Pseudomonas putida KT2440
ccagaacggcacgccc

SEQ ID NO: 1619719 - RNA, 17 nt, Pseudomonas putida KT2440
ccagaaagccacugcac

SEQ ID NO: 1619720 - RNA, 18 nt, Pseudomonas putida KT2440
ccagaacuucaccccgua

SEQ ID NO: 1619721 - RNA, 20 nt, Pseudomonas putida KT2440
ccagaagggcgcaaaagucc

SEQ ID NO: 1619722 - RNA, 18 nt, Pseudomonas putida KT2440
ccagaaucucaaccaccu

SEQ ID NO: 1619723 - RNA, 19 nt, Pseudomonas putida KT2440
ccagaauggaggagggcug

SEQ ID NO: 1619724 - RNA, 17 nt, Pseudomonas putida KT2440
ccagaauguugcaagga

SEQ ID NO: 1619725 - RNA, 18 nt, Pseudomonas putida KT2440
ccacuugaagaccgccau

SEQ ID NO: 1619726 - RNA, 13 nt, Pseudomonas putida KT2440
ccacuucuggcug

SEQ ID NO: 1619727 - RNA, 14 nt, Pseudomonas putida KT2440
ccacuucugcggcc

SEQ ID NO: 1619728 - RNA, 22 nt, Pseudomonas putida KT2440
ccacuucugcggccagggcauc

SEQ ID NO: 1619729 - RNA, 19 nt, Pseudomonas putida KT2440
ccacuugcguucgccgcuu

SEQ ID NO: 1619730 - RNA, 23 nt, Pseudomonas putida KT2440
ccacuugcagguagcgcccgggc

SEQ ID NO: 1619731 - RNA, 13 nt, Pseudomonas putida KT2440
ccacuugcucggu

SEQ ID NO: 1619732 - RNA, 21 nt, Pseudomonas putida KT2440
ccacuugcucggugcugcugc

SEQ ID NO: 1619733 - RNA, 13 nt, Pseudomonas putida KT2440
ccacuuccugaag

SEQ ID NO: 1619734 - RNA, 20 nt, Pseudomonas putida KT2440
ccacuucgcaacgcuuggca

SEQ ID NO: 1619735 - RNA, 24 nt, Pseudomonas putida KT2440
ccacuucacugacaaagccugcac

SEQ ID NO: 1619736 - RNA, 12 nt, Pseudomonas putida KT2440
ccacuucaagca

SEQ ID NO: 1619737 - RNA, 17 nt, Pseudomonas putida KT2440
ccacuguugcagcgcca

SEQ ID NO: 1619738 - RNA, 22 nt, Pseudomonas putida KT2440
ccacuguucagguguuccagca

SEQ ID NO: 1619739 - RNA, 22 nt, Pseudomonas putida KT2440
ccacugugcccgccaggcgcaa

SEQ ID NO: 1619740 - RNA, 21 nt, Pseudomonas putida KT2440
ccacuggaugacgccgcagcc

SEQ ID NO: 1619741 - RNA, 22 nt, Pseudomonas putida KT2440
ccacugucggguuggucgccag

SEQ ID NO: 1619742 - RNA, 15 nt, Pseudomonas putida KT2440
ccacugucugccagu

SEQ ID NO: 1619743 - RNA, 16 nt, Pseudomonas putida KT2440
ccacuggugccggcac

SEQ ID NO: 1619744 - RNA, 20 nt, Pseudomonas putida KT2440
ccacuggugccggcacggcc

SEQ ID NO: 1619745 - RNA, 16 nt, Pseudomonas putida KT2440
ccacugguaguucauc

SEQ ID NO: 1619746 - RNA, 16 nt, Pseudomonas putida KT2440
ccacuggggcuucugc

SEQ ID NO: 1619747 - RNA, 18 nt, Pseudomonas putida KT2440
ccacuggggcuucugccg

SEQ ID NO: 1619748 - RNA, 23 nt, Pseudomonas putida KT2440
ccacugcaccaaugacuccgccc

SEQ ID NO: 1619749 - RNA, 15 nt, Pseudomonas putida KT2440
ccacugcaggugcag

SEQ ID NO: 1619750 - RNA, 21 nt, Pseudomonas putida KT2440
ccacagugcuuccagcaggac

SEQ ID NO: 1619751 - RNA, 22 nt, Pseudomonas putida KT2440
ccacagugucccggccagggcu

SEQ ID NO: 1619752 - RNA, 22 nt, Pseudomonas putida KT2440
ccacaguucauuguucuggcca

SEQ ID NO: 1619753 - RNA, 19 nt, Pseudomonas putida KT2440
ccacauacugcuucugccg

SEQ ID NO: 1619754 - RNA, 15 nt, Pseudomonas putida KT2440
ccacauaggccagcu

SEQ ID NO: 1619755 - RNA, 18 nt, Pseudomonas putida KT2440
ccacagguuuagcgcugg

SEQ ID NO: 1619756 - RNA, 18 nt, Pseudomonas putida KT2440
ccacagguaagucacagg

SEQ ID NO: 1619757 - RNA, 17 nt, Pseudomonas putida KT2440
ccacagguaauacgcug

SEQ ID NO: 1619758 - RNA, 23 nt, Pseudomonas putida KT2440
ccacagguacugagucggccucg

SEQ ID NO: 1619759 - RNA, 18 nt, Pseudomonas putida KT2440
ccacagguaugugagcug

SEQ ID NO: 1619760 - RNA, 21 nt, Pseudomonas putida KT2440
ccacaggugacaagcugcgcc

SEQ ID NO: 1619761 - RNA, 13 nt, Pseudomonas putida KT2440
ccacaauggcgca

SEQ ID NO: 1619762 - RNA, 17 nt, Pseudomonas putida KT2440
ccacacucgacgcugcc

SEQ ID NO: 1619763 - RNA, 17 nt, Pseudomonas putida KT2440
ccacacggcaagccacg

SEQ ID NO: 1619764 - RNA, 14 nt, Pseudomonas putida KT2440
ccacacggcagccc

SEQ ID NO: 1619765 - RNA, 18 nt, Pseudomonas putida KT2440
ccacacugcucagugcug

SEQ ID NO: 1619766 - RNA, 22 nt, Pseudomonas putida KT2440
ccacacugcucagugcuggcgu

SEQ ID NO: 1619767 - RNA, 14 nt, Pseudomonas putida KT2440
ccacauccucugcc

SEQ ID NO: 1619768 - RNA, 15 nt, Pseudomonas putida KT2440
ccacauccucugccc

SEQ ID NO: 1619769 - RNA, 17 nt, Pseudomonas putida KT2440
ccacauccucugcccgc

SEQ ID NO: 1619770 - RNA, 20 nt, Pseudomonas putida KT2440
ccacauccccgccgccagca

SEQ ID NO: 1619771 - RNA, 21 nt, Pseudomonas putida KT2440
ccacauccgaccccagcauga

SEQ ID NO: 1619772 - RNA, 19 nt, Pseudomonas putida KT2440
ccacaugcgagccgcugcc

SEQ ID NO: 1619773 - RNA, 23 nt, Pseudomonas putida KT2440
ccacaugcgagccgcugccaaag

SEQ ID NO: 1619774 - RNA, 20 nt, Pseudomonas putida KT2440
ccacaagucggguuuaccug

SEQ ID NO: 1619775 - RNA, 16 nt, Pseudomonas putida KT2440
ccacaagcgcaggcgg

SEQ ID NO: 1619776 - RNA, 22 nt, Pseudomonas putida KT2440
ccacaaagccuucccccuccug

SEQ ID NO: 1619777 - RNA, 21 nt, Pseudomonas putida KT2440
ccacaaaaaagcagggccgcg

SEQ ID NO: 1619778 - RNA, 17 nt, Pseudomonas putida KT2440
ccacaaaaccuuccaug

SEQ ID NO: 1619779 - RNA, 18 nt, Pseudomonas putida KT2440
ccacaaaaucacaggcca

SEQ ID NO: 1619780 - RNA, 14 nt, Pseudomonas putida KT2440
ccacaaacucuccu

SEQ ID NO: 1619781 - RNA, 20 nt, Pseudomonas putida KT2440
ccaaugcagcuuugaggcuc

SEQ ID NO: 1619782 - RNA, 18 nt, Pseudomonas putida KT2440
ccaaugcagaugguccgg

SEQ ID NO: 1619783 - RNA, 16 nt, Pseudomonas putida KT2440
ccaaugcagccgcccg

SEQ ID NO: 1619784 - RNA, 16 nt, Pseudomonas putida KT2440
ccaaugcccaugccca

SEQ ID NO: 1619785 - RNA, 19 nt, Pseudomonas putida KT2440
ccaaguacaccggcagcac

SEQ ID NO: 1619786 - RNA, 19 nt, Pseudomonas putida KT2440
ccaaguuuucgcaguacuu

SEQ ID NO: 1619787 - RNA, 18 nt, Pseudomonas putida KT2440
ccaauaaaaaaccggcca

SEQ ID NO: 1619788 - RNA, 17 nt, Pseudomonas putida KT2440
ccaauaaaaacaacagg

SEQ ID NO: 1619789 - RNA, 18 nt, Pseudomonas putida KT2440
ccaauaaaaacaacaggu

SEQ ID NO: 1619790 - RNA, 14 nt, Pseudomonas putida KT2440
ccaauaauaaaaaa

SEQ ID NO: 1619791 - RNA, 16 nt, Pseudomonas putida KT2440
ccacccggcgcgcagc

SEQ ID NO: 1619792 - RNA, 15 nt, Pseudomonas putida KT2440
ccaccgagccuuccg

SEQ ID NO: 1619793 - RNA, 14 nt, Pseudomonas putida KT2440
ccaccgcacucugc

SEQ ID NO: 1619794 - RNA, 17 nt, Pseudomonas putida KT2440
ccaccgcacucugcugc

SEQ ID NO: 1619795 - RNA, 14 nt, Pseudomonas putida KT2440
ccaccgcgccagcc

SEQ ID NO: 1619796 - RNA, 15 nt, Pseudomonas putida KT2440
ccaccgcgccagccu

SEQ ID NO: 1619797 - RNA, 21 nt, Pseudomonas putida KT2440
ccaccccgcaaagcccugccu

SEQ ID NO: 1619798 - RNA, 20 nt, Pseudomonas putida KT2440
ccaccccgcaggccgcagcc

SEQ ID NO: 1619799 - RNA, 16 nt, Pseudomonas putida KT2440
ccaccccagcguuccu

SEQ ID NO: 1619800 - RNA, 18 nt, Pseudomonas putida KT2440
ccaccccagcguuccugg

SEQ ID NO: 1619801 - RNA, 21 nt, Pseudomonas putida KT2440
ccaccccggggcgcuccagca

SEQ ID NO: 1619802 - RNA, 22 nt, Pseudomonas putida KT2440
ccacccgacgccaccuucgcca

SEQ ID NO: 1619803 - RNA, 13 nt, Pseudomonas putida KT2440
ccacccgaacaaa

SEQ ID NO: 1619804 - RNA, 21 nt, Pseudomonas putida KT2440
ccacccgaacaaaacccuucu

SEQ ID NO: 1619805 - RNA, 21 nt, Pseudomonas putida KT2440
ccacccgcguuugcaacuggc

SEQ ID NO: 1619806 - RNA, 20 nt, Pseudomonas putida KT2440
ccaccagcguugucccgccc

SEQ ID NO: 1619807 - RNA, 21 nt, Pseudomonas putida KT2440
ccaccagcguugucccgcccu

SEQ ID NO: 1619808 - RNA, 18 nt, Pseudomonas putida KT2440
ccaccagcugcaccaccu

SEQ ID NO: 1619809 - RNA, 14 nt, Pseudomonas putida KT2440
ccaccagccccagc

SEQ ID NO: 1619810 - RNA, 12 nt, Pseudomonas putida KT2440
ccaccagcgccg

SEQ ID NO: 1619811 - RNA, 16 nt, Pseudomonas putida KT2440
ccacccaccuuggccc

SEQ ID NO: 1619812 - RNA, 12 nt, Pseudomonas putida KT2440
ccacccaaggca

SEQ ID NO: 1619813 - RNA, 15 nt, Pseudomonas putida KT2440
ccacccaccagcagu

SEQ ID NO: 1619814 - RNA, 21 nt, Pseudomonas putida KT2440
ccacccagaacagccacagcu

SEQ ID NO: 1619815 - RNA, 12 nt, Pseudomonas putida KT2440
ccacccaggccc

SEQ ID NO: 1619816 - RNA, 15 nt, Pseudomonas putida KT2440
ccaccaccagcaaca

SEQ ID NO: 1619817 - RNA, 14 nt, Pseudomonas putida KT2440
ccaccagcccuucg

SEQ ID NO: 1619818 - RNA, 12 nt, Pseudomonas putida KT2440
ccaccagcccca

SEQ ID NO: 1619819 - RNA, 13 nt, Pseudomonas putida KT2440
ccaccacacgccc

SEQ ID NO: 1619820 - RNA, 22 nt, Pseudomonas putida KT2440
ccaccaacagcaccggccaggc

SEQ ID NO: 1619821 - RNA, 14 nt, Pseudomonas putida KT2440
ccaccaaccggcca

SEQ ID NO: 1619822 - RNA, 13 nt, Pseudomonas putida KT2440
ccaccugcuccag

SEQ ID NO: 1619823 - RNA, 13 nt, Pseudomonas putida KT2440
ccaccuggccacc

SEQ ID NO: 1619824 - RNA, 16 nt, Pseudomonas putida KT2440
ccaccuggccacccgg

SEQ ID NO: 1619825 - RNA, 12 nt, Pseudomonas putida KT2440
ccaccugcccca

SEQ ID NO: 1619826 - RNA, 17 nt, Pseudomonas putida KT2440
ccaccuuccacucuucc

SEQ ID NO: 1619827 - RNA, 20 nt, Pseudomonas putida KT2440
ccaccuuacuugcacauccc

SEQ ID NO: 1619828 - RNA, 13 nt, Pseudomonas putida KT2440
ccaccuucagcgg

SEQ ID NO: 1619829 - RNA, 21 nt, Pseudomonas putida KT2440
ccaccuggucgaaugcgugca

SEQ ID NO: 1619830 - RNA, 12 nt, Pseudomonas putida KT2440
ccaccugggcca

SEQ ID NO: 1619831 - RNA, 19 nt, Pseudomonas putida KT2440
ccaccuugugcggcccucg

SEQ ID NO: 1619832 - RNA, 18 nt, Pseudomonas putida KT2440
ccacgaacgcccccagcc

SEQ ID NO: 1619833 - RNA, 19 nt, Pseudomonas putida KT2440
ccacgaacgcccccagccc

SEQ ID NO: 1619834 - RNA, 15 nt, Pseudomonas putida KT2440
ccacgaaccugugca

SEQ ID NO: 1619835 - RNA, 20 nt, Pseudomonas putida KT2440
ccaccggcagcaccugccag

SEQ ID NO: 1619836 - RNA, 24 nt, Pseudomonas putida KT2440
ccaccggcagcaccugccagccgc

SEQ ID NO: 1619837 - RNA, 21 nt, Pseudomonas putida KT2440
ccaccgcgcgguuaagcgcca

SEQ ID NO: 1619838 - RNA, 19 nt, Pseudomonas putida KT2440
ccaccgcgcgccaguucgc

SEQ ID NO: 1619839 - RNA, 16 nt, Pseudomonas putida KT2440
ccaccgcucgcgccgc

SEQ ID NO: 1619840 - RNA, 13 nt, Pseudomonas putida KT2440
ccaccgcugcaau

SEQ ID NO: 1619841 - RNA, 18 nt, Pseudomonas putida KT2440
ccaccgcggugucuucuu

SEQ ID NO: 1619842 - RNA, 14 nt, Pseudomonas putida KT2440
ccaccgcucaaacc

SEQ ID NO: 1619843 - RNA, 12 nt, Pseudomonas putida KT2440
ccaccggccgcc

SEQ ID NO: 1619844 - RNA, 14 nt, Pseudomonas putida KT2440
ccaccggccuggaa

SEQ ID NO: 1619845 - RNA, 15 nt, Pseudomonas putida KT2440
ccaccggccuggaac

SEQ ID NO: 1619846 - RNA, 17 nt, Pseudomonas putida KT2440
ccaccgugagcauggca

SEQ ID NO: 1619847 - RNA, 13 nt, Pseudomonas putida KT2440
ccaacccagccag

SEQ ID NO: 1619848 - RNA, 16 nt, Pseudomonas putida KT2440
ccaaccaugcuggcca

SEQ ID NO: 1619849 - RNA, 17 nt, Pseudomonas putida KT2440
ccaaccaugcuggccaa

SEQ ID NO: 1619850 - RNA, 19 nt, Pseudomonas putida KT2440
ccaacagcaccggccaggc

SEQ ID NO: 1619851 - RNA, 18 nt, Pseudomonas putida KT2440
ccaaauguuacggacccu

SEQ ID NO: 1619852 - RNA, 20 nt, Pseudomonas putida KT2440
ccaaauguuacggacccuau

SEQ ID NO: 1619853 - RNA, 23 nt, Pseudomonas putida KT2440
ccaaagcccgugccgcaucagcc

SEQ ID NO: 1619854 - RNA, 22 nt, Pseudomonas putida KT2440
ccaaagccaauuugccagcgug

SEQ ID NO: 1619855 - RNA, 19 nt, Pseudomonas putida KT2440
ccaaagauaccccugcgcc

SEQ ID NO: 1619856 - RNA, 16 nt, Pseudomonas putida KT2440
ccaaccugaucauuca

SEQ ID NO: 1619857 - RNA, 21 nt, Pseudomonas putida KT2440
ccaaccugccgaucuucgccc

SEQ ID NO: 1619858 - RNA, 18 nt, Pseudomonas putida KT2440
ccaacccucacucgcggc

SEQ ID NO: 1619859 - RNA, 18 nt, Pseudomonas putida KT2440
ccaacccggucccgcccu

SEQ ID NO: 1619860 - RNA, 16 nt, Pseudomonas putida KT2440
ccaaccgcucucgauc

SEQ ID NO: 1619861 - RNA, 22 nt, Pseudomonas putida KT2440
ccaaccgcuucaccgcgcaccu

SEQ ID NO: 1619862 - RNA, 18 nt, Pseudomonas putida KT2440
ccaaccgcgacucguccg

SEQ ID NO: 1619863 - RNA, 15 nt, Pseudomonas putida KT2440
ccaaccgccccaccc

SEQ ID NO: 1619864 - RNA, 13 nt, Pseudomonas putida KT2440
ccaacuccagcgc

SEQ ID NO: 1619865 - RNA, 23 nt, Pseudomonas putida KT2440
ccaacuccuucucgcccacgauc

SEQ ID NO: 1619866 - RNA, 23 nt, Pseudomonas putida KT2440
ccaacuccuugcgcaucaagcgg

SEQ ID NO: 1619867 - RNA, 21 nt, Pseudomonas putida KT2440
ccaacucgccauucaccagcu

SEQ ID NO: 1619868 - RNA, 18 nt, Pseudomonas putida KT2440
ccaacuccccacccaggu

SEQ ID NO: 1619869 - RNA, 22 nt, Pseudomonas putida KT2440
ccaacuucgugcucggcacugc

SEQ ID NO: 1619870 - RNA, 14 nt, Pseudomonas putida KT2440
ccaacuugcgcagu

SEQ ID NO: 1619871 - RNA, 15 nt, Pseudomonas putida KT2440
ccaacuugccaaaau

SEQ ID NO: 1619872 - RNA, 20 nt, Pseudomonas putida KT2440
ccaaggcugacgccaguugg

SEQ ID NO: 1619873 - RNA, 14 nt, Pseudomonas putida KT2440
ccaagcgucggcca

SEQ ID NO: 1619874 - RNA, 17 nt, Pseudomonas putida KT2440
ccaagcgucggccaccu

SEQ ID NO: 1619875 - RNA, 23 nt, Pseudomonas putida KT2440
ccaagcgcuccgccaauugcgcc

SEQ ID NO: 1619876 - RNA, 20 nt, Pseudomonas putida KT2440
ccaaggucagcaagccgccg

SEQ ID NO: 1619877 - RNA, 16 nt, Pseudomonas putida KT2440
ccaagguaaucuggcu

SEQ ID NO: 1619878 - RNA, 17 nt, Pseudomonas putida KT2440
ccaagguugccaccagc

SEQ ID NO: 1619879 - RNA, 18 nt, Pseudomonas putida KT2440
ccaagguugccaccagca

SEQ ID NO: 1619880 - RNA, 21 nt, Pseudomonas putida KT2440
ccaagcccuucucgcucagca

SEQ ID NO: 1619881 - RNA, 17 nt, Pseudomonas putida KT2440
ccaagccgcugccacag

SEQ ID NO: 1619882 - RNA, 18 nt, Pseudomonas putida KT2440
ccaagccgcugccacagg

SEQ ID NO: 1619883 - RNA, 16 nt, Pseudomonas putida KT2440
ccaagccugaggcugc

SEQ ID NO: 1619884 - RNA, 18 nt, Pseudomonas putida KT2440
ccaagcccacacaccgca

SEQ ID NO: 1619885 - RNA, 20 nt, Pseudomonas putida KT2440
ccaagccacuggccagcaga

SEQ ID NO: 1619886 - RNA, 17 nt, Pseudomonas putida KT2440
ccaaaccgcugcccagc

SEQ ID NO: 1619887 - RNA, 13 nt, Pseudomonas putida KT2440
ccaaaccccagca

SEQ ID NO: 1619888 - RNA, 22 nt, Pseudomonas putida KT2440
ccaaacaggaucuccucggcca

SEQ ID NO: 1619889 - RNA, 22 nt, Pseudomonas putida KT2440
ccaaacauaaggaguaccgagc

SEQ ID NO: 1619890 - RNA, 15 nt, Pseudomonas putida KT2440
ccaaaaccuguucca

SEQ ID NO: 1619891 - RNA, 16 nt, Pseudomonas putida KT2440
cauugaucgccgccag

SEQ ID NO: 1619892 - RNA, 19 nt, Pseudomonas putida KT2440
cauugaugccgaaggccuu

SEQ ID NO: 1619893 - RNA, 18 nt, Pseudomonas putida KT2440
cauugaggaugcugaagc

SEQ ID NO: 1619894 - RNA, 17 nt, Pseudomonas putida KT2440
cauugauaacugcggug

SEQ ID NO: 1619895 - RNA, 18 nt, Pseudomonas putida KT2440
caguaagauacgcgcaga

SEQ ID NO: 1619896 - RNA, 16 nt, Pseudomonas putida KT2440
caguaacaggcgcaca

SEQ ID NO: 1619897 - RNA, 16 nt, Pseudomonas putida KT2440
caguaccagcagcaca

SEQ ID NO: 1619898 - RNA, 21 nt, Pseudomonas putida KT2440
caguaccagcagcacaucccg

SEQ ID NO: 1619899 - RNA, 13 nt, Pseudomonas putida KT2440
caguaccagcagc

SEQ ID NO: 1619900 - RNA, 14 nt, Pseudomonas putida KT2440
caguacauagaaca

SEQ ID NO: 1619901 - RNA, 16 nt, Pseudomonas putida KT2440
caguacauagaacagc

SEQ ID NO: 1619902 - RNA, 14 nt, Pseudomonas putida KT2440
caguaccacuucca

SEQ ID NO: 1619903 - RNA, 14 nt, Pseudomonas putida KT2440
caguaccacagcca

SEQ ID NO: 1619904 - RNA, 16 nt, Pseudomonas putida KT2440
caguaaugcagccggc

SEQ ID NO: 1619905 - RNA, 19 nt, Pseudomonas putida KT2440
caguaaugcagccggcccc

SEQ ID NO: 1619906 - RNA, 13 nt, Pseudomonas putida KT2440
cagguugagcacc

SEQ ID NO: 1619907 - RNA, 16 nt, Pseudomonas putida KT2440
cagguugauccagccc

SEQ ID NO: 1619908 - RNA, 17 nt, Pseudomonas putida KT2440
cagguugaacagcagcg

SEQ ID NO: 1619909 - RNA, 23 nt, Pseudomonas putida KT2440
cagguugaacagcagcgccgcca

SEQ ID NO: 1619910 - RNA, 13 nt, Pseudomonas putida KT2440
cagguugcacagc

SEQ ID NO: 1619911 - RNA, 17 nt, Pseudomonas putida KT2440
cagguugcccagcaugc

SEQ ID NO: 1619912 - RNA, 16 nt, Pseudomonas putida KT2440
cagguugccucaucac

SEQ ID NO: 1619913 - RNA, 17 nt, Pseudomonas putida KT2440
cagguucgaauccugcu

SEQ ID NO: 1619914 - RNA, 23 nt, Pseudomonas putida KT2440
cagguucgaccacugcaggugca

SEQ ID NO: 1619915 - RNA, 17 nt, Pseudomonas putida KT2440
cagguucgaccagaaca

SEQ ID NO: 1619916 - RNA, 14 nt, Pseudomonas putida KT2440
cagguucagcagga

SEQ ID NO: 1619917 - RNA, 19 nt, Pseudomonas putida KT2440
cagguucagcaggauggcc

SEQ ID NO: 1619918 - RNA, 20 nt, Pseudomonas putida KT2440
cagguucaggcgcagcacgc

SEQ ID NO: 1619919 - RNA, 16 nt, Pseudomonas putida KT2440
cagguuccccccacgc

SEQ ID NO: 1619920 - RNA, 20 nt, Pseudomonas putida KT2440
cagguucugccggacaagaa

SEQ ID NO: 1619921 - RNA, 14 nt, Pseudomonas putida KT2440
cagguucugaaucu

SEQ ID NO: 1619922 - RNA, 23 nt, Pseudomonas putida KT2440
cagguucggguaguccuccaaca

SEQ ID NO: 1619923 - RNA, 15 nt, Pseudomonas putida KT2440
cagguuggccgccgc

SEQ ID NO: 1619924 - RNA, 22 nt, Pseudomonas putida KT2440
cagguugcgugccucgcccagg

SEQ ID NO: 1619925 - RNA, 20 nt, Pseudomonas putida KT2440
cagguugcguugaccugcug

SEQ ID NO: 1619926 - RNA, 22 nt, Pseudomonas putida KT2440
cagguuggagcggaacucgccc

SEQ ID NO: 1619927 - RNA, 17 nt, Pseudomonas putida KT2440
cagguugcuggccuugg

SEQ ID NO: 1619928 - RNA, 13 nt, Pseudomonas putida KT2440
cagguuggacagc

SEQ ID NO: 1619929 - RNA, 15 nt, Pseudomonas putida KT2440
cagguuggugcaauu

SEQ ID NO: 1619930 - RNA, 16 nt, Pseudomonas putida KT2440
cagguuuaccggccgc

SEQ ID NO: 1619931 - RNA, 10 nt, Pseudomonas putida KT2440
caguaaaaac

SEQ ID NO: 1619932 - RNA, 20 nt, Pseudomonas putida KT2440
caguaaaaacuggccagcag

SEQ ID NO: 1619933 - RNA, 16 nt, Pseudomonas putida KT2440
caggucgggcuggcug

SEQ ID NO: 1619934 - RNA, 15 nt, Pseudomonas putida KT2440
caggucggggugauu

SEQ ID NO: 1619935 - RNA, 23 nt, Pseudomonas putida KT2440
caggucggcggggcccggacagg

SEQ ID NO: 1619936 - RNA, 16 nt, Pseudomonas putida KT2440
caggucggcggccucg

SEQ ID NO: 1619937 - RNA, 18 nt, Pseudomonas putida KT2440
caggucggcaaccauggc

SEQ ID NO: 1619938 - RNA, 19 nt, Pseudomonas putida KT2440
caggucggcaaccauggcu

SEQ ID NO: 1619939 - RNA, 13 nt, Pseudomonas putida KT2440
caggucggcacgc

SEQ ID NO: 1619940 - RNA, 14 nt, Pseudomonas putida KT2440
caggucggcgcgcg

SEQ ID NO: 1619941 - RNA, 11 nt, Pseudomonas putida KT2440
caggucggcgg

SEQ ID NO: 1619942 - RNA, 20 nt, Pseudomonas putida KT2440
caggucgaugaucgccgccg

SEQ ID NO: 1619943 - RNA, 14 nt, Pseudomonas putida KT2440
caggucgaugccuu

SEQ ID NO: 1619944 - RNA, 21 nt, Pseudomonas putida KT2440
caggucgacgauacccagcgc

SEQ ID NO: 1619945 - RNA, 16 nt, Pseudomonas putida KT2440
caggucgacccgcgcc

SEQ ID NO: 1619946 - RNA, 20 nt, Pseudomonas putida KT2440
caggucgacccgcgccaggg

SEQ ID NO: 1619947 - RNA, 19 nt, Pseudomonas putida KT2440
caggucgacaugcaccacg

SEQ ID NO: 1619948 - RNA, 17 nt, Pseudomonas putida KT2440
caggucgacacccagca

SEQ ID NO: 1619949 - RNA, 20 nt, Pseudomonas putida KT2440
caggucgacacccagcaccc

SEQ ID NO: 1619950 - RNA, 13 nt, Pseudomonas putida KT2440
caggucgccagca

SEQ ID NO: 1619951 - RNA, 16 nt, Pseudomonas putida KT2440
caggucgccagcacca

SEQ ID NO: 1619952 - RNA, 19 nt, Pseudomonas putida KT2440
caggucgccagcaccauca

SEQ ID NO: 1619953 - RNA, 20 nt, Pseudomonas putida KT2440
caggucgcggagccaaucuc

SEQ ID NO: 1619954 - RNA, 17 nt, Pseudomonas putida KT2440
caggucgcggagccaga

SEQ ID NO: 1619955 - RNA, 13 nt, Pseudomonas putida KT2440
caggucgccgcug

SEQ ID NO: 1619956 - RNA, 22 nt, Pseudomonas putida KT2440
caggucgccgcuguucagcccu

SEQ ID NO: 1619957 - RNA, 21 nt, Pseudomonas putida KT2440
cagggguaaugccccagccga

SEQ ID NO: 1619958 - RNA, 13 nt, Pseudomonas putida KT2440
caggucagcacgc

SEQ ID NO: 1619959 - RNA, 20 nt, Pseudomonas putida KT2440
caggucaaacguauccgccg

SEQ ID NO: 1619960 - RNA, 21 nt, Pseudomonas putida KT2440
caggggcuguauagcccugcc

SEQ ID NO: 1619961 - RNA, 15 nt, Pseudomonas putida KT2440
cagggggcagcugcu

SEQ ID NO: 1619962 - RNA, 22 nt, Pseudomonas putida KT2440
cagggggccgcuucgcgaccca

SEQ ID NO: 1619963 - RNA, 20 nt, Pseudomonas putida KT2440
caggucagcgcucaaaaaaa

SEQ ID NO: 1619964 - RNA, 20 nt, Pseudomonas putida KT2440
caggucaugaugcccgucgg

SEQ ID NO: 1619965 - RNA, 21 nt, Pseudomonas putida KT2440
caggucauguagcgccuggcc

SEQ ID NO: 1619966 - RNA, 16 nt, Pseudomonas putida KT2440
cagguccagccgccau

SEQ ID NO: 1619967 - RNA, 14 nt, Pseudomonas putida KT2440
cagguccagcuccg

SEQ ID NO: 1619968 - RNA, 18 nt, Pseudomonas putida KT2440
cagguccgguaacuggcc

SEQ ID NO: 1619969 - RNA, 21 nt, Pseudomonas putida KT2440
cagguccgguaacuggcccac

SEQ ID NO: 1619970 - RNA, 23 nt, Pseudomonas putida KT2440
cagguccgguaacuggcccaccc

SEQ ID NO: 1619971 - RNA, 13 nt, Pseudomonas putida KT2440
cagguccugcucc

SEQ ID NO: 1619972 - RNA, 19 nt, Pseudomonas putida KT2440
cagguccugcuccacccgu

SEQ ID NO: 1619973 - RNA, 16 nt, Pseudomonas putida KT2440
cagguggauguugaug

SEQ ID NO: 1619974 - RNA, 19 nt, Pseudomonas putida KT2440
caggugguaacuggccagu

SEQ ID NO: 1619975 - RNA, 18 nt, Pseudomonas putida KT2440
cagguguagagccuuugg

SEQ ID NO: 1619976 - RNA, 19 nt, Pseudomonas putida KT2440
cagguguuguugcaaccag

SEQ ID NO: 1619977 - RNA, 16 nt, Pseudomonas putida KT2440
caggugugccacuuca

SEQ ID NO: 1619978 - RNA, 16 nt, Pseudomonas putida KT2440
cagguguggaaacccg

SEQ ID NO: 1619979 - RNA, 15 nt, Pseudomonas putida KT2440
cagguguggcucagc

SEQ ID NO: 1619980 - RNA, 16 nt, Pseudomonas putida KT2440
cagguguggcucagcu

SEQ ID NO: 1619981 - RNA, 14 nt, Pseudomonas putida KT2440
cagguucacuucca

SEQ ID NO: 1619982 - RNA, 15 nt, Pseudomonas putida KT2440
cagguucacuuccac

SEQ ID NO: 1619983 - RNA, 20 nt, Pseudomonas putida KT2440
cagguucaacggcgcccggg

SEQ ID NO: 1619984 - RNA, 21 nt, Pseudomonas putida KT2440
caggugcugaugcccaaacgc

SEQ ID NO: 1619985 - RNA, 20 nt, Pseudomonas putida KT2440
caggugcggcagcucgccgu

SEQ ID NO: 1619986 - RNA, 14 nt, Pseudomonas putida KT2440
caggugcggcgcga

SEQ ID NO: 1619987 - RNA, 16 nt, Pseudomonas putida KT2440
caggugcgcaccuugg

SEQ ID NO: 1619988 - RNA, 14 nt, Pseudomonas putida KT2440
caggugcgcacgcu

SEQ ID NO: 1619989 - RNA, 21 nt, Pseudomonas putida KT2440
caggugcgcacgcugcccagg

SEQ ID NO: 1619990 - RNA, 14 nt, Pseudomonas putida KT2440
caggugcgcaggcu

SEQ ID NO: 1619991 - RNA, 16 nt, Pseudomonas putida KT2440
caggugcagccagccc

SEQ ID NO: 1619992 - RNA, 17 nt, Pseudomonas putida KT2440
caggugcagccagcccc

SEQ ID NO: 1619993 - RNA, 22 nt, Pseudomonas putida KT2440
caggugcagccagccccaaccc

SEQ ID NO: 1619994 - RNA, 15 nt, Pseudomonas putida KT2440
caggugccucugcug

SEQ ID NO: 1619995 - RNA, 17 nt, Pseudomonas putida KT2440
caggugccucugcugcg

SEQ ID NO: 1619996 - RNA, 17 nt, Pseudomonas putida KT2440
caggugccaggcucagg

SEQ ID NO: 1619997 - RNA, 19 nt, Pseudomonas putida KT2440
caggugccaggcucaggcc

SEQ ID NO: 1619998 - RNA, 16 nt, Pseudomonas putida KT2440
caggugacaagcugcg

SEQ ID NO: 1619999 - RNA, 20 nt, Pseudomonas putida KT2440
caggugacaagcugcgcccu

SEQ ID NO: 1620000 - RNA, 20 nt, Pseudomonas putida KT2440
caggugauagacguggcugu

SEQ ID NO: 1620001 - RNA, 23 nt, Pseudomonas putida KT2440
caggugcagcaacagguacaugu

SEQ ID NO: 1620002 - RNA, 16 nt, Pseudomonas putida KT2440
caggugauuuccucuu

SEQ ID NO: 1620003 - RNA, 19 nt, Pseudomonas putida KT2440
caggugauuuccucuucac

SEQ ID NO: 1620004 - RNA, 20 nt, Pseudomonas putida KT2440
caggugcaacccggccuugg

SEQ ID NO: 1620005 - RNA, 14 nt, Pseudomonas putida KT2440
caggugcaccaaca

SEQ ID NO: 1620006 - RNA, 15 nt, Pseudomonas putida KT2440
caguagaagcccaga

SEQ ID NO: 1620007 - RNA, 15 nt, Pseudomonas putida KT2440
caguagagcccccag

SEQ ID NO: 1620008 - RNA, 15 nt, Pseudomonas putida KT2440
caguagaacaaccgg

SEQ ID NO: 1620009 - RNA, 21 nt, Pseudomonas putida KT2440
caguacuuauaagcagcaagc

SEQ ID NO: 1620010 - RNA, 21 nt, Pseudomonas putida KT2440
caguacggccaucagcaagcc

SEQ ID NO: 1620011 - RNA, 23 nt, Pseudomonas putida KT2440
caguacggccaucagcaagccgc

SEQ ID NO: 1620012 - RNA, 20 nt, Pseudomonas putida KT2440
caguaccuaggguucaaauc

SEQ ID NO: 1620013 - RNA, 15 nt, Pseudomonas putida KT2440
caguacgcaggcaua

SEQ ID NO: 1620014 - RNA, 13 nt, Pseudomonas putida KT2440
caguacgccaccc

SEQ ID NO: 1620015 - RNA, 15 nt, Pseudomonas putida KT2440
caguacgccacccag

SEQ ID NO: 1620016 - RNA, 17 nt, Pseudomonas putida KT2440
caguacgccacccagau

SEQ ID NO: 1620017 - RNA, 22 nt, Pseudomonas putida KT2440
caguacgcgccugcaccuggcu

SEQ ID NO: 1620018 - RNA, 13 nt, Pseudomonas putida KT2440
caguaggccaccg

SEQ ID NO: 1620019 - RNA, 12 nt, Pseudomonas putida KT2440
caguaggcugca

SEQ ID NO: 1620020 - RNA, 13 nt, Pseudomonas putida KT2440
caguagcacagug

SEQ ID NO: 1620021 - RNA, 14 nt, Pseudomonas putida KT2440
caguagcacagugc

SEQ ID NO: 1620022 - RNA, 19 nt, Pseudomonas putida KT2440
caguaucgccccggucagc

SEQ ID NO: 1620023 - RNA, 19 nt, Pseudomonas putida KT2440
caguccaaccgcaagcggc

SEQ ID NO: 1620024 - RNA, 18 nt, Pseudomonas putida KT2440
cagucagggucucggcca

SEQ ID NO: 1620025 - RNA, 14 nt, Pseudomonas putida KT2440
cagucagcgccgau

SEQ ID NO: 1620026 - RNA, 16 nt, Pseudomonas putida KT2440
cagucauccgggccgu

SEQ ID NO: 1620027 - RNA, 13 nt, Pseudomonas putida KT2440
cagucauccucag

SEQ ID NO: 1620028 - RNA, 22 nt, Pseudomonas putida KT2440
cagucacccaccggcuccaccu

SEQ ID NO: 1620029 - RNA, 13 nt, Pseudomonas putida KT2440
cagucgaaaccga

SEQ ID NO: 1620030 - RNA, 17 nt, Pseudomonas putida KT2440
cagucggcgcuggacag

SEQ ID NO: 1620031 - RNA, 18 nt, Pseudomonas putida KT2440
cagucucgaccacuuccc

SEQ ID NO: 1620032 - RNA, 20 nt, Pseudomonas putida KT2440
cagucucgaccacuucccac

SEQ ID NO: 1620033 - RNA, 20 nt, Pseudomonas putida KT2440
caguccgguagcgcgccugc

SEQ ID NO: 1620034 - RNA, 18 nt, Pseudomonas putida KT2440
cagucgaccgggcagacc

SEQ ID NO: 1620035 - RNA, 21 nt, Pseudomonas putida KT2440
cagucgcacagguccagccgc

SEQ ID NO: 1620036 - RNA, 22 nt, Pseudomonas putida KT2440
cagucgcacagguccagccgcc

SEQ ID NO: 1620037 - RNA, 21 nt, Pseudomonas putida KT2440
cagucgaugggcccgagcccc

SEQ ID NO: 1620038 - RNA, 22 nt, Pseudomonas putida KT2440
cagucgaucccgaggucagcag

SEQ ID NO: 1620039 - RNA, 17 nt, Pseudomonas putida KT2440
cagucgaugucgugguc

SEQ ID NO: 1620040 - RNA, 13 nt, Pseudomonas putida KT2440
caguccugcaacu

SEQ ID NO: 1620041 - RNA, 14 nt, Pseudomonas putida KT2440
caguccguuaccac

SEQ ID NO: 1620042 - RNA, 18 nt, Pseudomonas putida KT2440
cagugagccucacacagc

SEQ ID NO: 1620043 - RNA, 14 nt, Pseudomonas putida KT2440
cagugcaauaccag

SEQ ID NO: 1620044 - RNA, 17 nt, Pseudomonas putida KT2440
cagugcaauaccagccu

SEQ ID NO: 1620045 - RNA, 20 nt, Pseudomonas putida KT2440
cagucugcucagccaaccgc

SEQ ID NO: 1620046 - RNA, 18 nt, Pseudomonas putida KT2440
cagucuucguacaugcgc

SEQ ID NO: 1620047 - RNA, 16 nt, Pseudomonas putida KT2440
cagugaauuccuugcu

SEQ ID NO: 1620048 - RNA, 16 nt, Pseudomonas putida KT2440
cagugaacuccaacgc

SEQ ID NO: 1620049 - RNA, 20 nt, Pseudomonas putida KT2440
cagugaagcuuccaguuggc

SEQ ID NO: 1620050 - RNA, 14 nt, Pseudomonas putida KT2440
cagugaacaccacu

SEQ ID NO: 1620051 - RNA, 18 nt, Pseudomonas putida KT2440
caggccggccaccagugc

SEQ ID NO: 1620052 - RNA, 17 nt, Pseudomonas putida KT2440
caggccugaaacgcccu

SEQ ID NO: 1620053 - RNA, 19 nt, Pseudomonas putida KT2440
caggccgguugcuccagcg

SEQ ID NO: 1620054 - RNA, 22 nt, Pseudomonas putida KT2440
caggccggucuugucugacagc

SEQ ID NO: 1620055 - RNA, 16 nt, Pseudomonas putida KT2440
caggccuuucagcgcc

SEQ ID NO: 1620056 - RNA, 15 nt, Pseudomonas putida KT2440
caggcgaucagucag

SEQ ID NO: 1620057 - RNA, 15 nt, Pseudomonas putida KT2440
caggcgauucaggcu

SEQ ID NO: 1620058 - RNA, 21 nt, Pseudomonas putida KT2440
caggccuggaugcguugcuuc

SEQ ID NO: 1620059 - RNA, 17 nt, Pseudomonas putida KT2440
caggccuucaucggccu

SEQ ID NO: 1620060 - RNA, 21 nt, Pseudomonas putida KT2440
caggccuucaucggccuccuc

SEQ ID NO: 1620061 - RNA, 18 nt, Pseudomonas putida KT2440
caggccugcggccaggcc

SEQ ID NO: 1620062 - RNA, 20 nt, Pseudomonas putida KT2440
caggccuucgccacugccac

SEQ ID NO: 1620063 - RNA, 16 nt, Pseudomonas putida KT2440
caggccuucggugcug

SEQ ID NO: 1620064 - RNA, 21 nt, Pseudomonas putida KT2440
caggccuucggugcuggcgcu

SEQ ID NO: 1620065 - RNA, 20 nt, Pseudomonas putida KT2440
caggccuugccgcucaccac

SEQ ID NO: 1620066 - RNA, 18 nt, Pseudomonas putida KT2440
caggccgacaacagcaug

SEQ ID NO: 1620067 - RNA, 19 nt, Pseudomonas putida KT2440
caggccgacaacagcaugc

SEQ ID NO: 1620068 - RNA, 18 nt, Pseudomonas putida KT2440
caggcccugacgccagcg

SEQ ID NO: 1620069 - RNA, 18 nt, Pseudomonas putida KT2440
caggcccgccaccgccuc

SEQ ID NO: 1620070 - RNA, 16 nt, Pseudomonas putida KT2440
caggcccggcugaaac

SEQ ID NO: 1620071 - RNA, 19 nt, Pseudomonas putida KT2440
caggcccggcugaaaccgc

SEQ ID NO: 1620072 - RNA, 14 nt, Pseudomonas putida KT2440
caggccgcccaccc

SEQ ID NO: 1620073 - RNA, 16 nt, Pseudomonas putida KT2440
caggccgcccacccac

SEQ ID NO: 1620074 - RNA, 18 nt, Pseudomonas putida KT2440
caggccgcccacccacca

SEQ ID NO: 1620075 - RNA, 18 nt, Pseudomonas putida KT2440
caggccgcacgcgccucu

SEQ ID NO: 1620076 - RNA, 21 nt, Pseudomonas putida KT2440
caggccgcugaacaacuccgg

SEQ ID NO: 1620077 - RNA, 17 nt, Pseudomonas putida KT2440
caggccccugcaacagg

SEQ ID NO: 1620078 - RNA, 22 nt, Pseudomonas putida KT2440
caggccccuuggccaacggcau

SEQ ID NO: 1620079 - RNA, 13 nt, Pseudomonas putida KT2440
caggcccggcccu

SEQ ID NO: 1620080 - RNA, 13 nt, Pseudomonas putida KT2440
caggcccagccgg

SEQ ID NO: 1620081 - RNA, 14 nt, Pseudomonas putida KT2440
caggcccacggcgu

SEQ ID NO: 1620082 - RNA, 11 nt, Pseudomonas putida KT2440
caggcccacca

SEQ ID NO: 1620083 - RNA, 19 nt, Pseudomonas putida KT2440
caggcccaccagucugcuc

SEQ ID NO: 1620084 - RNA, 14 nt, Pseudomonas putida KT2440
caggcccagcaggu

SEQ ID NO: 1620085 - RNA, 12 nt, Pseudomonas putida KT2440
caggcccagccc

SEQ ID NO: 1620086 - RNA, 14 nt, Pseudomonas putida KT2440
caggcccagccccg

SEQ ID NO: 1620087 - RNA, 15 nt, Pseudomonas putida KT2440
caggcccagccccgc

SEQ ID NO: 1620088 - RNA, 16 nt, Pseudomonas putida KT2440
caggccagcgucgugu

SEQ ID NO: 1620089 - RNA, 14 nt, Pseudomonas putida KT2440
caggccacggucca

SEQ ID NO: 1620090 - RNA, 22 nt, Pseudomonas putida KT2440
caggccagcacggccagcaccg

SEQ ID NO: 1620091 - RNA, 21 nt, Pseudomonas putida KT2440
caggccaguuccucggccuga

SEQ ID NO: 1620092 - RNA, 22 nt, Pseudomonas putida KT2440
caggccauauugcugagccagu

SEQ ID NO: 1620093 - RNA, 16 nt, Pseudomonas putida KT2440
caggccaucagcagcu

SEQ ID NO: 1620094 - RNA, 21 nt, Pseudomonas putida KT2440
caggccauggugcacgccagc

SEQ ID NO: 1620095 - RNA, 14 nt, Pseudomonas putida KT2440
caggccauccagcg

SEQ ID NO: 1620096 - RNA, 22 nt, Pseudomonas putida KT2440
caggccaucuaagccuccagag

SEQ ID NO: 1620097 - RNA, 20 nt, Pseudomonas putida KT2440
caggccaugcccgcccgggc

SEQ ID NO: 1620098 - RNA, 22 nt, Pseudomonas putida KT2440
caggccaugcccuugccuucgg

SEQ ID NO: 1620099 - RNA, 14 nt, Pseudomonas putida KT2440
caggaucugcugca

SEQ ID NO: 1620100 - RNA, 17 nt, Pseudomonas putida KT2440
caggaucuccucggcca

SEQ ID NO: 1620101 - RNA, 23 nt, Pseudomonas putida KT2440
caggaucuccucggccagcggcc

SEQ ID NO: 1620102 - RNA, 12 nt, Pseudomonas putida KT2440
caggcaugccag

SEQ ID NO: 1620103 - RNA, 15 nt, Pseudomonas putida KT2440
caggcaugccagcag

SEQ ID NO: 1620104 - RNA, 20 nt, Pseudomonas putida KT2440
caggcaucgaacgccgccug

SEQ ID NO: 1620105 - RNA, 20 nt, Pseudomonas putida KT2440
cagggcgcugucggcgcgga

SEQ ID NO: 1620106 - RNA, 20 nt, Pseudomonas putida KT2440
cagggcguugccgaucaggu

SEQ ID NO: 1620107 - RNA, 18 nt, Pseudomonas putida KT2440
caggggcccuuggccuca

SEQ ID NO: 1620108 - RNA, 12 nt, Pseudomonas putida KT2440
caggggccgcgc

SEQ ID NO: 1620109 - RNA, 13 nt, Pseudomonas putida KT2440
caggggccgcgca

SEQ ID NO: 1620110 - RNA, 13 nt, Pseudomonas putida KT2440
aaaauuuuugaau

SEQ ID NO: 1620111 - RNA, 16 nt, Pseudomonas putida KT2440
cagggccggcccuuuc

SEQ ID NO: 1620112 - RNA, 15 nt, Pseudomonas putida KT2440
cagggcccagccacc

SEQ ID NO: 1620113 - RNA, 17 nt, Pseudomonas putida KT2440
cagggcccagccaccga

SEQ ID NO: 1620114 - RNA, 24 nt, Pseudomonas putida KT2440
cagggcccagccaccgacgaacag

SEQ ID NO: 1620115 - RNA, 22 nt, Pseudomonas putida KT2440
cagggcccucaacccucgccca

SEQ ID NO: 1620116 - RNA, 13 nt, Pseudomonas putida KT2440
cagggcaggcuga

SEQ ID NO: 1620117 - RNA, 15 nt, Pseudomonas putida KT2440
cagggcaggcugaug

SEQ ID NO: 1620118 - RNA, 16 nt, Pseudomonas putida KT2440
cagggcaggggacagc

SEQ ID NO: 1620119 - RNA, 21 nt, Pseudomonas putida KT2440
cagggcaggggacagccacau

SEQ ID NO: 1620120 - RNA, 21 nt, Pseudomonas putida KT2440
cagggcaucgaucccuggggc

SEQ ID NO: 1620121 - RNA, 14 nt, Pseudomonas putida KT2440
cagggcaucggaca

SEQ ID NO: 1620122 - RNA, 15 nt, Pseudomonas putida KT2440
cagggcaucggacag

SEQ ID NO: 1620123 - RNA, 17 nt, Pseudomonas putida KT2440
cagggcaucggacaggu

SEQ ID NO: 1620124 - RNA, 15 nt, Pseudomonas putida KT2440
cagggaccgugcagg

SEQ ID NO: 1620125 - RNA, 21 nt, Pseudomonas putida KT2440
cagggcacacuucgccgugcu

SEQ ID NO: 1620126 - RNA, 15 nt, Pseudomonas putida KT2440
cagggcacggcugcc

SEQ ID NO: 1620127 - RNA, 16 nt, Pseudomonas putida KT2440
cagggcaauggcguca

SEQ ID NO: 1620128 - RNA, 23 nt, Pseudomonas putida KT2440
cagggcaauggcgucacagacau

SEQ ID NO: 1620129 - RNA, 13 nt, Pseudomonas putida KT2440
caggcgcagcagc

SEQ ID NO: 1620130 - RNA, 14 nt, Pseudomonas putida KT2440
caggcgcagcugcc

SEQ ID NO: 1620131 - RNA, 18 nt, Pseudomonas putida KT2440
caggcgcagcgcaugcuc

SEQ ID NO: 1620132 - RNA, 19 nt, Pseudomonas putida KT2440
caggcgcaacucgcgccca

SEQ ID NO: 1620133 - RNA, 16 nt, Pseudomonas putida KT2440
caggcguaaacccagg

SEQ ID NO: 1620134 - RNA, 17 nt, Pseudomonas putida KT2440
caggcgguuggccaugu

SEQ ID NO: 1620135 - RNA, 14 nt, Pseudomonas putida KT2440
caggcgguccagca

SEQ ID NO: 1620136 - RNA, 14 nt, Pseudomonas putida KT2440
caggcucagcaggu

SEQ ID NO: 1620137 - RNA, 18 nt, Pseudomonas putida KT2440
caggcguacaucagccuc

SEQ ID NO: 1620138 - RNA, 16 nt, Pseudomonas putida KT2440
caggcuaucgaggggc

SEQ ID NO: 1620139 - RNA, 14 nt, Pseudomonas putida KT2440
caggcuaugccggu

SEQ ID NO: 1620140 - RNA, 19 nt, Pseudomonas putida KT2440
caggcuaugccggucagca

SEQ ID NO: 1620141 - RNA, 21 nt, Pseudomonas putida KT2440
caggcuaugccggucagcagc

SEQ ID NO: 1620142 - RNA, 22 nt, Pseudomonas putida KT2440
caggcuaugccggucagcagca

SEQ ID NO: 1620143 - RNA, 18 nt, Pseudomonas putida KT2440
caggcucagcuccaugcg

SEQ ID NO: 1620144 - RNA, 15 nt, Pseudomonas putida KT2440
caggcucagggcagc

SEQ ID NO: 1620145 - RNA, 18 nt, Pseudomonas putida KT2440
caggcuccaaagccagcg

SEQ ID NO: 1620146 - RNA, 17 nt, Pseudomonas putida KT2440
caggcuggccagcaagu

SEQ ID NO: 1620147 - RNA, 21 nt, Pseudomonas putida KT2440
caggcuggauaagaucacugc

SEQ ID NO: 1620148 - RNA, 23 nt, Pseudomonas putida KT2440
caggcuggauaagaucacugcgc

SEQ ID NO: 1620149 - RNA, 13 nt, Pseudomonas putida KT2440
caggcuggccacc

SEQ ID NO: 1620150 - RNA, 15 nt, Pseudomonas putida KT2440
caggcuggccaccau

SEQ ID NO: 1620151 - RNA, 19 nt, Pseudomonas putida KT2440
caggcuggcgacgccaccc

SEQ ID NO: 1620152 - RNA, 22 nt, Pseudomonas putida KT2440
caggcuguccacaccaaaguca

SEQ ID NO: 1620153 - RNA, 17 nt, Pseudomonas putida KT2440
caggcugucgaacaggc

SEQ ID NO: 1620154 - RNA, 17 nt, Pseudomonas putida KT2440
caggcugcgugccugcu

SEQ ID NO: 1620155 - RNA, 19 nt, Pseudomonas putida KT2440
caggcugcgcccgcacagc

SEQ ID NO: 1620156 - RNA, 18 nt, Pseudomonas putida KT2440
caggcuguuccauuuccc

SEQ ID NO: 1620157 - RNA, 19 nt, Pseudomonas putida KT2440
caggcuguuguacggcagc

SEQ ID NO: 1620158 - RNA, 22 nt, Pseudomonas putida KT2440
caggcuuacaacugcuccaggc

SEQ ID NO: 1620159 - RNA, 19 nt, Pseudomonas putida KT2440
cagggaacugcgcgagcca

SEQ ID NO: 1620160 - RNA, 16 nt, Pseudomonas putida KT2440
caggcuucaggccgcc

SEQ ID NO: 1620161 - RNA, 23 nt, Pseudomonas putida KT2440
caggaaccgcucccagguuuucu

SEQ ID NO: 1620162 - RNA, 16 nt, Pseudomonas putida KT2440
caggaacagcggcagc

SEQ ID NO: 1620163 - RNA, 20 nt, Pseudomonas putida KT2440
caggaaggucaccaguucac

SEQ ID NO: 1620164 - RNA, 23 nt, Pseudomonas putida KT2440
caggaagucgauguucagcaccu

SEQ ID NO: 1620165 - RNA, 14 nt, Pseudomonas putida KT2440
caggaaucaccaga

SEQ ID NO: 1620166 - RNA, 18 nt, Pseudomonas putida KT2440
caggagagcuuggucagc

SEQ ID NO: 1620167 - RNA, 17 nt, Pseudomonas putida KT2440
cagcuugccaccaucga

SEQ ID NO: 1620168 - RNA, 21 nt, Pseudomonas putida KT2440
cagcuugccauccuugaagua

SEQ ID NO: 1620169 - RNA, 17 nt, Pseudomonas putida KT2440
cagcuugcccaucaccu

SEQ ID NO: 1620170 - RNA, 20 nt, Pseudomonas putida KT2440
cagcuugccgaucagcgagu

SEQ ID NO: 1620171 - RNA, 21 nt, Pseudomonas putida KT2440
cagcuugaacuugcucuucaa

SEQ ID NO: 1620172 - RNA, 18 nt, Pseudomonas putida KT2440
cagcuugaggcccaugug

SEQ ID NO: 1620173 - RNA, 16 nt, Pseudomonas putida KT2440
cagcuugaccccuuca

SEQ ID NO: 1620174 - RNA, 20 nt, Pseudomonas putida KT2440
cagcuugacggugcgcgcca

SEQ ID NO: 1620175 - RNA, 16 nt, Pseudomonas putida KT2440
cagcuucuugcaccgc

SEQ ID NO: 1620176 - RNA, 18 nt, Pseudomonas putida KT2440
cagcuucuugcaccgcuc

SEQ ID NO: 1620177 - RNA, 13 nt, Pseudomonas putida KT2440
cagcuucuugugc

SEQ ID NO: 1620178 - RNA, 19 nt, Pseudomonas putida KT2440
cagcuugcgcaaggggucg

SEQ ID NO: 1620179 - RNA, 19 nt, Pseudomonas putida KT2440
cagcucuucaucccugacc

SEQ ID NO: 1620180 - RNA, 17 nt, Pseudomonas putida KT2440
cagcucuggucaccuuc

SEQ ID NO: 1620181 - RNA, 18 nt, Pseudomonas putida KT2440
cagcucuggucaccuucg

SEQ ID NO: 1620182 - RNA, 21 nt, Pseudomonas putida KT2440
cagcucuggagguagccgugg

SEQ ID NO: 1620183 - RNA, 17 nt, Pseudomonas putida KT2440
cagcucuggcagcagug

SEQ ID NO: 1620184 - RNA, 22 nt, Pseudomonas putida KT2440
cagcugugcugccauaagccca

SEQ ID NO: 1620185 - RNA, 21 nt, Pseudomonas putida KT2440
cagcugucauuacccggcaga

SEQ ID NO: 1620186 - RNA, 19 nt, Pseudomonas putida KT2440
cagcuguacgcuggccaag

SEQ ID NO: 1620187 - RNA, 22 nt, Pseudomonas putida KT2440
cagcuguacgcuggccaaggcc

SEQ ID NO: 1620188 - RNA, 17 nt, Pseudomonas putida KT2440
cagcucuugucgacagu

SEQ ID NO: 1620189 - RNA, 18 nt, Pseudomonas putida KT2440
cagcuucauggcgccgau

SEQ ID NO: 1620190 - RNA, 12 nt, Pseudomonas putida KT2440
cagcuucaacaa

SEQ ID NO: 1620191 - RNA, 19 nt, Pseudomonas putida KT2440
cagcgcuucgaucagcgcc

SEQ ID NO: 1620192 - RNA, 18 nt, Pseudomonas putida KT2440
cagcgcuucgaucgccgg

SEQ ID NO: 1620193 - RNA, 22 nt, Pseudomonas putida KT2440
cagcgcuucgaucgccggcagc

SEQ ID NO: 1620194 - RNA, 21 nt, Pseudomonas putida KT2440
cagcgcugcgaggccccagac

SEQ ID NO: 1620195 - RNA, 14 nt, Pseudomonas putida KT2440
cagcgcugccgccu

SEQ ID NO: 1620196 - RNA, 15 nt, Pseudomonas putida KT2440
cagcgcugccgccuu

SEQ ID NO: 1620197 - RNA, 17 nt, Pseudomonas putida KT2440
cagcgcugucccccagc

SEQ ID NO: 1620198 - RNA, 19 nt, Pseudomonas putida KT2440
cagcgcggucugcggcagc

SEQ ID NO: 1620199 - RNA, 19 nt, Pseudomonas putida KT2440
cagcgcggugaccagcggc

SEQ ID NO: 1620200 - RNA, 16 nt, Pseudomonas putida KT2440
cagcgcugacucagcg

SEQ ID NO: 1620201 - RNA, 19 nt, Pseudomonas putida KT2440
cagcgcugacucagcggcc

SEQ ID NO: 1620202 - RNA, 17 nt, Pseudomonas putida KT2440
cagcgcucgcugccggu

SEQ ID NO: 1620203 - RNA, 15 nt, Pseudomonas putida KT2440
cagcgcuccagcaac

SEQ ID NO: 1620204 - RNA, 14 nt, Pseudomonas putida KT2440
cagcgcguacagcg

SEQ ID NO: 1620205 - RNA, 21 nt, Pseudomonas putida KT2440
cagcgcuccgccaaaccccag

SEQ ID NO: 1620206 - RNA, 22 nt, Pseudomonas putida KT2440
cagcgcuccgccaaaccccagc

SEQ ID NO: 1620207 - RNA, 23 nt, Pseudomonas putida KT2440
cagcgcuccgccaaaccccagca

SEQ ID NO: 1620208 - RNA, 15 nt, Pseudomonas putida KT2440
cagcucaggccuugc

SEQ ID NO: 1620209 - RNA, 19 nt, Pseudomonas putida KT2440
cagcucaggccuugcucga

SEQ ID NO: 1620210 - RNA, 22 nt, Pseudomonas putida KT2440
cagcucacuggcauccagcgcc

SEQ ID NO: 1620211 - RNA, 15 nt, Pseudomonas putida KT2440
cagcucacuggccaa

SEQ ID NO: 1620212 - RNA, 17 nt, Pseudomonas putida KT2440
cagcucacuggccaacu

SEQ ID NO: 1620213 - RNA, 18 nt, Pseudomonas putida KT2440
cagcucacuggccaacuc

SEQ ID NO: 1620214 - RNA, 21 nt, Pseudomonas putida KT2440
cagcucacguuugggcggcgu

SEQ ID NO: 1620215 - RNA, 22 nt, Pseudomonas putida KT2440
cagcuauuucgggccuuugggc

SEQ ID NO: 1620216 - RNA, 20 nt, Pseudomonas putida KT2440
cagcucaaccccaaaccgcu

SEQ ID NO: 1620217 - RNA, 22 nt, Pseudomonas putida KT2440
cagcucacgcaagcggcccuga

SEQ ID NO: 1620218 - RNA, 15 nt, Pseudomonas putida KT2440
cagcucacgcagcca

SEQ ID NO: 1620219 - RNA, 14 nt, Pseudomonas putida KT2440
cagcucacagcacu

SEQ ID NO: 1620220 - RNA, 14 nt, Pseudomonas putida KT2440
cagcucaagcccug

SEQ ID NO: 1620221 - RNA, 16 nt, Pseudomonas putida KT2440
cagcucaagcccugcc

SEQ ID NO: 1620222 - RNA, 16 nt, Pseudomonas putida KT2440
cagcuaucucccagcc

SEQ ID NO: 1620223 - RNA, 20 nt, Pseudomonas putida KT2440
cagcuacgcuggacuugccu

SEQ ID NO: 1620224 - RNA, 15 nt, Pseudomonas putida KT2440
cagcuccauaccaaa

SEQ ID NO: 1620225 - RNA, 19 nt, Pseudomonas putida KT2440
cagcuccgacaggcugugu

SEQ ID NO: 1620226 - RNA, 22 nt, Pseudomonas putida KT2440
cagcucccgcgcaugcugccag

SEQ ID NO: 1620227 - RNA, 17 nt, Pseudomonas putida KT2440
cagcucccgagccagga

SEQ ID NO: 1620228 - RNA, 22 nt, Pseudomonas putida KT2440
cagcucccgagccaggaagauc

SEQ ID NO: 1620229 - RNA, 14 nt, Pseudomonas putida KT2440
cagcuccagcagug

SEQ ID NO: 1620230 - RNA, 15 nt, Pseudomonas putida KT2440
cagcuccagcaccaa

SEQ ID NO: 1620231 - RNA, 15 nt, Pseudomonas putida KT2440
cagcuccacacucga

SEQ ID NO: 1620232 - RNA, 12 nt, Pseudomonas putida KT2440
cagcuccacauc

SEQ ID NO: 1620233 - RNA, 18 nt, Pseudomonas putida KT2440
cagcuccacaucuugccc

SEQ ID NO: 1620234 - RNA, 21 nt, Pseudomonas putida KT2440
cagcucauccaucaccugccc

SEQ ID NO: 1620235 - RNA, 19 nt, Pseudomonas putida KT2440
cagcucucaacguucaucc

SEQ ID NO: 1620236 - RNA, 16 nt, Pseudomonas putida KT2440
cagcucggccacccgc

SEQ ID NO: 1620237 - RNA, 17 nt, Pseudomonas putida KT2440
cagcucggccacccgcg

SEQ ID NO: 1620238 - RNA, 14 nt, Pseudomonas putida KT2440
cagcucgcgcugcc

SEQ ID NO: 1620239 - RNA, 13 nt, Pseudomonas putida KT2440
cagcucgcuggcc

SEQ ID NO: 1620240 - RNA, 15 nt, Pseudomonas putida KT2440
cagcucgccgugggg

SEQ ID NO: 1620241 - RNA, 23 nt, Pseudomonas putida KT2440
cagcucgcagguauccgggucca

SEQ ID NO: 1620242 - RNA, 21 nt, Pseudomonas putida KT2440
cagcucgaaaccggccuugcc

SEQ ID NO: 1620243 - RNA, 19 nt, Pseudomonas putida KT2440
cagcucgagcaugcggaua

SEQ ID NO: 1620244 - RNA, 15 nt, Pseudomonas putida KT2440
cagcucgccgcccag

SEQ ID NO: 1620245 - RNA, 20 nt, Pseudomonas putida KT2440
cagcucgcccggcacggcgu

SEQ ID NO: 1620246 - RNA, 17 nt, Pseudomonas putida KT2440
cagcucgccaacaccgc

SEQ ID NO: 1620247 - RNA, 20 nt, Pseudomonas putida KT2440
cagcucgccaacaccgcccc

SEQ ID NO: 1620248 - RNA, 17 nt, Pseudomonas putida KT2440
cagcucgauggccagga

SEQ ID NO: 1620249 - RNA, 16 nt, Pseudomonas putida KT2440
cagcucgaucaggcuc

SEQ ID NO: 1620250 - RNA, 19 nt, Pseudomonas putida KT2440
cagcucgaucaggcucugu

SEQ ID NO: 1620251 - RNA, 19 nt, Pseudomonas putida KT2440
cacgucgcugucuucugcc

SEQ ID NO: 1620252 - RNA, 14 nt, Pseudomonas putida KT2440
cacgucgcgcaggg

SEQ ID NO: 1620253 - RNA, 14 nt, Pseudomonas putida KT2440
cacgucuuccuggc

SEQ ID NO: 1620254 - RNA, 20 nt, Pseudomonas putida KT2440
cacgucuggcaccaguucca

SEQ ID NO: 1620255 - RNA, 14 nt, Pseudomonas putida KT2440
cacuuucgcggccc

SEQ ID NO: 1620256 - RNA, 12 nt, Pseudomonas putida KT2440
cagaaacgccau

SEQ ID NO: 1620257 - RNA, 14 nt, Pseudomonas putida KT2440
cagaaacagauucc

SEQ ID NO: 1620258 - RNA, 18 nt, Pseudomonas putida KT2440
cagaagccuuggccuugg

SEQ ID NO: 1620259 - RNA, 16 nt, Pseudomonas putida KT2440
cagaauguugcaagga

SEQ ID NO: 1620260 - RNA, 19 nt, Pseudomonas putida KT2440
cagaagcgcugacugccag

SEQ ID NO: 1620261 - RNA, 12 nt, Pseudomonas putida KT2440
cagaacagccac

SEQ ID NO: 1620262 - RNA, 15 nt, Pseudomonas putida KT2440
cagaacaccaccagu

SEQ ID NO: 1620263 - RNA, 15 nt, Pseudomonas putida KT2440
cagacagggccuuga

SEQ ID NO: 1620264 - RNA, 14 nt, Pseudomonas putida KT2440
cagacagagcuccg

SEQ ID NO: 1620265 - RNA, 11 nt, Pseudomonas putida KT2440
cagaccaccuc

SEQ ID NO: 1620266 - RNA, 14 nt, Pseudomonas putida KT2440
cagaccaccugcca

SEQ ID NO: 1620267 - RNA, 13 nt, Pseudomonas putida KT2440
cagaccagcagca

SEQ ID NO: 1620268 - RNA, 16 nt, Pseudomonas putida KT2440
cagaccagcagcagug

SEQ ID NO: 1620269 - RNA, 14 nt, Pseudomonas putida KT2440
cagaccagacagcg

SEQ ID NO: 1620270 - RNA, 19 nt, Pseudomonas putida KT2440
cagacgcgcagcacuuccu

SEQ ID NO: 1620271 - RNA, 19 nt, Pseudomonas putida KT2440
cagacucaaucaggcagcg

SEQ ID NO: 1620272 - RNA, 12 nt, Pseudomonas putida KT2440
cagacuaccaac

SEQ ID NO: 1620273 - RNA, 23 nt, Pseudomonas putida KT2440
cagacuuuccugaaaccccgccc

SEQ ID NO: 1620274 - RNA, 21 nt, Pseudomonas putida KT2440
cagagaauuucuccccagcau

SEQ ID NO: 1620275 - RNA, 13 nt, Pseudomonas putida KT2440
cagagcauggcca

SEQ ID NO: 1620276 - RNA, 12 nt, Pseudomonas putida KT2440
cagaggccucaa

SEQ ID NO: 1620277 - RNA, 12 nt, Pseudomonas putida KT2440
cagagagcugag

SEQ ID NO: 1620278 - RNA, 16 nt, Pseudomonas putida KT2440
cagauggcccgguccc

SEQ ID NO: 1620279 - RNA, 22 nt, Pseudomonas putida KT2440
cagaugguggcauagcgcggcg

SEQ ID NO: 1620280 - RNA, 16 nt, Pseudomonas putida KT2440
cagaugcgggcccugg

SEQ ID NO: 1620281 - RNA, 14 nt, Pseudomonas putida KT2440
cagaugcugcugca

SEQ ID NO: 1620282 - RNA, 17 nt, Pseudomonas putida KT2440
cagaugcugcugcagug

SEQ ID NO: 1620283 - RNA, 20 nt, Pseudomonas putida KT2440
cagaugcugcugcagugccu

SEQ ID NO: 1620284 - RNA, 19 nt, Pseudomonas putida KT2440
cagauuacgcgucaucugc

SEQ ID NO: 1620285 - RNA, 14 nt, Pseudomonas putida KT2440
cagauucaagcccg

SEQ ID NO: 1620286 - RNA, 19 nt, Pseudomonas putida KT2440
cagauuucgugggucaugu

SEQ ID NO: 1620287 - RNA, 18 nt, Pseudomonas putida KT2440
cagaugaguuccguugcu

SEQ ID NO: 1620288 - RNA, 23 nt, Pseudomonas putida KT2440
cagaugccgccgcugccagcagg

SEQ ID NO: 1620289 - RNA, 15 nt, Pseudomonas putida KT2440
cagaguugccaccaa

SEQ ID NO: 1620290 - RNA, 22 nt, Pseudomonas putida KT2440
cagaucgagcgcccacgcaaaa

SEQ ID NO: 1620291 - RNA, 16 nt, Pseudomonas putida KT2440
cagaucgagcgccgcc

SEQ ID NO: 1620292 - RNA, 17 nt, Pseudomonas putida KT2440
cagcacuucgaucaggc

SEQ ID NO: 1620293 - RNA, 16 nt, Pseudomonas putida KT2440
cagcacuugcuugaca

SEQ ID NO: 1620294 - RNA, 18 nt, Pseudomonas putida KT2440
cagcacuugcuugacagc

SEQ ID NO: 1620295 - RNA, 19 nt, Pseudomonas putida KT2440
cagcacuuuugccaccacc

SEQ ID NO: 1620296 - RNA, 20 nt, Pseudomonas putida KT2440
cagcacuuuugccaccaccc

SEQ ID NO: 1620297 - RNA, 22 nt, Pseudomonas putida KT2440
cagcacuuuugccaccacccgg

SEQ ID NO: 1620298 - RNA, 20 nt, Pseudomonas putida KT2440
cagcacgcgaucggcagcga

SEQ ID NO: 1620299 - RNA, 13 nt, Pseudomonas putida KT2440
cagcacgccggca

SEQ ID NO: 1620300 - RNA, 20 nt, Pseudomonas putida KT2440
cagcacugccuugcccugca

SEQ ID NO: 1620301 - RNA, 12 nt, Pseudomonas putida KT2440
cagcacugcugc

SEQ ID NO: 1620302 - RNA, 18 nt, Pseudomonas putida KT2440
cagcacugccagcccggc

SEQ ID NO: 1620303 - RNA, 21 nt, Pseudomonas putida KT2440
cagcacugugcucgcccgggu

SEQ ID NO: 1620304 - RNA, 23 nt, Pseudomonas putida KT2440
cagcaccgucgaggaaaagcagc

SEQ ID NO: 1620305 - RNA, 19 nt, Pseudomonas putida KT2440
cagcacgcccaucagcgcc

SEQ ID NO: 1620306 - RNA, 23 nt, Pseudomonas putida KT2440
cagcacgcccaucagcgccgcca

SEQ ID NO: 1620307 - RNA, 17 nt, Pseudomonas putida KT2440
cagcacgaucaugggga

SEQ ID NO: 1620308 - RNA, 16 nt, Pseudomonas putida KT2440
cagcacgaugacgaac

SEQ ID NO: 1620309 - RNA, 23 nt, Pseudomonas putida KT2440
cagcacgauggcggucgaaccca

SEQ ID NO: 1620310 - RNA, 15 nt, Pseudomonas putida KT2440
cagcacgcaggccag

SEQ ID NO: 1620311 - RNA, 18 nt, Pseudomonas putida KT2440
cagcaccgcugccagcug

SEQ ID NO: 1620312 - RNA, 15 nt, Pseudomonas putida KT2440
cagcaccggccaggc

SEQ ID NO: 1620313 - RNA, 16 nt, Pseudomonas putida KT2440
cagcaccggccaggcu

SEQ ID NO: 1620314 - RNA, 18 nt, Pseudomonas putida KT2440
cagcacccgcuuggccac

SEQ ID NO: 1620315 - RNA, 19 nt, Pseudomonas putida KT2440
cagcacccgcuuggccacc

SEQ ID NO: 1620316 - RNA, 20 nt, Pseudomonas putida KT2440
cagcacccgcuuggccacca

SEQ ID NO: 1620317 - RNA, 23 nt, Pseudomonas putida KT2440
cagcacccgcuuggccaccacgu

SEQ ID NO: 1620318 - RNA, 22 nt, Pseudomonas putida KT2440
cagcacccgcuuguagcucagg

SEQ ID NO: 1620319 - RNA, 17 nt, Pseudomonas putida KT2440
cagcaccccagcaccac

SEQ ID NO: 1620320 - RNA, 18 nt, Pseudomonas putida KT2440
cagcaccccagcaccacc

SEQ ID NO: 1620321 - RNA, 16 nt, Pseudomonas putida KT2440
cagcacaucacacagc

SEQ ID NO: 1620322 - RNA, 14 nt, Pseudomonas putida KT2440
cagcacccacaccc

SEQ ID NO: 1620323 - RNA, 16 nt, Pseudomonas putida KT2440
cagcacacccagcacg

SEQ ID NO: 1620324 - RNA, 13 nt, Pseudomonas putida KT2440
cagcacaccuucc

SEQ ID NO: 1620325 - RNA, 13 nt, Pseudomonas putida KT2440
cagcacacugagc

SEQ ID NO: 1620326 - RNA, 14 nt, Pseudomonas putida KT2440
cagcacacugagca

SEQ ID NO: 1620327 - RNA, 23 nt, Pseudomonas putida KT2440
cagcacacugagcaccacauacg

SEQ ID NO: 1620328 - RNA, 17 nt, Pseudomonas putida KT2440
cagcaagcgacauaaaa

SEQ ID NO: 1620329 - RNA, 21 nt, Pseudomonas putida KT2440
cagcaacgcccgcaacaaccu

SEQ ID NO: 1620330 - RNA, 16 nt, Pseudomonas putida KT2440
cagcaacgcagccagg

SEQ ID NO: 1620331 - RNA, 18 nt, Pseudomonas putida KT2440
cagcaacaugccggccca

SEQ ID NO: 1620332 - RNA, 20 nt, Pseudomonas putida KT2440
cagcaacaugccggcccaag

SEQ ID NO: 1620333 - RNA, 13 nt, Pseudomonas putida KT2440
cagcaacaucugc

SEQ ID NO: 1620334 - RNA, 18 nt, Pseudomonas putida KT2440
cagcaaccacgcuuggcu

SEQ ID NO: 1620335 - RNA, 19 nt, Pseudomonas putida KT2440
cagcaaccacgcuuggcuc

SEQ ID NO: 1620336 - RNA, 17 nt, Pseudomonas putida KT2440
cagcaauucagaagucc

SEQ ID NO: 1620337 - RNA, 14 nt, Pseudomonas putida KT2440
cagcaauuacagcu

SEQ ID NO: 1620338 - RNA, 12 nt, Pseudomonas putida KT2440
cagcacaagccg

SEQ ID NO: 1620339 - RNA, 12 nt, Pseudomonas putida KT2440
cagcacaaggcu

SEQ ID NO: 1620340 - RNA, 20 nt, Pseudomonas putida KT2440
cagcacaaggcugcgccuga

SEQ ID NO: 1620341 - RNA, 18 nt, Pseudomonas putida KT2440
cagcacaaggcuguucca

SEQ ID NO: 1620342 - RNA, 20 nt, Pseudomonas putida KT2440
cagcaagucccccaucggca

SEQ ID NO: 1620343 - RNA, 15 nt, Pseudomonas putida KT2440
cagcaaggcauccag

SEQ ID NO: 1620344 - RNA, 17 nt, Pseudomonas putida KT2440
cagcaaggcauccagcg

SEQ ID NO: 1620345 - RNA, 21 nt, Pseudomonas putida KT2440
cagcaagcucaucaccaggcc

SEQ ID NO: 1620346 - RNA, 18 nt, Pseudomonas putida KT2440
cagcaagcuggcaccggc

SEQ ID NO: 1620347 - RNA, 15 nt, Pseudomonas putida KT2440
cagcaaucugcuggu

SEQ ID NO: 1620348 - RNA, 22 nt, Pseudomonas putida KT2440
cagcaaucccgccccaaaggaa

SEQ ID NO: 1620349 - RNA, 19 nt, Pseudomonas putida KT2440
cagcaucugcaccaggaag

SEQ ID NO: 1620350 - RNA, 16 nt, Pseudomonas putida KT2440
cagcaucuuccugcca

SEQ ID NO: 1620351 - RNA, 12 nt, Pseudomonas putida KT2440
cagcaucuucuu

SEQ ID NO: 1620352 - RNA, 23 nt, Pseudomonas putida KT2440
cagcaucuucuucacguccagcc

SEQ ID NO: 1620353 - RNA, 21 nt, Pseudomonas putida KT2440
cagcaucucggucgacagggg

SEQ ID NO: 1620354 - RNA, 14 nt, Pseudomonas putida KT2440
cagcaucaacgcug

SEQ ID NO: 1620355 - RNA, 19 nt, Pseudomonas putida KT2440
cagcaucaacgcugccaug

SEQ ID NO: 1620356 - RNA, 21 nt, Pseudomonas putida KT2440
cagcauauggcgcuuucacug

SEQ ID NO: 1620357 - RNA, 18 nt, Pseudomonas putida KT2440
cagcaucagugcaggugc

SEQ ID NO: 1620358 - RNA, 20 nt, Pseudomonas putida KT2440
cagcaucacgccgcgcuggc

SEQ ID NO: 1620359 - RNA, 20 nt, Pseudomonas putida KT2440
cagcaucaucucugccgaga

SEQ ID NO: 1620360 - RNA, 22 nt, Pseudomonas putida KT2440
cagcaucaucucugccgagagg

SEQ ID NO: 1620361 - RNA, 12 nt, Pseudomonas putida KT2440
cagcaucaucuc

SEQ ID NO: 1620362 - RNA, 20 nt, Pseudomonas putida KT2440
cagcauccaacccugcgccc

SEQ ID NO: 1620363 - RNA, 15 nt, Pseudomonas putida KT2440
cagcaugcccagcgc

SEQ ID NO: 1620364 - RNA, 17 nt, Pseudomonas putida KT2440
cagcaugcccagcgcca

SEQ ID NO: 1620365 - RNA, 23 nt, Pseudomonas putida KT2440
cagcaugcccagcgccaccggca

SEQ ID NO: 1620366 - RNA, 14 nt, Pseudomonas putida KT2440
cagcaugcgcuuga

SEQ ID NO: 1620367 - RNA, 18 nt, Pseudomonas putida KT2440
cagcaugcgcuugagcga

SEQ ID NO: 1620368 - RNA, 13 nt, Pseudomonas putida KT2440
cagcaugaacagc

SEQ ID NO: 1620369 - RNA, 16 nt, Pseudomonas putida KT2440
cagcaugaacagcgcu

SEQ ID NO: 1620370 - RNA, 19 nt, Pseudomonas putida KT2440
cagcauggccgaaaccagc

SEQ ID NO: 1620371 - RNA, 16 nt, Pseudomonas putida KT2440
cagcauggccaguucc

SEQ ID NO: 1620372 - RNA, 15 nt, Pseudomonas putida KT2440
cagcaugucccgggu

SEQ ID NO: 1620373 - RNA, 15 nt, Pseudomonas putida KT2440
cagcauguucaccag

SEQ ID NO: 1620374 - RNA, 21 nt, Pseudomonas putida KT2440
cagccacggaucaccuggccg

SEQ ID NO: 1620375 - RNA, 14 nt, Pseudomonas putida KT2440
cagccacgcuggca

SEQ ID NO: 1620376 - RNA, 18 nt, Pseudomonas putida KT2440
cagccacgcuggcaccca

SEQ ID NO: 1620377 - RNA, 17 nt, Pseudomonas putida KT2440
cagccacgucgccagcg

SEQ ID NO: 1620378 - RNA, 21 nt, Pseudomonas putida KT2440
cagccagcgguccggcccuuc

SEQ ID NO: 1620379 - RNA, 19 nt, Pseudomonas putida KT2440
cagccagccuucgccaacu

SEQ ID NO: 1620380 - RNA, 22 nt, Pseudomonas putida KT2440
cagccagcgacagcaucggcag

SEQ ID NO: 1620381 - RNA, 14 nt, Pseudomonas putida KT2440
cagccagccucuuc

SEQ ID NO: 1620382 - RNA, 12 nt, Pseudomonas putida KT2440
cagccaggcuga

SEQ ID NO: 1620383 - RNA, 19 nt, Pseudomonas putida KT2440
cagccaggcugagcccggc

SEQ ID NO: 1620384 - RNA, 22 nt, Pseudomonas putida KT2440
cagccauaguuuugugccaccu

SEQ ID NO: 1620385 - RNA, 16 nt, Pseudomonas putida KT2440
cagccagguauggcca

SEQ ID NO: 1620386 - RNA, 17 nt, Pseudomonas putida KT2440
cagccaccgcacucugc

SEQ ID NO: 1620387 - RNA, 21 nt, Pseudomonas putida KT2440
cagccaccgcacucugcugcu

SEQ ID NO: 1620388 - RNA, 15 nt, Pseudomonas putida KT2440
cagccaccgcgagcu

SEQ ID NO: 1620389 - RNA, 16 nt, Pseudomonas putida KT2440
cagccacgcccgucac

SEQ ID NO: 1620390 - RNA, 16 nt, Pseudomonas putida KT2440
cagccaccugcccggg

SEQ ID NO: 1620391 - RNA, 14 nt, Pseudomonas putida KT2440
cagccacauccucu

SEQ ID NO: 1620392 - RNA, 15 nt, Pseudomonas putida KT2440
cagccacagcugcug

SEQ ID NO: 1620393 - RNA, 19 nt, Pseudomonas putida KT2440
cagccacaugccagcuauc

SEQ ID NO: 1620394 - RNA, 16 nt, Pseudomonas putida KT2440
cagccaccaccaugcg

SEQ ID NO: 1620395 - RNA, 23 nt, Pseudomonas putida KT2440
cagcaguuggcugccggccucga

SEQ ID NO: 1620396 - RNA, 14 nt, Pseudomonas putida KT2440
cagcaguugcugcu

SEQ ID NO: 1620397 - RNA, 17 nt, Pseudomonas putida KT2440
cagcaguugcugcugcc

SEQ ID NO: 1620398 - RNA, 18 nt, Pseudomonas putida KT2440
cagcaguugcugcugcca

SEQ ID NO: 1620399 - RNA, 17 nt, Pseudomonas putida KT2440
cagcaguucgcgcacca

SEQ ID NO: 1620400 - RNA, 15 nt, Pseudomonas putida KT2440
cagcaguggcaagcc

SEQ ID NO: 1620401 - RNA, 16 nt, Pseudomonas putida KT2440
cagcagugccagcaac

SEQ ID NO: 1620402 - RNA, 17 nt, Pseudomonas putida KT2440
cagcagugaucaucaca

SEQ ID NO: 1620403 - RNA, 19 nt, Pseudomonas putida KT2440
cagcagugcaucgaagcag

SEQ ID NO: 1620404 - RNA, 20 nt, Pseudomonas putida KT2440
cagcaguuugcugcgcugcc

SEQ ID NO: 1620405 - RNA, 12 nt, Pseudomonas putida KT2440
cagcaggucagg

SEQ ID NO: 1620406 - RNA, 15 nt, Pseudomonas putida KT2440
cagcaggucaggccc

SEQ ID NO: 1620407 - RNA, 18 nt, Pseudomonas putida KT2440
cagcaggucaggcccuuu

SEQ ID NO: 1620408 - RNA, 16 nt, Pseudomonas putida KT2440
cagcagguccagcucc

SEQ ID NO: 1620409 - RNA, 17 nt, Pseudomonas putida KT2440
cagcagguccagcuccg

SEQ ID NO: 1620410 - RNA, 14 nt, Pseudomonas putida KT2440
cagcagggccaacg

SEQ ID NO: 1620411 - RNA, 13 nt, Pseudomonas putida KT2440
cagcagguacacc

SEQ ID NO: 1620412 - RNA, 17 nt, Pseudomonas putida KT2440
cagcaggucggcacgca

SEQ ID NO: 1620413 - RNA, 20 nt, Pseudomonas putida KT2440
cagcaggucggcacgcaccu

SEQ ID NO: 1620414 - RNA, 22 nt, Pseudomonas putida KT2440
cagcaggucggcacgcaccugu

SEQ ID NO: 1620415 - RNA, 19 nt, Pseudomonas putida KT2440
cagcagguuggacagcgcc

SEQ ID NO: 1620416 - RNA, 18 nt, Pseudomonas putida KT2440
cagcagguuuuccagccc

SEQ ID NO: 1620417 - RNA, 19 nt, Pseudomonas putida KT2440
cagcagguuuuccagcccg

SEQ ID NO: 1620418 - RNA, 19 nt, Pseudomonas putida KT2440
cagcaggcucagggccgca

SEQ ID NO: 1620419 - RNA, 22 nt, Pseudomonas putida KT2440
cagcaggcugcgugccugcugc

SEQ ID NO: 1620420 - RNA, 22 nt, Pseudomonas putida KT2440
cagcaggcuggcggccaaugcu

SEQ ID NO: 1620421 - RNA, 16 nt, Pseudomonas putida KT2440
cagcaggcuggcgggg

SEQ ID NO: 1620422 - RNA, 20 nt, Pseudomonas putida KT2440
cagcagggccaucaucugcu

SEQ ID NO: 1620423 - RNA, 16 nt, Pseudomonas putida KT2440
cagcagggccggcccu

SEQ ID NO: 1620424 - RNA, 13 nt, Pseudomonas putida KT2440
cagcaggguggcc

SEQ ID NO: 1620425 - RNA, 22 nt, Pseudomonas putida KT2440
cagcaggcaaagaaugccgccc

SEQ ID NO: 1620426 - RNA, 14 nt, Pseudomonas putida KT2440
cagcaggccaagga

SEQ ID NO: 1620427 - RNA, 23 nt, Pseudomonas putida KT2440
cagcaggccauauugcugagcca

SEQ ID NO: 1620428 - RNA, 14 nt, Pseudomonas putida KT2440
cagcaggcccggcc

SEQ ID NO: 1620429 - RNA, 20 nt, Pseudomonas putida KT2440
cagcagcugcauuggcggca

SEQ ID NO: 1620430 - RNA, 14 nt, Pseudomonas putida KT2440
cagcagcuccauac

SEQ ID NO: 1620431 - RNA, 12 nt, Pseudomonas putida KT2440
cagcagcgcgcc

SEQ ID NO: 1620432 - RNA, 15 nt, Pseudomonas putida KT2440
cagcagcuccacauc

SEQ ID NO: 1620433 - RNA, 14 nt, Pseudomonas putida KT2440
cagcagcuucuggc

SEQ ID NO: 1620434 - RNA, 14 nt, Pseudomonas putida KT2440
cagcagcuucuuca

SEQ ID NO: 1620435 - RNA, 15 nt, Pseudomonas putida KT2440
cagcagcuucuucac

SEQ ID NO: 1620436 - RNA, 22 nt, Pseudomonas putida KT2440
cagcagcuugaacaacggcgcu

SEQ ID NO: 1620437 - RNA, 17 nt, Pseudomonas putida KT2440
cagcagcuugcgcgccu

SEQ ID NO: 1620438 - RNA, 20 nt, Pseudomonas putida KT2440
cagcaggaaauacgccgcca

SEQ ID NO: 1620439 - RNA, 18 nt, Pseudomonas putida KT2440
cagcaggaacagcggcag

SEQ ID NO: 1620440 - RNA, 20 nt, Pseudomonas putida KT2440
cagcaggaacagcggcagca

SEQ ID NO: 1620441 - RNA, 21 nt, Pseudomonas putida KT2440
cagcaggaacagcggcagcaa

SEQ ID NO: 1620442 - RNA, 14 nt, Pseudomonas putida KT2440
cagcaggaagcugu

SEQ ID NO: 1620443 - RNA, 20 nt, Pseudomonas putida KT2440
cagcaggaagcuguacagcg

SEQ ID NO: 1620444 - RNA, 19 nt, Pseudomonas putida KT2440
cagcagcguuguucaccac

SEQ ID NO: 1620445 - RNA, 15 nt, Pseudomonas putida KT2440
cagcagcgccgccag

SEQ ID NO: 1620446 - RNA, 19 nt, Pseudomonas putida KT2440
cagcagcgccgccaggccc

SEQ ID NO: 1620447 - RNA, 16 nt, Pseudomonas putida KT2440
cagcagcgccugcagc

SEQ ID NO: 1620448 - RNA, 22 nt, Pseudomonas putida KT2440
cagcagcgccugcagcgcguca

SEQ ID NO: 1620449 - RNA, 16 nt, Pseudomonas putida KT2440
cagcagcgcgugcugg

SEQ ID NO: 1620450 - RNA, 18 nt, Pseudomonas putida KT2440
cagcagagagauugagag

SEQ ID NO: 1620451 - RNA, 20 nt, Pseudomonas putida KT2440
cagcagagagauugagagga

SEQ ID NO: 1620452 - RNA, 21 nt, Pseudomonas putida KT2440
cagcagcgcauggcucaacug

SEQ ID NO: 1620453 - RNA, 15 nt, Pseudomonas putida KT2440
cagcagcgcaccgug

SEQ ID NO: 1620454 - RNA, 13 nt, Pseudomonas putida KT2440
cagccuuuuccag

SEQ ID NO: 1620455 - RNA, 23 nt, Pseudomonas putida KT2440
cagcgaacacgaaaaagccagcg

SEQ ID NO: 1620456 - RNA, 19 nt, Pseudomonas putida KT2440
cagcgaauaguagaagcag

SEQ ID NO: 1620457 - RNA, 14 nt, Pseudomonas putida KT2440
cagccggccccugc

SEQ ID NO: 1620458 - RNA, 21 nt, Pseudomonas putida KT2440
cagccggcagcaaggcaucca

SEQ ID NO: 1620459 - RNA, 14 nt, Pseudomonas putida KT2440
cagccuccggccca

SEQ ID NO: 1620460 - RNA, 18 nt, Pseudomonas putida KT2440
cagccuccaguugcucca

SEQ ID NO: 1620461 - RNA, 13 nt, Pseudomonas putida KT2440
cagccucaaggcc

SEQ ID NO: 1620462 - RNA, 21 nt, Pseudomonas putida KT2440
cagccucaaggccggcagcca

SEQ ID NO: 1620463 - RNA, 20 nt, Pseudomonas putida KT2440
cagccggcccuucugcugcu

SEQ ID NO: 1620464 - RNA, 16 nt, Pseudomonas putida KT2440
cagccggcccggcugg

SEQ ID NO: 1620465 - RNA, 15 nt, Pseudomonas putida KT2440
cagccucuucggcca

SEQ ID NO: 1620466 - RNA, 20 nt, Pseudomonas putida KT2440
cagccucuucggccagcaac

SEQ ID NO: 1620467 - RNA, 21 nt, Pseudomonas putida KT2440
cagccucuucggccagcaacu

SEQ ID NO: 1620468 - RNA, 18 nt, Pseudomonas putida KT2440
cagccucuucuucaaggc

SEQ ID NO: 1620469 - RNA, 19 nt, Pseudomonas putida KT2440
cagccucuucuucaaggcu

SEQ ID NO: 1620470 - RNA, 21 nt, Pseudomonas putida KT2440
cagccucuucuucaaggcugc

SEQ ID NO: 1620471 - RNA, 23 nt, Pseudomonas putida KT2440
cagccucuucuucaaggcugcuc

SEQ ID NO: 1620472 - RNA, 16 nt, Pseudomonas putida KT2440
cagccugacgcgccgc

SEQ ID NO: 1620473 - RNA, 16 nt, Pseudomonas putida KT2440
cagccugccaggucac

SEQ ID NO: 1620474 - RNA, 23 nt, Pseudomonas putida KT2440
cagccugccaggucaccgcccag

SEQ ID NO: 1620475 - RNA, 18 nt, Pseudomonas putida KT2440
cagccugcagcgcggcga

SEQ ID NO: 1620476 - RNA, 14 nt, Pseudomonas putida KT2440
cagccugcagcacc

SEQ ID NO: 1620477 - RNA, 16 nt, Pseudomonas putida KT2440
cagccugcagcacccu

SEQ ID NO: 1620478 - RNA, 16 nt, Pseudomonas putida KT2440
cagccgccacaugccc

SEQ ID NO: 1620479 - RNA, 16 nt, Pseudomonas putida KT2440
cagccgcgcccucuuc

SEQ ID NO: 1620480 - RNA, 14 nt, Pseudomonas putida KT2440
cagccgccgcugcg

SEQ ID NO: 1620481 - RNA, 20 nt, Pseudomonas putida KT2440
cagccgcgaacgccccgaac

SEQ ID NO: 1620482 - RNA, 19 nt, Pseudomonas putida KT2440
cagccgaucacuuccuggc

SEQ ID NO: 1620483 - RNA, 19 nt, Pseudomonas putida KT2440
cagccgagggcaugggcca

SEQ ID NO: 1620484 - RNA, 19 nt, Pseudomonas putida KT2440
cagccgagccaaccgcuuc

SEQ ID NO: 1620485 - RNA, 20 nt, Pseudomonas putida KT2440
cagccgcacguuauccacag

SEQ ID NO: 1620486 - RNA, 18 nt, Pseudomonas putida KT2440
cagccaucaucagguacg

SEQ ID NO: 1620487 - RNA, 17 nt, Pseudomonas putida KT2440
cagcccuugcucggcca

SEQ ID NO: 1620488 - RNA, 21 nt, Pseudomonas putida KT2440
cagcccuucggcaucggccug

SEQ ID NO: 1620489 - RNA, 15 nt, Pseudomonas putida KT2440
cagcccuucacugug

SEQ ID NO: 1620490 - RNA, 15 nt, Pseudomonas putida KT2440
cagccgaagcugucg

SEQ ID NO: 1620491 - RNA, 16 nt, Pseudomonas putida KT2440
cagcccucccagguug

SEQ ID NO: 1620492 - RNA, 21 nt, Pseudomonas putida KT2440
cagcccuucgcaggcacgccc

SEQ ID NO: 1620493 - RNA, 18 nt, Pseudomonas putida KT2440
cagcccuucgcggcaagc

SEQ ID NO: 1620494 - RNA, 19 nt, Pseudomonas putida KT2440
cagcccuucgcggcaagcc

SEQ ID NO: 1620495 - RNA, 21 nt, Pseudomonas putida KT2440
cagcccuucgcgggcacgccc

SEQ ID NO: 1620496 - RNA, 23 nt, Pseudomonas putida KT2440
cagcccugccgaggccaugugcu

SEQ ID NO: 1620497 - RNA, 20 nt, Pseudomonas putida KT2440
cagcgccaccggcagcaaga

SEQ ID NO: 1620498 - RNA, 13 nt, Pseudomonas putida KT2440
cagcgccaccgcg

SEQ ID NO: 1620499 - RNA, 12 nt, Pseudomonas putida KT2440
cagcgccaccca

SEQ ID NO: 1620500 - RNA, 19 nt, Pseudomonas putida KT2440
cagcgccacgccugcaguc

SEQ ID NO: 1620501 - RNA, 14 nt, Pseudomonas putida KT2440
cagcgccagccauu

SEQ ID NO: 1620502 - RNA, 20 nt, Pseudomonas putida KT2440
cagcgccagcagccgggccu

SEQ ID NO: 1620503 - RNA, 21 nt, Pseudomonas putida KT2440
cagcgccagcagccgggccug

SEQ ID NO: 1620504 - RNA, 15 nt, Pseudomonas putida KT2440
cagcgccccaucauu

SEQ ID NO: 1620505 - RNA, 13 nt, Pseudomonas putida KT2440
cagcgcccagaac

SEQ ID NO: 1620506 - RNA, 12 nt, Pseudomonas putida KT2440
cagcgccccgcc

SEQ ID NO: 1620507 - RNA, 19 nt, Pseudomonas putida KT2440
cagcgcccgcugcgccgcu

SEQ ID NO: 1620508 - RNA, 20 nt, Pseudomonas putida KT2440
cagcgacugccaaugcucag

SEQ ID NO: 1620509 - RNA, 18 nt, Pseudomonas putida KT2440
cagcgcaaucaccgccgc

SEQ ID NO: 1620510 - RNA, 17 nt, Pseudomonas putida KT2440
cagcgcaccgugcacca

SEQ ID NO: 1620511 - RNA, 19 nt, Pseudomonas putida KT2440
cagcgcacucucccgcagc

SEQ ID NO: 1620512 - RNA, 19 nt, Pseudomonas putida KT2440
cagcgccaacgcccccgcc

SEQ ID NO: 1620513 - RNA, 20 nt, Pseudomonas putida KT2440
cagcgccaauaccgcgcauc

SEQ ID NO: 1620514 - RNA, 13 nt, Pseudomonas putida KT2440
cagcgcccuucac

SEQ ID NO: 1620515 - RNA, 20 nt, Pseudomonas putida KT2440
cagcgccgcauccagcacug

SEQ ID NO: 1620516 - RNA, 15 nt, Pseudomonas putida KT2440
cagcgccgccaacuc

SEQ ID NO: 1620517 - RNA, 12 nt, Pseudomonas putida KT2440
cagcgccgcgau

SEQ ID NO: 1620518 - RNA, 22 nt, Pseudomonas putida KT2440
cagcgccgcgaucaaugggccg

SEQ ID NO: 1620519 - RNA, 13 nt, Pseudomonas putida KT2440
cagcgccgccaug

SEQ ID NO: 1620520 - RNA, 11 nt, Pseudomonas putida KT2440
cagcgccucca

SEQ ID NO: 1620521 - RNA, 12 nt, Pseudomonas putida KT2440
cagcgccuccac

SEQ ID NO: 1620522 - RNA, 14 nt, Pseudomonas putida KT2440
cagcgccuccaccu

SEQ ID NO: 1620523 - RNA, 13 nt, Pseudomonas putida KT2440
cagcgccuccccc

SEQ ID NO: 1620524 - RNA, 14 nt, Pseudomonas putida KT2440
cagcgccuccccca

SEQ ID NO: 1620525 - RNA, 21 nt, Pseudomonas putida KT2440
cagcgccucccccagcgcggu

SEQ ID NO: 1620526 - RNA, 22 nt, Pseudomonas putida KT2440
cagcgcgcaggucgugcuugac

SEQ ID NO: 1620527 - RNA, 14 nt, Pseudomonas putida KT2440
cagcgccucgcccu

SEQ ID NO: 1620528 - RNA, 19 nt, Pseudomonas putida KT2440
cagcgccucgcccuuguca

SEQ ID NO: 1620529 - RNA, 14 nt, Pseudomonas putida KT2440
cagcgcgaaacccu

SEQ ID NO: 1620530 - RNA, 22 nt, Pseudomonas putida KT2440
uuuucggcggugacacugccau

SEQ ID NO: 1620531 - RNA, 19 nt, Pseudomonas putida KT2440
uuuucgguaaucaccuuga

SEQ ID NO: 1620532 - RNA, 21 nt, Pseudomonas putida KT2440
uuuucggcaaggcgaccugcc

SEQ ID NO: 1620533 - RNA, 14 nt, Pseudomonas putida KT2440
uuuuccaugcguuc

SEQ ID NO: 1620534 - RNA, 14 nt, Pseudomonas putida KT2440
uuuucaaugcugcu

SEQ ID NO: 1620535 - RNA, 14 nt, Pseudomonas putida KT2440
uuuuccaacuccac

SEQ ID NO: 1620536 - RNA, 21 nt, Pseudomonas putida KT2440
uuugcuugaguugaguggggu

SEQ ID NO: 1620537 - RNA, 15 nt, Pseudomonas putida KT2440
uuugcgcuggcugcc

SEQ ID NO: 1620538 - RNA, 14 nt, Pseudomonas putida KT2440
uuugcggggcuuuu

SEQ ID NO: 1620539 - RNA, 15 nt, Pseudomonas putida KT2440
uuugcgucuccacga

SEQ ID NO: 1620540 - RNA, 19 nt, Pseudomonas putida KT2440
uuugcuggucagugcacuu

SEQ ID NO: 1620541 - RNA, 18 nt, Pseudomonas putida KT2440
uuuggcuggugaaggcag

SEQ ID NO: 1620542 - RNA, 15 nt, Pseudomonas putida KT2440
uuuggcugugcaccc

SEQ ID NO: 1620543 - RNA, 22 nt, Pseudomonas putida KT2440
uuuggggcgcccggcagaucga

SEQ ID NO: 1620544 - RNA, 15 nt, Pseudomonas putida KT2440
uuuggccuguccagg

SEQ ID NO: 1620545 - RNA, 16 nt, Pseudomonas putida KT2440
uuuggccguagccagg

SEQ ID NO: 1620546 - RNA, 18 nt, Pseudomonas putida KT2440
uuugguucaagcacuaca

SEQ ID NO: 1620547 - RNA, 12 nt, Pseudomonas putida KT2440
uuuuaaaagaac

SEQ ID NO: 1620548 - RNA, 11 nt, Pseudomonas putida KT2440
uuuguuugcug

SEQ ID NO: 1620549 - RNA, 20 nt, Pseudomonas putida KT2440
uuugucgcccgccucgccau

SEQ ID NO: 1620550 - RNA, 18 nt, Pseudomonas putida KT2440
uuuacgcugggcgugcca

SEQ ID NO: 1620551 - RNA, 14 nt, Pseudomonas putida KT2440
uuuacagccagcau

SEQ ID NO: 1620552 - RNA, 18 nt, Pseudomonas putida KT2440
uuuacuggccauccaguc

SEQ ID NO: 1620553 - RNA, 18 nt, Pseudomonas putida KT2440
uuuaggcacgaucccguu

SEQ ID NO: 1620554 - RNA, 21 nt, Pseudomonas putida KT2440
uuuaguauggaaauggaauuu

SEQ ID NO: 1620555 - RNA, 18 nt, Pseudomonas putida KT2440
uuuaguccugcagcggca

SEQ ID NO: 1620556 - RNA, 12 nt, Pseudomonas putida KT2440
uuuagcaggcaa

SEQ ID NO: 1620557 - RNA, 12 nt, Pseudomonas putida KT2440
uuuagcaggcac

SEQ ID NO: 1620558 - RNA, 20 nt, Pseudomonas putida KT2440
uuuaugccgcguuccuuucu

SEQ ID NO: 1620559 - RNA, 16 nt, Pseudomonas putida KT2440
uuucagccuuggccgc

SEQ ID NO: 1620560 - RNA, 19 nt, Pseudomonas putida KT2440
uuucagcgccugccuggcc

SEQ ID NO: 1620561 - RNA, 20 nt, Pseudomonas putida KT2440
uuucagcccuugcucggcca

SEQ ID NO: 1620562 - RNA, 16 nt, Pseudomonas putida KT2440
uuucacuuucuugaaa

SEQ ID NO: 1620563 - RNA, 15 nt, Pseudomonas putida KT2440
uuucagauacugcac

SEQ ID NO: 1620564 - RNA, 16 nt, Pseudomonas putida KT2440
uuucagggguugcccc

SEQ ID NO: 1620565 - RNA, 17 nt, Pseudomonas putida KT2440
uuucaggguauugaacg

SEQ ID NO: 1620566 - RNA, 21 nt, Pseudomonas putida KT2440
uuucaggucgaugauggcugc

SEQ ID NO: 1620567 - RNA, 21 nt, Pseudomonas putida KT2440
uuucagguuucgggcaacuug

SEQ ID NO: 1620568 - RNA, 15 nt, Pseudomonas putida KT2440
uuucaagcuuuguau

SEQ ID NO: 1620569 - RNA, 23 nt, Pseudomonas putida KT2440
uuucacgcuacgggauugccguc

SEQ ID NO: 1620570 - RNA, 15 nt, Pseudomonas putida KT2440
uuucacguuugcuca

SEQ ID NO: 1620571 - RNA, 22 nt, Pseudomonas putida KT2440
uuucacacgccacuaagaagca

SEQ ID NO: 1620572 - RNA, 19 nt, Pseudomonas putida KT2440
uuucaaaaguuggcacgca

SEQ ID NO: 1620573 - RNA, 12 nt, Pseudomonas putida KT2440
uuucaaaugucc

SEQ ID NO: 1620574 - RNA, 22 nt, Pseudomonas putida KT2440
uuucaaaaaaaggguugcaaag

SEQ ID NO: 1620575 - RNA, 20 nt, Pseudomonas putida KT2440
uuucaaaaacggugcagacc

SEQ ID NO: 1620576 - RNA, 13 nt, Pseudomonas putida KT2440
uuucuucaucccu

SEQ ID NO: 1620577 - RNA, 16 nt, Pseudomonas putida KT2440
uuugaagucacuuugu

SEQ ID NO: 1620578 - RNA, 23 nt, Pseudomonas putida KT2440
uuugaaaauuaguuugacagccc

SEQ ID NO: 1620579 - RNA, 14 nt, Pseudomonas putida KT2440
uuugaaaaaaagau

SEQ ID NO: 1620580 - RNA, 16 nt, Pseudomonas putida KT2440
uuugacggugaauucc

SEQ ID NO: 1620581 - RNA, 21 nt, Pseudomonas putida KT2440
uuugacggugaauuccuugca

SEQ ID NO: 1620582 - RNA, 16 nt, Pseudomonas putida KT2440
uuugaugccaacuucc

SEQ ID NO: 1620583 - RNA, 21 nt, Pseudomonas putida KT2440
uuugcgagcgcgggcagacac

SEQ ID NO: 1620584 - RNA, 23 nt, Pseudomonas putida KT2440
uuugcagcacaaggcuguuccac

SEQ ID NO: 1620585 - RNA, 15 nt, Pseudomonas putida KT2440
uuugcauaucuacuc

SEQ ID NO: 1620586 - RNA, 17 nt, Pseudomonas putida KT2440
uuucgaucgagccacug

SEQ ID NO: 1620587 - RNA, 13 nt, Pseudomonas putida KT2440
uuuccagcccguc

SEQ ID NO: 1620588 - RNA, 21 nt, Pseudomonas putida KT2440
uuuccagcccuuccaccacau

SEQ ID NO: 1620589 - RNA, 19 nt, Pseudomonas putida KT2440
uuuccagcaaagucuucag

SEQ ID NO: 1620590 - RNA, 11 nt, Pseudomonas putida KT2440
uuuccacgccu

SEQ ID NO: 1620591 - RNA, 16 nt, Pseudomonas putida KT2440
uuuccagguccuugcu

SEQ ID NO: 1620592 - RNA, 19 nt, Pseudomonas putida KT2440
uuucccacauguaaugaaa

SEQ ID NO: 1620593 - RNA, 22 nt, Pseudomonas putida KT2440
uuucccacauguaaugaaaauc

SEQ ID NO: 1620594 - RNA, 17 nt, Pseudomonas putida KT2440
uuucgcgcucugcgccu

SEQ ID NO: 1620595 - RNA, 20 nt, Pseudomonas putida KT2440
uuucgcggcccagcccagua

SEQ ID NO: 1620596 - RNA, 15 nt, Pseudomonas putida KT2440
uuucgcggguaaacc

SEQ ID NO: 1620597 - RNA, 17 nt, Pseudomonas putida KT2440
uuucgcuggccugcccc

SEQ ID NO: 1620598 - RNA, 14 nt, Pseudomonas putida KT2440
uuucgcuggggcug

SEQ ID NO: 1620599 - RNA, 16 nt, Pseudomonas putida KT2440
uuucggcggccugcag

SEQ ID NO: 1620600 - RNA, 19 nt, Pseudomonas putida KT2440
uuucguccaggcucagcuc

SEQ ID NO: 1620601 - RNA, 20 nt, Pseudomonas putida KT2440
uuucucaggcgcgccgauca

SEQ ID NO: 1620602 - RNA, 14 nt, Pseudomonas putida KT2440
uuucugcuuccacu

SEQ ID NO: 1620603 - RNA, 21 nt, Pseudomonas putida KT2440
uugcgaagguaaccugguucu

SEQ ID NO: 1620604 - RNA, 19 nt, Pseudomonas putida KT2440
uugcguaagauacgccgcu

SEQ ID NO: 1620605 - RNA, 15 nt, Pseudomonas putida KT2440
uugcgcgccagggca

SEQ ID NO: 1620606 - RNA, 23 nt, Pseudomonas putida KT2440
uugcgcgccuugcgccaggugcc

SEQ ID NO: 1620607 - RNA, 17 nt, Pseudomonas putida KT2440
uugcguugaccugcugg

SEQ ID NO: 1620608 - RNA, 19 nt, Pseudomonas putida KT2440
uugcagcaacgccuuggcc

SEQ ID NO: 1620609 - RNA, 22 nt, Pseudomonas putida KT2440
uugcaucggugguuggacacag

SEQ ID NO: 1620610 - RNA, 15 nt, Pseudomonas putida KT2440
uugcccuccuaucgc

SEQ ID NO: 1620611 - RNA, 16 nt, Pseudomonas putida KT2440
uugcccggcgagcgca

SEQ ID NO: 1620612 - RNA, 21 nt, Pseudomonas putida KT2440
uugccgaucagguugcccagc

SEQ ID NO: 1620613 - RNA, 19 nt, Pseudomonas putida KT2440
uugccccaggcccacggcg

SEQ ID NO: 1620614 - RNA, 15 nt, Pseudomonas putida KT2440
uugccacccagauca

SEQ ID NO: 1620615 - RNA, 12 nt, Pseudomonas putida KT2440
uugccaccagca

SEQ ID NO: 1620616 - RNA, 22 nt, Pseudomonas putida KT2440
uugccaccaucgaccuggcccg

SEQ ID NO: 1620617 - RNA, 14 nt, Pseudomonas putida KT2440
uugccccacucggc

SEQ ID NO: 1620618 - RNA, 11 nt, Pseudomonas putida KT2440
uugguguccuu

SEQ ID NO: 1620619 - RNA, 13 nt, Pseudomonas putida KT2440
uugggcccgccau

SEQ ID NO: 1620620 - RNA, 16 nt, Pseudomonas putida KT2440
uugggcgaggacagca

SEQ ID NO: 1620621 - RNA, 13 nt, Pseudomonas putida KT2440
uuggcggcgcagc

SEQ ID NO: 1620622 - RNA, 21 nt, Pseudomonas putida KT2440
uuggcggcgcagcgcacggcu

SEQ ID NO: 1620623 - RNA, 15 nt, Pseudomonas putida KT2440
uuggcguccacagcc

SEQ ID NO: 1620624 - RNA, 22 nt, Pseudomonas putida KT2440
uuggcguccagcagugccaucg

SEQ ID NO: 1620625 - RNA, 21 nt, Pseudomonas putida KT2440
uuggccagcaggcccggcccu

SEQ ID NO: 1620626 - RNA, 14 nt, Pseudomonas putida KT2440
uuggccagcagggc

SEQ ID NO: 1620627 - RNA, 21 nt, Pseudomonas putida KT2440
uuggccagcaggucaggcccu

SEQ ID NO: 1620628 - RNA, 14 nt, Pseudomonas putida KT2440
uuggccaaugccag

SEQ ID NO: 1620629 - RNA, 19 nt, Pseudomonas putida KT2440
uuggcgcgacauguucagc

SEQ ID NO: 1620630 - RNA, 19 nt, Pseudomonas putida KT2440
uuggcagcaccgcugccag

SEQ ID NO: 1620631 - RNA, 14 nt, Pseudomonas putida KT2440
uuggcagccccgau

SEQ ID NO: 1620632 - RNA, 17 nt, Pseudomonas putida KT2440
uuggcagcgcugcaagc

SEQ ID NO: 1620633 - RNA, 21 nt, Pseudomonas putida KT2440
uuggcagugaucuggcgcagc

SEQ ID NO: 1620634 - RNA, 17 nt, Pseudomonas putida KT2440
uuggcagcuaccacccc

SEQ ID NO: 1620635 - RNA, 14 nt, Pseudomonas putida KT2440
uuggcagugccaug

SEQ ID NO: 1620636 - RNA, 15 nt, Pseudomonas putida KT2440
uuggcagugccaugu

SEQ ID NO: 1620637 - RNA, 23 nt, Pseudomonas putida KT2440
uuggacgccgcaccgucgauguc

SEQ ID NO: 1620638 - RNA, 17 nt, Pseudomonas putida KT2440
uuggagcguugcaggcg

SEQ ID NO: 1620639 - RNA, 11 nt, Pseudomonas putida KT2440
uuggaggcugg

SEQ ID NO: 1620640 - RNA, 15 nt, Pseudomonas putida KT2440
uuggacaccaggcug

SEQ ID NO: 1620641 - RNA, 16 nt, Pseudomonas putida KT2440
uugcuuugaagucacu

SEQ ID NO: 1620642 - RNA, 14 nt, Pseudomonas putida KT2440
uugcugaagucaua

SEQ ID NO: 1620643 - RNA, 15 nt, Pseudomonas putida KT2440
uugcuccaccaggcc

SEQ ID NO: 1620644 - RNA, 11 nt, Pseudomonas putida KT2440
uugcugccugu

SEQ ID NO: 1620645 - RNA, 14 nt, Pseudomonas putida KT2440
uugcuguugcugca

SEQ ID NO: 1620646 - RNA, 14 nt, Pseudomonas putida KT2440
uuguccagcagcag

SEQ ID NO: 1620647 - RNA, 18 nt, Pseudomonas putida KT2440
uugucaugccuuggcuac

SEQ ID NO: 1620648 - RNA, 16 nt, Pseudomonas putida KT2440
uugucggcgcgcggcu

SEQ ID NO: 1620649 - RNA, 12 nt, Pseudomonas putida KT2440
uugucccaggcc

SEQ ID NO: 1620650 - RNA, 23 nt, Pseudomonas putida KT2440
uugucuccgaacgccuuggccuc

SEQ ID NO: 1620651 - RNA, 22 nt, Pseudomonas putida KT2440
uugucggucucgaaccacagca

SEQ ID NO: 1620652 - RNA, 19 nt, Pseudomonas putida KT2440
uugugccgcgccagcuccg

SEQ ID NO: 1620653 - RNA, 20 nt, Pseudomonas putida KT2440
uugugcaguucgcacagcuc

SEQ ID NO: 1620654 - RNA, 14 nt, Pseudomonas putida KT2440
uuguggcuuggccc

SEQ ID NO: 1620655 - RNA, 17 nt, Pseudomonas putida KT2440
uuguucgucgagcacca

SEQ ID NO: 1620656 - RNA, 15 nt, Pseudomonas putida KT2440
uuguucggcaggcuc

SEQ ID NO: 1620657 - RNA, 22 nt, Pseudomonas putida KT2440
uuguucggcaucggugcuuucu

SEQ ID NO: 1620658 - RNA, 22 nt, Pseudomonas putida KT2440
uuguuccagccgcgccacuccc

SEQ ID NO: 1620659 - RNA, 13 nt, Pseudomonas putida KT2440
uuguuccaucaug

SEQ ID NO: 1620660 - RNA, 17 nt, Pseudomonas putida KT2440
uucgucauccaccgccc

SEQ ID NO: 1620661 - RNA, 20 nt, Pseudomonas putida KT2440
uucggcgguugcaccguggc

SEQ ID NO: 1620662 - RNA, 18 nt, Pseudomonas putida KT2440
uucggcugaucucuucag

SEQ ID NO: 1620663 - RNA, 14 nt, Pseudomonas putida KT2440
uucgggcuguccuc

SEQ ID NO: 1620664 - RNA, 22 nt, Pseudomonas putida KT2440
uucugccaguaaggcuugcuca

SEQ ID NO: 1620665 - RNA, 14 nt, Pseudomonas putida KT2440
uucuucgugcgccu

SEQ ID NO: 1620666 - RNA, 23 nt, Pseudomonas putida KT2440
uugaucaugcccauggccagcgu

SEQ ID NO: 1620667 - RNA, 15 nt, Pseudomonas putida KT2440
uugauccagcccuuc

SEQ ID NO: 1620668 - RNA, 15 nt, Pseudomonas putida KT2440
uugaucaccuccacu

SEQ ID NO: 1620669 - RNA, 19 nt, Pseudomonas putida KT2440
uugaucacguggcugaugc

SEQ ID NO: 1620670 - RNA, 14 nt, Pseudomonas putida KT2440
uugaucagcgccuc

SEQ ID NO: 1620671 - RNA, 17 nt, Pseudomonas putida KT2440
uugaucagguaccccuc

SEQ ID NO: 1620672 - RNA, 20 nt, Pseudomonas putida KT2440
uugaucagguuacuggccaa

SEQ ID NO: 1620673 - RNA, 23 nt, Pseudomonas putida KT2440
uugaugugcaggucgauguccag

SEQ ID NO: 1620674 - RNA, 19 nt, Pseudomonas putida KT2440
uugauggucuuguggcuca

SEQ ID NO: 1620675 - RNA, 18 nt, Pseudomonas putida KT2440
uugcaaauacggccaaua

SEQ ID NO: 1620676 - RNA, 20 nt, Pseudomonas putida KT2440
uugcaccaacggcuucacau

SEQ ID NO: 1620677 - RNA, 16 nt, Pseudomonas putida KT2440
uugaggcacaaaaaag

SEQ ID NO: 1620678 - RNA, 21 nt, Pseudomonas putida KT2440
uugaggcugaucaggaacacu

SEQ ID NO: 1620679 - RNA, 17 nt, Pseudomonas putida KT2440
uugaggguggcaaugcu

SEQ ID NO: 1620680 - RNA, 14 nt, Pseudomonas putida KT2440
uugacuaccaggua

SEQ ID NO: 1620681 - RNA, 12 nt, Pseudomonas putida KT2440
uugagcaccccc

SEQ ID NO: 1620682 - RNA, 16 nt, Pseudomonas putida KT2440
uucuucuuuaagcccc

SEQ ID NO: 1620683 - RNA, 18 nt, Pseudomonas putida KT2440
uucuucuuuaagccccug

SEQ ID NO: 1620684 - RNA, 16 nt, Pseudomonas putida KT2440
uucuuucucccaggcc

SEQ ID NO: 1620685 - RNA, 13 nt, Pseudomonas putida KT2440
uucuuucagguaa

SEQ ID NO: 1620686 - RNA, 12 nt, Pseudomonas putida KT2440
uugaccaggcag

SEQ ID NO: 1620687 - RNA, 19 nt, Pseudomonas putida KT2440
uugaccaggcaguccugca

SEQ ID NO: 1620688 - RNA, 21 nt, Pseudomonas putida KT2440
uugaccaccagacgggcaugg

SEQ ID NO: 1620689 - RNA, 19 nt, Pseudomonas putida KT2440
uugacacccucuugaaucc

SEQ ID NO: 1620690 - RNA, 17 nt, Pseudomonas putida KT2440
uugaagcccggccgcgc

SEQ ID NO: 1620691 - RNA, 23 nt, Pseudomonas putida KT2440
uugaagcgcggcaugcccgcccc

SEQ ID NO: 1620692 - RNA, 15 nt, Pseudomonas putida KT2440
uugaauaaagaaagu

SEQ ID NO: 1620693 - RNA, 17 nt, Pseudomonas putida KT2440
ugauguagucgucgcug

SEQ ID NO: 1620694 - RNA, 23 nt, Pseudomonas putida KT2440
ugaugucuacccacaagcgcagg

SEQ ID NO: 1620695 - RNA, 18 nt, Pseudomonas putida KT2440
ugauguucggugcucagg

SEQ ID NO: 1620696 - RNA, 14 nt, Pseudomonas putida KT2440
ugauucaacgcccc

SEQ ID NO: 1620697 - RNA, 13 nt, Pseudomonas putida KT2440
ugauggggccgcu

SEQ ID NO: 1620698 - RNA, 22 nt, Pseudomonas putida KT2440
ugauggggcgcuggaagugcug

SEQ ID NO: 1620699 - RNA, 21 nt, Pseudomonas putida KT2440
ugauggugucuuccagguucu

SEQ ID NO: 1620700 - RNA, 14 nt, Pseudomonas putida KT2440
ugauggcugccagg

SEQ ID NO: 1620701 - RNA, 14 nt, Pseudomonas putida KT2440
ugauggcaaucacg

SEQ ID NO: 1620702 - RNA, 18 nt, Pseudomonas putida KT2440
ugauucaagacaguggaa

SEQ ID NO: 1620703 - RNA, 22 nt, Pseudomonas putida KT2440
ugcaaacgcaggugcgcacgcu

SEQ ID NO: 1620704 - RNA, 13 nt, Pseudomonas putida KT2440
ugaucggcuggcc

SEQ ID NO: 1620705 - RNA, 23 nt, Pseudomonas putida KT2440
ugaucgcggcguugucagccuuc

SEQ ID NO: 1620706 - RNA, 18 nt, Pseudomonas putida KT2440
ugaucgcguuacccacca

SEQ ID NO: 1620707 - RNA, 19 nt, Pseudomonas putida KT2440
ugaucgcguuacccaccag

SEQ ID NO: 1620708 - RNA, 14 nt, Pseudomonas putida KT2440
ugaucgccuggccg

SEQ ID NO: 1620709 - RNA, 18 nt, Pseudomonas putida KT2440
ugaucgccuggccggccg

SEQ ID NO: 1620710 - RNA, 21 nt, Pseudomonas putida KT2440
ugauccuguugcgauuucuug

SEQ ID NO: 1620711 - RNA, 22 nt, Pseudomonas putida KT2440
ugaugcgggaccagcaccaccu

SEQ ID NO: 1620712 - RNA, 19 nt, Pseudomonas putida KT2440
ugaugcgcuggcccuugcc

SEQ ID NO: 1620713 - RNA, 13 nt, Pseudomonas putida KT2440
ugaugccacgggc

SEQ ID NO: 1620714 - RNA, 19 nt, Pseudomonas putida KT2440
ugaugcagcagugccagca

SEQ ID NO: 1620715 - RNA, 21 nt, Pseudomonas putida KT2440
ugaucccuacccccuccucca

SEQ ID NO: 1620716 - RNA, 22 nt, Pseudomonas putida KT2440
ugaucccuacccccuccuccag

SEQ ID NO: 1620717 - RNA, 16 nt, Pseudomonas putida KT2440
ugauccggcacuccag

SEQ ID NO: 1620718 - RNA, 20 nt, Pseudomonas putida KT2440
ugauccgcuuucggcagugu

SEQ ID NO: 1620719 - RNA, 17 nt, Pseudomonas putida KT2440
ugaucagcugccacucu

SEQ ID NO: 1620720 - RNA, 21 nt, Pseudomonas putida KT2440
ugaucagcuggucgaggcggc

SEQ ID NO: 1620721 - RNA, 15 nt, Pseudomonas putida KT2440
ugauccaaauugcuc

SEQ ID NO: 1620722 - RNA, 20 nt, Pseudomonas putida KT2440
ugauauuugccacucaggcg

SEQ ID NO: 1620723 - RNA, 15 nt, Pseudomonas putida KT2440
ugagugcaggcauau

SEQ ID NO: 1620724 - RNA, 21 nt, Pseudomonas putida KT2440
ugcacaguucgaaaaccugcu

SEQ ID NO: 1620725 - RNA, 21 nt, Pseudomonas putida KT2440
ugcacauacaaaaugugccgg

SEQ ID NO: 1620726 - RNA, 21 nt, Pseudomonas putida KT2440
ugcacagccgugccuuccagc

SEQ ID NO: 1620727 - RNA, 16 nt, Pseudomonas putida KT2440
ugcacacugcccagca

SEQ ID NO: 1620728 - RNA, 19 nt, Pseudomonas putida KT2440
ugcacacugcccagcagcc

SEQ ID NO: 1620729 - RNA, 13 nt, Pseudomonas putida KT2440
ugcacagcucccu

SEQ ID NO: 1620730 - RNA, 21 nt, Pseudomonas putida KT2440
ugcacagcucgcgcugccagg

SEQ ID NO: 1620731 - RNA, 22 nt, Pseudomonas putida KT2440
ugcacagcucgcgcugccaggc

SEQ ID NO: 1620732 - RNA, 16 nt, Pseudomonas putida KT2440
ugcacagggcggccaa

SEQ ID NO: 1620733 - RNA, 23 nt, Pseudomonas putida KT2440
ugcacaggccagccccagcggca

SEQ ID NO: 1620734 - RNA, 22 nt, Pseudomonas putida KT2440
ugcaccuugagaucagcaaccu

SEQ ID NO: 1620735 - RNA, 15 nt, Pseudomonas putida KT2440
ugcaccuuguuaccc

SEQ ID NO: 1620736 - RNA, 19 nt, Pseudomonas putida KT2440
ugcaccaaugacuccgccc

SEQ ID NO: 1620737 - RNA, 22 nt, Pseudomonas putida KT2440
ugcaccaacacuuccagcaucg

SEQ ID NO: 1620738 - RNA, 18 nt, Pseudomonas putida KT2440
ugcaccaacgccgauagc

SEQ ID NO: 1620739 - RNA, 21 nt, Pseudomonas putida KT2440
ugcaccaacgccgauagccag

SEQ ID NO: 1620740 - RNA, 15 nt, Pseudomonas putida KT2440
ugcaccaacggcuuc

SEQ ID NO: 1620741 - RNA, 21 nt, Pseudomonas putida KT2440
ugcacgucgcugucuucugcc

SEQ ID NO: 1620742 - RNA, 20 nt, Pseudomonas putida KT2440
ugcacuggcaggccuuguuc

SEQ ID NO: 1620743 - RNA, 23 nt, Pseudomonas putida KT2440
ugcacuggcggggcuuuuucauu

SEQ ID NO: 1620744 - RNA, 18 nt, Pseudomonas putida KT2440
ugcacggccguuggccag

SEQ ID NO: 1620745 - RNA, 19 nt, Pseudomonas putida KT2440
ugcacuuucgcggcccagc

SEQ ID NO: 1620746 - RNA, 20 nt, Pseudomonas putida KT2440
ugcacuuucgcggcccagcc

SEQ ID NO: 1620747 - RNA, 20 nt, Pseudomonas putida KT2440
ugcacuugcgguguccauuc

SEQ ID NO: 1620748 - RNA, 14 nt, Pseudomonas putida KT2440
ugcacuuccacacc

SEQ ID NO: 1620749 - RNA, 21 nt, Pseudomonas putida KT2440
ugcacuucgauacccagccag

SEQ ID NO: 1620750 - RNA, 22 nt, Pseudomonas putida KT2440
ugcacuucgauacccagccagc

SEQ ID NO: 1620751 - RNA, 18 nt, Pseudomonas putida KT2440
ugcagaaccgccagcacc

SEQ ID NO: 1620752 - RNA, 19 nt, Pseudomonas putida KT2440
ugcagaaccgccagcacca

SEQ ID NO: 1620753 - RNA, 22 nt, Pseudomonas putida KT2440
ugcagaacguacuggccgcuga

SEQ ID NO: 1620754 - RNA, 12 nt, Pseudomonas putida KT2440
ugcacaaagccc

SEQ ID NO: 1620755 - RNA, 19 nt, Pseudomonas putida KT2440
ugcacacgucgccugggca

SEQ ID NO: 1620756 - RNA, 17 nt, Pseudomonas putida KT2440
ugcaauccgccacaaac

SEQ ID NO: 1620757 - RNA, 19 nt, Pseudomonas putida KT2440
ugcaaguaaucuggggcgc

SEQ ID NO: 1620758 - RNA, 16 nt, Pseudomonas putida KT2440
ugcaagguccaggcgu

SEQ ID NO: 1620759 - RNA, 15 nt, Pseudomonas putida KT2440
ugcaaagcagcccca

SEQ ID NO: 1620760 - RNA, 15 nt, Pseudomonas putida KT2440
ugcaagcagccaccc

SEQ ID NO: 1620761 - RNA, 20 nt, Pseudomonas putida KT2440
ugcaagccggcgaacagcac

SEQ ID NO: 1620762 - RNA, 16 nt, Pseudomonas putida KT2440
ugcaaggaucaccaag

SEQ ID NO: 1620763 - RNA, 14 nt, Pseudomonas putida KT2440
ugcaaggaucauuu

SEQ ID NO: 1620764 - RNA, 22 nt, Pseudomonas putida KT2440
ugcagaccugugggagcgggca

SEQ ID NO: 1620765 - RNA, 21 nt, Pseudomonas putida KT2440
ugcagacgccgucaagccuaa

SEQ ID NO: 1620766 - RNA, 19 nt, Pseudomonas putida KT2440
ugcagauugcccuguggcu

SEQ ID NO: 1620767 - RNA, 14 nt, Pseudomonas putida KT2440
ugcagaugggggga

SEQ ID NO: 1620768 - RNA, 20 nt, Pseudomonas putida KT2440
ugcagauggggggauuugag

SEQ ID NO: 1620769 - RNA, 15 nt, Pseudomonas putida KT2440
ugcagauccaggugc

SEQ ID NO: 1620770 - RNA, 22 nt, Pseudomonas putida KT2440
ugcagccgcguccacaaacccc

SEQ ID NO: 1620771 - RNA, 13 nt, Pseudomonas putida KT2440
ugcagcccuucgc

SEQ ID NO: 1620772 - RNA, 18 nt, Pseudomonas putida KT2440
ugcagcccuucgcgggug

SEQ ID NO: 1620773 - RNA, 18 nt, Pseudomonas putida KT2440
ugcagccgcacccaggcc

SEQ ID NO: 1620774 - RNA, 16 nt, Pseudomonas putida KT2440
ugcagccgcaccugcc

SEQ ID NO: 1620775 - RNA, 17 nt, Pseudomonas putida KT2440
ugcagccgcaccugccc

SEQ ID NO: 1620776 - RNA, 21 nt, Pseudomonas putida KT2440
ugcagcccggcaaacuccacu

SEQ ID NO: 1620777 - RNA, 20 nt, Pseudomonas putida KT2440
ugcagccccagccucagcug

SEQ ID NO: 1620778 - RNA, 21 nt, Pseudomonas putida KT2440
ugcagccccagccucagcugg

SEQ ID NO: 1620779 - RNA, 16 nt, Pseudomonas putida KT2440
ugcagccccaaugguu

SEQ ID NO: 1620780 - RNA, 20 nt, Pseudomonas putida KT2440
ugcagcaccgcuucacccuc

SEQ ID NO: 1620781 - RNA, 13 nt, Pseudomonas putida KT2440
ugcagcaccucca

SEQ ID NO: 1620782 - RNA, 22 nt, Pseudomonas putida KT2440
ugcagcacggaaucacgcggcg

SEQ ID NO: 1620783 - RNA, 15 nt, Pseudomonas putida KT2440
ugcagcacaggucuc

SEQ ID NO: 1620784 - RNA, 18 nt, Pseudomonas putida KT2440
ugcagccaaccuucaggg

SEQ ID NO: 1620785 - RNA, 15 nt, Pseudomonas putida KT2440
ugcagcagcgcgccg

SEQ ID NO: 1620786 - RNA, 17 nt, Pseudomonas putida KT2440
ugcagcgccugugagau

SEQ ID NO: 1620787 - RNA, 21 nt, Pseudomonas putida KT2440
ugcagcggauugaaacugccc

SEQ ID NO: 1620788 - RNA, 16 nt, Pseudomonas putida KT2440
ugcagcggcaagguag

SEQ ID NO: 1620789 - RNA, 24 nt, Pseudomonas putida KT2440
ugcagcgucggcagagcgccagca

SEQ ID NO: 1620790 - RNA, 13 nt, Pseudomonas putida KT2440
ugcagcguggccu

SEQ ID NO: 1620791 - RNA, 16 nt, Pseudomonas putida KT2440
ugcagcuuugaggcuc

SEQ ID NO: 1620792 - RNA, 21 nt, Pseudomonas putida KT2440
ugcagcuuugaggcucaugac

SEQ ID NO: 1620793 - RNA, 23 nt, Pseudomonas putida KT2440
ugcagggcgagcacacccggcgu

SEQ ID NO: 1620794 - RNA, 14 nt, Pseudomonas putida KT2440
ugcagggaagggca

SEQ ID NO: 1620795 - RNA, 15 nt, Pseudomonas putida KT2440
ugcagggcacgccaa

SEQ ID NO: 1620796 - RNA, 20 nt, Pseudomonas putida KT2440
ugcaggggagggcgugaaaa

SEQ ID NO: 1620797 - RNA, 22 nt, Pseudomonas putida KT2440
ugcagggggguaaggcuggcuu

SEQ ID NO: 1620798 - RNA, 15 nt, Pseudomonas putida KT2440
ugcaggguaggggug

SEQ ID NO: 1620799 - RNA, 19 nt, Pseudomonas putida KT2440
ugcaggcgcacauccacau

SEQ ID NO: 1620800 - RNA, 23 nt, Pseudomonas putida KT2440
ugcaggcgaucguugguccgcga

SEQ ID NO: 1620801 - RNA, 19 nt, Pseudomonas putida KT2440
ugcaggcgcaggcucucca

SEQ ID NO: 1620802 - RNA, 15 nt, Pseudomonas putida KT2440
ugcaggcgcagggug

SEQ ID NO: 1620803 - RNA, 23 nt, Pseudomonas putida KT2440
ugcaggcgcagggugugcugcug

SEQ ID NO: 1620804 - RNA, 14 nt, Pseudomonas putida KT2440
ugcaggcucugaau

SEQ ID NO: 1620805 - RNA, 18 nt, Pseudomonas putida KT2440
ugcaggcggcgacaaccg

SEQ ID NO: 1620806 - RNA, 19 nt, Pseudomonas putida KT2440
ugcaggcggcgacaaccga

SEQ ID NO: 1620807 - RNA, 13 nt, Pseudomonas putida KT2440
ugcaggcccaggu

SEQ ID NO: 1620808 - RNA, 22 nt, Pseudomonas putida KT2440
ugcaggcaucgaacgccgccug

SEQ ID NO: 1620809 - RNA, 20 nt, Pseudomonas putida KT2440
ugagcggcucgcgcucuuca

SEQ ID NO: 1620810 - RNA, 18 nt, Pseudomonas putida KT2440
ugagcgccauccaccugu

SEQ ID NO: 1620811 - RNA, 18 nt, Pseudomonas putida KT2440
ugagcgacgcugccgcac

SEQ ID NO: 1620812 - RNA, 19 nt, Pseudomonas putida KT2440
ugagcuugacuuccagcuu

SEQ ID NO: 1620813 - RNA, 15 nt, Pseudomonas putida KT2440
ugagcuucagcgcgc

SEQ ID NO: 1620814 - RNA, 22 nt, Pseudomonas putida KT2440
ugagcuggccguccagcugagc

SEQ ID NO: 1620815 - RNA, 22 nt, Pseudomonas putida KT2440
ugaggaacaacuugguccgguc

SEQ ID NO: 1620816 - RNA, 19 nt, Pseudomonas putida KT2440
ugaggaaguagaacacccg

SEQ ID NO: 1620817 - RNA, 15 nt, Pseudomonas putida KT2440
ugagguucagcgcac

SEQ ID NO: 1620818 - RNA, 19 nt, Pseudomonas putida KT2440
ugaggugccauagcaccag

SEQ ID NO: 1620819 - RNA, 20 nt, Pseudomonas putida KT2440
ugaggugccauagcaccagc

SEQ ID NO: 1620820 - RNA, 21 nt, Pseudomonas putida KT2440
ugaggugccauagcaccagcg

SEQ ID NO: 1620821 - RNA, 20 nt, Pseudomonas putida KT2440
ugaggugcugcagacccgcg

SEQ ID NO: 1620822 - RNA, 17 nt, Pseudomonas putida KT2440
ugagguuugccaaggca

SEQ ID NO: 1620823 - RNA, 16 nt, Pseudomonas putida KT2440
ugagggcguuccagcc

SEQ ID NO: 1620824 - RNA, 15 nt, Pseudomonas putida KT2440
ugagggcucauccac

SEQ ID NO: 1620825 - RNA, 21 nt, Pseudomonas putida KT2440
ugaggcguagcacaagggcca

SEQ ID NO: 1620826 - RNA, 23 nt, Pseudomonas putida KT2440
ugaggcguagcacaagggccagg

SEQ ID NO: 1620827 - RNA, 20 nt, Pseudomonas putida KT2440
ugaggcuguggcccaaggcg

SEQ ID NO: 1620828 - RNA, 21 nt, Pseudomonas putida KT2440
ugaggcacaaaaaagcccggc

SEQ ID NO: 1620829 - RNA, 19 nt, Pseudomonas putida KT2440
ugaggccgaacaccgccag

SEQ ID NO: 1620830 - RNA, 19 nt, Pseudomonas putida KT2440
ugagccaggagaacaccca

SEQ ID NO: 1620831 - RNA, 18 nt, Pseudomonas putida KT2440
ugagcccaaccucugaug

SEQ ID NO: 1620832 - RNA, 17 nt, Pseudomonas putida KT2440
ugagcgaaacccggcgc

SEQ ID NO: 1620833 - RNA, 14 nt, Pseudomonas putida KT2440
ugagccuugugcug

SEQ ID NO: 1620834 - RNA, 16 nt, Pseudomonas putida KT2440
ugagccggcgcugggc

SEQ ID NO: 1620835 - RNA, 21 nt, Pseudomonas putida KT2440
ugagccuucacugugcagggg

SEQ ID NO: 1620836 - RNA, 15 nt, Pseudomonas putida KT2440
ugacggcgcugcugg

SEQ ID NO: 1620837 - RNA, 17 nt, Pseudomonas putida KT2440
ugacggcgcugcuggcc

SEQ ID NO: 1620838 - RNA, 23 nt, Pseudomonas putida KT2440
ugacucgaccgccgcacaggaaa

SEQ ID NO: 1620839 - RNA, 15 nt, Pseudomonas putida KT2440
ugacugccagcacga

SEQ ID NO: 1620840 - RNA, 15 nt, Pseudomonas putida KT2440
ugacuggcagcaagg

SEQ ID NO: 1620841 - RNA, 17 nt, Pseudomonas putida KT2440
ugacuggcagcaaggcc

SEQ ID NO: 1620842 - RNA, 19 nt, Pseudomonas putida KT2440
ugaccccuucaucacccag

SEQ ID NO: 1620843 - RNA, 16 nt, Pseudomonas putida KT2440
ugaccggccgggcuuc

SEQ ID NO: 1620844 - RNA, 17 nt, Pseudomonas putida KT2440
ugaccggcacugcacag

SEQ ID NO: 1620845 - RNA, 17 nt, Pseudomonas putida KT2440
ugaccgggugugagaac

SEQ ID NO: 1620846 - RNA, 14 nt, Pseudomonas putida KT2440
ugaccguccacacc

SEQ ID NO: 1620847 - RNA, 15 nt, Pseudomonas putida KT2440
ugaccguccacaccg

SEQ ID NO: 1620848 - RNA, 14 nt, Pseudomonas putida KT2440
ugacccagcgcugg

SEQ ID NO: 1620849 - RNA, 17 nt, Pseudomonas putida KT2440
ugacccagcgcugguuu

SEQ ID NO: 1620850 - RNA, 16 nt, Pseudomonas putida KT2440
ugaccauuuccggguc

SEQ ID NO: 1620851 - RNA, 20 nt, Pseudomonas putida KT2440
ugaccucugguuuugucggc

SEQ ID NO: 1620852 - RNA, 18 nt, Pseudomonas putida KT2440
ugaccucgaccaggcgcu

SEQ ID NO: 1620853 - RNA, 16 nt, Pseudomonas putida KT2440
ugaccucgacccgccc

SEQ ID NO: 1620854 - RNA, 18 nt, Pseudomonas putida KT2440
ugaccgugaucaucagcg

SEQ ID NO: 1620855 - RNA, 20 nt, Pseudomonas putida KT2440
ugacagcaggaacagcggca

SEQ ID NO: 1620856 - RNA, 13 nt, Pseudomonas putida KT2440
ugacagcgcuucc

SEQ ID NO: 1620857 - RNA, 15 nt, Pseudomonas putida KT2440
ugacaccggcuacga

SEQ ID NO: 1620858 - RNA, 13 nt, Pseudomonas putida KT2440
ugacaccgcugcc

SEQ ID NO: 1620859 - RNA, 22 nt, Pseudomonas putida KT2440
ugaccaguugcucgcagacuuc

SEQ ID NO: 1620860 - RNA, 21 nt, Pseudomonas putida KT2440
ugaccagugucugcaacugcc

SEQ ID NO: 1620861 - RNA, 17 nt, Pseudomonas putida KT2440
ugaccaauccagcccuc

SEQ ID NO: 1620862 - RNA, 18 nt, Pseudomonas putida KT2440
ugacauaacaagaacaac

SEQ ID NO: 1620863 - RNA, 13 nt, Pseudomonas putida KT2440
ugacaguggcagg

SEQ ID NO: 1620864 - RNA, 17 nt, Pseudomonas putida KT2440
ugacaguggcagguucg

SEQ ID NO: 1620865 - RNA, 17 nt, Pseudomonas putida KT2440
ugacaagauaguaggca

SEQ ID NO: 1620866 - RNA, 14 nt, Pseudomonas putida KT2440
ugaauucuggcuua

SEQ ID NO: 1620867 - RNA, 13 nt, Pseudomonas putida KT2440
ugaauacaaagga

SEQ ID NO: 1620868 - RNA, 20 nt, Pseudomonas putida KT2440
ugaaugaaaaagccccgcca

SEQ ID NO: 1620869 - RNA, 21 nt, Pseudomonas putida KT2440
ugaaugaaaaagccccgccag

SEQ ID NO: 1620870 - RNA, 22 nt, Pseudomonas putida KT2440
ugccgugaagacgcacacuccc

SEQ ID NO: 1620871 - RNA, 15 nt, Pseudomonas putida KT2440
ugccgugaguggccu

SEQ ID NO: 1620872 - RNA, 17 nt, Pseudomonas putida KT2440
ugccuaucucuuccagc

SEQ ID NO: 1620873 - RNA, 21 nt, Pseudomonas putida KT2440
ugccgucucgucacuggcugc

SEQ ID NO: 1620874 - RNA, 23 nt, Pseudomonas putida KT2440
ugccugcagcccggcaaacucca

SEQ ID NO: 1620875 - RNA, 14 nt, Pseudomonas putida KT2440
ugccucaucaccuc

SEQ ID NO: 1620876 - RNA, 18 nt, Pseudomonas putida KT2440
ugccugacgggccucuuc

SEQ ID NO: 1620877 - RNA, 17 nt, Pseudomonas putida KT2440
ugccugaccggucagcc

SEQ ID NO: 1620878 - RNA, 20 nt, Pseudomonas putida KT2440
ugccucaagaaauugcaggg

SEQ ID NO: 1620879 - RNA, 14 nt, Pseudomonas putida KT2440
ugccuucaccagcu

SEQ ID NO: 1620880 - RNA, 23 nt, Pseudomonas putida KT2440
ugccugugucgaaccacugaugc

SEQ ID NO: 1620881 - RNA, 15 nt, Pseudomonas putida KT2440
ugccugugcuggccu

SEQ ID NO: 1620882 - RNA, 14 nt, Pseudomonas putida KT2440
ugccugugccggcc

SEQ ID NO: 1620883 - RNA, 15 nt, Pseudomonas putida KT2440
ugccuugccugggcc

SEQ ID NO: 1620884 - RNA, 14 nt, Pseudomonas putida KT2440
ugccuuggaaugca

SEQ ID NO: 1620885 - RNA, 14 nt, Pseudomonas putida KT2440
ugccgccgcugcca

SEQ ID NO: 1620886 - RNA, 15 nt, Pseudomonas putida KT2440
ugccggaguggaaga

SEQ ID NO: 1620887 - RNA, 23 nt, Pseudomonas putida KT2440
ugccggacucacccgcaccucac

SEQ ID NO: 1620888 - RNA, 17 nt, Pseudomonas putida KT2440
ugccgccaccuggcugc

SEQ ID NO: 1620889 - RNA, 23 nt, Pseudomonas putida KT2440
ugccgccaccuggcugcgggugc

SEQ ID NO: 1620890 - RNA, 21 nt, Pseudomonas putida KT2440
ugccgccgcagcaaucugcug

SEQ ID NO: 1620891 - RNA, 13 nt, Pseudomonas putida KT2440
ugccgccauccuc

SEQ ID NO: 1620892 - RNA, 17 nt, Pseudomonas putida KT2440
ugccggcagcgagcgcu

SEQ ID NO: 1620893 - RNA, 20 nt, Pseudomonas putida KT2440
ugccggcaacgauacccacg

SEQ ID NO: 1620894 - RNA, 21 nt, Pseudomonas putida KT2440
ugccguaggugaucagcuugc

SEQ ID NO: 1620895 - RNA, 19 nt, Pseudomonas putida KT2440
ugccguccagguccaggcc

SEQ ID NO: 1620896 - RNA, 17 nt, Pseudomonas putida KT2440
ugcgaggaucagcgcau

SEQ ID NO: 1620897 - RNA, 19 nt, Pseudomonas putida KT2440
ugcgagguaccguugcgga

SEQ ID NO: 1620898 - RNA, 15 nt, Pseudomonas putida KT2440
ugcgagcccuugucc

SEQ ID NO: 1620899 - RNA, 15 nt, Pseudomonas putida KT2440
ugcgagcgaacagcu

SEQ ID NO: 1620900 - RNA, 19 nt, Pseudomonas putida KT2440
ugcgagacgccaccaagcc

SEQ ID NO: 1620901 - RNA, 23 nt, Pseudomonas putida KT2440
ugcgagacgccaccaagcccuuc

SEQ ID NO: 1620902 - RNA, 14 nt, Pseudomonas putida KT2440
ugcgacgaacucaa

SEQ ID NO: 1620903 - RNA, 18 nt, Pseudomonas putida KT2440
ugcgacuugugcauccug

SEQ ID NO: 1620904 - RNA, 20 nt, Pseudomonas putida KT2440
ugcgacuugugcauccugca

SEQ ID NO: 1620905 - RNA, 18 nt, Pseudomonas putida KT2440
ugcgaacugcagagccug

SEQ ID NO: 1620906 - RNA, 19 nt, Pseudomonas putida KT2440
ugcgaacugcagagccugc

SEQ ID NO: 1620907 - RNA, 18 nt, Pseudomonas putida KT2440
ugcgaauggccgcaaccc

SEQ ID NO: 1620908 - RNA, 23 nt, Pseudomonas putida KT2440
ugcgacacgcgaaucgccagggc

SEQ ID NO: 1620909 - RNA, 22 nt, Pseudomonas putida KT2440
ugcgacaggcgucggggccgga

SEQ ID NO: 1620910 - RNA, 15 nt, Pseudomonas putida KT2440
ugcgaagcggccuga

SEQ ID NO: 1620911 - RNA, 18 nt, Pseudomonas putida KT2440
ugcgaaggggcgcccaga

SEQ ID NO: 1620912 - RNA, 19 nt, Pseudomonas putida KT2440
ugcgcaagcaaccgggggc

SEQ ID NO: 1620913 - RNA, 17 nt, Pseudomonas putida KT2440
ugcgcaaggccgcggcu

SEQ ID NO: 1620914 - RNA, 17 nt, Pseudomonas putida KT2440
ugcgcaacgacaaggua

SEQ ID NO: 1620915 - RNA, 21 nt, Pseudomonas putida KT2440
ugcgauguaucagcgccucca

SEQ ID NO: 1620916 - RNA, 15 nt, Pseudomonas putida KT2440
ugcgauguugaucag

SEQ ID NO: 1620917 - RNA, 20 nt, Pseudomonas putida KT2440
ugcgaguucaggcgcccugc

SEQ ID NO: 1620918 - RNA, 15 nt, Pseudomonas putida KT2440
ugcgaucgaaaucag

SEQ ID NO: 1620919 - RNA, 20 nt, Pseudomonas putida KT2440
ugcgaucgaaaucagccuuc

SEQ ID NO: 1620920 - RNA, 19 nt, Pseudomonas putida KT2440
ugcgauccgccccauagcc

SEQ ID NO: 1620921 - RNA, 12 nt, Pseudomonas putida KT2440
ugcgcagcagca

SEQ ID NO: 1620922 - RNA, 22 nt, Pseudomonas putida KT2440
ugcgcacgccgguaucacccag

SEQ ID NO: 1620923 - RNA, 14 nt, Pseudomonas putida KT2440
ugcgcacggaaggc

SEQ ID NO: 1620924 - RNA, 21 nt, Pseudomonas putida KT2440
ugcgcacauugacgucugucc

SEQ ID NO: 1620925 - RNA, 17 nt, Pseudomonas putida KT2440
ugcgcacgcgcucugca

SEQ ID NO: 1620926 - RNA, 16 nt, Pseudomonas putida KT2440
ugcgcaccccuugcca

SEQ ID NO: 1620927 - RNA, 19 nt, Pseudomonas putida KT2440
ugcgcacccgaccacccuc

SEQ ID NO: 1620928 - RNA, 13 nt, Pseudomonas putida KT2440
ugcgcagcuuguu

SEQ ID NO: 1620929 - RNA, 21 nt, Pseudomonas putida KT2440
ugcgcagcggcgucaccuucc

SEQ ID NO: 1620930 - RNA, 14 nt, Pseudomonas putida KT2440
ugcgcagccggccu

SEQ ID NO: 1620931 - RNA, 17 nt, Pseudomonas putida KT2440
ugcgcagccggccuugc

SEQ ID NO: 1620932 - RNA, 14 nt, Pseudomonas putida KT2440
ugcgcagcccuccc

SEQ ID NO: 1620933 - RNA, 18 nt, Pseudomonas putida KT2440
ugcgcagucauuuucaug

SEQ ID NO: 1620934 - RNA, 21 nt, Pseudomonas putida KT2440
ugcgcagucauuuucaugcag

SEQ ID NO: 1620935 - RNA, 14 nt, Pseudomonas putida KT2440
ugcgcauaucccuc

SEQ ID NO: 1620936 - RNA, 12 nt, Pseudomonas putida KT2440
ugcgcagggugg

SEQ ID NO: 1620937 - RNA, 19 nt, Pseudomonas putida KT2440
ugcgcaggcgccgccagcu

SEQ ID NO: 1620938 - RNA, 23 nt, Pseudomonas putida KT2440
ugcgcaggcuuucggccacccgg

SEQ ID NO: 1620939 - RNA, 15 nt, Pseudomonas putida KT2440
ugcccggcgcgcgcg

SEQ ID NO: 1620940 - RNA, 15 nt, Pseudomonas putida KT2440
ugcccggccagcagg

SEQ ID NO: 1620941 - RNA, 16 nt, Pseudomonas putida KT2440
ugcccggccagcagga

SEQ ID NO: 1620942 - RNA, 18 nt, Pseudomonas putida KT2440
ugcccgggaacggcugcc

SEQ ID NO: 1620943 - RNA, 16 nt, Pseudomonas putida KT2440
ugcccggcucaccgca

SEQ ID NO: 1620944 - RNA, 18 nt, Pseudomonas putida KT2440
ugcccgggccuucaaccu

SEQ ID NO: 1620945 - RNA, 18 nt, Pseudomonas putida KT2440
ugcccgggcgcaggcagc

SEQ ID NO: 1620946 - RNA, 14 nt, Pseudomonas putida KT2440
ugcccgggccgcuu

SEQ ID NO: 1620947 - RNA, 22 nt, Pseudomonas putida KT2440
ugcccgggccgcuugcucaggc

SEQ ID NO: 1620948 - RNA, 11 nt, Pseudomonas putida KT2440
ugcccggugcc

SEQ ID NO: 1620949 - RNA, 13 nt, Pseudomonas putida KT2440
ugcccuugccgcc

SEQ ID NO: 1620950 - RNA, 19 nt, Pseudomonas putida KT2440
ugccgaacgauucugccag

SEQ ID NO: 1620951 - RNA, 12 nt, Pseudomonas putida KT2440
ugccccuggccc

SEQ ID NO: 1620952 - RNA, 16 nt, Pseudomonas putida KT2440
ugccccugaucaucca

SEQ ID NO: 1620953 - RNA, 23 nt, Pseudomonas putida KT2440
ugcccgcagcuucaacuccacca

SEQ ID NO: 1620954 - RNA, 16 nt, Pseudomonas putida KT2440
ugcccgcaggugcggc

SEQ ID NO: 1620955 - RNA, 13 nt, Pseudomonas putida KT2440
ugcccgccacacc

SEQ ID NO: 1620956 - RNA, 15 nt, Pseudomonas putida KT2440
ugccccuaccgccaa

SEQ ID NO: 1620957 - RNA, 17 nt, Pseudomonas putida KT2440
ugccccucaaugcugcc

SEQ ID NO: 1620958 - RNA, 18 nt, Pseudomonas putida KT2440
ugccccucaaugcugccu

SEQ ID NO: 1620959 - RNA, 21 nt, Pseudomonas putida KT2440
ugccccugauaggacugcuuc

SEQ ID NO: 1620960 - RNA, 13 nt, Pseudomonas putida KT2440
ugccccgcaggcc

SEQ ID NO: 1620961 - RNA, 22 nt, Pseudomonas putida KT2440
ugccccgggugcagccgcaccc

SEQ ID NO: 1620962 - RNA, 15 nt, Pseudomonas putida KT2440
ugccccgggcaggcc

SEQ ID NO: 1620963 - RNA, 23 nt, Pseudomonas putida KT2440
ugcccauuucugcauguccagcc

SEQ ID NO: 1620964 - RNA, 20 nt, Pseudomonas putida KT2440
ugccccaaacggaccgcaua

SEQ ID NO: 1620965 - RNA, 16 nt, Pseudomonas putida KT2440
ugcccaugccaagccc

SEQ ID NO: 1620966 - RNA, 13 nt, Pseudomonas putida KT2440
ugcccauggccag

SEQ ID NO: 1620967 - RNA, 14 nt, Pseudomonas putida KT2440
ugcccauggccagc

SEQ ID NO: 1620968 - RNA, 15 nt, Pseudomonas putida KT2440
ugcccauggccaggc

SEQ ID NO: 1620969 - RNA, 19 nt, Pseudomonas putida KT2440
ugcccauuccugaagugaa

SEQ ID NO: 1620970 - RNA, 23 nt, Pseudomonas putida KT2440
ugcccagcugaagugccaaggcu

SEQ ID NO: 1620971 - RNA, 17 nt, Pseudomonas putida KT2440
ugcccagcugcgggaug

SEQ ID NO: 1620972 - RNA, 16 nt, Pseudomonas putida KT2440
ugcccagcgccaccgg

SEQ ID NO: 1620973 - RNA, 18 nt, Pseudomonas putida KT2440
ugcccagcgccaccggca

SEQ ID NO: 1620974 - RNA, 22 nt, Pseudomonas putida KT2440
ugcccagcgccaccggcagcaa

SEQ ID NO: 1620975 - RNA, 21 nt, Pseudomonas putida KT2440
ugcccagcagguacaccgccu

SEQ ID NO: 1620976 - RNA, 15 nt, Pseudomonas putida KT2440
ugcccaggugccagg

SEQ ID NO: 1620977 - RNA, 16 nt, Pseudomonas putida KT2440
ugcccaggugccaggc

SEQ ID NO: 1620978 - RNA, 16 nt, Pseudomonas putida KT2440
ugcccagggcugcuuc

SEQ ID NO: 1620979 - RNA, 17 nt, Pseudomonas putida KT2440
ugcccaggcccgacucc

SEQ ID NO: 1620980 - RNA, 22 nt, Pseudomonas putida KT2440
ugcccaugaucuugcugccguc

SEQ ID NO: 1620981 - RNA, 24 nt, Pseudomonas putida KT2440
ugccaggccgcacgcgccucuugc

SEQ ID NO: 1620982 - RNA, 16 nt, Pseudomonas putida KT2440
ugccaggccggguccu

SEQ ID NO: 1620983 - RNA, 16 nt, Pseudomonas putida KT2440
ugccagucgcacaggu

SEQ ID NO: 1620984 - RNA, 16 nt, Pseudomonas putida KT2440
ugccagcuuggucagg

SEQ ID NO: 1620985 - RNA, 22 nt, Pseudomonas putida KT2440
ugccagcguguuccaucaccgg

SEQ ID NO: 1620986 - RNA, 22 nt, Pseudomonas putida KT2440
ugccagcgucuuuggccugcuu

SEQ ID NO: 1620987 - RNA, 23 nt, Pseudomonas putida KT2440
ugccagcgugaaccggcuguugg

SEQ ID NO: 1620988 - RNA, 16 nt, Pseudomonas putida KT2440
ugccagcagcuggcuu

SEQ ID NO: 1620989 - RNA, 17 nt, Pseudomonas putida KT2440
ugccagcagcuggcuug

SEQ ID NO: 1620990 - RNA, 17 nt, Pseudomonas putida KT2440
ugccagcaccagcgcga

SEQ ID NO: 1620991 - RNA, 14 nt, Pseudomonas putida KT2440
ugccagcaaaugcc

SEQ ID NO: 1620992 - RNA, 21 nt, Pseudomonas putida KT2440
ugccagcaaaugcccacugcg

SEQ ID NO: 1620993 - RNA, 14 nt, Pseudomonas putida KT2440
ugcccaccgcugca

SEQ ID NO: 1620994 - RNA, 19 nt, Pseudomonas putida KT2440
ugcccacccaaccgcgcca

SEQ ID NO: 1620995 - RNA, 20 nt, Pseudomonas putida KT2440
ugcccaagcggcacuaccag

SEQ ID NO: 1620996 - RNA, 18 nt, Pseudomonas putida KT2440
ugcccaaagcccgugccg

SEQ ID NO: 1620997 - RNA, 22 nt, Pseudomonas putida KT2440
ugccagugucaguugcucgccc

SEQ ID NO: 1620998 - RNA, 21 nt, Pseudomonas putida KT2440
ugccaguugaucaccgucguc

SEQ ID NO: 1620999 - RNA, 15 nt, Pseudomonas putida KT2440
ugccauagcgcugca

SEQ ID NO: 1621000 - RNA, 22 nt, Pseudomonas putida KT2440
ugcaguaucgccccggucagca

SEQ ID NO: 1621001 - RNA, 17 nt, Pseudomonas putida KT2440
ugcagucaccuggccca

SEQ ID NO: 1621002 - RNA, 18 nt, Pseudomonas putida KT2440
ugcagucgaccgggcaga

SEQ ID NO: 1621003 - RNA, 16 nt, Pseudomonas putida KT2440
ugcagucguuguccag

SEQ ID NO: 1621004 - RNA, 17 nt, Pseudomonas putida KT2440
ugcagucguuguccagg

SEQ ID NO: 1621005 - RNA, 13 nt, Pseudomonas putida KT2440
ugccaacgcaccg

SEQ ID NO: 1621006 - RNA, 14 nt, Pseudomonas putida KT2440
ugcagguucugaau

SEQ ID NO: 1621007 - RNA, 14 nt, Pseudomonas putida KT2440
ugcagguccggaaa

SEQ ID NO: 1621008 - RNA, 22 nt, Pseudomonas putida KT2440
ugcaggucgacgaucgccgcca

SEQ ID NO: 1621009 - RNA, 15 nt, Pseudomonas putida KT2440
ugcaggucggccagc

SEQ ID NO: 1621010 - RNA, 16 nt, Pseudomonas putida KT2440
ugcaggugcagguucg

SEQ ID NO: 1621011 - RNA, 18 nt, Pseudomonas putida KT2440
ugccaccaucgaccuggc

SEQ ID NO: 1621012 - RNA, 19 nt, Pseudomonas putida KT2440
ugccacccaugccacccau

SEQ ID NO: 1621013 - RNA, 15 nt, Pseudomonas putida KT2440
ugccacccgaacaaa

SEQ ID NO: 1621014 - RNA, 18 nt, Pseudomonas putida KT2440
ugccacccgaacaaaacc

SEQ ID NO: 1621015 - RNA, 15 nt, Pseudomonas putida KT2440
ugccacccaaggcau

SEQ ID NO: 1621016 - RNA, 19 nt, Pseudomonas putida KT2440
ugccacccaaggcauccag

SEQ ID NO: 1621017 - RNA, 14 nt, Pseudomonas putida KT2440
ugccacccagauca

SEQ ID NO: 1621018 - RNA, 19 nt, Pseudomonas putida KT2440
ugccaccagcaucaacagg

SEQ ID NO: 1621019 - RNA, 16 nt, Pseudomonas putida KT2440
ugccacuucacccaau

SEQ ID NO: 1621020 - RNA, 16 nt, Pseudomonas putida KT2440
ugcgucaggccaugcc

SEQ ID NO: 1621021 - RNA, 14 nt, Pseudomonas putida KT2440
ugcgucaggcuuca

SEQ ID NO: 1621022 - RNA, 13 nt, Pseudomonas putida KT2440
ugcgucagcaucc

SEQ ID NO: 1621023 - RNA, 16 nt, Pseudomonas putida KT2440
ugcgucaacucaucac

SEQ ID NO: 1621024 - RNA, 18 nt, Pseudomonas putida KT2440
ugcguccgucgccggccg

SEQ ID NO: 1621025 - RNA, 21 nt, Pseudomonas putida KT2440
ugcgucgcgaugggcugcaaa

SEQ ID NO: 1621026 - RNA, 18 nt, Pseudomonas putida KT2440
ugcgucggcguggaacaa

SEQ ID NO: 1621027 - RNA, 16 nt, Pseudomonas putida KT2440
ugcgguaccggccagc

SEQ ID NO: 1621028 - RNA, 14 nt, Pseudomonas putida KT2440
ugcgguagcggcug

SEQ ID NO: 1621029 - RNA, 15 nt, Pseudomonas putida KT2440
ugcguacccagcccc

SEQ ID NO: 1621030 - RNA, 17 nt, Pseudomonas putida KT2440
ugcguagccuucagcgg

SEQ ID NO: 1621031 - RNA, 12 nt, Pseudomonas putida KT2440
ugcgggccacca

SEQ ID NO: 1621032 - RNA, 16 nt, Pseudomonas putida KT2440
ugcgggaagccaugca

SEQ ID NO: 1621033 - RNA, 20 nt, Pseudomonas putida KT2440
ugcgggaaguccgccaggaa

SEQ ID NO: 1621034 - RNA, 23 nt, Pseudomonas putida KT2440
ugcgggaccagcaccaccugugc

SEQ ID NO: 1621035 - RNA, 19 nt, Pseudomonas putida KT2440
ugcgggcaaagaacaucac

SEQ ID NO: 1621036 - RNA, 19 nt, Pseudomonas putida KT2440
ugcgcugauucaacgcccc

SEQ ID NO: 1621037 - RNA, 21 nt, Pseudomonas putida KT2440
ugcgcugcugguacaugccgc

SEQ ID NO: 1621038 - RNA, 12 nt, Pseudomonas putida KT2440
ugcgcuggcaca

SEQ ID NO: 1621039 - RNA, 23 nt, Pseudomonas putida KT2440
ugcgcuggccaauggcaaucccc

SEQ ID NO: 1621040 - RNA, 11 nt, Pseudomonas putida KT2440
ugcgcuggcug

SEQ ID NO: 1621041 - RNA, 18 nt, Pseudomonas putida KT2440
ugcgcauggccgccacau

SEQ ID NO: 1621042 - RNA, 21 nt, Pseudomonas putida KT2440
ugcgcaugcgcgccauggccu

SEQ ID NO: 1621043 - RNA, 14 nt, Pseudomonas putida KT2440
ugcgcucgcugccg

SEQ ID NO: 1621044 - RNA, 16 nt, Pseudomonas putida KT2440
ugcggcagcucgccgu

SEQ ID NO: 1621045 - RNA, 15 nt, Pseudomonas putida KT2440
ugcggcggcacugau

SEQ ID NO: 1621046 - RNA, 18 nt, Pseudomonas putida KT2440
ugcggcugggucacccag

SEQ ID NO: 1621047 - RNA, 22 nt, Pseudomonas putida KT2440
ugcggcugccccaacugcaucc

SEQ ID NO: 1621048 - RNA, 17 nt, Pseudomonas putida KT2440
ugcggcaaccaccaaca

SEQ ID NO: 1621049 - RNA, 22 nt, Pseudomonas putida KT2440
ugcggcaaccaccaacagcacc

SEQ ID NO: 1621050 - RNA, 19 nt, Pseudomonas putida KT2440
ugcggcagauccugcagcc

SEQ ID NO: 1621051 - RNA, 23 nt, Pseudomonas putida KT2440
ugcuauaucucugguacaacaac

SEQ ID NO: 1621052 - RNA, 13 nt, Pseudomonas putida KT2440
ugcuaauuucagg

SEQ ID NO: 1621053 - RNA, 14 nt, Pseudomonas putida KT2440
ugcuaauuucaggu

SEQ ID NO: 1621054 - RNA, 23 nt, Pseudomonas putida KT2440
ugcuacgcgcgggguugacagag

SEQ ID NO: 1621055 - RNA, 17 nt, Pseudomonas putida KT2440
ugcuacggccgugcagg

SEQ ID NO: 1621056 - RNA, 14 nt, Pseudomonas putida KT2440
ugcuaccggcgcca

SEQ ID NO: 1621057 - RNA, 13 nt, Pseudomonas putida KT2440
ugcuacgccgccg

SEQ ID NO: 1621058 - RNA, 15 nt, Pseudomonas putida KT2440
ugcucuuguuccgcc

SEQ ID NO: 1621059 - RNA, 14 nt, Pseudomonas putida KT2440
ugcucugcaaugcc

SEQ ID NO: 1621060 - RNA, 15 nt, Pseudomonas putida KT2440
ugcucugcaaugccg

SEQ ID NO: 1621061 - RNA, 15 nt, Pseudomonas putida KT2440
ugcucugccgccgca

SEQ ID NO: 1621062 - RNA, 22 nt, Pseudomonas putida KT2440
ugcucugcaggcacacccggac

SEQ ID NO: 1621063 - RNA, 17 nt, Pseudomonas putida KT2440
ugcucuggcugagcgca

SEQ ID NO: 1621064 - RNA, 22 nt, Pseudomonas putida KT2440
ugcucggcaacggccgugcgcc

SEQ ID NO: 1621065 - RNA, 13 nt, Pseudomonas putida KT2440
ugcucggcaccac

SEQ ID NO: 1621066 - RNA, 20 nt, Pseudomonas putida KT2440
ugcucacgcacgaucucccg

SEQ ID NO: 1621067 - RNA, 17 nt, Pseudomonas putida KT2440
ugcucaggcgggcagcg

SEQ ID NO: 1621068 - RNA, 15 nt, Pseudomonas putida KT2440
ugcucaggcucagcu

SEQ ID NO: 1621069 - RNA, 22 nt, Pseudomonas putida KT2440
ugcuccagcguguucaaugccc

SEQ ID NO: 1621070 - RNA, 19 nt, Pseudomonas putida KT2440
ugcuccagcucacagcacu

SEQ ID NO: 1621071 - RNA, 12 nt, Pseudomonas putida KT2440
ugcuccagcucc

SEQ ID NO: 1621072 - RNA, 13 nt, Pseudomonas putida KT2440
ugcuccagcucca

SEQ ID NO: 1621073 - RNA, 17 nt, Pseudomonas putida KT2440
ugcuccagcuccaggcg

SEQ ID NO: 1621074 - RNA, 14 nt, Pseudomonas putida KT2440
ugcuccagcugcuc

SEQ ID NO: 1621075 - RNA, 14 nt, Pseudomonas putida KT2440
ugcucgcugccacg

SEQ ID NO: 1621076 - RNA, 16 nt, Pseudomonas putida KT2440
ugcucgcugcugccuu

SEQ ID NO: 1621077 - RNA, 17 nt, Pseudomonas putida KT2440
ugcucgcugcugccuuc

SEQ ID NO: 1621078 - RNA, 19 nt, Pseudomonas putida KT2440
ugcucgcucaggcucuuga

SEQ ID NO: 1621079 - RNA, 20 nt, Pseudomonas putida KT2440
ugcucgcucaggcucuugaa

SEQ ID NO: 1621080 - RNA, 13 nt, Pseudomonas putida KT2440
ugcucgccugcuu

SEQ ID NO: 1621081 - RNA, 19 nt, Pseudomonas putida KT2440
ugcucgccugcuuggcacc

SEQ ID NO: 1621082 - RNA, 21 nt, Pseudomonas putida KT2440
ugcucccgcaggggcugcgca

SEQ ID NO: 1621083 - RNA, 21 nt, Pseudomonas putida KT2440
ugcucccagaaaggccgcugu

SEQ ID NO: 1621084 - RNA, 19 nt, Pseudomonas putida KT2440
ugcuccccaaccaccuccc

SEQ ID NO: 1621085 - RNA, 21 nt, Pseudomonas putida KT2440
ugcuccccaaccaccucccca

SEQ ID NO: 1621086 - RNA, 13 nt, Pseudomonas putida KT2440
uggacacagaccg

SEQ ID NO: 1621087 - RNA, 17 nt, Pseudomonas putida KT2440
uggacagcggcagcauc

SEQ ID NO: 1621088 - RNA, 15 nt, Pseudomonas putida KT2440
uggacagcaauucca

SEQ ID NO: 1621089 - RNA, 19 nt, Pseudomonas putida KT2440
uggaaugcacauuccgcac

SEQ ID NO: 1621090 - RNA, 16 nt, Pseudomonas putida KT2440
uggaauucgcugcgca

SEQ ID NO: 1621091 - RNA, 17 nt, Pseudomonas putida KT2440
uggaauuauuggccagc

SEQ ID NO: 1621092 - RNA, 14 nt, Pseudomonas putida KT2440
uggaauaccaccuc

SEQ ID NO: 1621093 - RNA, 14 nt, Pseudomonas putida KT2440
uggaaguuccugcu

SEQ ID NO: 1621094 - RNA, 15 nt, Pseudomonas putida KT2440
uggaagcgcgcauca

SEQ ID NO: 1621095 - RNA, 17 nt, Pseudomonas putida KT2440
uggaacgcuuggccaga

SEQ ID NO: 1621096 - RNA, 22 nt, Pseudomonas putida KT2440
uggaacaggauggcaaagcgca

SEQ ID NO: 1621097 - RNA, 22 nt, Pseudomonas putida KT2440
uggaaauucucggcugccuggg

SEQ ID NO: 1621098 - RNA, 14 nt, Pseudomonas putida KT2440
uggaaauggaauuu

SEQ ID NO: 1621099 - RNA, 16 nt, Pseudomonas putida KT2440
uggaaaucgccugcuu

SEQ ID NO: 1621100 - RNA, 21 nt, Pseudomonas putida KT2440
ugcuugucauaagccuuucau

SEQ ID NO: 1621101 - RNA, 14 nt, Pseudomonas putida KT2440
ugcuuguccauccc

SEQ ID NO: 1621102 - RNA, 21 nt, Pseudomonas putida KT2440
ugcuugcggaacaggaucagc

SEQ ID NO: 1621103 - RNA, 13 nt, Pseudomonas putida KT2440
ugcuugcgggccc

SEQ ID NO: 1621104 - RNA, 15 nt, Pseudomonas putida KT2440
ugcuuucaguugagg

SEQ ID NO: 1621105 - RNA, 17 nt, Pseudomonas putida KT2440
ugcuuugaagucacuuu

SEQ ID NO: 1621106 - RNA, 17 nt, Pseudomonas putida KT2440
ugcuuccagggcgccgu

SEQ ID NO: 1621107 - RNA, 20 nt, Pseudomonas putida KT2440
ugcuucgcccagugccugac

SEQ ID NO: 1621108 - RNA, 15 nt, Pseudomonas putida KT2440
ugcuucugcagaucc

SEQ ID NO: 1621109 - RNA, 15 nt, Pseudomonas putida KT2440
ugcuucggcugaucu

SEQ ID NO: 1621110 - RNA, 17 nt, Pseudomonas putida KT2440
ugcugcgucucuuccuc

SEQ ID NO: 1621111 - RNA, 14 nt, Pseudomonas putida KT2440
ugcuggcacgccuu

SEQ ID NO: 1621112 - RNA, 14 nt, Pseudomonas putida KT2440
ugcuggcacugcgg

SEQ ID NO: 1621113 - RNA, 16 nt, Pseudomonas putida KT2440
ugcuggcaauccagcg

SEQ ID NO: 1621114 - RNA, 22 nt, Pseudomonas putida KT2440
ugcugcggggugcucugccgca

SEQ ID NO: 1621115 - RNA, 14 nt, Pseudomonas putida KT2440
ugcugcggccgcgc

SEQ ID NO: 1621116 - RNA, 13 nt, Pseudomonas putida KT2440
ugcugcggcaggc

SEQ ID NO: 1621117 - RNA, 21 nt, Pseudomonas putida KT2440
ugcugcucauacugcugaccc

SEQ ID NO: 1621118 - RNA, 15 nt, Pseudomonas putida KT2440
ugcugaccaccgugc

SEQ ID NO: 1621119 - RNA, 19 nt, Pseudomonas putida KT2440
ugcugucacccuugggcac

SEQ ID NO: 1621120 - RNA, 23 nt, Pseudomonas putida KT2440
ugcugguguaggacaucugguca

SEQ ID NO: 1621121 - RNA, 21 nt, Pseudomonas putida KT2440
ugcugguuaacaugcuggcca

SEQ ID NO: 1621122 - RNA, 13 nt, Pseudomonas putida KT2440
ugcugugcacugc

SEQ ID NO: 1621123 - RNA, 22 nt, Pseudomonas putida KT2440
ugcugucgguaccuggccgugc

SEQ ID NO: 1621124 - RNA, 20 nt, Pseudomonas putida KT2440
ugcugucggugaagccgacc

SEQ ID NO: 1621125 - RNA, 20 nt, Pseudomonas putida KT2440
ugcuggccgcgcaggaagaa

SEQ ID NO: 1621126 - RNA, 12 nt, Pseudomonas putida KT2440
ugcuggccaccg

SEQ ID NO: 1621127 - RNA, 16 nt, Pseudomonas putida KT2440
ugcuggccgccagaca

SEQ ID NO: 1621128 - RNA, 15 nt, Pseudomonas putida KT2440
ugcugguggccacgc

SEQ ID NO: 1621129 - RNA, 21 nt, Pseudomonas putida KT2440
ugcuggucgccgugcagcacc

SEQ ID NO: 1621130 - RNA, 19 nt, Pseudomonas putida KT2440
ugcugguagaaccacucca

SEQ ID NO: 1621131 - RNA, 15 nt, Pseudomonas putida KT2440
ugcugguccuccccu

SEQ ID NO: 1621132 - RNA, 22 nt, Pseudomonas putida KT2440
ugcugguccucgacgggcaggc

SEQ ID NO: 1621133 - RNA, 21 nt, Pseudomonas putida KT2440
ugcuggucgaacaacuugugc

SEQ ID NO: 1621134 - RNA, 18 nt, Pseudomonas putida KT2440
uuaguuuaacggauagaa

SEQ ID NO: 1621135 - RNA, 14 nt, Pseudomonas putida KT2440
uuauacgccgccga

SEQ ID NO: 1621136 - RNA, 16 nt, Pseudomonas putida KT2440
uuagacaauucugaag

SEQ ID NO: 1621137 - RNA, 14 nt, Pseudomonas putida KT2440
uuaggcgagaucga

SEQ ID NO: 1621138 - RNA, 21 nt, Pseudomonas putida KT2440
uuaauccugccggcuucacua

SEQ ID NO: 1621139 - RNA, 22 nt, Pseudomonas putida KT2440
uuacccuguacccgcuggcuga

SEQ ID NO: 1621140 - RNA, 22 nt, Pseudomonas putida KT2440
uuaccaggcgccauuuggcgcc

SEQ ID NO: 1621141 - RNA, 13 nt, Pseudomonas putida KT2440
uguguccaccacc

SEQ ID NO: 1621142 - RNA, 20 nt, Pseudomonas putida KT2440
ugugugcaagucugaaaaca

SEQ ID NO: 1621143 - RNA, 15 nt, Pseudomonas putida KT2440
ugugugccugcuccg

SEQ ID NO: 1621144 - RNA, 18 nt, Pseudomonas putida KT2440
ugugggagcgggcgugcc

SEQ ID NO: 1621145 - RNA, 18 nt, Pseudomonas putida KT2440
ugugggagcgggcuugcc

SEQ ID NO: 1621146 - RNA, 13 nt, Pseudomonas putida KT2440
uguggcgcacaga

SEQ ID NO: 1621147 - RNA, 15 nt, Pseudomonas putida KT2440
ugugcggguucuccc

SEQ ID NO: 1621148 - RNA, 14 nt, Pseudomonas putida KT2440
ugugcuccagcucc

SEQ ID NO: 1621149 - RNA, 16 nt, Pseudomonas putida KT2440
ugugcuccagcuccag

SEQ ID NO: 1621150 - RNA, 16 nt, Pseudomonas putida KT2440
ugucagcagcuucagc

SEQ ID NO: 1621151 - RNA, 22 nt, Pseudomonas putida KT2440
ugucaccgguaucgaugcacag

SEQ ID NO: 1621152 - RNA, 20 nt, Pseudomonas putida KT2440
ugucaccgcgagcagcguuc

SEQ ID NO: 1621153 - RNA, 23 nt, Pseudomonas putida KT2440
ugucacgcgccagguuggcaaac

SEQ ID NO: 1621154 - RNA, 22 nt, Pseudomonas putida KT2440
ugucacccagcacuucguccag

SEQ ID NO: 1621155 - RNA, 24 nt, Pseudomonas putida KT2440
ugucaccccguucgcccugcgccu

SEQ ID NO: 1621156 - RNA, 21 nt, Pseudomonas putida KT2440
ugucaccgagacgaucaccag

SEQ ID NO: 1621157 - RNA, 20 nt, Pseudomonas putida KT2440
ugugcgagcccuuguccagg

SEQ ID NO: 1621158 - RNA, 17 nt, Pseudomonas putida KT2440
ugugcgccgucaccagc

SEQ ID NO: 1621159 - RNA, 18 nt, Pseudomonas putida KT2440
ugugcacccgugccugcc

SEQ ID NO: 1621160 - RNA, 23 nt, Pseudomonas putida KT2440
ugugcacccgugccugccugcaa

SEQ ID NO: 1621161 - RNA, 16 nt, Pseudomonas putida KT2440
ugugcacauucuccag

SEQ ID NO: 1621162 - RNA, 19 nt, Pseudomonas putida KT2440
ugugcauccugcacugcaa

SEQ ID NO: 1621163 - RNA, 21 nt, Pseudomonas putida KT2440
ugugcagcgcucgcugccggu

SEQ ID NO: 1621164 - RNA, 13 nt, Pseudomonas putida KT2440
ugugcauccagcc

SEQ ID NO: 1621165 - RNA, 14 nt, Pseudomonas putida KT2440
ugugcauccagccc

SEQ ID NO: 1621166 - RNA, 18 nt, Pseudomonas putida KT2440
ugugcaugcgccccccau

SEQ ID NO: 1621167 - RNA, 24 nt, Pseudomonas putida KT2440
ugugcaggggcugccuugcagccc

SEQ ID NO: 1621168 - RNA, 23 nt, Pseudomonas putida KT2440
ugugcaggucgauguccaggccg

SEQ ID NO: 1621169 - RNA, 11 nt, Pseudomonas putida KT2440
uguuggccacg

SEQ ID NO: 1621170 - RNA, 22 nt, Pseudomonas putida KT2440
uguuggggucugcuuugcagcc

SEQ ID NO: 1621171 - RNA, 18 nt, Pseudomonas putida KT2440
uguugggcgggccgccga

SEQ ID NO: 1621172 - RNA, 14 nt, Pseudomonas putida KT2440
uguugcagcgccag

SEQ ID NO: 1621173 - RNA, 11 nt, Pseudomonas putida KT2440
uguugcugggc

SEQ ID NO: 1621174 - RNA, 12 nt, Pseudomonas putida KT2440
uguugcuugucc

SEQ ID NO: 1621175 - RNA, 20 nt, Pseudomonas putida KT2440
uguugcugcagguucugaau

SEQ ID NO: 1621176 - RNA, 14 nt, Pseudomonas putida KT2440
uguugccacccggc

SEQ ID NO: 1621177 - RNA, 19 nt, Pseudomonas putida KT2440
uguugccaaugccggcaca

SEQ ID NO: 1621178 - RNA, 22 nt, Pseudomonas putida KT2440
uguuccagccgcgccacuccca

SEQ ID NO: 1621179 - RNA, 19 nt, Pseudomonas putida KT2440
uguucagguguuccagcac

SEQ ID NO: 1621180 - RNA, 14 nt, Pseudomonas putida KT2440
uguucccccaccgg

SEQ ID NO: 1621181 - RNA, 18 nt, Pseudomonas putida KT2440
uguuccauuucacuggcu

SEQ ID NO: 1621182 - RNA, 13 nt, Pseudomonas putida KT2440
uguuccauuuccc

SEQ ID NO: 1621183 - RNA, 14 nt, Pseudomonas putida KT2440
uguucccagcaccc

SEQ ID NO: 1621184 - RNA, 17 nt, Pseudomonas putida KT2440
uguucccagcaccccag

SEQ ID NO: 1621185 - RNA, 20 nt, Pseudomonas putida KT2440
uguucagcaccuucuugccc

SEQ ID NO: 1621186 - RNA, 13 nt, Pseudomonas putida KT2440
uguuaaguauuaa

SEQ ID NO: 1621187 - RNA, 18 nt, Pseudomonas putida KT2440
uguuucagcccuugcucg

SEQ ID NO: 1621188 - RNA, 19 nt, Pseudomonas putida KT2440
uguuuacaaccuguaacuc

SEQ ID NO: 1621189 - RNA, 18 nt, Pseudomonas putida KT2440
uguuuugccuccagcuuu

SEQ ID NO: 1621190 - RNA, 11 nt, Pseudomonas putida KT2440
uguuuugagag

SEQ ID NO: 1621191 - RNA, 16 nt, Pseudomonas putida KT2440
uguuugggccugugcc

SEQ ID NO: 1621192 - RNA, 22 nt, Pseudomonas putida KT2440
uguuugggccugugccggccgc

SEQ ID NO: 1621193 - RNA, 15 nt, Pseudomonas putida KT2440
uguuugggcuugagc

SEQ ID NO: 1621194 - RNA, 16 nt, Pseudomonas putida KT2440
uguuugaccaccagac

SEQ ID NO: 1621195 - RNA, 18 nt, Pseudomonas putida KT2440
uggcaaacagcaccagcc

SEQ ID NO: 1621196 - RNA, 17 nt, Pseudomonas putida KT2440
uggcaaacaugaaaccg

SEQ ID NO: 1621197 - RNA, 18 nt, Pseudomonas putida KT2440
uggcaauuggcuuccagg

SEQ ID NO: 1621198 - RNA, 15 nt, Pseudomonas putida KT2440
uggcaaucgggccgg

SEQ ID NO: 1621199 - RNA, 18 nt, Pseudomonas putida KT2440
uggcaaucccccgcucau

SEQ ID NO: 1621200 - RNA, 16 nt, Pseudomonas putida KT2440
uggcaagggcggaggc

SEQ ID NO: 1621201 - RNA, 17 nt, Pseudomonas putida KT2440
uggcaccuaucgcugcc

SEQ ID NO: 1621202 - RNA, 14 nt, Pseudomonas putida KT2440
uggcaccgccgccc

SEQ ID NO: 1621203 - RNA, 17 nt, Pseudomonas putida KT2440
uggcaccggcagcagca

SEQ ID NO: 1621204 - RNA, 14 nt, Pseudomonas putida KT2440
uggcaccggcgcca

SEQ ID NO: 1621205 - RNA, 15 nt, Pseudomonas putida KT2440
uggcaccggcuuugc

SEQ ID NO: 1621206 - RNA, 21 nt, Pseudomonas putida KT2440
uggcaccagauucaagcccgg

SEQ ID NO: 1621207 - RNA, 20 nt, Pseudomonas putida KT2440
uggcaccgaucaccugggcg

SEQ ID NO: 1621208 - RNA, 23 nt, Pseudomonas putida KT2440
uggcacagaacaauaaaacuacc

SEQ ID NO: 1621209 - RNA, 17 nt, Pseudomonas putida KT2440
uggcacccucaccaacu

SEQ ID NO: 1621210 - RNA, 13 nt, Pseudomonas putida KT2440
uggcacgccuuca

SEQ ID NO: 1621211 - RNA, 16 nt, Pseudomonas putida KT2440
uggcacguugcugccu

SEQ ID NO: 1621212 - RNA, 20 nt, Pseudomonas putida KT2440
uggcacguugcugccugugc

SEQ ID NO: 1621213 - RNA, 22 nt, Pseudomonas putida KT2440
uggcacugcccaagccauccac

SEQ ID NO: 1621214 - RNA, 20 nt, Pseudomonas putida KT2440
uggcagcaccgggcgggugc

SEQ ID NO: 1621215 - RNA, 20 nt, Pseudomonas putida KT2440
uggcagcacgaucagcgcgg

SEQ ID NO: 1621216 - RNA, 16 nt, Pseudomonas putida KT2440
uggcagcaaucggcag

SEQ ID NO: 1621217 - RNA, 21 nt, Pseudomonas putida KT2440
uggcagcaaucggcagcgcgc

SEQ ID NO: 1621218 - RNA, 16 nt, Pseudomonas putida KT2440
uggcagcuugcccugc

SEQ ID NO: 1621219 - RNA, 17 nt, Pseudomonas putida KT2440
uggcagcucugcgacug

SEQ ID NO: 1621220 - RNA, 16 nt, Pseudomonas putida KT2440
uggcagcugcagugcu

SEQ ID NO: 1621221 - RNA, 22 nt, Pseudomonas putida KT2440
uggcaggcaguucgagcgccug

SEQ ID NO: 1621222 - RNA, 16 nt, Pseudomonas putida KT2440
uggcagcuaccacccc

SEQ ID NO: 1621223 - RNA, 16 nt, Pseudomonas putida KT2440
uggcagcuccagccag

SEQ ID NO: 1621224 - RNA, 14 nt, Pseudomonas putida KT2440
uggcagccucgucc

SEQ ID NO: 1621225 - RNA, 20 nt, Pseudomonas putida KT2440
uggcaggcucagggcagcaa

SEQ ID NO: 1621226 - RNA, 21 nt, Pseudomonas putida KT2440
uggcaggcucagggcagcaac

SEQ ID NO: 1621227 - RNA, 15 nt, Pseudomonas putida KT2440
uggcagugaucuggc

SEQ ID NO: 1621228 - RNA, 18 nt, Pseudomonas putida KT2440
uggauggucacgccaucc

SEQ ID NO: 1621229 - RNA, 20 nt, Pseudomonas putida KT2440
uggauggcaccggcuuugcc

SEQ ID NO: 1621230 - RNA, 22 nt, Pseudomonas putida KT2440
uggauggugcgcucguaggcug

SEQ ID NO: 1621231 - RNA, 15 nt, Pseudomonas putida KT2440
uggaugcgggcuuuc

SEQ ID NO: 1621232 - RNA, 11 nt, Pseudomonas putida KT2440
uggaucuugcu

SEQ ID NO: 1621233 - RNA, 21 nt, Pseudomonas putida KT2440
uggaugacgccgcagccgggc

SEQ ID NO: 1621234 - RNA, 16 nt, Pseudomonas putida KT2440
uggaucacugccagca

SEQ ID NO: 1621235 - RNA, 21 nt, Pseudomonas putida KT2440
uggaucacugccagcaccugg

SEQ ID NO: 1621236 - RNA, 22 nt, Pseudomonas putida KT2440
uggaucaccaccgucgaagccc

SEQ ID NO: 1621237 - RNA, 15 nt, Pseudomonas putida KT2440
uggaucgccaggcug

SEQ ID NO: 1621238 - RNA, 17 nt, Pseudomonas putida KT2440
uggaguugucacuccag

SEQ ID NO: 1621239 - RNA, 17 nt, Pseudomonas putida KT2440
uggauacugcccgucag

SEQ ID NO: 1621240 - RNA, 17 nt, Pseudomonas putida KT2440
uggauaugcuccauguu

SEQ ID NO: 1621241 - RNA, 15 nt, Pseudomonas putida KT2440
uggagagguacaccc

SEQ ID NO: 1621242 - RNA, 14 nt, Pseudomonas putida KT2440
uggacugugggagc

SEQ ID NO: 1621243 - RNA, 18 nt, Pseudomonas putida KT2440
uggaguacgggcacaccu

SEQ ID NO: 1621244 - RNA, 22 nt, Pseudomonas putida KT2440
uggagucgacacgcuuuucagg

SEQ ID NO: 1621245 - RNA, 17 nt, Pseudomonas putida KT2440
uggagcaaggcguuguc

SEQ ID NO: 1621246 - RNA, 15 nt, Pseudomonas putida KT2440
uggagauuggccagc

SEQ ID NO: 1621247 - RNA, 19 nt, Pseudomonas putida KT2440
uggagauuggccagcaggg

SEQ ID NO: 1621248 - RNA, 23 nt, Pseudomonas putida KT2440
uggagaucgucguaggagcgggu

SEQ ID NO: 1621249 - RNA, 20 nt, Pseudomonas putida KT2440
uggagaucuugucgaccugg

SEQ ID NO: 1621250 - RNA, 22 nt, Pseudomonas putida KT2440
uggagcguuauaccggcccuga

SEQ ID NO: 1621251 - RNA, 17 nt, Pseudomonas putida KT2440
uggcgcgaacagggccu

SEQ ID NO: 1621252 - RNA, 19 nt, Pseudomonas putida KT2440
uggcgccauuggugcccuu

SEQ ID NO: 1621253 - RNA, 22 nt, Pseudomonas putida KT2440
uggcgcaaauugcccggccagc

SEQ ID NO: 1621254 - RNA, 21 nt, Pseudomonas putida KT2440
uggcgcagcagguccagcucc

SEQ ID NO: 1621255 - RNA, 16 nt, Pseudomonas putida KT2440
uggcgcaucuuccagc

SEQ ID NO: 1621256 - RNA, 21 nt, Pseudomonas putida KT2440
uggcgcaguucguccaggcuu

SEQ ID NO: 1621257 - RNA, 14 nt, Pseudomonas putida KT2440
uggcgcaaacccuc

SEQ ID NO: 1621258 - RNA, 15 nt, Pseudomonas putida KT2440
uggcgagcaggucau

SEQ ID NO: 1621259 - RNA, 19 nt, Pseudomonas putida KT2440
uggcgacacuugguccagg

SEQ ID NO: 1621260 - RNA, 18 nt, Pseudomonas putida KT2440
uggcgaagaccgccgccc

SEQ ID NO: 1621261 - RNA, 14 nt, Pseudomonas putida KT2440
uggcgacagcccau

SEQ ID NO: 1621262 - RNA, 20 nt, Pseudomonas putida KT2440
uggcgaucaggcaggccagc

SEQ ID NO: 1621263 - RNA, 13 nt, Pseudomonas putida KT2440
uggcgauccauuc

SEQ ID NO: 1621264 - RNA, 14 nt, Pseudomonas putida KT2440
uggcgaucccugua

SEQ ID NO: 1621265 - RNA, 17 nt, Pseudomonas putida KT2440
uggcgaucgaacaacug

SEQ ID NO: 1621266 - RNA, 13 nt, Pseudomonas putida KT2440
uggcgagcccggc

SEQ ID NO: 1621267 - RNA, 14 nt, Pseudomonas putida KT2440
uggcgagcccggcg

SEQ ID NO: 1621268 - RNA, 17 nt, Pseudomonas putida KT2440
uggccugcucacccgac

SEQ ID NO: 1621269 - RNA, 23 nt, Pseudomonas putida KT2440
uggccugcaagccggcgaacagc

SEQ ID NO: 1621270 - RNA, 24 nt, Pseudomonas putida KT2440
uggccugcagagacaucuccauag

SEQ ID NO: 1621271 - RNA, 22 nt, Pseudomonas putida KT2440
uggccucgucgcgguccuugcc

SEQ ID NO: 1621272 - RNA, 19 nt, Pseudomonas putida KT2440
uggccucuggcuuggcugc

SEQ ID NO: 1621273 - RNA, 20 nt, Pseudomonas putida KT2440
uggccucuggcuuggcugcg

SEQ ID NO: 1621274 - RNA, 17 nt, Pseudomonas putida KT2440
uggccucuucucgggca

SEQ ID NO: 1621275 - RNA, 20 nt, Pseudomonas putida KT2440
uggccugacgcuucaucgag

SEQ ID NO: 1621276 - RNA, 20 nt, Pseudomonas putida KT2440
uggccuguaccgaccucuuc

SEQ ID NO: 1621277 - RNA, 14 nt, Pseudomonas putida KT2440
uggccuguccaggc

SEQ ID NO: 1621278 - RNA, 19 nt, Pseudomonas putida KT2440
uggccuugaucaggcccug

SEQ ID NO: 1621279 - RNA, 12 nt, Pseudomonas putida KT2440
uggccuuccagc

SEQ ID NO: 1621280 - RNA, 14 nt, Pseudomonas putida KT2440
uggccuuccuugcc

SEQ ID NO: 1621281 - RNA, 22 nt, Pseudomonas putida KT2440
uggccuucucuuccgccagcca

SEQ ID NO: 1621282 - RNA, 17 nt, Pseudomonas putida KT2440
uggccuuucugcuucca

SEQ ID NO: 1621283 - RNA, 19 nt, Pseudomonas putida KT2440
uggccuuguugccacccag

SEQ ID NO: 1621284 - RNA, 16 nt, Pseudomonas putida KT2440
uggccuuggcgugcac

SEQ ID NO: 1621285 - RNA, 16 nt, Pseudomonas putida KT2440
uggccgggcucggccg

SEQ ID NO: 1621286 - RNA, 22 nt, Pseudomonas putida KT2440
uggccggggccgcuuggcggcc

SEQ ID NO: 1621287 - RNA, 16 nt, Pseudomonas putida KT2440
uggccggcgcgucuca

SEQ ID NO: 1621288 - RNA, 12 nt, Pseudomonas putida KT2440
uggccggcgcug

SEQ ID NO: 1621289 - RNA, 21 nt, Pseudomonas putida KT2440
uggccgguuucagucagccag

SEQ ID NO: 1621290 - RNA, 21 nt, Pseudomonas putida KT2440
uggccgcgcaggaagaaggca

SEQ ID NO: 1621291 - RNA, 15 nt, Pseudomonas putida KT2440
uggccgcuggcccuu

SEQ ID NO: 1621292 - RNA, 21 nt, Pseudomonas putida KT2440
uggccgcugaaccucaccgcc

SEQ ID NO: 1621293 - RNA, 14 nt, Pseudomonas putida KT2440
uggccggagcugga

SEQ ID NO: 1621294 - RNA, 15 nt, Pseudomonas putida KT2440
uggccaccagggugg

SEQ ID NO: 1621295 - RNA, 23 nt, Pseudomonas putida KT2440
uggccaccaggguggcgauccac

SEQ ID NO: 1621296 - RNA, 17 nt, Pseudomonas putida KT2440
uggccaccaugaacagc

SEQ ID NO: 1621297 - RNA, 23 nt, Pseudomonas putida KT2440
uggccaccagcaccugcagguac

SEQ ID NO: 1621298 - RNA, 15 nt, Pseudomonas putida KT2440
uggccacacugcuca

SEQ ID NO: 1621299 - RNA, 18 nt, Pseudomonas putida KT2440
uggccaagccaccgccac

SEQ ID NO: 1621300 - RNA, 18 nt, Pseudomonas putida KT2440
uggccacacgcugcugcu

SEQ ID NO: 1621301 - RNA, 16 nt, Pseudomonas putida KT2440
uggccacgcccaaccc

SEQ ID NO: 1621302 - RNA, 21 nt, Pseudomonas putida KT2440
uggccaccgaaguucagcacg

SEQ ID NO: 1621303 - RNA, 23 nt, Pseudomonas putida KT2440
uggccagaaacggcggcagauac

SEQ ID NO: 1621304 - RNA, 19 nt, Pseudomonas putida KT2440
uggccagacucagcugcug

SEQ ID NO: 1621305 - RNA, 22 nt, Pseudomonas putida KT2440
uggccagacucagcugcugcuc

SEQ ID NO: 1621306 - RNA, 13 nt, Pseudomonas putida KT2440
uggccacuguugc

SEQ ID NO: 1621307 - RNA, 20 nt, Pseudomonas putida KT2440
uggccacuucgcgagcgagc

SEQ ID NO: 1621308 - RNA, 22 nt, Pseudomonas putida KT2440
uggccaggguacuugugugccu

SEQ ID NO: 1621309 - RNA, 19 nt, Pseudomonas putida KT2440
uggccagugccaugaacac

SEQ ID NO: 1621310 - RNA, 20 nt, Pseudomonas putida KT2440
uggccaucagcuguucuucg

SEQ ID NO: 1621311 - RNA, 22 nt, Pseudomonas putida KT2440
uggccaucacuuccggcugcag

SEQ ID NO: 1621312 - RNA, 16 nt, Pseudomonas putida KT2440
uggccagccggcagca

SEQ ID NO: 1621313 - RNA, 16 nt, Pseudomonas putida KT2440
uggccagcucauccag

SEQ ID NO: 1621314 - RNA, 22 nt, Pseudomonas putida KT2440
uggccagcucauccagccgcgu

SEQ ID NO: 1621315 - RNA, 20 nt, Pseudomonas putida KT2440
uggcaugucgcuuugggggg

SEQ ID NO: 1621316 - RNA, 10 nt, Pseudomonas putida KT2440
uggcaugccc

SEQ ID NO: 1621317 - RNA, 11 nt, Pseudomonas putida KT2440
uggcaugcccc

SEQ ID NO: 1621318 - RNA, 15 nt, Pseudomonas putida KT2440
uggcauccaccaggu

SEQ ID NO: 1621319 - RNA, 15 nt, Pseudomonas putida KT2440
uggcaucaaugcaau

SEQ ID NO: 1621320 - RNA, 19 nt, Pseudomonas putida KT2440
uggccaacuccccacccag

SEQ ID NO: 1621321 - RNA, 17 nt, Pseudomonas putida KT2440
uggccaauaccgcugca

SEQ ID NO: 1621322 - RNA, 22 nt, Pseudomonas putida KT2440
uggccaagaaucucccgggcca

SEQ ID NO: 1621323 - RNA, 13 nt, Pseudomonas putida KT2440
uggccaaggccuc

SEQ ID NO: 1621324 - RNA, 16 nt, Pseudomonas putida KT2440
uggccaaggcggcgau

SEQ ID NO: 1621325 - RNA, 13 nt, Pseudomonas putida KT2440
uggccccgcccag

SEQ ID NO: 1621326 - RNA, 20 nt, Pseudomonas putida KT2440
uggcccgacaaagaagcgcc

SEQ ID NO: 1621327 - RNA, 13 nt, Pseudomonas putida KT2440
uggcccgccgcca

SEQ ID NO: 1621328 - RNA, 18 nt, Pseudomonas putida KT2440
uggcccggucccgcugcc

SEQ ID NO: 1621329 - RNA, 12 nt, Pseudomonas putida KT2440
uggccccaccca

SEQ ID NO: 1621330 - RNA, 20 nt, Pseudomonas putida KT2440
uggcccaguacgccacccag

SEQ ID NO: 1621331 - RNA, 17 nt, Pseudomonas putida KT2440
uggcccacgccuuccac

SEQ ID NO: 1621332 - RNA, 16 nt, Pseudomonas putida KT2440
uggccgcaauggcgcc

SEQ ID NO: 1621333 - RNA, 13 nt, Pseudomonas putida KT2440
uggccgcacccag

SEQ ID NO: 1621334 - RNA, 15 nt, Pseudomonas putida KT2440
uggccgcacccagca

SEQ ID NO: 1621335 - RNA, 14 nt, Pseudomonas putida KT2440
uggccgccaacagc

SEQ ID NO: 1621336 - RNA, 19 nt, Pseudomonas putida KT2440
uggccgccaacagcgcagg

SEQ ID NO: 1621337 - RNA, 13 nt, Pseudomonas putida KT2440
uggccgccaaggc

SEQ ID NO: 1621338 - RNA, 15 nt, Pseudomonas putida KT2440
uggccgccaaggcga

SEQ ID NO: 1621339 - RNA, 23 nt, Pseudomonas putida KT2440
uggccgcccgccucgacaaacug

SEQ ID NO: 1621340 - RNA, 17 nt, Pseudomonas putida KT2440
uggcccuguacauccag

SEQ ID NO: 1621341 - RNA, 21 nt, Pseudomonas putida KT2440
uggcccugugcuuugagcagg

SEQ ID NO: 1621342 - RNA, 23 nt, Pseudomonas putida KT2440
uggcccugugcuuugagcaggcg

SEQ ID NO: 1621343 - RNA, 12 nt, Pseudomonas putida KT2440
uggcccuggcca

SEQ ID NO: 1621344 - RNA, 21 nt, Pseudomonas putida KT2440
uggcccgucugcgugcaccca

SEQ ID NO: 1621345 - RNA, 17 nt, Pseudomonas putida KT2440
uggcccugaucugcccc

SEQ ID NO: 1621346 - RNA, 14 nt, Pseudomonas putida KT2440
uggccgacauggcg

SEQ ID NO: 1621347 - RNA, 17 nt, Pseudomonas putida KT2440
uggccgaaggccguggc

SEQ ID NO: 1621348 - RNA, 23 nt, Pseudomonas putida KT2440
uggccgaaggccguggcaaggcc

SEQ ID NO: 1621349 - RNA, 17 nt, Pseudomonas putida KT2440
uguacgggacaaggcau

SEQ ID NO: 1621350 - RNA, 13 nt, Pseudomonas putida KT2440
uguaccgccguca

SEQ ID NO: 1621351 - RNA, 22 nt, Pseudomonas putida KT2440
uguaccgccgucaacucgccaa

SEQ ID NO: 1621352 - RNA, 19 nt, Pseudomonas putida KT2440
uguacucaggggcauugcg

SEQ ID NO: 1621353 - RNA, 14 nt, Pseudomonas putida KT2440
uguacguugccaga

SEQ ID NO: 1621354 - RNA, 12 nt, Pseudomonas putida KT2440
uguaccagaacc

SEQ ID NO: 1621355 - RNA, 21 nt, Pseudomonas putida KT2440
uguacaacgcagccggcaccg

SEQ ID NO: 1621356 - RNA, 14 nt, Pseudomonas putida KT2440
ugguguuuugcaaa

SEQ ID NO: 1621357 - RNA, 20 nt, Pseudomonas putida KT2440
uguaaagaaaagccgcuggc

SEQ ID NO: 1621358 - RNA, 20 nt, Pseudomonas putida KT2440
uguaggcgcaacucagcgca

SEQ ID NO: 1621359 - RNA, 14 nt, Pseudomonas putida KT2440
uguaggagcggguu

SEQ ID NO: 1621360 - RNA, 21 nt, Pseudomonas putida KT2440
uguaggacaucuggucagucg

SEQ ID NO: 1621361 - RNA, 14 nt, Pseudomonas putida KT2440
uguaggcagcugcc

SEQ ID NO: 1621362 - RNA, 20 nt, Pseudomonas putida KT2440
uguagcucagguagaccugc

SEQ ID NO: 1621363 - RNA, 20 nt, Pseudomonas putida KT2440
uguagcggucgaacauguag

SEQ ID NO: 1621364 - RNA, 15 nt, Pseudomonas putida KT2440
uguagaccaccagcg

SEQ ID NO: 1621365 - RNA, 16 nt, Pseudomonas putida KT2440
uguaucccaggcgcuu

SEQ ID NO: 1621366 - RNA, 11 nt, Pseudomonas putida KT2440
ugucacauugg

SEQ ID NO: 1621367 - RNA, 19 nt, Pseudomonas putida KT2440
uggguugcucggcaccacc

SEQ ID NO: 1621368 - RNA, 14 nt, Pseudomonas putida KT2440
ugggugucuucugu

SEQ ID NO: 1621369 - RNA, 20 nt, Pseudomonas putida KT2440
ugguaccgucgaucagcuuc

SEQ ID NO: 1621370 - RNA, 19 nt, Pseudomonas putida KT2440
ugguacagcucacuggcca

SEQ ID NO: 1621371 - RNA, 17 nt, Pseudomonas putida KT2440
uggucagcgacugccaa

SEQ ID NO: 1621372 - RNA, 18 nt, Pseudomonas putida KT2440
uggucagcggaccaggug

SEQ ID NO: 1621373 - RNA, 16 nt, Pseudomonas putida KT2440
uggucacgcucggcca

SEQ ID NO: 1621374 - RNA, 15 nt, Pseudomonas putida KT2440
uggucacgccauccc

SEQ ID NO: 1621375 - RNA, 15 nt, Pseudomonas putida KT2440
ugguaugauuucagg

SEQ ID NO: 1621376 - RNA, 14 nt, Pseudomonas putida KT2440
ugguaguuccuguc

SEQ ID NO: 1621377 - RNA, 13 nt, Pseudomonas putida KT2440
uggugacugccag

SEQ ID NO: 1621378 - RNA, 14 nt, Pseudomonas putida KT2440
ugguggcccugacc

SEQ ID NO: 1621379 - RNA, 13 nt, Pseudomonas putida KT2440
ugguguccuuguc

SEQ ID NO: 1621380 - RNA, 13 nt, Pseudomonas putida KT2440
ugguguggcagcu

SEQ ID NO: 1621381 - RNA, 13 nt, Pseudomonas putida KT2440
uggucgaagccga

SEQ ID NO: 1621382 - RNA, 17 nt, Pseudomonas putida KT2440
uggucgaaccaguacug

SEQ ID NO: 1621383 - RNA, 21 nt, Pseudomonas putida KT2440
ugguccgggucugauugggcc

SEQ ID NO: 1621384 - RNA, 15 nt, Pseudomonas putida KT2440
ugguccgugagaaag

SEQ ID NO: 1621385 - RNA, 20 nt, Pseudomonas putida KT2440
ugguccuccccuucccgcca

SEQ ID NO: 1621386 - RNA, 14 nt, Pseudomonas putida KT2440
ugguccugaugagu

SEQ ID NO: 1621387 - RNA, 13 nt, Pseudomonas putida KT2440
uggucuagagauc

SEQ ID NO: 1621388 - RNA, 20 nt, Pseudomonas putida KT2440
uggucuccgggcgcccuggc

SEQ ID NO: 1621389 - RNA, 15 nt, Pseudomonas putida KT2440
uggugaaggccagga

SEQ ID NO: 1621390 - RNA, 22 nt, Pseudomonas putida KT2440
uggugaccucgaugcccuccag

SEQ ID NO: 1621391 - RNA, 19 nt, Pseudomonas putida KT2440
uggugaaucagccccagcc

SEQ ID NO: 1621392 - RNA, 13 nt, Pseudomonas putida KT2440
ugggcuccucaag

SEQ ID NO: 1621393 - RNA, 22 nt, Pseudomonas putida KT2440
ugggcugcgcggcagcccuucg

SEQ ID NO: 1621394 - RNA, 21 nt, Pseudomonas putida KT2440
ugggcuguuccagcagcgaca

SEQ ID NO: 1621395 - RNA, 18 nt, Pseudomonas putida KT2440
ugggcugcaaagcagccc

SEQ ID NO: 1621396 - RNA, 20 nt, Pseudomonas putida KT2440
ugggcugcaaagcagccccc

SEQ ID NO: 1621397 - RNA, 15 nt, Pseudomonas putida KT2440
uggggccaggcuuuc

SEQ ID NO: 1621398 - RNA, 18 nt, Pseudomonas putida KT2440
ugggcgaacgccugcagg

SEQ ID NO: 1621399 - RNA, 16 nt, Pseudomonas putida KT2440
ugggccgaucacgaag

SEQ ID NO: 1621400 - RNA, 18 nt, Pseudomonas putida KT2440
ugggccgugcaggcggcg

SEQ ID NO: 1621401 - RNA, 16 nt, Pseudomonas putida KT2440
ugggugaccaccagca

SEQ ID NO: 1621402 - RNA, 20 nt, Pseudomonas putida KT2440
ugggugaccaccagcaacau

SEQ ID NO: 1621403 - RNA, 14 nt, Pseudomonas putida KT2440
ugggugcacagguu

SEQ ID NO: 1621404 - RNA, 22 nt, Pseudomonas putida KT2440
ugggugcacagguuagggucga

SEQ ID NO: 1621405 - RNA, 13 nt, Pseudomonas putida KT2440
ugggucacccagg

SEQ ID NO: 1621406 - RNA, 14 nt, Pseudomonas putida KT2440
ugggucacccaggu

SEQ ID NO: 1621407 - RNA, 14 nt, Pseudomonas putida KT2440
ugggucaaccccag

SEQ ID NO: 1621408 - RNA, 13 nt, Pseudomonas putida KT2440
ugggucaggaugc

SEQ ID NO: 1621409 - RNA, 15 nt, Pseudomonas putida KT2440
ugggucacggcaucc

SEQ ID NO: 1621410 - RNA, 14 nt, Pseudomonas putida KT2440
uggguccaggcaca

SEQ ID NO: 1621411 - RNA, 22 nt, Pseudomonas putida KT2440
uggguaucguucuccagcuccu

SEQ ID NO: 1621412 - RNA, 18 nt, Pseudomonas putida KT2440
uggggcugcaccgcagcc

SEQ ID NO: 1621413 - RNA, 21 nt, Pseudomonas putida KT2440
uggggccugccgguacagccu

SEQ ID NO: 1621414 - RNA, 14 nt, Pseudomonas putida KT2440
ugggcaacagcugc

SEQ ID NO: 1621415 - RNA, 23 nt, Pseudomonas putida KT2440
ugggauuugugcauugccuguuc

SEQ ID NO: 1621416 - RNA, 22 nt, Pseudomonas putida KT2440
ugggcaaaaucgaccagggccu

SEQ ID NO: 1621417 - RNA, 15 nt, Pseudomonas putida KT2440
ugggcaagggccugc

SEQ ID NO: 1621418 - RNA, 20 nt, Pseudomonas putida KT2440
ugggcaagggccugcaggca

SEQ ID NO: 1621419 - RNA, 22 nt, Pseudomonas putida KT2440
ugggcaagggccugcaggcagc

SEQ ID NO: 1621420 - RNA, 23 nt, Pseudomonas putida KT2440
ugggcaagggccugcaggcagca

SEQ ID NO: 1621421 - RNA, 13 nt, Pseudomonas putida KT2440
ugggcaagugcgu

SEQ ID NO: 1621422 - RNA, 17 nt, Pseudomonas putida KT2440
ugggcaauguucgcugc

SEQ ID NO: 1621423 - RNA, 17 nt, Pseudomonas putida KT2440
ugggcauccagcuugcc

SEQ ID NO: 1621424 - RNA, 19 nt, Pseudomonas putida KT2440
ugggcaugagccuggccgg

SEQ ID NO: 1621425 - RNA, 17 nt, Pseudomonas putida KT2440
ugggcacuggccacccc

SEQ ID NO: 1621426 - RNA, 13 nt, Pseudomonas putida KT2440
uggcggagccagc

SEQ ID NO: 1621427 - RNA, 16 nt, Pseudomonas putida KT2440
uggcggcaggcgcagc

SEQ ID NO: 1621428 - RNA, 18 nt, Pseudomonas putida KT2440
uggcggcagcaacgguga

SEQ ID NO: 1621429 - RNA, 15 nt, Pseudomonas putida KT2440
uggcggcaacgguga

SEQ ID NO: 1621430 - RNA, 16 nt, Pseudomonas putida KT2440
uggcuuucccccagcc

SEQ ID NO: 1621431 - RNA, 13 nt, Pseudomonas putida KT2440
uggcggcccagcc

SEQ ID NO: 1621432 - RNA, 14 nt, Pseudomonas putida KT2440
uggcggcccagcca

SEQ ID NO: 1621433 - RNA, 22 nt, Pseudomonas putida KT2440
ugggaaaccuccggcaucaucc

SEQ ID NO: 1621434 - RNA, 15 nt, Pseudomonas putida KT2440
ucugcuucgcugcca

SEQ ID NO: 1621435 - RNA, 16 nt, Pseudomonas putida KT2440
ucugcuucgcugccag

SEQ ID NO: 1621436 - RNA, 18 nt, Pseudomonas putida KT2440
ucugcuucgcugccagga

SEQ ID NO: 1621437 - RNA, 20 nt, Pseudomonas putida KT2440
ucugcgcaaaggcuuuggcc

SEQ ID NO: 1621438 - RNA, 23 nt, Pseudomonas putida KT2440
ucugcgcaaaggcuuuggccgua

SEQ ID NO: 1621439 - RNA, 20 nt, Pseudomonas putida KT2440
ucugcgacugaauacagcca

SEQ ID NO: 1621440 - RNA, 15 nt, Pseudomonas putida KT2440
ucugcgacugcaggu

SEQ ID NO: 1621441 - RNA, 12 nt, Pseudomonas putida KT2440
ucuggcaacagc

SEQ ID NO: 1621442 - RNA, 15 nt, Pseudomonas putida KT2440
ucuggauaugcucca

SEQ ID NO: 1621443 - RNA, 16 nt, Pseudomonas putida KT2440
ucuggaucacugccag

SEQ ID NO: 1621444 - RNA, 20 nt, Pseudomonas putida KT2440
ucugcuugggcaauggcgua

SEQ ID NO: 1621445 - RNA, 21 nt, Pseudomonas putida KT2440
ucugcuugccugucaguuccu

SEQ ID NO: 1621446 - RNA, 14 nt, Pseudomonas putida KT2440
ucugcuugcccaga

SEQ ID NO: 1621447 - RNA, 16 nt, Pseudomonas putida KT2440
ucuggcccgaacagca

SEQ ID NO: 1621448 - RNA, 16 nt, Pseudomonas putida KT2440
ucuggcaccaguucca

SEQ ID NO: 1621449 - RNA, 16 nt, Pseudomonas putida KT2440
ucugggguuggaccca

SEQ ID NO: 1621450 - RNA, 22 nt, Pseudomonas putida KT2440
ucugggcaaaaucgaccagggc

SEQ ID NO: 1621451 - RNA, 20 nt, Pseudomonas putida KT2440
ucuggucuaaaacugccaau

SEQ ID NO: 1621452 - RNA, 13 nt, Pseudomonas putida KT2440
ucugugcccgcga

SEQ ID NO: 1621453 - RNA, 18 nt, Pseudomonas putida KT2440
ucuguugcugcagguucu

SEQ ID NO: 1621454 - RNA, 12 nt, Pseudomonas putida KT2440
ucugugggagcg

SEQ ID NO: 1621455 - RNA, 21 nt, Pseudomonas putida KT2440
ucugugggagcgggcuugccc

SEQ ID NO: 1621456 - RNA, 23 nt, Pseudomonas putida KT2440
ucuguuucugccccuggcccauc

SEQ ID NO: 1621457 - RNA, 15 nt, Pseudomonas putida KT2440
ucuguuucaccagca

SEQ ID NO: 1621458 - RNA, 18 nt, Pseudomonas putida KT2440
ucugcagguggugguccc

SEQ ID NO: 1621459 - RNA, 22 nt, Pseudomonas putida KT2440
ucugcagguggugguccccuuc

SEQ ID NO: 1621460 - RNA, 13 nt, Pseudomonas putida KT2440
ucugcauggcaua

SEQ ID NO: 1621461 - RNA, 14 nt, Pseudomonas putida KT2440
ucugcaugccagua

SEQ ID NO: 1621462 - RNA, 15 nt, Pseudomonas putida KT2440
ucugcauguccagcc

SEQ ID NO: 1621463 - RNA, 23 nt, Pseudomonas putida KT2440
ucugccaguccuuggccaaugcc

SEQ ID NO: 1621464 - RNA, 18 nt, Pseudomonas putida KT2440
ucugccaguucaugcagc

SEQ ID NO: 1621465 - RNA, 19 nt, Pseudomonas putida KT2440
ucugccaucuccaaugcgu

SEQ ID NO: 1621466 - RNA, 23 nt, Pseudomonas putida KT2440
ucugccgguagugaugcaucagc

SEQ ID NO: 1621467 - RNA, 17 nt, Pseudomonas putida KT2440
ucugccgggccaccacc

SEQ ID NO: 1621468 - RNA, 17 nt, Pseudomonas putida KT2440
ucugccguuguucggca

SEQ ID NO: 1621469 - RNA, 19 nt, Pseudomonas putida KT2440
ucugccguuguucggcaaa

SEQ ID NO: 1621470 - RNA, 14 nt, Pseudomonas putida KT2440
ucugccguuugcug

SEQ ID NO: 1621471 - RNA, 19 nt, Pseudomonas putida KT2440
ucugccguuugcuggccug

SEQ ID NO: 1621472 - RNA, 23 nt, Pseudomonas putida KT2440
ucugccguuugcuggccugcagc

SEQ ID NO: 1621473 - RNA, 13 nt, Pseudomonas putida KT2440
ucugccugcugca

SEQ ID NO: 1621474 - RNA, 23 nt, Pseudomonas putida KT2440
ucugccgccgcagcaaucugcug

SEQ ID NO: 1621475 - RNA, 17 nt, Pseudomonas putida KT2440
ucugccggcgccuccag

SEQ ID NO: 1621476 - RNA, 20 nt, Pseudomonas putida KT2440
ucugccggcgccuccagcaa

SEQ ID NO: 1621477 - RNA, 14 nt, Pseudomonas putida KT2440
ucugccggacaaga

SEQ ID NO: 1621478 - RNA, 19 nt, Pseudomonas putida KT2440
ucugaaaccagugaacccc

SEQ ID NO: 1621479 - RNA, 23 nt, Pseudomonas putida KT2440
ucugaaaccguuggucagcgacu

SEQ ID NO: 1621480 - RNA, 19 nt, Pseudomonas putida KT2440
ucugaaagaacuuggucca

SEQ ID NO: 1621481 - RNA, 22 nt, Pseudomonas putida KT2440
ucugaaaggcguaggcacaccc

SEQ ID NO: 1621482 - RNA, 23 nt, Pseudomonas putida KT2440
ucugaaaggcguaggcacacccg

SEQ ID NO: 1621483 - RNA, 18 nt, Pseudomonas putida KT2440
ucucgcgcuuggccaggg

SEQ ID NO: 1621484 - RNA, 17 nt, Pseudomonas putida KT2440
ucucgccucagcgccaa

SEQ ID NO: 1621485 - RNA, 14 nt, Pseudomonas putida KT2440
ucucgcccuugucc

SEQ ID NO: 1621486 - RNA, 22 nt, Pseudomonas putida KT2440
ucucgcccacgaucucacgcgc

SEQ ID NO: 1621487 - RNA, 23 nt, Pseudomonas putida KT2440
ucucgccagccugcagcgcggcg

SEQ ID NO: 1621488 - RNA, 14 nt, Pseudomonas putida KT2440
ucucgaacgcugug

SEQ ID NO: 1621489 - RNA, 21 nt, Pseudomonas putida KT2440
ucugaccggcacugcacagcu

SEQ ID NO: 1621490 - RNA, 22 nt, Pseudomonas putida KT2440
ucugacauaacaagaacaacac

SEQ ID NO: 1621491 - RNA, 18 nt, Pseudomonas putida KT2440
ucuucuggggugauuuuu

SEQ ID NO: 1621492 - RNA, 16 nt, Pseudomonas putida KT2440
ucuucucggcagaccc

SEQ ID NO: 1621493 - RNA, 12 nt, Pseudomonas putida KT2440
ucuucucuucca

SEQ ID NO: 1621494 - RNA, 19 nt, Pseudomonas putida KT2440
ucuucuuucgacaugcagu

SEQ ID NO: 1621495 - RNA, 13 nt, Pseudomonas putida KT2440
ucuucuuucaggu

SEQ ID NO: 1621496 - RNA, 20 nt, Pseudomonas putida KT2440
ucuugaagcguucagucagu

SEQ ID NO: 1621497 - RNA, 18 nt, Pseudomonas putida KT2440
ucuugacgggugaccagg

SEQ ID NO: 1621498 - RNA, 23 nt, Pseudomonas putida KT2440
ucuugcgcacgcgcuuuuccagc

SEQ ID NO: 1621499 - RNA, 20 nt, Pseudomonas putida KT2440
ucuugcgccccagcagcgcu

SEQ ID NO: 1621500 - RNA, 19 nt, Pseudomonas putida KT2440
ucuuguagcugaccuugga

SEQ ID NO: 1621501 - RNA, 21 nt, Pseudomonas putida KT2440
ucuugucgacagugaauuccu

SEQ ID NO: 1621502 - RNA, 14 nt, Pseudomonas putida KT2440
ucuugccuuccacc

SEQ ID NO: 1621503 - RNA, 16 nt, Pseudomonas putida KT2440
ucuugccuucggccac

SEQ ID NO: 1621504 - RNA, 21 nt, Pseudomonas putida KT2440
ucuugcaccugucccagcugg

SEQ ID NO: 1621505 - RNA, 22 nt, Pseudomonas putida KT2440
ucuucgguagacuucugcgugc

SEQ ID NO: 1621506 - RNA, 16 nt, Pseudomonas putida KT2440
ucuucgugcgccucau

SEQ ID NO: 1621507 - RNA, 22 nt, Pseudomonas putida KT2440
ucuucgugcgccucaugcagca

SEQ ID NO: 1621508 - RNA, 23 nt, Pseudomonas putida KT2440
ucuucgcgcucgaacaacgccuc

SEQ ID NO: 1621509 - RNA, 14 nt, Pseudomonas putida KT2440
ucuucgcgggcaug

SEQ ID NO: 1621510 - RNA, 18 nt, Pseudomonas putida KT2440
ucuucgcgggcaugcccg

SEQ ID NO: 1621511 - RNA, 12 nt, Pseudomonas putida KT2440
ucuuccugguuu

SEQ ID NO: 1621512 - RNA, 20 nt, Pseudomonas putida KT2440
ucuucgaauaccaguaaugc

SEQ ID NO: 1621513 - RNA, 21 nt, Pseudomonas putida KT2440
ucuucgaggaugcggcugacc

SEQ ID NO: 1621514 - RNA, 13 nt, Pseudomonas putida KT2440
ucuucgaggucau

SEQ ID NO: 1621515 - RNA, 23 nt, Pseudomonas putida KT2440
ucuucgauguacggcagaacggc

SEQ ID NO: 1621516 - RNA, 16 nt, Pseudomonas putida KT2440
ucuucgaucucggcca

SEQ ID NO: 1621517 - RNA, 18 nt, Pseudomonas putida KT2440
ucuucgaucuggaucacu

SEQ ID NO: 1621518 - RNA, 22 nt, Pseudomonas putida KT2440
ucuuaauucauaaggaucauga

SEQ ID NO: 1621519 - RNA, 16 nt, Pseudomonas putida KT2440
ucuuccggcagguaag

SEQ ID NO: 1621520 - RNA, 19 nt, Pseudomonas putida KT2440
ucuuccggcaggucggcaa

SEQ ID NO: 1621521 - RNA, 19 nt, Pseudomonas putida KT2440
ucuuccgccagccaacgcu

SEQ ID NO: 1621522 - RNA, 18 nt, Pseudomonas putida KT2440
ucuuccggcaugaacaca

SEQ ID NO: 1621523 - RNA, 17 nt, Pseudomonas putida KT2440
ucuuccucgacccagcc

SEQ ID NO: 1621524 - RNA, 20 nt, Pseudomonas putida KT2440
ucuuccucgacccagccacc

SEQ ID NO: 1621525 - RNA, 19 nt, Pseudomonas putida KT2440
ucuuccuggcuggcagccg

SEQ ID NO: 1621526 - RNA, 21 nt, Pseudomonas putida KT2440
ucuuccuggcuggcagccggc

SEQ ID NO: 1621527 - RNA, 22 nt, Pseudomonas putida KT2440
ucguccuggaaaagcaaggcuc

SEQ ID NO: 1621528 - RNA, 23 nt, Pseudomonas putida KT2440
ucgugggucaugucggcagccag

SEQ ID NO: 1621529 - RNA, 22 nt, Pseudomonas putida KT2440
ucguggucgccgucgcacaggc

SEQ ID NO: 1621530 - RNA, 13 nt, Pseudomonas putida KT2440
ucgugcucgucuu

SEQ ID NO: 1621531 - RNA, 14 nt, Pseudomonas putida KT2440
ucgugcgccucaug

SEQ ID NO: 1621532 - RNA, 22 nt, Pseudomonas putida KT2440
ucgugcucacgccccuuggcac

SEQ ID NO: 1621533 - RNA, 18 nt, Pseudomonas putida KT2440
ucgucaagcucuuccuug

SEQ ID NO: 1621534 - RNA, 18 nt, Pseudomonas putida KT2440
ucgucaaggaagcuccag

SEQ ID NO: 1621535 - RNA, 22 nt, Pseudomonas putida KT2440
ucgucacauccugcucgucguc

SEQ ID NO: 1621536 - RNA, 17 nt, Pseudomonas putida KT2440
ucgucaccgccccagcg

SEQ ID NO: 1621537 - RNA, 21 nt, Pseudomonas putida KT2440
ucgucaccgccccagcgcgcc

SEQ ID NO: 1621538 - RNA, 22 nt, Pseudomonas putida KT2440
ucgucacugacccucaagugcc

SEQ ID NO: 1621539 - RNA, 15 nt, Pseudomonas putida KT2440
ucguaguaauggccg

SEQ ID NO: 1621540 - RNA, 18 nt, Pseudomonas putida KT2440
ucggcaugcacggcagca

SEQ ID NO: 1621541 - RNA, 16 nt, Pseudomonas putida KT2440
ucggcaugcacuucca

SEQ ID NO: 1621542 - RNA, 20 nt, Pseudomonas putida KT2440
ucggcaggcgguccagcaag

SEQ ID NO: 1621543 - RNA, 10 nt, Pseudomonas putida KT2440
ucggcagcuc

SEQ ID NO: 1621544 - RNA, 18 nt, Pseudomonas putida KT2440
ucggcagcgaucagcgca

SEQ ID NO: 1621545 - RNA, 17 nt, Pseudomonas putida KT2440
ucguugcgagcgaacag

SEQ ID NO: 1621546 - RNA, 17 nt, Pseudomonas putida KT2440
ucguugcgggucagcuc

SEQ ID NO: 1621547 - RNA, 19 nt, Pseudomonas putida KT2440
ucguugcgcgccagggcaa

SEQ ID NO: 1621548 - RNA, 17 nt, Pseudomonas putida KT2440
ucuaccacuggggcuuc

SEQ ID NO: 1621549 - RNA, 20 nt, Pseudomonas putida KT2440
ucuaccguuggcaucugcug

SEQ ID NO: 1621550 - RNA, 19 nt, Pseudomonas putida KT2440
ucuaccggcauaccaucuu

SEQ ID NO: 1621551 - RNA, 18 nt, Pseudomonas putida KT2440
ucuaccucacugacagca

SEQ ID NO: 1621552 - RNA, 18 nt, Pseudomonas putida KT2440
ucuaccugagccugcagg

SEQ ID NO: 1621553 - RNA, 15 nt, Pseudomonas putida KT2440
ucuacgcccauggcc

SEQ ID NO: 1621554 - RNA, 16 nt, Pseudomonas putida KT2440
ucuaguacuuuuucag

SEQ ID NO: 1621555 - RNA, 21 nt, Pseudomonas putida KT2440
ucuaucaccuguucccccacc

SEQ ID NO: 1621556 - RNA, 15 nt, Pseudomonas putida KT2440
ucuaucuucaggcau

SEQ ID NO: 1621557 - RNA, 18 nt, Pseudomonas putida KT2440
ucuauggccggaggcaaa

SEQ ID NO: 1621558 - RNA, 17 nt, Pseudomonas putida KT2440
ucucaacguucaucccc

SEQ ID NO: 1621559 - RNA, 15 nt, Pseudomonas putida KT2440
ucuauucgacccgcg

SEQ ID NO: 1621560 - RNA, 17 nt, Pseudomonas putida KT2440
ucucacgcgccacauag

SEQ ID NO: 1621561 - RNA, 19 nt, Pseudomonas putida KT2440
ucucacgcgccacauagcu

SEQ ID NO: 1621562 - RNA, 12 nt, Pseudomonas putida KT2440
ucuccccagucc

SEQ ID NO: 1621563 - RNA, 17 nt, Pseudomonas putida KT2440
ucuccaagccgcuucac

SEQ ID NO: 1621564 - RNA, 14 nt, Pseudomonas putida KT2440
ucuccaugcugcug

SEQ ID NO: 1621565 - RNA, 16 nt, Pseudomonas putida KT2440
ucuccaugcugcugcc

SEQ ID NO: 1621566 - RNA, 22 nt, Pseudomonas putida KT2440
ucucagcuggaacgcuuggcca

SEQ ID NO: 1621567 - RNA, 14 nt, Pseudomonas putida KT2440
ucucaggcccacca

SEQ ID NO: 1621568 - RNA, 22 nt, Pseudomonas putida KT2440
ucucauaggguguugcccucac

SEQ ID NO: 1621569 - RNA, 20 nt, Pseudomonas putida KT2440
ucuccaacgucaaccgugcc

SEQ ID NO: 1621570 - RNA, 21 nt, Pseudomonas putida KT2440
ucuccaacuggcgaauacgcu

SEQ ID NO: 1621571 - RNA, 15 nt, Pseudomonas putida KT2440
uccgcguccccuuca

SEQ ID NO: 1621572 - RNA, 23 nt, Pseudomonas putida KT2440
uccgcuugacgaucgccagcccc

SEQ ID NO: 1621573 - RNA, 17 nt, Pseudomonas putida KT2440
uccggaauuucugcacc

SEQ ID NO: 1621574 - RNA, 16 nt, Pseudomonas putida KT2440
uccgcgcaagcgguug

SEQ ID NO: 1621575 - RNA, 23 nt, Pseudomonas putida KT2440
uccgcgauuuuuuuguccacgcu

SEQ ID NO: 1621576 - RNA, 20 nt, Pseudomonas putida KT2440
uccgccucauccucgcccac

SEQ ID NO: 1621577 - RNA, 21 nt, Pseudomonas putida KT2440
uccgccuggccgcugcgcccg

SEQ ID NO: 1621578 - RNA, 18 nt, Pseudomonas putida KT2440
uccgccccaaaccaggcc

SEQ ID NO: 1621579 - RNA, 19 nt, Pseudomonas putida KT2440
uccgccccauagccugcug

SEQ ID NO: 1621580 - RNA, 12 nt, Pseudomonas putida KT2440
uccgccgucacc

SEQ ID NO: 1621581 - RNA, 19 nt, Pseudomonas putida KT2440
uccgcaccgggcaaaaaag

SEQ ID NO: 1621582 - RNA, 19 nt, Pseudomonas putida KT2440
uccgcaccccaaggcugcc

SEQ ID NO: 1621583 - RNA, 23 nt, Pseudomonas putida KT2440
uccgcauaucauagaucucgaca

SEQ ID NO: 1621584 - RNA, 15 nt, Pseudomonas putida KT2440
uccgccaaaccccag

SEQ ID NO: 1621585 - RNA, 14 nt, Pseudomonas putida KT2440
uccgcaugcuuggc

SEQ ID NO: 1621586 - RNA, 22 nt, Pseudomonas putida KT2440
uccgccaauugcgccagccgcu

SEQ ID NO: 1621587 - RNA, 18 nt, Pseudomonas putida KT2440
uccgccacaacccuugca

SEQ ID NO: 1621588 - RNA, 24 nt, Pseudomonas putida KT2440
uccgccaccaaccggccaguggcc

SEQ ID NO: 1621589 - RNA, 11 nt, Pseudomonas putida KT2440
uccgguccagu

SEQ ID NO: 1621590 - RNA, 23 nt, Pseudomonas putida KT2440
uccgguauauaucucgggcuucc

SEQ ID NO: 1621591 - RNA, 17 nt, Pseudomonas putida KT2440
uccgguggcaucaccgg

SEQ ID NO: 1621592 - RNA, 15 nt, Pseudomonas putida KT2440
uccguaccaguuccu

SEQ ID NO: 1621593 - RNA, 19 nt, Pseudomonas putida KT2440
uccggggccgcaaggcggc

SEQ ID NO: 1621594 - RNA, 11 nt, Pseudomonas putida KT2440
uccgggcugcu

SEQ ID NO: 1621595 - RNA, 22 nt, Pseudomonas putida KT2440
uccgggcgguacuggaagagca

SEQ ID NO: 1621596 - RNA, 19 nt, Pseudomonas putida KT2440
uccggguuaccgcacagca

SEQ ID NO: 1621597 - RNA, 16 nt, Pseudomonas putida KT2440
uccgguaacuggccca

SEQ ID NO: 1621598 - RNA, 13 nt, Pseudomonas putida KT2440
uccgggcaaugca

SEQ ID NO: 1621599 - RNA, 18 nt, Pseudomonas putida KT2440
uccgggcaaugcaggcag

SEQ ID NO: 1621600 - RNA, 22 nt, Pseudomonas putida KT2440
uccggccgacucuucaccagcu

SEQ ID NO: 1621601 - RNA, 13 nt, Pseudomonas putida KT2440
uccggcccggcau

SEQ ID NO: 1621602 - RNA, 13 nt, Pseudomonas putida KT2440
uccggccagcaac

SEQ ID NO: 1621603 - RNA, 18 nt, Pseudomonas putida KT2440
uccggccccggugcaucc

SEQ ID NO: 1621604 - RNA, 15 nt, Pseudomonas putida KT2440
uccggcgcggccugc

SEQ ID NO: 1621605 - RNA, 13 nt, Pseudomonas putida KT2440
uccggcgcggccu

SEQ ID NO: 1621606 - RNA, 20 nt, Pseudomonas putida KT2440
uccggagcuccccucagaca

SEQ ID NO: 1621607 - RNA, 23 nt, Pseudomonas putida KT2440
uccggcaaccccgccaaccccuc

SEQ ID NO: 1621608 - RNA, 15 nt, Pseudomonas putida KT2440
uccggcaacuggcac

SEQ ID NO: 1621609 - RNA, 22 nt, Pseudomonas putida KT2440
uccggcaccccuuucuccagca

SEQ ID NO: 1621610 - RNA, 14 nt, Pseudomonas putida KT2440
uccggcagcucacc

SEQ ID NO: 1621611 - RNA, 17 nt, Pseudomonas putida KT2440
uccguggguugaucucu

SEQ ID NO: 1621612 - RNA, 22 nt, Pseudomonas putida KT2440
uccguuggccaccaccagcaac

SEQ ID NO: 1621613 - RNA, 21 nt, Pseudomonas putida KT2440
uccguguccguccgcaaaucc

SEQ ID NO: 1621614 - RNA, 21 nt, Pseudomonas putida KT2440
uccuacgcgccagucagaagc

SEQ ID NO: 1621615 - RNA, 16 nt, Pseudomonas putida KT2440
uccuacgcucuauccc

SEQ ID NO: 1621616 - RNA, 14 nt, Pseudomonas putida KT2440
uccuacgggcaacc

SEQ ID NO: 1621617 - RNA, 21 nt, Pseudomonas putida KT2440
uccuacggggguucacagccg

SEQ ID NO: 1621618 - RNA, 19 nt, Pseudomonas putida KT2440
uccuacgacggucugcgua

SEQ ID NO: 1621619 - RNA, 18 nt, Pseudomonas putida KT2440
uccuacacgacccaccau

SEQ ID NO: 1621620 - RNA, 13 nt, Pseudomonas putida KT2440
uccuacacgaccc

SEQ ID NO: 1621621 - RNA, 22 nt, Pseudomonas putida KT2440
uccuacaggauggccgcaggcc

SEQ ID NO: 1621622 - RNA, 14 nt, Pseudomonas putida KT2440
uccuacaagguacc

SEQ ID NO: 1621623 - RNA, 11 nt, Pseudomonas putida KT2440
uccuccccuuc

SEQ ID NO: 1621624 - RNA, 17 nt, Pseudomonas putida KT2440
uccuccccuucccgcca

SEQ ID NO: 1621625 - RNA, 18 nt, Pseudomonas putida KT2440
uccuccccuucccgccau

SEQ ID NO: 1621626 - RNA, 14 nt, Pseudomonas putida KT2440
uccuccgcccugcc

SEQ ID NO: 1621627 - RNA, 16 nt, Pseudomonas putida KT2440
uccuccgcccugcccu

SEQ ID NO: 1621628 - RNA, 11 nt, Pseudomonas putida KT2440
uccuccagcuc

SEQ ID NO: 1621629 - RNA, 22 nt, Pseudomonas putida KT2440
uccucagggguaaugccccagc

SEQ ID NO: 1621630 - RNA, 19 nt, Pseudomonas putida KT2440
uccucaugggugucggcau

SEQ ID NO: 1621631 - RNA, 22 nt, Pseudomonas putida KT2440
uccucaagggguacgaacgcca

SEQ ID NO: 1621632 - RNA, 21 nt, Pseudomonas putida KT2440
uccucaaaggcagccucguaa

SEQ ID NO: 1621633 - RNA, 16 nt, Pseudomonas putida KT2440
uccucaccgcaggcau

SEQ ID NO: 1621634 - RNA, 17 nt, Pseudomonas putida KT2440
uccucaccggcaaagcu

SEQ ID NO: 1621635 - RNA, 14 nt, Pseudomonas putida KT2440
uccucggccaggcc

SEQ ID NO: 1621636 - RNA, 18 nt, Pseudomonas putida KT2440
uccucggcagaaauguuu

SEQ ID NO: 1621637 - RNA, 15 nt, Pseudomonas putida KT2440
uccucgacccaguca

SEQ ID NO: 1621638 - RNA, 20 nt, Pseudomonas putida KT2440
uccucgacgccauauacgca

SEQ ID NO: 1621639 - RNA, 14 nt, Pseudomonas putida KT2440
uccucgaacucaug

SEQ ID NO: 1621640 - RNA, 21 nt, Pseudomonas putida KT2440
uccucgaaacgcaggcucugc

SEQ ID NO: 1621641 - RNA, 21 nt, Pseudomonas putida KT2440
uccugaacgaugcccgggccu

SEQ ID NO: 1621642 - RNA, 22 nt, Pseudomonas putida KT2440
uccugaaccaccaguggguuau

SEQ ID NO: 1621643 - RNA, 14 nt, Pseudomonas putida KT2440
uccucuucgaagac

SEQ ID NO: 1621644 - RNA, 21 nt, Pseudomonas putida KT2440
uccucuucgaagacgccgcca

SEQ ID NO: 1621645 - RNA, 18 nt, Pseudomonas putida KT2440
uccucugugggagcggcc

SEQ ID NO: 1621646 - RNA, 16 nt, Pseudomonas putida KT2440
uccucucccaccagca

SEQ ID NO: 1621647 - RNA, 15 nt, Pseudomonas putida KT2440
uccuggcgcuccucc

SEQ ID NO: 1621648 - RNA, 15 nt, Pseudomonas putida KT2440
uccugggcuggccuu

SEQ ID NO: 1621649 - RNA, 19 nt, Pseudomonas putida KT2440
uccugggugaccaccagca

SEQ ID NO: 1621650 - RNA, 17 nt, Pseudomonas putida KT2440
uccuggucaucgaagcc

SEQ ID NO: 1621651 - RNA, 18 nt, Pseudomonas putida KT2440
uccugguccgaggucagc

SEQ ID NO: 1621652 - RNA, 18 nt, Pseudomonas putida KT2440
uccuggucgcgggccagc

SEQ ID NO: 1621653 - RNA, 22 nt, Pseudomonas putida KT2440
uccuggugaucaacaaaccgac

SEQ ID NO: 1621654 - RNA, 16 nt, Pseudomonas putida KT2440
uccugguuauccaggu

SEQ ID NO: 1621655 - RNA, 15 nt, Pseudomonas putida KT2440
uccugguuggccagu

SEQ ID NO: 1621656 - RNA, 19 nt, Pseudomonas putida KT2440
uccugcaaggcaaugccca

SEQ ID NO: 1621657 - RNA, 18 nt, Pseudomonas putida KT2440
ucgaugucgguggcaacc

SEQ ID NO: 1621658 - RNA, 16 nt, Pseudomonas putida KT2440
ucgauguucagcaccu

SEQ ID NO: 1621659 - RNA, 13 nt, Pseudomonas putida KT2440
ucgauuagcucca

SEQ ID NO: 1621660 - RNA, 19 nt, Pseudomonas putida KT2440
ucgauuagcuccaccagcg

SEQ ID NO: 1621661 - RNA, 17 nt, Pseudomonas putida KT2440
ucgauggccaggaacag

SEQ ID NO: 1621662 - RNA, 15 nt, Pseudomonas putida KT2440
ucgaugcgcacggca

SEQ ID NO: 1621663 - RNA, 16 nt, Pseudomonas putida KT2440
ucgaugauggcugcca

SEQ ID NO: 1621664 - RNA, 22 nt, Pseudomonas putida KT2440
ucgaugcacguaccuggcugca

SEQ ID NO: 1621665 - RNA, 16 nt, Pseudomonas putida KT2440
ucgaucccgaggucag

SEQ ID NO: 1621666 - RNA, 19 nt, Pseudomonas putida KT2440
ucgaucaucgccaccggca

SEQ ID NO: 1621667 - RNA, 13 nt, Pseudomonas putida KT2440
ucgaucaggcucu

SEQ ID NO: 1621668 - RNA, 22 nt, Pseudomonas putida KT2440
ucgaucagcgccugcucaucca

SEQ ID NO: 1621669 - RNA, 17 nt, Pseudomonas putida KT2440
ucgaucagauaagucau

SEQ ID NO: 1621670 - RNA, 14 nt, Pseudomonas putida KT2440
ucgauagccagccc

SEQ ID NO: 1621671 - RNA, 20 nt, Pseudomonas putida KT2440
ucgauacucacccgcuugcc

SEQ ID NO: 1621672 - RNA, 12 nt, Pseudomonas putida KT2440
ucgagcgcaccu

SEQ ID NO: 1621673 - RNA, 14 nt, Pseudomonas putida KT2440
ucgagcgcaccugg

SEQ ID NO: 1621674 - RNA, 14 nt, Pseudomonas putida KT2440
ucgauacccaggcg

SEQ ID NO: 1621675 - RNA, 18 nt, Pseudomonas putida KT2440
ucgauacaccacuggugc

SEQ ID NO: 1621676 - RNA, 17 nt, Pseudomonas putida KT2440
ucgagcuacagccccuu

SEQ ID NO: 1621677 - RNA, 14 nt, Pseudomonas putida KT2440
ucgccagccccagc

SEQ ID NO: 1621678 - RNA, 14 nt, Pseudomonas putida KT2440
ucgccagcaggccg

SEQ ID NO: 1621679 - RNA, 20 nt, Pseudomonas putida KT2440
ucgccagcaggccgccgacg

SEQ ID NO: 1621680 - RNA, 14 nt, Pseudomonas putida KT2440
ucgccagcaccauc

SEQ ID NO: 1621681 - RNA, 23 nt, Pseudomonas putida KT2440
ucgccacgguacgggcaaagccc

SEQ ID NO: 1621682 - RNA, 22 nt, Pseudomonas putida KT2440
ucgccacaccacagcugcacau

SEQ ID NO: 1621683 - RNA, 21 nt, Pseudomonas putida KT2440
ucgcagacuucgaagugccac

SEQ ID NO: 1621684 - RNA, 12 nt, Pseudomonas putida KT2440
ucgcagcacaag

SEQ ID NO: 1621685 - RNA, 21 nt, Pseudomonas putida KT2440
ucgcagcacaagacugcugug

SEQ ID NO: 1621686 - RNA, 14 nt, Pseudomonas putida KT2440
ucgcaggcacgccc

SEQ ID NO: 1621687 - RNA, 14 nt, Pseudomonas putida KT2440
ucgaagcagcagcu

SEQ ID NO: 1621688 - RNA, 16 nt, Pseudomonas putida KT2440
ucgaagcgacagcggc

SEQ ID NO: 1621689 - RNA, 19 nt, Pseudomonas putida KT2440
ucgaagcgcucaugcaaca

SEQ ID NO: 1621690 - RNA, 21 nt, Pseudomonas putida KT2440
ucgaaggccuucagguugcuc

SEQ ID NO: 1621691 - RNA, 22 nt, Pseudomonas putida KT2440
ucgaauucagcccgcucauguc

SEQ ID NO: 1621692 - RNA, 21 nt, Pseudomonas putida KT2440
ucgacaugcaguugagcccuc

SEQ ID NO: 1621693 - RNA, 15 nt, Pseudomonas putida KT2440
ucgacaaaucccgca

SEQ ID NO: 1621694 - RNA, 13 nt, Pseudomonas putida KT2440
ucgaccagcagcu

SEQ ID NO: 1621695 - RNA, 22 nt, Pseudomonas putida KT2440
ucgaccagaagggcgcaaaagu

SEQ ID NO: 1621696 - RNA, 22 nt, Pseudomonas putida KT2440
ucgaccacgcacagcugugugu

SEQ ID NO: 1621697 - RNA, 18 nt, Pseudomonas putida KT2440
ucgaccaccgccaaggca

SEQ ID NO: 1621698 - RNA, 20 nt, Pseudomonas putida KT2440
ucgaccaccgccaaggcacg

SEQ ID NO: 1621699 - RNA, 13 nt, Pseudomonas putida KT2440
ucgaccaaaaauc

SEQ ID NO: 1621700 - RNA, 12 nt, Pseudomonas putida KT2440
ucgaccugcccg

SEQ ID NO: 1621701 - RNA, 20 nt, Pseudomonas putida KT2440
ucgaccagggccuuggccug

SEQ ID NO: 1621702 - RNA, 18 nt, Pseudomonas putida KT2440
ucgacccagccacccggc

SEQ ID NO: 1621703 - RNA, 11 nt, Pseudomonas putida KT2440
ucgacccaguc

SEQ ID NO: 1621704 - RNA, 13 nt, Pseudomonas putida KT2440
ucgacuucccgca

SEQ ID NO: 1621705 - RNA, 15 nt, Pseudomonas putida KT2440
ucgacucccgcugcc

SEQ ID NO: 1621706 - RNA, 23 nt, Pseudomonas putida KT2440
ucgacguacagcagcucacugaa

SEQ ID NO: 1621707 - RNA, 19 nt, Pseudomonas putida KT2440
ucgacgaugaggcgaugca

SEQ ID NO: 1621708 - RNA, 21 nt, Pseudomonas putida KT2440
ucgacgaugaggcgaugcagg

SEQ ID NO: 1621709 - RNA, 18 nt, Pseudomonas putida KT2440
ucgaccuggcucuucaac

SEQ ID NO: 1621710 - RNA, 16 nt, Pseudomonas putida KT2440
ucgaccugggccaggu

SEQ ID NO: 1621711 - RNA, 21 nt, Pseudomonas putida KT2440
ucgagaccuugccuuccggcc

SEQ ID NO: 1621712 - RNA, 20 nt, Pseudomonas putida KT2440
ucgagauguaguccaccccc

SEQ ID NO: 1621713 - RNA, 15 nt, Pseudomonas putida KT2440
ucgagccggucacga

SEQ ID NO: 1621714 - RNA, 23 nt, Pseudomonas putida KT2440
ucgagccgaucaggaagccccgc

SEQ ID NO: 1621715 - RNA, 22 nt, Pseudomonas putida KT2440
ucgcggccaagccgcugccaca

SEQ ID NO: 1621716 - RNA, 14 nt, Pseudomonas putida KT2440
ucgcggcgcuggcc

SEQ ID NO: 1621717 - RNA, 23 nt, Pseudomonas putida KT2440
ucgcggguaaacccauuccuaca

SEQ ID NO: 1621718 - RNA, 23 nt, Pseudomonas putida KT2440
ucgcggguaaacccgggucaggc

SEQ ID NO: 1621719 - RNA, 13 nt, Pseudomonas putida KT2440
ucgcgggcucgcc

SEQ ID NO: 1621720 - RNA, 20 nt, Pseudomonas putida KT2440
ucgcggcuacgcucguccag

SEQ ID NO: 1621721 - RNA, 22 nt, Pseudomonas putida KT2440
ucgcggcuggugucggccaggg

SEQ ID NO: 1621722 - RNA, 15 nt, Pseudomonas putida KT2440
ucgcgggccagccca

SEQ ID NO: 1621723 - RNA, 20 nt, Pseudomonas putida KT2440
ucgcgcccgcagugcacgcg

SEQ ID NO: 1621724 - RNA, 15 nt, Pseudomonas putida KT2440
ucgcgauugaucagc

SEQ ID NO: 1621725 - RNA, 24 nt, Pseudomonas putida KT2440
ucgcgcaacaccgccagcgggcug

SEQ ID NO: 1621726 - RNA, 16 nt, Pseudomonas putida KT2440
ucgccucccccuccac

SEQ ID NO: 1621727 - RNA, 15 nt, Pseudomonas putida KT2440
ucgccucgugcagcu

SEQ ID NO: 1621728 - RNA, 22 nt, Pseudomonas putida KT2440
ucgcgaaacgcggcaaccugca

SEQ ID NO: 1621729 - RNA, 13 nt, Pseudomonas putida KT2440
ucgcgaaagggcc

SEQ ID NO: 1621730 - RNA, 23 nt, Pseudomonas putida KT2440
ucgcgaaagggccgcaaagcggc

SEQ ID NO: 1621731 - RNA, 18 nt, Pseudomonas putida KT2440
ucgccuuucuuaugccug

SEQ ID NO: 1621732 - RNA, 15 nt, Pseudomonas putida KT2440
ucgcgagccucuguu

SEQ ID NO: 1621733 - RNA, 16 nt, Pseudomonas putida KT2440
ucgcgagucaggcugc

SEQ ID NO: 1621734 - RNA, 21 nt, Pseudomonas putida KT2440
ucgccgcccuuggugcaccag

SEQ ID NO: 1621735 - RNA, 18 nt, Pseudomonas putida KT2440
ucgccgccgcugaccacg

SEQ ID NO: 1621736 - RNA, 20 nt, Pseudomonas putida KT2440
ucgccgccgcugaccacgcc

SEQ ID NO: 1621737 - RNA, 16 nt, Pseudomonas putida KT2440
ucgccagguuggcccu

SEQ ID NO: 1621738 - RNA, 20 nt, Pseudomonas putida KT2440
ucgccagguuggcccugaac

SEQ ID NO: 1621739 - RNA, 21 nt, Pseudomonas putida KT2440
ucgccaggugcucagccacgc

SEQ ID NO: 1621740 - RNA, 12 nt, Pseudomonas putida KT2440
ucgccaggcuuc

SEQ ID NO: 1621741 - RNA, 15 nt, Pseudomonas putida KT2440
ucgccggccuuggcg

SEQ ID NO: 1621742 - RNA, 19 nt, Pseudomonas putida KT2440
ucgccggguccaccagccc

SEQ ID NO: 1621743 - RNA, 18 nt, Pseudomonas putida KT2440
ucgccgcgcaugaaggac

SEQ ID NO: 1621744 - RNA, 22 nt, Pseudomonas putida KT2440
ucgccgccgguuucucgcagca

SEQ ID NO: 1621745 - RNA, 23 nt, Pseudomonas putida KT2440
ucggcaaucacccgcagggucgu

SEQ ID NO: 1621746 - RNA, 17 nt, Pseudomonas putida KT2440
ucggacagggucagcgg

SEQ ID NO: 1621747 - RNA, 23 nt, Pseudomonas putida KT2440
ucggcacgcguaccccuggcgcu

SEQ ID NO: 1621748 - RNA, 21 nt, Pseudomonas putida KT2440
ucggcacgcccagcaacugcg

SEQ ID NO: 1621749 - RNA, 21 nt, Pseudomonas putida KT2440
ucggcagcacccgcuuggcca

SEQ ID NO: 1621750 - RNA, 22 nt, Pseudomonas putida KT2440
ucggcagcacccgcuuggccac

SEQ ID NO: 1621751 - RNA, 19 nt, Pseudomonas putida KT2440
ucggcagagcgccagcauc

SEQ ID NO: 1621752 - RNA, 15 nt, Pseudomonas putida KT2440
ucggcacugcuaucc

SEQ ID NO: 1621753 - RNA, 19 nt, Pseudomonas putida KT2440
ucggcaaucugcagcagca

SEQ ID NO: 1621754 - RNA, 15 nt, Pseudomonas putida KT2440
ucggcaccgacggcg

SEQ ID NO: 1621755 - RNA, 20 nt, Pseudomonas putida KT2440
ucgcugauuucgucaccgau

SEQ ID NO: 1621756 - RNA, 17 nt, Pseudomonas putida KT2440
ucgcugccacgcaugcc

SEQ ID NO: 1621757 - RNA, 22 nt, Pseudomonas putida KT2440
ucgcugccagcguuuccggguu

SEQ ID NO: 1621758 - RNA, 16 nt, Pseudomonas putida KT2440
ucgcugcccgagcguu

SEQ ID NO: 1621759 - RNA, 16 nt, Pseudomonas putida KT2440
ucgcuuacagaugucu

SEQ ID NO: 1621760 - RNA, 16 nt, Pseudomonas putida KT2440
ucgcuucugcacuccc

SEQ ID NO: 1621761 - RNA, 14 nt, Pseudomonas putida KT2440
ucgcugacuuccag

SEQ ID NO: 1621762 - RNA, 13 nt, Pseudomonas putida KT2440
ucgcucuucaacc

SEQ ID NO: 1621763 - RNA, 15 nt, Pseudomonas putida KT2440
ucgcuccaggcggcc

SEQ ID NO: 1621764 - RNA, 12 nt, Pseudomonas putida KT2440
ucgcuccagggc

SEQ ID NO: 1621765 - RNA, 20 nt, Pseudomonas putida KT2440
ucgcucagcuugaacuugcu

SEQ ID NO: 1621766 - RNA, 15 nt, Pseudomonas putida KT2440
ucgcucagguaggca

SEQ ID NO: 1621767 - RNA, 19 nt, Pseudomonas putida KT2440
ucgcucagguaggcagcaa

SEQ ID NO: 1621768 - RNA, 15 nt, Pseudomonas putida KT2440
ucgcucaaaugggua

SEQ ID NO: 1621769 - RNA, 21 nt, Pseudomonas putida KT2440
ucgcuaucguccugggugugc

SEQ ID NO: 1621770 - RNA, 17 nt, Pseudomonas putida KT2440
ucgcuaagguggugcgg

SEQ ID NO: 1621771 - RNA, 23 nt, Pseudomonas putida KT2440
ucgcgguucaucggcaaacacau

SEQ ID NO: 1621772 - RNA, 14 nt, Pseudomonas putida KT2440
ucgcggugcagcgg

SEQ ID NO: 1621773 - RNA, 21 nt, Pseudomonas putida KT2440
ucgcgugaggcauggaagggc

SEQ ID NO: 1621774 - RNA, 19 nt, Pseudomonas putida KT2440
uccgaggucagcaccagcu

SEQ ID NO: 1621775 - RNA, 21 nt, Pseudomonas putida KT2440
uccgaccggucauacauccag

SEQ ID NO: 1621776 - RNA, 15 nt, Pseudomonas putida KT2440
uccgacaagggcuac

SEQ ID NO: 1621777 - RNA, 19 nt, Pseudomonas putida KT2440
ucccuguaggcgcaacuca

SEQ ID NO: 1621778 - RNA, 17 nt, Pseudomonas putida KT2440
ucccugcccccaaagcc

SEQ ID NO: 1621779 - RNA, 20 nt, Pseudomonas putida KT2440
ucccugcccccaaagccgcc

SEQ ID NO: 1621780 - RNA, 18 nt, Pseudomonas putida KT2440
ucccucugccugcccauu

SEQ ID NO: 1621781 - RNA, 16 nt, Pseudomonas putida KT2440
ucccucauuucaggcu

SEQ ID NO: 1621782 - RNA, 20 nt, Pseudomonas putida KT2440
ucccgguaacgggccagccg

SEQ ID NO: 1621783 - RNA, 17 nt, Pseudomonas putida KT2440
ucccggcagaagcgcug

SEQ ID NO: 1621784 - RNA, 21 nt, Pseudomonas putida KT2440
ucccggccacugguaguucau

SEQ ID NO: 1621785 - RNA, 15 nt, Pseudomonas putida KT2440
ucccgcgcauccucc

SEQ ID NO: 1621786 - RNA, 20 nt, Pseudomonas putida KT2440
ucccgcgcaugcugccaggc

SEQ ID NO: 1621787 - RNA, 17 nt, Pseudomonas putida KT2440
ucccgcuucgccagcgc

SEQ ID NO: 1621788 - RNA, 18 nt, Pseudomonas putida KT2440
ucccgcuucgccagcgcc

SEQ ID NO: 1621789 - RNA, 15 nt, Pseudomonas putida KT2440
uccccuuccaugccc

SEQ ID NO: 1621790 - RNA, 21 nt, Pseudomonas putida KT2440
uccccggcgacggcgagguga

SEQ ID NO: 1621791 - RNA, 23 nt, Pseudomonas putida KT2440
uccccggcgacggcgaggugauu

SEQ ID NO: 1621792 - RNA, 15 nt, Pseudomonas putida KT2440
uccccggcgccgccg

SEQ ID NO: 1621793 - RNA, 23 nt, Pseudomonas putida KT2440
uccccggcgccgccgaacucugg

SEQ ID NO: 1621794 - RNA, 16 nt, Pseudomonas putida KT2440
uccccggguccaccuc

SEQ ID NO: 1621795 - RNA, 15 nt, Pseudomonas putida KT2440
uccccggucagcaug

SEQ ID NO: 1621796 - RNA, 17 nt, Pseudomonas putida KT2440
uccccguugguguccuu

SEQ ID NO: 1621797 - RNA, 15 nt, Pseudomonas putida KT2440
ucccgccgccagacc

SEQ ID NO: 1621798 - RNA, 15 nt, Pseudomonas putida KT2440
ucccgcccuccagcc

SEQ ID NO: 1621799 - RNA, 19 nt, Pseudomonas putida KT2440
ucccgcccugagccaaggc

SEQ ID NO: 1621800 - RNA, 16 nt, Pseudomonas putida KT2440
ucccgccauguugcgc

SEQ ID NO: 1621801 - RNA, 20 nt, Pseudomonas putida KT2440
ucccgcacgauccccggccg

SEQ ID NO: 1621802 - RNA, 20 nt, Pseudomonas putida KT2440
ucccgaucuccccaccauca

SEQ ID NO: 1621803 - RNA, 17 nt, Pseudomonas putida KT2440
ucccgaggucagcagug

SEQ ID NO: 1621804 - RNA, 19 nt, Pseudomonas putida KT2440
ucccacaggugcagcacag

SEQ ID NO: 1621805 - RNA, 14 nt, Pseudomonas putida KT2440
ucccacauguaaug

SEQ ID NO: 1621806 - RNA, 22 nt, Pseudomonas putida KT2440
ucccacaggggccgcgcagccu

SEQ ID NO: 1621807 - RNA, 14 nt, Pseudomonas putida KT2440
ucccacagguaaua

SEQ ID NO: 1621808 - RNA, 20 nt, Pseudomonas putida KT2440
ucccaacgcaaauccuccug

SEQ ID NO: 1621809 - RNA, 14 nt, Pseudomonas putida KT2440
uccauuucccuaca

SEQ ID NO: 1621810 - RNA, 22 nt, Pseudomonas putida KT2440
uccaugucggaagccugcaucc

SEQ ID NO: 1621811 - RNA, 16 nt, Pseudomonas putida KT2440
uccaugucauaaacgc

SEQ ID NO: 1621812 - RNA, 16 nt, Pseudomonas putida KT2440
uccaugucgugcugcc

SEQ ID NO: 1621813 - RNA, 14 nt, Pseudomonas putida KT2440
uccauguagcaccu

SEQ ID NO: 1621814 - RNA, 17 nt, Pseudomonas putida KT2440
uccaucugcuucuggug

SEQ ID NO: 1621815 - RNA, 15 nt, Pseudomonas putida KT2440
uccaucuugcugcuc

SEQ ID NO: 1621816 - RNA, 15 nt, Pseudomonas putida KT2440
uccaucuugguuggc

SEQ ID NO: 1621817 - RNA, 23 nt, Pseudomonas putida KT2440
uccaugccuagauaagcgacaaa

SEQ ID NO: 1621818 - RNA, 18 nt, Pseudomonas putida KT2440
uccauggcaaaacucacc

SEQ ID NO: 1621819 - RNA, 20 nt, Pseudomonas putida KT2440
uccauggcaauuggcuucca

SEQ ID NO: 1621820 - RNA, 17 nt, Pseudomonas putida KT2440
uccauggccagggcaaa

SEQ ID NO: 1621821 - RNA, 14 nt, Pseudomonas putida KT2440
uccaugggcaggcc

SEQ ID NO: 1621822 - RNA, 21 nt, Pseudomonas putida KT2440
ucccagcgcugucccccagcc

SEQ ID NO: 1621823 - RNA, 22 nt, Pseudomonas putida KT2440
ucccagcgcugucccccagccc

SEQ ID NO: 1621824 - RNA, 18 nt, Pseudomonas putida KT2440
ucccaggacuucagcagu

SEQ ID NO: 1621825 - RNA, 19 nt, Pseudomonas putida KT2440
ucccaggcagccuccaggu

SEQ ID NO: 1621826 - RNA, 22 nt, Pseudomonas putida KT2440
ucccagcuggcaaugcaacucg

SEQ ID NO: 1621827 - RNA, 21 nt, Pseudomonas putida KT2440
ucccaguugugacuagaggau

SEQ ID NO: 1621828 - RNA, 18 nt, Pseudomonas putida KT2440
uccccaaccaccucccca

SEQ ID NO: 1621829 - RNA, 14 nt, Pseudomonas putida KT2440
uccccaaucaccag

SEQ ID NO: 1621830 - RNA, 18 nt, Pseudomonas putida KT2440
ucccauagccaaucccua

SEQ ID NO: 1621831 - RNA, 14 nt, Pseudomonas putida KT2440
uccccaucagcagc

SEQ ID NO: 1621832 - RNA, 15 nt, Pseudomonas putida KT2440
uccccaucagcagcu

SEQ ID NO: 1621833 - RNA, 12 nt, Pseudomonas putida KT2440
ucccccagcccu

SEQ ID NO: 1621834 - RNA, 16 nt, Pseudomonas putida KT2440
ucccccacccccgccc

SEQ ID NO: 1621835 - RNA, 22 nt, Pseudomonas putida KT2440
ucccccaucggcacccgcacau

SEQ ID NO: 1621836 - RNA, 18 nt, Pseudomonas putida KT2440
ucccccaaucuccagccc

SEQ ID NO: 1621837 - RNA, 14 nt, Pseudomonas putida KT2440
ucccccaccggccg

SEQ ID NO: 1621838 - RNA, 16 nt, Pseudomonas putida KT2440
uccccgcuucauccau

SEQ ID NO: 1621839 - RNA, 18 nt, Pseudomonas putida KT2440
uccccccacgcacaucac

SEQ ID NO: 1621840 - RNA, 16 nt, Pseudomonas putida KT2440
ucccccggcccagccc

SEQ ID NO: 1621841 - RNA, 22 nt, Pseudomonas putida KT2440
uccaacuggcgcaucuuccagc

SEQ ID NO: 1621842 - RNA, 20 nt, Pseudomonas putida KT2440
uccaacucgcgcauccagcc

SEQ ID NO: 1621843 - RNA, 17 nt, Pseudomonas putida KT2440
uccaagccgcuucacug

SEQ ID NO: 1621844 - RNA, 15 nt, Pseudomonas putida KT2440
uccaagugccgugca

SEQ ID NO: 1621845 - RNA, 16 nt, Pseudomonas putida KT2440
uccacaaucagcacug

SEQ ID NO: 1621846 - RNA, 23 nt, Pseudomonas putida KT2440
uccacaaacucuccuugcguugc

SEQ ID NO: 1621847 - RNA, 14 nt, Pseudomonas putida KT2440
uccaauccgcagcu

SEQ ID NO: 1621848 - RNA, 21 nt, Pseudomonas putida KT2440
uccaccacagcugcgccagcc

SEQ ID NO: 1621849 - RNA, 17 nt, Pseudomonas putida KT2440
uccacaucacugcugua

SEQ ID NO: 1621850 - RNA, 22 nt, Pseudomonas putida KT2440
uccacauaggccagcuccuucg

SEQ ID NO: 1621851 - RNA, 14 nt, Pseudomonas putida KT2440
uccacaucuugccc

SEQ ID NO: 1621852 - RNA, 16 nt, Pseudomonas putida KT2440
uccacaucuugccccg

SEQ ID NO: 1621853 - RNA, 12 nt, Pseudomonas putida KT2440
uccacagccucc

SEQ ID NO: 1621854 - RNA, 20 nt, Pseudomonas putida KT2440
uccacagguaccaggcugcc

SEQ ID NO: 1621855 - RNA, 15 nt, Pseudomonas putida KT2440
uccacacgcugcugc

SEQ ID NO: 1621856 - RNA, 23 nt, Pseudomonas putida KT2440
uccacacgcugcugcguaccauc

SEQ ID NO: 1621857 - RNA, 15 nt, Pseudomonas putida KT2440
uccacaccguacugc

SEQ ID NO: 1621858 - RNA, 22 nt, Pseudomonas putida KT2440
uccacaccaaagucagccagcc

SEQ ID NO: 1621859 - RNA, 14 nt, Pseudomonas putida KT2440
uccacccccgcacc

SEQ ID NO: 1621860 - RNA, 16 nt, Pseudomonas putida KT2440
uccaccccgcaggccg

SEQ ID NO: 1621861 - RNA, 19 nt, Pseudomonas putida KT2440
uccaccccggcagugccug

SEQ ID NO: 1621862 - RNA, 22 nt, Pseudomonas putida KT2440
uccaccccuuccagcuucugca

SEQ ID NO: 1621863 - RNA, 13 nt, Pseudomonas putida KT2440
uccacccacccuc

SEQ ID NO: 1621864 - RNA, 22 nt, Pseudomonas putida KT2440
uccacccgccugcaaccaguca

SEQ ID NO: 1621865 - RNA, 17 nt, Pseudomonas putida KT2440
uccacccggucccgccc

SEQ ID NO: 1621866 - RNA, 18 nt, Pseudomonas putida KT2440
uccaccaguugguaaaac

SEQ ID NO: 1621867 - RNA, 20 nt, Pseudomonas putida KT2440
uccaccaggccgaucaccag

SEQ ID NO: 1621868 - RNA, 21 nt, Pseudomonas putida KT2440
uccaccaggcuggccaccacc

SEQ ID NO: 1621869 - RNA, 14 nt, Pseudomonas putida KT2440
uccaccagcaggcu

SEQ ID NO: 1621870 - RNA, 15 nt, Pseudomonas putida KT2440
uccaccagccccagc

SEQ ID NO: 1621871 - RNA, 13 nt, Pseudomonas putida KT2440
uccaccagcggcu

SEQ ID NO: 1621872 - RNA, 16 nt, Pseudomonas putida KT2440
uccaccgcucgcgccg

SEQ ID NO: 1621873 - RNA, 19 nt, Pseudomonas putida KT2440
uccaccgcucgcgccgccg

SEQ ID NO: 1621874 - RNA, 15 nt, Pseudomonas putida KT2440
uccaccgcgccagcc

SEQ ID NO: 1621875 - RNA, 12 nt, Pseudomonas putida KT2440
uccaccgcccca

SEQ ID NO: 1621876 - RNA, 19 nt, Pseudomonas putida KT2440
uccaccgccccaagcgccu

SEQ ID NO: 1621877 - RNA, 19 nt, Pseudomonas putida KT2440
uccaccgaaaucagcaacg

SEQ ID NO: 1621878 - RNA, 16 nt, Pseudomonas putida KT2440
uccacggucagcaucc

SEQ ID NO: 1621879 - RNA, 20 nt, Pseudomonas putida KT2440
uccacggcaaucggcaggcc

SEQ ID NO: 1621880 - RNA, 14 nt, Pseudomonas putida KT2440
uccacgcgcaggcc

SEQ ID NO: 1621881 - RNA, 16 nt, Pseudomonas putida KT2440
uccacgcgcaggccac

SEQ ID NO: 1621882 - RNA, 18 nt, Pseudomonas putida KT2440
uccacgcgcaggcgcugc

SEQ ID NO: 1621883 - RNA, 18 nt, Pseudomonas putida KT2440
uccaccucgucaugcagc

SEQ ID NO: 1621884 - RNA, 22 nt, Pseudomonas putida KT2440
uccaccucgucaugcagcgcca

SEQ ID NO: 1621885 - RNA, 19 nt, Pseudomonas putida KT2440
uccaccugcuccagcaccu

SEQ ID NO: 1621886 - RNA, 22 nt, Pseudomonas putida KT2440
uccaccuggccacccggcugcu

SEQ ID NO: 1621887 - RNA, 13 nt, Pseudomonas putida KT2440
uccacgaccguga

SEQ ID NO: 1621888 - RNA, 21 nt, Pseudomonas putida KT2440
uccacugcacccgugcagggc

SEQ ID NO: 1621889 - RNA, 16 nt, Pseudomonas putida KT2440
uccacuaccuccagcc

SEQ ID NO: 1621890 - RNA, 12 nt, Pseudomonas putida KT2440
uccagaagcggc

SEQ ID NO: 1621891 - RNA, 14 nt, Pseudomonas putida KT2440
uccagaaauccauc

SEQ ID NO: 1621892 - RNA, 19 nt, Pseudomonas putida KT2440
uccagaaacggcuugaacc

SEQ ID NO: 1621893 - RNA, 17 nt, Pseudomonas putida KT2440
uccagcaccucgcucag

SEQ ID NO: 1621894 - RNA, 19 nt, Pseudomonas putida KT2440
uccagcaccucgcucagcu

SEQ ID NO: 1621895 - RNA, 15 nt, Pseudomonas putida KT2440
uccagcacugccugg

SEQ ID NO: 1621896 - RNA, 18 nt, Pseudomonas putida KT2440
uccagcacugccuggcca

SEQ ID NO: 1621897 - RNA, 19 nt, Pseudomonas putida KT2440
uccagcacugccuggccac

SEQ ID NO: 1621898 - RNA, 21 nt, Pseudomonas putida KT2440
uccagcacuuuugccaccacc

SEQ ID NO: 1621899 - RNA, 16 nt, Pseudomonas putida KT2440
uccagcagcacacgcu

SEQ ID NO: 1621900 - RNA, 11 nt, Pseudomonas putida KT2440
uccagcagcag

SEQ ID NO: 1621901 - RNA, 15 nt, Pseudomonas putida KT2440
uccagcaacggacgu

SEQ ID NO: 1621902 - RNA, 10 nt, Pseudomonas putida KT2440
uccagccagg

SEQ ID NO: 1621903 - RNA, 17 nt, Pseudomonas putida KT2440
uccagccacuuggcccc

SEQ ID NO: 1621904 - RNA, 23 nt, Pseudomonas putida KT2440
uccagccccucauucaaagccug

SEQ ID NO: 1621905 - RNA, 14 nt, Pseudomonas putida KT2440
uccagcccuuccac

SEQ ID NO: 1621906 - RNA, 14 nt, Pseudomonas putida KT2440
uccagcccggcguu

SEQ ID NO: 1621907 - RNA, 20 nt, Pseudomonas putida KT2440
uccagcccgucacgugccuu

SEQ ID NO: 1621908 - RNA, 19 nt, Pseudomonas putida KT2440
uccagcccgaaaccaugca

SEQ ID NO: 1621909 - RNA, 12 nt, Pseudomonas putida KT2440
uccagcagugcc

SEQ ID NO: 1621910 - RNA, 22 nt, Pseudomonas putida KT2440
uccagcagugccgccugguugc

SEQ ID NO: 1621911 - RNA, 21 nt, Pseudomonas putida KT2440
uccagcagugccguggcaggc

SEQ ID NO: 1621912 - RNA, 20 nt, Pseudomonas putida KT2440
uccagcaucagcacacccag

SEQ ID NO: 1621913 - RNA, 16 nt, Pseudomonas putida KT2440
uccagcagcgcaucca

SEQ ID NO: 1621914 - RNA, 19 nt, Pseudomonas putida KT2440
uccagcagcgacaccagcg

SEQ ID NO: 1621915 - RNA, 22 nt, Pseudomonas putida KT2440
uccagcagguuggacagcgccc

SEQ ID NO: 1621916 - RNA, 21 nt, Pseudomonas putida KT2440
uccagcagguuuuccagcccg

SEQ ID NO: 1621917 - RNA, 14 nt, Pseudomonas putida KT2440
uccagccugcagca

SEQ ID NO: 1621918 - RNA, 18 nt, Pseudomonas putida KT2440
uccagccugcagcacccu

SEQ ID NO: 1621919 - RNA, 14 nt, Pseudomonas putida KT2440
uccagcgcaggcuu

SEQ ID NO: 1621920 - RNA, 16 nt, Pseudomonas putida KT2440
uccagcgccagcagcc

SEQ ID NO: 1621921 - RNA, 17 nt, Pseudomonas putida KT2440
uccagcgccagcagccg

SEQ ID NO: 1621922 - RNA, 21 nt, Pseudomonas putida KT2440
uccagcgccagcagccgggcc

SEQ ID NO: 1621923 - RNA, 17 nt, Pseudomonas putida KT2440
uccagcgaggcgggccg

SEQ ID NO: 1621924 - RNA, 14 nt, Pseudomonas putida KT2440
uccagcgaggguuc

SEQ ID NO: 1621925 - RNA, 20 nt, Pseudomonas putida KT2440
uccagcgaggguuccaggcc

SEQ ID NO: 1621926 - RNA, 20 nt, Pseudomonas putida KT2440
uccagcgaugacccggccuu

SEQ ID NO: 1621927 - RNA, 22 nt, Pseudomonas putida KT2440
uccagcggcgacaggugccccu

SEQ ID NO: 1621928 - RNA, 22 nt, Pseudomonas putida KT2440
uccagcggcaaggucaacggca

SEQ ID NO: 1621929 - RNA, 13 nt, Pseudomonas putida KT2440
uccagcgccuccc

SEQ ID NO: 1621930 - RNA, 15 nt, Pseudomonas putida KT2440
uccagcgccuccccc

SEQ ID NO: 1621931 - RNA, 13 nt, Pseudomonas putida KT2440
uccagcgccgcca

SEQ ID NO: 1621932 - RNA, 17 nt, Pseudomonas putida KT2440
uccagcuugccaccauc

SEQ ID NO: 1621933 - RNA, 23 nt, Pseudomonas putida KT2440
uccaggaacgcugccuccacacc

SEQ ID NO: 1621934 - RNA, 22 nt, Pseudomonas putida KT2440
uccaggcacaggcgcacacgcu

SEQ ID NO: 1621935 - RNA, 18 nt, Pseudomonas putida KT2440
uccaggcagccugccagg

SEQ ID NO: 1621936 - RNA, 23 nt, Pseudomonas putida KT2440
uccaggcugcgcaucaggcugcg

SEQ ID NO: 1621937 - RNA, 13 nt, Pseudomonas putida KT2440
uccaggcucagcu

SEQ ID NO: 1621938 - RNA, 23 nt, Pseudomonas putida KT2440
uccaggcccgugacgaaggcggu

SEQ ID NO: 1621939 - RNA, 17 nt, Pseudomonas putida KT2440
uccaggcgcaaguagaa

SEQ ID NO: 1621940 - RNA, 21 nt, Pseudomonas putida KT2440
uccaggcguucaucgaaggcc

SEQ ID NO: 1621941 - RNA, 19 nt, Pseudomonas putida KT2440
uccagcucggcuggcuguc

SEQ ID NO: 1621942 - RNA, 15 nt, Pseudomonas putida KT2440
uccagcucuggucac

SEQ ID NO: 1621943 - RNA, 15 nt, Pseudomonas putida KT2440
uccagcucuugcuug

SEQ ID NO: 1621944 - RNA, 20 nt, Pseudomonas putida KT2440
uccagcugcggcugggucac

SEQ ID NO: 1621945 - RNA, 19 nt, Pseudomonas putida KT2440
uccagcugcuggauugccu

SEQ ID NO: 1621946 - RNA, 13 nt, Pseudomonas putida KT2440
uccagcugaaagu

SEQ ID NO: 1621947 - RNA, 18 nt, Pseudomonas putida KT2440
uccagcugaaagucgucg

SEQ ID NO: 1621948 - RNA, 20 nt, Pseudomonas putida KT2440
uccagcugagcgccauccac

SEQ ID NO: 1621949 - RNA, 22 nt, Pseudomonas putida KT2440
uccagcuggccaucgacccgcu

SEQ ID NO: 1621950 - RNA, 13 nt, Pseudomonas putida KT2440
uccagcuccagca

SEQ ID NO: 1621951 - RNA, 14 nt, Pseudomonas putida KT2440
uccagcucacagca

SEQ ID NO: 1621952 - RNA, 15 nt, Pseudomonas putida KT2440
uccagcucacagcac

SEQ ID NO: 1621953 - RNA, 16 nt, Pseudomonas putida KT2440
uccagcucacagcacu

SEQ ID NO: 1621954 - RNA, 15 nt, Pseudomonas putida KT2440
uccagcgucaccacc

SEQ ID NO: 1621955 - RNA, 15 nt, Pseudomonas putida KT2440
uccagcguggcgagg

SEQ ID NO: 1621956 - RNA, 17 nt, Pseudomonas putida KT2440
uccagcgucucgaugca

SEQ ID NO: 1621957 - RNA, 14 nt, Pseudomonas putida KT2440
uccagcgucugcuu

SEQ ID NO: 1621958 - RNA, 20 nt, Pseudomonas putida KT2440
uccagcguucggccagcacu

SEQ ID NO: 1621959 - RNA, 20 nt, Pseudomonas putida KT2440
uccagguuuggguuggcuuu

SEQ ID NO: 1621960 - RNA, 18 nt, Pseudomonas putida KT2440
uccaggucgaucgcaacg

SEQ ID NO: 1621961 - RNA, 19 nt, Pseudomonas putida KT2440
uccaggucauccgcacgca

SEQ ID NO: 1621962 - RNA, 17 nt, Pseudomonas putida KT2440
uccagguccaggccagc

SEQ ID NO: 1621963 - RNA, 11 nt, Pseudomonas putida KT2440
uccagguggcc

SEQ ID NO: 1621964 - RNA, 15 nt, Pseudomonas putida KT2440
uccagguccugcucc

SEQ ID NO: 1621965 - RNA, 18 nt, Pseudomonas putida KT2440
uccagguagcgcaaaugg

SEQ ID NO: 1621966 - RNA, 14 nt, Pseudomonas putida KT2440
uccagguaaaccug

SEQ ID NO: 1621967 - RNA, 19 nt, Pseudomonas putida KT2440
uccaguugcuccaccugcc

SEQ ID NO: 1621968 - RNA, 14 nt, Pseudomonas putida KT2440
uccagucggcaucc

SEQ ID NO: 1621969 - RNA, 19 nt, Pseudomonas putida KT2440
uccagugaagcuuccaguu

SEQ ID NO: 1621970 - RNA, 23 nt, Pseudomonas putida KT2440
uccagucaggccguagcgcugac

SEQ ID NO: 1621971 - RNA, 18 nt, Pseudomonas putida KT2440
uccagucgaucagcgaca

SEQ ID NO: 1621972 - RNA, 18 nt, Pseudomonas putida KT2440
uccagugcuucacugccg

SEQ ID NO: 1621973 - RNA, 19 nt, Pseudomonas putida KT2440
uccagugcuucacugccgg

SEQ ID NO: 1621974 - RNA, 21 nt, Pseudomonas putida KT2440
uccauacuuggccgacauggc

SEQ ID NO: 1621975 - RNA, 14 nt, Pseudomonas putida KT2440
ucauugcucaccgu

SEQ ID NO: 1621976 - RNA, 22 nt, Pseudomonas putida KT2440
uccaacgggcggaacuggcccu

SEQ ID NO: 1621977 - RNA, 14 nt, Pseudomonas putida KT2440
uccaaccgcaagcg

SEQ ID NO: 1621978 - RNA, 18 nt, Pseudomonas putida KT2440
uccaacaagucuuccccu

SEQ ID NO: 1621979 - RNA, 15 nt, Pseudomonas putida KT2440
uccaaccagccagcc

SEQ ID NO: 1621980 - RNA, 11 nt, Pseudomonas putida KT2440
ucauggcaguc

SEQ ID NO: 1621981 - RNA, 23 nt, Pseudomonas putida KT2440
ucauggcagucguacgcgggcag

SEQ ID NO: 1621982 - RNA, 21 nt, Pseudomonas putida KT2440
ucauggcgcgccaugccccua

SEQ ID NO: 1621983 - RNA, 22 nt, Pseudomonas putida KT2440
ucaugggugucggcauacagcu

SEQ ID NO: 1621984 - RNA, 15 nt, Pseudomonas putida KT2440
ucaugguccuugaac

SEQ ID NO: 1621985 - RNA, 13 nt, Pseudomonas putida KT2440
ucauguaggcaua

SEQ ID NO: 1621986 - RNA, 16 nt, Pseudomonas putida KT2440
ucauguccuugcugcg

SEQ ID NO: 1621987 - RNA, 20 nt, Pseudomonas putida KT2440
ucauugacggucagugaagc

SEQ ID NO: 1621988 - RNA, 17 nt, Pseudomonas putida KT2440
ucauucaaggucagcuu

SEQ ID NO: 1621989 - RNA, 14 nt, Pseudomonas putida KT2440
ucauucaaagccug

SEQ ID NO: 1621990 - RNA, 16 nt, Pseudomonas putida KT2440
ucauucaaagccugcu

SEQ ID NO: 1621991 - RNA, 17 nt, Pseudomonas putida KT2440
ucauucaaagccugcuc

SEQ ID NO: 1621992 - RNA, 16 nt, Pseudomonas putida KT2440
ucauucagcuuuggcu

SEQ ID NO: 1621993 - RNA, 12 nt, Pseudomonas putida KT2440
ucaugaagcuuc

SEQ ID NO: 1621994 - RNA, 13 nt, Pseudomonas putida KT2440
ucaugaaggcggg

SEQ ID NO: 1621995 - RNA, 11 nt, Pseudomonas putida KT2440
ucaugaacagc

SEQ ID NO: 1621996 - RNA, 15 nt, Pseudomonas putida KT2440
ucaugcgacaggcgu

SEQ ID NO: 1621997 - RNA, 15 nt, Pseudomonas putida KT2440
ucaugcgguacagca

SEQ ID NO: 1621998 - RNA, 23 nt, Pseudomonas putida KT2440
ucaugcgggaagccaugcaccuc

SEQ ID NO: 1621999 - RNA, 15 nt, Pseudomonas putida KT2440
ucaugcgcuggccac

SEQ ID NO: 1622000 - RNA, 15 nt, Pseudomonas putida KT2440
ucaugcucgccggcc

SEQ ID NO: 1622001 - RNA, 13 nt, Pseudomonas putida KT2440
ucaugcuggccag

SEQ ID NO: 1622002 - RNA, 19 nt, Pseudomonas putida KT2440
ucaugcuggccaggaugcc

SEQ ID NO: 1622003 - RNA, 15 nt, Pseudomonas putida KT2440
ucaugcccauggcca

SEQ ID NO: 1622004 - RNA, 22 nt, Pseudomonas putida KT2440
ucaucugcgcacggaaggcauc

SEQ ID NO: 1622005 - RNA, 17 nt, Pseudomonas putida KT2440
ucaucugcgccugugca

SEQ ID NO: 1622006 - RNA, 11 nt, Pseudomonas putida KT2440
ucaucugcuga

SEQ ID NO: 1622007 - RNA, 20 nt, Pseudomonas putida KT2440
ucaucggcacgcccagcaac

SEQ ID NO: 1622008 - RNA, 22 nt, Pseudomonas putida KT2440
ucaucggcaaacacauccagcg

SEQ ID NO: 1622009 - RNA, 17 nt, Pseudomonas putida KT2440
ucaucggcaugcagcgg

SEQ ID NO: 1622010 - RNA, 19 nt, Pseudomonas putida KT2440
ucaucggcaugcagcggcc

SEQ ID NO: 1622011 - RNA, 14 nt, Pseudomonas putida KT2440
ucaucguccaccca

SEQ ID NO: 1622012 - RNA, 12 nt, Pseudomonas putida KT2440
ucaucuccauga

SEQ ID NO: 1622013 - RNA, 15 nt, Pseudomonas putida KT2440
ucaucaggucgccuu

SEQ ID NO: 1622014 - RNA, 17 nt, Pseudomonas putida KT2440
ucaucaggccgaaggcc

SEQ ID NO: 1622015 - RNA, 20 nt, Pseudomonas putida KT2440
ucaucaggccgaugccaagc

SEQ ID NO: 1622016 - RNA, 22 nt, Pseudomonas putida KT2440
ucaucagcaggcagucuugaaa

SEQ ID NO: 1622017 - RNA, 23 nt, Pseudomonas putida KT2440
ucaucacgcgacgggaagugcac

SEQ ID NO: 1622018 - RNA, 22 nt, Pseudomonas putida KT2440
ucaucacuagaucucgcuucau

SEQ ID NO: 1622019 - RNA, 22 nt, Pseudomonas putida KT2440
ucaucaccggccagcacuuccu

SEQ ID NO: 1622020 - RNA, 12 nt, Pseudomonas putida KT2440
ucaucaccagcc

SEQ ID NO: 1622021 - RNA, 16 nt, Pseudomonas putida KT2440
ucaucaccacuucacu

SEQ ID NO: 1622022 - RNA, 18 nt, Pseudomonas putida KT2440
ucaucacacucgccccca

SEQ ID NO: 1622023 - RNA, 21 nt, Pseudomonas putida KT2440
ucauccacauaggccagcucc

SEQ ID NO: 1622024 - RNA, 17 nt, Pseudomonas putida KT2440
ucauccaccacccuggc

SEQ ID NO: 1622025 - RNA, 15 nt, Pseudomonas putida KT2440
ucauccacaccuucg

SEQ ID NO: 1622026 - RNA, 21 nt, Pseudomonas putida KT2440
ucauccaccgccccaagcgcc

SEQ ID NO: 1622027 - RNA, 14 nt, Pseudomonas putida KT2440
ucaucgaagaucag

SEQ ID NO: 1622028 - RNA, 17 nt, Pseudomonas putida KT2440
ucaucgaagaucagcuc

SEQ ID NO: 1622029 - RNA, 18 nt, Pseudomonas putida KT2440
ucaucgaagaucagcuca

SEQ ID NO: 1622030 - RNA, 15 nt, Pseudomonas putida KT2440
ucaucgacuggaugc

SEQ ID NO: 1622031 - RNA, 17 nt, Pseudomonas putida KT2440
ucaucgacuggaugcuc

SEQ ID NO: 1622032 - RNA, 18 nt, Pseudomonas putida KT2440
ucauccagcgggaugcag

SEQ ID NO: 1622033 - RNA, 20 nt, Pseudomonas putida KT2440
ucauccagcagcucggacaa

SEQ ID NO: 1622034 - RNA, 11 nt, Pseudomonas putida KT2440
ucauccagcag

SEQ ID NO: 1622035 - RNA, 14 nt, Pseudomonas putida KT2440
ucauccaucaccug

SEQ ID NO: 1622036 - RNA, 23 nt, Pseudomonas putida KT2440
ucauccggccgacucuucaccag

SEQ ID NO: 1622037 - RNA, 20 nt, Pseudomonas putida KT2440
ucauccggguuccagccguc

SEQ ID NO: 1622038 - RNA, 17 nt, Pseudomonas putida KT2440
ucauccgagcugagcag

SEQ ID NO: 1622039 - RNA, 14 nt, Pseudomonas putida KT2440
ucauccgccaggcu

SEQ ID NO: 1622040 - RNA, 19 nt, Pseudomonas putida KT2440
ucauccgccaggcucucca

SEQ ID NO: 1622041 - RNA, 20 nt, Pseudomonas putida KT2440
ucauagcucagcuggauaga

SEQ ID NO: 1622042 - RNA, 21 nt, Pseudomonas putida KT2440
ucauacggguguuuccacccc

SEQ ID NO: 1622043 - RNA, 21 nt, Pseudomonas putida KT2440
ucauaaugcuccgccaccaga

SEQ ID NO: 1622044 - RNA, 20 nt, Pseudomonas putida KT2440
ucauacccuuugccauccac

SEQ ID NO: 1622045 - RNA, 16 nt, Pseudomonas putida KT2440
ucauacagcgccucca

SEQ ID NO: 1622046 - RNA, 22 nt, Pseudomonas putida KT2440
ucauauccgcuuugcuugaguu

SEQ ID NO: 1622047 - RNA, 21 nt, Pseudomonas putida KT2440
ucaucaaagacuccgcuucau

SEQ ID NO: 1622048 - RNA, 16 nt, Pseudomonas putida KT2440
ucaguucgacgcggac

SEQ ID NO: 1622049 - RNA, 15 nt, Pseudomonas putida KT2440
ucaguugcucgcccg

SEQ ID NO: 1622050 - RNA, 23 nt, Pseudomonas putida KT2440
ucaguugcucgcccgcaacauaa

SEQ ID NO: 1622051 - RNA, 17 nt, Pseudomonas putida KT2440
ucaguugguagagcacg

SEQ ID NO: 1622052 - RNA, 15 nt, Pseudomonas putida KT2440
ucaguuaaucagcaa

SEQ ID NO: 1622053 - RNA, 17 nt, Pseudomonas putida KT2440
ucaguuuuucuccgccc

SEQ ID NO: 1622054 - RNA, 23 nt, Pseudomonas putida KT2440
ucagugccugcuccaugggcagg

SEQ ID NO: 1622055 - RNA, 17 nt, Pseudomonas putida KT2440
ucagugcugucacccuu

SEQ ID NO: 1622056 - RNA, 18 nt, Pseudomonas putida KT2440
ucagugcuucacagcguu

SEQ ID NO: 1622057 - RNA, 19 nt, Pseudomonas putida KT2440
ucagucgagucgacaguga

SEQ ID NO: 1622058 - RNA, 17 nt, Pseudomonas putida KT2440
ucaguccaucaccacca

SEQ ID NO: 1622059 - RNA, 16 nt, Pseudomonas putida KT2440
ucaguaccuggccgcg

SEQ ID NO: 1622060 - RNA, 13 nt, Pseudomonas putida KT2440
ucaguaccaggcc

SEQ ID NO: 1622061 - RNA, 21 nt, Pseudomonas putida KT2440
ucagguucugccggacaagaa

SEQ ID NO: 1622062 - RNA, 13 nt, Pseudomonas putida KT2440
ucagguuguucac

SEQ ID NO: 1622063 - RNA, 19 nt, Pseudomonas putida KT2440
ucagcucuucgaucucuuc

SEQ ID NO: 1622064 - RNA, 16 nt, Pseudomonas putida KT2440
ucagcugguucugcug

SEQ ID NO: 1622065 - RNA, 17 nt, Pseudomonas putida KT2440
ucagcugguucugcugc

SEQ ID NO: 1622066 - RNA, 18 nt, Pseudomonas putida KT2440
ucagcugguucugcugca

SEQ ID NO: 1622067 - RNA, 21 nt, Pseudomonas putida KT2440
ucagcugguucugcugcagcc

SEQ ID NO: 1622068 - RNA, 19 nt, Pseudomonas putida KT2440
ucagcuuaacgcuuggcca

SEQ ID NO: 1622069 - RNA, 20 nt, Pseudomonas putida KT2440
ucagcuuaacgcuuggccag

SEQ ID NO: 1622070 - RNA, 19 nt, Pseudomonas putida KT2440
ucagcucgugggucaucuu

SEQ ID NO: 1622071 - RNA, 20 nt, Pseudomonas putida KT2440
ucagcucgugggucaucuug

SEQ ID NO: 1622072 - RNA, 15 nt, Pseudomonas putida KT2440
ucagcucgcacaucu

SEQ ID NO: 1622073 - RNA, 16 nt, Pseudomonas putida KT2440
ucagcuugaucugguc

SEQ ID NO: 1622074 - RNA, 21 nt, Pseudomonas putida KT2440
ucagcuucucgcgcuuggcca

SEQ ID NO: 1622075 - RNA, 22 nt, Pseudomonas putida KT2440
ucagcuucucgcgcuuggccag

SEQ ID NO: 1622076 - RNA, 23 nt, Pseudomonas putida KT2440
ucaggaacagcucgauggccagg

SEQ ID NO: 1622077 - RNA, 22 nt, Pseudomonas putida KT2440
ucaggaccugguccccauagcu

SEQ ID NO: 1622078 - RNA, 17 nt, Pseudomonas putida KT2440
ucagcgccgcaacggcc

SEQ ID NO: 1622079 - RNA, 13 nt, Pseudomonas putida KT2440
ucagcgccuccag

SEQ ID NO: 1622080 - RNA, 19 nt, Pseudomonas putida KT2440
ucagcgccuucuugucucc

SEQ ID NO: 1622081 - RNA, 22 nt, Pseudomonas putida KT2440
ucagcgccagcacgcaggccag

SEQ ID NO: 1622082 - RNA, 13 nt, Pseudomonas putida KT2440
ucagcgccaauac

SEQ ID NO: 1622083 - RNA, 17 nt, Pseudomonas putida KT2440
ucagcgcagcaucuucc

SEQ ID NO: 1622084 - RNA, 14 nt, Pseudomonas putida KT2440
ucagcgcacccuuu

SEQ ID NO: 1622085 - RNA, 20 nt, Pseudomonas putida KT2440
ucagcgcacugaacagcgcc

SEQ ID NO: 1622086 - RNA, 16 nt, Pseudomonas putida KT2440
ucagcguacacugcag

SEQ ID NO: 1622087 - RNA, 18 nt, Pseudomonas putida KT2440
ucagcguacacugcagga

SEQ ID NO: 1622088 - RNA, 18 nt, Pseudomonas putida KT2440
ucagcgugugcugggugu

SEQ ID NO: 1622089 - RNA, 18 nt, Pseudomonas putida KT2440
ucagcgggucgagccagg

SEQ ID NO: 1622090 - RNA, 19 nt, Pseudomonas putida KT2440
ucagcgggcgauugccagg

SEQ ID NO: 1622091 - RNA, 20 nt, Pseudomonas putida KT2440
ucagcggcuuguucagcugg

SEQ ID NO: 1622092 - RNA, 17 nt, Pseudomonas putida KT2440
ucagcggcaacaccagc

SEQ ID NO: 1622093 - RNA, 18 nt, Pseudomonas putida KT2440
ucagcggcaacaccagca

SEQ ID NO: 1622094 - RNA, 19 nt, Pseudomonas putida KT2440
ucagcgcucaaaaaaauac

SEQ ID NO: 1622095 - RNA, 21 nt, Pseudomonas putida KT2440
ucagcgcucaaaaaaauacgu

SEQ ID NO: 1622096 - RNA, 18 nt, Pseudomonas putida KT2440
ucagcggaccaggugcag

SEQ ID NO: 1622097 - RNA, 14 nt, Pseudomonas putida KT2440
ucaggccccaggcc

SEQ ID NO: 1622098 - RNA, 14 nt, Pseudomonas putida KT2440
ucaggccccaguca

SEQ ID NO: 1622099 - RNA, 15 nt, Pseudomonas putida KT2440
ucaggccgaugggca

SEQ ID NO: 1622100 - RNA, 17 nt, Pseudomonas putida KT2440
ucaggccgaugggcagg

SEQ ID NO: 1622101 - RNA, 21 nt, Pseudomonas putida KT2440
ucaggcccaccagucugcuca

SEQ ID NO: 1622102 - RNA, 12 nt, Pseudomonas putida KT2440
ucaggccgccuu

SEQ ID NO: 1622103 - RNA, 20 nt, Pseudomonas putida KT2440
ucaggccaugcugcgccagg

SEQ ID NO: 1622104 - RNA, 16 nt, Pseudomonas putida KT2440
ucaggccguagcgcug

SEQ ID NO: 1622105 - RNA, 15 nt, Pseudomonas putida KT2440
ucaggccuccccgcu

SEQ ID NO: 1622106 - RNA, 17 nt, Pseudomonas putida KT2440
ucaggccuuuucacaca

SEQ ID NO: 1622107 - RNA, 20 nt, Pseudomonas putida KT2440
ucaggccuugccgcucacca

SEQ ID NO: 1622108 - RNA, 23 nt, Pseudomonas putida KT2440
ucaggagggccguaggacagugc

SEQ ID NO: 1622109 - RNA, 13 nt, Pseudomonas putida KT2440
ucaggaucacguc

SEQ ID NO: 1622110 - RNA, 21 nt, Pseudomonas putida KT2440
ucaggaugcuucggcugaucu

SEQ ID NO: 1622111 - RNA, 17 nt, Pseudomonas putida KT2440
ucaggcaggaacuggcu

SEQ ID NO: 1622112 - RNA, 20 nt, Pseudomonas putida KT2440
ucaggcaggccagcacggcc

SEQ ID NO: 1622113 - RNA, 22 nt, Pseudomonas putida KT2440
ucaggcaucgcuuucaguagaa

SEQ ID NO: 1622114 - RNA, 18 nt, Pseudomonas putida KT2440
ucaggcaugccagcagcu

SEQ ID NO: 1622115 - RNA, 21 nt, Pseudomonas putida KT2440
ucaggcaaucacgaucacucg

SEQ ID NO: 1622116 - RNA, 22 nt, Pseudomonas putida KT2440
ucaggcaaacgaaaucugccug

SEQ ID NO: 1622117 - RNA, 23 nt, Pseudomonas putida KT2440
ucaggcaaacgaaaucugccugc

SEQ ID NO: 1622118 - RNA, 12 nt, Pseudomonas putida KT2440
ucaggcacagca

SEQ ID NO: 1622119 - RNA, 13 nt, Pseudomonas putida KT2440
ucaggcaccagcg

SEQ ID NO: 1622120 - RNA, 18 nt, Pseudomonas putida KT2440
ucaggcacggcaccagca

SEQ ID NO: 1622121 - RNA, 15 nt, Pseudomonas putida KT2440
ucagguagcugggcc

SEQ ID NO: 1622122 - RNA, 14 nt, Pseudomonas putida KT2440
ucagguaggcagca

SEQ ID NO: 1622123 - RNA, 14 nt, Pseudomonas putida KT2440
ucagguacagcagc

SEQ ID NO: 1622124 - RNA, 15 nt, Pseudomonas putida KT2440
ucagguacagcagcu

SEQ ID NO: 1622125 - RNA, 23 nt, Pseudomonas putida KT2440
ucagggucgggcacaggcccagc

SEQ ID NO: 1622126 - RNA, 18 nt, Pseudomonas putida KT2440
ucaggguuugcagcucac

SEQ ID NO: 1622127 - RNA, 16 nt, Pseudomonas putida KT2440
ucaggucgacacccag

SEQ ID NO: 1622128 - RNA, 16 nt, Pseudomonas putida KT2440
ucaggucgccuugaaa

SEQ ID NO: 1622129 - RNA, 20 nt, Pseudomonas putida KT2440
ucaggugguaguccuugccg

SEQ ID NO: 1622130 - RNA, 14 nt, Pseudomonas putida KT2440
ucagguguggcuca

SEQ ID NO: 1622131 - RNA, 15 nt, Pseudomonas putida KT2440
ucagguguuccagca

SEQ ID NO: 1622132 - RNA, 16 nt, Pseudomonas putida KT2440
ucagggcacggcugcc

SEQ ID NO: 1622133 - RNA, 18 nt, Pseudomonas putida KT2440
ucagggaaggcuacaucc

SEQ ID NO: 1622134 - RNA, 15 nt, Pseudomonas putida KT2440
ucagggcuuuuucca

SEQ ID NO: 1622135 - RNA, 11 nt, Pseudomonas putida KT2440
ucagggcugcg

SEQ ID NO: 1622136 - RNA, 12 nt, Pseudomonas putida KT2440
ucaggcucagcu

SEQ ID NO: 1622137 - RNA, 21 nt, Pseudomonas putida KT2440
ucaggcugcgcccgcacagca

SEQ ID NO: 1622138 - RNA, 14 nt, Pseudomonas putida KT2440
ucaggcuggcgacg

SEQ ID NO: 1622139 - RNA, 17 nt, Pseudomonas putida KT2440
ucaggcuucagaagccu

SEQ ID NO: 1622140 - RNA, 23 nt, Pseudomonas putida KT2440
ggauucaacagcgcgacgcagca

SEQ ID NO: 1622141 - RNA, 16 nt, Pseudomonas putida KT2440
ggauuggcgcggcugg

SEQ ID NO: 1622142 - RNA, 14 nt, Pseudomonas putida KT2440
ggauugggaaaaca

SEQ ID NO: 1622143 - RNA, 19 nt, Pseudomonas putida KT2440
ggauggcaaagcgcagcaa

SEQ ID NO: 1622144 - RNA, 15 nt, Pseudomonas putida KT2440
ggauggcaccggcuc

SEQ ID NO: 1622145 - RNA, 17 nt, Pseudomonas putida KT2440
ggauggcaccggcucug

SEQ ID NO: 1622146 - RNA, 20 nt, Pseudomonas putida KT2440
ggauggcaccggcucugccg

SEQ ID NO: 1622147 - RNA, 18 nt, Pseudomonas putida KT2440
ggaucaccacgucuuccu

SEQ ID NO: 1622148 - RNA, 18 nt, Pseudomonas putida KT2440
ggaucaccgcaagcugca

SEQ ID NO: 1622149 - RNA, 17 nt, Pseudomonas putida KT2440
ggaucacugccagcacc

SEQ ID NO: 1622150 - RNA, 15 nt, Pseudomonas putida KT2440
ggaucuccucggcca

SEQ ID NO: 1622151 - RNA, 17 nt, Pseudomonas putida KT2440
ggaucuccucggccagc

SEQ ID NO: 1622152 - RNA, 19 nt, Pseudomonas putida KT2440
ggaucugcugcagcauggc

SEQ ID NO: 1622153 - RNA, 16 nt, Pseudomonas putida KT2440
ggaucugagcagcaga

SEQ ID NO: 1622154 - RNA, 15 nt, Pseudomonas putida KT2440
ggaugauccagccca

SEQ ID NO: 1622155 - RNA, 14 nt, Pseudomonas putida KT2440
ggaugccaauuucc

SEQ ID NO: 1622156 - RNA, 12 nt, Pseudomonas putida KT2440
ggaugccacgcu

SEQ ID NO: 1622157 - RNA, 19 nt, Pseudomonas putida KT2440
ggaugccacgcugaacacg

SEQ ID NO: 1622158 - RNA, 23 nt, Pseudomonas putida KT2440
ggcaaccaccaacagcaccggcc

SEQ ID NO: 1622159 - RNA, 17 nt, Pseudomonas putida KT2440
ggcaacauucaccagcc

SEQ ID NO: 1622160 - RNA, 22 nt, Pseudomonas putida KT2440
ggcaacauucaccagccaggca

SEQ ID NO: 1622161 - RNA, 16 nt, Pseudomonas putida KT2440
ggcaaccugacccgcg

SEQ ID NO: 1622162 - RNA, 18 nt, Pseudomonas putida KT2440
ggcaacccggcagucagg

SEQ ID NO: 1622163 - RNA, 19 nt, Pseudomonas putida KT2440
ggcaacccuucggccagca

SEQ ID NO: 1622164 - RNA, 21 nt, Pseudomonas putida KT2440
ggcaacccuucggccagcagu

SEQ ID NO: 1622165 - RNA, 20 nt, Pseudomonas putida KT2440
ggcaaccugcucgcucaggc

SEQ ID NO: 1622166 - RNA, 13 nt, Pseudomonas putida KT2440
ggcaaccauggcu

SEQ ID NO: 1622167 - RNA, 15 nt, Pseudomonas putida KT2440
ggcaacggccacgcu

SEQ ID NO: 1622168 - RNA, 21 nt, Pseudomonas putida KT2440
ggcaacggccacgcugcggcg

SEQ ID NO: 1622169 - RNA, 22 nt, Pseudomonas putida KT2440
ggcaaagaucgcccagcuggag

SEQ ID NO: 1622170 - RNA, 15 nt, Pseudomonas putida KT2440
ggcaaaggucugcug

SEQ ID NO: 1622171 - RNA, 20 nt, Pseudomonas putida KT2440
ggcaaagguggcaccgccgc

SEQ ID NO: 1622172 - RNA, 14 nt, Pseudomonas putida KT2440
ggcaacuccuccag

SEQ ID NO: 1622173 - RNA, 18 nt, Pseudomonas putida KT2440
ggcaagcccauggcuggc

SEQ ID NO: 1622174 - RNA, 23 nt, Pseudomonas putida KT2440
ggcaagcccgcgaagaggccagc

SEQ ID NO: 1622175 - RNA, 18 nt, Pseudomonas putida KT2440
ggcaagcccgcucccaca

SEQ ID NO: 1622176 - RNA, 18 nt, Pseudomonas putida KT2440
ggcaagcccgcuccuaca

SEQ ID NO: 1622177 - RNA, 17 nt, Pseudomonas putida KT2440
ggcaagccaaaguccug

SEQ ID NO: 1622178 - RNA, 16 nt, Pseudomonas putida KT2440
ggcaagcuggucaggu

SEQ ID NO: 1622179 - RNA, 19 nt, Pseudomonas putida KT2440
ggcaagggccugcaggcag

SEQ ID NO: 1622180 - RNA, 16 nt, Pseudomonas putida KT2440
ggcaaugaccaagcaa

SEQ ID NO: 1622181 - RNA, 17 nt, Pseudomonas putida KT2440
ggcaaucgccgggcgca

SEQ ID NO: 1622182 - RNA, 23 nt, Pseudomonas putida KT2440
ggcaaucacgaacaccagcccca

SEQ ID NO: 1622183 - RNA, 14 nt, Pseudomonas putida KT2440
ggcaaucacccgca

SEQ ID NO: 1622184 - RNA, 13 nt, Pseudomonas putida KT2440
ggcaaucaguaag

SEQ ID NO: 1622185 - RNA, 16 nt, Pseudomonas putida KT2440
ggcaagggcgaaccag

SEQ ID NO: 1622186 - RNA, 16 nt, Pseudomonas putida KT2440
ggcaaguugacccuga

SEQ ID NO: 1622187 - RNA, 22 nt, Pseudomonas putida KT2440
ggcaaguugacccugaaucagc

SEQ ID NO: 1622188 - RNA, 21 nt, Pseudomonas putida KT2440
ggcaauggcguauccacauac

SEQ ID NO: 1622189 - RNA, 23 nt, Pseudomonas putida KT2440
ggcaauggcccgcuccaguguag

SEQ ID NO: 1622190 - RNA, 20 nt, Pseudomonas putida KT2440
ggcaaugcgagacgccacca

SEQ ID NO: 1622191 - RNA, 17 nt, Pseudomonas putida KT2440
ggcaaugcccauggcca

SEQ ID NO: 1622192 - RNA, 21 nt, Pseudomonas putida KT2440
ggcaaugcccauggccaggcu

SEQ ID NO: 1622193 - RNA, 19 nt, Pseudomonas putida KT2440
ggcaaugcgccggucgcgu

SEQ ID NO: 1622194 - RNA, 20 nt, Pseudomonas putida KT2440
ggcaaugcucgccugcuugg

SEQ ID NO: 1622195 - RNA, 22 nt, Pseudomonas putida KT2440
ggcaauucgccggcagcaaacc

SEQ ID NO: 1622196 - RNA, 21 nt, Pseudomonas putida KT2440
ggcaauuuccugcgcggccuu

SEQ ID NO: 1622197 - RNA, 17 nt, Pseudomonas putida KT2440
ggcacccgcacaugccu

SEQ ID NO: 1622198 - RNA, 18 nt, Pseudomonas putida KT2440
ggcacccaauagcccacc

SEQ ID NO: 1622199 - RNA, 17 nt, Pseudomonas putida KT2440
ggcacccagccagcgau

SEQ ID NO: 1622200 - RNA, 19 nt, Pseudomonas putida KT2440
ggcacaccacgccaaccug

SEQ ID NO: 1622201 - RNA, 19 nt, Pseudomonas putida KT2440
ggcaccuaucgcugccgcc

SEQ ID NO: 1622202 - RNA, 18 nt, Pseudomonas putida KT2440
ggcaccuccagaggugcc

SEQ ID NO: 1622203 - RNA, 16 nt, Pseudomonas putida KT2440
ggcaccggcuucgccg

SEQ ID NO: 1622204 - RNA, 18 nt, Pseudomonas putida KT2440
ggcaccgacccggccgcu

SEQ ID NO: 1622205 - RNA, 14 nt, Pseudomonas putida KT2440
ggcaccggcagcag

SEQ ID NO: 1622206 - RNA, 23 nt, Pseudomonas putida KT2440
ggcacgggaucaaacggucccga

SEQ ID NO: 1622207 - RNA, 13 nt, Pseudomonas putida KT2440
ggcacggugcuac

SEQ ID NO: 1622208 - RNA, 12 nt, Pseudomonas putida KT2440
ggcacggccagc

SEQ ID NO: 1622209 - RNA, 18 nt, Pseudomonas putida KT2440
ggcacgguugcgcccggc

SEQ ID NO: 1622210 - RNA, 22 nt, Pseudomonas putida KT2440
ggcacgguugcgcccggcgucg

SEQ ID NO: 1622211 - RNA, 23 nt, Pseudomonas putida KT2440
ggcacuggcgcgaugcgguugca

SEQ ID NO: 1622212 - RNA, 24 nt, Pseudomonas putida KT2440
ggcacuggcugauagccgccagca

SEQ ID NO: 1622213 - RNA, 14 nt, Pseudomonas putida KT2440
ggcaccuuucucca

SEQ ID NO: 1622214 - RNA, 19 nt, Pseudomonas putida KT2440
ggcaccuuucuccaggugg

SEQ ID NO: 1622215 - RNA, 18 nt, Pseudomonas putida KT2440
ggcacgccuucagcagcc

SEQ ID NO: 1622216 - RNA, 19 nt, Pseudomonas putida KT2440
ggaguggaagauggucucg

SEQ ID NO: 1622217 - RNA, 12 nt, Pseudomonas putida KT2440
ggaguccagcug

SEQ ID NO: 1622218 - RNA, 14 nt, Pseudomonas putida KT2440
ggaguccagcugca

SEQ ID NO: 1622219 - RNA, 19 nt, Pseudomonas putida KT2440
ggagucggcucuggcaaga

SEQ ID NO: 1622220 - RNA, 20 nt, Pseudomonas putida KT2440
ggagucggcucuggcaagau

SEQ ID NO: 1622221 - RNA, 16 nt, Pseudomonas putida KT2440
ggauacugcugaaccu

SEQ ID NO: 1622222 - RNA, 23 nt, Pseudomonas putida KT2440
ggauagagcaucccccuccuaag

SEQ ID NO: 1622223 - RNA, 19 nt, Pseudomonas putida KT2440
ggauagcgcgccaaagccu

SEQ ID NO: 1622224 - RNA, 15 nt, Pseudomonas putida KT2440
ggagcgggcgugccc

SEQ ID NO: 1622225 - RNA, 12 nt, Pseudomonas putida KT2440
ggagcgggcuug

SEQ ID NO: 1622226 - RNA, 16 nt, Pseudomonas putida KT2440
ggagcggguucacccg

SEQ ID NO: 1622227 - RNA, 20 nt, Pseudomonas putida KT2440
ggagcggcuuugcgucccga

SEQ ID NO: 1622228 - RNA, 19 nt, Pseudomonas putida KT2440
ggagcgggacugcccgccc

SEQ ID NO: 1622229 - RNA, 21 nt, Pseudomonas putida KT2440
ggagcgggacugcccgccccc

SEQ ID NO: 1622230 - RNA, 21 nt, Pseudomonas putida KT2440
ggaggccgucaggccuccccg

SEQ ID NO: 1622231 - RNA, 14 nt, Pseudomonas putida KT2440
ggagaacacccagc

SEQ ID NO: 1622232 - RNA, 12 nt, Pseudomonas putida KT2440
ggagauuggcca

SEQ ID NO: 1622233 - RNA, 17 nt, Pseudomonas putida KT2440
ggagauuggccagcagg

SEQ ID NO: 1622234 - RNA, 22 nt, Pseudomonas putida KT2440
ggacugcaccagguccagcgug

SEQ ID NO: 1622235 - RNA, 14 nt, Pseudomonas putida KT2440
ggacugcaccauga

SEQ ID NO: 1622236 - RNA, 15 nt, Pseudomonas putida KT2440
ggacgucccagcagg

SEQ ID NO: 1622237 - RNA, 19 nt, Pseudomonas putida KT2440
ggacggugguggccgcgcg

SEQ ID NO: 1622238 - RNA, 19 nt, Pseudomonas putida KT2440
ggacggucaugcucagcug

SEQ ID NO: 1622239 - RNA, 23 nt, Pseudomonas putida KT2440
ggacggucaugcucagcugggcg

SEQ ID NO: 1622240 - RNA, 23 nt, Pseudomonas putida KT2440
ggacgagguugccauugaggcug

SEQ ID NO: 1622241 - RNA, 21 nt, Pseudomonas putida KT2440
ggacgauggugaaggccagga

SEQ ID NO: 1622242 - RNA, 15 nt, Pseudomonas putida KT2440
ggacaaauccagguc

SEQ ID NO: 1622243 - RNA, 23 nt, Pseudomonas putida KT2440
ggaaucggcuccaggcacaggcg

SEQ ID NO: 1622244 - RNA, 14 nt, Pseudomonas putida KT2440
ggaauagaacacug

SEQ ID NO: 1622245 - RNA, 17 nt, Pseudomonas putida KT2440
ggaauagaacacuggca

SEQ ID NO: 1622246 - RNA, 17 nt, Pseudomonas putida KT2440
gcucgggggugcacagc

SEQ ID NO: 1622247 - RNA, 11 nt, Pseudomonas putida KT2440
gcucgggaaca

SEQ ID NO: 1622248 - RNA, 18 nt, Pseudomonas putida KT2440
ggaagucgcggaacagug

SEQ ID NO: 1622249 - RNA, 19 nt, Pseudomonas putida KT2440
ggaagugcuucaccuugcc

SEQ ID NO: 1622250 - RNA, 16 nt, Pseudomonas putida KT2440
ggacccaaucgcugug

SEQ ID NO: 1622251 - RNA, 18 nt, Pseudomonas putida KT2440
ggacccaaucgcugugca

SEQ ID NO: 1622252 - RNA, 15 nt, Pseudomonas putida KT2440
ggacccggcuggaag

SEQ ID NO: 1622253 - RNA, 19 nt, Pseudomonas putida KT2440
ggaccucuggcgugcaccu

SEQ ID NO: 1622254 - RNA, 16 nt, Pseudomonas putida KT2440
ggaccagcaccaccug

SEQ ID NO: 1622255 - RNA, 13 nt, Pseudomonas putida KT2440
ggaccagacccgc

SEQ ID NO: 1622256 - RNA, 15 nt, Pseudomonas putida KT2440
ggaccaccugggcca

SEQ ID NO: 1622257 - RNA, 13 nt, Pseudomonas putida KT2440
ggacagcaauucc

SEQ ID NO: 1622258 - RNA, 18 nt, Pseudomonas putida KT2440
ggacagccacaugccagc

SEQ ID NO: 1622259 - RNA, 11 nt, Pseudomonas putida KT2440
ggacagcagcu

SEQ ID NO: 1622260 - RNA, 19 nt, Pseudomonas putida KT2440
ggcauccacacgcugcugc

SEQ ID NO: 1622261 - RNA, 13 nt, Pseudomonas putida KT2440
ggcauccaccugc

SEQ ID NO: 1622262 - RNA, 16 nt, Pseudomonas putida KT2440
ggcaucauccugcugg

SEQ ID NO: 1622263 - RNA, 17 nt, Pseudomonas putida KT2440
ggcaucauccugcuggc

SEQ ID NO: 1622264 - RNA, 16 nt, Pseudomonas putida KT2440
ggcaucacgcuggcca

SEQ ID NO: 1622265 - RNA, 18 nt, Pseudomonas putida KT2440
ggcaucacgucacagcca

SEQ ID NO: 1622266 - RNA, 16 nt, Pseudomonas putida KT2440
ggcaucaaugcaaugu

SEQ ID NO: 1622267 - RNA, 15 nt, Pseudomonas putida KT2440
ggcaucagcgcaccc

SEQ ID NO: 1622268 - RNA, 15 nt, Pseudomonas putida KT2440
ggcaucagggcccgg

SEQ ID NO: 1622269 - RNA, 22 nt, Pseudomonas putida KT2440
ggcagugcacccgcgaguucau

SEQ ID NO: 1622270 - RNA, 15 nt, Pseudomonas putida KT2440
ggcaggucgacccgc

SEQ ID NO: 1622271 - RNA, 20 nt, Pseudomonas putida KT2440
ggcaggguucgcuguccuga

SEQ ID NO: 1622272 - RNA, 17 nt, Pseudomonas putida KT2440
ggcagguugcuggccuu

SEQ ID NO: 1622273 - RNA, 13 nt, Pseudomonas putida KT2440
ggcagguuggcgc

SEQ ID NO: 1622274 - RNA, 14 nt, Pseudomonas putida KT2440
ggcagguucgacca

SEQ ID NO: 1622275 - RNA, 18 nt, Pseudomonas putida KT2440
ggcagguucgaccacugc

SEQ ID NO: 1622276 - RNA, 21 nt, Pseudomonas putida KT2440
ggcagaaucagguucagggca

SEQ ID NO: 1622277 - RNA, 19 nt, Pseudomonas putida KT2440
ggcaggcugauggauuccu

SEQ ID NO: 1622278 - RNA, 14 nt, Pseudomonas putida KT2440
ggcacuguaggcaa

SEQ ID NO: 1622279 - RNA, 22 nt, Pseudomonas putida KT2440
ggcaugacaaacgccagcaugc

SEQ ID NO: 1622280 - RNA, 14 nt, Pseudomonas putida KT2440
ggcaucgaagcgca

SEQ ID NO: 1622281 - RNA, 19 nt, Pseudomonas putida KT2440
ggcaucgaagcgcaccagu

SEQ ID NO: 1622282 - RNA, 18 nt, Pseudomonas putida KT2440
ggcaucgaaggugguagc

SEQ ID NO: 1622283 - RNA, 17 nt, Pseudomonas putida KT2440
ggcaucgaacgccgccu

SEQ ID NO: 1622284 - RNA, 20 nt, Pseudomonas putida KT2440
ggcauccucaagcugcaccg

SEQ ID NO: 1622285 - RNA, 17 nt, Pseudomonas putida KT2440
ggcauccgucgacucau

SEQ ID NO: 1622286 - RNA, 22 nt, Pseudomonas putida KT2440
ggcaucugccgggucggccugc

SEQ ID NO: 1622287 - RNA, 11 nt, Pseudomonas putida KT2440
ggcaucugcug

SEQ ID NO: 1622288 - RNA, 18 nt, Pseudomonas putida KT2440
ggcaucgacaaucggcuc

SEQ ID NO: 1622289 - RNA, 16 nt, Pseudomonas putida KT2440
ggccaaaccguccagg

SEQ ID NO: 1622290 - RNA, 17 nt, Pseudomonas putida KT2440
ggccaaaccguccaggu

SEQ ID NO: 1622291 - RNA, 17 nt, Pseudomonas putida KT2440
ggcauuggcgcgcucga

SEQ ID NO: 1622292 - RNA, 22 nt, Pseudomonas putida KT2440
ggcauuuucgauacggccgugg

SEQ ID NO: 1622293 - RNA, 14 nt, Pseudomonas putida KT2440
ggccaaggcggcga

SEQ ID NO: 1622294 - RNA, 19 nt, Pseudomonas putida KT2440
ggccaaggguuugccaggc

SEQ ID NO: 1622295 - RNA, 20 nt, Pseudomonas putida KT2440
ggccaaggucagcaagccgc

SEQ ID NO: 1622296 - RNA, 18 nt, Pseudomonas putida KT2440
ggccaaguacggccagca

SEQ ID NO: 1622297 - RNA, 13 nt, Pseudomonas putida KT2440
ggccaagccgcug

SEQ ID NO: 1622298 - RNA, 19 nt, Pseudomonas putida KT2440
ggccaagccgcugccacag

SEQ ID NO: 1622299 - RNA, 21 nt, Pseudomonas putida KT2440
ggccaagccgcugccacaggu

SEQ ID NO: 1622300 - RNA, 14 nt, Pseudomonas putida KT2440
ggccaacugcagca

SEQ ID NO: 1622301 - RNA, 13 nt, Pseudomonas putida KT2440
ggccagcgcacag

SEQ ID NO: 1622302 - RNA, 14 nt, Pseudomonas putida KT2440
ggccagcggccgcu

SEQ ID NO: 1622303 - RNA, 20 nt, Pseudomonas putida KT2440
ggccagcucgccaaacagga

SEQ ID NO: 1622304 - RNA, 22 nt, Pseudomonas putida KT2440
ggccagcucggcaguggcggug

SEQ ID NO: 1622305 - RNA, 14 nt, Pseudomonas putida KT2440
ggccagcucggccg

SEQ ID NO: 1622306 - RNA, 21 nt, Pseudomonas putida KT2440
ggccagcguggccgccaacag

SEQ ID NO: 1622307 - RNA, 15 nt, Pseudomonas putida KT2440
ggccagcucauccag

SEQ ID NO: 1622308 - RNA, 19 nt, Pseudomonas putida KT2440
ggccagcucauccagccgc

SEQ ID NO: 1622309 - RNA, 21 nt, Pseudomonas putida KT2440
ggccagcucauccagccgcgu

SEQ ID NO: 1622310 - RNA, 15 nt, Pseudomonas putida KT2440
ggccagggcccgccg

SEQ ID NO: 1622311 - RNA, 16 nt, Pseudomonas putida KT2440
ggccagggcccgccgc

SEQ ID NO: 1622312 - RNA, 19 nt, Pseudomonas putida KT2440
ggccagggcccgccgcgcg

SEQ ID NO: 1622313 - RNA, 11 nt, Pseudomonas putida KT2440
ggccagggccu

SEQ ID NO: 1622314 - RNA, 13 nt, Pseudomonas putida KT2440
ggccaggccggcg

SEQ ID NO: 1622315 - RNA, 13 nt, Pseudomonas putida KT2440
ggcccaaggcacc

SEQ ID NO: 1622316 - RNA, 14 nt, Pseudomonas putida KT2440
ggccaugaucgccg

SEQ ID NO: 1622317 - RNA, 23 nt, Pseudomonas putida KT2440
ggccauuucgcggcgcagggccu

SEQ ID NO: 1622318 - RNA, 17 nt, Pseudomonas putida KT2440
ggcccacagugcuucca

SEQ ID NO: 1622319 - RNA, 15 nt, Pseudomonas putida KT2440
ggccaguaccagcag

SEQ ID NO: 1622320 - RNA, 16 nt, Pseudomonas putida KT2440
ggccaguaccagcagc

SEQ ID NO: 1622321 - RNA, 14 nt, Pseudomonas putida KT2440
ggccaguaccaggu

SEQ ID NO: 1622322 - RNA, 20 nt, Pseudomonas putida KT2440
ggccaguaccuucuggcugg

SEQ ID NO: 1622323 - RNA, 22 nt, Pseudomonas putida KT2440
ggccaguaccuucuggcuggag

SEQ ID NO: 1622324 - RNA, 22 nt, Pseudomonas putida KT2440
ggccagugagccucacacagca

SEQ ID NO: 1622325 - RNA, 23 nt, Pseudomonas putida KT2440
ggccaucugguugcuggcgccag

SEQ ID NO: 1622326 - RNA, 17 nt, Pseudomonas putida KT2440
ggccaucuaagccucca

SEQ ID NO: 1622327 - RNA, 15 nt, Pseudomonas putida KT2440
ggccagccgccgccg

SEQ ID NO: 1622328 - RNA, 14 nt, Pseudomonas putida KT2440
ggccagccggcagc

SEQ ID NO: 1622329 - RNA, 16 nt, Pseudomonas putida KT2440
ggccagccggcagcaa

SEQ ID NO: 1622330 - RNA, 17 nt, Pseudomonas putida KT2440
ggccagccggcagcaag

SEQ ID NO: 1622331 - RNA, 15 nt, Pseudomonas putida KT2440
ggccagccggcgcug

SEQ ID NO: 1622332 - RNA, 17 nt, Pseudomonas putida KT2440
ggccagcagccccccuu

SEQ ID NO: 1622333 - RNA, 19 nt, Pseudomonas putida KT2440
ggccacugguacagcucac

SEQ ID NO: 1622334 - RNA, 22 nt, Pseudomonas putida KT2440
ggccacugguacagcucacgca

SEQ ID NO: 1622335 - RNA, 17 nt, Pseudomonas putida KT2440
ggccagcacgaacagca

SEQ ID NO: 1622336 - RNA, 20 nt, Pseudomonas putida KT2440
ggccagaccuugcgcacggc

SEQ ID NO: 1622337 - RNA, 23 nt, Pseudomonas putida KT2440
ggccaccuggucgaaugcgugca

SEQ ID NO: 1622338 - RNA, 22 nt, Pseudomonas putida KT2440
ggccacgguguauccagcccgg

SEQ ID NO: 1622339 - RNA, 13 nt, Pseudomonas putida KT2440
ggccaaugcugcc

SEQ ID NO: 1622340 - RNA, 13 nt, Pseudomonas putida KT2440
ggccaauggcagg

SEQ ID NO: 1622341 - RNA, 15 nt, Pseudomonas putida KT2440
ggccaauggcaggua

SEQ ID NO: 1622342 - RNA, 21 nt, Pseudomonas putida KT2440
ggccaauggccgggauggcag

SEQ ID NO: 1622343 - RNA, 22 nt, Pseudomonas putida KT2440
ggccacacgcugcugcuggccg

SEQ ID NO: 1622344 - RNA, 17 nt, Pseudomonas putida KT2440
ggccaaucgaucugcuc

SEQ ID NO: 1622345 - RNA, 18 nt, Pseudomonas putida KT2440
ggcccggucccgcugccg

SEQ ID NO: 1622346 - RNA, 22 nt, Pseudomonas putida KT2440
ggcccggggaucuugcuggccg

SEQ ID NO: 1622347 - RNA, 15 nt, Pseudomonas putida KT2440
ggcccuucuccgccu

SEQ ID NO: 1622348 - RNA, 24 nt, Pseudomonas putida KT2440
ggcccugugcuuugagcaggcgcu

SEQ ID NO: 1622349 - RNA, 16 nt, Pseudomonas putida KT2440
ggcccuguacauccag

SEQ ID NO: 1622350 - RNA, 18 nt, Pseudomonas putida KT2440
ggcccucaagggcgcuga

SEQ ID NO: 1622351 - RNA, 14 nt, Pseudomonas putida KT2440
ggccgaaaggugca

SEQ ID NO: 1622352 - RNA, 15 nt, Pseudomonas putida KT2440
ggccgaaaccagccc

SEQ ID NO: 1622353 - RNA, 17 nt, Pseudomonas putida KT2440
ggccgaaaccagccccu

SEQ ID NO: 1622354 - RNA, 22 nt, Pseudomonas putida KT2440
ggcccuuucgcgggagacccgu

SEQ ID NO: 1622355 - RNA, 18 nt, Pseudomonas putida KT2440
ggcccuuucgcgggcgcg

SEQ ID NO: 1622356 - RNA, 23 nt, Pseudomonas putida KT2440
ggcccuuucgcggguaaacccgc

SEQ ID NO: 1622357 - RNA, 19 nt, Pseudomonas putida KT2440
ggccgaacaccgccagccc

SEQ ID NO: 1622358 - RNA, 13 nt, Pseudomonas putida KT2440
ggccccucgacca

SEQ ID NO: 1622359 - RNA, 15 nt, Pseudomonas putida KT2440
ggccccugcaacagg

SEQ ID NO: 1622360 - RNA, 21 nt, Pseudomonas putida KT2440
ggccccugugggagcgggggc

SEQ ID NO: 1622361 - RNA, 22 nt, Pseudomonas putida KT2440
ggccccugugggagcgggggcg

SEQ ID NO: 1622362 - RNA, 21 nt, Pseudomonas putida KT2440
ggcccgacaaagaagcgccgc

SEQ ID NO: 1622363 - RNA, 16 nt, Pseudomonas putida KT2440
ggcccgaccucacgca

SEQ ID NO: 1622364 - RNA, 19 nt, Pseudomonas putida KT2440
ggcccgccgccaccagcgc

SEQ ID NO: 1622365 - RNA, 20 nt, Pseudomonas putida KT2440
ggcccgccgccaccagcgcc

SEQ ID NO: 1622366 - RNA, 15 nt, Pseudomonas putida KT2440
ggcccgacuccaccg

SEQ ID NO: 1622367 - RNA, 13 nt, Pseudomonas putida KT2440
ggcccgagccccc

SEQ ID NO: 1622368 - RNA, 16 nt, Pseudomonas putida KT2440
ggcccgaaacaaaugu

SEQ ID NO: 1622369 - RNA, 15 nt, Pseudomonas putida KT2440
ggcccgccgcgcggc

SEQ ID NO: 1622370 - RNA, 22 nt, Pseudomonas putida KT2440
ggcccgccccuuuagcaggcaa

SEQ ID NO: 1622371 - RNA, 13 nt, Pseudomonas putida KT2440
ggcccgcccagcu

SEQ ID NO: 1622372 - RNA, 16 nt, Pseudomonas putida KT2440
ggcccgcccagcuggc

SEQ ID NO: 1622373 - RNA, 18 nt, Pseudomonas putida KT2440
ggcccgcccagcuggcuc

SEQ ID NO: 1622374 - RNA, 18 nt, Pseudomonas putida KT2440
ggcccgcgaugccgacag

SEQ ID NO: 1622375 - RNA, 18 nt, Pseudomonas putida KT2440
ggcccgcgccgacagccu

SEQ ID NO: 1622376 - RNA, 16 nt, Pseudomonas putida KT2440
ggccgcgaagcggccc

SEQ ID NO: 1622377 - RNA, 16 nt, Pseudomonas putida KT2440
ggccgcgacgcggccc

SEQ ID NO: 1622378 - RNA, 20 nt, Pseudomonas putida KT2440
ggccgcgacgcggcccuggg

SEQ ID NO: 1622379 - RNA, 14 nt, Pseudomonas putida KT2440
ggccgcgcaggaag

SEQ ID NO: 1622380 - RNA, 12 nt, Pseudomonas putida KT2440
ggccgcgcaggc

SEQ ID NO: 1622381 - RNA, 14 nt, Pseudomonas putida KT2440
ggccgcgcagccuu

SEQ ID NO: 1622382 - RNA, 22 nt, Pseudomonas putida KT2440
ggccgacgucaguucggcggcc

SEQ ID NO: 1622383 - RNA, 19 nt, Pseudomonas putida KT2440
ggccgacucuucaccagcu

SEQ ID NO: 1622384 - RNA, 13 nt, Pseudomonas putida KT2440
ggccgagcaggag

SEQ ID NO: 1622385 - RNA, 17 nt, Pseudomonas putida KT2440
ggccgccaauagcccgc

SEQ ID NO: 1622386 - RNA, 23 nt, Pseudomonas putida KT2440
ggccgccaauagcccgcuggccg

SEQ ID NO: 1622387 - RNA, 13 nt, Pseudomonas putida KT2440
ggccgcccugcgg

SEQ ID NO: 1622388 - RNA, 14 nt, Pseudomonas putida KT2440
ggccgguacaggcu

SEQ ID NO: 1622389 - RNA, 22 nt, Pseudomonas putida KT2440
ggccggggccgcuuggcggccc

SEQ ID NO: 1622390 - RNA, 15 nt, Pseudomonas putida KT2440
ggccgggucgaaggc

SEQ ID NO: 1622391 - RNA, 20 nt, Pseudomonas putida KT2440
ggccgggucgauagccagcc

SEQ ID NO: 1622392 - RNA, 15 nt, Pseudomonas putida KT2440
ggccgggcucggccg

SEQ ID NO: 1622393 - RNA, 23 nt, Pseudomonas putida KT2440
ggccggcucuaucuucaggcauc

SEQ ID NO: 1622394 - RNA, 22 nt, Pseudomonas putida KT2440
ggccgguguggccaaggcggcg

SEQ ID NO: 1622395 - RNA, 19 nt, Pseudomonas putida KT2440
ggccgguuaaaacccaggc

SEQ ID NO: 1622396 - RNA, 13 nt, Pseudomonas putida KT2440
ggccgguggcuuc

SEQ ID NO: 1622397 - RNA, 19 nt, Pseudomonas putida KT2440
ggccggucguuacccacca

SEQ ID NO: 1622398 - RNA, 21 nt, Pseudomonas putida KT2440
ggccggucguuacccaccagc

SEQ ID NO: 1622399 - RNA, 16 nt, Pseudomonas putida KT2440
ggccggucccaauaau

SEQ ID NO: 1622400 - RNA, 22 nt, Pseudomonas putida KT2440
ggccgucaccgcugccgaucag

SEQ ID NO: 1622401 - RNA, 13 nt, Pseudomonas putida KT2440
ggccguccagcug

SEQ ID NO: 1622402 - RNA, 14 nt, Pseudomonas putida KT2440
ggccgucgcggcug

SEQ ID NO: 1622403 - RNA, 17 nt, Pseudomonas putida KT2440
ggccgcgcuuggcggcc

SEQ ID NO: 1622404 - RNA, 17 nt, Pseudomonas putida KT2440
ggccgcgucgcggcccc

SEQ ID NO: 1622405 - RNA, 17 nt, Pseudomonas putida KT2440
ggccgcguaccagcagg

SEQ ID NO: 1622406 - RNA, 17 nt, Pseudomonas putida KT2440
ggccgcggcugaacacg

SEQ ID NO: 1622407 - RNA, 18 nt, Pseudomonas putida KT2440
ggccgcguucgcccaggc

SEQ ID NO: 1622408 - RNA, 22 nt, Pseudomonas putida KT2440
ggccgcucaccggccagcgcgc

SEQ ID NO: 1622409 - RNA, 18 nt, Pseudomonas putida KT2440
ggccgcuacgcgccccuu

SEQ ID NO: 1622410 - RNA, 15 nt, Pseudomonas putida KT2440
ggccgcugugggagu

SEQ ID NO: 1622411 - RNA, 19 nt, Pseudomonas putida KT2440
ggccggccccacgcaguug

SEQ ID NO: 1622412 - RNA, 18 nt, Pseudomonas putida KT2440
ggccggcccugcuggcca

SEQ ID NO: 1622413 - RNA, 13 nt, Pseudomonas putida KT2440
ggccggccccggc

SEQ ID NO: 1622414 - RNA, 12 nt, Pseudomonas putida KT2440
ggccggccgggc

SEQ ID NO: 1622415 - RNA, 18 nt, Pseudomonas putida KT2440
ggccggcgcagauggugg

SEQ ID NO: 1622416 - RNA, 17 nt, Pseudomonas putida KT2440
ggccggcaccgacagca

SEQ ID NO: 1622417 - RNA, 15 nt, Pseudomonas putida KT2440
ggccggcacugacca

SEQ ID NO: 1622418 - RNA, 19 nt, Pseudomonas putida KT2440
ggccggcacagacaccaca

SEQ ID NO: 1622419 - RNA, 17 nt, Pseudomonas putida KT2440
ggccggcacagaccgca

SEQ ID NO: 1622420 - RNA, 20 nt, Pseudomonas putida KT2440
ggccggcacaggcccaaaca

SEQ ID NO: 1622421 - RNA, 23 nt, Pseudomonas putida KT2440
ggccggcagccagggccugaccg

SEQ ID NO: 1622422 - RNA, 13 nt, Pseudomonas putida KT2440
ggccggacgacgc

SEQ ID NO: 1622423 - RNA, 16 nt, Pseudomonas putida KT2440
ggccgcuuugcggccc

SEQ ID NO: 1622424 - RNA, 12 nt, Pseudomonas putida KT2440
ggcgaugaaagc

SEQ ID NO: 1622425 - RNA, 14 nt, Pseudomonas putida KT2440
ggcgaugccgcgcg

SEQ ID NO: 1622426 - RNA, 21 nt, Pseudomonas putida KT2440
ggcgcaaauugcccggccagc

SEQ ID NO: 1622427 - RNA, 22 nt, Pseudomonas putida KT2440
ggcgcaaauugcccggccagcg

SEQ ID NO: 1622428 - RNA, 15 nt, Pseudomonas putida KT2440
ggcgauucaggcuuu

SEQ ID NO: 1622429 - RNA, 14 nt, Pseudomonas putida KT2440
ggcgaucagggugu

SEQ ID NO: 1622430 - RNA, 14 nt, Pseudomonas putida KT2440
ggcgaucaggcagg

SEQ ID NO: 1622431 - RNA, 20 nt, Pseudomonas putida KT2440
ggcgaucaggcaggccagca

SEQ ID NO: 1622432 - RNA, 21 nt, Pseudomonas putida KT2440
ggcgaucaggcaggccagcac

SEQ ID NO: 1622433 - RNA, 18 nt, Pseudomonas putida KT2440
ggcgauauggcuccacca

SEQ ID NO: 1622434 - RNA, 14 nt, Pseudomonas putida KT2440
ggcgccacccagaa

SEQ ID NO: 1622435 - RNA, 23 nt, Pseudomonas putida KT2440
ggcgccaccggucgccuguagga

SEQ ID NO: 1622436 - RNA, 15 nt, Pseudomonas putida KT2440
ggcgcaucgacgggc

SEQ ID NO: 1622437 - RNA, 18 nt, Pseudomonas putida KT2440
ggcgcaggccgcuggccg

SEQ ID NO: 1622438 - RNA, 18 nt, Pseudomonas putida KT2440
ggcgcagggugucggugg

SEQ ID NO: 1622439 - RNA, 23 nt, Pseudomonas putida KT2440
ggcgcagggugucgguggcggcc

SEQ ID NO: 1622440 - RNA, 19 nt, Pseudomonas putida KT2440
ggcgcaggugcagccagcc

SEQ ID NO: 1622441 - RNA, 21 nt, Pseudomonas putida KT2440
ggcgcaguggucauagucacc

SEQ ID NO: 1622442 - RNA, 19 nt, Pseudomonas putida KT2440
ggcgcagcaaggucgccgc

SEQ ID NO: 1622443 - RNA, 16 nt, Pseudomonas putida KT2440
ggcgcagcagguccag

SEQ ID NO: 1622444 - RNA, 19 nt, Pseudomonas putida KT2440
ggcgcagccguucuggcca

SEQ ID NO: 1622445 - RNA, 20 nt, Pseudomonas putida KT2440
ggcgcaauccgugagccagg

SEQ ID NO: 1622446 - RNA, 21 nt, Pseudomonas putida KT2440
ggcgcaaugaaaaagccccug

SEQ ID NO: 1622447 - RNA, 15 nt, Pseudomonas putida KT2440
ggcgcaccagcggcu

SEQ ID NO: 1622448 - RNA, 19 nt, Pseudomonas putida KT2440
ggcgcacagaacaccacca

SEQ ID NO: 1622449 - RNA, 16 nt, Pseudomonas putida KT2440
ggcgcaccgagcgcuc

SEQ ID NO: 1622450 - RNA, 13 nt, Pseudomonas putida KT2440
ggcgccgccaggc

SEQ ID NO: 1622451 - RNA, 16 nt, Pseudomonas putida KT2440
ggcgccgccaggcagc

SEQ ID NO: 1622452 - RNA, 18 nt, Pseudomonas putida KT2440
ggcgccgccaggcagcag

SEQ ID NO: 1622453 - RNA, 18 nt, Pseudomonas putida KT2440
ggcgccgagcgcggcgcc

SEQ ID NO: 1622454 - RNA, 23 nt, Pseudomonas putida KT2440
ggcgccgagcgcggcgcccagca

SEQ ID NO: 1622455 - RNA, 14 nt, Pseudomonas putida KT2440
ggcgcccugcgcca

SEQ ID NO: 1622456 - RNA, 17 nt, Pseudomonas putida KT2440
ggcgcccgggccaugcu

SEQ ID NO: 1622457 - RNA, 22 nt, Pseudomonas putida KT2440
ggcgcccggcagaucgagcgcc

SEQ ID NO: 1622458 - RNA, 18 nt, Pseudomonas putida KT2440
ggcgccaucgcccacggc

SEQ ID NO: 1622459 - RNA, 16 nt, Pseudomonas putida KT2440
ggcgcgaacagggccu

SEQ ID NO: 1622460 - RNA, 20 nt, Pseudomonas putida KT2440
ggcgcgaaaagccugcacca

SEQ ID NO: 1622461 - RNA, 18 nt, Pseudomonas putida KT2440
ggcgcgaccaucaccgcc

SEQ ID NO: 1622462 - RNA, 13 nt, Pseudomonas putida KT2440
ggcgcgacagcgu

SEQ ID NO: 1622463 - RNA, 16 nt, Pseudomonas putida KT2440
ggcgcgcagcgcacuu

SEQ ID NO: 1622464 - RNA, 21 nt, Pseudomonas putida KT2440
ggcgcgaucacgcacugguca

SEQ ID NO: 1622465 - RNA, 22 nt, Pseudomonas putida KT2440
ggcgcgaucaucgaagccagua

SEQ ID NO: 1622466 - RNA, 22 nt, Pseudomonas putida KT2440
ggcgccgguggcggccgcagcc

SEQ ID NO: 1622467 - RNA, 15 nt, Pseudomonas putida KT2440
ggcgccggacuucuu

SEQ ID NO: 1622468 - RNA, 16 nt, Pseudomonas putida KT2440
ggccucgaacauggcc

SEQ ID NO: 1622469 - RNA, 11 nt, Pseudomonas putida KT2440
ggccuccagca

SEQ ID NO: 1622470 - RNA, 12 nt, Pseudomonas putida KT2440
ggccuccaggua

SEQ ID NO: 1622471 - RNA, 23 nt, Pseudomonas putida KT2440
ggccuccaccaccugcaggguca

SEQ ID NO: 1622472 - RNA, 11 nt, Pseudomonas putida KT2440
ggccuccucga

SEQ ID NO: 1622473 - RNA, 11 nt, Pseudomonas putida KT2440
ggccuccucgc

SEQ ID NO: 1622474 - RNA, 14 nt, Pseudomonas putida KT2440
ggccuccucgcggg

SEQ ID NO: 1622475 - RNA, 23 nt, Pseudomonas putida KT2440
ggccuccucgcgggcaaacccgc

SEQ ID NO: 1622476 - RNA, 16 nt, Pseudomonas putida KT2440
ggccucuucgcggccu

SEQ ID NO: 1622477 - RNA, 17 nt, Pseudomonas putida KT2440
ggccucuucgcggccuu

SEQ ID NO: 1622478 - RNA, 15 nt, Pseudomonas putida KT2440
ggccucuucgcgggc

SEQ ID NO: 1622479 - RNA, 23 nt, Pseudomonas putida KT2440
ggccucuucgcggguaaacccgc

SEQ ID NO: 1622480 - RNA, 19 nt, Pseudomonas putida KT2440
ggccucggcgaucgccagg

SEQ ID NO: 1622481 - RNA, 20 nt, Pseudomonas putida KT2440
ggccucggcgaucgccaggu

SEQ ID NO: 1622482 - RNA, 22 nt, Pseudomonas putida KT2440
ggccguggucgccuucacugcg

SEQ ID NO: 1622483 - RNA, 23 nt, Pseudomonas putida KT2440
ggccuauucgcggguaaacccgc

SEQ ID NO: 1622484 - RNA, 14 nt, Pseudomonas putida KT2440
ggccucagccggcu

SEQ ID NO: 1622485 - RNA, 16 nt, Pseudomonas putida KT2440
ggccuagcaaggccuc

SEQ ID NO: 1622486 - RNA, 19 nt, Pseudomonas putida KT2440
ggccuagcaaggccuccag

SEQ ID NO: 1622487 - RNA, 17 nt, Pseudomonas putida KT2440
ggccugggucagcuggu

SEQ ID NO: 1622488 - RNA, 11 nt, Pseudomonas putida KT2440
ggccugugccg

SEQ ID NO: 1622489 - RNA, 13 nt, Pseudomonas putida KT2440
ggccugugccggc

SEQ ID NO: 1622490 - RNA, 13 nt, Pseudomonas putida KT2440
ggccuguccaggc

SEQ ID NO: 1622491 - RNA, 14 nt, Pseudomonas putida KT2440
ggccuguccaggca

SEQ ID NO: 1622492 - RNA, 23 nt, Pseudomonas putida KT2440
ggccugggcuucuaccugagcuu

SEQ ID NO: 1622493 - RNA, 15 nt, Pseudomonas putida KT2440
ggccuucgaagaaca

SEQ ID NO: 1622494 - RNA, 19 nt, Pseudomonas putida KT2440
ggccuucaaccucacuggc

SEQ ID NO: 1622495 - RNA, 20 nt, Pseudomonas putida KT2440
ggccuucaagcuccccagca

SEQ ID NO: 1622496 - RNA, 16 nt, Pseudomonas putida KT2440
ggccuuggccgcuggc

SEQ ID NO: 1622497 - RNA, 15 nt, Pseudomonas putida KT2440
ggccuugcucaauuu

SEQ ID NO: 1622498 - RNA, 14 nt, Pseudomonas putida KT2440
ggccuugcuccagu

SEQ ID NO: 1622499 - RNA, 14 nt, Pseudomonas putida KT2440
ggccugcucgcugg

SEQ ID NO: 1622500 - RNA, 12 nt, Pseudomonas putida KT2440
ggccugcugccg

SEQ ID NO: 1622501 - RNA, 14 nt, Pseudomonas putida KT2440
ggccuggccaagcg

SEQ ID NO: 1622502 - RNA, 15 nt, Pseudomonas putida KT2440
ggccugcaagccggc

SEQ ID NO: 1622503 - RNA, 11 nt, Pseudomonas putida KT2440
ggccugcagcc

SEQ ID NO: 1622504 - RNA, 13 nt, Pseudomonas putida KT2440
ggccugcaggcag

SEQ ID NO: 1622505 - RNA, 14 nt, Pseudomonas putida KT2440
ggccugcaggcagc

SEQ ID NO: 1622506 - RNA, 22 nt, Pseudomonas putida KT2440
ggccugcauccacaccagcggc

SEQ ID NO: 1622507 - RNA, 23 nt, Pseudomonas putida KT2440
ggccugcauccacaccagcggcg

SEQ ID NO: 1622508 - RNA, 12 nt, Pseudomonas putida KT2440
ggccugcauuca

SEQ ID NO: 1622509 - RNA, 16 nt, Pseudomonas putida KT2440
ggcgacuucgugcgcu

SEQ ID NO: 1622510 - RNA, 15 nt, Pseudomonas putida KT2440
ggcgagcgcgcaggc

SEQ ID NO: 1622511 - RNA, 17 nt, Pseudomonas putida KT2440
ggcgagcgcgcaggcgg

SEQ ID NO: 1622512 - RNA, 22 nt, Pseudomonas putida KT2440
ggcgagcgcaggaacaggcuga

SEQ ID NO: 1622513 - RNA, 14 nt, Pseudomonas putida KT2440
ggcgaggacagcau

SEQ ID NO: 1622514 - RNA, 14 nt, Pseudomonas putida KT2440
ggcgacgagccagu

SEQ ID NO: 1622515 - RNA, 24 nt, Pseudomonas putida KT2440
ggcgacgaguuuaccuccaucacc

SEQ ID NO: 1622516 - RNA, 22 nt, Pseudomonas putida KT2440
ggcgacgcaucugcacuuucac

SEQ ID NO: 1622517 - RNA, 23 nt, Pseudomonas putida KT2440
ggcgacacuugguccagggccau

SEQ ID NO: 1622518 - RNA, 13 nt, Pseudomonas putida KT2440
ggcgaaugcgccc

SEQ ID NO: 1622519 - RNA, 20 nt, Pseudomonas putida KT2440
ggcgaagacggcagaucagg

SEQ ID NO: 1622520 - RNA, 17 nt, Pseudomonas putida KT2440
ggcgaagaccgccgccc

SEQ ID NO: 1622521 - RNA, 17 nt, Pseudomonas putida KT2440
ggcgaacgccugcaggg

SEQ ID NO: 1622522 - RNA, 22 nt, Pseudomonas putida KT2440
ggcgaacgccugcagggccugg

SEQ ID NO: 1622523 - RNA, 12 nt, Pseudomonas putida KT2440
ggcgaacagcaa

SEQ ID NO: 1622524 - RNA, 22 nt, Pseudomonas putida KT2440
ggcgaacgccacggcggcaucc

SEQ ID NO: 1622525 - RNA, 14 nt, Pseudomonas putida KT2440
ggcgaaagccagca

SEQ ID NO: 1622526 - RNA, 21 nt, Pseudomonas putida KT2440
ggccuuguuauccaggcuggc

SEQ ID NO: 1622527 - RNA, 18 nt, Pseudomonas putida KT2440
ggccuuuucauauggcuc

SEQ ID NO: 1622528 - RNA, 13 nt, Pseudomonas putida KT2440
ggcuauccuucug

SEQ ID NO: 1622529 - RNA, 16 nt, Pseudomonas putida KT2440
ggcuaucggacgauga

SEQ ID NO: 1622530 - RNA, 16 nt, Pseudomonas putida KT2440
ggcuaauggcgcgccu

SEQ ID NO: 1622531 - RNA, 19 nt, Pseudomonas putida KT2440
ggcuacgaaccgagcgguc

SEQ ID NO: 1622532 - RNA, 23 nt, Pseudomonas putida KT2440
ggcuacgaucaaaugaucgccag

SEQ ID NO: 1622533 - RNA, 22 nt, Pseudomonas putida KT2440
ggcuaaaaauugcuuggcggcu

SEQ ID NO: 1622534 - RNA, 21 nt, Pseudomonas putida KT2440
ggcuaaaaccgguucagucgg

SEQ ID NO: 1622535 - RNA, 19 nt, Pseudomonas putida KT2440
ggcguuguguugcugggcg

SEQ ID NO: 1622536 - RNA, 15 nt, Pseudomonas putida KT2440
ggcguugucagccuu

SEQ ID NO: 1622537 - RNA, 14 nt, Pseudomonas putida KT2440
ggcguuggcugccg

SEQ ID NO: 1622538 - RNA, 16 nt, Pseudomonas putida KT2440
ggcguguccagcaggu

SEQ ID NO: 1622539 - RNA, 23 nt, Pseudomonas putida KT2440
ggcguucagcuugucgaccagga

SEQ ID NO: 1622540 - RNA, 22 nt, Pseudomonas putida KT2440
ggcguuaccccguugcgcagca

SEQ ID NO: 1622541 - RNA, 18 nt, Pseudomonas putida KT2440
ggcgucgaugaucaccug

SEQ ID NO: 1622542 - RNA, 15 nt, Pseudomonas putida KT2440
ggcgucgccugcaug

SEQ ID NO: 1622543 - RNA, 21 nt, Pseudomonas putida KT2440
ggcgucggccaugccaccccc

SEQ ID NO: 1622544 - RNA, 19 nt, Pseudomonas putida KT2440
ggcgucggcgcgcaacagc

SEQ ID NO: 1622545 - RNA, 16 nt, Pseudomonas putida KT2440
ggcgucggggccggag

SEQ ID NO: 1622546 - RNA, 14 nt, Pseudomonas putida KT2440
ggcgugaaauccuc

SEQ ID NO: 1622547 - RNA, 13 nt, Pseudomonas putida KT2440
ggcgugcccgcga

SEQ ID NO: 1622548 - RNA, 20 nt, Pseudomonas putida KT2440
ggcgugcccgcgaagagggc

SEQ ID NO: 1622549 - RNA, 23 nt, Pseudomonas putida KT2440
ggcgugcccgcgaagggccgcaa

SEQ ID NO: 1622550 - RNA, 21 nt, Pseudomonas putida KT2440
ggcgugcacgcuugagcgcgc

SEQ ID NO: 1622551 - RNA, 14 nt, Pseudomonas putida KT2440
ggcgugcgcccggc

SEQ ID NO: 1622552 - RNA, 17 nt, Pseudomonas putida KT2440
ggcgugcucggcaugca

SEQ ID NO: 1622553 - RNA, 13 nt, Pseudomonas putida KT2440
ggcgugcuccaca

SEQ ID NO: 1622554 - RNA, 19 nt, Pseudomonas putida KT2440
ggcguguuagccguggggc

SEQ ID NO: 1622555 - RNA, 21 nt, Pseudomonas putida KT2440
ggcguggcugcguucaggcag

SEQ ID NO: 1622556 - RNA, 20 nt, Pseudomonas putida KT2440
ggcgguguagaacggcagca

SEQ ID NO: 1622557 - RNA, 22 nt, Pseudomonas putida KT2440
ggcgguguagaacggcagcagg

SEQ ID NO: 1622558 - RNA, 20 nt, Pseudomonas putida KT2440
ggcgguguaucuccaugcug

SEQ ID NO: 1622559 - RNA, 13 nt, Pseudomonas putida KT2440
ggcggugacccgu

SEQ ID NO: 1622560 - RNA, 16 nt, Pseudomonas putida KT2440
ggcggugcgcacgaag

SEQ ID NO: 1622561 - RNA, 18 nt, Pseudomonas putida KT2440
ggcguaccugccccccca

SEQ ID NO: 1622562 - RNA, 14 nt, Pseudomonas putida KT2440
ggcguaccuggcug

SEQ ID NO: 1622563 - RNA, 13 nt, Pseudomonas putida KT2440
ggcguccacugca

SEQ ID NO: 1622564 - RNA, 13 nt, Pseudomonas putida KT2440
ggcgucacgcagg

SEQ ID NO: 1622565 - RNA, 14 nt, Pseudomonas putida KT2440
ggcgucagccgcgg

SEQ ID NO: 1622566 - RNA, 24 nt, Pseudomonas putida KT2440
ggcgucagucgccaaccgccagca

SEQ ID NO: 1622567 - RNA, 19 nt, Pseudomonas putida KT2440
ggcgucauccugcgcggcc

SEQ ID NO: 1622568 - RNA, 19 nt, Pseudomonas putida KT2440
ggcgggcaaacuggcgccc

SEQ ID NO: 1622569 - RNA, 12 nt, Pseudomonas putida KT2440
ggcgggccgccg

SEQ ID NO: 1622570 - RNA, 22 nt, Pseudomonas putida KT2440
ggcgggcggagauuggccagca

SEQ ID NO: 1622571 - RNA, 17 nt, Pseudomonas putida KT2440
ggcggcuuccagggcug

SEQ ID NO: 1622572 - RNA, 18 nt, Pseudomonas putida KT2440
ggcggcuuccagggcugg

SEQ ID NO: 1622573 - RNA, 19 nt, Pseudomonas putida KT2440
ggcggcuuccagggcuggu

SEQ ID NO: 1622574 - RNA, 13 nt, Pseudomonas putida KT2440
ggcggcugagccg

SEQ ID NO: 1622575 - RNA, 17 nt, Pseudomonas putida KT2440
ggcggcugucgcagaag

SEQ ID NO: 1622576 - RNA, 18 nt, Pseudomonas putida KT2440
ggcggcuuucagcgccgc

SEQ ID NO: 1622577 - RNA, 22 nt, Pseudomonas putida KT2440
ggcgguaaacguggucagccac

SEQ ID NO: 1622578 - RNA, 17 nt, Pseudomonas putida KT2440
ggcgggguuuuuucuau

SEQ ID NO: 1622579 - RNA, 14 nt, Pseudomonas putida KT2440
ggcgguccagcaag

SEQ ID NO: 1622580 - RNA, 21 nt, Pseudomonas putida KT2440
ggcgguccagcaagcucauca

SEQ ID NO: 1622581 - RNA, 19 nt, Pseudomonas putida KT2440
ggcgguauucacaccugcc

SEQ ID NO: 1622582 - RNA, 20 nt, Pseudomonas putida KT2440
ggcgguacuggaagagcagg

SEQ ID NO: 1622583 - RNA, 22 nt, Pseudomonas putida KT2440
ggcgguacuggaagagcaggaa

SEQ ID NO: 1622584 - RNA, 23 nt, Pseudomonas putida KT2440
ggcgguacuggaagagcaggaag

SEQ ID NO: 1622585 - RNA, 16 nt, Pseudomonas putida KT2440
ggcgcuccuccagcca

SEQ ID NO: 1622586 - RNA, 14 nt, Pseudomonas putida KT2440
ggcgcuccaucaug

SEQ ID NO: 1622587 - RNA, 15 nt, Pseudomonas putida KT2440
ggcgcuccagcaggg

SEQ ID NO: 1622588 - RNA, 13 nt, Pseudomonas putida KT2440
ggcgcuccagcac

SEQ ID NO: 1622589 - RNA, 22 nt, Pseudomonas putida KT2440
ggcgcguuucgaucucgccaau

SEQ ID NO: 1622590 - RNA, 16 nt, Pseudomonas putida KT2440
ggcgcguguagcccgc

SEQ ID NO: 1622591 - RNA, 23 nt, Pseudomonas putida KT2440
ggcgcgugucaggagggccguag

SEQ ID NO: 1622592 - RNA, 20 nt, Pseudomonas putida KT2440
ggcgcgugccgcaugugcca

SEQ ID NO: 1622593 - RNA, 17 nt, Pseudomonas putida KT2440
ggcgcugcguuggccau

SEQ ID NO: 1622594 - RNA, 19 nt, Pseudomonas putida KT2440
ggcgcuggcgccagccgcc

SEQ ID NO: 1622595 - RNA, 14 nt, Pseudomonas putida KT2440
ggcgcuggccaggc

SEQ ID NO: 1622596 - RNA, 15 nt, Pseudomonas putida KT2440
ggcgcuggccaggcu

SEQ ID NO: 1622597 - RNA, 19 nt, Pseudomonas putida KT2440
ggcgcuugaucugccaggc

SEQ ID NO: 1622598 - RNA, 14 nt, Pseudomonas putida KT2440
ggcgcuugaagaag

SEQ ID NO: 1622599 - RNA, 15 nt, Pseudomonas putida KT2440
ggcgcuuugcgcccc

SEQ ID NO: 1622600 - RNA, 15 nt, Pseudomonas putida KT2440
ggcgcgcgccugggu

SEQ ID NO: 1622601 - RNA, 13 nt, Pseudomonas putida KT2440
ggcgcgcgcgacc

SEQ ID NO: 1622602 - RNA, 18 nt, Pseudomonas putida KT2440
ggcgcggaauucgcggcg

SEQ ID NO: 1622603 - RNA, 19 nt, Pseudomonas putida KT2440
ggcgcgcggcucggccacc

SEQ ID NO: 1622604 - RNA, 21 nt, Pseudomonas putida KT2440
ggcgcggugcggcgacagggc

SEQ ID NO: 1622605 - RNA, 20 nt, Pseudomonas putida KT2440
ggcgcggucaagcucguccu

SEQ ID NO: 1622606 - RNA, 22 nt, Pseudomonas putida KT2440
ggcgcggugccggcagcucgcg

SEQ ID NO: 1622607 - RNA, 20 nt, Pseudomonas putida KT2440
ggcgcguaguacuccagcag

SEQ ID NO: 1622608 - RNA, 13 nt, Pseudomonas putida KT2440
ggcgcggccgggc

SEQ ID NO: 1622609 - RNA, 16 nt, Pseudomonas putida KT2440
ggcgcgggcgcaggca

SEQ ID NO: 1622610 - RNA, 14 nt, Pseudomonas putida KT2440
ggcgcgggcacccu

SEQ ID NO: 1622611 - RNA, 16 nt, Pseudomonas putida KT2440
ggcgcggcguggccuc

SEQ ID NO: 1622612 - RNA, 12 nt, Pseudomonas putida KT2440
ggcggcgugagc

SEQ ID NO: 1622613 - RNA, 15 nt, Pseudomonas putida KT2440
ggcggcuaagcgcca

SEQ ID NO: 1622614 - RNA, 17 nt, Pseudomonas putida KT2440
ggcggcuaagcgccagc

SEQ ID NO: 1622615 - RNA, 22 nt, Pseudomonas putida KT2440
ggcggcgcucgaucucacaggc

SEQ ID NO: 1622616 - RNA, 12 nt, Pseudomonas putida KT2440
ggcggcccagcc

SEQ ID NO: 1622617 - RNA, 22 nt, Pseudomonas putida KT2440
ggcggccuuggcucgacacgcu

SEQ ID NO: 1622618 - RNA, 12 nt, Pseudomonas putida KT2440
ggcggccagcac

SEQ ID NO: 1622619 - RNA, 11 nt, Pseudomonas putida KT2440
ggcggccagcg

SEQ ID NO: 1622620 - RNA, 16 nt, Pseudomonas putida KT2440
ggcggcccgccggcaa

SEQ ID NO: 1622621 - RNA, 15 nt, Pseudomonas putida KT2440
ggcggccaaacugga

SEQ ID NO: 1622622 - RNA, 23 nt, Pseudomonas putida KT2440
ggcggccacggcaauggcccgcu

SEQ ID NO: 1622623 - RNA, 18 nt, Pseudomonas putida KT2440
ggcggcagcgcgggcaga

SEQ ID NO: 1622624 - RNA, 15 nt, Pseudomonas putida KT2440
ggcggcaggcgcagc

SEQ ID NO: 1622625 - RNA, 17 nt, Pseudomonas putida KT2440
ggcggaucagcgcgucc

SEQ ID NO: 1622626 - RNA, 18 nt, Pseudomonas putida KT2440
ggcggaucugacggcgcu

SEQ ID NO: 1622627 - RNA, 17 nt, Pseudomonas putida KT2440
ggcggauuugcccgcua

SEQ ID NO: 1622628 - RNA, 15 nt, Pseudomonas putida KT2440
gucaggugcggggca

SEQ ID NO: 1622629 - RNA, 19 nt, Pseudomonas putida KT2440
gucaggugcggggcaaacu

SEQ ID NO: 1622630 - RNA, 22 nt, Pseudomonas putida KT2440
gucagguagccuuccagcuccu

SEQ ID NO: 1622631 - RNA, 16 nt, Pseudomonas putida KT2440
gucaggggugccuucg

SEQ ID NO: 1622632 - RNA, 19 nt, Pseudomonas putida KT2440
gucagggucucgcggcugg

SEQ ID NO: 1622633 - RNA, 23 nt, Pseudomonas putida KT2440
gucagggucucgcggcugguguc

SEQ ID NO: 1622634 - RNA, 22 nt, Pseudomonas putida KT2440
gucagggcuuuuuccagcgcca

SEQ ID NO: 1622635 - RNA, 14 nt, Pseudomonas putida KT2440
gucaguucggcggc

SEQ ID NO: 1622636 - RNA, 16 nt, Pseudomonas putida KT2440
gucaguucugcucagc

SEQ ID NO: 1622637 - RNA, 16 nt, Pseudomonas putida KT2440
gucauaguucuggcug

SEQ ID NO: 1622638 - RNA, 15 nt, Pseudomonas putida KT2440
gucagccgacagaua

SEQ ID NO: 1622639 - RNA, 21 nt, Pseudomonas putida KT2440
gucagccacauccucugcccg

SEQ ID NO: 1622640 - RNA, 16 nt, Pseudomonas putida KT2440
gucagccaccaccagc

SEQ ID NO: 1622641 - RNA, 14 nt, Pseudomonas putida KT2440
gucagcauccagcc

SEQ ID NO: 1622642 - RNA, 13 nt, Pseudomonas putida KT2440
gucagcagcaggc

SEQ ID NO: 1622643 - RNA, 14 nt, Pseudomonas putida KT2440
gucagcagcaugaa

SEQ ID NO: 1622644 - RNA, 22 nt, Pseudomonas putida KT2440
gucagccgcggugaagaccacu

SEQ ID NO: 1622645 - RNA, 21 nt, Pseudomonas putida KT2440
gucagccuuucgagagccggg

SEQ ID NO: 1622646 - RNA, 19 nt, Pseudomonas putida KT2440
gucagcguacacugcagga

SEQ ID NO: 1622647 - RNA, 22 nt, Pseudomonas putida KT2440
gucagcuugccuuccgggaaga

SEQ ID NO: 1622648 - RNA, 14 nt, Pseudomonas putida KT2440
gucagcuucugggu

SEQ ID NO: 1622649 - RNA, 12 nt, Pseudomonas putida KT2440
gucaggcucagc

SEQ ID NO: 1622650 - RNA, 23 nt, Pseudomonas putida KT2440
gucacccugacgcugcacuucca

SEQ ID NO: 1622651 - RNA, 13 nt, Pseudomonas putida KT2440
gucacccuccacg

SEQ ID NO: 1622652 - RNA, 20 nt, Pseudomonas putida KT2440
gucaccccucggcucacgcc

SEQ ID NO: 1622653 - RNA, 20 nt, Pseudomonas putida KT2440
gucaauuggagcggccuugu

SEQ ID NO: 1622654 - RNA, 19 nt, Pseudomonas putida KT2440
gucacgcccaucaggaaca

SEQ ID NO: 1622655 - RNA, 23 nt, Pseudomonas putida KT2440
gucaccgcccagcuucuccagca

SEQ ID NO: 1622656 - RNA, 15 nt, Pseudomonas putida KT2440
gucacguagaacagg

SEQ ID NO: 1622657 - RNA, 17 nt, Pseudomonas putida KT2440
gucacguagaacaggcc

SEQ ID NO: 1622658 - RNA, 13 nt, Pseudomonas putida KT2440
gucacggccaccc

SEQ ID NO: 1622659 - RNA, 21 nt, Pseudomonas putida KT2440
gucacggccacccauggcggu

SEQ ID NO: 1622660 - RNA, 14 nt, Pseudomonas putida KT2440
gucacugcgcgccg

SEQ ID NO: 1622661 - RNA, 11 nt, Pseudomonas putida KT2440
gucacugccgu

SEQ ID NO: 1622662 - RNA, 15 nt, Pseudomonas putida KT2440
gucacugagccaggc

SEQ ID NO: 1622663 - RNA, 22 nt, Pseudomonas putida KT2440
gucacucugccgccccuccacc

SEQ ID NO: 1622664 - RNA, 19 nt, Pseudomonas putida KT2440
gucagauaacccuuggcgu

SEQ ID NO: 1622665 - RNA, 17 nt, Pseudomonas putida KT2440
gucaacgaggccgccau

SEQ ID NO: 1622666 - RNA, 22 nt, Pseudomonas putida KT2440
gucaaccccaggugcugaugcc

SEQ ID NO: 1622667 - RNA, 19 nt, Pseudomonas putida KT2440
gucaagacgaagcgcuugg

SEQ ID NO: 1622668 - RNA, 18 nt, Pseudomonas putida KT2440
gucaacucgccaaaccau

SEQ ID NO: 1622669 - RNA, 11 nt, Pseudomonas putida KT2440
gucaacucauc

SEQ ID NO: 1622670 - RNA, 18 nt, Pseudomonas putida KT2440
guauuuuugcgccaggcg

SEQ ID NO: 1622671 - RNA, 23 nt, Pseudomonas putida KT2440
guccucauaaugcuccgccacca

SEQ ID NO: 1622672 - RNA, 24 nt, Pseudomonas putida KT2440
guccuggaaaagcaaggcucaggc

SEQ ID NO: 1622673 - RNA, 19 nt, Pseudomonas putida KT2440
guccuggacccgcagcagg

SEQ ID NO: 1622674 - RNA, 20 nt, Pseudomonas putida KT2440
guccuggacccgcagcaggu

SEQ ID NO: 1622675 - RNA, 22 nt, Pseudomonas putida KT2440
guccugcgcgucgacaaaccgc

SEQ ID NO: 1622676 - RNA, 22 nt, Pseudomonas putida KT2440
guccugcuccacccgugcaggg

SEQ ID NO: 1622677 - RNA, 23 nt, Pseudomonas putida KT2440
guccugcuccacccgugcagggg

SEQ ID NO: 1622678 - RNA, 14 nt, Pseudomonas putida KT2440
guccugcugcaggc

SEQ ID NO: 1622679 - RNA, 16 nt, Pseudomonas putida KT2440
guccugcugcaggcuc

SEQ ID NO: 1622680 - RNA, 14 nt, Pseudomonas putida KT2440
guccugcgccaggc

SEQ ID NO: 1622681 - RNA, 21 nt, Pseudomonas putida KT2440
guccggcaugugcacuggcag

SEQ ID NO: 1622682 - RNA, 18 nt, Pseudomonas putida KT2440
guccggcaucacuaccca

SEQ ID NO: 1622683 - RNA, 19 nt, Pseudomonas putida KT2440
guccgcccuugccaccagu

SEQ ID NO: 1622684 - RNA, 11 nt, Pseudomonas putida KT2440
gucccgcccgg

SEQ ID NO: 1622685 - RNA, 20 nt, Pseudomonas putida KT2440
gucccgcccugagccaaggc

SEQ ID NO: 1622686 - RNA, 15 nt, Pseudomonas putida KT2440
gucccgaucucccca

SEQ ID NO: 1622687 - RNA, 13 nt, Pseudomonas putida KT2440
guccgccaggaag

SEQ ID NO: 1622688 - RNA, 17 nt, Pseudomonas putida KT2440
guccgaggucagcacca

SEQ ID NO: 1622689 - RNA, 16 nt, Pseudomonas putida KT2440
guccaugaucuccacg

SEQ ID NO: 1622690 - RNA, 21 nt, Pseudomonas putida KT2440
gucccagcuggcaaugcaacu

SEQ ID NO: 1622691 - RNA, 18 nt, Pseudomonas putida KT2440
guccccuucgucuagugg

SEQ ID NO: 1622692 - RNA, 22 nt, Pseudomonas putida KT2440
guccccgcgcuuugugcacaag

SEQ ID NO: 1622693 - RNA, 13 nt, Pseudomonas putida KT2440
guccccaaccggg

SEQ ID NO: 1622694 - RNA, 16 nt, Pseudomonas putida KT2440
guccaucaccggcgag

SEQ ID NO: 1622695 - RNA, 20 nt, Pseudomonas putida KT2440
guccaucuugcugcucugca

SEQ ID NO: 1622696 - RNA, 17 nt, Pseudomonas putida KT2440
gucauucaaggucagcu

SEQ ID NO: 1622697 - RNA, 16 nt, Pseudomonas putida KT2440
gucauugaaggccagu

SEQ ID NO: 1622698 - RNA, 17 nt, Pseudomonas putida KT2440
gucgaucccgccgagca

SEQ ID NO: 1622699 - RNA, 14 nt, Pseudomonas putida KT2440
gucgaucagcgaca

SEQ ID NO: 1622700 - RNA, 17 nt, Pseudomonas putida KT2440
gucgaucagauaaguca

SEQ ID NO: 1622701 - RNA, 21 nt, Pseudomonas putida KT2440
gucgauaaaccgugcaaacaa

SEQ ID NO: 1622702 - RNA, 23 nt, Pseudomonas putida KT2440
gucgcagguucgaauccugcuga

SEQ ID NO: 1622703 - RNA, 16 nt, Pseudomonas putida KT2440
gucgcacaugaagccg

SEQ ID NO: 1622704 - RNA, 17 nt, Pseudomonas putida KT2440
gucgagguugcgcucca

SEQ ID NO: 1622705 - RNA, 16 nt, Pseudomonas putida KT2440
gucgagcugcccacca

SEQ ID NO: 1622706 - RNA, 13 nt, Pseudomonas putida KT2440
guccuugcacagu

SEQ ID NO: 1622707 - RNA, 14 nt, Pseudomonas putida KT2440
guccuugagcgccg

SEQ ID NO: 1622708 - RNA, 21 nt, Pseudomonas putida KT2440
guccuggucacggccacccau

SEQ ID NO: 1622709 - RNA, 19 nt, Pseudomonas putida KT2440
guccuuauccagacccuga

SEQ ID NO: 1622710 - RNA, 17 nt, Pseudomonas putida KT2440
gucgccggugugcaucc

SEQ ID NO: 1622711 - RNA, 12 nt, Pseudomonas putida KT2440
gucgcggcgcug

SEQ ID NO: 1622712 - RNA, 14 nt, Pseudomonas putida KT2440
gucgcggccccagg

SEQ ID NO: 1622713 - RNA, 15 nt, Pseudomonas putida KT2440
gucgccuuuuuucca

SEQ ID NO: 1622714 - RNA, 18 nt, Pseudomonas putida KT2440
gucgcgaaagggccgcaa

SEQ ID NO: 1622715 - RNA, 15 nt, Pseudomonas putida KT2440
gucgcgaaaggggcg

SEQ ID NO: 1622716 - RNA, 22 nt, Pseudomonas putida KT2440
gucgcaucgacagguccaccgc

SEQ ID NO: 1622717 - RNA, 16 nt, Pseudomonas putida KT2440
gucgccagguuggccc

SEQ ID NO: 1622718 - RNA, 21 nt, Pseudomonas putida KT2440
gucgcccgcaacaccaggaca

SEQ ID NO: 1622719 - RNA, 14 nt, Pseudomonas putida KT2440
gucgcccgcccagc

SEQ ID NO: 1622720 - RNA, 17 nt, Pseudomonas putida KT2440
gucgcccgcccagccca

SEQ ID NO: 1622721 - RNA, 19 nt, Pseudomonas putida KT2440
gucgcccgcccagcccaug

SEQ ID NO: 1622722 - RNA, 20 nt, Pseudomonas putida KT2440
gucgccgaaccccaccagca

SEQ ID NO: 1622723 - RNA, 15 nt, Pseudomonas putida KT2440
guaguucaucuucuu

SEQ ID NO: 1622724 - RNA, 12 nt, Pseudomonas putida KT2440
guaguucucgac

SEQ ID NO: 1622725 - RNA, 16 nt, Pseudomonas putida KT2440
guaguacuccagcagc

SEQ ID NO: 1622726 - RNA, 15 nt, Pseudomonas putida KT2440
guaguggaacccacu

SEQ ID NO: 1622727 - RNA, 19 nt, Pseudomonas putida KT2440
guagucggcaaucagcagg

SEQ ID NO: 1622728 - RNA, 13 nt, Pseudomonas putida KT2440
guaguccggcacg

SEQ ID NO: 1622729 - RNA, 14 nt, Pseudomonas putida KT2440
guagaucaucagcg

SEQ ID NO: 1622730 - RNA, 17 nt, Pseudomonas putida KT2440
guagaucaucagcgcca

SEQ ID NO: 1622731 - RNA, 17 nt, Pseudomonas putida KT2440
guagaucgccggcagca

SEQ ID NO: 1622732 - RNA, 19 nt, Pseudomonas putida KT2440
guagccguuugaagccaac

SEQ ID NO: 1622733 - RNA, 15 nt, Pseudomonas putida KT2440
guagccuuccagcuc

SEQ ID NO: 1622734 - RNA, 20 nt, Pseudomonas putida KT2440
guagccuuccagcuccuucu

SEQ ID NO: 1622735 - RNA, 23 nt, Pseudomonas putida KT2440
guagccuucuucggucagcuggu

SEQ ID NO: 1622736 - RNA, 22 nt, Pseudomonas putida KT2440
guagcgcccuugaacagacccc

SEQ ID NO: 1622737 - RNA, 19 nt, Pseudomonas putida KT2440
guagcgcagaucccgcucg

SEQ ID NO: 1622738 - RNA, 20 nt, Pseudomonas putida KT2440
guaggcacggucgguagccu

SEQ ID NO: 1622739 - RNA, 17 nt, Pseudomonas putida KT2440
guagcuccagcccagcg

SEQ ID NO: 1622740 - RNA, 17 nt, Pseudomonas putida KT2440
guaggccgucagcagca

SEQ ID NO: 1622741 - RNA, 20 nt, Pseudomonas putida KT2440
guaggccauuucccaaagau

SEQ ID NO: 1622742 - RNA, 15 nt, Pseudomonas putida KT2440
guaggcccagcccag

SEQ ID NO: 1622743 - RNA, 16 nt, Pseudomonas putida KT2440
guaggcgcaacucagc

SEQ ID NO: 1622744 - RNA, 19 nt, Pseudomonas putida KT2440
guaggccugcgaaaggcgc

SEQ ID NO: 1622745 - RNA, 22 nt, Pseudomonas putida KT2440
guagggaucaccgccagcagcu

SEQ ID NO: 1622746 - RNA, 14 nt, Pseudomonas putida KT2440
guaggggcuaaaac

SEQ ID NO: 1622747 - RNA, 21 nt, Pseudomonas putida KT2440
guaggucuaaccgcgcuggua

SEQ ID NO: 1622748 - RNA, 14 nt, Pseudomonas putida KT2440
guagggaaauccuc

SEQ ID NO: 1622749 - RNA, 15 nt, Pseudomonas putida KT2440
guaggcgucuuccac

SEQ ID NO: 1622750 - RNA, 19 nt, Pseudomonas putida KT2440
guaggcgucuuccacgccc

SEQ ID NO: 1622751 - RNA, 17 nt, Pseudomonas putida KT2440
guaggcgggagagcagg

SEQ ID NO: 1622752 - RNA, 13 nt, Pseudomonas putida KT2440
guacgcuggccaa

SEQ ID NO: 1622753 - RNA, 18 nt, Pseudomonas putida KT2440
guacgcuggccaaggccu

SEQ ID NO: 1622754 - RNA, 15 nt, Pseudomonas putida KT2440
guacggcagcucgag

SEQ ID NO: 1622755 - RNA, 15 nt, Pseudomonas putida KT2440
guacggcgcugagga

SEQ ID NO: 1622756 - RNA, 20 nt, Pseudomonas putida KT2440
guaccucauaguaaggcugg

SEQ ID NO: 1622757 - RNA, 17 nt, Pseudomonas putida KT2440
guaccgggcggccaccg

SEQ ID NO: 1622758 - RNA, 23 nt, Pseudomonas putida KT2440
guaccgggcggccaccggccacg

SEQ ID NO: 1622759 - RNA, 20 nt, Pseudomonas putida KT2440
guacuccacuuccagcagcu

SEQ ID NO: 1622760 - RNA, 17 nt, Pseudomonas putida KT2440
guagaccuucuggcagc

SEQ ID NO: 1622761 - RNA, 15 nt, Pseudomonas putida KT2440
guagagcccccagca

SEQ ID NO: 1622762 - RNA, 16 nt, Pseudomonas putida KT2440
guacugggcguccuuc

SEQ ID NO: 1622763 - RNA, 17 nt, Pseudomonas putida KT2440
guacuggaagagcagga

SEQ ID NO: 1622764 - RNA, 14 nt, Pseudomonas putida KT2440
guacuccagcagcg

SEQ ID NO: 1622765 - RNA, 15 nt, Pseudomonas putida KT2440
guaccgcucugcgcc

SEQ ID NO: 1622766 - RNA, 13 nt, Pseudomonas putida KT2440
guacccggcugga

SEQ ID NO: 1622767 - RNA, 14 nt, Pseudomonas putida KT2440
guaccgaccucuuc

SEQ ID NO: 1622768 - RNA, 22 nt, Pseudomonas putida KT2440
guaccccucgcugcccaacgcc

SEQ ID NO: 1622769 - RNA, 18 nt, Pseudomonas putida KT2440
guaccccuggcgcuuucc

SEQ ID NO: 1622770 - RNA, 14 nt, Pseudomonas putida KT2440
guacccgccagcaa

SEQ ID NO: 1622771 - RNA, 15 nt, Pseudomonas putida KT2440
guacccgccagcaau

SEQ ID NO: 1622772 - RNA, 20 nt, Pseudomonas putida KT2440
guacccagcucgaucagcug

SEQ ID NO: 1622773 - RNA, 22 nt, Pseudomonas putida KT2440
guaccauccaguaccagugcau

SEQ ID NO: 1622774 - RNA, 13 nt, Pseudomonas putida KT2440
guaaucuggcugu

SEQ ID NO: 1622775 - RNA, 23 nt, Pseudomonas putida KT2440
guaaucgaugaaauucaccugcc

SEQ ID NO: 1622776 - RNA, 19 nt, Pseudomonas putida KT2440
gguguuugaccaccagacg

SEQ ID NO: 1622777 - RNA, 20 nt, Pseudomonas putida KT2440
gguuaaaagccaacugcucu

SEQ ID NO: 1622778 - RNA, 18 nt, Pseudomonas putida KT2440
guaaacccgcuccuacgg

SEQ ID NO: 1622779 - RNA, 17 nt, Pseudomonas putida KT2440
guaaagcacacaacugu

SEQ ID NO: 1622780 - RNA, 15 nt, Pseudomonas putida KT2440
guaaagcgccccagg

SEQ ID NO: 1622781 - RNA, 16 nt, Pseudomonas putida KT2440
guaacccugcucgcca

SEQ ID NO: 1622782 - RNA, 21 nt, Pseudomonas putida KT2440
guaacccugcucgccaucgcc

SEQ ID NO: 1622783 - RNA, 17 nt, Pseudomonas putida KT2440
guaaccgcugccauagc

SEQ ID NO: 1622784 - RNA, 22 nt, Pseudomonas putida KT2440
guaacggucacugagccaggcc

SEQ ID NO: 1622785 - RNA, 19 nt, Pseudomonas putida KT2440
guaacggcucugacauaac

SEQ ID NO: 1622786 - RNA, 15 nt, Pseudomonas putida KT2440
guaacucaccacauc

SEQ ID NO: 1622787 - RNA, 14 nt, Pseudomonas putida KT2440
guaagauugcaggc

SEQ ID NO: 1622788 - RNA, 17 nt, Pseudomonas putida KT2440
guaagauugcaggccau

SEQ ID NO: 1622789 - RNA, 22 nt, Pseudomonas putida KT2440
guaagcccgcuccuacagggga

SEQ ID NO: 1622790 - RNA, 14 nt, Pseudomonas putida KT2440
ggucguagcgucuc

SEQ ID NO: 1622791 - RNA, 14 nt, Pseudomonas putida KT2440
ggucggccagcucg

SEQ ID NO: 1622792 - RNA, 15 nt, Pseudomonas putida KT2440
ggucuuccagcggug

SEQ ID NO: 1622793 - RNA, 18 nt, Pseudomonas putida KT2440
ggucuucaaaucgcugcg

SEQ ID NO: 1622794 - RNA, 18 nt, Pseudomonas putida KT2440
ggucuucucaggcaccag

SEQ ID NO: 1622795 - RNA, 22 nt, Pseudomonas putida KT2440
ggucuucgaucucggccagcag

SEQ ID NO: 1622796 - RNA, 17 nt, Pseudomonas putida KT2440
ggucuugucugacagca

SEQ ID NO: 1622797 - RNA, 16 nt, Pseudomonas putida KT2440
ggucuuuuggcucagg

SEQ ID NO: 1622798 - RNA, 18 nt, Pseudomonas putida KT2440
ggucuuuuggcucaggug

SEQ ID NO: 1622799 - RNA, 15 nt, Pseudomonas putida KT2440
ggugacugccagcac

SEQ ID NO: 1622800 - RNA, 20 nt, Pseudomonas putida KT2440
ggugauaccgaggaggaggc

SEQ ID NO: 1622801 - RNA, 16 nt, Pseudomonas putida KT2440
ggugaagcccugcugc

SEQ ID NO: 1622802 - RNA, 17 nt, Pseudomonas putida KT2440
ggugaaggcaggucagc

SEQ ID NO: 1622803 - RNA, 21 nt, Pseudomonas putida KT2440
ggugacgaucaccagggcauc

SEQ ID NO: 1622804 - RNA, 16 nt, Pseudomonas putida KT2440
ggugaccuuuucuaag

SEQ ID NO: 1622805 - RNA, 20 nt, Pseudomonas putida KT2440
ggugaacggcggguggaaau

SEQ ID NO: 1622806 - RNA, 19 nt, Pseudomonas putida KT2440
ggugaaagucgaccagcag

SEQ ID NO: 1622807 - RNA, 18 nt, Pseudomonas putida KT2440
ggucgacgauacccagcg

SEQ ID NO: 1622808 - RNA, 21 nt, Pseudomonas putida KT2440
ggucgaggcggcugucgcaga

SEQ ID NO: 1622809 - RNA, 12 nt, Pseudomonas putida KT2440
ggucagguggcu

SEQ ID NO: 1622810 - RNA, 15 nt, Pseudomonas putida KT2440
ggucagguggcugua

SEQ ID NO: 1622811 - RNA, 14 nt, Pseudomonas putida KT2440
ggucagcuggccuu

SEQ ID NO: 1622812 - RNA, 17 nt, Pseudomonas putida KT2440
ggucagcgcucaaaaaa

SEQ ID NO: 1622813 - RNA, 17 nt, Pseudomonas putida KT2440
ggucagcggaccaggug

SEQ ID NO: 1622814 - RNA, 18 nt, Pseudomonas putida KT2440
ggucagcggaccaggugc

SEQ ID NO: 1622815 - RNA, 15 nt, Pseudomonas putida KT2440
ggucagcguugccga

SEQ ID NO: 1622816 - RNA, 16 nt, Pseudomonas putida KT2440
ggucagcuccucugcc

SEQ ID NO: 1622817 - RNA, 15 nt, Pseudomonas putida KT2440
ggucgcuugucgcca

SEQ ID NO: 1622818 - RNA, 18 nt, Pseudomonas putida KT2440
ggucggaaggggccgcaa

SEQ ID NO: 1622819 - RNA, 18 nt, Pseudomonas putida KT2440
ggucgccgucgcacaggc

SEQ ID NO: 1622820 - RNA, 18 nt, Pseudomonas putida KT2440
ggucgaugcaggagcggc

SEQ ID NO: 1622821 - RNA, 20 nt, Pseudomonas putida KT2440
ggucgaugcaggagcggcuu

SEQ ID NO: 1622822 - RNA, 18 nt, Pseudomonas putida KT2440
ggucgaucccggacagca

SEQ ID NO: 1622823 - RNA, 16 nt, Pseudomonas putida KT2440
ggucgccagguuggcc

SEQ ID NO: 1622824 - RNA, 14 nt, Pseudomonas putida KT2440
ggucgccagcacca

SEQ ID NO: 1622825 - RNA, 15 nt, Pseudomonas putida KT2440
ggucgccaaccccac

SEQ ID NO: 1622826 - RNA, 17 nt, Pseudomonas putida KT2440
ggugcggcagcucgccg

SEQ ID NO: 1622827 - RNA, 22 nt, Pseudomonas putida KT2440
ggugcgccaguggcacccacag

SEQ ID NO: 1622828 - RNA, 15 nt, Pseudomonas putida KT2440
ggugcgccuccagca

SEQ ID NO: 1622829 - RNA, 19 nt, Pseudomonas putida KT2440
ggugcgcacgcugcccagg

SEQ ID NO: 1622830 - RNA, 23 nt, Pseudomonas putida KT2440
ggugccuaucgcucuggcacuca

SEQ ID NO: 1622831 - RNA, 18 nt, Pseudomonas putida KT2440
ggugccugcagcccggca

SEQ ID NO: 1622832 - RNA, 16 nt, Pseudomonas putida KT2440
ggugccgugcaggggc

SEQ ID NO: 1622833 - RNA, 11 nt, Pseudomonas putida KT2440
ggugccggccu

SEQ ID NO: 1622834 - RNA, 13 nt, Pseudomonas putida KT2440
ggugccggccucu

SEQ ID NO: 1622835 - RNA, 23 nt, Pseudomonas putida KT2440
ggugaucagugcggucaggccaa

SEQ ID NO: 1622836 - RNA, 17 nt, Pseudomonas putida KT2440
ggugcagcaacagguac

SEQ ID NO: 1622837 - RNA, 21 nt, Pseudomonas putida KT2440
ggugcacguagucgucagggu

SEQ ID NO: 1622838 - RNA, 18 nt, Pseudomonas putida KT2440
ggugcacgacgucgucga

SEQ ID NO: 1622839 - RNA, 14 nt, Pseudomonas putida KT2440
ggugcacgccagcc

SEQ ID NO: 1622840 - RNA, 18 nt, Pseudomonas putida KT2440
ggugcaccaacacuucca

SEQ ID NO: 1622841 - RNA, 23 nt, Pseudomonas putida KT2440
gguggaguaccugugggagcggg

SEQ ID NO: 1622842 - RNA, 16 nt, Pseudomonas putida KT2440
gguggcaccggcaccg

SEQ ID NO: 1622843 - RNA, 23 nt, Pseudomonas putida KT2440
ggugcucgaugaucaucccggcg

SEQ ID NO: 1622844 - RNA, 13 nt, Pseudomonas putida KT2440
gguggcguggcug

SEQ ID NO: 1622845 - RNA, 14 nt, Pseudomonas putida KT2440
gguggugcgcccgg

SEQ ID NO: 1622846 - RNA, 19 nt, Pseudomonas putida KT2440
ggugguaucugccgaugcg

SEQ ID NO: 1622847 - RNA, 16 nt, Pseudomonas putida KT2440
ggugucgguggcggcc

SEQ ID NO: 1622848 - RNA, 22 nt, Pseudomonas putida KT2440
ggugucggacagguuggcgccc

SEQ ID NO: 1622849 - RNA, 16 nt, Pseudomonas putida KT2440
ggugucggccagggcc

SEQ ID NO: 1622850 - RNA, 18 nt, Pseudomonas putida KT2440
gguguccuugcacucccc

SEQ ID NO: 1622851 - RNA, 15 nt, Pseudomonas putida KT2440
gguggugcugggcau

SEQ ID NO: 1622852 - RNA, 18 nt, Pseudomonas putida KT2440
ggucaccagcacgucacc

SEQ ID NO: 1622853 - RNA, 17 nt, Pseudomonas putida KT2440
ggucaccaucagccgcg

SEQ ID NO: 1622854 - RNA, 13 nt, Pseudomonas putida KT2440
ggucaccaguuca

SEQ ID NO: 1622855 - RNA, 22 nt, Pseudomonas putida KT2440
gguaugcauggguuguggcuug

SEQ ID NO: 1622856 - RNA, 22 nt, Pseudomonas putida KT2440
gguaugcgcccaucucaggccc

SEQ ID NO: 1622857 - RNA, 17 nt, Pseudomonas putida KT2440
gguauggccuuucugcu

SEQ ID NO: 1622858 - RNA, 14 nt, Pseudomonas putida KT2440
gguaucugccagca

SEQ ID NO: 1622859 - RNA, 22 nt, Pseudomonas putida KT2440
ggucagccacgucgccagcggc

SEQ ID NO: 1622860 - RNA, 22 nt, Pseudomonas putida KT2440
ggucagcgaauaguagaagcag

SEQ ID NO: 1622861 - RNA, 15 nt, Pseudomonas putida KT2440
ggucagcgacugcca

SEQ ID NO: 1622862 - RNA, 19 nt, Pseudomonas putida KT2440
ggucaccuuguccagcagg

SEQ ID NO: 1622863 - RNA, 16 nt, Pseudomonas putida KT2440
ggucacgcagagcaug

SEQ ID NO: 1622864 - RNA, 16 nt, Pseudomonas putida KT2440
ggucacgcucggccag

SEQ ID NO: 1622865 - RNA, 15 nt, Pseudomonas putida KT2440
ggucacggcugucac

SEQ ID NO: 1622866 - RNA, 13 nt, Pseudomonas putida KT2440
gguaguccuccaa

SEQ ID NO: 1622867 - RNA, 16 nt, Pseudomonas putida KT2440
gguagugcggccgggu

SEQ ID NO: 1622868 - RNA, 19 nt, Pseudomonas putida KT2440
gguagaucacaccggccgc

SEQ ID NO: 1622869 - RNA, 20 nt, Pseudomonas putida KT2440
gguagaucacaccggccgcc

SEQ ID NO: 1622870 - RNA, 18 nt, Pseudomonas putida KT2440
gguagcugcgcagguugg

SEQ ID NO: 1622871 - RNA, 20 nt, Pseudomonas putida KT2440
gguagcucgcuuuccaaacc

SEQ ID NO: 1622872 - RNA, 17 nt, Pseudomonas putida KT2440
gguaggcccagcccagc

SEQ ID NO: 1622873 - RNA, 17 nt, Pseudomonas putida KT2440
gguaggccgucagcagc

SEQ ID NO: 1622874 - RNA, 21 nt, Pseudomonas putida KT2440
gguaggucuaaccgcgcuggu

SEQ ID NO: 1622875 - RNA, 14 nt, Pseudomonas putida KT2440
gguaauccaccagc

SEQ ID NO: 1622876 - RNA, 19 nt, Pseudomonas putida KT2440
gguaaugcuggugguggcc

SEQ ID NO: 1622877 - RNA, 22 nt, Pseudomonas putida KT2440
gguaauagcggcgguucuucaa

SEQ ID NO: 1622878 - RNA, 21 nt, Pseudomonas putida KT2440
gguacagcacugcauuggcca

SEQ ID NO: 1622879 - RNA, 14 nt, Pseudomonas putida KT2440
gguacagcagcuug

SEQ ID NO: 1622880 - RNA, 14 nt, Pseudomonas putida KT2440
gguacagccagcaa

SEQ ID NO: 1622881 - RNA, 15 nt, Pseudomonas putida KT2440
gguacagccagcaaa

SEQ ID NO: 1622882 - RNA, 15 nt, Pseudomonas putida KT2440
gguaccaggcugcca

SEQ ID NO: 1622883 - RNA, 22 nt, Pseudomonas putida KT2440
gguacagcucacuggccaacuc

SEQ ID NO: 1622884 - RNA, 14 nt, Pseudomonas putida KT2440
gguaaugcccgcag

SEQ ID NO: 1622885 - RNA, 14 nt, Pseudomonas putida KT2440
gguaauugguggug

SEQ ID NO: 1622886 - RNA, 15 nt, Pseudomonas putida KT2440
gguacccgccagcaa

SEQ ID NO: 1622887 - RNA, 20 nt, Pseudomonas putida KT2440
gguacccgcguuggcagcac

SEQ ID NO: 1622888 - RNA, 17 nt, Pseudomonas putida KT2440
gguaccgugcugcaggc

SEQ ID NO: 1622889 - RNA, 19 nt, Pseudomonas putida KT2440
gguaccggccagcugcgca

SEQ ID NO: 1622890 - RNA, 15 nt, Pseudomonas putida KT2440
gguaccuguggggca

SEQ ID NO: 1622891 - RNA, 16 nt, Pseudomonas putida KT2440
gguacgcacuguagcg

SEQ ID NO: 1622892 - RNA, 22 nt, Pseudomonas putida KT2440
gguacgcagaaugugcucggcc

SEQ ID NO: 1622893 - RNA, 15 nt, Pseudomonas putida KT2440
gguacugcuucauga

SEQ ID NO: 1622894 - RNA, 16 nt, Pseudomonas putida KT2440
gguacuucucgaccag

SEQ ID NO: 1622895 - RNA, 19 nt, Pseudomonas putida KT2440
gguacucgcgacugaagcg

SEQ ID NO: 1622896 - RNA, 13 nt, Pseudomonas putida KT2440
gguagacuucugc

SEQ ID NO: 1622897 - RNA, 18 nt, Pseudomonas putida KT2440
gguaaccugguucuucgc

SEQ ID NO: 1622898 - RNA, 18 nt, Pseudomonas putida KT2440
gguaacagggaaacaaau

SEQ ID NO: 1622899 - RNA, 24 nt, Pseudomonas putida KT2440
gguaagccaugcgcaggcagcgau

SEQ ID NO: 1622900 - RNA, 15 nt, Pseudomonas putida KT2440
gguaagccggcggcc

SEQ ID NO: 1622901 - RNA, 17 nt, Pseudomonas putida KT2440
gguaacgggcaaggcug

SEQ ID NO: 1622902 - RNA, 20 nt, Pseudomonas putida KT2440
gguaacgggcaaggcuggca

SEQ ID NO: 1622903 - RNA, 21 nt, Pseudomonas putida KT2440
gguaaacccgggucaggcgca

SEQ ID NO: 1622904 - RNA, 20 nt, Pseudomonas putida KT2440
gguaaagcgcgccuccagcu

SEQ ID NO: 1622905 - RNA, 17 nt, Pseudomonas putida KT2440
gguaaaaaucaugcagu

SEQ ID NO: 1622906 - RNA, 20 nt, Pseudomonas putida KT2440
ggguugaccuuguccugccc

SEQ ID NO: 1622907 - RNA, 15 nt, Pseudomonas putida KT2440
ggguuucagugaccg

SEQ ID NO: 1622908 - RNA, 19 nt, Pseudomonas putida KT2440
ggguuuuuugugccugugu

SEQ ID NO: 1622909 - RNA, 19 nt, Pseudomonas putida KT2440
gggugcuccaccaaggcug

SEQ ID NO: 1622910 - RNA, 17 nt, Pseudomonas putida KT2440
gggugcuccaggccugc

SEQ ID NO: 1622911 - RNA, 19 nt, Pseudomonas putida KT2440
gggucuuuucuucgcccuu

SEQ ID NO: 1622912 - RNA, 17 nt, Pseudomonas putida KT2440
gggucuuccggcagggu

SEQ ID NO: 1622913 - RNA, 18 nt, Pseudomonas putida KT2440
gggucuugccggucacug

SEQ ID NO: 1622914 - RNA, 14 nt, Pseudomonas putida KT2440
gggugacaaagcgg

SEQ ID NO: 1622915 - RNA, 14 nt, Pseudomonas putida KT2440
gggugaccaccagc

SEQ ID NO: 1622916 - RNA, 23 nt, Pseudomonas putida KT2440
gggugaccaggcccagcagguag

SEQ ID NO: 1622917 - RNA, 16 nt, Pseudomonas putida KT2440
gggugaggaugaggga

SEQ ID NO: 1622918 - RNA, 20 nt, Pseudomonas putida KT2440
gggucguucggugcacggcc

SEQ ID NO: 1622919 - RNA, 13 nt, Pseudomonas putida KT2440
gggucugcccggc

SEQ ID NO: 1622920 - RNA, 14 nt, Pseudomonas putida KT2440
gggucugcccggcc

SEQ ID NO: 1622921 - RNA, 19 nt, Pseudomonas putida KT2440
gggucugcuuugcagcccu

SEQ ID NO: 1622922 - RNA, 14 nt, Pseudomonas putida KT2440
gggucuuccaccac

SEQ ID NO: 1622923 - RNA, 14 nt, Pseudomonas putida KT2440
gggucugugcagcg

SEQ ID NO: 1622924 - RNA, 15 nt, Pseudomonas putida KT2440
gggucugugcagcga

SEQ ID NO: 1622925 - RNA, 16 nt, Pseudomonas putida KT2440
ggguccugcgccaggc

SEQ ID NO: 1622926 - RNA, 22 nt, Pseudomonas putida KT2440
gggucaugucggcagccagggu

SEQ ID NO: 1622927 - RNA, 17 nt, Pseudomonas putida KT2440
gggucauccggccgacu

SEQ ID NO: 1622928 - RNA, 12 nt, Pseudomonas putida KT2440
gggucaugccac

SEQ ID NO: 1622929 - RNA, 18 nt, Pseudomonas putida KT2440
ggguccagcgcggccacg

SEQ ID NO: 1622930 - RNA, 16 nt, Pseudomonas putida KT2440
gggucaguucagccag

SEQ ID NO: 1622931 - RNA, 19 nt, Pseudomonas putida KT2440
gggucaguucagccagggu

SEQ ID NO: 1622932 - RNA, 13 nt, Pseudomonas putida KT2440
ggguacuccacca

SEQ ID NO: 1622933 - RNA, 18 nt, Pseudomonas putida KT2440
ggguacgauagggcggug

SEQ ID NO: 1622934 - RNA, 17 nt, Pseudomonas putida KT2440
ggguacgcaccuugccc

SEQ ID NO: 1622935 - RNA, 14 nt, Pseudomonas putida KT2440
ggguaggccccagg

SEQ ID NO: 1622936 - RNA, 14 nt, Pseudomonas putida KT2440
ggggacgaucugca

SEQ ID NO: 1622937 - RNA, 14 nt, Pseudomonas putida KT2440
ggggacggcagccg

SEQ ID NO: 1622938 - RNA, 18 nt, Pseudomonas putida KT2440
gggcaucgaucacuacau

SEQ ID NO: 1622939 - RNA, 19 nt, Pseudomonas putida KT2440
gggcaugagccuggccggu

SEQ ID NO: 1622940 - RNA, 20 nt, Pseudomonas putida KT2440
gggcaugagccuggccggug

SEQ ID NO: 1622941 - RNA, 22 nt, Pseudomonas putida KT2440
gggcaucggcgugcugcgucuc

SEQ ID NO: 1622942 - RNA, 14 nt, Pseudomonas putida KT2440
gggcagugcaauac

SEQ ID NO: 1622943 - RNA, 22 nt, Pseudomonas putida KT2440
gggcagugcaauaccagccugg

SEQ ID NO: 1622944 - RNA, 18 nt, Pseudomonas putida KT2440
gggcauaacgccccagca

SEQ ID NO: 1622945 - RNA, 13 nt, Pseudomonas putida KT2440
gggcaggccccug

SEQ ID NO: 1622946 - RNA, 13 nt, Pseudomonas putida KT2440
gggcaggcccggc

SEQ ID NO: 1622947 - RNA, 20 nt, Pseudomonas putida KT2440
gggccgcgucgcggccccag

SEQ ID NO: 1622948 - RNA, 18 nt, Pseudomonas putida KT2440
gggccgcguugcggcccu

SEQ ID NO: 1622949 - RNA, 14 nt, Pseudomonas putida KT2440
gggcccucaacccu

SEQ ID NO: 1622950 - RNA, 23 nt, Pseudomonas putida KT2440
gggcccggacaggggaugcgcga

SEQ ID NO: 1622951 - RNA, 14 nt, Pseudomonas putida KT2440
gggcccgcccagcu

SEQ ID NO: 1622952 - RNA, 17 nt, Pseudomonas putida KT2440
gggcccgcccagcuggc

SEQ ID NO: 1622953 - RNA, 18 nt, Pseudomonas putida KT2440
gggccccuucaaggggcc

SEQ ID NO: 1622954 - RNA, 20 nt, Pseudomonas putida KT2440
gggcaauguucgcugccagc

SEQ ID NO: 1622955 - RNA, 15 nt, Pseudomonas putida KT2440
gggcacaggcccagc

SEQ ID NO: 1622956 - RNA, 16 nt, Pseudomonas putida KT2440
gggcacaucaccagca

SEQ ID NO: 1622957 - RNA, 16 nt, Pseudomonas putida KT2440
gggaucuggccgaugc

SEQ ID NO: 1622958 - RNA, 18 nt, Pseudomonas putida KT2440
gggaucuugcuggccggu

SEQ ID NO: 1622959 - RNA, 20 nt, Pseudomonas putida KT2440
gggagcgggcuugcccgcga

SEQ ID NO: 1622960 - RNA, 17 nt, Pseudomonas putida KT2440
gggaggccgucaggccu

SEQ ID NO: 1622961 - RNA, 19 nt, Pseudomonas putida KT2440
gggagugcucgccucacag

SEQ ID NO: 1622962 - RNA, 23 nt, Pseudomonas putida KT2440
gggaacagcucuggcagcagugc

SEQ ID NO: 1622963 - RNA, 14 nt, Pseudomonas putida KT2440
gggaacagggcaga

SEQ ID NO: 1622964 - RNA, 19 nt, Pseudomonas putida KT2440
gggaaaccuccggcaucau

SEQ ID NO: 1622965 - RNA, 15 nt, Pseudomonas putida KT2440
gggcgcagagcgccc

SEQ ID NO: 1622966 - RNA, 22 nt, Pseudomonas putida KT2440
gggccuggacgcgugcaaggga

SEQ ID NO: 1622967 - RNA, 19 nt, Pseudomonas putida KT2440
gggccuuccccgugauauc

SEQ ID NO: 1622968 - RNA, 17 nt, Pseudomonas putida KT2440
gggccuucgcccgccgc

SEQ ID NO: 1622969 - RNA, 16 nt, Pseudomonas putida KT2440
gggccuugaccagcaa

SEQ ID NO: 1622970 - RNA, 14 nt, Pseudomonas putida KT2440
gggccgcuguggga

SEQ ID NO: 1622971 - RNA, 17 nt, Pseudomonas putida KT2440
gggccgcuuggcggccc

SEQ ID NO: 1622972 - RNA, 14 nt, Pseudomonas putida KT2440
gggcgacagacagg

SEQ ID NO: 1622973 - RNA, 13 nt, Pseudomonas putida KT2440
gggcgaaccaggu

SEQ ID NO: 1622974 - RNA, 17 nt, Pseudomonas putida KT2440
gggccuuggccuggggc

SEQ ID NO: 1622975 - RNA, 22 nt, Pseudomonas putida KT2440
gggcgaagcccguggcccucag

SEQ ID NO: 1622976 - RNA, 10 nt, Pseudomonas putida KT2440
gggcuuugaa

SEQ ID NO: 1622977 - RNA, 15 nt, Pseudomonas putida KT2440
gggcuuuuuccagcg

SEQ ID NO: 1622978 - RNA, 22 nt, Pseudomonas putida KT2440
gggcuuuuuuuguuggccugga

SEQ ID NO: 1622979 - RNA, 16 nt, Pseudomonas putida KT2440
ggggaagguugcaggu

SEQ ID NO: 1622980 - RNA, 23 nt, Pseudomonas putida KT2440
gggcuggcauaguccaggaagca

SEQ ID NO: 1622981 - RNA, 23 nt, Pseudomonas putida KT2440
gggcuggcauucaacgcccgccg

SEQ ID NO: 1622982 - RNA, 18 nt, Pseudomonas putida KT2440
gggcugcuuugcagccca

SEQ ID NO: 1622983 - RNA, 13 nt, Pseudomonas putida KT2440
gggcugccgcgca

SEQ ID NO: 1622984 - RNA, 18 nt, Pseudomonas putida KT2440
gggcugccgcgcagccca

SEQ ID NO: 1622985 - RNA, 22 nt, Pseudomonas putida KT2440
gggcugcgauagaacuccacca

SEQ ID NO: 1622986 - RNA, 18 nt, Pseudomonas putida KT2440
gggcugcgcggcagcccu

SEQ ID NO: 1622987 - RNA, 18 nt, Pseudomonas putida KT2440
gggcugcaaagcagcccc

SEQ ID NO: 1622988 - RNA, 19 nt, Pseudomonas putida KT2440
gggcugcaaagcagcccca

SEQ ID NO: 1622989 - RNA, 18 nt, Pseudomonas putida KT2440
gggcugcugcgcagcccu

SEQ ID NO: 1622990 - RNA, 18 nt, Pseudomonas putida KT2440
gggcugcggggcagcccc

SEQ ID NO: 1622991 - RNA, 17 nt, Pseudomonas putida KT2440
gggcgucuuccaggugg

SEQ ID NO: 1622992 - RNA, 14 nt, Pseudomonas putida KT2440
gggcgugccaggcu

SEQ ID NO: 1622993 - RNA, 16 nt, Pseudomonas putida KT2440
gggcgugccaggcuug

SEQ ID NO: 1622994 - RNA, 23 nt, Pseudomonas putida KT2440
gggcguugaucuguugcugcagg

SEQ ID NO: 1622995 - RNA, 21 nt, Pseudomonas putida KT2440
gggcgugcguuugcgaaccuc

SEQ ID NO: 1622996 - RNA, 14 nt, Pseudomonas putida KT2440
gggcgugacggcga

SEQ ID NO: 1622997 - RNA, 13 nt, Pseudomonas putida KT2440
gggcgugcucggc

SEQ ID NO: 1622998 - RNA, 19 nt, Pseudomonas putida KT2440
gggcgguugucgaccuggc

SEQ ID NO: 1622999 - RNA, 14 nt, Pseudomonas putida KT2440
gggcgcuaccgagg

SEQ ID NO: 1623000 - RNA, 14 nt, Pseudomonas putida KT2440
ggcuugugcaucag

SEQ ID NO: 1623001 - RNA, 15 nt, Pseudomonas putida KT2440
ggcuuguucagcugg

SEQ ID NO: 1623002 - RNA, 16 nt, Pseudomonas putida KT2440
ggcuuuuuccagcgcc

SEQ ID NO: 1623003 - RNA, 15 nt, Pseudomonas putida KT2440
ggcuuuuugauugug

SEQ ID NO: 1623004 - RNA, 19 nt, Pseudomonas putida KT2440
ggcuucgacaaccggggca

SEQ ID NO: 1623005 - RNA, 17 nt, Pseudomonas putida KT2440
ggcuucguggugcuggc

SEQ ID NO: 1623006 - RNA, 12 nt, Pseudomonas putida KT2440
ggcuuguagccg

SEQ ID NO: 1623007 - RNA, 18 nt, Pseudomonas putida KT2440
ggcuugucaugccuuggc

SEQ ID NO: 1623008 - RNA, 14 nt, Pseudomonas putida KT2440
ggcuuggugcucau

SEQ ID NO: 1623009 - RNA, 15 nt, Pseudomonas putida KT2440
ggcuuggcugccggc

SEQ ID NO: 1623010 - RNA, 13 nt, Pseudomonas putida KT2440
ggcuuccagcuug

SEQ ID NO: 1623011 - RNA, 16 nt, Pseudomonas putida KT2440
ggcuuccagcuuggaa

SEQ ID NO: 1623012 - RNA, 11 nt, Pseudomonas putida KT2440
ggcuuccucuu

SEQ ID NO: 1623013 - RNA, 19 nt, Pseudomonas putida KT2440
ggcuguuccucgccauggc

SEQ ID NO: 1623014 - RNA, 21 nt, Pseudomonas putida KT2440
ggcuguugcgguugccaagca

SEQ ID NO: 1623015 - RNA, 18 nt, Pseudomonas putida KT2440
ggcuguuguacggcagcu

SEQ ID NO: 1623016 - RNA, 16 nt, Pseudomonas putida KT2440
ggcuggucuccagcag

SEQ ID NO: 1623017 - RNA, 17 nt, Pseudomonas putida KT2440
ggcuggugaagcccuuc

SEQ ID NO: 1623018 - RNA, 20 nt, Pseudomonas putida KT2440
ggcugguccgggcccaugcc

SEQ ID NO: 1623019 - RNA, 22 nt, Pseudomonas putida KT2440
ggcugggucacccaggugagga

SEQ ID NO: 1623020 - RNA, 21 nt, Pseudomonas putida KT2440
ggcugggggcgcuuugcgccc

SEQ ID NO: 1623021 - RNA, 17 nt, Pseudomonas putida KT2440
ggcugggcgcggcgggc

SEQ ID NO: 1623022 - RNA, 16 nt, Pseudomonas putida KT2440
ggcugguuaugagccu

SEQ ID NO: 1623023 - RNA, 19 nt, Pseudomonas putida KT2440
ggcugguuccugggaagcu

SEQ ID NO: 1623024 - RNA, 22 nt, Pseudomonas putida KT2440
ggcugguuccugggaagcugca

SEQ ID NO: 1623025 - RNA, 13 nt, Pseudomonas putida KT2440
ggcuggcgcuucc

SEQ ID NO: 1623026 - RNA, 13 nt, Pseudomonas putida KT2440
ggcuggcccugua

SEQ ID NO: 1623027 - RNA, 11 nt, Pseudomonas putida KT2440
ggcuggccaga

SEQ ID NO: 1623028 - RNA, 14 nt, Pseudomonas putida KT2440
ggcuggccagcaag

SEQ ID NO: 1623029 - RNA, 23 nt, Pseudomonas putida KT2440
ggcuggccagcaagugccccugg

SEQ ID NO: 1623030 - RNA, 17 nt, Pseudomonas putida KT2440
ggcuggcacgugacugg

SEQ ID NO: 1623031 - RNA, 13 nt, Pseudomonas putida KT2440
ggcuggcacucca

SEQ ID NO: 1623032 - RNA, 15 nt, Pseudomonas putida KT2440
ggcuggcagccggcg

SEQ ID NO: 1623033 - RNA, 14 nt, Pseudomonas putida KT2440
ggcuggcagcuugc

SEQ ID NO: 1623034 - RNA, 15 nt, Pseudomonas putida KT2440
ggcuggcaucgccuc

SEQ ID NO: 1623035 - RNA, 18 nt, Pseudomonas putida KT2440
ggcugcuuugcagcccuu

SEQ ID NO: 1623036 - RNA, 18 nt, Pseudomonas putida KT2440
ggcuggacucgccgagaa

SEQ ID NO: 1623037 - RNA, 22 nt, Pseudomonas putida KT2440
ggcuggacucgccgagaaaugg

SEQ ID NO: 1623038 - RNA, 19 nt, Pseudomonas putida KT2440
ggcugcaggucggccagcu

SEQ ID NO: 1623039 - RNA, 20 nt, Pseudomonas putida KT2440
ggcugcaguagucgccaggc

SEQ ID NO: 1623040 - RNA, 21 nt, Pseudomonas putida KT2440
ggcugcaguagucgccaggcc

SEQ ID NO: 1623041 - RNA, 16 nt, Pseudomonas putida KT2440
ggcugcauccacccac

SEQ ID NO: 1623042 - RNA, 10 nt, Pseudomonas putida KT2440
ggcugcagca

SEQ ID NO: 1623043 - RNA, 21 nt, Pseudomonas putida KT2440
ggcugccaaaccgccccacca

SEQ ID NO: 1623044 - RNA, 12 nt, Pseudomonas putida KT2440
ggcugccacggc

SEQ ID NO: 1623045 - RNA, 21 nt, Pseudomonas putida KT2440
ggcugcgauagaacuccacca

SEQ ID NO: 1623046 - RNA, 22 nt, Pseudomonas putida KT2440
ggcugcgauagaacuccaccag

SEQ ID NO: 1623047 - RNA, 22 nt, Pseudomonas putida KT2440
ggcugccguccccaaccggguu

SEQ ID NO: 1623048 - RNA, 14 nt, Pseudomonas putida KT2440
ggcugcccugcaug

SEQ ID NO: 1623049 - RNA, 18 nt, Pseudomonas putida KT2440
ggcugcgcggcagcccuu

SEQ ID NO: 1623050 - RNA, 14 nt, Pseudomonas putida KT2440
ggcugcugccgccc

SEQ ID NO: 1623051 - RNA, 17 nt, Pseudomonas putida KT2440
ggcugcugccgccccaa

SEQ ID NO: 1623052 - RNA, 16 nt, Pseudomonas putida KT2440
ggcugcugcgcagccc

SEQ ID NO: 1623053 - RNA, 21 nt, Pseudomonas putida KT2440
ggcugcugcgguuugcucuga

SEQ ID NO: 1623054 - RNA, 17 nt, Pseudomonas putida KT2440
ggcugcuucucgcucag

SEQ ID NO: 1623055 - RNA, 19 nt, Pseudomonas putida KT2440
ggcugcgguagcgcagccu

SEQ ID NO: 1623056 - RNA, 19 nt, Pseudomonas putida KT2440
ggcugauugagcagcuggg

SEQ ID NO: 1623057 - RNA, 23 nt, Pseudomonas putida KT2440
ggcugaucucacggccauccugc

SEQ ID NO: 1623058 - RNA, 17 nt, Pseudomonas putida KT2440
ggcugagcagaccagcc

SEQ ID NO: 1623059 - RNA, 22 nt, Pseudomonas putida KT2440
ggcugaccugauacacccgcuc

SEQ ID NO: 1623060 - RNA, 17 nt, Pseudomonas putida KT2440
ggcugaaaucuuugcuu

SEQ ID NO: 1623061 - RNA, 19 nt, Pseudomonas putida KT2440
ggcugaauccuagcuucuu

SEQ ID NO: 1623062 - RNA, 22 nt, Pseudomonas putida KT2440
ggcugaccccacccuugaagac

SEQ ID NO: 1623063 - RNA, 15 nt, Pseudomonas putida KT2440
ggcucgcugaacacg

SEQ ID NO: 1623064 - RNA, 22 nt, Pseudomonas putida KT2440
ggcucgcugaacacgcaggucu

SEQ ID NO: 1623065 - RNA, 18 nt, Pseudomonas putida KT2440
ggcucgacacgcuugcga

SEQ ID NO: 1623066 - RNA, 22 nt, Pseudomonas putida KT2440
ggcucgcgcucuucaucgcggu

SEQ ID NO: 1623067 - RNA, 17 nt, Pseudomonas putida KT2440
ggcucgcccucgcggcg

SEQ ID NO: 1623068 - RNA, 19 nt, Pseudomonas putida KT2440
ggcucgcccucgcggcggc

SEQ ID NO: 1623069 - RNA, 14 nt, Pseudomonas putida KT2440
ggcucgucacugcc

SEQ ID NO: 1623070 - RNA, 13 nt, Pseudomonas putida KT2440
ggcucggccacca

SEQ ID NO: 1623071 - RNA, 18 nt, Pseudomonas putida KT2440
ggcucggccaccacuucu

SEQ ID NO: 1623072 - RNA, 23 nt, Pseudomonas putida KT2440
ggcucuccauugcgccugucacg

SEQ ID NO: 1623073 - RNA, 17 nt, Pseudomonas putida KT2440
ggcucugcuugagcgca

SEQ ID NO: 1623074 - RNA, 20 nt, Pseudomonas putida KT2440
ggcucugcuugagcgcagcg

SEQ ID NO: 1623075 - RNA, 18 nt, Pseudomonas putida KT2440
ggcucuugaacugggcau

SEQ ID NO: 1623076 - RNA, 21 nt, Pseudomonas putida KT2440
ggcuccaggcacaggcgcaca

SEQ ID NO: 1623077 - RNA, 22 nt, Pseudomonas putida KT2440
ggcuccaggcacaggcgcacac

SEQ ID NO: 1623078 - RNA, 15 nt, Pseudomonas putida KT2440
ggcuccaucuccagc

SEQ ID NO: 1623079 - RNA, 22 nt, Pseudomonas putida KT2440
ggcuccaggugaaucagcggca

SEQ ID NO: 1623080 - RNA, 14 nt, Pseudomonas putida KT2440
ggcucccccuccac

SEQ ID NO: 1623081 - RNA, 22 nt, Pseudomonas putida KT2440
ggcucccggcuacgcacccgca

SEQ ID NO: 1623082 - RNA, 13 nt, Pseudomonas putida KT2440
ggcucgaugcugc

SEQ ID NO: 1623083 - RNA, 21 nt, Pseudomonas putida KT2440
ggcuccuucucgaacagcugg

SEQ ID NO: 1623084 - RNA, 19 nt, Pseudomonas putida KT2440
ggcuccaccugcuccagca

SEQ ID NO: 1623085 - RNA, 14 nt, Pseudomonas putida KT2440
ggcucagcucggca

SEQ ID NO: 1623086 - RNA, 14 nt, Pseudomonas putida KT2440
ggcucagcucgucg

SEQ ID NO: 1623087 - RNA, 14 nt, Pseudomonas putida KT2440
ggcucaguggcugc

SEQ ID NO: 1623088 - RNA, 15 nt, Pseudomonas putida KT2440
ggcucaguggcugca

SEQ ID NO: 1623089 - RNA, 24 nt, Pseudomonas putida KT2440
ggcucaguugcaagucucgcgccu

SEQ ID NO: 1623090 - RNA, 15 nt, Pseudomonas putida KT2440
ggcucagggcagcaa

SEQ ID NO: 1623091 - RNA, 19 nt, Pseudomonas putida KT2440
ggcucagggccgcagagcg

SEQ ID NO: 1623092 - RNA, 13 nt, Pseudomonas putida KT2440
ggcucacacccag

SEQ ID NO: 1623093 - RNA, 21 nt, Pseudomonas putida KT2440
ggcucagcagguugaacagca

SEQ ID NO: 1623094 - RNA, 13 nt, Pseudomonas putida KT2440
ggcucaacgccag

SEQ ID NO: 1623095 - RNA, 17 nt, Pseudomonas putida KT2440
ggcucaauagcggcggu

SEQ ID NO: 1623096 - RNA, 18 nt, Pseudomonas putida KT2440
ggcucaauagcggcgguc

SEQ ID NO: 1623097 - RNA, 16 nt, Pseudomonas putida KT2440
uaauccaucaccacaa

SEQ ID NO: 1623098 - RNA, 15 nt, Pseudomonas putida KT2440
uaaucaggcugucca

SEQ ID NO: 1623099 - RNA, 12 nt, Pseudomonas putida KT2440
uaaggcuggcuu

SEQ ID NO: 1623100 - RNA, 19 nt, Pseudomonas putida KT2440
uaaggcuugcucaaggugu

SEQ ID NO: 1623101 - RNA, 19 nt, Pseudomonas putida KT2440
uaagguugcuccugcaggu

SEQ ID NO: 1623102 - RNA, 15 nt, Pseudomonas putida KT2440
uaaguuugcccagcg

SEQ ID NO: 1623103 - RNA, 12 nt, Pseudomonas putida KT2440
uaauacgcugug

SEQ ID NO: 1623104 - RNA, 20 nt, Pseudomonas putida KT2440
uacggguguuuccaccccgg

SEQ ID NO: 1623105 - RNA, 23 nt, Pseudomonas putida KT2440
uacggguguuuccaccccggcag

SEQ ID NO: 1623106 - RNA, 17 nt, Pseudomonas putida KT2440
uacggguucaagggcag

SEQ ID NO: 1623107 - RNA, 16 nt, Pseudomonas putida KT2440
uacgcucguccaggcc

SEQ ID NO: 1623108 - RNA, 16 nt, Pseudomonas putida KT2440
uacgcuggaucaccac

SEQ ID NO: 1623109 - RNA, 12 nt, Pseudomonas putida KT2440
uacgcuggccaa

SEQ ID NO: 1623110 - RNA, 14 nt, Pseudomonas putida KT2440
uaccuggguccagg

SEQ ID NO: 1623111 - RNA, 16 nt, Pseudomonas putida KT2440
uaccuggguccaggca

SEQ ID NO: 1623112 - RNA, 19 nt, Pseudomonas putida KT2440
uacgacccugaagcccugg

SEQ ID NO: 1623113 - RNA, 18 nt, Pseudomonas putida KT2440
uacgacgggcugagccca

SEQ ID NO: 1623114 - RNA, 12 nt, Pseudomonas putida KT2440
uacgacgcauca

SEQ ID NO: 1623115 - RNA, 14 nt, Pseudomonas putida KT2440
uacgccgccccacu

SEQ ID NO: 1623116 - RNA, 16 nt, Pseudomonas putida KT2440
uacgccggccaagguc

SEQ ID NO: 1623117 - RNA, 14 nt, Pseudomonas putida KT2440
uacgcccccagccu

SEQ ID NO: 1623118 - RNA, 14 nt, Pseudomonas putida KT2440
uacgcccauccaac

SEQ ID NO: 1623119 - RNA, 22 nt, Pseudomonas putida KT2440
uacgcccauccaacgcauccag

SEQ ID NO: 1623120 - RNA, 22 nt, Pseudomonas putida KT2440
uacgccguugucacgcgccagg

SEQ ID NO: 1623121 - RNA, 20 nt, Pseudomonas putida KT2440
uacgccucgaaguaggcaaa

SEQ ID NO: 1623122 - RNA, 12 nt, Pseudomonas putida KT2440
uacgcaaaccaa

SEQ ID NO: 1623123 - RNA, 11 nt, Pseudomonas putida KT2440
uacgccaggcg

SEQ ID NO: 1623124 - RNA, 16 nt, Pseudomonas putida KT2440
uacccaggugaugcag

SEQ ID NO: 1623125 - RNA, 19 nt, Pseudomonas putida KT2440
uacccaggugaugcaggca

SEQ ID NO: 1623126 - RNA, 21 nt, Pseudomonas putida KT2440
uacccaggugaugcaggcaau

SEQ ID NO: 1623127 - RNA, 21 nt, Pseudomonas putida KT2440
uacccaggccaacgauuggca

SEQ ID NO: 1623128 - RNA, 20 nt, Pseudomonas putida KT2440
uacccaugguaaaagccgcc

SEQ ID NO: 1623129 - RNA, 19 nt, Pseudomonas putida KT2440
uacccgggcgcaggggucu

SEQ ID NO: 1623130 - RNA, 22 nt, Pseudomonas putida KT2440
uacccgcgaaagggccgggccu

SEQ ID NO: 1623131 - RNA, 23 nt, Pseudomonas putida KT2440
uacccgcgaacaggcccugacag

SEQ ID NO: 1623132 - RNA, 16 nt, Pseudomonas putida KT2440
uacccgcgaagaagcc

SEQ ID NO: 1623133 - RNA, 16 nt, Pseudomonas putida KT2440
uacccgcgaagaggcc

SEQ ID NO: 1623134 - RNA, 19 nt, Pseudomonas putida KT2440
uaccacacaccccagaacg

SEQ ID NO: 1623135 - RNA, 22 nt, Pseudomonas putida KT2440
uaccacacguuguccgacagcu

SEQ ID NO: 1623136 - RNA, 18 nt, Pseudomonas putida KT2440
uaccucccgcacugcugc

SEQ ID NO: 1623137 - RNA, 13 nt, Pseudomonas putida KT2440
uaccuccagcccg

SEQ ID NO: 1623138 - RNA, 19 nt, Pseudomonas putida KT2440
uaccuccagcccggcuuca

SEQ ID NO: 1623139 - RNA, 11 nt, Pseudomonas putida KT2440
uaccugagcuu

SEQ ID NO: 1623140 - RNA, 15 nt, Pseudomonas putida KT2440
uaccggccgcucacc

SEQ ID NO: 1623141 - RNA, 17 nt, Pseudomonas putida KT2440
uacaggcaaccgcaucc

SEQ ID NO: 1623142 - RNA, 16 nt, Pseudomonas putida KT2440
uacagcggccugugca

SEQ ID NO: 1623143 - RNA, 19 nt, Pseudomonas putida KT2440
uacauccgcguccccuuca

SEQ ID NO: 1623144 - RNA, 19 nt, Pseudomonas putida KT2440
uacauguuggucagcgccu

SEQ ID NO: 1623145 - RNA, 21 nt, Pseudomonas putida KT2440
uacaugcgaacgcaggcgcga

SEQ ID NO: 1623146 - RNA, 15 nt, Pseudomonas putida KT2440
uaccaacgcagcaug

SEQ ID NO: 1623147 - RNA, 14 nt, Pseudomonas putida KT2440
uacaacgucacaug

SEQ ID NO: 1623148 - RNA, 20 nt, Pseudomonas putida KT2440
uacaauaccgacaaguucau

SEQ ID NO: 1623149 - RNA, 14 nt, Pseudomonas putida KT2440
uacaaaucaguaag

SEQ ID NO: 1623150 - RNA, 14 nt, Pseudomonas putida KT2440
uacaacaacaaaaa

SEQ ID NO: 1623151 - RNA, 18 nt, Pseudomonas putida KT2440
uacaacaacaaaaaaaac

SEQ ID NO: 1623152 - RNA, 19 nt, Pseudomonas putida KT2440
uacaacaacaaaaaaaacg

SEQ ID NO: 1623153 - RNA, 14 nt, Pseudomonas putida KT2440
uacaaagcggcgcg

SEQ ID NO: 1623154 - RNA, 15 nt, Pseudomonas putida KT2440
uacagcacaccuucc

SEQ ID NO: 1623155 - RNA, 18 nt, Pseudomonas putida KT2440
uacagccccuuccccagg

SEQ ID NO: 1623156 - RNA, 16 nt, Pseudomonas putida KT2440
uacagaugcugcugca

SEQ ID NO: 1623157 - RNA, 13 nt, Pseudomonas putida KT2440
uacagaucagcca

SEQ ID NO: 1623158 - RNA, 18 nt, Pseudomonas putida KT2440
uacagaccgccgggccca

SEQ ID NO: 1623159 - RNA, 13 nt, Pseudomonas putida KT2440
uagaacggcagca

SEQ ID NO: 1623160 - RNA, 16 nt, Pseudomonas putida KT2440
uagaacuccaccagcc

SEQ ID NO: 1623161 - RNA, 15 nt, Pseudomonas putida KT2440
uagaacucggcgagc

SEQ ID NO: 1623162 - RNA, 18 nt, Pseudomonas putida KT2440
uagaagcagaucaucaug

SEQ ID NO: 1623163 - RNA, 15 nt, Pseudomonas putida KT2440
uacuagcggugcaga

SEQ ID NO: 1623164 - RNA, 17 nt, Pseudomonas putida KT2440
uagaacaagccccuccu

SEQ ID NO: 1623165 - RNA, 24 nt, Pseudomonas putida KT2440
uagaacagauccaucggcgucgcu

SEQ ID NO: 1623166 - RNA, 14 nt, Pseudomonas putida KT2440
uagaaccacuccag

SEQ ID NO: 1623167 - RNA, 18 nt, Pseudomonas putida KT2440
uagagcaguuggcuuuua

SEQ ID NO: 1623168 - RNA, 17 nt, Pseudomonas putida KT2440
uagagcaucccccuccu

SEQ ID NO: 1623169 - RNA, 14 nt, Pseudomonas putida KT2440
uagaggaucugaau

SEQ ID NO: 1623170 - RNA, 13 nt, Pseudomonas putida KT2440
uagaccaccagcg

SEQ ID NO: 1623171 - RNA, 17 nt, Pseudomonas putida KT2440
uaggagcgggcuugccc

SEQ ID NO: 1623172 - RNA, 17 nt, Pseudomonas putida KT2440
uaggccuugaccagcuu

SEQ ID NO: 1623173 - RNA, 22 nt, Pseudomonas putida KT2440
uaggccuuggcuucacuguuca

SEQ ID NO: 1623174 - RNA, 16 nt, Pseudomonas putida KT2440
uaggccgucagcagca

SEQ ID NO: 1623175 - RNA, 24 nt, Pseudomonas putida KT2440
uaggccgucagcagcaggcgcgag

SEQ ID NO: 1623176 - RNA, 21 nt, Pseudomonas putida KT2440
uagggcguucagcaagaccag

SEQ ID NO: 1623177 - RNA, 13 nt, Pseudomonas putida KT2440
uaggguucgaugg

SEQ ID NO: 1623178 - RNA, 14 nt, Pseudomonas putida KT2440
uaggcgccacgccg

SEQ ID NO: 1623179 - RNA, 12 nt, Pseudomonas putida KT2440
uagggaagcgga

SEQ ID NO: 1623180 - RNA, 14 nt, Pseudomonas putida KT2440
uagcuuggucucgu

SEQ ID NO: 1623181 - RNA, 16 nt, Pseudomonas putida KT2440
uagcuuggucucguug

SEQ ID NO: 1623182 - RNA, 15 nt, Pseudomonas putida KT2440
uagcugaccuuggac

SEQ ID NO: 1623183 - RNA, 17 nt, Pseudomonas putida KT2440
uagcucagguagaccug

SEQ ID NO: 1623184 - RNA, 17 nt, Pseudomonas putida KT2440
uagcacaagggccaggu

SEQ ID NO: 1623185 - RNA, 22 nt, Pseudomonas putida KT2440
uagcaccagcgggcccagcagg

SEQ ID NO: 1623186 - RNA, 15 nt, Pseudomonas putida KT2440
uagcagaacagaaac

SEQ ID NO: 1623187 - RNA, 17 nt, Pseudomonas putida KT2440
uagccaggcauugcccg

SEQ ID NO: 1623188 - RNA, 18 nt, Pseudomonas putida KT2440
uagccagggccuguagga

SEQ ID NO: 1623189 - RNA, 17 nt, Pseudomonas putida KT2440
uagccagcccaggcugg

SEQ ID NO: 1623190 - RNA, 13 nt, Pseudomonas putida KT2440
uagccacgcugcc

SEQ ID NO: 1623191 - RNA, 17 nt, Pseudomonas putida KT2440
uagccacgcugccagga

SEQ ID NO: 1623192 - RNA, 22 nt, Pseudomonas putida KT2440
uagccaccugauguacaaggac

SEQ ID NO: 1623193 - RNA, 13 nt, Pseudomonas putida KT2440
uagccaaucccua

SEQ ID NO: 1623194 - RNA, 20 nt, Pseudomonas putida KT2440
uagccuguggggcaacugcg

SEQ ID NO: 1623195 - RNA, 20 nt, Pseudomonas putida KT2440
uagccguuugaagccaaccc

SEQ ID NO: 1623196 - RNA, 13 nt, Pseudomonas putida KT2440
uagccucaucaga

SEQ ID NO: 1623197 - RNA, 14 nt, Pseudomonas putida KT2440
uagccucaucagag

SEQ ID NO: 1623198 - RNA, 21 nt, Pseudomonas putida KT2440
uagccggcacagugccaagga

SEQ ID NO: 1623199 - RNA, 22 nt, Pseudomonas putida KT2440
uagccggcacagugccaaggac

SEQ ID NO: 1623200 - RNA, 18 nt, Pseudomonas putida KT2440
uaucgagcuacagccccu

SEQ ID NO: 1623201 - RNA, 19 nt, Pseudomonas putida KT2440
uaucgcaaauaguuuuaug

SEQ ID NO: 1623202 - RNA, 15 nt, Pseudomonas putida KT2440
uaucucgggcuucca

SEQ ID NO: 1623203 - RNA, 20 nt, Pseudomonas putida KT2440
uauccagugcuucacugccg

SEQ ID NO: 1623204 - RNA, 20 nt, Pseudomonas putida KT2440
uauccuucugccguuugcug

SEQ ID NO: 1623205 - RNA, 20 nt, Pseudomonas putida KT2440
uaucaggcaugccagcagcu

SEQ ID NO: 1623206 - RNA, 13 nt, Pseudomonas putida KT2440
uaggucaccauca

SEQ ID NO: 1623207 - RNA, 14 nt, Pseudomonas putida KT2440
uaggucaggucgcu

SEQ ID NO: 1623208 - RNA, 15 nt, Pseudomonas putida KT2440
uagucguccugcccc

SEQ ID NO: 1623209 - RNA, 23 nt, Pseudomonas putida KT2440
uauacgccgcguugucaggcacu

SEQ ID NO: 1623210 - RNA, 14 nt, Pseudomonas putida KT2440
uauagcccugcccu

SEQ ID NO: 1623211 - RNA, 13 nt, Pseudomonas putida KT2440
uaagagcggccuu

SEQ ID NO: 1623212 - RNA, 19 nt, Pseudomonas putida KT2440
uaagacaggcguucacauc

SEQ ID NO: 1623213 - RNA, 18 nt, Pseudomonas putida KT2440
uaagaagccgacccacuu

SEQ ID NO: 1623214 - RNA, 14 nt, Pseudomonas putida KT2440
uaagccagcccugc

SEQ ID NO: 1623215 - RNA, 15 nt, Pseudomonas putida KT2440
uaagcggucucggug

SEQ ID NO: 1623216 - RNA, 23 nt, Pseudomonas putida KT2440
uaagcgccagcaacgcagccagg

SEQ ID NO: 1623217 - RNA, 19 nt, Pseudomonas putida KT2440
uaagccggcggccaucgcu

SEQ ID NO: 1623218 - RNA, 17 nt, Pseudomonas putida KT2440
uaagcgaaacaccagca

SEQ ID NO: 1623219 - RNA, 15 nt, Pseudomonas putida KT2440
uaaggaaaaucagcu

SEQ ID NO: 1623220 - RNA, 15 nt, Pseudomonas putida KT2440
uaaccuggcucggcu

SEQ ID NO: 1623221 - RNA, 14 nt, Pseudomonas putida KT2440
uaaccucugcaugc

SEQ ID NO: 1623222 - RNA, 14 nt, Pseudomonas putida KT2440
uaacgcccacguuc

SEQ ID NO: 1623223 - RNA, 12 nt, Pseudomonas putida KT2440
uaacgggccagc

SEQ ID NO: 1623224 - RNA, 23 nt, Pseudomonas putida KT2440
uaacgggccagccgcgccagguc

SEQ ID NO: 1623225 - RNA, 20 nt, Pseudomonas putida KT2440
uaacggucacugagccaggc

SEQ ID NO: 1623226 - RNA, 15 nt, Pseudomonas putida KT2440
uaacguuggccgggg

SEQ ID NO: 1623227 - RNA, 13 nt, Pseudomonas putida KT2440
uaacuggcccacc

SEQ ID NO: 1623228 - RNA, 19 nt, Pseudomonas putida KT2440
uaaccaaccccugcggcgu

SEQ ID NO: 1623229 - RNA, 15 nt, Pseudomonas putida KT2440
uaacagggaaacaaa

SEQ ID NO: 1623230 - RNA, 21 nt, Pseudomonas putida KT2440
uaaauguucucgccgccgcga

SEQ ID NO: 1623231 - RNA, 12 nt, Pseudomonas putida KT2440
uaacaaggcacg

SEQ ID NO: 1623232 - RNA, 15 nt, Pseudomonas putida KT2440
uaaagauuaggcucc

SEQ ID NO: 1623233 - RNA, 16 nt, Pseudomonas putida KT2440
uaaagauuaggcucca

SEQ ID NO: 1623234 - RNA, 19 nt, Pseudomonas putida KT2440
uaaaccccagccuucagca

SEQ ID NO: 1623235 - RNA, 16 nt, Pseudomonas putida KT2440
uaaacccauuccuaca

SEQ ID NO: 1623236 - RNA, 14 nt, Pseudomonas putida KT2440
uaaacccgccccua

SEQ ID NO: 1623237 - RNA, 16 nt, Pseudomonas putida KT2440
uaaauccaaucuccaa

SEQ ID NO: 1623238 - RNA, 19 nt, Pseudomonas putida KT2440
uaaacacgaacaucagcag

SEQ ID NO: 1623239 - RNA, 21 nt, Pseudomonas putida KT2440
uaaaacuaauauuugaacacc

SEQ ID NO: 1623240 - RNA, 19 nt, Pseudomonas putida KT2440
guuugaucauuucaucgcc

SEQ ID NO: 1623241 - RNA, 21 nt, Pseudomonas putida KT2440
uaaaaacgccaucggccucuc

SEQ ID NO: 1623242 - RNA, 22 nt, Pseudomonas putida KT2440
uaaaaacgccaucggccucucu

SEQ ID NO: 1623243 - RNA, 19 nt, Pseudomonas putida KT2440
uaaaaacuggccagcagcc

SEQ ID NO: 1623244 - RNA, 19 nt, Pseudomonas putida KT2440
guuuaaaccgcgaagcagg

SEQ ID NO: 1623245 - RNA, 16 nt, Pseudomonas putida KT2440
guuguaccgaaguuca

SEQ ID NO: 1623246 - RNA, 21 nt, Pseudomonas putida KT2440
guuguauugccggggcugcuu

SEQ ID NO: 1623247 - RNA, 16 nt, Pseudomonas putida KT2440
guuuaccuccaucacc

SEQ ID NO: 1623248 - RNA, 15 nt, Pseudomonas putida KT2440
guuuaccugcagcuc

SEQ ID NO: 1623249 - RNA, 18 nt, Pseudomonas putida KT2440
guuucgcuggccugcccc

SEQ ID NO: 1623250 - RNA, 14 nt, Pseudomonas putida KT2440
guuugaagcuaaac

SEQ ID NO: 1623251 - RNA, 23 nt, Pseudomonas putida KT2440
guuugaagcuaaacgaguuucuc

SEQ ID NO: 1623252 - RNA, 14 nt, Pseudomonas putida KT2440
guuugacgcugcuc

SEQ ID NO: 1623253 - RNA, 20 nt, Pseudomonas putida KT2440
guuugagccggcgcugggcu

SEQ ID NO: 1623254 - RNA, 19 nt, Pseudomonas putida KT2440
guuuccccuguucccucaa

SEQ ID NO: 1623255 - RNA, 21 nt, Pseudomonas putida KT2440
guuggcggagccagccacaga

SEQ ID NO: 1623256 - RNA, 15 nt, Pseudomonas putida KT2440
guuggcguccagcag

SEQ ID NO: 1623257 - RNA, 21 nt, Pseudomonas putida KT2440
guuggcguccagcagugccau

SEQ ID NO: 1623258 - RNA, 16 nt, Pseudomonas putida KT2440
guuggcggucgagcuu

SEQ ID NO: 1623259 - RNA, 15 nt, Pseudomonas putida KT2440
guuggcggugagaug

SEQ ID NO: 1623260 - RNA, 22 nt, Pseudomonas putida KT2440
guuggcuuuuaaccaauugguc

SEQ ID NO: 1623261 - RNA, 16 nt, Pseudomonas putida KT2440
guugggcaagugcgug

SEQ ID NO: 1623262 - RNA, 22 nt, Pseudomonas putida KT2440
guuggguuggcacguugcugcc

SEQ ID NO: 1623263 - RNA, 16 nt, Pseudomonas putida KT2440
guuggugggcaaccag

SEQ ID NO: 1623264 - RNA, 19 nt, Pseudomonas putida KT2440
guuguaaacaaagccccgg

SEQ ID NO: 1623265 - RNA, 21 nt, Pseudomonas putida KT2440
guuguaaagaaaagccgcugg

SEQ ID NO: 1623266 - RNA, 14 nt, Pseudomonas putida KT2440
guugcuggccuugg

SEQ ID NO: 1623267 - RNA, 17 nt, Pseudomonas putida KT2440
guugcuguuggggagga

SEQ ID NO: 1623268 - RNA, 21 nt, Pseudomonas putida KT2440
guugcuguuguagggggaggg

SEQ ID NO: 1623269 - RNA, 17 nt, Pseudomonas putida KT2440
guugcuugucccaggcc

SEQ ID NO: 1623270 - RNA, 16 nt, Pseudomonas putida KT2440
guuggccagcaugaca

SEQ ID NO: 1623271 - RNA, 22 nt, Pseudomonas putida KT2440
guuggcccugaacuuggccucc

SEQ ID NO: 1623272 - RNA, 15 nt, Pseudomonas putida KT2440
guugccgccagcccc

SEQ ID NO: 1623273 - RNA, 19 nt, Pseudomonas putida KT2440
guugcccucggccaccugg

SEQ ID NO: 1623274 - RNA, 22 nt, Pseudomonas putida KT2440
guugcccggguacagccccugc

SEQ ID NO: 1623275 - RNA, 14 nt, Pseudomonas putida KT2440
guugccaccagcau

SEQ ID NO: 1623276 - RNA, 14 nt, Pseudomonas putida KT2440
guugcccgcugcau

SEQ ID NO: 1623277 - RNA, 20 nt, Pseudomonas putida KT2440
guugcgaugggcugcaaagc

SEQ ID NO: 1623278 - RNA, 16 nt, Pseudomonas putida KT2440
guugcgcagcagcagg

SEQ ID NO: 1623279 - RNA, 12 nt, Pseudomonas putida KT2440
guugccugugcu

SEQ ID NO: 1623280 - RNA, 14 nt, Pseudomonas putida KT2440
guugcgcugggcgu

SEQ ID NO: 1623281 - RNA, 18 nt, Pseudomonas putida KT2440
guugcgcuccauccaguc

SEQ ID NO: 1623282 - RNA, 14 nt, Pseudomonas putida KT2440
guugcgggucagcu

SEQ ID NO: 1623283 - RNA, 14 nt, Pseudomonas putida KT2440
guugcggugaggug

SEQ ID NO: 1623284 - RNA, 23 nt, Pseudomonas putida KT2440
guugcgugccucgcccaggucaa

SEQ ID NO: 1623285 - RNA, 16 nt, Pseudomonas putida KT2440
guugaugaucugcucc

SEQ ID NO: 1623286 - RNA, 22 nt, Pseudomonas putida KT2440
guugaucgcuugucuccauguc

SEQ ID NO: 1623287 - RNA, 20 nt, Pseudomonas putida KT2440
guugaucuguugcugcaggu

SEQ ID NO: 1623288 - RNA, 22 nt, Pseudomonas putida KT2440
guugcaagccuucgucgcuggc

SEQ ID NO: 1623289 - RNA, 19 nt, Pseudomonas putida KT2440
guugcagucguuguccagg

SEQ ID NO: 1623290 - RNA, 20 nt, Pseudomonas putida KT2440
guugacggugaagaguggau

SEQ ID NO: 1623291 - RNA, 19 nt, Pseudomonas putida KT2440
guugagcacgaaacugcgc

SEQ ID NO: 1623292 - RNA, 15 nt, Pseudomonas putida KT2440
guugaggguggcaau

SEQ ID NO: 1623293 - RNA, 24 nt, Pseudomonas putida KT2440
guugagugggguggaaguuccugc

SEQ ID NO: 1623294 - RNA, 18 nt, Pseudomonas putida KT2440
guugagugucagaaaaaa

SEQ ID NO: 1623295 - RNA, 18 nt, Pseudomonas putida KT2440
guugaccguguugcagcg

SEQ ID NO: 1623296 - RNA, 14 nt, Pseudomonas putida KT2440
guugacaagcaaaa

SEQ ID NO: 1623297 - RNA, 15 nt, Pseudomonas putida KT2440
guugaaugccgccau

SEQ ID NO: 1623298 - RNA, 12 nt, Pseudomonas putida KT2440
guugaagaacag

SEQ ID NO: 1623299 - RNA, 14 nt, Pseudomonas putida KT2440
guugaagaagaagg

SEQ ID NO: 1623300 - RNA, 19 nt, Pseudomonas putida KT2440
guugaagaagaaggagagc

SEQ ID NO: 1623301 - RNA, 17 nt, Pseudomonas putida KT2440
guugaaagacugcuccg

SEQ ID NO: 1623302 - RNA, 13 nt, Pseudomonas putida KT2440
guucuugaccuug

SEQ ID NO: 1623303 - RNA, 14 nt, Pseudomonas putida KT2440
guucuugccgagca

SEQ ID NO: 1623304 - RNA, 18 nt, Pseudomonas putida KT2440
guucuugccuguccccuu

SEQ ID NO: 1623305 - RNA, 17 nt, Pseudomonas putida KT2440
guucuuucucccaggcc

SEQ ID NO: 1623306 - RNA, 16 nt, Pseudomonas putida KT2440
guucggcaucggugcu

SEQ ID NO: 1623307 - RNA, 21 nt, Pseudomonas putida KT2440
guucguccucgacccacggcu

SEQ ID NO: 1623308 - RNA, 20 nt, Pseudomonas putida KT2440
guucgucgagcaucugcugc

SEQ ID NO: 1623309 - RNA, 19 nt, Pseudomonas putida KT2440
guucggcaccuuucuccag

SEQ ID NO: 1623310 - RNA, 23 nt, Pseudomonas putida KT2440
guucuuccauuugcgcuggcugc

SEQ ID NO: 1623311 - RNA, 21 nt, Pseudomonas putida KT2440
guucauugacggucagugaag

SEQ ID NO: 1623312 - RNA, 17 nt, Pseudomonas putida KT2440
guucauuguucuggcca

SEQ ID NO: 1623313 - RNA, 22 nt, Pseudomonas putida KT2440
guucagucgguaugcgcccauc

SEQ ID NO: 1623314 - RNA, 16 nt, Pseudomonas putida KT2440
guucagugccugcucc

SEQ ID NO: 1623315 - RNA, 16 nt, Pseudomonas putida KT2440
guucagugaucaugcc

SEQ ID NO: 1623316 - RNA, 19 nt, Pseudomonas putida KT2440
guucaggcgcccugcgcca

SEQ ID NO: 1623317 - RNA, 16 nt, Pseudomonas putida KT2440
guucaggcgccugccg

SEQ ID NO: 1623318 - RNA, 20 nt, Pseudomonas putida KT2440
guucagguguggaaacccgc

SEQ ID NO: 1623319 - RNA, 19 nt, Pseudomonas putida KT2440
guucagguguuccagcacg

SEQ ID NO: 1623320 - RNA, 20 nt, Pseudomonas putida KT2440
guucagguguuccagcacgu

SEQ ID NO: 1623321 - RNA, 22 nt, Pseudomonas putida KT2440
guucagcccuugcugcagcagg

SEQ ID NO: 1623322 - RNA, 22 nt, Pseudomonas putida KT2440
guucccgccauguugcgcagca

SEQ ID NO: 1623323 - RNA, 14 nt, Pseudomonas putida KT2440
guucccgauccuca

SEQ ID NO: 1623324 - RNA, 12 nt, Pseudomonas putida KT2440
guucccccaccg

SEQ ID NO: 1623325 - RNA, 19 nt, Pseudomonas putida KT2440
guuccccgaccaaaugagu

SEQ ID NO: 1623326 - RNA, 18 nt, Pseudomonas putida KT2440
guucccucaacaagcuga

SEQ ID NO: 1623327 - RNA, 22 nt, Pseudomonas putida KT2440
guucccgcgcaaaugcaccccu

SEQ ID NO: 1623328 - RNA, 19 nt, Pseudomonas putida KT2440
guuccuacgcaggcaccgc

SEQ ID NO: 1623329 - RNA, 18 nt, Pseudomonas putida KT2440
guucgcccugcgccugca

SEQ ID NO: 1623330 - RNA, 17 nt, Pseudomonas putida KT2440
guucggaaaacuccugc

SEQ ID NO: 1623331 - RNA, 18 nt, Pseudomonas putida KT2440
guuccuggcgcuccucca

SEQ ID NO: 1623332 - RNA, 18 nt, Pseudomonas putida KT2440
guuacggcggccugcugc

SEQ ID NO: 1623333 - RNA, 17 nt, Pseudomonas putida KT2440
guuacuguuccagcgua

SEQ ID NO: 1623334 - RNA, 15 nt, Pseudomonas putida KT2440
guuaccucccgcaca

SEQ ID NO: 1623335 - RNA, 15 nt, Pseudomonas putida KT2440
gugugcccaccgcag

SEQ ID NO: 1623336 - RNA, 23 nt, Pseudomonas putida KT2440
gugugcgaaaaccccggcucggu

SEQ ID NO: 1623337 - RNA, 15 nt, Pseudomonas putida KT2440
guguggugcggcugg

SEQ ID NO: 1623338 - RNA, 16 nt, Pseudomonas putida KT2440
gugugggggcggccuc

SEQ ID NO: 1623339 - RNA, 19 nt, Pseudomonas putida KT2440
guguaccccaucugcucgg

SEQ ID NO: 1623340 - RNA, 15 nt, Pseudomonas putida KT2440
gugugaucuucuucg

SEQ ID NO: 1623341 - RNA, 21 nt, Pseudomonas putida KT2440
guguucuaccgcguuggacac

SEQ ID NO: 1623342 - RNA, 16 nt, Pseudomonas putida KT2440
guguuguugcaaccag

SEQ ID NO: 1623343 - RNA, 18 nt, Pseudomonas putida KT2440
guguuuugccuccagcuu

SEQ ID NO: 1623344 - RNA, 20 nt, Pseudomonas putida KT2440
gugguugacguuggccgcca

SEQ ID NO: 1623345 - RNA, 15 nt, Pseudomonas putida KT2440
gugguucaucaccag

SEQ ID NO: 1623346 - RNA, 19 nt, Pseudomonas putida KT2440
gugguucaucaccagcccc

SEQ ID NO: 1623347 - RNA, 13 nt, Pseudomonas putida KT2440
guggugcugcaua

SEQ ID NO: 1623348 - RNA, 13 nt, Pseudomonas putida KT2440
gugguggcugcuu

SEQ ID NO: 1623349 - RNA, 15 nt, Pseudomonas putida KT2440
guggucagccaggcg

SEQ ID NO: 1623350 - RNA, 15 nt, Pseudomonas putida KT2440
guggugaucacgggu

SEQ ID NO: 1623351 - RNA, 16 nt, Pseudomonas putida KT2440
guggggcaacugcgcg

SEQ ID NO: 1623352 - RNA, 19 nt, Pseudomonas putida KT2440
guggggcaacugcgcgauc

SEQ ID NO: 1623353 - RNA, 22 nt, Pseudomonas putida KT2440
guggcucuccucucccaccagc

SEQ ID NO: 1623354 - RNA, 14 nt, Pseudomonas putida KT2440
guggguccugcgcc

SEQ ID NO: 1623355 - RNA, 16 nt, Pseudomonas putida KT2440
gugggucguuccagug

SEQ ID NO: 1623356 - RNA, 23 nt, Pseudomonas putida KT2440
guggggcuauagcucagcuggga

SEQ ID NO: 1623357 - RNA, 15 nt, Pseudomonas putida KT2440
guggggucugcccgg

SEQ ID NO: 1623358 - RNA, 21 nt, Pseudomonas putida KT2440
guggcgcagcaucaucucugc

SEQ ID NO: 1623359 - RNA, 21 nt, Pseudomonas putida KT2440
guggcgcagcaccgugggcgc

SEQ ID NO: 1623360 - RNA, 12 nt, Pseudomonas putida KT2440
guggcgcagcau

SEQ ID NO: 1623361 - RNA, 14 nt, Pseudomonas putida KT2440
guggcgcccggcgc

SEQ ID NO: 1623362 - RNA, 18 nt, Pseudomonas putida KT2440
guggccacacugcucagu

SEQ ID NO: 1623363 - RNA, 15 nt, Pseudomonas putida KT2440
guggccagugccaug

SEQ ID NO: 1623364 - RNA, 20 nt, Pseudomonas putida KT2440
guggcaacgauugggcggca

SEQ ID NO: 1623365 - RNA, 14 nt, Pseudomonas putida KT2440
gugcuucgcccagu

SEQ ID NO: 1623366 - RNA, 21 nt, Pseudomonas putida KT2440
gugcuucuggauaugcuccau

SEQ ID NO: 1623367 - RNA, 17 nt, Pseudomonas putida KT2440
gugcuugugguagugau

SEQ ID NO: 1623368 - RNA, 21 nt, Pseudomonas putida KT2440
gugcuucaucgcugacuucca

SEQ ID NO: 1623369 - RNA, 18 nt, Pseudomonas putida KT2440
gugccccgguccagcaca

SEQ ID NO: 1623370 - RNA, 13 nt, Pseudomonas putida KT2440
gugccccuugagc

SEQ ID NO: 1623371 - RNA, 18 nt, Pseudomonas putida KT2440
gugcccccccaacaacag

SEQ ID NO: 1623372 - RNA, 14 nt, Pseudomonas putida KT2440
gugccaggcucagg

SEQ ID NO: 1623373 - RNA, 16 nt, Pseudomonas putida KT2440
gugccaggcucaggcc

SEQ ID NO: 1623374 - RNA, 20 nt, Pseudomonas putida KT2440
gugccaggugauaguccagc

SEQ ID NO: 1623375 - RNA, 23 nt, Pseudomonas putida KT2440
gugccaggugauaguccagcaac

SEQ ID NO: 1623376 - RNA, 17 nt, Pseudomonas putida KT2440
gugccagguguuugggc

SEQ ID NO: 1623377 - RNA, 14 nt, Pseudomonas putida KT2440
gugccagcggccac

SEQ ID NO: 1623378 - RNA, 20 nt, Pseudomonas putida KT2440
gugcccgcgaguccuccaac

SEQ ID NO: 1623379 - RNA, 19 nt, Pseudomonas putida KT2440
gugcccgcgaacaaggcuc

SEQ ID NO: 1623380 - RNA, 23 nt, Pseudomonas putida KT2440
gugcagcacggaaucacgcggcg

SEQ ID NO: 1623381 - RNA, 19 nt, Pseudomonas putida KT2440
gugccacccaaggcaucca

SEQ ID NO: 1623382 - RNA, 21 nt, Pseudomonas putida KT2440
gugccaccgauggugugguag

SEQ ID NO: 1623383 - RNA, 15 nt, Pseudomonas putida KT2440
gugccaacaggcagc

SEQ ID NO: 1623384 - RNA, 17 nt, Pseudomonas putida KT2440
gugccaacaggcagcau

SEQ ID NO: 1623385 - RNA, 18 nt, Pseudomonas putida KT2440
gugcaacugguucuccag

SEQ ID NO: 1623386 - RNA, 23 nt, Pseudomonas putida KT2440
gugcaagggauaucaggcccugg

SEQ ID NO: 1623387 - RNA, 21 nt, Pseudomonas putida KT2440
gugcagaacguacuggccgcu

SEQ ID NO: 1623388 - RNA, 14 nt, Pseudomonas putida KT2440
gugcaccagcacca

SEQ ID NO: 1623389 - RNA, 19 nt, Pseudomonas putida KT2440
gugcacagcguccaguuca

SEQ ID NO: 1623390 - RNA, 16 nt, Pseudomonas putida KT2440
gugcaauugcaguuga

SEQ ID NO: 1623391 - RNA, 20 nt, Pseudomonas putida KT2440
gugcaaucaggucucccgcc

SEQ ID NO: 1623392 - RNA, 20 nt, Pseudomonas putida KT2440
gucgcuucuuugcgauccag

SEQ ID NO: 1623393 - RNA, 22 nt, Pseudomonas putida KT2440
gucgcuguucuugaacucgccg

SEQ ID NO: 1623394 - RNA, 23 nt, Pseudomonas putida KT2440
gugaugcgguaaccggaauagaa

SEQ ID NO: 1623395 - RNA, 15 nt, Pseudomonas putida KT2440
gugauggcgcauggc

SEQ ID NO: 1623396 - RNA, 19 nt, Pseudomonas putida KT2440
gugaugguaucugccagca

SEQ ID NO: 1623397 - RNA, 14 nt, Pseudomonas putida KT2440
gugaugccgugguu

SEQ ID NO: 1623398 - RNA, 12 nt, Pseudomonas putida KT2440
gugcucaggcuc

SEQ ID NO: 1623399 - RNA, 15 nt, Pseudomonas putida KT2440
gugcucaggcucagc

SEQ ID NO: 1623400 - RNA, 16 nt, Pseudomonas putida KT2440
gugcucaugauccagu

SEQ ID NO: 1623401 - RNA, 14 nt, Pseudomonas putida KT2440
gugcuaaugcucuu

SEQ ID NO: 1623402 - RNA, 19 nt, Pseudomonas putida KT2440
gugcuacggccgugcaggg

SEQ ID NO: 1623403 - RNA, 21 nt, Pseudomonas putida KT2440
gugcuaccaaccuccagguca

SEQ ID NO: 1623404 - RNA, 22 nt, Pseudomonas putida KT2440
gugcugaccaccgugcuguguu

SEQ ID NO: 1623405 - RNA, 16 nt, Pseudomonas putida KT2440
gugcucguccaguucc

SEQ ID NO: 1623406 - RNA, 16 nt, Pseudomonas putida KT2440
gugcucugcaggcaca

SEQ ID NO: 1623407 - RNA, 14 nt, Pseudomonas putida KT2440
gugcucggccuugc

SEQ ID NO: 1623408 - RNA, 18 nt, Pseudomonas putida KT2440
gugcucgucuucgaucug

SEQ ID NO: 1623409 - RNA, 23 nt, Pseudomonas putida KT2440
gugcucgaacucuuccagcucgc

SEQ ID NO: 1623410 - RNA, 16 nt, Pseudomonas putida KT2440
gugcucgccucacagc

SEQ ID NO: 1623411 - RNA, 19 nt, Pseudomonas putida KT2440
gugcuggcgcucaauggca

SEQ ID NO: 1623412 - RNA, 17 nt, Pseudomonas putida KT2440
gugcugguccuccccuu

SEQ ID NO: 1623413 - RNA, 16 nt, Pseudomonas putida KT2440
gugcugguggccacgc

SEQ ID NO: 1623414 - RNA, 16 nt, Pseudomonas putida KT2440
gugccuugaucaaugc

SEQ ID NO: 1623415 - RNA, 16 nt, Pseudomonas putida KT2440
gugccuucaggcgcug

SEQ ID NO: 1623416 - RNA, 22 nt, Pseudomonas putida KT2440
gugccugucgucagcucaggcc

SEQ ID NO: 1623417 - RNA, 22 nt, Pseudomonas putida KT2440
gugccugugagaucgagcgccg

SEQ ID NO: 1623418 - RNA, 16 nt, Pseudomonas putida KT2440
gugcgcccggcaaaca

SEQ ID NO: 1623419 - RNA, 16 nt, Pseudomonas putida KT2440
gugccuuggcggcgga

SEQ ID NO: 1623420 - RNA, 19 nt, Pseudomonas putida KT2440
gugcgccuuuuccaccagc

SEQ ID NO: 1623421 - RNA, 20 nt, Pseudomonas putida KT2440
gugcgccuccagcagcgaca

SEQ ID NO: 1623422 - RNA, 16 nt, Pseudomonas putida KT2440
gugcgcucaggcgugg

SEQ ID NO: 1623423 - RNA, 16 nt, Pseudomonas putida KT2440
gugcgggccaccaggc

SEQ ID NO: 1623424 - RNA, 13 nt, Pseudomonas putida KT2440
gccuucgcgggcu

SEQ ID NO: 1623425 - RNA, 18 nt, Pseudomonas putida KT2440
gccuucgcgggcucgccc

SEQ ID NO: 1623426 - RNA, 19 nt, Pseudomonas putida KT2440
gccuucgcgggcucgcccg

SEQ ID NO: 1623427 - RNA, 18 nt, Pseudomonas putida KT2440
gccuucgcgaccgccauu

SEQ ID NO: 1623428 - RNA, 19 nt, Pseudomonas putida KT2440
gccuucgucgcuggccagc

SEQ ID NO: 1623429 - RNA, 20 nt, Pseudomonas putida KT2440
gccuucgucgcuggccagcu

SEQ ID NO: 1623430 - RNA, 14 nt, Pseudomonas putida KT2440
gccuuccugcaccu

SEQ ID NO: 1623431 - RNA, 15 nt, Pseudomonas putida KT2440
gccuuccugcaccuu

SEQ ID NO: 1623432 - RNA, 17 nt, Pseudomonas putida KT2440
gccuuccuucuuugaaa

SEQ ID NO: 1623433 - RNA, 21 nt, Pseudomonas putida KT2440
gccuuccuugaacucagugcc

SEQ ID NO: 1623434 - RNA, 15 nt, Pseudomonas putida KT2440
gccuucgcccgccgc

SEQ ID NO: 1623435 - RNA, 20 nt, Pseudomonas putida KT2440
gccuucccgccuggcgccug

SEQ ID NO: 1623436 - RNA, 17 nt, Pseudomonas putida KT2440
gccuuccgggcacuggc

SEQ ID NO: 1623437 - RNA, 19 nt, Pseudomonas putida KT2440
gccuucaggcgcugguuga

SEQ ID NO: 1623438 - RNA, 20 nt, Pseudomonas putida KT2440
gccuucauaggcggccacgg

SEQ ID NO: 1623439 - RNA, 17 nt, Pseudomonas putida KT2440
gccuuccacccgccugc

SEQ ID NO: 1623440 - RNA, 20 nt, Pseudomonas putida KT2440
gccuuccacccgccugcaac

SEQ ID NO: 1623441 - RNA, 14 nt, Pseudomonas putida KT2440
gccuuccaaccagc

SEQ ID NO: 1623442 - RNA, 21 nt, Pseudomonas putida KT2440
gccuucaugguguccggcaug

SEQ ID NO: 1623443 - RNA, 23 nt, Pseudomonas putida KT2440
gccuucaaacacuucaucucgcu

SEQ ID NO: 1623444 - RNA, 23 nt, Pseudomonas putida KT2440
gccuucagauaguccuuauccag

SEQ ID NO: 1623445 - RNA, 16 nt, Pseudomonas putida KT2440
gccuucagcagccggu

SEQ ID NO: 1623446 - RNA, 20 nt, Pseudomonas putida KT2440
gccuucagcaggcgcggcgu

SEQ ID NO: 1623447 - RNA, 12 nt, Pseudomonas putida KT2440
gccuucaaccuc

SEQ ID NO: 1623448 - RNA, 16 nt, Pseudomonas putida KT2440
gccuucaagcucccca

SEQ ID NO: 1623449 - RNA, 17 nt, Pseudomonas putida KT2440
gccuguugcgcacugcc

SEQ ID NO: 1623450 - RNA, 14 nt, Pseudomonas putida KT2440
gccuguuucucacg

SEQ ID NO: 1623451 - RNA, 15 nt, Pseudomonas putida KT2440
gccuguuuggccgca

SEQ ID NO: 1623452 - RNA, 17 nt, Pseudomonas putida KT2440
gccuguuuuccauugca

SEQ ID NO: 1623453 - RNA, 23 nt, Pseudomonas putida KT2440
gccuguuuuccauugcacacguu

SEQ ID NO: 1623454 - RNA, 13 nt, Pseudomonas putida KT2440
gccuuggccucgc

SEQ ID NO: 1623455 - RNA, 21 nt, Pseudomonas putida KT2440
gccuuggccucgcugaccagu

SEQ ID NO: 1623456 - RNA, 14 nt, Pseudomonas putida KT2440
gccuuggccuggcg

SEQ ID NO: 1623457 - RNA, 16 nt, Pseudomonas putida KT2440
gccuuggccuggcgag

SEQ ID NO: 1623458 - RNA, 13 nt, Pseudomonas putida KT2440
gccuuggccuggg

SEQ ID NO: 1623459 - RNA, 17 nt, Pseudomonas putida KT2440
gccuuggcgcagcaagg

SEQ ID NO: 1623460 - RNA, 21 nt, Pseudomonas putida KT2440
gccuuggccagcucauccagc

SEQ ID NO: 1623461 - RNA, 21 nt, Pseudomonas putida KT2440
gccuuggcucgacacgcuugc

SEQ ID NO: 1623462 - RNA, 22 nt, Pseudomonas putida KT2440
gccuuggcgccggacuucuuca

SEQ ID NO: 1623463 - RNA, 15 nt, Pseudomonas putida KT2440
gccuugucggcacgc

SEQ ID NO: 1623464 - RNA, 17 nt, Pseudomonas putida KT2440
gccuugucggcacgcgc

SEQ ID NO: 1623465 - RNA, 17 nt, Pseudomonas putida KT2440
gccuuggagcgcgcccc

SEQ ID NO: 1623466 - RNA, 18 nt, Pseudomonas putida KT2440
gccuugcuuggcagcggc

SEQ ID NO: 1623467 - RNA, 22 nt, Pseudomonas putida KT2440
gccuugcgucgcgaugggcugc

SEQ ID NO: 1623468 - RNA, 17 nt, Pseudomonas putida KT2440
gccuugcuccaguucau

SEQ ID NO: 1623469 - RNA, 19 nt, Pseudomonas putida KT2440
gccuuggcagccgcguccu

SEQ ID NO: 1623470 - RNA, 19 nt, Pseudomonas putida KT2440
gccuuggcauagcgcucgc

SEQ ID NO: 1623471 - RNA, 13 nt, Pseudomonas putida KT2440
gccuugcgccagg

SEQ ID NO: 1623472 - RNA, 15 nt, Pseudomonas putida KT2440
gccuugcccugcagc

SEQ ID NO: 1623473 - RNA, 16 nt, Pseudomonas putida KT2440
gccuugccgcucacca

SEQ ID NO: 1623474 - RNA, 12 nt, Pseudomonas putida KT2440
gccuucuucacg

SEQ ID NO: 1623475 - RNA, 16 nt, Pseudomonas putida KT2440
gccuugaagcgcggca

SEQ ID NO: 1623476 - RNA, 18 nt, Pseudomonas putida KT2440
gccuugaagcuggccgug

SEQ ID NO: 1623477 - RNA, 20 nt, Pseudomonas putida KT2440
gccuugaagcuggccguggu

SEQ ID NO: 1623478 - RNA, 18 nt, Pseudomonas putida KT2440
gccuugauacgcccaucc

SEQ ID NO: 1623479 - RNA, 19 nt, Pseudomonas putida KT2440
gccuugaucgucauggugg

SEQ ID NO: 1623480 - RNA, 15 nt, Pseudomonas putida KT2440
gccuugaugacuuug

SEQ ID NO: 1623481 - RNA, 18 nt, Pseudomonas putida KT2440
gccuugauuaccagcgcc

SEQ ID NO: 1623482 - RNA, 16 nt, Pseudomonas putida KT2440
gccuugcagccccugc

SEQ ID NO: 1623483 - RNA, 22 nt, Pseudomonas putida KT2440
gccuugcaggaagcggcgcuuu

SEQ ID NO: 1623484 - RNA, 19 nt, Pseudomonas putida KT2440
gccuucucuuccgccagcc

SEQ ID NO: 1623485 - RNA, 16 nt, Pseudomonas putida KT2440
gccuucuccagcucgc

SEQ ID NO: 1623486 - RNA, 15 nt, Pseudomonas putida KT2440
gcgacagcaucauca

SEQ ID NO: 1623487 - RNA, 16 nt, Pseudomonas putida KT2440
gcgacagcaucggcag

SEQ ID NO: 1623488 - RNA, 20 nt, Pseudomonas putida KT2440
gcgacagcaucggcagguca

SEQ ID NO: 1623489 - RNA, 14 nt, Pseudomonas putida KT2440
gcgaccaucaccag

SEQ ID NO: 1623490 - RNA, 20 nt, Pseudomonas putida KT2440
gcgaccuucacgccagccgu

SEQ ID NO: 1623491 - RNA, 12 nt, Pseudomonas putida KT2440
gcgacaaccgaa

SEQ ID NO: 1623492 - RNA, 20 nt, Pseudomonas putida KT2440
gcgacacaaggccccacaau

SEQ ID NO: 1623493 - RNA, 21 nt, Pseudomonas putida KT2440
gcgacacaaggccgcucccac

SEQ ID NO: 1623494 - RNA, 12 nt, Pseudomonas putida KT2440
gcgacaccagcg

SEQ ID NO: 1623495 - RNA, 18 nt, Pseudomonas putida KT2440
gcgacaccagcgcaccac

SEQ ID NO: 1623496 - RNA, 19 nt, Pseudomonas putida KT2440
gcgacaccagcgcaccacu

SEQ ID NO: 1623497 - RNA, 21 nt, Pseudomonas putida KT2440
gcgacaccagcgcaccacugu

SEQ ID NO: 1623498 - RNA, 16 nt, Pseudomonas putida KT2440
gcgacacccuggucau

SEQ ID NO: 1623499 - RNA, 22 nt, Pseudomonas putida KT2440
gcgacacccuggucaugcagcg

SEQ ID NO: 1623500 - RNA, 23 nt, Pseudomonas putida KT2440
gcgacacgcgaaucgccagggcu

SEQ ID NO: 1623501 - RNA, 12 nt, Pseudomonas putida KT2440
gcgaaggcugcc

SEQ ID NO: 1623502 - RNA, 14 nt, Pseudomonas putida KT2440
gcgaaggcugccug

SEQ ID NO: 1623503 - RNA, 14 nt, Pseudomonas putida KT2440
gcgaagggcugccg

SEQ ID NO: 1623504 - RNA, 17 nt, Pseudomonas putida KT2440
gcgaagggcugccgcgc

SEQ ID NO: 1623505 - RNA, 20 nt, Pseudomonas putida KT2440
gccuuuccgcacucagguga

SEQ ID NO: 1623506 - RNA, 20 nt, Pseudomonas putida KT2440
gccuuguuccacgcgcaggc

SEQ ID NO: 1623507 - RNA, 15 nt, Pseudomonas putida KT2440
gccuuucugcuucca

SEQ ID NO: 1623508 - RNA, 16 nt, Pseudomonas putida KT2440
gccuuucuuaugccug

SEQ ID NO: 1623509 - RNA, 15 nt, Pseudomonas putida KT2440
gccuuuggccgccag

SEQ ID NO: 1623510 - RNA, 22 nt, Pseudomonas putida KT2440
gcgaacacgaaaaagccagcgu

SEQ ID NO: 1623511 - RNA, 17 nt, Pseudomonas putida KT2440
gcgaacacuuggcagcc

SEQ ID NO: 1623512 - RNA, 13 nt, Pseudomonas putida KT2440
gcgaacacagcgg

SEQ ID NO: 1623513 - RNA, 16 nt, Pseudomonas putida KT2440
gcgaaagggccagcac

SEQ ID NO: 1623514 - RNA, 17 nt, Pseudomonas putida KT2440
gcgaaagggccagcaca

SEQ ID NO: 1623515 - RNA, 23 nt, Pseudomonas putida KT2440
gcgaaagggccgcaaggccgcuc

SEQ ID NO: 1623516 - RNA, 14 nt, Pseudomonas putida KT2440
gcgaaagggccggg

SEQ ID NO: 1623517 - RNA, 23 nt, Pseudomonas putida KT2440
gcgaaaaacagcaguuugcugcg

SEQ ID NO: 1623518 - RNA, 20 nt, Pseudomonas putida KT2440
gcgcaacaccgccagcgggc

SEQ ID NO: 1623519 - RNA, 15 nt, Pseudomonas putida KT2440
gcgcaacaccgccau

SEQ ID NO: 1623520 - RNA, 19 nt, Pseudomonas putida KT2440
gcgcaacacuucaggcugc

SEQ ID NO: 1623521 - RNA, 15 nt, Pseudomonas putida KT2440
gcgcaacagcaaggc

SEQ ID NO: 1623522 - RNA, 15 nt, Pseudomonas putida KT2440
gcgcaacagugcccc

SEQ ID NO: 1623523 - RNA, 21 nt, Pseudomonas putida KT2440
gcgcaaaucuuguaggcgcgg

SEQ ID NO: 1623524 - RNA, 21 nt, Pseudomonas putida KT2440
gcgauuuuuuugaaaaaaaga

SEQ ID NO: 1623525 - RNA, 19 nt, Pseudomonas putida KT2440
gcgcaaaaccaccagccgu

SEQ ID NO: 1623526 - RNA, 22 nt, Pseudomonas putida KT2440
gcgcaaacugauucacgcccuu

SEQ ID NO: 1623527 - RNA, 17 nt, Pseudomonas putida KT2440
gcgcaaacccucggcca

SEQ ID NO: 1623528 - RNA, 16 nt, Pseudomonas putida KT2440
gcgauggauggcaccg

SEQ ID NO: 1623529 - RNA, 14 nt, Pseudomonas putida KT2440
gcgauggcguccuu

SEQ ID NO: 1623530 - RNA, 13 nt, Pseudomonas putida KT2440
gcgaugggcugca

SEQ ID NO: 1623531 - RNA, 14 nt, Pseudomonas putida KT2440
gcgauugcggccua

SEQ ID NO: 1623532 - RNA, 15 nt, Pseudomonas putida KT2440
gcgcagcaucuuccu

SEQ ID NO: 1623533 - RNA, 18 nt, Pseudomonas putida KT2440
gcgcagcccaaacagcau

SEQ ID NO: 1623534 - RNA, 12 nt, Pseudomonas putida KT2440
gcgcagcccugu

SEQ ID NO: 1623535 - RNA, 22 nt, Pseudomonas putida KT2440
gcgcagcagguccagcuccggu

SEQ ID NO: 1623536 - RNA, 15 nt, Pseudomonas putida KT2440
gcgcagcagcucccg

SEQ ID NO: 1623537 - RNA, 19 nt, Pseudomonas putida KT2440
gcgcagcaauacgcacagg

SEQ ID NO: 1623538 - RNA, 13 nt, Pseudomonas putida KT2440
gcgcagcggcccc

SEQ ID NO: 1623539 - RNA, 18 nt, Pseudomonas putida KT2440
gcgcagcacaaggcugcg

SEQ ID NO: 1623540 - RNA, 17 nt, Pseudomonas putida KT2440
gcgcacgucucgggaau

SEQ ID NO: 1623541 - RNA, 13 nt, Pseudomonas putida KT2440
gcgcacggucucc

SEQ ID NO: 1623542 - RNA, 21 nt, Pseudomonas putida KT2440
gcgcacggcaucggccgagcc

SEQ ID NO: 1623543 - RNA, 12 nt, Pseudomonas putida KT2440
gcgcacggccuc

SEQ ID NO: 1623544 - RNA, 23 nt, Pseudomonas putida KT2440
gcgcacgcaucugcaccggcagc

SEQ ID NO: 1623545 - RNA, 21 nt, Pseudomonas putida KT2440
gcgcacgcgcuuuuccagcaa

SEQ ID NO: 1623546 - RNA, 19 nt, Pseudomonas putida KT2440
gcgcaaugaaaaagccccu

SEQ ID NO: 1623547 - RNA, 23 nt, Pseudomonas putida KT2440
gcgcaaucaaagcagacagcugu

SEQ ID NO: 1623548 - RNA, 16 nt, Pseudomonas putida KT2440
gcgacgaccugcacaa

SEQ ID NO: 1623549 - RNA, 14 nt, Pseudomonas putida KT2440
gcgacgaaacccag

SEQ ID NO: 1623550 - RNA, 16 nt, Pseudomonas putida KT2440
gcgacgaggccgagcg

SEQ ID NO: 1623551 - RNA, 22 nt, Pseudomonas putida KT2440
gcgacucguccgacaaugccag

SEQ ID NO: 1623552 - RNA, 16 nt, Pseudomonas putida KT2440
gcgacgaugaucaggu

SEQ ID NO: 1623553 - RNA, 15 nt, Pseudomonas putida KT2440
gcgagagcgacgcgc

SEQ ID NO: 1623554 - RNA, 16 nt, Pseudomonas putida KT2440
gcgagagcuucagacc

SEQ ID NO: 1623555 - RNA, 19 nt, Pseudomonas putida KT2440
gcgagagcuucagaccuga

SEQ ID NO: 1623556 - RNA, 16 nt, Pseudomonas putida KT2440
gcgacuugauccagau

SEQ ID NO: 1623557 - RNA, 17 nt, Pseudomonas putida KT2440
gcgagagaucacuguug

SEQ ID NO: 1623558 - RNA, 20 nt, Pseudomonas putida KT2440
gcgacuucgugcgcuacaag

SEQ ID NO: 1623559 - RNA, 19 nt, Pseudomonas putida KT2440
gcgacugccaaugcucagu

SEQ ID NO: 1623560 - RNA, 13 nt, Pseudomonas putida KT2440
gcgaggcucuuga

SEQ ID NO: 1623561 - RNA, 12 nt, Pseudomonas putida KT2440
gcgaggccccag

SEQ ID NO: 1623562 - RNA, 15 nt, Pseudomonas putida KT2440
gcgaggacagcaucu

SEQ ID NO: 1623563 - RNA, 18 nt, Pseudomonas putida KT2440
gcgagccgcauuggccgg

SEQ ID NO: 1623564 - RNA, 15 nt, Pseudomonas putida KT2440
gcgagcaagcucgcu

SEQ ID NO: 1623565 - RNA, 15 nt, Pseudomonas putida KT2440
gcgagcccggcgcca

SEQ ID NO: 1623566 - RNA, 16 nt, Pseudomonas putida KT2440
gcgaugacccggccuu

SEQ ID NO: 1623567 - RNA, 23 nt, Pseudomonas putida KT2440
gcgaugaucgccuggccggccgg

SEQ ID NO: 1623568 - RNA, 11 nt, Pseudomonas putida KT2440
gcgaugaugau

SEQ ID NO: 1623569 - RNA, 16 nt, Pseudomonas putida KT2440
gcgaugagguagauca

SEQ ID NO: 1623570 - RNA, 14 nt, Pseudomonas putida KT2440
gcgaugcacgccag

SEQ ID NO: 1623571 - RNA, 18 nt, Pseudomonas putida KT2440
gcgaugaugugcgccggc

SEQ ID NO: 1623572 - RNA, 13 nt, Pseudomonas putida KT2440
gcgaucgccaggu

SEQ ID NO: 1623573 - RNA, 23 nt, Pseudomonas putida KT2440
gcgaucgccagguggaagcgcgc

SEQ ID NO: 1623574 - RNA, 19 nt, Pseudomonas putida KT2440
gcgaucgaacaacuguccu

SEQ ID NO: 1623575 - RNA, 19 nt, Pseudomonas putida KT2440
gcgagguaggccgucagca

SEQ ID NO: 1623576 - RNA, 16 nt, Pseudomonas putida KT2440
gcgauagccugugggg

SEQ ID NO: 1623577 - RNA, 13 nt, Pseudomonas putida KT2440
gcgaucagggugu

SEQ ID NO: 1623578 - RNA, 14 nt, Pseudomonas putida KT2440
gcgaucaggcaggc

SEQ ID NO: 1623579 - RNA, 19 nt, Pseudomonas putida KT2440
gcgaucaggcaggccagca

SEQ ID NO: 1623580 - RNA, 20 nt, Pseudomonas putida KT2440
gcgccagaauggaggagggc

SEQ ID NO: 1623581 - RNA, 19 nt, Pseudomonas putida KT2440
gcgccagacgcgcgcuggc

SEQ ID NO: 1623582 - RNA, 18 nt, Pseudomonas putida KT2440
gcgcaggauauccacacc

SEQ ID NO: 1623583 - RNA, 18 nt, Pseudomonas putida KT2440
gcgcaggccgacaacagc

SEQ ID NO: 1623584 - RNA, 15 nt, Pseudomonas putida KT2440
gcgcaggaacaggcu

SEQ ID NO: 1623585 - RNA, 17 nt, Pseudomonas putida KT2440
gcgcaggaacaggcuga

SEQ ID NO: 1623586 - RNA, 13 nt, Pseudomonas putida KT2440
gcgccaggucgga

SEQ ID NO: 1623587 - RNA, 22 nt, Pseudomonas putida KT2440
gcgccaggguugcaucgcgcac

SEQ ID NO: 1623588 - RNA, 16 nt, Pseudomonas putida KT2440
gcgccaguacgccagc

SEQ ID NO: 1623589 - RNA, 18 nt, Pseudomonas putida KT2440
gcgccaggucggcggggc

SEQ ID NO: 1623590 - RNA, 14 nt, Pseudomonas putida KT2440
gcgccaggcgcagg

SEQ ID NO: 1623591 - RNA, 15 nt, Pseudomonas putida KT2440
gcgccaggcgcaggc

SEQ ID NO: 1623592 - RNA, 18 nt, Pseudomonas putida KT2440
gcgccauuggugcccuug

SEQ ID NO: 1623593 - RNA, 22 nt, Pseudomonas putida KT2440
gcgccaugccccuaccgccaac

SEQ ID NO: 1623594 - RNA, 23 nt, Pseudomonas putida KT2440
gcgccauggccucgucgcggucc

SEQ ID NO: 1623595 - RNA, 13 nt, Pseudomonas putida KT2440
gcgcccgcggccc

SEQ ID NO: 1623596 - RNA, 16 nt, Pseudomonas putida KT2440
gcgcccgcugcgccgc

SEQ ID NO: 1623597 - RNA, 21 nt, Pseudomonas putida KT2440
gcgcccgcugcgccgcucugc

SEQ ID NO: 1623598 - RNA, 21 nt, Pseudomonas putida KT2440
gcgcccggcaaacacauccac

SEQ ID NO: 1623599 - RNA, 22 nt, Pseudomonas putida KT2440
gcgcccggcagaucgagcgccg

SEQ ID NO: 1623600 - RNA, 12 nt, Pseudomonas putida KT2440
gcgcccggcgcu

SEQ ID NO: 1623601 - RNA, 21 nt, Pseudomonas putida KT2440
gcgcccugugggagcggccuu

SEQ ID NO: 1623602 - RNA, 12 nt, Pseudomonas putida KT2440
gcgcccugcuca

SEQ ID NO: 1623603 - RNA, 20 nt, Pseudomonas putida KT2440
gcgcccugcugccgcaccuc

SEQ ID NO: 1623604 - RNA, 22 nt, Pseudomonas putida KT2440
gcgcccgguggcgcggccgggc

SEQ ID NO: 1623605 - RNA, 12 nt, Pseudomonas putida KT2440
gcgcccgggcca

SEQ ID NO: 1623606 - RNA, 16 nt, Pseudomonas putida KT2440
gcgcccgggccaugcu

SEQ ID NO: 1623607 - RNA, 21 nt, Pseudomonas putida KT2440
gcgcccguuacguaagucagg

SEQ ID NO: 1623608 - RNA, 16 nt, Pseudomonas putida KT2440
gcgcccaguagcgcca

SEQ ID NO: 1623609 - RNA, 18 nt, Pseudomonas putida KT2440
gcgcccaguagcgccacc

SEQ ID NO: 1623610 - RNA, 17 nt, Pseudomonas putida KT2440
gcgcccaucucaggccc

SEQ ID NO: 1623611 - RNA, 12 nt, Pseudomonas putida KT2440
gcgcccgcccac

SEQ ID NO: 1623612 - RNA, 13 nt, Pseudomonas putida KT2440
gcgcccgccccuc

SEQ ID NO: 1623613 - RNA, 21 nt, Pseudomonas putida KT2440
gcgcccgccccucgucacuga

SEQ ID NO: 1623614 - RNA, 21 nt, Pseudomonas putida KT2440
gcgcccgcaacagaucccgcu

SEQ ID NO: 1623615 - RNA, 13 nt, Pseudomonas putida KT2440
gcgcccgcacagc

SEQ ID NO: 1623616 - RNA, 14 nt, Pseudomonas putida KT2440
gcgccgcccagcuc

SEQ ID NO: 1623617 - RNA, 19 nt, Pseudomonas putida KT2440
gcgccgcccaguaccgggg

SEQ ID NO: 1623618 - RNA, 18 nt, Pseudomonas putida KT2440
gcgccgccaugcagcccg

SEQ ID NO: 1623619 - RNA, 22 nt, Pseudomonas putida KT2440
gcgccggauuucuuccauggcc

SEQ ID NO: 1623620 - RNA, 15 nt, Pseudomonas putida KT2440
gcgccggccgcacuu

SEQ ID NO: 1623621 - RNA, 14 nt, Pseudomonas putida KT2440
gcgccgagaggcgc

SEQ ID NO: 1623622 - RNA, 16 nt, Pseudomonas putida KT2440
gcgccgagccauagcg

SEQ ID NO: 1623623 - RNA, 15 nt, Pseudomonas putida KT2440
gcgccgagcgcggcg

SEQ ID NO: 1623624 - RNA, 20 nt, Pseudomonas putida KT2440
gcgccgagcgcggcgcccag

SEQ ID NO: 1623625 - RNA, 15 nt, Pseudomonas putida KT2440
gcgccgacccugugg

SEQ ID NO: 1623626 - RNA, 18 nt, Pseudomonas putida KT2440
gcgccgaccaagcgcccc

SEQ ID NO: 1623627 - RNA, 20 nt, Pseudomonas putida KT2440
gcgccgaccaagcgccccac

SEQ ID NO: 1623628 - RNA, 19 nt, Pseudomonas putida KT2440
gcgccgccacauccagcgc

SEQ ID NO: 1623629 - RNA, 23 nt, Pseudomonas putida KT2440
gcgccgccacauccagcgccucc

SEQ ID NO: 1623630 - RNA, 21 nt, Pseudomonas putida KT2440
gcgccgccaaaaaauccgccu

SEQ ID NO: 1623631 - RNA, 15 nt, Pseudomonas putida KT2440
gcgccgccaggcagc

SEQ ID NO: 1623632 - RNA, 14 nt, Pseudomonas putida KT2440
gcgccgccagcugc

SEQ ID NO: 1623633 - RNA, 13 nt, Pseudomonas putida KT2440
gcgccgccaggcg

SEQ ID NO: 1623634 - RNA, 16 nt, Pseudomonas putida KT2440
gcgccgauugcugccg

SEQ ID NO: 1623635 - RNA, 21 nt, Pseudomonas putida KT2440
gcgccgaugcucgucagcccc

SEQ ID NO: 1623636 - RNA, 21 nt, Pseudomonas putida KT2440
gcgcucgucgaacucgcgccc

SEQ ID NO: 1623637 - RNA, 21 nt, Pseudomonas putida KT2440
gcgcucggucucacaggcgcu

SEQ ID NO: 1623638 - RNA, 18 nt, Pseudomonas putida KT2440
gcgcucgaaacgccgggu

SEQ ID NO: 1623639 - RNA, 21 nt, Pseudomonas putida KT2440
gcgcucauccagcguggccug

SEQ ID NO: 1623640 - RNA, 14 nt, Pseudomonas putida KT2440
gcgcuccgccaaac

SEQ ID NO: 1623641 - RNA, 18 nt, Pseudomonas putida KT2440
gcgcuccgccaaacccca

SEQ ID NO: 1623642 - RNA, 22 nt, Pseudomonas putida KT2440
gcgcuccccgguaaugcuggug

SEQ ID NO: 1623643 - RNA, 18 nt, Pseudomonas putida KT2440
gcgcugcgaggccccaga

SEQ ID NO: 1623644 - RNA, 14 nt, Pseudomonas putida KT2440
gcgcugcgcaagga

SEQ ID NO: 1623645 - RNA, 14 nt, Pseudomonas putida KT2440
gcgcugccugcugg

SEQ ID NO: 1623646 - RNA, 21 nt, Pseudomonas putida KT2440
gcgcugcaccgaaggccgccg

SEQ ID NO: 1623647 - RNA, 18 nt, Pseudomonas putida KT2440
gcgcugcagcgucgccuc

SEQ ID NO: 1623648 - RNA, 13 nt, Pseudomonas putida KT2440
gcgcugcagcucc

SEQ ID NO: 1623649 - RNA, 17 nt, Pseudomonas putida KT2440
gcgcugcagggcgccga

SEQ ID NO: 1623650 - RNA, 16 nt, Pseudomonas putida KT2440
gcgcugccaggccggg

SEQ ID NO: 1623651 - RNA, 17 nt, Pseudomonas putida KT2440
gcgcugccaggccgggu

SEQ ID NO: 1623652 - RNA, 20 nt, Pseudomonas putida KT2440
gcgcugccaggccggguccu

SEQ ID NO: 1623653 - RNA, 19 nt, Pseudomonas putida KT2440
gcgcugauucaacgcccca

SEQ ID NO: 1623654 - RNA, 20 nt, Pseudomonas putida KT2440
gcgcugcaagcgcaccugca

SEQ ID NO: 1623655 - RNA, 18 nt, Pseudomonas putida KT2440
gcgcucaaggucacggcu

SEQ ID NO: 1623656 - RNA, 19 nt, Pseudomonas putida KT2440
gcgcucaaccgaccugcaa

SEQ ID NO: 1623657 - RNA, 16 nt, Pseudomonas putida KT2440
gcgcuacaagccggcg

SEQ ID NO: 1623658 - RNA, 19 nt, Pseudomonas putida KT2440
gcgcgugcuugcaccgaca

SEQ ID NO: 1623659 - RNA, 22 nt, Pseudomonas putida KT2440
gcgcgucugauagccagggccu

SEQ ID NO: 1623660 - RNA, 13 nt, Pseudomonas putida KT2440
gcgcggggcccga

SEQ ID NO: 1623661 - RNA, 22 nt, Pseudomonas putida KT2440
gcgcgucccccgguaccagcag

SEQ ID NO: 1623662 - RNA, 23 nt, Pseudomonas putida KT2440
gcgcgucccccgguaccagcagg

SEQ ID NO: 1623663 - RNA, 21 nt, Pseudomonas putida KT2440
gcgcgucgacaaaccgcaccc

SEQ ID NO: 1623664 - RNA, 20 nt, Pseudomonas putida KT2440
gcgcgcugaaguagcgcaga

SEQ ID NO: 1623665 - RNA, 14 nt, Pseudomonas putida KT2440
gcgcgccgccuucg

SEQ ID NO: 1623666 - RNA, 14 nt, Pseudomonas putida KT2440
gcgcgcugcugggc

SEQ ID NO: 1623667 - RNA, 14 nt, Pseudomonas putida KT2440
gcgcgcugcgcaag

SEQ ID NO: 1623668 - RNA, 22 nt, Pseudomonas putida KT2440
gcgcggcgaucaacgcaggcuc

SEQ ID NO: 1623669 - RNA, 12 nt, Pseudomonas putida KT2440
gcgcggcgcgcc

SEQ ID NO: 1623670 - RNA, 19 nt, Pseudomonas putida KT2440
gcgcgggcacccuggcggu

SEQ ID NO: 1623671 - RNA, 16 nt, Pseudomonas putida KT2440
gcgcgggcccuguggg

SEQ ID NO: 1623672 - RNA, 23 nt, Pseudomonas putida KT2440
gcgcggcauguagccacgcugcc

SEQ ID NO: 1623673 - RNA, 16 nt, Pseudomonas putida KT2440
gcgcggcaugcccgcc

SEQ ID NO: 1623674 - RNA, 21 nt, Pseudomonas putida KT2440
gcgcgacauguucagcuugua

SEQ ID NO: 1623675 - RNA, 18 nt, Pseudomonas putida KT2440
gcgcgaagcccagcuugc

SEQ ID NO: 1623676 - RNA, 16 nt, Pseudomonas putida KT2440
gcgccguggccgccau

SEQ ID NO: 1623677 - RNA, 16 nt, Pseudomonas putida KT2440
gcgccuacgacggccu

SEQ ID NO: 1623678 - RNA, 16 nt, Pseudomonas putida KT2440
gcgccuacagcggccu

SEQ ID NO: 1623679 - RNA, 15 nt, Pseudomonas putida KT2440
gcgcgacgcagcagc

SEQ ID NO: 1623680 - RNA, 16 nt, Pseudomonas putida KT2440
gcgcgaucaccagccc

SEQ ID NO: 1623681 - RNA, 17 nt, Pseudomonas putida KT2440
gcgcgauagccuguggg

SEQ ID NO: 1623682 - RNA, 18 nt, Pseudomonas putida KT2440
gcgcgagcugggcacggc

SEQ ID NO: 1623683 - RNA, 14 nt, Pseudomonas putida KT2440
gcgcgccagcaggu

SEQ ID NO: 1623684 - RNA, 12 nt, Pseudomonas putida KT2440
gcgcgccagcgc

SEQ ID NO: 1623685 - RNA, 18 nt, Pseudomonas putida KT2440
gcgcgccaguucgcggcg

SEQ ID NO: 1623686 - RNA, 15 nt, Pseudomonas putida KT2440
gcguuucuucauccc

SEQ ID NO: 1623687 - RNA, 16 nt, Pseudomonas putida KT2440
gcguuucuucaucccu

SEQ ID NO: 1623688 - RNA, 14 nt, Pseudomonas putida KT2440
gcguuuuauaaaga

SEQ ID NO: 1623689 - RNA, 14 nt, Pseudomonas putida KT2440
gcguggucgccggc

SEQ ID NO: 1623690 - RNA, 15 nt, Pseudomonas putida KT2440
gcguucgaaagccca

SEQ ID NO: 1623691 - RNA, 20 nt, Pseudomonas putida KT2440
gcguucgaugcgcagagcca

SEQ ID NO: 1623692 - RNA, 22 nt, Pseudomonas putida KT2440
gcguucgcccaggcgccgcagc

SEQ ID NO: 1623693 - RNA, 16 nt, Pseudomonas putida KT2440
gcguucgcccuccugc

SEQ ID NO: 1623694 - RNA, 15 nt, Pseudomonas putida KT2440
gcguucggccagcac

SEQ ID NO: 1623695 - RNA, 17 nt, Pseudomonas putida KT2440
gcguuaugacuggccuc

SEQ ID NO: 1623696 - RNA, 21 nt, Pseudomonas putida KT2440
gcgugcuguugagccagggcg

SEQ ID NO: 1623697 - RNA, 19 nt, Pseudomonas putida KT2440
gcgugcuuccaccucgggc

SEQ ID NO: 1623698 - RNA, 19 nt, Pseudomonas putida KT2440
gcguggaugaucggcuggc

SEQ ID NO: 1623699 - RNA, 23 nt, Pseudomonas putida KT2440
gcgugcccggcaaucgccaggcg

SEQ ID NO: 1623700 - RNA, 18 nt, Pseudomonas putida KT2440
gcgugcccgcgaaugcaa

SEQ ID NO: 1623701 - RNA, 13 nt, Pseudomonas putida KT2440
gcgugaaauccuc

SEQ ID NO: 1623702 - RNA, 14 nt, Pseudomonas putida KT2440
gcgucugccgcagc

SEQ ID NO: 1623703 - RNA, 20 nt, Pseudomonas putida KT2440
gcgucugccgcagccccgcc

SEQ ID NO: 1623704 - RNA, 15 nt, Pseudomonas putida KT2440
gcgucugauagccag

SEQ ID NO: 1623705 - RNA, 22 nt, Pseudomonas putida KT2440
gcgucucuuucaggcacagcac

SEQ ID NO: 1623706 - RNA, 12 nt, Pseudomonas putida KT2440
gcguagugcagg

SEQ ID NO: 1623707 - RNA, 20 nt, Pseudomonas putida KT2440
gcuaccugugggagcgggcg

SEQ ID NO: 1623708 - RNA, 16 nt, Pseudomonas putida KT2440
gcuacgauccgauaau

SEQ ID NO: 1623709 - RNA, 20 nt, Pseudomonas putida KT2440
gcuacgaaaccgucaugcag

SEQ ID NO: 1623710 - RNA, 20 nt, Pseudomonas putida KT2440
gcuaccgcauucuuggccag

SEQ ID NO: 1623711 - RNA, 19 nt, Pseudomonas putida KT2440
gcuaccccacaaccccugc

SEQ ID NO: 1623712 - RNA, 14 nt, Pseudomonas putida KT2440
gcuacccagccggg

SEQ ID NO: 1623713 - RNA, 17 nt, Pseudomonas putida KT2440
gcuacccagccgggcau

SEQ ID NO: 1623714 - RNA, 19 nt, Pseudomonas putida KT2440
gcuacggccgugcagggcg

SEQ ID NO: 1623715 - RNA, 21 nt, Pseudomonas putida KT2440
gcuacgcuggacuugccuugg

SEQ ID NO: 1623716 - RNA, 23 nt, Pseudomonas putida KT2440
gcuacgcgcgggguugacagagg

SEQ ID NO: 1623717 - RNA, 14 nt, Pseudomonas putida KT2440
gcuacgcagcaccc

SEQ ID NO: 1623718 - RNA, 12 nt, Pseudomonas putida KT2440
gcuacgccgccc

SEQ ID NO: 1623719 - RNA, 17 nt, Pseudomonas putida KT2440
gcuacgccgccgcuggc

SEQ ID NO: 1623720 - RNA, 14 nt, Pseudomonas putida KT2440
gcuacagccccuuc

SEQ ID NO: 1623721 - RNA, 19 nt, Pseudomonas putida KT2440
gcuacagaucagccacggg

SEQ ID NO: 1623722 - RNA, 17 nt, Pseudomonas putida KT2440
gcuacagaagccucacc

SEQ ID NO: 1623723 - RNA, 15 nt, Pseudomonas putida KT2440
gcuacaugaaccaca

SEQ ID NO: 1623724 - RNA, 17 nt, Pseudomonas putida KT2440
gcuacaugaaccacaca

SEQ ID NO: 1623725 - RNA, 19 nt, Pseudomonas putida KT2440
gcuaaaccgcgaugcugca

SEQ ID NO: 1623726 - RNA, 15 nt, Pseudomonas putida KT2440
gcuaaagaguccgaa

SEQ ID NO: 1623727 - RNA, 18 nt, Pseudomonas putida KT2440
gcuaaggcugauaagcaa

SEQ ID NO: 1623728 - RNA, 22 nt, Pseudomonas putida KT2440
gcuaacguagggaagcggauga

SEQ ID NO: 1623729 - RNA, 13 nt, Pseudomonas putida KT2440
gcuaauacccugu

SEQ ID NO: 1623730 - RNA, 17 nt, Pseudomonas putida KT2440
gcucaggcucaguugca

SEQ ID NO: 1623731 - RNA, 19 nt, Pseudomonas putida KT2440
gcucaggcucaguugcaag

SEQ ID NO: 1623732 - RNA, 22 nt, Pseudomonas putida KT2440
gcucagggcagcaacgccgagc

SEQ ID NO: 1623733 - RNA, 16 nt, Pseudomonas putida KT2440
gcucagugucagcggc

SEQ ID NO: 1623734 - RNA, 15 nt, Pseudomonas putida KT2440
gcucauccaggcugc

SEQ ID NO: 1623735 - RNA, 13 nt, Pseudomonas putida KT2440
gcucaucaccagg

SEQ ID NO: 1623736 - RNA, 23 nt, Pseudomonas putida KT2440
gcucaucaccaggcccgcaaggg

SEQ ID NO: 1623737 - RNA, 21 nt, Pseudomonas putida KT2440
gcucauacccuuugccaucca

SEQ ID NO: 1623738 - RNA, 22 nt, Pseudomonas putida KT2440
gcucauacccuuugccauccac

SEQ ID NO: 1623739 - RNA, 14 nt, Pseudomonas putida KT2440
gcuccagcaccucg

SEQ ID NO: 1623740 - RNA, 21 nt, Pseudomonas putida KT2440
gcuccagacgcuguacgucca

SEQ ID NO: 1623741 - RNA, 15 nt, Pseudomonas putida KT2440
gcuccagcagugccg

SEQ ID NO: 1623742 - RNA, 19 nt, Pseudomonas putida KT2440
gcuccagcgcacgcaacag

SEQ ID NO: 1623743 - RNA, 21 nt, Pseudomonas putida KT2440
gcucauccuuuuuugggcuga

SEQ ID NO: 1623744 - RNA, 24 nt, Pseudomonas putida KT2440
gcucauccagcguggccugcaagc

SEQ ID NO: 1623745 - RNA, 19 nt, Pseudomonas putida KT2440
gcuccaacuggcgcaucuu

SEQ ID NO: 1623746 - RNA, 14 nt, Pseudomonas putida KT2440
gcuccaacaaacuc

SEQ ID NO: 1623747 - RNA, 12 nt, Pseudomonas putida KT2440
gcuccaaagcca

SEQ ID NO: 1623748 - RNA, 18 nt, Pseudomonas putida KT2440
gcucaccggccagcgcgc

SEQ ID NO: 1623749 - RNA, 20 nt, Pseudomonas putida KT2440
gcucaccggccagcgcgcug

SEQ ID NO: 1623750 - RNA, 22 nt, Pseudomonas putida KT2440
gcucacccgaccagaucaggcc

SEQ ID NO: 1623751 - RNA, 14 nt, Pseudomonas putida KT2440
gcucacagcacucg

SEQ ID NO: 1623752 - RNA, 22 nt, Pseudomonas putida KT2440
gcucacagcccgggcauguuca

SEQ ID NO: 1623753 - RNA, 15 nt, Pseudomonas putida KT2440
gcucacaggcucagu

SEQ ID NO: 1623754 - RNA, 11 nt, Pseudomonas putida KT2440
gcucaccacca

SEQ ID NO: 1623755 - RNA, 13 nt, Pseudomonas putida KT2440
gcucacccaccag

SEQ ID NO: 1623756 - RNA, 16 nt, Pseudomonas putida KT2440
gcucagcaacugggca

SEQ ID NO: 1623757 - RNA, 14 nt, Pseudomonas putida KT2440
gcucagcacauuca

SEQ ID NO: 1623758 - RNA, 22 nt, Pseudomonas putida KT2440
gcucagcagguugaacagcagc

SEQ ID NO: 1623759 - RNA, 22 nt, Pseudomonas putida KT2440
gcucaggccuucgccacugcca

SEQ ID NO: 1623760 - RNA, 14 nt, Pseudomonas putida KT2440
gcucaggccaugcu

SEQ ID NO: 1623761 - RNA, 13 nt, Pseudomonas putida KT2440
gcucacugcucau

SEQ ID NO: 1623762 - RNA, 21 nt, Pseudomonas putida KT2440
gcucacuggccaacuccccac

SEQ ID NO: 1623763 - RNA, 20 nt, Pseudomonas putida KT2440
gcuaggcggccccauuucaa

SEQ ID NO: 1623764 - RNA, 20 nt, Pseudomonas putida KT2440
gcuacugccgucguuguucu

SEQ ID NO: 1623765 - RNA, 16 nt, Pseudomonas putida KT2440
gcucaauagcggcggu

SEQ ID NO: 1623766 - RNA, 19 nt, Pseudomonas putida KT2440
gcucaaucaaccagcccgc

SEQ ID NO: 1623767 - RNA, 14 nt, Pseudomonas putida KT2440
gcucacaaagcccu

SEQ ID NO: 1623768 - RNA, 21 nt, Pseudomonas putida KT2440
gcucaauuggauagagcaucc

SEQ ID NO: 1623769 - RNA, 17 nt, Pseudomonas putida KT2440
gcuccaucuccagcuca

SEQ ID NO: 1623770 - RNA, 18 nt, Pseudomonas putida KT2440
gcuccgaccgguggccug

SEQ ID NO: 1623771 - RNA, 13 nt, Pseudomonas putida KT2440
gcuccgacaggcu

SEQ ID NO: 1623772 - RNA, 14 nt, Pseudomonas putida KT2440
gcuccaguggugca

SEQ ID NO: 1623773 - RNA, 20 nt, Pseudomonas putida KT2440
gcuccaguucauucccggcc

SEQ ID NO: 1623774 - RNA, 18 nt, Pseudomonas putida KT2440
gcuccgccaaaccccagc

SEQ ID NO: 1623775 - RNA, 14 nt, Pseudomonas putida KT2440
gcucgacaaauccc

SEQ ID NO: 1623776 - RNA, 17 nt, Pseudomonas putida KT2440
gcucgacaacccgcgcu

SEQ ID NO: 1623777 - RNA, 18 nt, Pseudomonas putida KT2440
gcucgaauacacgggaca

SEQ ID NO: 1623778 - RNA, 15 nt, Pseudomonas putida KT2440
gcucgacagcaacuu

SEQ ID NO: 1623779 - RNA, 18 nt, Pseudomonas putida KT2440
gcucgaacucuuccagcu

SEQ ID NO: 1623780 - RNA, 18 nt, Pseudomonas putida KT2440
gcucgaagcgcucaugca

SEQ ID NO: 1623781 - RNA, 13 nt, Pseudomonas putida KT2440
gcucgaaccaagg

SEQ ID NO: 1623782 - RNA, 16 nt, Pseudomonas putida KT2440
gcucgaacccacuguc

SEQ ID NO: 1623783 - RNA, 22 nt, Pseudomonas putida KT2440
gcucgacccgcgucagcucaag

SEQ ID NO: 1623784 - RNA, 17 nt, Pseudomonas putida KT2440
gcucgaucuugccuucg

SEQ ID NO: 1623785 - RNA, 15 nt, Pseudomonas putida KT2440
gcuccuacacaggaa

SEQ ID NO: 1623786 - RNA, 17 nt, Pseudomonas putida KT2440
gcuccuacacgcggccu

SEQ ID NO: 1623787 - RNA, 18 nt, Pseudomonas putida KT2440
gcuccuacaggggacgca

SEQ ID NO: 1623788 - RNA, 20 nt, Pseudomonas putida KT2440
gcuccuacgacggccugcgc

SEQ ID NO: 1623789 - RNA, 17 nt, Pseudomonas putida KT2440
gcuccuacgcggggcag

SEQ ID NO: 1623790 - RNA, 18 nt, Pseudomonas putida KT2440
gcuccuacgcggggcagc

SEQ ID NO: 1623791 - RNA, 19 nt, Pseudomonas putida KT2440
gcuccuacgcggggcagcg

SEQ ID NO: 1623792 - RNA, 21 nt, Pseudomonas putida KT2440
gcuccuacggaaucugcaccg

SEQ ID NO: 1623793 - RNA, 20 nt, Pseudomonas putida KT2440
gcuccuacgggcaaccgcau

SEQ ID NO: 1623794 - RNA, 20 nt, Pseudomonas putida KT2440
gcuccuacggggguucacag

SEQ ID NO: 1623795 - RNA, 16 nt, Pseudomonas putida KT2440
gcucgcagauaaccug

SEQ ID NO: 1623796 - RNA, 19 nt, Pseudomonas putida KT2440
gcucgcaugagccggggcu

SEQ ID NO: 1623797 - RNA, 18 nt, Pseudomonas putida KT2440
gcucgccaacaccgcccc

SEQ ID NO: 1623798 - RNA, 12 nt, Pseudomonas putida KT2440
gcucgccugcuu

SEQ ID NO: 1623799 - RNA, 14 nt, Pseudomonas putida KT2440
gcucgccugcuugg

SEQ ID NO: 1623800 - RNA, 17 nt, Pseudomonas putida KT2440
gcucgcgaugcgccgcg

SEQ ID NO: 1623801 - RNA, 16 nt, Pseudomonas putida KT2440
gcucgcgcagggcauc

SEQ ID NO: 1623802 - RNA, 15 nt, Pseudomonas putida KT2440
gcucgcgcaugaucg

SEQ ID NO: 1623803 - RNA, 18 nt, Pseudomonas putida KT2440
gcucgcgggccuggagca

SEQ ID NO: 1623804 - RNA, 24 nt, Pseudomonas putida KT2440
gcucggcgaugccgcgcgcccgcu

SEQ ID NO: 1623805 - RNA, 14 nt, Pseudomonas putida KT2440
gcucggccugggca

SEQ ID NO: 1623806 - RNA, 19 nt, Pseudomonas putida KT2440
gcucggccuugcgagccug

SEQ ID NO: 1623807 - RNA, 17 nt, Pseudomonas putida KT2440
gcucggcaucuuuggcu

SEQ ID NO: 1623808 - RNA, 18 nt, Pseudomonas putida KT2440
gcucggccaccacuucug

SEQ ID NO: 1623809 - RNA, 19 nt, Pseudomonas putida KT2440
gcucggccggggcaaccug

SEQ ID NO: 1623810 - RNA, 19 nt, Pseudomonas putida KT2440
gcucgcuuuccaaaccugc

SEQ ID NO: 1623811 - RNA, 16 nt, Pseudomonas putida KT2440
gcucggagaacgggcu

SEQ ID NO: 1623812 - RNA, 19 nt, Pseudomonas putida KT2440
gcucggaaaggucggcggc

SEQ ID NO: 1623813 - RNA, 21 nt, Pseudomonas putida KT2440
gcucgcugcugccuucccguc

SEQ ID NO: 1623814 - RNA, 15 nt, Pseudomonas putida KT2440
gcucgcugccccagu

SEQ ID NO: 1623815 - RNA, 20 nt, Pseudomonas putida KT2440
gcucgcugcgaucgaaauca

SEQ ID NO: 1623816 - RNA, 17 nt, Pseudomonas putida KT2440
gcucgcucaggcgcagc

SEQ ID NO: 1623817 - RNA, 16 nt, Pseudomonas putida KT2440
gcggcauuggcgcgcu

SEQ ID NO: 1623818 - RNA, 20 nt, Pseudomonas putida KT2440
gcggccagcacgaacagcaa

SEQ ID NO: 1623819 - RNA, 14 nt, Pseudomonas putida KT2440
gcggccagcccgcc

SEQ ID NO: 1623820 - RNA, 20 nt, Pseudomonas putida KT2440
gcggccacgcccuuuuucac

SEQ ID NO: 1623821 - RNA, 14 nt, Pseudomonas putida KT2440
gcggccaaugcugc

SEQ ID NO: 1623822 - RNA, 17 nt, Pseudomonas putida KT2440
gcggccacagcgccaac

SEQ ID NO: 1623823 - RNA, 21 nt, Pseudomonas putida KT2440
gcggccccggcgccgccaggc

SEQ ID NO: 1623824 - RNA, 23 nt, Pseudomonas putida KT2440
gcggccccagauuucucagcugg

SEQ ID NO: 1623825 - RNA, 22 nt, Pseudomonas putida KT2440
gcggccccaagcuucaccucag

SEQ ID NO: 1623826 - RNA, 15 nt, Pseudomonas putida KT2440
gcggccccaguggcu

SEQ ID NO: 1623827 - RNA, 22 nt, Pseudomonas putida KT2440
gcggccaugauuacgcugaaag

SEQ ID NO: 1623828 - RNA, 13 nt, Pseudomonas putida KT2440
gcggcccagccca

SEQ ID NO: 1623829 - RNA, 14 nt, Pseudomonas putida KT2440
gcggcccagcccag

SEQ ID NO: 1623830 - RNA, 16 nt, Pseudomonas putida KT2440
gcggccagcgccuggc

SEQ ID NO: 1623831 - RNA, 20 nt, Pseudomonas putida KT2440
gcggcacugaugcccaugcc

SEQ ID NO: 1623832 - RNA, 15 nt, Pseudomonas putida KT2440
gcggcagaacacauc

SEQ ID NO: 1623833 - RNA, 14 nt, Pseudomonas putida KT2440
gcggcagcagcagc

SEQ ID NO: 1623834 - RNA, 17 nt, Pseudomonas putida KT2440
gcggcagauccugcagc

SEQ ID NO: 1623835 - RNA, 19 nt, Pseudomonas putida KT2440
gcgcuuaaaucaagagccc

SEQ ID NO: 1623836 - RNA, 23 nt, Pseudomonas putida KT2440
gcggcacuaccaggcccaacagc

SEQ ID NO: 1623837 - RNA, 16 nt, Pseudomonas putida KT2440
gcgcugucggucagca

SEQ ID NO: 1623838 - RNA, 14 nt, Pseudomonas putida KT2440
gcgcugugcucagc

SEQ ID NO: 1623839 - RNA, 13 nt, Pseudomonas putida KT2440
gcgcuguggcgcc

SEQ ID NO: 1623840 - RNA, 14 nt, Pseudomonas putida KT2440
gcgcuguggcgccc

SEQ ID NO: 1623841 - RNA, 17 nt, Pseudomonas putida KT2440
gcgcuguggcgcccggc

SEQ ID NO: 1623842 - RNA, 17 nt, Pseudomonas putida KT2440
gcgcugucccccagccc

SEQ ID NO: 1623843 - RNA, 22 nt, Pseudomonas putida KT2440
gcgcugguucauugccaacagc

SEQ ID NO: 1623844 - RNA, 18 nt, Pseudomonas putida KT2440
gcggcaguugcaggcgca

SEQ ID NO: 1623845 - RNA, 20 nt, Pseudomonas putida KT2440
gcggcaguugcaggcgcagg

SEQ ID NO: 1623846 - RNA, 18 nt, Pseudomonas putida KT2440
gcggcauccaggcgggcg

SEQ ID NO: 1623847 - RNA, 13 nt, Pseudomonas putida KT2440
gcggcaggcuggc

SEQ ID NO: 1623848 - RNA, 16 nt, Pseudomonas putida KT2440
gcggcaggcuggcgug

SEQ ID NO: 1623849 - RNA, 17 nt, Pseudomonas putida KT2440
gcggcagguaggcccag

SEQ ID NO: 1623850 - RNA, 15 nt, Pseudomonas putida KT2440
gcggcagccagcauc

SEQ ID NO: 1623851 - RNA, 19 nt, Pseudomonas putida KT2440
gcggcagcaugaacagcgc

SEQ ID NO: 1623852 - RNA, 15 nt, Pseudomonas putida KT2440
gcggcaggcgcagcu

SEQ ID NO: 1623853 - RNA, 17 nt, Pseudomonas putida KT2440
gcggcaggcgcagcugc

SEQ ID NO: 1623854 - RNA, 22 nt, Pseudomonas putida KT2440
gcggccgaggccgauuuggccc

SEQ ID NO: 1623855 - RNA, 19 nt, Pseudomonas putida KT2440
gcggccgcagccccaccuc

SEQ ID NO: 1623856 - RNA, 15 nt, Pseudomonas putida KT2440
gcggccgaaggggcg

SEQ ID NO: 1623857 - RNA, 16 nt, Pseudomonas putida KT2440
gcggcccuucgcgggc

SEQ ID NO: 1623858 - RNA, 20 nt, Pseudomonas putida KT2440
gcggccgccuccugcugcug

SEQ ID NO: 1623859 - RNA, 16 nt, Pseudomonas putida KT2440
gcggccuacccgggcg

SEQ ID NO: 1623860 - RNA, 13 nt, Pseudomonas putida KT2440
gcggccugcagcu

SEQ ID NO: 1623861 - RNA, 20 nt, Pseudomonas putida KT2440
gcggccgggucgauagccag

SEQ ID NO: 1623862 - RNA, 22 nt, Pseudomonas putida KT2440
gcggccgucaacgaggccgcca

SEQ ID NO: 1623863 - RNA, 14 nt, Pseudomonas putida KT2440
gcggccgucaugcg

SEQ ID NO: 1623864 - RNA, 16 nt, Pseudomonas putida KT2440
gcggccgucgcggcug

SEQ ID NO: 1623865 - RNA, 17 nt, Pseudomonas putida KT2440
gcggccuugugcggccc

SEQ ID NO: 1623866 - RNA, 17 nt, Pseudomonas putida KT2440
gcggccuugaccacuuc

SEQ ID NO: 1623867 - RNA, 19 nt, Pseudomonas putida KT2440
gcggccuucaagcucccca

SEQ ID NO: 1623868 - RNA, 21 nt, Pseudomonas putida KT2440
gcggccuucaagcuccccagc

SEQ ID NO: 1623869 - RNA, 20 nt, Pseudomonas putida KT2440
gcggcgacaggugccccuug

SEQ ID NO: 1623870 - RNA, 23 nt, Pseudomonas putida KT2440
gcggcgcgagaaccacaucacga

SEQ ID NO: 1623871 - RNA, 21 nt, Pseudomonas putida KT2440
gcgguugucgaccuggcucuu

SEQ ID NO: 1623872 - RNA, 23 nt, Pseudomonas putida KT2440
gcgguuguagaucgccggcagca

SEQ ID NO: 1623873 - RNA, 22 nt, Pseudomonas putida KT2440
gcgguuggugcgccuccagcag

SEQ ID NO: 1623874 - RNA, 17 nt, Pseudomonas putida KT2440
gcguaaagcgccccagg

SEQ ID NO: 1623875 - RNA, 22 nt, Pseudomonas putida KT2440
gcgguucaucggcaaacacauc

SEQ ID NO: 1623876 - RNA, 20 nt, Pseudomonas putida KT2440
gcgguucuucgccugcagca

SEQ ID NO: 1623877 - RNA, 14 nt, Pseudomonas putida KT2440
gcgguugaccaggg

SEQ ID NO: 1623878 - RNA, 15 nt, Pseudomonas putida KT2440
gcgguugcaggacua

SEQ ID NO: 1623879 - RNA, 21 nt, Pseudomonas putida KT2440
gcgguugcaccguggcagcaa

SEQ ID NO: 1623880 - RNA, 14 nt, Pseudomonas putida KT2440
gcguaccagcaggg

SEQ ID NO: 1623881 - RNA, 14 nt, Pseudomonas putida KT2440
gcguacagcugcuc

SEQ ID NO: 1623882 - RNA, 15 nt, Pseudomonas putida KT2440
gcguacaucagccuc

SEQ ID NO: 1623883 - RNA, 21 nt, Pseudomonas putida KT2440
gcguacagcgacaugccggcc

SEQ ID NO: 1623884 - RNA, 14 nt, Pseudomonas putida KT2440
gcguacggccuugg

SEQ ID NO: 1623885 - RNA, 22 nt, Pseudomonas putida KT2440
gcguaccccuggcgcuuuccag

SEQ ID NO: 1623886 - RNA, 21 nt, Pseudomonas putida KT2440
gcggugccuucaggcgcuggu

SEQ ID NO: 1623887 - RNA, 19 nt, Pseudomonas putida KT2440
gcgguggaucgcacucagu

SEQ ID NO: 1623888 - RNA, 11 nt, Pseudomonas putida KT2440
gcggugcucga

SEQ ID NO: 1623889 - RNA, 12 nt, Pseudomonas putida KT2440
gcgguggaagcu

SEQ ID NO: 1623890 - RNA, 20 nt, Pseudomonas putida KT2440
gcggugcggcguagaccagu

SEQ ID NO: 1623891 - RNA, 17 nt, Pseudomonas putida KT2440
gcggucaagcucguccu

SEQ ID NO: 1623892 - RNA, 23 nt, Pseudomonas putida KT2440
gcggguuuccucggucgccgagc

SEQ ID NO: 1623893 - RNA, 23 nt, Pseudomonas putida KT2440
gcggguuuacccgcgaacaggcc

SEQ ID NO: 1623894 - RNA, 23 nt, Pseudomonas putida KT2440
gcggguucacccgcgaagcaggc

SEQ ID NO: 1623895 - RNA, 20 nt, Pseudomonas putida KT2440
gcggucgccaaauucgacca

SEQ ID NO: 1623896 - RNA, 14 nt, Pseudomonas putida KT2440
gcggucagccugcg

SEQ ID NO: 1623897 - RNA, 21 nt, Pseudomonas putida KT2440
gcggucaauuggagcggccuu

SEQ ID NO: 1623898 - RNA, 17 nt, Pseudomonas putida KT2440
gcgggcaaacuggcgcc

SEQ ID NO: 1623899 - RNA, 18 nt, Pseudomonas putida KT2440
gcgggcaaacuggcgccc

SEQ ID NO: 1623900 - RNA, 16 nt, Pseudomonas putida KT2440
gcgggcaagcccgcuc

SEQ ID NO: 1623901 - RNA, 14 nt, Pseudomonas putida KT2440
gcgggcacgcccgc

SEQ ID NO: 1623902 - RNA, 20 nt, Pseudomonas putida KT2440
gcgggcacgcccgcucccac

SEQ ID NO: 1623903 - RNA, 21 nt, Pseudomonas putida KT2440
gcgggcacgcccgcucccaca

SEQ ID NO: 1623904 - RNA, 22 nt, Pseudomonas putida KT2440
gcgggcaaggucgaugcugcug

SEQ ID NO: 1623905 - RNA, 15 nt, Pseudomonas putida KT2440
gcgggcagugcaaua

SEQ ID NO: 1623906 - RNA, 14 nt, Pseudomonas putida KT2440
gcggcuuggcacga

SEQ ID NO: 1623907 - RNA, 19 nt, Pseudomonas putida KT2440
gcggcgcuuauggcgccgc

SEQ ID NO: 1623908 - RNA, 21 nt, Pseudomonas putida KT2440
gcggcgcuuauggcgccgcga

SEQ ID NO: 1623909 - RNA, 19 nt, Pseudomonas putida KT2440
gcggcggcuaagcgccagc

SEQ ID NO: 1623910 - RNA, 14 nt, Pseudomonas putida KT2440
gcggcugaauccua

SEQ ID NO: 1623911 - RNA, 15 nt, Pseudomonas putida KT2440
gcggcugaacacgcu

SEQ ID NO: 1623912 - RNA, 15 nt, Pseudomonas putida KT2440
gcggcucgucaacca

SEQ ID NO: 1623913 - RNA, 19 nt, Pseudomonas putida KT2440
gcggcuguucgcagcacaa

SEQ ID NO: 1623914 - RNA, 22 nt, Pseudomonas putida KT2440
gcggcugccuacccaggcaacg

SEQ ID NO: 1623915 - RNA, 16 nt, Pseudomonas putida KT2440
gcggcugcgacggcga

SEQ ID NO: 1623916 - RNA, 14 nt, Pseudomonas putida KT2440
gcggcugacgaagc

SEQ ID NO: 1623917 - RNA, 10 nt, Pseudomonas putida KT2440
gcggcugacc

SEQ ID NO: 1623918 - RNA, 13 nt, Pseudomonas putida KT2440
gcggcugagccgg

SEQ ID NO: 1623919 - RNA, 17 nt, Pseudomonas putida KT2440
gcggguccagcgcggcc

SEQ ID NO: 1623920 - RNA, 13 nt, Pseudomonas putida KT2440
gcgggucagcagc

SEQ ID NO: 1623921 - RNA, 14 nt, Pseudomonas putida KT2440
gcgggucaagcugg

SEQ ID NO: 1623922 - RNA, 15 nt, Pseudomonas putida KT2440
gcgggucaagcugga

SEQ ID NO: 1623923 - RNA, 13 nt, Pseudomonas putida KT2440
gcgggggcgcguc

SEQ ID NO: 1623924 - RNA, 21 nt, Pseudomonas putida KT2440
gcggguccucgaaacgcaggc

SEQ ID NO: 1623925 - RNA, 17 nt, Pseudomonas putida KT2440
gcggggcaucgccgagg

SEQ ID NO: 1623926 - RNA, 15 nt, Pseudomonas putida KT2440
gcgggcaugcccgcu

SEQ ID NO: 1623927 - RNA, 16 nt, Pseudomonas putida KT2440
gcgggcaugcccgcuc

SEQ ID NO: 1623928 - RNA, 21 nt, Pseudomonas putida KT2440
gcgggcaugcccgcucccaca

SEQ ID NO: 1623929 - RNA, 16 nt, Pseudomonas putida KT2440
gcgggccagcccaucc

SEQ ID NO: 1623930 - RNA, 20 nt, Pseudomonas putida KT2440
gcgggcccagcaggugccca

SEQ ID NO: 1623931 - RNA, 14 nt, Pseudomonas putida KT2440
gcgggcuuucuggu

SEQ ID NO: 1623932 - RNA, 22 nt, Pseudomonas putida KT2440
gcgggcgauugccagggugcca

SEQ ID NO: 1623933 - RNA, 19 nt, Pseudomonas putida KT2440
gcgggcgaagaugcguucg

SEQ ID NO: 1623934 - RNA, 17 nt, Pseudomonas putida KT2440
gccugcugguacagccg

SEQ ID NO: 1623935 - RNA, 20 nt, Pseudomonas putida KT2440
gccugcuggccgcgcaggaa

SEQ ID NO: 1623936 - RNA, 20 nt, Pseudomonas putida KT2440
gccugcuggcggcugagccg

SEQ ID NO: 1623937 - RNA, 23 nt, Pseudomonas putida KT2440
gccugcugcuggaucagugucug

SEQ ID NO: 1623938 - RNA, 15 nt, Pseudomonas putida KT2440
gccugcugcucccca

SEQ ID NO: 1623939 - RNA, 23 nt, Pseudomonas putida KT2440
gccugcuuggcaccuaucgcugc

SEQ ID NO: 1623940 - RNA, 22 nt, Pseudomonas putida KT2440
gccugcuuggccgacuggcgca

SEQ ID NO: 1623941 - RNA, 13 nt, Pseudomonas putida KT2440
gccuggccacugu

SEQ ID NO: 1623942 - RNA, 15 nt, Pseudomonas putida KT2440
gccuggccacuguug

SEQ ID NO: 1623943 - RNA, 15 nt, Pseudomonas putida KT2440
gccuggcccggugca

SEQ ID NO: 1623944 - RNA, 16 nt, Pseudomonas putida KT2440
gccuggcccgcagcgc

SEQ ID NO: 1623945 - RNA, 15 nt, Pseudomonas putida KT2440
gccuggccgcugcgc

SEQ ID NO: 1623946 - RNA, 19 nt, Pseudomonas putida KT2440
gccugcucaaucaaccagc

SEQ ID NO: 1623947 - RNA, 13 nt, Pseudomonas putida KT2440
gccugcucgcugg

SEQ ID NO: 1623948 - RNA, 14 nt, Pseudomonas putida KT2440
gccugcugccaggc

SEQ ID NO: 1623949 - RNA, 12 nt, Pseudomonas putida KT2440
gccugcuccagc

SEQ ID NO: 1623950 - RNA, 19 nt, Pseudomonas putida KT2440
gccugcgggaaguccgcca

SEQ ID NO: 1623951 - RNA, 16 nt, Pseudomonas putida KT2440
gccugcggcagccagc

SEQ ID NO: 1623952 - RNA, 15 nt, Pseudomonas putida KT2440
gccugcggccaggcc

SEQ ID NO: 1623953 - RNA, 17 nt, Pseudomonas putida KT2440
gccugcggccaggccgg

SEQ ID NO: 1623954 - RNA, 17 nt, Pseudomonas putida KT2440
gccugcggcaucagggc

SEQ ID NO: 1623955 - RNA, 19 nt, Pseudomonas putida KT2440
gccugcggcaucagggccc

SEQ ID NO: 1623956 - RNA, 14 nt, Pseudomonas putida KT2440
gccugcgcuccagc

SEQ ID NO: 1623957 - RNA, 17 nt, Pseudomonas putida KT2440
gccugcgcuccagcagc

SEQ ID NO: 1623958 - RNA, 19 nt, Pseudomonas putida KT2440
gccugcgcuccagcagcuc

SEQ ID NO: 1623959 - RNA, 11 nt, Pseudomonas putida KT2440
gccugggcucg

SEQ ID NO: 1623960 - RNA, 22 nt, Pseudomonas putida KT2440
gccugggcugucgccuacagga

SEQ ID NO: 1623961 - RNA, 15 nt, Pseudomonas putida KT2440
gccugggucagcugg

SEQ ID NO: 1623962 - RNA, 17 nt, Pseudomonas putida KT2440
gccugggggucgcccgc

SEQ ID NO: 1623963 - RNA, 12 nt, Pseudomonas putida KT2440
gccuggguuuua

SEQ ID NO: 1623964 - RNA, 16 nt, Pseudomonas putida KT2440
gccuggugccagcggc

SEQ ID NO: 1623965 - RNA, 23 nt, Pseudomonas putida KT2440
gccuggucuucguuacgcccggc

SEQ ID NO: 1623966 - RNA, 19 nt, Pseudomonas putida KT2440
gccuggcgcaguucgucca

SEQ ID NO: 1623967 - RNA, 15 nt, Pseudomonas putida KT2440
gccuggccugcaugc

SEQ ID NO: 1623968 - RNA, 16 nt, Pseudomonas putida KT2440
gccuggccugcaugcu

SEQ ID NO: 1623969 - RNA, 23 nt, Pseudomonas putida KT2440
gccuggcgcuuggaaauguucaa

SEQ ID NO: 1623970 - RNA, 10 nt, Pseudomonas putida KT2440
gccugggccg

SEQ ID NO: 1623971 - RNA, 19 nt, Pseudomonas putida KT2440
gccuguacacagcccaagg

SEQ ID NO: 1623972 - RNA, 19 nt, Pseudomonas putida KT2440
gccugguuuucgcucgccg

SEQ ID NO: 1623973 - RNA, 13 nt, Pseudomonas putida KT2440
gccugucacgccu

SEQ ID NO: 1623974 - RNA, 22 nt, Pseudomonas putida KT2440
gccugucacgccuucaaacacu

SEQ ID NO: 1623975 - RNA, 17 nt, Pseudomonas putida KT2440
gccuguccccuuggccc

SEQ ID NO: 1623976 - RNA, 16 nt, Pseudomonas putida KT2440
gccuguccgggcucgu

SEQ ID NO: 1623977 - RNA, 13 nt, Pseudomonas putida KT2440
gccuguccaggca

SEQ ID NO: 1623978 - RNA, 20 nt, Pseudomonas putida KT2440
gccugucgcgacgggcugcu

SEQ ID NO: 1623979 - RNA, 19 nt, Pseudomonas putida KT2440
gccugucuagccgccugcc

SEQ ID NO: 1623980 - RNA, 15 nt, Pseudomonas putida KT2440
gccuguggggcaacu

SEQ ID NO: 1623981 - RNA, 18 nt, Pseudomonas putida KT2440
gccugugcuggccucuuc

SEQ ID NO: 1623982 - RNA, 15 nt, Pseudomonas putida KT2440
gccugugccgggcca

SEQ ID NO: 1623983 - RNA, 15 nt, Pseudomonas putida KT2440
gccucuucgcgggca

SEQ ID NO: 1623984 - RNA, 19 nt, Pseudomonas putida KT2440
gccucuucgcgggcaagcc

SEQ ID NO: 1623985 - RNA, 20 nt, Pseudomonas putida KT2440
gccucuucgcgggcaagccc

SEQ ID NO: 1623986 - RNA, 22 nt, Pseudomonas putida KT2440
gccucuucgcgggcaagcccgc

SEQ ID NO: 1623987 - RNA, 23 nt, Pseudomonas putida KT2440
gccucuucgcggguaaacccgcu

SEQ ID NO: 1623988 - RNA, 15 nt, Pseudomonas putida KT2440
gccucuucggccagc

SEQ ID NO: 1623989 - RNA, 23 nt, Pseudomonas putida KT2440
gccucugcugcggauacagcgcc

SEQ ID NO: 1623990 - RNA, 14 nt, Pseudomonas putida KT2440
gccucuggcuuggc

SEQ ID NO: 1623991 - RNA, 13 nt, Pseudomonas putida KT2440
gccugaaacccau

SEQ ID NO: 1623992 - RNA, 24 nt, Pseudomonas putida KT2440
gccucuucuucaaggcugcucucc

SEQ ID NO: 1623993 - RNA, 21 nt, Pseudomonas putida KT2440
gccugagggucgugagccugc

SEQ ID NO: 1623994 - RNA, 15 nt, Pseudomonas putida KT2440
gccugacgcagugca

SEQ ID NO: 1623995 - RNA, 14 nt, Pseudomonas putida KT2440
gccugaccugugcu

SEQ ID NO: 1623996 - RNA, 17 nt, Pseudomonas putida KT2440
gccugacucagcccuga

SEQ ID NO: 1623997 - RNA, 17 nt, Pseudomonas putida KT2440
gccugacgggccucuuc

SEQ ID NO: 1623998 - RNA, 16 nt, Pseudomonas putida KT2440
gccugacgcgccgcca

SEQ ID NO: 1623999 - RNA, 19 nt, Pseudomonas putida KT2440
gccugcaaacgccgcucga

SEQ ID NO: 1624000 - RNA, 17 nt, Pseudomonas putida KT2440
gccugauugccuggcuu

SEQ ID NO: 1624001 - RNA, 15 nt, Pseudomonas putida KT2440
gccugauuacccugc

SEQ ID NO: 1624002 - RNA, 23 nt, Pseudomonas putida KT2440
gccugauuacccugcgccaggca

SEQ ID NO: 1624003 - RNA, 23 nt, Pseudomonas putida KT2440
gccugcgcaggcgccgccagcug

SEQ ID NO: 1624004 - RNA, 15 nt, Pseudomonas putida KT2440
gccugcgcccaauca

SEQ ID NO: 1624005 - RNA, 22 nt, Pseudomonas putida KT2440
gccugcgauugcgauccgcccc

SEQ ID NO: 1624006 - RNA, 16 nt, Pseudomonas putida KT2440
gccugcgcacggcgcu

SEQ ID NO: 1624007 - RNA, 22 nt, Pseudomonas putida KT2440
gccugcccgccccccaccuggc

SEQ ID NO: 1624008 - RNA, 16 nt, Pseudomonas putida KT2440
gccugcccgccgucca

SEQ ID NO: 1624009 - RNA, 24 nt, Pseudomonas putida KT2440
gccugccgggucaaggccagcgcc

SEQ ID NO: 1624010 - RNA, 16 nt, Pseudomonas putida KT2440
gccugccgguacagcc

SEQ ID NO: 1624011 - RNA, 11 nt, Pseudomonas putida KT2440
gccugcagccc

SEQ ID NO: 1624012 - RNA, 21 nt, Pseudomonas putida KT2440
gccugcacggcaaaguccagc

SEQ ID NO: 1624013 - RNA, 13 nt, Pseudomonas putida KT2440
gccugcagcgcgu

SEQ ID NO: 1624014 - RNA, 15 nt, Pseudomonas putida KT2440
gccugcagcgcguca

SEQ ID NO: 1624015 - RNA, 19 nt, Pseudomonas putida KT2440
gccugcagccguugcuggg

SEQ ID NO: 1624016 - RNA, 22 nt, Pseudomonas putida KT2440
gccugcacuaagggcaggccug

SEQ ID NO: 1624017 - RNA, 20 nt, Pseudomonas putida KT2440
gccugcacuaccucgcucag

SEQ ID NO: 1624018 - RNA, 22 nt, Pseudomonas putida KT2440
gccugcacuaccucgcucaggc

SEQ ID NO: 1624019 - RNA, 23 nt, Pseudomonas putida KT2440
gccugcaaggaaaaccccgcuuc

SEQ ID NO: 1624020 - RNA, 18 nt, Pseudomonas putida KT2440
gccugcaagucaggcgaa

SEQ ID NO: 1624021 - RNA, 14 nt, Pseudomonas putida KT2440
gccugcaagccggc

SEQ ID NO: 1624022 - RNA, 23 nt, Pseudomonas putida KT2440
gccugcaagccggcgaacagcac

SEQ ID NO: 1624023 - RNA, 17 nt, Pseudomonas putida KT2440
gccugcacccaggcucu

SEQ ID NO: 1624024 - RNA, 13 nt, Pseudomonas putida KT2440
gccugcaccuggc

SEQ ID NO: 1624025 - RNA, 15 nt, Pseudomonas putida KT2440
gccugcaccuggcug

SEQ ID NO: 1624026 - RNA, 17 nt, Pseudomonas putida KT2440
gccugcacccgcgcgcc

SEQ ID NO: 1624027 - RNA, 20 nt, Pseudomonas putida KT2440
gccugcacccgcgcgcccgc

SEQ ID NO: 1624028 - RNA, 13 nt, Pseudomonas putida KT2440
gccugcaggcagc

SEQ ID NO: 1624029 - RNA, 15 nt, Pseudomonas putida KT2440
gccugcaggcagcau

SEQ ID NO: 1624030 - RNA, 22 nt, Pseudomonas putida KT2440
gccugcauucaaagcuuucugg

SEQ ID NO: 1624031 - RNA, 15 nt, Pseudomonas putida KT2440
gccguugcgccgcuc

SEQ ID NO: 1624032 - RNA, 19 nt, Pseudomonas putida KT2440
gccuaagguugcuccugca

SEQ ID NO: 1624033 - RNA, 18 nt, Pseudomonas putida KT2440
gccuaccaccgcauccgc

SEQ ID NO: 1624034 - RNA, 14 nt, Pseudomonas putida KT2440
gccuaccaacgcag

SEQ ID NO: 1624035 - RNA, 16 nt, Pseudomonas putida KT2440
gccuaccgcgucgcca

SEQ ID NO: 1624036 - RNA, 21 nt, Pseudomonas putida KT2440
gccuacccgggcgcagggguc

SEQ ID NO: 1624037 - RNA, 21 nt, Pseudomonas putida KT2440
gccuacaggaaucugucagcc

SEQ ID NO: 1624038 - RNA, 23 nt, Pseudomonas putida KT2440
gccuacaggcaaccgcauccccu

SEQ ID NO: 1624039 - RNA, 16 nt, Pseudomonas putida KT2440
gccuacgacggccugc

SEQ ID NO: 1624040 - RNA, 16 nt, Pseudomonas putida KT2440
gccuacugcuggcgcg

SEQ ID NO: 1624041 - RNA, 15 nt, Pseudomonas putida KT2440
gccuagcaaggccuc

SEQ ID NO: 1624042 - RNA, 18 nt, Pseudomonas putida KT2440
gccuaguucggcaccuuu

SEQ ID NO: 1624043 - RNA, 14 nt, Pseudomonas putida KT2440
gccuaucucuucca

SEQ ID NO: 1624044 - RNA, 15 nt, Pseudomonas putida KT2440
gccuaucucuuccag

SEQ ID NO: 1624045 - RNA, 16 nt, Pseudomonas putida KT2440
gccuaucucuuccagc

SEQ ID NO: 1624046 - RNA, 20 nt, Pseudomonas putida KT2440
gccucaccgacccacaggca

SEQ ID NO: 1624047 - RNA, 18 nt, Pseudomonas putida KT2440
gccucacagcgccgcggc

SEQ ID NO: 1624048 - RNA, 15 nt, Pseudomonas putida KT2440
gccucaccuccaccg

SEQ ID NO: 1624049 - RNA, 20 nt, Pseudomonas putida KT2440
gccucaaugggcuuccccag

SEQ ID NO: 1624050 - RNA, 21 nt, Pseudomonas putida KT2440
gccucaaugggcuuccccagc

SEQ ID NO: 1624051 - RNA, 13 nt, Pseudomonas putida KT2440
gccucaauacccc

SEQ ID NO: 1624052 - RNA, 15 nt, Pseudomonas putida KT2440
gccgguacagccagc

SEQ ID NO: 1624053 - RNA, 18 nt, Pseudomonas putida KT2440
gccggguuuuucaugaag

SEQ ID NO: 1624054 - RNA, 19 nt, Pseudomonas putida KT2440
gccggguuuuucaugaagc

SEQ ID NO: 1624055 - RNA, 21 nt, Pseudomonas putida KT2440
gccgggucgauagccagcccg

SEQ ID NO: 1624056 - RNA, 21 nt, Pseudomonas putida KT2440
gccgggucgaaggcaaucggg

SEQ ID NO: 1624057 - RNA, 15 nt, Pseudomonas putida KT2440
gccggguccaccagc

SEQ ID NO: 1624058 - RNA, 17 nt, Pseudomonas putida KT2440
gccgggguaauggcgcu

SEQ ID NO: 1624059 - RNA, 13 nt, Pseudomonas putida KT2440
gccggggcugcuu

SEQ ID NO: 1624060 - RNA, 21 nt, Pseudomonas putida KT2440
gccggggcugcuuugcagccc

SEQ ID NO: 1624061 - RNA, 15 nt, Pseudomonas putida KT2440
gccgggguucuggua

SEQ ID NO: 1624062 - RNA, 22 nt, Pseudomonas putida KT2440
gccgugguucaucaccagcccc

SEQ ID NO: 1624063 - RNA, 22 nt, Pseudomonas putida KT2440
gccguugauccaggcuuggcga

SEQ ID NO: 1624064 - RNA, 12 nt, Pseudomonas putida KT2440
gccgugcagcac

SEQ ID NO: 1624065 - RNA, 23 nt, Pseudomonas putida KT2440
gccgugaugguaucugccagcac

SEQ ID NO: 1624066 - RNA, 15 nt, Pseudomonas putida KT2440
gccgugcccaccagc

SEQ ID NO: 1624067 - RNA, 18 nt, Pseudomonas putida KT2440
gccgugcccaccagcgcu

SEQ ID NO: 1624068 - RNA, 17 nt, Pseudomonas putida KT2440
gccuccagagaaccgca

SEQ ID NO: 1624069 - RNA, 20 nt, Pseudomonas putida KT2440
gccuccagagaaccgcacac

SEQ ID NO: 1624070 - RNA, 14 nt, Pseudomonas putida KT2440
gccuccagggcggc

SEQ ID NO: 1624071 - RNA, 11 nt, Pseudomonas putida KT2440
gccuccagcug

SEQ ID NO: 1624072 - RNA, 14 nt, Pseudomonas putida KT2440
gccuccagcuggcc

SEQ ID NO: 1624073 - RNA, 18 nt, Pseudomonas putida KT2440
gccucaaggccggcagcc

SEQ ID NO: 1624074 - RNA, 18 nt, Pseudomonas putida KT2440
gccucacgcaucugcgcu

SEQ ID NO: 1624075 - RNA, 13 nt, Pseudomonas putida KT2440
gccucagccggcu

SEQ ID NO: 1624076 - RNA, 16 nt, Pseudomonas putida KT2440
gccucagccaggcuga

SEQ ID NO: 1624077 - RNA, 14 nt, Pseudomonas putida KT2440
gccucagcgcccgc

SEQ ID NO: 1624078 - RNA, 20 nt, Pseudomonas putida KT2440
gccucagcgcccgcugcgcc

SEQ ID NO: 1624079 - RNA, 21 nt, Pseudomonas putida KT2440
gccucagcgcccgcugcgccg

SEQ ID NO: 1624080 - RNA, 16 nt, Pseudomonas putida KT2440
gccucagcuggccggc

SEQ ID NO: 1624081 - RNA, 18 nt, Pseudomonas putida KT2440
gccucaggugcacagggc

SEQ ID NO: 1624082 - RNA, 21 nt, Pseudomonas putida KT2440
gccucauagcuuucaggcgca

SEQ ID NO: 1624083 - RNA, 22 nt, Pseudomonas putida KT2440
gccucaucaggccgaaggccag

SEQ ID NO: 1624084 - RNA, 16 nt, Pseudomonas putida KT2440
gccucaugcagcaccu

SEQ ID NO: 1624085 - RNA, 13 nt, Pseudomonas putida KT2440
gccucgaacaccu

SEQ ID NO: 1624086 - RNA, 18 nt, Pseudomonas putida KT2440
gccucgaaguaggcaaac

SEQ ID NO: 1624087 - RNA, 15 nt, Pseudomonas putida KT2440
gccucgacgcagaca

SEQ ID NO: 1624088 - RNA, 14 nt, Pseudomonas putida KT2440
gccucgaccuggcc

SEQ ID NO: 1624089 - RNA, 15 nt, Pseudomonas putida KT2440
gccucgaccuggccc

SEQ ID NO: 1624090 - RNA, 16 nt, Pseudomonas putida KT2440
gccucgaccuggcccg

SEQ ID NO: 1624091 - RNA, 15 nt, Pseudomonas putida KT2440
gccuccaguugcucc

SEQ ID NO: 1624092 - RNA, 19 nt, Pseudomonas putida KT2440
gccuccagguaauccagcu

SEQ ID NO: 1624093 - RNA, 21 nt, Pseudomonas putida KT2440
gccucccccacccccgcccca

SEQ ID NO: 1624094 - RNA, 22 nt, Pseudomonas putida KT2440
gccucccccacccccgccccac

SEQ ID NO: 1624095 - RNA, 12 nt, Pseudomonas putida KT2440
gccucccccagc

SEQ ID NO: 1624096 - RNA, 14 nt, Pseudomonas putida KT2440
gccucccccuccac

SEQ ID NO: 1624097 - RNA, 14 nt, Pseudomonas putida KT2440
gccucgcccaggcc

SEQ ID NO: 1624098 - RNA, 16 nt, Pseudomonas putida KT2440
gccucgcccaggccgc

SEQ ID NO: 1624099 - RNA, 19 nt, Pseudomonas putida KT2440
gccucgcccaggccgccga

SEQ ID NO: 1624100 - RNA, 21 nt, Pseudomonas putida KT2440
gccucgaugcggucuuccagc

SEQ ID NO: 1624101 - RNA, 16 nt, Pseudomonas putida KT2440
gccucgauuucuucau

SEQ ID NO: 1624102 - RNA, 21 nt, Pseudomonas putida KT2440
gccucgauuucuucaucgcca

SEQ ID NO: 1624103 - RNA, 21 nt, Pseudomonas putida KT2440
gccucgaucauuuccggcacg

SEQ ID NO: 1624104 - RNA, 16 nt, Pseudomonas putida KT2440
gccucgaucccgccgc

SEQ ID NO: 1624105 - RNA, 18 nt, Pseudomonas putida KT2440
gccucgaucccgccgcca

SEQ ID NO: 1624106 - RNA, 21 nt, Pseudomonas putida KT2440
gccucgaucccgccgccagac

SEQ ID NO: 1624107 - RNA, 22 nt, Pseudomonas putida KT2440
gccucgaccacgaucuuggcca

SEQ ID NO: 1624108 - RNA, 12 nt, Pseudomonas putida KT2440
gccucgcuggcg

SEQ ID NO: 1624109 - RNA, 24 nt, Pseudomonas putida KT2440
gccucgcugccuuuggccgccagc

SEQ ID NO: 1624110 - RNA, 20 nt, Pseudomonas putida KT2440
gccucgcgcauggccgcuuc

SEQ ID NO: 1624111 - RNA, 21 nt, Pseudomonas putida KT2440
gccucgcgcaacaccgccagc

SEQ ID NO: 1624112 - RNA, 17 nt, Pseudomonas putida KT2440
gccucggcgaucgccag

SEQ ID NO: 1624113 - RNA, 14 nt, Pseudomonas putida KT2440
gccucggccgcccu

SEQ ID NO: 1624114 - RNA, 14 nt, Pseudomonas putida KT2440
gccucgugcagcug

SEQ ID NO: 1624115 - RNA, 16 nt, Pseudomonas putida KT2440
gccucgucgcgguccu

SEQ ID NO: 1624116 - RNA, 22 nt, Pseudomonas putida KT2440
gccucgucgcgguccuugccgu

SEQ ID NO: 1624117 - RNA, 18 nt, Pseudomonas putida KT2440
gccucgguacccgccagc

SEQ ID NO: 1624118 - RNA, 15 nt, Pseudomonas putida KT2440
gccgcucgcccagca

SEQ ID NO: 1624119 - RNA, 14 nt, Pseudomonas putida KT2440
gccgcucguacugg

SEQ ID NO: 1624120 - RNA, 23 nt, Pseudomonas putida KT2440
gccgcugaacaacuccgggugcu

SEQ ID NO: 1624121 - RNA, 17 nt, Pseudomonas putida KT2440
gccgcugaccacgccga

SEQ ID NO: 1624122 - RNA, 15 nt, Pseudomonas putida KT2440
gccgcuggcuuccuc

SEQ ID NO: 1624123 - RNA, 20 nt, Pseudomonas putida KT2440
gccgcugcugcgccucgcag

SEQ ID NO: 1624124 - RNA, 15 nt, Pseudomonas putida KT2440
gccgcuaggcggccc

SEQ ID NO: 1624125 - RNA, 15 nt, Pseudomonas putida KT2440
gccgcguugcggccc

SEQ ID NO: 1624126 - RNA, 15 nt, Pseudomonas putida KT2440
gccgcguucgcccag

SEQ ID NO: 1624127 - RNA, 23 nt, Pseudomonas putida KT2440
gccgcgguagugcggccgggucg

SEQ ID NO: 1624128 - RNA, 18 nt, Pseudomonas putida KT2440
gccgcgcagccuuugaaa

SEQ ID NO: 1624129 - RNA, 20 nt, Pseudomonas putida KT2440
gccgcgccauuggccgcgcg

SEQ ID NO: 1624130 - RNA, 19 nt, Pseudomonas putida KT2440
gccgcgccaggucggcggg

SEQ ID NO: 1624131 - RNA, 23 nt, Pseudomonas putida KT2440
gccgcgcaugaugaaguggcgca

SEQ ID NO: 1624132 - RNA, 23 nt, Pseudomonas putida KT2440
gccggaguggaagauggucucga

SEQ ID NO: 1624133 - RNA, 17 nt, Pseudomonas putida KT2440
gccggauagagcccggc

SEQ ID NO: 1624134 - RNA, 22 nt, Pseudomonas putida KT2440
gccggauagagcccggcgcagc

SEQ ID NO: 1624135 - RNA, 13 nt, Pseudomonas putida KT2440
gccggaucuggca

SEQ ID NO: 1624136 - RNA, 21 nt, Pseudomonas putida KT2440
gccggcaaacaaaaagcaccu

SEQ ID NO: 1624137 - RNA, 22 nt, Pseudomonas putida KT2440
gccggcaaacaaaaagcaccuc

SEQ ID NO: 1624138 - RNA, 15 nt, Pseudomonas putida KT2440
gccggcaaccccugc

SEQ ID NO: 1624139 - RNA, 19 nt, Pseudomonas putida KT2440
gccggcauaacggcuggcg

SEQ ID NO: 1624140 - RNA, 18 nt, Pseudomonas putida KT2440
gccggcauagauggcugu

SEQ ID NO: 1624141 - RNA, 18 nt, Pseudomonas putida KT2440
gccggcaggcccggcccu

SEQ ID NO: 1624142 - RNA, 22 nt, Pseudomonas putida KT2440
gccggcaguccacuugcguucg

SEQ ID NO: 1624143 - RNA, 21 nt, Pseudomonas putida KT2440
gccggcagcucgcgcugcgca

SEQ ID NO: 1624144 - RNA, 18 nt, Pseudomonas putida KT2440
gccggcaacgauacccac

SEQ ID NO: 1624145 - RNA, 17 nt, Pseudomonas putida KT2440
gccggaccugccgcagc

SEQ ID NO: 1624146 - RNA, 18 nt, Pseudomonas putida KT2440
gccgcuuugcggccccuu

SEQ ID NO: 1624147 - RNA, 17 nt, Pseudomonas putida KT2440
gccgcuuuggcagcagc

SEQ ID NO: 1624148 - RNA, 18 nt, Pseudomonas putida KT2440
gccgggcacaucaccagc

SEQ ID NO: 1624149 - RNA, 20 nt, Pseudomonas putida KT2440
gccgggcacaucaccagcag

SEQ ID NO: 1624150 - RNA, 21 nt, Pseudomonas putida KT2440
gccgggcacaucaccagcagc

SEQ ID NO: 1624151 - RNA, 15 nt, Pseudomonas putida KT2440
gccgggccaccaccg

SEQ ID NO: 1624152 - RNA, 20 nt, Pseudomonas putida KT2440
gccgggcacgacacuccgcu

SEQ ID NO: 1624153 - RNA, 12 nt, Pseudomonas putida KT2440
gccgggcacugc

SEQ ID NO: 1624154 - RNA, 13 nt, Pseudomonas putida KT2440
gccgggcagccgu

SEQ ID NO: 1624155 - RNA, 15 nt, Pseudomonas putida KT2440
gccggggcaaccugg

SEQ ID NO: 1624156 - RNA, 16 nt, Pseudomonas putida KT2440
gccggggcaaccuggg

SEQ ID NO: 1624157 - RNA, 14 nt, Pseudomonas putida KT2440
gccggcgcaggucg

SEQ ID NO: 1624158 - RNA, 14 nt, Pseudomonas putida KT2440
gccggcgcccugca

SEQ ID NO: 1624159 - RNA, 14 nt, Pseudomonas putida KT2440
gccggcgagcgcgu

SEQ ID NO: 1624160 - RNA, 17 nt, Pseudomonas putida KT2440
gccggcgagcgcgugcg

SEQ ID NO: 1624161 - RNA, 16 nt, Pseudomonas putida KT2440
gccggccucagcagcg

SEQ ID NO: 1624162 - RNA, 11 nt, Pseudomonas putida KT2440
gccggccucuu

SEQ ID NO: 1624163 - RNA, 15 nt, Pseudomonas putida KT2440
gccggccgggcucug

SEQ ID NO: 1624164 - RNA, 17 nt, Pseudomonas putida KT2440
gccggccguggguccug

SEQ ID NO: 1624165 - RNA, 18 nt, Pseudomonas putida KT2440
gccggccuuggcgcggcg

SEQ ID NO: 1624166 - RNA, 17 nt, Pseudomonas putida KT2440
gccggcgaauccagccg

SEQ ID NO: 1624167 - RNA, 15 nt, Pseudomonas putida KT2440
gccggccuugaccuc

SEQ ID NO: 1624168 - RNA, 15 nt, Pseudomonas putida KT2440
gccggcgaacagcac

SEQ ID NO: 1624169 - RNA, 21 nt, Pseudomonas putida KT2440
gccggcgaacagcacugccag

SEQ ID NO: 1624170 - RNA, 21 nt, Pseudomonas putida KT2440
gccggcccuucugcugcucgu

SEQ ID NO: 1624171 - RNA, 20 nt, Pseudomonas putida KT2440
gccggccauugccgcgccgc

SEQ ID NO: 1624172 - RNA, 13 nt, Pseudomonas putida KT2440
gccggccccugcu

SEQ ID NO: 1624173 - RNA, 17 nt, Pseudomonas putida KT2440
gccggcauggcgugccc

SEQ ID NO: 1624174 - RNA, 21 nt, Pseudomonas putida KT2440
gccggcaucgccaacagaggc

SEQ ID NO: 1624175 - RNA, 17 nt, Pseudomonas putida KT2440
gccgaucuucaggcuga

SEQ ID NO: 1624176 - RNA, 20 nt, Pseudomonas putida KT2440
gccgaucuucaggcugacgu

SEQ ID NO: 1624177 - RNA, 19 nt, Pseudomonas putida KT2440
gccgaucuucgcccugggc

SEQ ID NO: 1624178 - RNA, 15 nt, Pseudomonas putida KT2440
gcccuggucauucca

SEQ ID NO: 1624179 - RNA, 16 nt, Pseudomonas putida KT2440
gccgauagcagcaccg

SEQ ID NO: 1624180 - RNA, 22 nt, Pseudomonas putida KT2440
gccgauggcgcaaacccucggc

SEQ ID NO: 1624181 - RNA, 19 nt, Pseudomonas putida KT2440
gccgaugggcacuggccac

SEQ ID NO: 1624182 - RNA, 22 nt, Pseudomonas putida KT2440
gccgaugggcuguuccagcagc

SEQ ID NO: 1624183 - RNA, 17 nt, Pseudomonas putida KT2440
gccgaugucggcgugca

SEQ ID NO: 1624184 - RNA, 13 nt, Pseudomonas putida KT2440
gccgcacccaggc

SEQ ID NO: 1624185 - RNA, 22 nt, Pseudomonas putida KT2440
gccgcaccagguccaccagcag

SEQ ID NO: 1624186 - RNA, 19 nt, Pseudomonas putida KT2440
gccgcaccugcccgcccuc

SEQ ID NO: 1624187 - RNA, 13 nt, Pseudomonas putida KT2440
gccgcacgcgccu

SEQ ID NO: 1624188 - RNA, 22 nt, Pseudomonas putida KT2440
gccgcagagcggcccugagccu

SEQ ID NO: 1624189 - RNA, 21 nt, Pseudomonas putida KT2440
gccgcacguuauccacagcgu

SEQ ID NO: 1624190 - RNA, 13 nt, Pseudomonas putida KT2440
gccgcagcaaucu

SEQ ID NO: 1624191 - RNA, 14 nt, Pseudomonas putida KT2440
gccgcagucccgcc

SEQ ID NO: 1624192 - RNA, 16 nt, Pseudomonas putida KT2440
gccgcauauacgccgg

SEQ ID NO: 1624193 - RNA, 14 nt, Pseudomonas putida KT2440
gccgcaggcgcccc

SEQ ID NO: 1624194 - RNA, 14 nt, Pseudomonas putida KT2440
gccgcagguccacc

SEQ ID NO: 1624195 - RNA, 19 nt, Pseudomonas putida KT2440
gccgcagguccaccugguu

SEQ ID NO: 1624196 - RNA, 12 nt, Pseudomonas putida KT2440
gccgccagcagc

SEQ ID NO: 1624197 - RNA, 15 nt, Pseudomonas putida KT2440
gccgccaccugcggc

SEQ ID NO: 1624198 - RNA, 22 nt, Pseudomonas putida KT2440
gccgccaccugcggcagguggg

SEQ ID NO: 1624199 - RNA, 14 nt, Pseudomonas putida KT2440
gccgccaccuggcu

SEQ ID NO: 1624200 - RNA, 20 nt, Pseudomonas putida KT2440
gccgcaucguuauccagcac

SEQ ID NO: 1624201 - RNA, 21 nt, Pseudomonas putida KT2440
gccgcaucguuauccagcacc

SEQ ID NO: 1624202 - RNA, 15 nt, Pseudomonas putida KT2440
gccgccaagcggccc

SEQ ID NO: 1624203 - RNA, 19 nt, Pseudomonas putida KT2440
gccgccaagcggccccaga

SEQ ID NO: 1624204 - RNA, 22 nt, Pseudomonas putida KT2440
gccgccaauagcccgcuggccg

SEQ ID NO: 1624205 - RNA, 15 nt, Pseudomonas putida KT2440
gccgccacauccagc

SEQ ID NO: 1624206 - RNA, 18 nt, Pseudomonas putida KT2440
gccgccacauccagcgcc

SEQ ID NO: 1624207 - RNA, 19 nt, Pseudomonas putida KT2440
gccgccacauccagcgccu

SEQ ID NO: 1624208 - RNA, 23 nt, Pseudomonas putida KT2440
gccgccaaaaaauccgccuggcc

SEQ ID NO: 1624209 - RNA, 20 nt, Pseudomonas putida KT2440
gccgccaaccccuccagcac

SEQ ID NO: 1624210 - RNA, 22 nt, Pseudomonas putida KT2440
gccgccgguuucucgcagcagc

SEQ ID NO: 1624211 - RNA, 19 nt, Pseudomonas putida KT2440
gccgccgcagcaaucugcu

SEQ ID NO: 1624212 - RNA, 14 nt, Pseudomonas putida KT2440
gccgccgccagaag

SEQ ID NO: 1624213 - RNA, 14 nt, Pseudomonas putida KT2440
gccgcgacgcggcc

SEQ ID NO: 1624214 - RNA, 15 nt, Pseudomonas putida KT2440
gccgcgacgcggccc

SEQ ID NO: 1624215 - RNA, 19 nt, Pseudomonas putida KT2440
gccgcgacgcggccccaga

SEQ ID NO: 1624216 - RNA, 17 nt, Pseudomonas putida KT2440
gccgcgacgcggcccug

SEQ ID NO: 1624217 - RNA, 18 nt, Pseudomonas putida KT2440
gccgcgacgcggcccugg

SEQ ID NO: 1624218 - RNA, 15 nt, Pseudomonas putida KT2440
gccgccugcccgccc

SEQ ID NO: 1624219 - RNA, 19 nt, Pseudomonas putida KT2440
gccgccguucaggcgccug

SEQ ID NO: 1624220 - RNA, 15 nt, Pseudomonas putida KT2440
gccgccccuccaccc

SEQ ID NO: 1624221 - RNA, 21 nt, Pseudomonas putida KT2440
gccgcccucuucgcgggcacg

SEQ ID NO: 1624222 - RNA, 13 nt, Pseudomonas putida KT2440
gccgcccuggucc

SEQ ID NO: 1624223 - RNA, 16 nt, Pseudomonas putida KT2440
gccgcccaucaccggc

SEQ ID NO: 1624224 - RNA, 14 nt, Pseudomonas putida KT2440
gccgccccgcacca

SEQ ID NO: 1624225 - RNA, 16 nt, Pseudomonas putida KT2440
gccgccccgcaccaga

SEQ ID NO: 1624226 - RNA, 20 nt, Pseudomonas putida KT2440
gccgccccacucgcgcagca

SEQ ID NO: 1624227 - RNA, 22 nt, Pseudomonas putida KT2440
gccgccccaaacauaaggagua

SEQ ID NO: 1624228 - RNA, 15 nt, Pseudomonas putida KT2440
gccgccaggcccacc

SEQ ID NO: 1624229 - RNA, 16 nt, Pseudomonas putida KT2440
gccgccaggcccacca

SEQ ID NO: 1624230 - RNA, 16 nt, Pseudomonas putida KT2440
gccgccaggcagcaga

SEQ ID NO: 1624231 - RNA, 15 nt, Pseudomonas putida KT2440
gccgcccacgccggc

SEQ ID NO: 1624232 - RNA, 17 nt, Pseudomonas putida KT2440
gccgccauugaggaagu

SEQ ID NO: 1624233 - RNA, 17 nt, Pseudomonas putida KT2440
gccgccaugaucugccc

SEQ ID NO: 1624234 - RNA, 13 nt, Pseudomonas putida KT2440
gccgccauugccc

SEQ ID NO: 1624235 - RNA, 17 nt, Pseudomonas putida KT2440
gccgccaugcagcccgc

SEQ ID NO: 1624236 - RNA, 12 nt, Pseudomonas putida KT2440
gccgccaucucg

SEQ ID NO: 1624237 - RNA, 19 nt, Pseudomonas putida KT2440
gccaccgccggguggguga

SEQ ID NO: 1624238 - RNA, 20 nt, Pseudomonas putida KT2440
gccaccgccucgcccaggcc

SEQ ID NO: 1624239 - RNA, 19 nt, Pseudomonas putida KT2440
gccaccgaucucgccagcc

SEQ ID NO: 1624240 - RNA, 22 nt, Pseudomonas putida KT2440
gccaccgaucucgccagccugc

SEQ ID NO: 1624241 - RNA, 21 nt, Pseudomonas putida KT2440
gccaccgcacucugcugcucu

SEQ ID NO: 1624242 - RNA, 13 nt, Pseudomonas putida KT2440
gccaccuggcugc

SEQ ID NO: 1624243 - RNA, 22 nt, Pseudomonas putida KT2440
gccaccuggucgaaugcgugca

SEQ ID NO: 1624244 - RNA, 22 nt, Pseudomonas putida KT2440
gccaccugauguacaaggaccu

SEQ ID NO: 1624245 - RNA, 20 nt, Pseudomonas putida KT2440
gccaccuucaccccguggcc

SEQ ID NO: 1624246 - RNA, 22 nt, Pseudomonas putida KT2440
gccaccuucagcgggucgagcc

SEQ ID NO: 1624247 - RNA, 12 nt, Pseudomonas putida KT2440
gccaccuuccag

SEQ ID NO: 1624248 - RNA, 22 nt, Pseudomonas putida KT2440
gccaccguaaggaaaaucagcu

SEQ ID NO: 1624249 - RNA, 15 nt, Pseudomonas putida KT2440
gccacgcaugccuau

SEQ ID NO: 1624250 - RNA, 15 nt, Pseudomonas putida KT2440
gccacgcaccagggc

SEQ ID NO: 1624251 - RNA, 23 nt, Pseudomonas putida KT2440
gccacgaucgacaaccccagccc

SEQ ID NO: 1624252 - RNA, 22 nt, Pseudomonas putida KT2440
gccacgauagcgucagcagggc

SEQ ID NO: 1624253 - RNA, 14 nt, Pseudomonas putida KT2440
gccaccuucgccag

SEQ ID NO: 1624254 - RNA, 16 nt, Pseudomonas putida KT2440
gccacgcccgcugcau

SEQ ID NO: 1624255 - RNA, 12 nt, Pseudomonas putida KT2440
gccacgccgcca

SEQ ID NO: 1624256 - RNA, 16 nt, Pseudomonas putida KT2440
gccacgcccaacccag

SEQ ID NO: 1624257 - RNA, 17 nt, Pseudomonas putida KT2440
gccacgcccaaccccag

SEQ ID NO: 1624258 - RNA, 18 nt, Pseudomonas putida KT2440
gccacgcccaaccccagc

SEQ ID NO: 1624259 - RNA, 19 nt, Pseudomonas putida KT2440
gccacgcccaaccccagcg

SEQ ID NO: 1624260 - RNA, 19 nt, Pseudomonas putida KT2440
gccaccaccgcguacagcu

SEQ ID NO: 1624261 - RNA, 22 nt, Pseudomonas putida KT2440
gccacauugauaguagccgcca

SEQ ID NO: 1624262 - RNA, 15 nt, Pseudomonas putida KT2440
gccaccacccggggc

SEQ ID NO: 1624263 - RNA, 14 nt, Pseudomonas putida KT2440
gccacaugccagcu

SEQ ID NO: 1624264 - RNA, 16 nt, Pseudomonas putida KT2440
gccacaugcugcgccc

SEQ ID NO: 1624265 - RNA, 18 nt, Pseudomonas putida KT2440
gccacauccagcgccucc

SEQ ID NO: 1624266 - RNA, 16 nt, Pseudomonas putida KT2440
gccacauagcuggcac

SEQ ID NO: 1624267 - RNA, 21 nt, Pseudomonas putida KT2440
gccacauagcuggcacugccc

SEQ ID NO: 1624268 - RNA, 20 nt, Pseudomonas putida KT2440
gccaccagcauggcgucggc

SEQ ID NO: 1624269 - RNA, 15 nt, Pseudomonas putida KT2440
gccaccagcaccugc

SEQ ID NO: 1624270 - RNA, 19 nt, Pseudomonas putida KT2440
gccaccagcaccugcaggu

SEQ ID NO: 1624271 - RNA, 20 nt, Pseudomonas putida KT2440
gccaccagcaccugcaggua

SEQ ID NO: 1624272 - RNA, 13 nt, Pseudomonas putida KT2440
gccaccagggugg

SEQ ID NO: 1624273 - RNA, 15 nt, Pseudomonas putida KT2440
gccaccagugccggg

SEQ ID NO: 1624274 - RNA, 23 nt, Pseudomonas putida KT2440
gccaccaguucauggcucacacc

SEQ ID NO: 1624275 - RNA, 18 nt, Pseudomonas putida KT2440
gccaccaguuccaccggc

SEQ ID NO: 1624276 - RNA, 22 nt, Pseudomonas putida KT2440
gccaccaguuccaccggcaagc

SEQ ID NO: 1624277 - RNA, 19 nt, Pseudomonas putida KT2440
gcauagcgguacagcaccc

SEQ ID NO: 1624278 - RNA, 23 nt, Pseudomonas putida KT2440
gccacaggugacaagcugcgccc

SEQ ID NO: 1624279 - RNA, 15 nt, Pseudomonas putida KT2440
gcauacagcuggccu

SEQ ID NO: 1624280 - RNA, 16 nt, Pseudomonas putida KT2440
gcauacagcuggccuu

SEQ ID NO: 1624281 - RNA, 12 nt, Pseudomonas putida KT2440
gcauacagcgca

SEQ ID NO: 1624282 - RNA, 22 nt, Pseudomonas putida KT2440
gcauacagcgcacucucccgca

SEQ ID NO: 1624283 - RNA, 17 nt, Pseudomonas putida KT2440
gcauacaggaccaggcc

SEQ ID NO: 1624284 - RNA, 17 nt, Pseudomonas putida KT2440
gccagaucggccagcuu

SEQ ID NO: 1624285 - RNA, 19 nt, Pseudomonas putida KT2440
gccagcacgcaggccagcg

SEQ ID NO: 1624286 - RNA, 14 nt, Pseudomonas putida KT2440
gccagcacgccggc

SEQ ID NO: 1624287 - RNA, 21 nt, Pseudomonas putida KT2440
gccagaccaccucaucccccg

SEQ ID NO: 1624288 - RNA, 22 nt, Pseudomonas putida KT2440
gccagaccaccucaucccccgg

SEQ ID NO: 1624289 - RNA, 19 nt, Pseudomonas putida KT2440
gccagacauugaagaagcc

SEQ ID NO: 1624290 - RNA, 15 nt, Pseudomonas putida KT2440
gccagaccuugcgca

SEQ ID NO: 1624291 - RNA, 22 nt, Pseudomonas putida KT2440
gccagaccuugcgcacggccuc

SEQ ID NO: 1624292 - RNA, 16 nt, Pseudomonas putida KT2440
gccagacaacuggcca

SEQ ID NO: 1624293 - RNA, 14 nt, Pseudomonas putida KT2440
gccacucuucacca

SEQ ID NO: 1624294 - RNA, 22 nt, Pseudomonas putida KT2440
gccacucuucaccaugggccug

SEQ ID NO: 1624295 - RNA, 22 nt, Pseudomonas putida KT2440
gccagaaccaggauauugccga

SEQ ID NO: 1624296 - RNA, 13 nt, Pseudomonas putida KT2440
gccagaaggcuca

SEQ ID NO: 1624297 - RNA, 19 nt, Pseudomonas putida KT2440
gccagaagguaucggccau

SEQ ID NO: 1624298 - RNA, 21 nt, Pseudomonas putida KT2440
gccacuaagaagcaaccgcug

SEQ ID NO: 1624299 - RNA, 18 nt, Pseudomonas putida KT2440
gccacguuuucgcggccc

SEQ ID NO: 1624300 - RNA, 12 nt, Pseudomonas putida KT2440
gccacucaggcg

SEQ ID NO: 1624301 - RNA, 22 nt, Pseudomonas putida KT2440
gccacucguccgggcgccagga

SEQ ID NO: 1624302 - RNA, 21 nt, Pseudomonas putida KT2440
gccacgguacgggcaaagccc

SEQ ID NO: 1624303 - RNA, 16 nt, Pseudomonas putida KT2440
gccacgguguauccag

SEQ ID NO: 1624304 - RNA, 20 nt, Pseudomonas putida KT2440
gccacgguguauccagcccg

SEQ ID NO: 1624305 - RNA, 20 nt, Pseudomonas putida KT2440
gccacgcgggcuaugcgauu

SEQ ID NO: 1624306 - RNA, 19 nt, Pseudomonas putida KT2440
gccacgcgguaccuguggg

SEQ ID NO: 1624307 - RNA, 14 nt, Pseudomonas putida KT2440
gccacgcugccagg

SEQ ID NO: 1624308 - RNA, 17 nt, Pseudomonas putida KT2440
gccacgcugaacacgcc

SEQ ID NO: 1624309 - RNA, 22 nt, Pseudomonas putida KT2440
gccacgcugaacacgcccgcgu

SEQ ID NO: 1624310 - RNA, 23 nt, Pseudomonas putida KT2440
gccacgcugcggcgaaagccagc

SEQ ID NO: 1624311 - RNA, 21 nt, Pseudomonas putida KT2440
gccacgcucaaccccaucacc

SEQ ID NO: 1624312 - RNA, 14 nt, Pseudomonas putida KT2440
gccacgcucgugca

SEQ ID NO: 1624313 - RNA, 16 nt, Pseudomonas putida KT2440
gccacgcucgugcagg

SEQ ID NO: 1624314 - RNA, 20 nt, Pseudomonas putida KT2440
gccacgcucgugcaggcugu

SEQ ID NO: 1624315 - RNA, 15 nt, Pseudomonas putida KT2440
gccacggaucaccug

SEQ ID NO: 1624316 - RNA, 18 nt, Pseudomonas putida KT2440
gccacggcaauggcccgc

SEQ ID NO: 1624317 - RNA, 17 nt, Pseudomonas putida KT2440
gccacggcggcauccag

SEQ ID NO: 1624318 - RNA, 22 nt, Pseudomonas putida KT2440
gccaucgcucaccguucuucuc

SEQ ID NO: 1624319 - RNA, 20 nt, Pseudomonas putida KT2440
gccaugcccaccgcauugca

SEQ ID NO: 1624320 - RNA, 17 nt, Pseudomonas putida KT2440
gccaugccacccccggc

SEQ ID NO: 1624321 - RNA, 13 nt, Pseudomonas putida KT2440
gccaugccccuac

SEQ ID NO: 1624322 - RNA, 17 nt, Pseudomonas putida KT2440
gccaugcccgcccgggc

SEQ ID NO: 1624323 - RNA, 17 nt, Pseudomonas putida KT2440
gccaucggugccgugca

SEQ ID NO: 1624324 - RNA, 16 nt, Pseudomonas putida KT2440
gccaugaucgccgccg

SEQ ID NO: 1624325 - RNA, 19 nt, Pseudomonas putida KT2440
gccauagcaccagcgggcc

SEQ ID NO: 1624326 - RNA, 15 nt, Pseudomonas putida KT2440
gccauagcccucggc

SEQ ID NO: 1624327 - RNA, 22 nt, Pseudomonas putida KT2440
gccauagcguugucgacugcac

SEQ ID NO: 1624328 - RNA, 17 nt, Pseudomonas putida KT2440
gccauaagcugucagca

SEQ ID NO: 1624329 - RNA, 19 nt, Pseudomonas putida KT2440
gccauccaccgcgccagcc

SEQ ID NO: 1624330 - RNA, 17 nt, Pseudomonas putida KT2440
gccauaguuuugugcca

SEQ ID NO: 1624331 - RNA, 16 nt, Pseudomonas putida KT2440
gccauauucagcuuca

SEQ ID NO: 1624332 - RNA, 22 nt, Pseudomonas putida KT2440
gccaguccuuggccaaugccag

SEQ ID NO: 1624333 - RNA, 19 nt, Pseudomonas putida KT2440
gccaguacgcgccugcacc

SEQ ID NO: 1624334 - RNA, 22 nt, Pseudomonas putida KT2440
gccaguacggccaucagcaagc

SEQ ID NO: 1624335 - RNA, 15 nt, Pseudomonas putida KT2440
gccaguagcaaucag

SEQ ID NO: 1624336 - RNA, 17 nt, Pseudomonas putida KT2440
gccaguacgccagcagc

SEQ ID NO: 1624337 - RNA, 14 nt, Pseudomonas putida KT2440
gccagugaccgcug

SEQ ID NO: 1624338 - RNA, 16 nt, Pseudomonas putida KT2440
gccaguugcuucugca

SEQ ID NO: 1624339 - RNA, 23 nt, Pseudomonas putida KT2440
gccaguugccccaggcccacggc

SEQ ID NO: 1624340 - RNA, 13 nt, Pseudomonas putida KT2440
gccaguuugcacu

SEQ ID NO: 1624341 - RNA, 17 nt, Pseudomonas putida KT2440
gccaguuugucguucuc

SEQ ID NO: 1624342 - RNA, 16 nt, Pseudomonas putida KT2440
gccaguucgacgcugc

SEQ ID NO: 1624343 - RNA, 22 nt, Pseudomonas putida KT2440
gccaguucgacgcugcugucgg

SEQ ID NO: 1624344 - RNA, 14 nt, Pseudomonas putida KT2440
gccaguucgacggu

SEQ ID NO: 1624345 - RNA, 23 nt, Pseudomonas putida KT2440
gccagugucaguugcucgcccgc

SEQ ID NO: 1624346 - RNA, 19 nt, Pseudomonas putida KT2440
gccaguuacccuguacccg

SEQ ID NO: 1624347 - RNA, 21 nt, Pseudomonas putida KT2440
gccagcuuggcuuucggcgca

SEQ ID NO: 1624348 - RNA, 18 nt, Pseudomonas putida KT2440
gccagcuuggucagggca

SEQ ID NO: 1624349 - RNA, 17 nt, Pseudomonas putida KT2440
gccagcuccuggcucag

SEQ ID NO: 1624350 - RNA, 17 nt, Pseudomonas putida KT2440
gccagcuccgacaggcu

SEQ ID NO: 1624351 - RNA, 13 nt, Pseudomonas putida KT2440
gccagcucaucca

SEQ ID NO: 1624352 - RNA, 16 nt, Pseudomonas putida KT2440
gccagcucauccagcc

SEQ ID NO: 1624353 - RNA, 14 nt, Pseudomonas putida KT2440
gccagcuccaccag

SEQ ID NO: 1624354 - RNA, 16 nt, Pseudomonas putida KT2440
gccaggccaaacaggc

SEQ ID NO: 1624355 - RNA, 14 nt, Pseudomonas putida KT2440
gccaggcccaccac

SEQ ID NO: 1624356 - RNA, 22 nt, Pseudomonas putida KT2440
gccaggcauuccccggucagca

SEQ ID NO: 1624357 - RNA, 13 nt, Pseudomonas putida KT2440
gccaggcagcaga

SEQ ID NO: 1624358 - RNA, 14 nt, Pseudomonas putida KT2440
gccaggcagcagac

SEQ ID NO: 1624359 - RNA, 13 nt, Pseudomonas putida KT2440
gccaggaacagcg

SEQ ID NO: 1624360 - RNA, 21 nt, Pseudomonas putida KT2440
gccaggaacagcgcagccacc

SEQ ID NO: 1624361 - RNA, 19 nt, Pseudomonas putida KT2440
gccaggaacagcgccacgc

SEQ ID NO: 1624362 - RNA, 21 nt, Pseudomonas putida KT2440
gccaggaagucgauguucagc

SEQ ID NO: 1624363 - RNA, 17 nt, Pseudomonas putida KT2440
gccagguacaggcaaag

SEQ ID NO: 1624364 - RNA, 15 nt, Pseudomonas putida KT2440
gccaggguuaccugc

SEQ ID NO: 1624365 - RNA, 21 nt, Pseudomonas putida KT2440
gccaggucaccgcccagcuuc

SEQ ID NO: 1624366 - RNA, 22 nt, Pseudomonas putida KT2440
gccagguccgguaacuggccca

SEQ ID NO: 1624367 - RNA, 22 nt, Pseudomonas putida KT2440
gccagggcaaaaugcagcaagc

SEQ ID NO: 1624368 - RNA, 17 nt, Pseudomonas putida KT2440
gccagggcccgccgcgc

SEQ ID NO: 1624369 - RNA, 21 nt, Pseudomonas putida KT2440
gccagggcccgccgcgcggcu

SEQ ID NO: 1624370 - RNA, 16 nt, Pseudomonas putida KT2440
gccagggcgcugucgg

SEQ ID NO: 1624371 - RNA, 20 nt, Pseudomonas putida KT2440
gccagggauuccuuggucag

SEQ ID NO: 1624372 - RNA, 17 nt, Pseudomonas putida KT2440
gccaggccccuuggcca

SEQ ID NO: 1624373 - RNA, 15 nt, Pseudomonas putida KT2440
gccaggcccagcccc

SEQ ID NO: 1624374 - RNA, 16 nt, Pseudomonas putida KT2440
gccagcgccaccgcgc

SEQ ID NO: 1624375 - RNA, 22 nt, Pseudomonas putida KT2440
gccagcgucagggucucgcggc

SEQ ID NO: 1624376 - RNA, 23 nt, Pseudomonas putida KT2440
gccagcgggaaguuaccgcccgc

SEQ ID NO: 1624377 - RNA, 19 nt, Pseudomonas putida KT2440
gccagcggcucgaccaagc

SEQ ID NO: 1624378 - RNA, 22 nt, Pseudomonas putida KT2440
gccagcggcucgaccaagccug

SEQ ID NO: 1624379 - RNA, 15 nt, Pseudomonas putida KT2440
gccagcggcgcggcc

SEQ ID NO: 1624380 - RNA, 21 nt, Pseudomonas putida KT2440
gccagcgcgcugcgcaaggac

SEQ ID NO: 1624381 - RNA, 17 nt, Pseudomonas putida KT2440
gccagcagcuggcuugu

SEQ ID NO: 1624382 - RNA, 22 nt, Pseudomonas putida KT2440
gccagcagggcaggggacagcc

SEQ ID NO: 1624383 - RNA, 14 nt, Pseudomonas putida KT2440
gccagcaggccgcc

SEQ ID NO: 1624384 - RNA, 15 nt, Pseudomonas putida KT2440
gccagcaggccgccg

SEQ ID NO: 1624385 - RNA, 16 nt, Pseudomonas putida KT2440
gccagcaggucaggcc

SEQ ID NO: 1624386 - RNA, 17 nt, Pseudomonas putida KT2440
gccagcagggccggccc

SEQ ID NO: 1624387 - RNA, 22 nt, Pseudomonas putida KT2440
gccagcaguucgcagccauagu

SEQ ID NO: 1624388 - RNA, 22 nt, Pseudomonas putida KT2440
gccagccggcgcaucagugccg

SEQ ID NO: 1624389 - RNA, 20 nt, Pseudomonas putida KT2440
gccagccggcagcaaggcau

SEQ ID NO: 1624390 - RNA, 23 nt, Pseudomonas putida KT2440
gccagccguugcgccgcucgccc

SEQ ID NO: 1624391 - RNA, 18 nt, Pseudomonas putida KT2440
gccccgccagcgccuggc

SEQ ID NO: 1624392 - RNA, 19 nt, Pseudomonas putida KT2440
gccccgccagcgccuggcg

SEQ ID NO: 1624393 - RNA, 22 nt, Pseudomonas putida KT2440
gccccgcaugcucgcugcugcc

SEQ ID NO: 1624394 - RNA, 12 nt, Pseudomonas putida KT2440
gccccgccgccc

SEQ ID NO: 1624395 - RNA, 11 nt, Pseudomonas putida KT2440
gccccgccagu

SEQ ID NO: 1624396 - RNA, 16 nt, Pseudomonas putida KT2440
gccccgauacagcgcg

SEQ ID NO: 1624397 - RNA, 15 nt, Pseudomonas putida KT2440
gccccgcaccagacc

SEQ ID NO: 1624398 - RNA, 21 nt, Pseudomonas putida KT2440
gccccgcaccagaccagcagc

SEQ ID NO: 1624399 - RNA, 17 nt, Pseudomonas putida KT2440
gccccgcaccgcggaug

SEQ ID NO: 1624400 - RNA, 16 nt, Pseudomonas putida KT2440
gccccgagcaaagccc

SEQ ID NO: 1624401 - RNA, 20 nt, Pseudomonas putida KT2440
gccccgagcaaagcccgccc

SEQ ID NO: 1624402 - RNA, 22 nt, Pseudomonas putida KT2440
gcccccgcucccacaggggccg

SEQ ID NO: 1624403 - RNA, 14 nt, Pseudomonas putida KT2440
gcccccgcugcaca

SEQ ID NO: 1624404 - RNA, 19 nt, Pseudomonas putida KT2440
gcccccggauggugugcag

SEQ ID NO: 1624405 - RNA, 15 nt, Pseudomonas putida KT2440
gcccccgucagcggc

SEQ ID NO: 1624406 - RNA, 15 nt, Pseudomonas putida KT2440
gcccccggcggcggc

SEQ ID NO: 1624407 - RNA, 13 nt, Pseudomonas putida KT2440
gcccccgccacag

SEQ ID NO: 1624408 - RNA, 20 nt, Pseudomonas putida KT2440
gcccccgccacccccgccgc

SEQ ID NO: 1624409 - RNA, 14 nt, Pseudomonas putida KT2440
gcccccgccgaagc

SEQ ID NO: 1624410 - RNA, 21 nt, Pseudomonas putida KT2440
gcccccugguuuuccaccggc

SEQ ID NO: 1624411 - RNA, 19 nt, Pseudomonas putida KT2440
gccccagucauccgggccg

SEQ ID NO: 1624412 - RNA, 21 nt, Pseudomonas putida KT2440
gccccagucauccgggccguc

SEQ ID NO: 1624413 - RNA, 20 nt, Pseudomonas putida KT2440
gccccaguggcuuacagcgu

SEQ ID NO: 1624414 - RNA, 23 nt, Pseudomonas putida KT2440
gccccagugugcaaacacccagc

SEQ ID NO: 1624415 - RNA, 19 nt, Pseudomonas putida KT2440
gccccaggcggugcacggc

SEQ ID NO: 1624416 - RNA, 19 nt, Pseudomonas putida KT2440
gccccagggggcagcugcu

SEQ ID NO: 1624417 - RNA, 18 nt, Pseudomonas putida KT2440
gccccagggcccucaacc

SEQ ID NO: 1624418 - RNA, 17 nt, Pseudomonas putida KT2440
gccccaucaccagcccg

SEQ ID NO: 1624419 - RNA, 22 nt, Pseudomonas putida KT2440
gccccauucgcugcgucaggcc

SEQ ID NO: 1624420 - RNA, 16 nt, Pseudomonas putida KT2440
gcccccaacccucacu

SEQ ID NO: 1624421 - RNA, 22 nt, Pseudomonas putida KT2440
gcccccaacccucacucgcggc

SEQ ID NO: 1624422 - RNA, 19 nt, Pseudomonas putida KT2440
gcccccaaaccgcugccca

SEQ ID NO: 1624423 - RNA, 22 nt, Pseudomonas putida KT2440
gcccccaugaugaccaccagga

SEQ ID NO: 1624424 - RNA, 14 nt, Pseudomonas putida KT2440
gccccccagccagc

SEQ ID NO: 1624425 - RNA, 18 nt, Pseudomonas putida KT2440
gccccccuuccgcgugcc

SEQ ID NO: 1624426 - RNA, 22 nt, Pseudomonas putida KT2440
gccccagcgccuuggccugcuc

SEQ ID NO: 1624427 - RNA, 12 nt, Pseudomonas putida KT2440
gccccagcguca

SEQ ID NO: 1624428 - RNA, 20 nt, Pseudomonas putida KT2440
gccccagccucagcuggccg

SEQ ID NO: 1624429 - RNA, 12 nt, Pseudomonas putida KT2440
gccccaggccgc

SEQ ID NO: 1624430 - RNA, 18 nt, Pseudomonas putida KT2440
gccccagauuucucagcu

SEQ ID NO: 1624431 - RNA, 11 nt, Pseudomonas putida KT2440
gccccaccucg

SEQ ID NO: 1624432 - RNA, 18 nt, Pseudomonas putida KT2440
gccccacuuccagcgaca

SEQ ID NO: 1624433 - RNA, 20 nt, Pseudomonas putida KT2440
gccccaagcgccugacgcag

SEQ ID NO: 1624434 - RNA, 14 nt, Pseudomonas putida KT2440
gccccaagcgggcc

SEQ ID NO: 1624435 - RNA, 15 nt, Pseudomonas putida KT2440
gccccaacugcaucc

SEQ ID NO: 1624436 - RNA, 14 nt, Pseudomonas putida KT2440
gccccaccaggcac

SEQ ID NO: 1624437 - RNA, 11 nt, Pseudomonas putida KT2440
gcccauugccg

SEQ ID NO: 1624438 - RNA, 23 nt, Pseudomonas putida KT2440
gcccauuucgugggucacgcaga

SEQ ID NO: 1624439 - RNA, 22 nt, Pseudomonas putida KT2440
gcccauuucugcauguccagcc

SEQ ID NO: 1624440 - RNA, 16 nt, Pseudomonas putida KT2440
gccccaacccaccagc

SEQ ID NO: 1624441 - RNA, 11 nt, Pseudomonas putida KT2440
gccccaaagga

SEQ ID NO: 1624442 - RNA, 21 nt, Pseudomonas putida KT2440
gccccaaaggaagucaaccuc

SEQ ID NO: 1624443 - RNA, 17 nt, Pseudomonas putida KT2440
gcccauggggauuggaa

SEQ ID NO: 1624444 - RNA, 15 nt, Pseudomonas putida KT2440
gcccauggcuggcag

SEQ ID NO: 1624445 - RNA, 19 nt, Pseudomonas putida KT2440
gcccauggcuggcagcacg

SEQ ID NO: 1624446 - RNA, 14 nt, Pseudomonas putida KT2440
gcccauggcgcuga

SEQ ID NO: 1624447 - RNA, 16 nt, Pseudomonas putida KT2440
gcccauggcgcagcuc

SEQ ID NO: 1624448 - RNA, 15 nt, Pseudomonas putida KT2440
gcccaucucaggccc

SEQ ID NO: 1624449 - RNA, 20 nt, Pseudomonas putida KT2440
gcccaucucaggcccaccag

SEQ ID NO: 1624450 - RNA, 14 nt, Pseudomonas putida KT2440
gcccaugaacagca

SEQ ID NO: 1624451 - RNA, 23 nt, Pseudomonas putida KT2440
gcccaugccaagcccacacaccg

SEQ ID NO: 1624452 - RNA, 17 nt, Pseudomonas putida KT2440
gcccagccugcccgccg

SEQ ID NO: 1624453 - RNA, 19 nt, Pseudomonas putida KT2440
gcccagcagccaacgcccc

SEQ ID NO: 1624454 - RNA, 22 nt, Pseudomonas putida KT2440
gcccagcagccaacgccccagg

SEQ ID NO: 1624455 - RNA, 13 nt, Pseudomonas putida KT2440
gcccagcagcccc

SEQ ID NO: 1624456 - RNA, 18 nt, Pseudomonas putida KT2440
gcccagcccggacugcac

SEQ ID NO: 1624457 - RNA, 13 nt, Pseudomonas putida KT2440
gcccagcgcucgu

SEQ ID NO: 1624458 - RNA, 21 nt, Pseudomonas putida KT2440
gcccagcgcucguaggcuuca

SEQ ID NO: 1624459 - RNA, 14 nt, Pseudomonas putida KT2440
gcccagcucgcugg

SEQ ID NO: 1624460 - RNA, 22 nt, Pseudomonas putida KT2440
gcccagcucgcuggccaccagc

SEQ ID NO: 1624461 - RNA, 14 nt, Pseudomonas putida KT2440
gcccagcuccagca

SEQ ID NO: 1624462 - RNA, 17 nt, Pseudomonas putida KT2440
gcccaggcccaacgggc

SEQ ID NO: 1624463 - RNA, 23 nt, Pseudomonas putida KT2440
gcccaggcccaacgggcgcgacu

SEQ ID NO: 1624464 - RNA, 14 nt, Pseudomonas putida KT2440
gcccacugcagcca

SEQ ID NO: 1624465 - RNA, 19 nt, Pseudomonas putida KT2440
gcccacuguaggagauucu

SEQ ID NO: 1624466 - RNA, 13 nt, Pseudomonas putida KT2440
gccaugcgcaggc

SEQ ID NO: 1624467 - RNA, 16 nt, Pseudomonas putida KT2440
gccaugcgcgggguga

SEQ ID NO: 1624468 - RNA, 18 nt, Pseudomonas putida KT2440
gcccacggcguccaggcc

SEQ ID NO: 1624469 - RNA, 19 nt, Pseudomonas putida KT2440
gcccacggcguccaggccc

SEQ ID NO: 1624470 - RNA, 19 nt, Pseudomonas putida KT2440
gcccagguuauacgccgcc

SEQ ID NO: 1624471 - RNA, 21 nt, Pseudomonas putida KT2440
gcccagguuauacgccgccga

SEQ ID NO: 1624472 - RNA, 21 nt, Pseudomonas putida KT2440
gcccagguguuguugcaacca

SEQ ID NO: 1624473 - RNA, 17 nt, Pseudomonas putida KT2440
gcccaguagcgccacca

SEQ ID NO: 1624474 - RNA, 19 nt, Pseudomonas putida KT2440
gcccaguagcgccaccauc

SEQ ID NO: 1624475 - RNA, 14 nt, Pseudomonas putida KT2440
gcccaguacgccac

SEQ ID NO: 1624476 - RNA, 15 nt, Pseudomonas putida KT2440
gcccaguacgccacc

SEQ ID NO: 1624477 - RNA, 17 nt, Pseudomonas putida KT2440
gcccaggcgccgcagca

SEQ ID NO: 1624478 - RNA, 21 nt, Pseudomonas putida KT2440
gcccaggcgcuugggugccga

SEQ ID NO: 1624479 - RNA, 16 nt, Pseudomonas putida KT2440
gcccaucgcacacccu

SEQ ID NO: 1624480 - RNA, 17 nt, Pseudomonas putida KT2440
gcccaucagcgccgcca

SEQ ID NO: 1624481 - RNA, 18 nt, Pseudomonas putida KT2440
gcccaguucuuggcggcu

SEQ ID NO: 1624482 - RNA, 21 nt, Pseudomonas putida KT2440
gcccaguucuuggcggcuggg

SEQ ID NO: 1624483 - RNA, 19 nt, Pseudomonas putida KT2440
gcccagugcgcgcaacagu

SEQ ID NO: 1624484 - RNA, 15 nt, Pseudomonas putida KT2440
gcccaguucuccggc

SEQ ID NO: 1624485 - RNA, 16 nt, Pseudomonas putida KT2440
gcccaguucuccggca

SEQ ID NO: 1624486 - RNA, 18 nt, Pseudomonas putida KT2440
gcccaguucuccggcagg

SEQ ID NO: 1624487 - RNA, 17 nt, Pseudomonas putida KT2440
gcccaucaccggcaccg

SEQ ID NO: 1624488 - RNA, 19 nt, Pseudomonas putida KT2440
gcccucuucgcgggcaugc

SEQ ID NO: 1624489 - RNA, 21 nt, Pseudomonas putida KT2440
gcccucuucgcgggcaugccc

SEQ ID NO: 1624490 - RNA, 17 nt, Pseudomonas putida KT2440
gcccucguucgcgggca

SEQ ID NO: 1624491 - RNA, 20 nt, Pseudomonas putida KT2440
gcccucugcgugguaugcau

SEQ ID NO: 1624492 - RNA, 21 nt, Pseudomonas putida KT2440
gcccugccuaccaccgcaucc

SEQ ID NO: 1624493 - RNA, 21 nt, Pseudomonas putida KT2440
gcccugccggccucaauucca

SEQ ID NO: 1624494 - RNA, 19 nt, Pseudomonas putida KT2440
gcccugcggcuguucgcag

SEQ ID NO: 1624495 - RNA, 22 nt, Pseudomonas putida KT2440
gcccugcggcuguucgcagcac

SEQ ID NO: 1624496 - RNA, 18 nt, Pseudomonas putida KT2440
gcccugcucgccaaaugu

SEQ ID NO: 1624497 - RNA, 19 nt, Pseudomonas putida KT2440
gcccguccgccuugagguu

SEQ ID NO: 1624498 - RNA, 19 nt, Pseudomonas putida KT2440
gcccguugaaagcggccuu

SEQ ID NO: 1624499 - RNA, 23 nt, Pseudomonas putida KT2440
gcccguucuggccuuggcgugca

SEQ ID NO: 1624500 - RNA, 14 nt, Pseudomonas putida KT2440
gcccuccuugggua

SEQ ID NO: 1624501 - RNA, 16 nt, Pseudomonas putida KT2440
gcccuccugcagcagg

SEQ ID NO: 1624502 - RNA, 18 nt, Pseudomonas putida KT2440
gcccuccuaucgcgacac

SEQ ID NO: 1624503 - RNA, 13 nt, Pseudomonas putida KT2440
gcccuccagcccu

SEQ ID NO: 1624504 - RNA, 15 nt, Pseudomonas putida KT2440
gcccuccagcccugg

SEQ ID NO: 1624505 - RNA, 16 nt, Pseudomonas putida KT2440
gcccuccagcccuggc

SEQ ID NO: 1624506 - RNA, 18 nt, Pseudomonas putida KT2440
gcccucauucgcccgcac

SEQ ID NO: 1624507 - RNA, 19 nt, Pseudomonas putida KT2440
gcccgcgucugccgcagcc

SEQ ID NO: 1624508 - RNA, 18 nt, Pseudomonas putida KT2440
gcccgcguucaugccggc

SEQ ID NO: 1624509 - RNA, 17 nt, Pseudomonas putida KT2440
gcccgcugaccgggucg

SEQ ID NO: 1624510 - RNA, 14 nt, Pseudomonas putida KT2440
gcccgcucccacag

SEQ ID NO: 1624511 - RNA, 20 nt, Pseudomonas putida KT2440
gcccgcucccacaggaauua

SEQ ID NO: 1624512 - RNA, 20 nt, Pseudomonas putida KT2440
gcccgcucccacagggaccg

SEQ ID NO: 1624513 - RNA, 11 nt, Pseudomonas putida KT2440
gcccggccagg

SEQ ID NO: 1624514 - RNA, 20 nt, Pseudomonas putida KT2440
gcccgcuguugagcagcagc

SEQ ID NO: 1624515 - RNA, 16 nt, Pseudomonas putida KT2440
gcccgcugcuuccggc

SEQ ID NO: 1624516 - RNA, 18 nt, Pseudomonas putida KT2440
gcccgggccaggccccuu

SEQ ID NO: 1624517 - RNA, 17 nt, Pseudomonas putida KT2440
gcccggcucaccgcagc

SEQ ID NO: 1624518 - RNA, 15 nt, Pseudomonas putida KT2440
gcccggcgcuggugc

SEQ ID NO: 1624519 - RNA, 14 nt, Pseudomonas putida KT2440
gcccgggcgcaggc

SEQ ID NO: 1624520 - RNA, 17 nt, Pseudomonas putida KT2440
gcccgcgaaaugcccaa

SEQ ID NO: 1624521 - RNA, 21 nt, Pseudomonas putida KT2440
gcccgcgaaaugcccaaagcc

SEQ ID NO: 1624522 - RNA, 23 nt, Pseudomonas putida KT2440
gcccgcgaaaugcccaaagcccg

SEQ ID NO: 1624523 - RNA, 22 nt, Pseudomonas putida KT2440
gcccgcgaacaaggcucagcug

SEQ ID NO: 1624524 - RNA, 16 nt, Pseudomonas putida KT2440
gcccgcgaagaggcca

SEQ ID NO: 1624525 - RNA, 19 nt, Pseudomonas putida KT2440
gcccgcgaagaggccagca

SEQ ID NO: 1624526 - RNA, 20 nt, Pseudomonas putida KT2440
gcccgcgaagaggccagcac

SEQ ID NO: 1624527 - RNA, 21 nt, Pseudomonas putida KT2440
gcccgcgaaggcuccagcacc

SEQ ID NO: 1624528 - RNA, 18 nt, Pseudomonas putida KT2440
gcccgcgaagggccgcaa

SEQ ID NO: 1624529 - RNA, 16 nt, Pseudomonas putida KT2440
gcccgcgaaggggccg

SEQ ID NO: 1624530 - RNA, 14 nt, Pseudomonas putida KT2440
gcccgcgaaugcaa

SEQ ID NO: 1624531 - RNA, 17 nt, Pseudomonas putida KT2440
gcccgcgccgacagccu

SEQ ID NO: 1624532 - RNA, 14 nt, Pseudomonas putida KT2440
gcccgcgccaggcu

SEQ ID NO: 1624533 - RNA, 16 nt, Pseudomonas putida KT2440
gcccgcguacucggcc

SEQ ID NO: 1624534 - RNA, 13 nt, Pseudomonas putida KT2440
gcccgccgccagu

SEQ ID NO: 1624535 - RNA, 21 nt, Pseudomonas putida KT2440
gcccgccgccaguuucaccug

SEQ ID NO: 1624536 - RNA, 14 nt, Pseudomonas putida KT2440
gcccgccgccacca

SEQ ID NO: 1624537 - RNA, 19 nt, Pseudomonas putida KT2440
gcccgccgccaccagcgcc

SEQ ID NO: 1624538 - RNA, 14 nt, Pseudomonas putida KT2440
gcccgccgcgcggc

SEQ ID NO: 1624539 - RNA, 17 nt, Pseudomonas putida KT2440
gcccgccgcccgcggcg

SEQ ID NO: 1624540 - RNA, 19 nt, Pseudomonas putida KT2440
gcccgccggcaacuccucc

SEQ ID NO: 1624541 - RNA, 19 nt, Pseudomonas putida KT2440
gcccgccggcacuuccucg

SEQ ID NO: 1624542 - RNA, 13 nt, Pseudomonas putida KT2440
gcccgccagcagg

SEQ ID NO: 1624543 - RNA, 14 nt, Pseudomonas putida KT2440
gcccgccagcaggc

SEQ ID NO: 1624544 - RNA, 15 nt, Pseudomonas putida KT2440
gcccgccagcaggcc

SEQ ID NO: 1624545 - RNA, 17 nt, Pseudomonas putida KT2440
gcccgccagcaggccac

SEQ ID NO: 1624546 - RNA, 19 nt, Pseudomonas putida KT2440
gcccgccagcaggccaccg

SEQ ID NO: 1624547 - RNA, 17 nt, Pseudomonas putida KT2440
gcccgacuggcuggccu

SEQ ID NO: 1624548 - RNA, 14 nt, Pseudomonas putida KT2440
gcccgagcccccgc

SEQ ID NO: 1624549 - RNA, 14 nt, Pseudomonas putida KT2440
gcccgagcaaggcg

SEQ ID NO: 1624550 - RNA, 19 nt, Pseudomonas putida KT2440
gcccgcaugauugcgggcu

SEQ ID NO: 1624551 - RNA, 15 nt, Pseudomonas putida KT2440
gcccgcaccggccga

SEQ ID NO: 1624552 - RNA, 14 nt, Pseudomonas putida KT2440
gccccggccccagg

SEQ ID NO: 1624553 - RNA, 15 nt, Pseudomonas putida KT2440
gccccggccccaggg

SEQ ID NO: 1624554 - RNA, 12 nt, Pseudomonas putida KT2440
gccccggccagu

SEQ ID NO: 1624555 - RNA, 14 nt, Pseudomonas putida KT2440
gccccggccaggcc

SEQ ID NO: 1624556 - RNA, 17 nt, Pseudomonas putida KT2440
gccccggccaggccggc

SEQ ID NO: 1624557 - RNA, 16 nt, Pseudomonas putida KT2440
gccccggcaauccugg

SEQ ID NO: 1624558 - RNA, 15 nt, Pseudomonas putida KT2440
gccccggccugcaca

SEQ ID NO: 1624559 - RNA, 13 nt, Pseudomonas putida KT2440
gccccggcgccgc

SEQ ID NO: 1624560 - RNA, 22 nt, Pseudomonas putida KT2440
gccccggcgccgccaggcagca

SEQ ID NO: 1624561 - RNA, 12 nt, Pseudomonas putida KT2440
gccccgcgccgc

SEQ ID NO: 1624562 - RNA, 14 nt, Pseudomonas putida KT2440
gccccgcgccgcca

SEQ ID NO: 1624563 - RNA, 17 nt, Pseudomonas putida KT2440
gccccgcucgccuggcc

SEQ ID NO: 1624564 - RNA, 20 nt, Pseudomonas putida KT2440
gccccgcgcguccauggcgc

SEQ ID NO: 1624565 - RNA, 17 nt, Pseudomonas putida KT2440
gccccgggugcagccgc

SEQ ID NO: 1624566 - RNA, 15 nt, Pseudomonas putida KT2440
gccccuggaagcgaa

SEQ ID NO: 1624567 - RNA, 15 nt, Pseudomonas putida KT2440
gccccugcggcugcc

SEQ ID NO: 1624568 - RNA, 20 nt, Pseudomonas putida KT2440
gccccugcggcugccccaac

SEQ ID NO: 1624569 - RNA, 20 nt, Pseudomonas putida KT2440
gccccugguaccgauggugc

SEQ ID NO: 1624570 - RNA, 16 nt, Pseudomonas putida KT2440
gccccuggcuguccca

SEQ ID NO: 1624571 - RNA, 23 nt, Pseudomonas putida KT2440
gccccuggcugucccaugcugca

SEQ ID NO: 1624572 - RNA, 17 nt, Pseudomonas putida KT2440
gcccgaccucacgcagg

SEQ ID NO: 1624573 - RNA, 18 nt, Pseudomonas putida KT2440
gcccgaccgccagcccgc

SEQ ID NO: 1624574 - RNA, 15 nt, Pseudomonas putida KT2440
gccccuuccccaggc

SEQ ID NO: 1624575 - RNA, 16 nt, Pseudomonas putida KT2440
gccccuuccccaggcc

SEQ ID NO: 1624576 - RNA, 13 nt, Pseudomonas putida KT2440
gccccuguggggg

SEQ ID NO: 1624577 - RNA, 14 nt, Pseudomonas putida KT2440
gcccgacaagccac

SEQ ID NO: 1624578 - RNA, 23 nt, Pseudomonas putida KT2440
gccccuucuauuaaugcacgccu

SEQ ID NO: 1624579 - RNA, 18 nt, Pseudomonas putida KT2440
gcaaccggacggguuucg

SEQ ID NO: 1624580 - RNA, 21 nt, Pseudomonas putida KT2440
gcaaccgggucggcgccaggc

SEQ ID NO: 1624581 - RNA, 22 nt, Pseudomonas putida KT2440
gcaaccgggucggcgccaggcc

SEQ ID NO: 1624582 - RNA, 17 nt, Pseudomonas putida KT2440
gcaaccgggucuugaag

SEQ ID NO: 1624583 - RNA, 16 nt, Pseudomonas putida KT2440
gcaacccggccaggcc

SEQ ID NO: 1624584 - RNA, 11 nt, Pseudomonas putida KT2440
gcaacccagcc

SEQ ID NO: 1624585 - RNA, 20 nt, Pseudomonas putida KT2440
gcaaccucggccgcauccug

SEQ ID NO: 1624586 - RNA, 13 nt, Pseudomonas putida KT2440
gcaaccgugacug

SEQ ID NO: 1624587 - RNA, 15 nt, Pseudomonas putida KT2440
gcaaccugcucgcuc

SEQ ID NO: 1624588 - RNA, 22 nt, Pseudomonas putida KT2440
gcaacgaaaaaaagggcaccuc

SEQ ID NO: 1624589 - RNA, 14 nt, Pseudomonas putida KT2440
gcaacgacaaggua

SEQ ID NO: 1624590 - RNA, 21 nt, Pseudomonas putida KT2440
gcaacggcacacgcaccaccc

SEQ ID NO: 1624591 - RNA, 20 nt, Pseudomonas putida KT2440
gcaacggacgucccagcagg

SEQ ID NO: 1624592 - RNA, 22 nt, Pseudomonas putida KT2440
gcaacggacgucccagcaggca

SEQ ID NO: 1624593 - RNA, 19 nt, Pseudomonas putida KT2440
gcaacggccacgcugcggc

SEQ ID NO: 1624594 - RNA, 21 nt, Pseudomonas putida KT2440
gcaacgcuuggcaaucaaggu

SEQ ID NO: 1624595 - RNA, 17 nt, Pseudomonas putida KT2440
gcaacgcagcgcgugcu

SEQ ID NO: 1624596 - RNA, 15 nt, Pseudomonas putida KT2440
gcaacgccacacugu

SEQ ID NO: 1624597 - RNA, 16 nt, Pseudomonas putida KT2440
gcaacgcgccauggcc

SEQ ID NO: 1624598 - RNA, 15 nt, Pseudomonas putida KT2440
gcaacgcggcccugg

SEQ ID NO: 1624599 - RNA, 20 nt, Pseudomonas putida KT2440
gcaacagcucaacccgccug

SEQ ID NO: 1624600 - RNA, 16 nt, Pseudomonas putida KT2440
gcaacagcucauccag

SEQ ID NO: 1624601 - RNA, 14 nt, Pseudomonas putida KT2440
gcaacagcuccagc

SEQ ID NO: 1624602 - RNA, 18 nt, Pseudomonas putida KT2440
gcaacaggucgaccugcc

SEQ ID NO: 1624603 - RNA, 17 nt, Pseudomonas putida KT2440
gcaacaguuucuugccu

SEQ ID NO: 1624604 - RNA, 20 nt, Pseudomonas putida KT2440
gcaacaguuucuugccuucc

SEQ ID NO: 1624605 - RNA, 18 nt, Pseudomonas putida KT2440
gcaacauucaccagccag

SEQ ID NO: 1624606 - RNA, 17 nt, Pseudomonas putida KT2440
gcaacaugaagccaugg

SEQ ID NO: 1624607 - RNA, 17 nt, Pseudomonas putida KT2440
gcaacauguccacaccc

SEQ ID NO: 1624608 - RNA, 15 nt, Pseudomonas putida KT2440
gcaaccauggcuucg

SEQ ID NO: 1624609 - RNA, 17 nt, Pseudomonas putida KT2440
gcaacacgacgauggcc

SEQ ID NO: 1624610 - RNA, 20 nt, Pseudomonas putida KT2440
gcaacagaaaaugcccgcug

SEQ ID NO: 1624611 - RNA, 16 nt, Pseudomonas putida KT2440
gcaacagccccaucac

SEQ ID NO: 1624612 - RNA, 17 nt, Pseudomonas putida KT2440
gcaacagccccaucacc

SEQ ID NO: 1624613 - RNA, 13 nt, Pseudomonas putida KT2440
gcaacaccagcag

SEQ ID NO: 1624614 - RNA, 16 nt, Pseudomonas putida KT2440
gcaacaccgccagaaa

SEQ ID NO: 1624615 - RNA, 19 nt, Pseudomonas putida KT2440
gcaacaccgccagcgggcu

SEQ ID NO: 1624616 - RNA, 23 nt, Pseudomonas putida KT2440
gcaacaccgccagcgggcuggca

SEQ ID NO: 1624617 - RNA, 17 nt, Pseudomonas putida KT2440
gcaacaaggccaaccac

SEQ ID NO: 1624618 - RNA, 23 nt, Pseudomonas putida KT2440
gcaaaacgguuguuucagccuug

SEQ ID NO: 1624619 - RNA, 17 nt, Pseudomonas putida KT2440
gcaaaaccugagucagg

SEQ ID NO: 1624620 - RNA, 13 nt, Pseudomonas putida KT2440
gcaaucgccaggc

SEQ ID NO: 1624621 - RNA, 14 nt, Pseudomonas putida KT2440
gcaaucgccaggcg

SEQ ID NO: 1624622 - RNA, 18 nt, Pseudomonas putida KT2440
gcaauccuuggcgcacuu

SEQ ID NO: 1624623 - RNA, 19 nt, Pseudomonas putida KT2440
gcaaucgacucaaggaugu

SEQ ID NO: 1624624 - RNA, 16 nt, Pseudomonas putida KT2440
gcaaucgggauggcac

SEQ ID NO: 1624625 - RNA, 15 nt, Pseudomonas putida KT2440
gcaaucgggccggcg

SEQ ID NO: 1624626 - RNA, 21 nt, Pseudomonas putida KT2440
gcaaucgccgggcgcaccaca

SEQ ID NO: 1624627 - RNA, 16 nt, Pseudomonas putida KT2440
gcaaucgcgauauauu

SEQ ID NO: 1624628 - RNA, 17 nt, Pseudomonas putida KT2440
gcaauccagcgugaccu

SEQ ID NO: 1624629 - RNA, 18 nt, Pseudomonas putida KT2440
gcaauccgugagccagga

SEQ ID NO: 1624630 - RNA, 16 nt, Pseudomonas putida KT2440
gcaaggcggcccaacg

SEQ ID NO: 1624631 - RNA, 13 nt, Pseudomonas putida KT2440
gcaaggcgagguu

SEQ ID NO: 1624632 - RNA, 18 nt, Pseudomonas putida KT2440
gcaaggcgaucuggcgga

SEQ ID NO: 1624633 - RNA, 19 nt, Pseudomonas putida KT2440
gcaaggcgaccugccagcc

SEQ ID NO: 1624634 - RNA, 14 nt, Pseudomonas putida KT2440
gcaaggccgcggcu

SEQ ID NO: 1624635 - RNA, 16 nt, Pseudomonas putida KT2440
gcaaggccuccaggua

SEQ ID NO: 1624636 - RNA, 21 nt, Pseudomonas putida KT2440
gcaagggccguuacucccaca

SEQ ID NO: 1624637 - RNA, 15 nt, Pseudomonas putida KT2440
gcaagggccugcagg

SEQ ID NO: 1624638 - RNA, 16 nt, Pseudomonas putida KT2440
gcaagggccugcaggc

SEQ ID NO: 1624639 - RNA, 17 nt, Pseudomonas putida KT2440
gcaagggcgaaccaggu

SEQ ID NO: 1624640 - RNA, 16 nt, Pseudomonas putida KT2440
gcaauaaccaaucaac

SEQ ID NO: 1624641 - RNA, 21 nt, Pseudomonas putida KT2440
gcaacuggcccgcgccaggcu

SEQ ID NO: 1624642 - RNA, 22 nt, Pseudomonas putida KT2440
gcaacuggcccgcgccaggcug

SEQ ID NO: 1624643 - RNA, 15 nt, Pseudomonas putida KT2440
gcaacucgcgcccac

SEQ ID NO: 1624644 - RNA, 15 nt, Pseudomonas putida KT2440
gcaacucggccuugu

SEQ ID NO: 1624645 - RNA, 18 nt, Pseudomonas putida KT2440
gcaacuccuccagccgac

SEQ ID NO: 1624646 - RNA, 20 nt, Pseudomonas putida KT2440
gcaacuccucgaucaccugc

SEQ ID NO: 1624647 - RNA, 23 nt, Pseudomonas putida KT2440
gcaacgugcgccgagaccugugg

SEQ ID NO: 1624648 - RNA, 20 nt, Pseudomonas putida KT2440
gcaacuguuggaauggcgca

SEQ ID NO: 1624649 - RNA, 13 nt, Pseudomonas putida KT2440
gcaagcuggucag

SEQ ID NO: 1624650 - RNA, 20 nt, Pseudomonas putida KT2440
gcaagcugcaccgccacccc

SEQ ID NO: 1624651 - RNA, 20 nt, Pseudomonas putida KT2440
gcaagcugagaaugcccucc

SEQ ID NO: 1624652 - RNA, 23 nt, Pseudomonas putida KT2440
gcaagcuggcgcaagccgugccu

SEQ ID NO: 1624653 - RNA, 16 nt, Pseudomonas putida KT2440
gcaaggcauccagaaa

SEQ ID NO: 1624654 - RNA, 22 nt, Pseudomonas putida KT2440
gcaaggcaaugcccauggccag

SEQ ID NO: 1624655 - RNA, 12 nt, Pseudomonas putida KT2440
gcaccagcacca

SEQ ID NO: 1624656 - RNA, 16 nt, Pseudomonas putida KT2440
gcaccagcaccaccgg

SEQ ID NO: 1624657 - RNA, 17 nt, Pseudomonas putida KT2440
gcaccagcaccagcucc

SEQ ID NO: 1624658 - RNA, 18 nt, Pseudomonas putida KT2440
gcaccagcaccagcuccu

SEQ ID NO: 1624659 - RNA, 16 nt, Pseudomonas putida KT2440
gcacaugcagguugcc

SEQ ID NO: 1624660 - RNA, 19 nt, Pseudomonas putida KT2440
gcacauccugcaaggcaau

SEQ ID NO: 1624661 - RNA, 14 nt, Pseudomonas putida KT2440
gcacaucguccgcc

SEQ ID NO: 1624662 - RNA, 19 nt, Pseudomonas putida KT2440
gcacaucggcaaucgccgg

SEQ ID NO: 1624663 - RNA, 15 nt, Pseudomonas putida KT2440
gcacauucagcagcg

SEQ ID NO: 1624664 - RNA, 17 nt, Pseudomonas putida KT2440
gcaccaggucaggacau

SEQ ID NO: 1624665 - RNA, 15 nt, Pseudomonas putida KT2440
gcaccagggcuggca

SEQ ID NO: 1624666 - RNA, 16 nt, Pseudomonas putida KT2440
gcaccaguuccagggc

SEQ ID NO: 1624667 - RNA, 13 nt, Pseudomonas putida KT2440
gcaccaguuccug

SEQ ID NO: 1624668 - RNA, 20 nt, Pseudomonas putida KT2440
gcaccaucagagcgccagca

SEQ ID NO: 1624669 - RNA, 23 nt, Pseudomonas putida KT2440
gcaccaucagagcgccagcaagc

SEQ ID NO: 1624670 - RNA, 16 nt, Pseudomonas putida KT2440
gcaccaucaggcacag

SEQ ID NO: 1624671 - RNA, 22 nt, Pseudomonas putida KT2440
gcaccaucaggcacaggccagc

SEQ ID NO: 1624672 - RNA, 20 nt, Pseudomonas putida KT2440
gcaccaucggcuccagcgca

SEQ ID NO: 1624673 - RNA, 18 nt, Pseudomonas putida KT2440
gcaccaugaacucuuccc

SEQ ID NO: 1624674 - RNA, 19 nt, Pseudomonas putida KT2440
gcaccaugaacucuucccc

SEQ ID NO: 1624675 - RNA, 22 nt, Pseudomonas putida KT2440
gcaccaugaacucuuccccgcc

SEQ ID NO: 1624676 - RNA, 23 nt, Pseudomonas putida KT2440
gcaccaugaacucuuccccgccc

SEQ ID NO: 1624677 - RNA, 17 nt, Pseudomonas putida KT2440
gcacaacgcgcgggcaa

SEQ ID NO: 1624678 - RNA, 23 nt, Pseudomonas putida KT2440
gcacaacgcgcgggcaauggcca

SEQ ID NO: 1624679 - RNA, 19 nt, Pseudomonas putida KT2440
gcacaacccuaucagggcu

SEQ ID NO: 1624680 - RNA, 19 nt, Pseudomonas putida KT2440
gcacaaccgaacccgcugc

SEQ ID NO: 1624681 - RNA, 23 nt, Pseudomonas putida KT2440
gcacaacccgauuccuugcagcg

SEQ ID NO: 1624682 - RNA, 22 nt, Pseudomonas putida KT2440
gcaaugccgaacagucauccag

SEQ ID NO: 1624683 - RNA, 13 nt, Pseudomonas putida KT2440
gcaaugcaacucg

SEQ ID NO: 1624684 - RNA, 18 nt, Pseudomonas putida KT2440
gcaaugcaggcaguaggc

SEQ ID NO: 1624685 - RNA, 21 nt, Pseudomonas putida KT2440
gcaaugauugcugccggaccu

SEQ ID NO: 1624686 - RNA, 23 nt, Pseudomonas putida KT2440
gcaaugauugcugccggaccugc

SEQ ID NO: 1624687 - RNA, 17 nt, Pseudomonas putida KT2440
gcacagcaucagcacac

SEQ ID NO: 1624688 - RNA, 18 nt, Pseudomonas putida KT2440
gcacagcgagcagccugg

SEQ ID NO: 1624689 - RNA, 21 nt, Pseudomonas putida KT2440
gcacaccgcugguggcguggc

SEQ ID NO: 1624690 - RNA, 16 nt, Pseudomonas putida KT2440
gcacaccuugggccca

SEQ ID NO: 1624691 - RNA, 19 nt, Pseudomonas putida KT2440
gcacaccuugggcccacac

SEQ ID NO: 1624692 - RNA, 13 nt, Pseudomonas putida KT2440
gcacacgcaccac

SEQ ID NO: 1624693 - RNA, 21 nt, Pseudomonas putida KT2440
gcacacgcaccaccccggggc

SEQ ID NO: 1624694 - RNA, 22 nt, Pseudomonas putida KT2440
gcacacgaccuuggacgcuggc

SEQ ID NO: 1624695 - RNA, 23 nt, Pseudomonas putida KT2440
gcacacgaccuuggacgcuggca

SEQ ID NO: 1624696 - RNA, 16 nt, Pseudomonas putida KT2440
gcacaggcuggccacc

SEQ ID NO: 1624697 - RNA, 23 nt, Pseudomonas putida KT2440
gcacagggcggccaaggcguggc

SEQ ID NO: 1624698 - RNA, 18 nt, Pseudomonas putida KT2440
gcacagguaucgccgccc

SEQ ID NO: 1624699 - RNA, 16 nt, Pseudomonas putida KT2440
gcacagguccagccgc

SEQ ID NO: 1624700 - RNA, 12 nt, Pseudomonas putida KT2440
gcacaucccaga

SEQ ID NO: 1624701 - RNA, 21 nt, Pseudomonas putida KT2440
gcacagcucgcgcugccaggc

SEQ ID NO: 1624702 - RNA, 22 nt, Pseudomonas putida KT2440
gcacagcucgcgcugccaggcc

SEQ ID NO: 1624703 - RNA, 20 nt, Pseudomonas putida KT2440
gcacaggaaaacugcgggcu

SEQ ID NO: 1624704 - RNA, 13 nt, Pseudomonas putida KT2440
gcacaggcgcagc

SEQ ID NO: 1624705 - RNA, 16 nt, Pseudomonas putida KT2440
gcacaggccagcccca

SEQ ID NO: 1624706 - RNA, 18 nt, Pseudomonas putida KT2440
gcacaggccagccccagc

SEQ ID NO: 1624707 - RNA, 16 nt, Pseudomonas putida KT2440
gcacaggcccagcaac

SEQ ID NO: 1624708 - RNA, 22 nt, Pseudomonas putida KT2440
gcacaggcccagcaugaacgca

SEQ ID NO: 1624709 - RNA, 18 nt, Pseudomonas putida KT2440
gcacaggcauaccgcaac

SEQ ID NO: 1624710 - RNA, 21 nt, Pseudomonas putida KT2440
gcaccgcggaugcgccuggcc

SEQ ID NO: 1624711 - RNA, 23 nt, Pseudomonas putida KT2440
gcaccgcggaugcgccuggcccg

SEQ ID NO: 1624712 - RNA, 23 nt, Pseudomonas putida KT2440
gcaccgcuucacccucgcgcagc

SEQ ID NO: 1624713 - RNA, 17 nt, Pseudomonas putida KT2440
gcaccgcuaccauggcc

SEQ ID NO: 1624714 - RNA, 17 nt, Pseudomonas putida KT2440
gcaccgcugccagcugc

SEQ ID NO: 1624715 - RNA, 22 nt, Pseudomonas putida KT2440
gcaccgaccgugcauacacccg

SEQ ID NO: 1624716 - RNA, 21 nt, Pseudomonas putida KT2440
gcaccgacuuccccggcgccg

SEQ ID NO: 1624717 - RNA, 22 nt, Pseudomonas putida KT2440
gcaccgacuuccccggcgccgc

SEQ ID NO: 1624718 - RNA, 14 nt, Pseudomonas putida KT2440
gcaccccuuucucc

SEQ ID NO: 1624719 - RNA, 15 nt, Pseudomonas putida KT2440
gcaccccggccgcuu

SEQ ID NO: 1624720 - RNA, 19 nt, Pseudomonas putida KT2440
gcaccccggccgcuugcaa

SEQ ID NO: 1624721 - RNA, 15 nt, Pseudomonas putida KT2440
gcaccccugccacca

SEQ ID NO: 1624722 - RNA, 23 nt, Pseudomonas putida KT2440
gcacccgcccaucgcacacccug

SEQ ID NO: 1624723 - RNA, 13 nt, Pseudomonas putida KT2440
gcacccaggccac

SEQ ID NO: 1624724 - RNA, 13 nt, Pseudomonas putida KT2440
gcaccccagcacc

SEQ ID NO: 1624725 - RNA, 18 nt, Pseudomonas putida KT2440
gcaccccauaacgcccac

SEQ ID NO: 1624726 - RNA, 16 nt, Pseudomonas putida KT2440
gcacccaauagcccac

SEQ ID NO: 1624727 - RNA, 21 nt, Pseudomonas putida KT2440
gcacccacagagacaccgcag

SEQ ID NO: 1624728 - RNA, 15 nt, Pseudomonas putida KT2440
gcaccuaaccagugg

SEQ ID NO: 1624729 - RNA, 22 nt, Pseudomonas putida KT2440
gcaccggcaguagaaaguccau

SEQ ID NO: 1624730 - RNA, 15 nt, Pseudomonas putida KT2440
gcaccggcagcagca

SEQ ID NO: 1624731 - RNA, 12 nt, Pseudomonas putida KT2440
gcaccggccagg

SEQ ID NO: 1624732 - RNA, 14 nt, Pseudomonas putida KT2440
gcaccggccaggcu

SEQ ID NO: 1624733 - RNA, 13 nt, Pseudomonas putida KT2440
gcaccggccacca

SEQ ID NO: 1624734 - RNA, 14 nt, Pseudomonas putida KT2440
gcaccuccaccuuc

SEQ ID NO: 1624735 - RNA, 21 nt, Pseudomonas putida KT2440
gcaccugcagguacagcagcu

SEQ ID NO: 1624736 - RNA, 23 nt, Pseudomonas putida KT2440
gcaccugccgggcaucgggugaa

SEQ ID NO: 1624737 - RNA, 18 nt, Pseudomonas putida KT2440
gcaccucauagaucagca

SEQ ID NO: 1624738 - RNA, 22 nt, Pseudomonas putida KT2440
gcaccucauagaucagcaucgg

SEQ ID NO: 1624739 - RNA, 17 nt, Pseudomonas putida KT2440
gcaccuggccgggcuuu

SEQ ID NO: 1624740 - RNA, 17 nt, Pseudomonas putida KT2440
gcaccuggcggcccgcc

SEQ ID NO: 1624741 - RNA, 15 nt, Pseudomonas putida KT2440
gcacgaacagauggu

SEQ ID NO: 1624742 - RNA, 16 nt, Pseudomonas putida KT2440
gcacgaaggccagcaa

SEQ ID NO: 1624743 - RNA, 17 nt, Pseudomonas putida KT2440
gcacgaaguaacggcca

SEQ ID NO: 1624744 - RNA, 18 nt, Pseudomonas putida KT2440
gcacgaagcccaguugcu

SEQ ID NO: 1624745 - RNA, 13 nt, Pseudomonas putida KT2440
gcacgcaggccag

SEQ ID NO: 1624746 - RNA, 15 nt, Pseudomonas putida KT2440
gcacgcaucugcacc

SEQ ID NO: 1624747 - RNA, 19 nt, Pseudomonas putida KT2440
gcacgccgguaucacccag

SEQ ID NO: 1624748 - RNA, 20 nt, Pseudomonas putida KT2440
gcacgccgguaucacccagu

SEQ ID NO: 1624749 - RNA, 19 nt, Pseudomonas putida KT2440
gcacgccuucagcagccgg

SEQ ID NO: 1624750 - RNA, 15 nt, Pseudomonas putida KT2440
gcacgcgaucggcag

SEQ ID NO: 1624751 - RNA, 16 nt, Pseudomonas putida KT2440
gcacgcgcagagaagc

SEQ ID NO: 1624752 - RNA, 19 nt, Pseudomonas putida KT2440
gcaggugggucacggucag

SEQ ID NO: 1624753 - RNA, 21 nt, Pseudomonas putida KT2440
gcagguucaggcgcagcacgc

SEQ ID NO: 1624754 - RNA, 20 nt, Pseudomonas putida KT2440
gcagguucaacggcgcccgg

SEQ ID NO: 1624755 - RNA, 16 nt, Pseudomonas putida KT2440
gcagguugaacagcag

SEQ ID NO: 1624756 - RNA, 16 nt, Pseudomonas putida KT2440
gcagguucgaccacug

SEQ ID NO: 1624757 - RNA, 16 nt, Pseudomonas putida KT2440
gcagguucugaaucug

SEQ ID NO: 1624758 - RNA, 18 nt, Pseudomonas putida KT2440
gcagguucugaaucuggc

SEQ ID NO: 1624759 - RNA, 22 nt, Pseudomonas putida KT2440
gcagguucugaaucuggcucug

SEQ ID NO: 1624760 - RNA, 13 nt, Pseudomonas putida KT2440
gcagguccagcuc

SEQ ID NO: 1624761 - RNA, 20 nt, Pseudomonas putida KT2440
gcagguccggaaacucacgc

SEQ ID NO: 1624762 - RNA, 19 nt, Pseudomonas putida KT2440
gcaggucgaacagcccccg

SEQ ID NO: 1624763 - RNA, 20 nt, Pseudomonas putida KT2440
gcaggucgacaugcaccacg

SEQ ID NO: 1624764 - RNA, 15 nt, Pseudomonas putida KT2440
gcaggucgaccugcc

SEQ ID NO: 1624765 - RNA, 20 nt, Pseudomonas putida KT2440
gcaggucgacgauacccagc

SEQ ID NO: 1624766 - RNA, 21 nt, Pseudomonas putida KT2440
gcaggucgacgauacccagcg

SEQ ID NO: 1624767 - RNA, 14 nt, Pseudomonas putida KT2440
gcaggucaugcagg

SEQ ID NO: 1624768 - RNA, 19 nt, Pseudomonas putida KT2440
gcaggucauuggcgccauc

SEQ ID NO: 1624769 - RNA, 19 nt, Pseudomonas putida KT2440
gcaggucagcgagcgggug

SEQ ID NO: 1624770 - RNA, 16 nt, Pseudomonas putida KT2440
gcagguacgcgcaggc

SEQ ID NO: 1624771 - RNA, 18 nt, Pseudomonas putida KT2440
gcagguacgcgcaggcag

SEQ ID NO: 1624772 - RNA, 15 nt, Pseudomonas putida KT2440
gcagguacaccgccu

SEQ ID NO: 1624773 - RNA, 14 nt, Pseudomonas putida KT2440
gcagguacagcagc

SEQ ID NO: 1624774 - RNA, 16 nt, Pseudomonas putida KT2440
gcagguacagcagcug

SEQ ID NO: 1624775 - RNA, 18 nt, Pseudomonas putida KT2440
gcagguacagcagcugca

SEQ ID NO: 1624776 - RNA, 15 nt, Pseudomonas putida KT2440
gcagguaaacccgcg

SEQ ID NO: 1624777 - RNA, 21 nt, Pseudomonas putida KT2440
gcaggguuuucagcgccgcaa

SEQ ID NO: 1624778 - RNA, 18 nt, Pseudomonas putida KT2440
gcagguaaugcgccgcac

SEQ ID NO: 1624779 - RNA, 20 nt, Pseudomonas putida KT2440
gcaggguucgccgucagccu

SEQ ID NO: 1624780 - RNA, 22 nt, Pseudomonas putida KT2440
gcaggguucgccgucagccuuu

SEQ ID NO: 1624781 - RNA, 16 nt, Pseudomonas putida KT2440
gcagggugccgccaug

SEQ ID NO: 1624782 - RNA, 23 nt, Pseudomonas putida KT2440
gcagggucgcgccccaagcgggc

SEQ ID NO: 1624783 - RNA, 22 nt, Pseudomonas putida KT2440
gcagggcgccgaucauugcugc

SEQ ID NO: 1624784 - RNA, 12 nt, Pseudomonas putida KT2440
gcagggccuugu

SEQ ID NO: 1624785 - RNA, 22 nt, Pseudomonas putida KT2440
gcagggcgagcacacccggcgu

SEQ ID NO: 1624786 - RNA, 13 nt, Pseudomonas putida KT2440
gcagggcggccuc

SEQ ID NO: 1624787 - RNA, 21 nt, Pseudomonas putida KT2440
gcagggcgcgaaaagccugca

SEQ ID NO: 1624788 - RNA, 22 nt, Pseudomonas putida KT2440
gcagggcgaucuccugcaggga

SEQ ID NO: 1624789 - RNA, 14 nt, Pseudomonas putida KT2440
gcagggucaggcgg

SEQ ID NO: 1624790 - RNA, 19 nt, Pseudomonas putida KT2440
gcaggggcugcgcaaggcg

SEQ ID NO: 1624791 - RNA, 19 nt, Pseudomonas putida KT2440
gcaggguagggguggauca

SEQ ID NO: 1624792 - RNA, 21 nt, Pseudomonas putida KT2440
gcaguucgucgaccgccgccu

SEQ ID NO: 1624793 - RNA, 20 nt, Pseudomonas putida KT2440
gcaguucacgcaggucgggg

SEQ ID NO: 1624794 - RNA, 20 nt, Pseudomonas putida KT2440
gcaguucagggcguggugaa

SEQ ID NO: 1624795 - RNA, 21 nt, Pseudomonas putida KT2440
gcaguugcaggcgcagggugu

SEQ ID NO: 1624796 - RNA, 15 nt, Pseudomonas putida KT2440
gcaguuguccaggcu

SEQ ID NO: 1624797 - RNA, 21 nt, Pseudomonas putida KT2440
gcagugguugugcuggcccuu

SEQ ID NO: 1624798 - RNA, 13 nt, Pseudomonas putida KT2440
gcaguguacaugg

SEQ ID NO: 1624799 - RNA, 14 nt, Pseudomonas putida KT2440
gcaguggcucgugc

SEQ ID NO: 1624800 - RNA, 17 nt, Pseudomonas putida KT2440
gcagucuugcugaucac

SEQ ID NO: 1624801 - RNA, 15 nt, Pseudomonas putida KT2440
gcaguacaggcugcc

SEQ ID NO: 1624802 - RNA, 18 nt, Pseudomonas putida KT2440
gcaguacuuauaagcagc

SEQ ID NO: 1624803 - RNA, 22 nt, Pseudomonas putida KT2440
gcaguacuuauaagcagcaagc

SEQ ID NO: 1624804 - RNA, 21 nt, Pseudomonas putida KT2440
gcaggaacagcggcagcaaca

SEQ ID NO: 1624805 - RNA, 15 nt, Pseudomonas putida KT2440
gcagcuucuggcgcg

SEQ ID NO: 1624806 - RNA, 19 nt, Pseudomonas putida KT2440
gcagcuucuggcgcguguc

SEQ ID NO: 1624807 - RNA, 17 nt, Pseudomonas putida KT2440
gcaggaaauacgccgcc

SEQ ID NO: 1624808 - RNA, 13 nt, Pseudomonas putida KT2440
gcagcuucuucac

SEQ ID NO: 1624809 - RNA, 14 nt, Pseudomonas putida KT2440
gcagcuucuucaca

SEQ ID NO: 1624810 - RNA, 15 nt, Pseudomonas putida KT2440
gcagcuucuucacac

SEQ ID NO: 1624811 - RNA, 18 nt, Pseudomonas putida KT2440
gcagcuucccggccuggc

SEQ ID NO: 1624812 - RNA, 17 nt, Pseudomonas putida KT2440
gcagcuuccaccauucc

SEQ ID NO: 1624813 - RNA, 17 nt, Pseudomonas putida KT2440
gcagcuucagccagggc

SEQ ID NO: 1624814 - RNA, 14 nt, Pseudomonas putida KT2440
gcaggaagcggcgc

SEQ ID NO: 1624815 - RNA, 23 nt, Pseudomonas putida KT2440
gcaggacuacaucuucgcgcucg

SEQ ID NO: 1624816 - RNA, 23 nt, Pseudomonas putida KT2440
gcagcuaaggcugauaagcaaga

SEQ ID NO: 1624817 - RNA, 14 nt, Pseudomonas putida KT2440
gcagcucagccagc

SEQ ID NO: 1624818 - RNA, 14 nt, Pseudomonas putida KT2440
gcagcuaccacccc

SEQ ID NO: 1624819 - RNA, 20 nt, Pseudomonas putida KT2440
gcagcuacgagacgguggcu

SEQ ID NO: 1624820 - RNA, 19 nt, Pseudomonas putida KT2440
gcagcucggugaacagguu

SEQ ID NO: 1624821 - RNA, 19 nt, Pseudomonas putida KT2440
gcagcucggacaaauccag

SEQ ID NO: 1624822 - RNA, 17 nt, Pseudomonas putida KT2440
gcagcucgcgcugcgca

SEQ ID NO: 1624823 - RNA, 22 nt, Pseudomonas putida KT2440
gcagcuccacuggaacucgauc

SEQ ID NO: 1624824 - RNA, 14 nt, Pseudomonas putida KT2440
gcagcuccauacca

SEQ ID NO: 1624825 - RNA, 12 nt, Pseudomonas putida KT2440
gcaggaucuggc

SEQ ID NO: 1624826 - RNA, 13 nt, Pseudomonas putida KT2440
gcaggccgcagcc

SEQ ID NO: 1624827 - RNA, 22 nt, Pseudomonas putida KT2440
gcaggagcgagcaagcucgcuc

SEQ ID NO: 1624828 - RNA, 13 nt, Pseudomonas putida KT2440
gcaggagcaaaca

SEQ ID NO: 1624829 - RNA, 23 nt, Pseudomonas putida KT2440
gcaggauauccacacccgccacg

SEQ ID NO: 1624830 - RNA, 24 nt, Pseudomonas putida KT2440
gcaggauauccacacccgccacgc

SEQ ID NO: 1624831 - RNA, 20 nt, Pseudomonas putida KT2440
gcaggaucuagcccaauaga

SEQ ID NO: 1624832 - RNA, 16 nt, Pseudomonas putida KT2440
gcaggcgcagcugcca

SEQ ID NO: 1624833 - RNA, 19 nt, Pseudomonas putida KT2440
gcaggcgccgccagcugcu

SEQ ID NO: 1624834 - RNA, 20 nt, Pseudomonas putida KT2440
gcaggcgcugcagggcgccg

SEQ ID NO: 1624835 - RNA, 14 nt, Pseudomonas putida KT2440
gcaggcucagggcc

SEQ ID NO: 1624836 - RNA, 21 nt, Pseudomonas putida KT2440
gcaggcggcgacaaccgaaaa

SEQ ID NO: 1624837 - RNA, 16 nt, Pseudomonas putida KT2440
gcaggcgcgagccuug

SEQ ID NO: 1624838 - RNA, 16 nt, Pseudomonas putida KT2440
gcagggcccagccacc

SEQ ID NO: 1624839 - RNA, 12 nt, Pseudomonas putida KT2440
gcagggccgcgc

SEQ ID NO: 1624840 - RNA, 22 nt, Pseudomonas putida KT2440
gcagggccuccauacgcuggug

SEQ ID NO: 1624841 - RNA, 23 nt, Pseudomonas putida KT2440
gcagggccuggacgcgugcaagg

SEQ ID NO: 1624842 - RNA, 15 nt, Pseudomonas putida KT2440
gcaggcuggcaauca

SEQ ID NO: 1624843 - RNA, 21 nt, Pseudomonas putida KT2440
gcaggcuguuguacggcagcu

SEQ ID NO: 1624844 - RNA, 17 nt, Pseudomonas putida KT2440
gcaggcucuccacgucc

SEQ ID NO: 1624845 - RNA, 15 nt, Pseudomonas putida KT2440
gcaggcuccaaagcc

SEQ ID NO: 1624846 - RNA, 14 nt, Pseudomonas putida KT2440
gcaggcugccgcgc

SEQ ID NO: 1624847 - RNA, 21 nt, Pseudomonas putida KT2440
gcagcagcuuccugugccgcu

SEQ ID NO: 1624848 - RNA, 15 nt, Pseudomonas putida KT2440
gcagcaccuccaccu

SEQ ID NO: 1624849 - RNA, 14 nt, Pseudomonas putida KT2440
gcagcaccugccag

SEQ ID NO: 1624850 - RNA, 13 nt, Pseudomonas putida KT2440
gcagcacaggucu

SEQ ID NO: 1624851 - RNA, 17 nt, Pseudomonas putida KT2440
gcagcaccgcuucaccc

SEQ ID NO: 1624852 - RNA, 19 nt, Pseudomonas putida KT2440
gcagcaccgcuucacccuc

SEQ ID NO: 1624853 - RNA, 19 nt, Pseudomonas putida KT2440
gcagcacaaggcugcgccu

SEQ ID NO: 1624854 - RNA, 22 nt, Pseudomonas putida KT2440
gcagcaauacgcacaggcgcag

SEQ ID NO: 1624855 - RNA, 19 nt, Pseudomonas putida KT2440
gcagcaaucgccgccugga

SEQ ID NO: 1624856 - RNA, 14 nt, Pseudomonas putida KT2440
gcagcaagcuggca

SEQ ID NO: 1624857 - RNA, 23 nt, Pseudomonas putida KT2440
gcagaugguggcauagcgcggcg

SEQ ID NO: 1624858 - RNA, 13 nt, Pseudomonas putida KT2440
gcagcaagccugc

SEQ ID NO: 1624859 - RNA, 21 nt, Pseudomonas putida KT2440
gcagauaucuggaccccgccc

SEQ ID NO: 1624860 - RNA, 16 nt, Pseudomonas putida KT2440
gcagaucaggcaauca

SEQ ID NO: 1624861 - RNA, 17 nt, Pseudomonas putida KT2440
gcagaucaggcaaucac

SEQ ID NO: 1624862 - RNA, 16 nt, Pseudomonas putida KT2440
gcagauacaaccccag

SEQ ID NO: 1624863 - RNA, 18 nt, Pseudomonas putida KT2440
gcagauacaaccccagau

SEQ ID NO: 1624864 - RNA, 18 nt, Pseudomonas putida KT2440
gcagaucguuguaggagc

SEQ ID NO: 1624865 - RNA, 14 nt, Pseudomonas putida KT2440
gcagauccugcagc

SEQ ID NO: 1624866 - RNA, 15 nt, Pseudomonas putida KT2440
gcagauccugcagcc

SEQ ID NO: 1624867 - RNA, 19 nt, Pseudomonas putida KT2440
gcagaugcuccaaccccag

SEQ ID NO: 1624868 - RNA, 21 nt, Pseudomonas putida KT2440
gcagaugcuccaaccccagcg

SEQ ID NO: 1624869 - RNA, 16 nt, Pseudomonas putida KT2440
gcagauggggcagacu

SEQ ID NO: 1624870 - RNA, 20 nt, Pseudomonas putida KT2440
gcagccgcccuugagcuuca

SEQ ID NO: 1624871 - RNA, 14 nt, Pseudomonas putida KT2440
gcagccgcccgccc

SEQ ID NO: 1624872 - RNA, 15 nt, Pseudomonas putida KT2440
gcagccgcaccugcc

SEQ ID NO: 1624873 - RNA, 22 nt, Pseudomonas putida KT2440
gcagccgauacggugccaauaa

SEQ ID NO: 1624874 - RNA, 21 nt, Pseudomonas putida KT2440
gcagccuugucucugaacaca

SEQ ID NO: 1624875 - RNA, 16 nt, Pseudomonas putida KT2440
gcagcgaacgccgggg

SEQ ID NO: 1624876 - RNA, 16 nt, Pseudomonas putida KT2440
gcagccguugcugggc

SEQ ID NO: 1624877 - RNA, 17 nt, Pseudomonas putida KT2440
gcagccguugcugggcu

SEQ ID NO: 1624878 - RNA, 20 nt, Pseudomonas putida KT2440
gcagccguugcugggcugcg

SEQ ID NO: 1624879 - RNA, 21 nt, Pseudomonas putida KT2440
gcagccucguccaucuugcug

SEQ ID NO: 1624880 - RNA, 22 nt, Pseudomonas putida KT2440
gcagccaggauuuucagcgcga

SEQ ID NO: 1624881 - RNA, 18 nt, Pseudomonas putida KT2440
gcagccauagccaguagc

SEQ ID NO: 1624882 - RNA, 11 nt, Pseudomonas putida KT2440
gcagccccaaa

SEQ ID NO: 1624883 - RNA, 20 nt, Pseudomonas putida KT2440
gcagccccagccucagcugg

SEQ ID NO: 1624884 - RNA, 17 nt, Pseudomonas putida KT2440
gcagcagguccagcucc

SEQ ID NO: 1624885 - RNA, 20 nt, Pseudomonas putida KT2440
gcagcaggcgcgagccuugc

SEQ ID NO: 1624886 - RNA, 19 nt, Pseudomonas putida KT2440
gcagcagcuugcagcgccg

SEQ ID NO: 1624887 - RNA, 14 nt, Pseudomonas putida KT2440
gcagcaggcccgcc

SEQ ID NO: 1624888 - RNA, 13 nt, Pseudomonas putida KT2440
gcacuucguccag

SEQ ID NO: 1624889 - RNA, 16 nt, Pseudomonas putida KT2440
gcacuucguccagggu

SEQ ID NO: 1624890 - RNA, 16 nt, Pseudomonas putida KT2440
gcacuucuguggaaaa

SEQ ID NO: 1624891 - RNA, 22 nt, Pseudomonas putida KT2440
gcacuucuguggaaaaccgcuc

SEQ ID NO: 1624892 - RNA, 20 nt, Pseudomonas putida KT2440
gcacuuccacuccagccguc

SEQ ID NO: 1624893 - RNA, 15 nt, Pseudomonas putida KT2440
gcacgcgccagcagc

SEQ ID NO: 1624894 - RNA, 23 nt, Pseudomonas putida KT2440
gcacuuguuccagccgcgccacu

SEQ ID NO: 1624895 - RNA, 21 nt, Pseudomonas putida KT2440
gcagaacggcuucgauguccu

SEQ ID NO: 1624896 - RNA, 19 nt, Pseudomonas putida KT2440
gcagaacguacuggccgcu

SEQ ID NO: 1624897 - RNA, 21 nt, Pseudomonas putida KT2440
gcagaagccuucaucacgcac

SEQ ID NO: 1624898 - RNA, 19 nt, Pseudomonas putida KT2440
gcagaagcgugcgaaguug

SEQ ID NO: 1624899 - RNA, 16 nt, Pseudomonas putida KT2440
gcagaaccgccagcac

SEQ ID NO: 1624900 - RNA, 22 nt, Pseudomonas putida KT2440
gcagaaccgccagcaccaauga

SEQ ID NO: 1624901 - RNA, 18 nt, Pseudomonas putida KT2440
gcacuuuugccaccaccc

SEQ ID NO: 1624902 - RNA, 23 nt, Pseudomonas putida KT2440
gcagagcggccccaagcuucacc

SEQ ID NO: 1624903 - RNA, 21 nt, Pseudomonas putida KT2440
gcagagcggcccugagccuug

SEQ ID NO: 1624904 - RNA, 16 nt, Pseudomonas putida KT2440
gcagagcgcccaccaa

SEQ ID NO: 1624905 - RNA, 20 nt, Pseudomonas putida KT2440
gcagaggcguagcaagcaga

SEQ ID NO: 1624906 - RNA, 18 nt, Pseudomonas putida KT2440
gcagagggccgcgcaggc

SEQ ID NO: 1624907 - RNA, 14 nt, Pseudomonas putida KT2440
gcagacugggugau

SEQ ID NO: 1624908 - RNA, 15 nt, Pseudomonas putida KT2440
gcagagagauugaga

SEQ ID NO: 1624909 - RNA, 15 nt, Pseudomonas putida KT2440
gcagagacaucucca

SEQ ID NO: 1624910 - RNA, 21 nt, Pseudomonas putida KT2440
gcagaccugugggagcgggca

SEQ ID NO: 1624911 - RNA, 22 nt, Pseudomonas putida KT2440
gcagaccugugggagcgggcau

SEQ ID NO: 1624912 - RNA, 13 nt, Pseudomonas putida KT2440
gcagacgaucagg

SEQ ID NO: 1624913 - RNA, 12 nt, Pseudomonas putida KT2440
gcagacccagaa

SEQ ID NO: 1624914 - RNA, 14 nt, Pseudomonas putida KT2440
gcagaccagccggg

SEQ ID NO: 1624915 - RNA, 15 nt, Pseudomonas putida KT2440
gcagaccagccgggc

SEQ ID NO: 1624916 - RNA, 13 nt, Pseudomonas putida KT2440
gcagaauuucagg

SEQ ID NO: 1624917 - RNA, 19 nt, Pseudomonas putida KT2440
gagugguaaugaaagucca

SEQ ID NO: 1624918 - RNA, 20 nt, Pseudomonas putida KT2440
gagugucaguuuuuuugugu

SEQ ID NO: 1624919 - RNA, 22 nt, Pseudomonas putida KT2440
gaguugccuucgaucggcgcgc

SEQ ID NO: 1624920 - RNA, 20 nt, Pseudomonas putida KT2440
gaguugcguggggccugccg

SEQ ID NO: 1624921 - RNA, 16 nt, Pseudomonas putida KT2440
gaguugaguggggugg

SEQ ID NO: 1624922 - RNA, 21 nt, Pseudomonas putida KT2440
gaguccuccaacucgcgcauc

SEQ ID NO: 1624923 - RNA, 17 nt, Pseudomonas putida KT2440
gaguccugcgcgcuuga

SEQ ID NO: 1624924 - RNA, 15 nt, Pseudomonas putida KT2440
gagucgacagugacc

SEQ ID NO: 1624925 - RNA, 17 nt, Pseudomonas putida KT2440
gauaaagagaagcugca

SEQ ID NO: 1624926 - RNA, 22 nt, Pseudomonas putida KT2440
gauaaagagaagcugcagcuuc

SEQ ID NO: 1624927 - RNA, 19 nt, Pseudomonas putida KT2440
gauaaacgcgauaucccaa

SEQ ID NO: 1624928 - RNA, 17 nt, Pseudomonas putida KT2440
gauaagaucacugcgca

SEQ ID NO: 1624929 - RNA, 15 nt, Pseudomonas putida KT2440
gaguaaaaagagccc

SEQ ID NO: 1624930 - RNA, 16 nt, Pseudomonas putida KT2440
gaguaaagccagcagc

SEQ ID NO: 1624931 - RNA, 18 nt, Pseudomonas putida KT2440
gaggucggcgcguggggu

SEQ ID NO: 1624932 - RNA, 23 nt, Pseudomonas putida KT2440
gaggucggcucgucgaacagcau

SEQ ID NO: 1624933 - RNA, 19 nt, Pseudomonas putida KT2440
gagguaggccgucagcagc

SEQ ID NO: 1624934 - RNA, 18 nt, Pseudomonas putida KT2440
gagguggucgaggcaaag

SEQ ID NO: 1624935 - RNA, 21 nt, Pseudomonas putida KT2440
gaggugcaggguaggggugga

SEQ ID NO: 1624936 - RNA, 19 nt, Pseudomonas putida KT2440
gaggcucuugaggucggcg

SEQ ID NO: 1624937 - RNA, 16 nt, Pseudomonas putida KT2440
gaggcuugaaucccug

SEQ ID NO: 1624938 - RNA, 20 nt, Pseudomonas putida KT2440
gagggcuucuucuucaagca

SEQ ID NO: 1624939 - RNA, 12 nt, Pseudomonas putida KT2440
gaggggcggcgu

SEQ ID NO: 1624940 - RNA, 17 nt, Pseudomonas putida KT2440
gaggggacgaucugcag

SEQ ID NO: 1624941 - RNA, 14 nt, Pseudomonas putida KT2440
gagggucggcgggc

SEQ ID NO: 1624942 - RNA, 15 nt, Pseudomonas putida KT2440
gagggucgugagccu

SEQ ID NO: 1624943 - RNA, 22 nt, Pseudomonas putida KT2440
gagguacgagucagcgugccag

SEQ ID NO: 1624944 - RNA, 22 nt, Pseudomonas putida KT2440
gagguagaucacaccggccgcc

SEQ ID NO: 1624945 - RNA, 15 nt, Pseudomonas putida KT2440
gauagccagggccug

SEQ ID NO: 1624946 - RNA, 12 nt, Pseudomonas putida KT2440
gauacucacccg

SEQ ID NO: 1624947 - RNA, 18 nt, Pseudomonas putida KT2440
gauacucacccgcuugcc

SEQ ID NO: 1624948 - RNA, 20 nt, Pseudomonas putida KT2440
gauacucacccgcuugccac

SEQ ID NO: 1624949 - RNA, 16 nt, Pseudomonas putida KT2440
gauacggugccaauaa

SEQ ID NO: 1624950 - RNA, 14 nt, Pseudomonas putida KT2440
gauaccgcccaggu

SEQ ID NO: 1624951 - RNA, 19 nt, Pseudomonas putida KT2440
gauaagucauggcuauucu

SEQ ID NO: 1624952 - RNA, 22 nt, Pseudomonas putida KT2440
gauaccgggauucgacuaucag

SEQ ID NO: 1624953 - RNA, 16 nt, Pseudomonas putida KT2440
gauaccggcgccgccc

SEQ ID NO: 1624954 - RNA, 15 nt, Pseudomonas putida KT2440
gauaguccagcaacu

SEQ ID NO: 1624955 - RNA, 16 nt, Pseudomonas putida KT2440
gauagccuguggggca

SEQ ID NO: 1624956 - RNA, 22 nt, Pseudomonas putida KT2440
gauagccuguggggcaacugcg

SEQ ID NO: 1624957 - RNA, 17 nt, Pseudomonas putida KT2440
gauagggaacagggcag

SEQ ID NO: 1624958 - RNA, 12 nt, Pseudomonas putida KT2440
gauaggcauuga

SEQ ID NO: 1624959 - RNA, 19 nt, Pseudomonas putida KT2440
gaucagcacgcccaucagc

SEQ ID NO: 1624960 - RNA, 22 nt, Pseudomonas putida KT2440
gaucagcacgcccaucagcgcc

SEQ ID NO: 1624961 - RNA, 11 nt, Pseudomonas putida KT2440
gaucagcagca

SEQ ID NO: 1624962 - RNA, 22 nt, Pseudomonas putida KT2440
gaucagugucugcgccugcugg

SEQ ID NO: 1624963 - RNA, 15 nt, Pseudomonas putida KT2440
gaucagcaaccugcu

SEQ ID NO: 1624964 - RNA, 18 nt, Pseudomonas putida KT2440
gaucaguuccgcguccuu

SEQ ID NO: 1624965 - RNA, 20 nt, Pseudomonas putida KT2440
gaucaguuccgcguccuuga

SEQ ID NO: 1624966 - RNA, 18 nt, Pseudomonas putida KT2440
gaucacgcaggcccagca

SEQ ID NO: 1624967 - RNA, 13 nt, Pseudomonas putida KT2440
gaucaccuggccg

SEQ ID NO: 1624968 - RNA, 18 nt, Pseudomonas putida KT2440
gaucacgggcaggccccu

SEQ ID NO: 1624969 - RNA, 15 nt, Pseudomonas putida KT2440
gaucacgucacccag

SEQ ID NO: 1624970 - RNA, 16 nt, Pseudomonas putida KT2440
gaucacgucggccugc

SEQ ID NO: 1624971 - RNA, 18 nt, Pseudomonas putida KT2440
gaucacuacaugcggccc

SEQ ID NO: 1624972 - RNA, 14 nt, Pseudomonas putida KT2440
gaucacucggcagg

SEQ ID NO: 1624973 - RNA, 20 nt, Pseudomonas putida KT2440
gaucacuguugucggccaga

SEQ ID NO: 1624974 - RNA, 20 nt, Pseudomonas putida KT2440
gaucacugccagcaccuggc

SEQ ID NO: 1624975 - RNA, 18 nt, Pseudomonas putida KT2440
gaucagacuuugcggacg

SEQ ID NO: 1624976 - RNA, 18 nt, Pseudomonas putida KT2440
gaucacuuccaccugcgc

SEQ ID NO: 1624977 - RNA, 19 nt, Pseudomonas putida KT2440
gaucacuuccaccugcgcc

SEQ ID NO: 1624978 - RNA, 23 nt, Pseudomonas putida KT2440
gaucaucuccaugaaggccggca

SEQ ID NO: 1624979 - RNA, 16 nt, Pseudomonas putida KT2440
gaucaugcccauggcc

SEQ ID NO: 1624980 - RNA, 15 nt, Pseudomonas putida KT2440
gaucaugccgacggu

SEQ ID NO: 1624981 - RNA, 16 nt, Pseudomonas putida KT2440
gaucaugaacgaggac

SEQ ID NO: 1624982 - RNA, 19 nt, Pseudomonas putida KT2440
gaucaugaacgaggacugc

SEQ ID NO: 1624983 - RNA, 14 nt, Pseudomonas putida KT2440
gaucauccccagca

SEQ ID NO: 1624984 - RNA, 17 nt, Pseudomonas putida KT2440
gaucaucaucggcaugc

SEQ ID NO: 1624985 - RNA, 13 nt, Pseudomonas putida KT2440
gaucaucagcgcc

SEQ ID NO: 1624986 - RNA, 18 nt, Pseudomonas putida KT2440
gaucauccacaaucagca

SEQ ID NO: 1624987 - RNA, 16 nt, Pseudomonas putida KT2440
gauccagucagacucc

SEQ ID NO: 1624988 - RNA, 14 nt, Pseudomonas putida KT2440
gauccaucuucacc

SEQ ID NO: 1624989 - RNA, 15 nt, Pseudomonas putida KT2440
gauccaucuucaccu

SEQ ID NO: 1624990 - RNA, 13 nt, Pseudomonas putida KT2440
gaucaaugggccg

SEQ ID NO: 1624991 - RNA, 18 nt, Pseudomonas putida KT2440
gaucacacccucugccau

SEQ ID NO: 1624992 - RNA, 14 nt, Pseudomonas putida KT2440
gaucacaccggcaa

SEQ ID NO: 1624993 - RNA, 15 nt, Pseudomonas putida KT2440
gaucacaccggccgc

SEQ ID NO: 1624994 - RNA, 20 nt, Pseudomonas putida KT2440
gaucacauaaggcagcagcu

SEQ ID NO: 1624995 - RNA, 19 nt, Pseudomonas putida KT2440
gaucaagcuguacaacgca

SEQ ID NO: 1624996 - RNA, 21 nt, Pseudomonas putida KT2440
gaucaagcuguacaacgcagc

SEQ ID NO: 1624997 - RNA, 21 nt, Pseudomonas putida KT2440
gaucaauacacccacaccucg

SEQ ID NO: 1624998 - RNA, 17 nt, Pseudomonas putida KT2440
gaucaccagcaccccga

SEQ ID NO: 1624999 - RNA, 17 nt, Pseudomonas putida KT2440
gaucaccgacaagauaa

SEQ ID NO: 1625000 - RNA, 22 nt, Pseudomonas putida KT2440
gaucaccgacaagauaacaccc

SEQ ID NO: 1625001 - RNA, 15 nt, Pseudomonas putida KT2440
gaucaccugcggccu

SEQ ID NO: 1625002 - RNA, 16 nt, Pseudomonas putida KT2440
gaucaccugcggccug

SEQ ID NO: 1625003 - RNA, 17 nt, Pseudomonas putida KT2440
gaucaccgcaagcugca

SEQ ID NO: 1625004 - RNA, 13 nt, Pseudomonas putida KT2440
gaucaccgccagc

SEQ ID NO: 1625005 - RNA, 17 nt, Pseudomonas putida KT2440
gaucaccgccagcagcu

SEQ ID NO: 1625006 - RNA, 16 nt, Pseudomonas putida KT2440
gaucugcugcagcaug

SEQ ID NO: 1625007 - RNA, 15 nt, Pseudomonas putida KT2440
gaucugcucuucgcc

SEQ ID NO: 1625008 - RNA, 19 nt, Pseudomonas putida KT2440
gaucugcucgcccaccgac

SEQ ID NO: 1625009 - RNA, 17 nt, Pseudomonas putida KT2440
gaucuguugcugcaggu

SEQ ID NO: 1625010 - RNA, 17 nt, Pseudomonas putida KT2440
gaucuucccgggaaaag

SEQ ID NO: 1625011 - RNA, 17 nt, Pseudomonas putida KT2440
gaucuugcgccccagca

SEQ ID NO: 1625012 - RNA, 18 nt, Pseudomonas putida KT2440
gaucuuggccagggccuu

SEQ ID NO: 1625013 - RNA, 16 nt, Pseudomonas putida KT2440
gaucuuuacuuucuac

SEQ ID NO: 1625014 - RNA, 13 nt, Pseudomonas putida KT2440
gaugaacgacagg

SEQ ID NO: 1625015 - RNA, 18 nt, Pseudomonas putida KT2440
gaucguugcgcgccaggg

SEQ ID NO: 1625016 - RNA, 17 nt, Pseudomonas putida KT2440
gaucccacggccgcgca

SEQ ID NO: 1625017 - RNA, 20 nt, Pseudomonas putida KT2440
gaucccacggccgcgcaggg

SEQ ID NO: 1625018 - RNA, 15 nt, Pseudomonas putida KT2440
gauccccaccagcau

SEQ ID NO: 1625019 - RNA, 16 nt, Pseudomonas putida KT2440
gaucuccccaccauca

SEQ ID NO: 1625020 - RNA, 16 nt, Pseudomonas putida KT2440
gaucucgaagcugcca

SEQ ID NO: 1625021 - RNA, 19 nt, Pseudomonas putida KT2440
gaucuccucggccagcggc

SEQ ID NO: 1625022 - RNA, 13 nt, Pseudomonas putida KT2440
gaucucgccagcc

SEQ ID NO: 1625023 - RNA, 19 nt, Pseudomonas putida KT2440
gaucucgccagccugcagc

SEQ ID NO: 1625024 - RNA, 21 nt, Pseudomonas putida KT2440
gaucucgcugucguccagcuc

SEQ ID NO: 1625025 - RNA, 21 nt, Pseudomonas putida KT2440
gaucucgcuucauggccccac

SEQ ID NO: 1625026 - RNA, 17 nt, Pseudomonas putida KT2440
gaucucggccagcaggc

SEQ ID NO: 1625027 - RNA, 20 nt, Pseudomonas putida KT2440
gaucucguccagggcauugc

SEQ ID NO: 1625028 - RNA, 20 nt, Pseudomonas putida KT2440
gaucucuucggccaguuuca

SEQ ID NO: 1625029 - RNA, 13 nt, Pseudomonas putida KT2440
gaucugccaggca

SEQ ID NO: 1625030 - RNA, 19 nt, Pseudomonas putida KT2440
gaugacccuuccagcccgc

SEQ ID NO: 1625031 - RNA, 18 nt, Pseudomonas putida KT2440
gaugaacuugcgcucaag

SEQ ID NO: 1625032 - RNA, 19 nt, Pseudomonas putida KT2440
gaugaacuugcgcucaagc

SEQ ID NO: 1625033 - RNA, 16 nt, Pseudomonas putida KT2440
gaugaacuggaugauc

SEQ ID NO: 1625034 - RNA, 22 nt, Pseudomonas putida KT2440
gaugaacuggaugauccagccc

SEQ ID NO: 1625035 - RNA, 21 nt, Pseudomonas putida KT2440
gaugaagacgcucgacagcaa

SEQ ID NO: 1625036 - RNA, 24 nt, Pseudomonas putida KT2440
gaugaagacgcucgacagcaacuu

SEQ ID NO: 1625037 - RNA, 16 nt, Pseudomonas putida KT2440
gaugaggcgaugcagg

SEQ ID NO: 1625038 - RNA, 14 nt, Pseudomonas putida KT2440
gaugagggaaggcu

SEQ ID NO: 1625039 - RNA, 14 nt, Pseudomonas putida KT2440
gaugaguaaagccg

SEQ ID NO: 1625040 - RNA, 14 nt, Pseudomonas putida KT2440
gaugaggaacugcu

SEQ ID NO: 1625041 - RNA, 17 nt, Pseudomonas putida KT2440
gaugacgaacucgucac

SEQ ID NO: 1625042 - RNA, 14 nt, Pseudomonas putida KT2440
gaugcagauggggg

SEQ ID NO: 1625043 - RNA, 21 nt, Pseudomonas putida KT2440
gaugcagauggggggauuuga

SEQ ID NO: 1625044 - RNA, 13 nt, Pseudomonas putida KT2440
gaugcagcagugc

SEQ ID NO: 1625045 - RNA, 15 nt, Pseudomonas putida KT2440
gaugcagcagugcca

SEQ ID NO: 1625046 - RNA, 21 nt, Pseudomonas putida KT2440
gaugcagcagugccagcaaca

SEQ ID NO: 1625047 - RNA, 17 nt, Pseudomonas putida KT2440
gaugcacgccagcauca

SEQ ID NO: 1625048 - RNA, 20 nt, Pseudomonas putida KT2440
gaugcacgccagcaucaccc

SEQ ID NO: 1625049 - RNA, 17 nt, Pseudomonas putida KT2440
gauggccaccagcaccu

SEQ ID NO: 1625050 - RNA, 14 nt, Pseudomonas putida KT2440
gaugcucugcagca

SEQ ID NO: 1625051 - RNA, 20 nt, Pseudomonas putida KT2440
gaugcugaagcucuccagca

SEQ ID NO: 1625052 - RNA, 21 nt, Pseudomonas putida KT2440
gaugcccaaacgccaacagca

SEQ ID NO: 1625053 - RNA, 15 nt, Pseudomonas putida KT2440
gaugcccauggggau

SEQ ID NO: 1625054 - RNA, 19 nt, Pseudomonas putida KT2440
gaugccguaguaagccagc

SEQ ID NO: 1625055 - RNA, 20 nt, Pseudomonas putida KT2440
gaugccguaguaagccagcc

SEQ ID NO: 1625056 - RNA, 18 nt, Pseudomonas putida KT2440
gaugcccgaucggguacu

SEQ ID NO: 1625057 - RNA, 13 nt, Pseudomonas putida KT2440
gaugcccgcagua

SEQ ID NO: 1625058 - RNA, 15 nt, Pseudomonas putida KT2440
gaugcggacccagcg

SEQ ID NO: 1625059 - RNA, 13 nt, Pseudomonas putida KT2440
gaugcgccgcgcg

SEQ ID NO: 1625060 - RNA, 13 nt, Pseudomonas putida KT2440
gauucgccucccg

SEQ ID NO: 1625061 - RNA, 13 nt, Pseudomonas putida KT2440
gauucggggauga

SEQ ID NO: 1625062 - RNA, 18 nt, Pseudomonas putida KT2440
gauuggccagcagggccg

SEQ ID NO: 1625063 - RNA, 14 nt, Pseudomonas putida KT2440
gauugggaaaacac

SEQ ID NO: 1625064 - RNA, 17 nt, Pseudomonas putida KT2440
gauugcccuguggcugu

SEQ ID NO: 1625065 - RNA, 19 nt, Pseudomonas putida KT2440
gauuuccaccggcuugccc

SEQ ID NO: 1625066 - RNA, 23 nt, Pseudomonas putida KT2440
gauuucgaagggauguuggaaua

SEQ ID NO: 1625067 - RNA, 15 nt, Pseudomonas putida KT2440
gcaaaaaacuucaaa

SEQ ID NO: 1625068 - RNA, 19 nt, Pseudomonas putida KT2440
gcaaaaccaccagccgugg

SEQ ID NO: 1625069 - RNA, 18 nt, Pseudomonas putida KT2440
gauuuggggcgcccggca

SEQ ID NO: 1625070 - RNA, 16 nt, Pseudomonas putida KT2440
gauuccuugcagcgcc

SEQ ID NO: 1625071 - RNA, 19 nt, Pseudomonas putida KT2440
gauuccagcaggggacgca

SEQ ID NO: 1625072 - RNA, 16 nt, Pseudomonas putida KT2440
gauucagcacgcuggc

SEQ ID NO: 1625073 - RNA, 20 nt, Pseudomonas putida KT2440
gauucagcacaccgcucaac

SEQ ID NO: 1625074 - RNA, 16 nt, Pseudomonas putida KT2440
gauucacggaucagcc

SEQ ID NO: 1625075 - RNA, 12 nt, Pseudomonas putida KT2440
gauucaagcccg

SEQ ID NO: 1625076 - RNA, 18 nt, Pseudomonas putida KT2440
gauggcugaaaucuuugc

SEQ ID NO: 1625077 - RNA, 14 nt, Pseudomonas putida KT2440
gauggcucaucgcc

SEQ ID NO: 1625078 - RNA, 16 nt, Pseudomonas putida KT2440
gaugucuuccagacca

SEQ ID NO: 1625079 - RNA, 12 nt, Pseudomonas putida KT2440
gauguggcuggu

SEQ ID NO: 1625080 - RNA, 19 nt, Pseudomonas putida KT2440
gauuacaagggccugugcc

SEQ ID NO: 1625081 - RNA, 13 nt, Pseudomonas putida KT2440
gauuagacccaga

SEQ ID NO: 1625082 - RNA, 14 nt, Pseudomonas putida KT2440
gauguuggccacga

SEQ ID NO: 1625083 - RNA, 17 nt, Pseudomonas putida KT2440
gauguugcggcgguggc

SEQ ID NO: 1625084 - RNA, 15 nt, Pseudomonas putida KT2440
gauguguuggccgga

SEQ ID NO: 1625085 - RNA, 14 nt, Pseudomonas putida KT2440
gagccggucacgau

SEQ ID NO: 1625086 - RNA, 12 nt, Pseudomonas putida KT2440
gagccggcuggc

SEQ ID NO: 1625087 - RNA, 14 nt, Pseudomonas putida KT2440
gagccggcgcuggg

SEQ ID NO: 1625088 - RNA, 13 nt, Pseudomonas putida KT2440
gagccgccaaccc

SEQ ID NO: 1625089 - RNA, 12 nt, Pseudomonas putida KT2440
gagccgccagac

SEQ ID NO: 1625090 - RNA, 16 nt, Pseudomonas putida KT2440
gagccgaucaggaagc

SEQ ID NO: 1625091 - RNA, 16 nt, Pseudomonas putida KT2440
gagccgaacagcaggc

SEQ ID NO: 1625092 - RNA, 17 nt, Pseudomonas putida KT2440
gagccgaacagcaggca

SEQ ID NO: 1625093 - RNA, 18 nt, Pseudomonas putida KT2440
gagcccggguugaccuug

SEQ ID NO: 1625094 - RNA, 17 nt, Pseudomonas putida KT2440
gagcccggcgcagccgu

SEQ ID NO: 1625095 - RNA, 16 nt, Pseudomonas putida KT2440
gagccccaccaggaag

SEQ ID NO: 1625096 - RNA, 13 nt, Pseudomonas putida KT2440
gagcccgccagca

SEQ ID NO: 1625097 - RNA, 16 nt, Pseudomonas putida KT2440
gagcccgccagcaggc

SEQ ID NO: 1625098 - RNA, 21 nt, Pseudomonas putida KT2440
gagcccgccagcaggccaccg

SEQ ID NO: 1625099 - RNA, 23 nt, Pseudomonas putida KT2440
gagcccgcucggucagggcggca

SEQ ID NO: 1625100 - RNA, 14 nt, Pseudomonas putida KT2440
gagcccccagcaca

SEQ ID NO: 1625101 - RNA, 15 nt, Pseudomonas putida KT2440
gagccagccagguug

SEQ ID NO: 1625102 - RNA, 16 nt, Pseudomonas putida KT2440
gagccagacauugaag

SEQ ID NO: 1625103 - RNA, 18 nt, Pseudomonas putida KT2440
gagccagaucauggcggu

SEQ ID NO: 1625104 - RNA, 19 nt, Pseudomonas putida KT2440
gagccaggagaacacccag

SEQ ID NO: 1625105 - RNA, 23 nt, Pseudomonas putida KT2440
gagccaggcguauucggccacca

SEQ ID NO: 1625106 - RNA, 14 nt, Pseudomonas putida KT2440
gagccagggcgcug

SEQ ID NO: 1625107 - RNA, 18 nt, Pseudomonas putida KT2440
gagcaucuuccagccugc

SEQ ID NO: 1625108 - RNA, 14 nt, Pseudomonas putida KT2440
gagcaucugcugcg

SEQ ID NO: 1625109 - RNA, 21 nt, Pseudomonas putida KT2440
gagcaucugcugcggcaggcu

SEQ ID NO: 1625110 - RNA, 23 nt, Pseudomonas putida KT2440
gagcaucccccuccuaaggggaa

SEQ ID NO: 1625111 - RNA, 16 nt, Pseudomonas putida KT2440
gagcauggccagccgg

SEQ ID NO: 1625112 - RNA, 17 nt, Pseudomonas putida KT2440
gagcauggccagccggc

SEQ ID NO: 1625113 - RNA, 22 nt, Pseudomonas putida KT2440
gagcauggccagccggcagcaa

SEQ ID NO: 1625114 - RNA, 15 nt, Pseudomonas putida KT2440
gagcauuacaggcag

SEQ ID NO: 1625115 - RNA, 17 nt, Pseudomonas putida KT2440
gagcauggucaugccau

SEQ ID NO: 1625116 - RNA, 13 nt, Pseudomonas putida KT2440
gagccaauuucaa

SEQ ID NO: 1625117 - RNA, 21 nt, Pseudomonas putida KT2440
gagccaaggccgcccaguuca

SEQ ID NO: 1625118 - RNA, 18 nt, Pseudomonas putida KT2440
gagcaggucgaacagccc

SEQ ID NO: 1625119 - RNA, 17 nt, Pseudomonas putida KT2440
gagcagguucaggcgca

SEQ ID NO: 1625120 - RNA, 20 nt, Pseudomonas putida KT2440
gagcaguucauccggcggca

SEQ ID NO: 1625121 - RNA, 17 nt, Pseudomonas putida KT2440
gagcagggcugcgcgcc

SEQ ID NO: 1625122 - RNA, 18 nt, Pseudomonas putida KT2440
gagcagggcugcgcgccc

SEQ ID NO: 1625123 - RNA, 22 nt, Pseudomonas putida KT2440
gagcagggcugcgcgcccaggg

SEQ ID NO: 1625124 - RNA, 22 nt, Pseudomonas putida KT2440
gagcaggcgcucgggggugcac

SEQ ID NO: 1625125 - RNA, 19 nt, Pseudomonas putida KT2440
gagcagcuuauugcgcagg

SEQ ID NO: 1625126 - RNA, 20 nt, Pseudomonas putida KT2440
gagcagcuuauugcgcaggg

SEQ ID NO: 1625127 - RNA, 23 nt, Pseudomonas putida KT2440
gagcagcuuauugcgcagggugg

SEQ ID NO: 1625128 - RNA, 14 nt, Pseudomonas putida KT2440
gagcagcuggguga

SEQ ID NO: 1625129 - RNA, 13 nt, Pseudomonas putida KT2440
gagcaggcccgcc

SEQ ID NO: 1625130 - RNA, 23 nt, Pseudomonas putida KT2440
gagaucugcaggggugggaugcc

SEQ ID NO: 1625131 - RNA, 19 nt, Pseudomonas putida KT2440
gagauguaguccacccccg

SEQ ID NO: 1625132 - RNA, 17 nt, Pseudomonas putida KT2440
gagauuccgggcugcug

SEQ ID NO: 1625133 - RNA, 13 nt, Pseudomonas putida KT2440
gagauuggccagc

SEQ ID NO: 1625134 - RNA, 18 nt, Pseudomonas putida KT2440
gagauuggccagcagggc

SEQ ID NO: 1625135 - RNA, 17 nt, Pseudomonas putida KT2440
gagaucagcaaccugcu

SEQ ID NO: 1625136 - RNA, 16 nt, Pseudomonas putida KT2440
gagaguccugcgcgcu

SEQ ID NO: 1625137 - RNA, 21 nt, Pseudomonas putida KT2440
gagcaagacacgagcggccuu

SEQ ID NO: 1625138 - RNA, 12 nt, Pseudomonas putida KT2440
gagcaaaaccgu

SEQ ID NO: 1625139 - RNA, 13 nt, Pseudomonas putida KT2440
gagcaaagcccgc

SEQ ID NO: 1625140 - RNA, 18 nt, Pseudomonas putida KT2440
gagcaauacauccaggcc

SEQ ID NO: 1625141 - RNA, 20 nt, Pseudomonas putida KT2440
gagcaauacauccaggcccg

SEQ ID NO: 1625142 - RNA, 15 nt, Pseudomonas putida KT2440
gagcagcagcccuuc

SEQ ID NO: 1625143 - RNA, 22 nt, Pseudomonas putida KT2440
gagcacuuccuugaccauuucc

SEQ ID NO: 1625144 - RNA, 16 nt, Pseudomonas putida KT2440
gagcaccggcaguaca

SEQ ID NO: 1625145 - RNA, 17 nt, Pseudomonas putida KT2440
gagcacgaaacugcgcu

SEQ ID NO: 1625146 - RNA, 18 nt, Pseudomonas putida KT2440
gagcuuggacaggcccca

SEQ ID NO: 1625147 - RNA, 14 nt, Pseudomonas putida KT2440
gaggaggccgggga

SEQ ID NO: 1625148 - RNA, 15 nt, Pseudomonas putida KT2440
gaggacauaccacac

SEQ ID NO: 1625149 - RNA, 14 nt, Pseudomonas putida KT2440
gagcugggcacggc

SEQ ID NO: 1625150 - RNA, 17 nt, Pseudomonas putida KT2440
gagcuguuucaugcugc

SEQ ID NO: 1625151 - RNA, 14 nt, Pseudomonas putida KT2440
gagcuuguacacgc

SEQ ID NO: 1625152 - RNA, 16 nt, Pseudomonas putida KT2440
gaggauauaagccgcc

SEQ ID NO: 1625153 - RNA, 15 nt, Pseudomonas putida KT2440
gaggaggcuggggau

SEQ ID NO: 1625154 - RNA, 13 nt, Pseudomonas putida KT2440
gaggaguccagcu

SEQ ID NO: 1625155 - RNA, 20 nt, Pseudomonas putida KT2440
gaggauugggaaaacacagg

SEQ ID NO: 1625156 - RNA, 17 nt, Pseudomonas putida KT2440
gaggaugcugaagcucu

SEQ ID NO: 1625157 - RNA, 23 nt, Pseudomonas putida KT2440
gaggaugcugaagcucuccagca

SEQ ID NO: 1625158 - RNA, 14 nt, Pseudomonas putida KT2440
gaggccggcacagg

SEQ ID NO: 1625159 - RNA, 14 nt, Pseudomonas putida KT2440
gaggccggcacugg

SEQ ID NO: 1625160 - RNA, 15 nt, Pseudomonas putida KT2440
gaggccggggaugcg

SEQ ID NO: 1625161 - RNA, 21 nt, Pseudomonas putida KT2440
gaggccgguaggucuaaccgc

SEQ ID NO: 1625162 - RNA, 17 nt, Pseudomonas putida KT2440
gaggccgaacaccgcca

SEQ ID NO: 1625163 - RNA, 20 nt, Pseudomonas putida KT2440
gaggccgaacaccgccagcc

SEQ ID NO: 1625164 - RNA, 17 nt, Pseudomonas putida KT2440
gaggccagcgggaaguu

SEQ ID NO: 1625165 - RNA, 16 nt, Pseudomonas putida KT2440
gaggccaguaccagca

SEQ ID NO: 1625166 - RNA, 18 nt, Pseudomonas putida KT2440
gaggccaguaccagcagc

SEQ ID NO: 1625167 - RNA, 15 nt, Pseudomonas putida KT2440
gaggccccgacagca

SEQ ID NO: 1625168 - RNA, 13 nt, Pseudomonas putida KT2440
gaggccaugugcu

SEQ ID NO: 1625169 - RNA, 17 nt, Pseudomonas putida KT2440
gaggcauccacacccug

SEQ ID NO: 1625170 - RNA, 19 nt, Pseudomonas putida KT2440
gagcgcuuucagccguuca

SEQ ID NO: 1625171 - RNA, 20 nt, Pseudomonas putida KT2440
gagcgccugauuacccugcg

SEQ ID NO: 1625172 - RNA, 23 nt, Pseudomonas putida KT2440
gagcgccugauuacccugcgcca

SEQ ID NO: 1625173 - RNA, 14 nt, Pseudomonas putida KT2440
gagcgcgccgccuu

SEQ ID NO: 1625174 - RNA, 13 nt, Pseudomonas putida KT2440
gagcgccgcccgc

SEQ ID NO: 1625175 - RNA, 11 nt, Pseudomonas putida KT2440
gagcgccgcgc

SEQ ID NO: 1625176 - RNA, 12 nt, Pseudomonas putida KT2440
gagcgccagcau

SEQ ID NO: 1625177 - RNA, 12 nt, Pseudomonas putida KT2440
gagcgccagcaa

SEQ ID NO: 1625178 - RNA, 22 nt, Pseudomonas putida KT2440
gagccuugccaacggcacucga

SEQ ID NO: 1625179 - RNA, 17 nt, Pseudomonas putida KT2440
gagccugcagggccucc

SEQ ID NO: 1625180 - RNA, 17 nt, Pseudomonas putida KT2440
gagcgggacugcccgcc

SEQ ID NO: 1625181 - RNA, 17 nt, Pseudomonas putida KT2440
gagcgggugccgcagca

SEQ ID NO: 1625182 - RNA, 14 nt, Pseudomonas putida KT2440
gagcggccuucagg

SEQ ID NO: 1625183 - RNA, 23 nt, Pseudomonas putida KT2440
gagcgguugcacggcccccgcgg

SEQ ID NO: 1625184 - RNA, 20 nt, Pseudomonas putida KT2440
gagcgucaaccaggcgcagc

SEQ ID NO: 1625185 - RNA, 18 nt, Pseudomonas putida KT2440
gagcgugaagcggacagc

SEQ ID NO: 1625186 - RNA, 22 nt, Pseudomonas putida KT2440
gagcuaaaccgcgaugcugcaa

SEQ ID NO: 1625187 - RNA, 14 nt, Pseudomonas putida KT2440
gagcguggcaaacc

SEQ ID NO: 1625188 - RNA, 14 nt, Pseudomonas putida KT2440
gagcuacagccccu

SEQ ID NO: 1625189 - RNA, 15 nt, Pseudomonas putida KT2440
gagcuacagccccuu

SEQ ID NO: 1625190 - RNA, 11 nt, Pseudomonas putida KT2440
gagcuccccuc

SEQ ID NO: 1625191 - RNA, 21 nt, Pseudomonas putida KT2440
gagcuccccucagacagagcu

SEQ ID NO: 1625192 - RNA, 22 nt, Pseudomonas putida KT2440
gagcugaaacugaucagcuucg

SEQ ID NO: 1625193 - RNA, 16 nt, Pseudomonas putida KT2440
gacgggcugcucccgc

SEQ ID NO: 1625194 - RNA, 22 nt, Pseudomonas putida KT2440
gacgggugaccaggcccagcag

SEQ ID NO: 1625195 - RNA, 15 nt, Pseudomonas putida KT2440
gacgggcauggugga

SEQ ID NO: 1625196 - RNA, 15 nt, Pseudomonas putida KT2440
gacgguugacagcac

SEQ ID NO: 1625197 - RNA, 17 nt, Pseudomonas putida KT2440
gacgguuacgugcaggc

SEQ ID NO: 1625198 - RNA, 16 nt, Pseudomonas putida KT2440
gacggugcgcgccagc

SEQ ID NO: 1625199 - RNA, 20 nt, Pseudomonas putida KT2440
gacggugcgcgccagcgggu

SEQ ID NO: 1625200 - RNA, 17 nt, Pseudomonas putida KT2440
gacgguggcguggccac

SEQ ID NO: 1625201 - RNA, 19 nt, Pseudomonas putida KT2440
gacggguuacccuggucau

SEQ ID NO: 1625202 - RNA, 14 nt, Pseudomonas putida KT2440
gacggucagugaag

SEQ ID NO: 1625203 - RNA, 19 nt, Pseudomonas putida KT2440
gacgugcgcuccuggucau

SEQ ID NO: 1625204 - RNA, 14 nt, Pseudomonas putida KT2440
gacgugcaggaucu

SEQ ID NO: 1625205 - RNA, 21 nt, Pseudomonas putida KT2440
gacgugcccagaucacuucca

SEQ ID NO: 1625206 - RNA, 14 nt, Pseudomonas putida KT2440
gacguccggcugcg

SEQ ID NO: 1625207 - RNA, 16 nt, Pseudomonas putida KT2440
gacguuuaccugcagc

SEQ ID NO: 1625208 - RNA, 17 nt, Pseudomonas putida KT2440
gacguuuaccugcagcu

SEQ ID NO: 1625209 - RNA, 18 nt, Pseudomonas putida KT2440
gacuaacaggugcucacc

SEQ ID NO: 1625210 - RNA, 13 nt, Pseudomonas putida KT2440
gacucccgcugcc

SEQ ID NO: 1625211 - RNA, 17 nt, Pseudomonas putida KT2440
gacuccggccggggcuc

SEQ ID NO: 1625212 - RNA, 23 nt, Pseudomonas putida KT2440
gacuccggcaaggcauccagaaa

SEQ ID NO: 1625213 - RNA, 13 nt, Pseudomonas putida KT2440
gacucaugccuuc

SEQ ID NO: 1625214 - RNA, 16 nt, Pseudomonas putida KT2440
gacucauagcucagcu

SEQ ID NO: 1625215 - RNA, 16 nt, Pseudomonas putida KT2440
gacucagcgcuugccg

SEQ ID NO: 1625216 - RNA, 17 nt, Pseudomonas putida KT2440
gacucagcgcuugccgc

SEQ ID NO: 1625217 - RNA, 12 nt, Pseudomonas putida KT2440
gacugcugugga

SEQ ID NO: 1625218 - RNA, 18 nt, Pseudomonas putida KT2440
gacugcuucaggccuucg

SEQ ID NO: 1625219 - RNA, 16 nt, Pseudomonas putida KT2440
gacugcaccaggucca

SEQ ID NO: 1625220 - RNA, 15 nt, Pseudomonas putida KT2440
gacugcaccaugaau

SEQ ID NO: 1625221 - RNA, 18 nt, Pseudomonas putida KT2440
gacugcagguaguuuucc

SEQ ID NO: 1625222 - RNA, 18 nt, Pseudomonas putida KT2440
gacugcacugccagcgcc

SEQ ID NO: 1625223 - RNA, 21 nt, Pseudomonas putida KT2440
gacugaacaccugccagcccc

SEQ ID NO: 1625224 - RNA, 19 nt, Pseudomonas putida KT2440
gacugaagcgcgggucuuc

SEQ ID NO: 1625225 - RNA, 19 nt, Pseudomonas putida KT2440
gacucuuguguugccaccc

SEQ ID NO: 1625226 - RNA, 20 nt, Pseudomonas putida KT2440
gagacauccgcaacaugaag

SEQ ID NO: 1625227 - RNA, 11 nt, Pseudomonas putida KT2440
gagaaugaaac

SEQ ID NO: 1625228 - RNA, 14 nt, Pseudomonas putida KT2440
gagaaugugcuucu

SEQ ID NO: 1625229 - RNA, 21 nt, Pseudomonas putida KT2440
gagaaccugaugcgagcuacc

SEQ ID NO: 1625230 - RNA, 23 nt, Pseudomonas putida KT2440
gagaaccugaugcgagcuaccug

SEQ ID NO: 1625231 - RNA, 13 nt, Pseudomonas putida KT2440
gagaagcugcagc

SEQ ID NO: 1625232 - RNA, 20 nt, Pseudomonas putida KT2440
gagagauugagaggacuuua

SEQ ID NO: 1625233 - RNA, 18 nt, Pseudomonas putida KT2440
gagagcaguuccuucagc

SEQ ID NO: 1625234 - RNA, 15 nt, Pseudomonas putida KT2440
gagagcuucagaccu

SEQ ID NO: 1625235 - RNA, 18 nt, Pseudomonas putida KT2440
gagaccgauuucaacccu

SEQ ID NO: 1625236 - RNA, 21 nt, Pseudomonas putida KT2440
gagaccugugguuucacacuc

SEQ ID NO: 1625237 - RNA, 18 nt, Pseudomonas putida KT2440
gagacgguggcugccagc

SEQ ID NO: 1625238 - RNA, 20 nt, Pseudomonas putida KT2440
gacuuucccacauguaauga

SEQ ID NO: 1625239 - RNA, 21 nt, Pseudomonas putida KT2440
gacuuucccacauguaaugaa

SEQ ID NO: 1625240 - RNA, 18 nt, Pseudomonas putida KT2440
gacuggugcucugcaggc

SEQ ID NO: 1625241 - RNA, 17 nt, Pseudomonas putida KT2440
gacuggucauacuccag

SEQ ID NO: 1625242 - RNA, 18 nt, Pseudomonas putida KT2440
gacuggucauacuccagc

SEQ ID NO: 1625243 - RNA, 15 nt, Pseudomonas putida KT2440
gacuggcuggccuug

SEQ ID NO: 1625244 - RNA, 15 nt, Pseudomonas putida KT2440
gacuggcgcaccagc

SEQ ID NO: 1625245 - RNA, 14 nt, Pseudomonas putida KT2440
gacugucucgccca

SEQ ID NO: 1625246 - RNA, 15 nt, Pseudomonas putida KT2440
gacuucaucaccucc

SEQ ID NO: 1625247 - RNA, 17 nt, Pseudomonas putida KT2440
gacuugcgccccucauc

SEQ ID NO: 1625248 - RNA, 21 nt, Pseudomonas putida KT2440
gacuucgucgaacaccagggu

SEQ ID NO: 1625249 - RNA, 17 nt, Pseudomonas putida KT2440
gacauaacaagaacaac

SEQ ID NO: 1625250 - RNA, 23 nt, Pseudomonas putida KT2440
gacauaccacacaccccagaacg

SEQ ID NO: 1625251 - RNA, 22 nt, Pseudomonas putida KT2440
gacaggcagucaugggccaugc

SEQ ID NO: 1625252 - RNA, 19 nt, Pseudomonas putida KT2440
gacaggccgugaaccaucc

SEQ ID NO: 1625253 - RNA, 19 nt, Pseudomonas putida KT2440
gacaggcuugaagcugcgc

SEQ ID NO: 1625254 - RNA, 16 nt, Pseudomonas putida KT2440
gacaggugccucugcu

SEQ ID NO: 1625255 - RNA, 20 nt, Pseudomonas putida KT2440
gacauccugcucccaaagca

SEQ ID NO: 1625256 - RNA, 23 nt, Pseudomonas putida KT2440
gacaucgcgguauccaucaccau

SEQ ID NO: 1625257 - RNA, 16 nt, Pseudomonas putida KT2440
gacauugaagaagccc

SEQ ID NO: 1625258 - RNA, 22 nt, Pseudomonas putida KT2440
gaccaggccgauguuguggcug

SEQ ID NO: 1625259 - RNA, 21 nt, Pseudomonas putida KT2440
gaccaggcccagcagguagac

SEQ ID NO: 1625260 - RNA, 19 nt, Pseudomonas putida KT2440
gaccagcugccauacagcc

SEQ ID NO: 1625261 - RNA, 21 nt, Pseudomonas putida KT2440
gaccagcaugcgaagccgcca

SEQ ID NO: 1625262 - RNA, 15 nt, Pseudomonas putida KT2440
gaccagcccgcugca

SEQ ID NO: 1625263 - RNA, 12 nt, Pseudomonas putida KT2440
gaccagcagugu

SEQ ID NO: 1625264 - RNA, 15 nt, Pseudomonas putida KT2440
gaccagaaacccagg

SEQ ID NO: 1625265 - RNA, 14 nt, Pseudomonas putida KT2440
gaccagaucagccg

SEQ ID NO: 1625266 - RNA, 14 nt, Pseudomonas putida KT2440
gaccagcggcagca

SEQ ID NO: 1625267 - RNA, 20 nt, Pseudomonas putida KT2440
gaccaccagacgggcauggu

SEQ ID NO: 1625268 - RNA, 15 nt, Pseudomonas putida KT2440
gaccaauccagcccu

SEQ ID NO: 1625269 - RNA, 13 nt, Pseudomonas putida KT2440
gaccacaggcgcu

SEQ ID NO: 1625270 - RNA, 23 nt, Pseudomonas putida KT2440
gaccacaggcgcuugaagaagcc

SEQ ID NO: 1625271 - RNA, 14 nt, Pseudomonas putida KT2440
gaccaagcaacgca

SEQ ID NO: 1625272 - RNA, 11 nt, Pseudomonas putida KT2440
gaccaacuuuu

SEQ ID NO: 1625273 - RNA, 22 nt, Pseudomonas putida KT2440
gaccacgccgaagcgcgccugg

SEQ ID NO: 1625274 - RNA, 20 nt, Pseudomonas putida KT2440
gaccacggccggggccuguu

SEQ ID NO: 1625275 - RNA, 15 nt, Pseudomonas putida KT2440
gaccacugcaggugc

SEQ ID NO: 1625276 - RNA, 19 nt, Pseudomonas putida KT2440
gaccacugcaggugcaggu

SEQ ID NO: 1625277 - RNA, 18 nt, Pseudomonas putida KT2440
gaccacuucaagcacgcc

SEQ ID NO: 1625278 - RNA, 15 nt, Pseudomonas putida KT2440
gaccaccgcaggugc

SEQ ID NO: 1625279 - RNA, 17 nt, Pseudomonas putida KT2440
gaccaccaucgccaggc

SEQ ID NO: 1625280 - RNA, 18 nt, Pseudomonas putida KT2440
gaccaccaucgccaggcc

SEQ ID NO: 1625281 - RNA, 16 nt, Pseudomonas putida KT2440
gaccaccgccaaggca

SEQ ID NO: 1625282 - RNA, 19 nt, Pseudomonas putida KT2440
gaccaccgccaaggcacgg

SEQ ID NO: 1625283 - RNA, 14 nt, Pseudomonas putida KT2440
gaccaccugcucgg

SEQ ID NO: 1625284 - RNA, 16 nt, Pseudomonas putida KT2440
cuuuggucgcggcgcu

SEQ ID NO: 1625285 - RNA, 15 nt, Pseudomonas putida KT2440
cuuugggggugcuga

SEQ ID NO: 1625286 - RNA, 13 nt, Pseudomonas putida KT2440
gacaacagcaugc

SEQ ID NO: 1625287 - RNA, 14 nt, Pseudomonas putida KT2440
gacaaaggccggca

SEQ ID NO: 1625288 - RNA, 23 nt, Pseudomonas putida KT2440
gacaaaggccggcaccgacagca

SEQ ID NO: 1625289 - RNA, 17 nt, Pseudomonas putida KT2440
gacaaacccgugcucuu

SEQ ID NO: 1625290 - RNA, 16 nt, Pseudomonas putida KT2440
gacaaacguaccagcc

SEQ ID NO: 1625291 - RNA, 12 nt, Pseudomonas putida KT2440
gacaaaccgcac

SEQ ID NO: 1625292 - RNA, 22 nt, Pseudomonas putida KT2440
gacaaacuccuugaaauucaau

SEQ ID NO: 1625293 - RNA, 23 nt, Pseudomonas putida KT2440
gacaaacugcucgcugccacgca

SEQ ID NO: 1625294 - RNA, 15 nt, Pseudomonas putida KT2440
gacaaacugcugagu

SEQ ID NO: 1625295 - RNA, 19 nt, Pseudomonas putida KT2440
gacaaacugcugagucagc

SEQ ID NO: 1625296 - RNA, 17 nt, Pseudomonas putida KT2440
gacaagccgacaaaaac

SEQ ID NO: 1625297 - RNA, 19 nt, Pseudomonas putida KT2440
gacaagccgcugggcuuca

SEQ ID NO: 1625298 - RNA, 14 nt, Pseudomonas putida KT2440
gacaaccccagccc

SEQ ID NO: 1625299 - RNA, 19 nt, Pseudomonas putida KT2440
gacaacccccacagggcaa

SEQ ID NO: 1625300 - RNA, 21 nt, Pseudomonas putida KT2440
gacaaccaagcgaacuauccu

SEQ ID NO: 1625301 - RNA, 17 nt, Pseudomonas putida KT2440
gacaacgcacccgccuc

SEQ ID NO: 1625302 - RNA, 14 nt, Pseudomonas putida KT2440
gacaaucgccaggu

SEQ ID NO: 1625303 - RNA, 22 nt, Pseudomonas putida KT2440
gacaaggcauuuucaaugcuuu

SEQ ID NO: 1625304 - RNA, 23 nt, Pseudomonas putida KT2440
gacaaguucauuaccauccauca

SEQ ID NO: 1625305 - RNA, 15 nt, Pseudomonas putida KT2440
gacagcaggaacagc

SEQ ID NO: 1625306 - RNA, 17 nt, Pseudomonas putida KT2440
gacagaaucgcggucuu

SEQ ID NO: 1625307 - RNA, 17 nt, Pseudomonas putida KT2440
gacagcuugcccagcug

SEQ ID NO: 1625308 - RNA, 19 nt, Pseudomonas putida KT2440
gacagcugcggcaugaagg

SEQ ID NO: 1625309 - RNA, 18 nt, Pseudomonas putida KT2440
gacagcucaagcccugcc

SEQ ID NO: 1625310 - RNA, 23 nt, Pseudomonas putida KT2440
gacagcggcagcaucgaccugcc

SEQ ID NO: 1625311 - RNA, 14 nt, Pseudomonas putida KT2440
gacagcggccagcu

SEQ ID NO: 1625312 - RNA, 21 nt, Pseudomonas putida KT2440
gacagcgcagucaccacacgg

SEQ ID NO: 1625313 - RNA, 17 nt, Pseudomonas putida KT2440
gacagcgcccggcgcag

SEQ ID NO: 1625314 - RNA, 14 nt, Pseudomonas putida KT2440
gacagccacaugcc

SEQ ID NO: 1625315 - RNA, 15 nt, Pseudomonas putida KT2440
gacagccacaugcca

SEQ ID NO: 1625316 - RNA, 22 nt, Pseudomonas putida KT2440
gacagcaucugcaccaggaagc

SEQ ID NO: 1625317 - RNA, 14 nt, Pseudomonas putida KT2440
gacagcccaaggcc

SEQ ID NO: 1625318 - RNA, 13 nt, Pseudomonas putida KT2440
gacagccaccugc

SEQ ID NO: 1625319 - RNA, 13 nt, Pseudomonas putida KT2440
gacacgagcggcc

SEQ ID NO: 1625320 - RNA, 19 nt, Pseudomonas putida KT2440
gacaccgggauacugcgca

SEQ ID NO: 1625321 - RNA, 23 nt, Pseudomonas putida KT2440
gacacuccgcuuucagccgagcc

SEQ ID NO: 1625322 - RNA, 15 nt, Pseudomonas putida KT2440
gacacccucuugaau

SEQ ID NO: 1625323 - RNA, 20 nt, Pseudomonas putida KT2440
gacacccagcacccgcaggc

SEQ ID NO: 1625324 - RNA, 16 nt, Pseudomonas putida KT2440
gacacaccaauggcca

SEQ ID NO: 1625325 - RNA, 16 nt, Pseudomonas putida KT2440
gacacauaacccccca

SEQ ID NO: 1625326 - RNA, 21 nt, Pseudomonas putida KT2440
gacgacuuauccgcuggcuug

SEQ ID NO: 1625327 - RNA, 14 nt, Pseudomonas putida KT2440
gacgaggccgagcg

SEQ ID NO: 1625328 - RNA, 14 nt, Pseudomonas putida KT2440
gacgaucgccagcc

SEQ ID NO: 1625329 - RNA, 17 nt, Pseudomonas putida KT2440
gacgaucgccagcccca

SEQ ID NO: 1625330 - RNA, 17 nt, Pseudomonas putida KT2440
gacgaguuuaccuccau

SEQ ID NO: 1625331 - RNA, 19 nt, Pseudomonas putida KT2440
gacgcaaggccgcucccac

SEQ ID NO: 1625332 - RNA, 12 nt, Pseudomonas putida KT2440
gacgcagcagcg

SEQ ID NO: 1625333 - RNA, 18 nt, Pseudomonas putida KT2440
gacgaugaccuugccuuu

SEQ ID NO: 1625334 - RNA, 20 nt, Pseudomonas putida KT2440
gacgaugaucagguugacgu

SEQ ID NO: 1625335 - RNA, 17 nt, Pseudomonas putida KT2440
gaccuucuggcagccgc

SEQ ID NO: 1625336 - RNA, 19 nt, Pseudomonas putida KT2440
gaccuucuggcagccgccc

SEQ ID NO: 1625337 - RNA, 13 nt, Pseudomonas putida KT2440
gaccuugccuuuc

SEQ ID NO: 1625338 - RNA, 18 nt, Pseudomonas putida KT2440
gaccuugucagcaaccac

SEQ ID NO: 1625339 - RNA, 13 nt, Pseudomonas putida KT2440
gaccuugcugcuc

SEQ ID NO: 1625340 - RNA, 15 nt, Pseudomonas putida KT2440
gacgaacagcgccgc

SEQ ID NO: 1625341 - RNA, 19 nt, Pseudomonas putida KT2440
gacgaaguacggcuugccg

SEQ ID NO: 1625342 - RNA, 20 nt, Pseudomonas putida KT2440
gacgaaggcgguauggguga

SEQ ID NO: 1625343 - RNA, 15 nt, Pseudomonas putida KT2440
gacgacgcgauaaug

SEQ ID NO: 1625344 - RNA, 16 nt, Pseudomonas putida KT2440
gacgcucggacagcuu

SEQ ID NO: 1625345 - RNA, 21 nt, Pseudomonas putida KT2440
gacgcugcacuuccacacccg

SEQ ID NO: 1625346 - RNA, 17 nt, Pseudomonas putida KT2440
gacgcugccgcaccugc

SEQ ID NO: 1625347 - RNA, 15 nt, Pseudomonas putida KT2440
gacgcugccgucucg

SEQ ID NO: 1625348 - RNA, 23 nt, Pseudomonas putida KT2440
gacgcuggcagcuuggccauuuc

SEQ ID NO: 1625349 - RNA, 16 nt, Pseudomonas putida KT2440
gacggauuggaaaaug

SEQ ID NO: 1625350 - RNA, 18 nt, Pseudomonas putida KT2440
gacggccaauggccggga

SEQ ID NO: 1625351 - RNA, 12 nt, Pseudomonas putida KT2440
gacgccgcagcc

SEQ ID NO: 1625352 - RNA, 16 nt, Pseudomonas putida KT2440
gacgccgcagccgggc

SEQ ID NO: 1625353 - RNA, 17 nt, Pseudomonas putida KT2440
gacgccgcagccgggcg

SEQ ID NO: 1625354 - RNA, 15 nt, Pseudomonas putida KT2440
gacgccagcgcuggg

SEQ ID NO: 1625355 - RNA, 15 nt, Pseudomonas putida KT2440
gacgcauguugaaac

SEQ ID NO: 1625356 - RNA, 22 nt, Pseudomonas putida KT2440
gacgcauucgcgggugaacccg

SEQ ID NO: 1625357 - RNA, 16 nt, Pseudomonas putida KT2440
gacgcgccgugccagg

SEQ ID NO: 1625358 - RNA, 11 nt, Pseudomonas putida KT2440
gacgccuuggc

SEQ ID NO: 1625359 - RNA, 16 nt, Pseudomonas putida KT2440
gaccaucggcaggcgg

SEQ ID NO: 1625360 - RNA, 22 nt, Pseudomonas putida KT2440
gaccaucggcaggcgguccagc

SEQ ID NO: 1625361 - RNA, 22 nt, Pseudomonas putida KT2440
gaccaucaccgccagcauggcc

SEQ ID NO: 1625362 - RNA, 15 nt, Pseudomonas putida KT2440
gaccauuucgcgcag

SEQ ID NO: 1625363 - RNA, 16 nt, Pseudomonas putida KT2440
gaccauuucgcgcagg

SEQ ID NO: 1625364 - RNA, 17 nt, Pseudomonas putida KT2440
gacccaaucgcugugca

SEQ ID NO: 1625365 - RNA, 17 nt, Pseudomonas putida KT2440
gacccaccuacccgcaa

SEQ ID NO: 1625366 - RNA, 17 nt, Pseudomonas putida KT2440
gacccagccacccggcg

SEQ ID NO: 1625367 - RNA, 20 nt, Pseudomonas putida KT2440
gacccagccacccggcgcgc

SEQ ID NO: 1625368 - RNA, 17 nt, Pseudomonas putida KT2440
gacccagucagucgccg

SEQ ID NO: 1625369 - RNA, 22 nt, Pseudomonas putida KT2440
gaccccgcccuagcgguccgga

SEQ ID NO: 1625370 - RNA, 15 nt, Pseudomonas putida KT2440
gaccgcacuccccau

SEQ ID NO: 1625371 - RNA, 19 nt, Pseudomonas putida KT2440
gaccgcaucuccaaaaggu

SEQ ID NO: 1625372 - RNA, 24 nt, Pseudomonas putida KT2440
gaccgcauugaucaugcccauggc

SEQ ID NO: 1625373 - RNA, 20 nt, Pseudomonas putida KT2440
gaccgaugcccaacauaucg

SEQ ID NO: 1625374 - RNA, 15 nt, Pseudomonas putida KT2440
gaccgaugccgccgu

SEQ ID NO: 1625375 - RNA, 19 nt, Pseudomonas putida KT2440
gaccgagcacucggcggcg

SEQ ID NO: 1625376 - RNA, 16 nt, Pseudomonas putida KT2440
gaccgaccaccugcuc

SEQ ID NO: 1625377 - RNA, 15 nt, Pseudomonas putida KT2440
gaccgagaacaggcg

SEQ ID NO: 1625378 - RNA, 19 nt, Pseudomonas putida KT2440
gaccgagaacaggcggccc

SEQ ID NO: 1625379 - RNA, 19 nt, Pseudomonas putida KT2440
gacccggccgcuccagcuc

SEQ ID NO: 1625380 - RNA, 18 nt, Pseudomonas putida KT2440
gacccgcucccacagaag

SEQ ID NO: 1625381 - RNA, 22 nt, Pseudomonas putida KT2440
gacccgcgucagcucaagcgcu

SEQ ID NO: 1625382 - RNA, 22 nt, Pseudomonas putida KT2440
gacccgccuggugccagcggcc

SEQ ID NO: 1625383 - RNA, 13 nt, Pseudomonas putida KT2440
gacccgggccagc

SEQ ID NO: 1625384 - RNA, 16 nt, Pseudomonas putida KT2440
gacccucaagugccgu

SEQ ID NO: 1625385 - RNA, 14 nt, Pseudomonas putida KT2440
gacccugaagcccu

SEQ ID NO: 1625386 - RNA, 15 nt, Pseudomonas putida KT2440
gacccugaagcccug

SEQ ID NO: 1625387 - RNA, 19 nt, Pseudomonas putida KT2440
gacccugagucuggcgccu

SEQ ID NO: 1625388 - RNA, 20 nt, Pseudomonas putida KT2440
gacccuguagccccgcuggu

SEQ ID NO: 1625389 - RNA, 14 nt, Pseudomonas putida KT2440
gacccuuccagccc

SEQ ID NO: 1625390 - RNA, 22 nt, Pseudomonas putida KT2440
gacccuuccagcccgccugcuc

SEQ ID NO: 1625391 - RNA, 17 nt, Pseudomonas putida KT2440
gacccuugugugggccu

SEQ ID NO: 1625392 - RNA, 19 nt, Pseudomonas putida KT2440
gacccuugugugggccuug

SEQ ID NO: 1625393 - RNA, 19 nt, Pseudomonas putida KT2440
gaccugauccaaauugcuc

SEQ ID NO: 1625394 - RNA, 16 nt, Pseudomonas putida KT2440
gaccucugguuuuguc

SEQ ID NO: 1625395 - RNA, 16 nt, Pseudomonas putida KT2440
gaccucuuagcgggca

SEQ ID NO: 1625396 - RNA, 14 nt, Pseudomonas putida KT2440
gaccugccgcagcg

SEQ ID NO: 1625397 - RNA, 15 nt, Pseudomonas putida KT2440
gaccugcguggugcc

SEQ ID NO: 1625398 - RNA, 19 nt, Pseudomonas putida KT2440
gaccugcguugggggccuu

SEQ ID NO: 1625399 - RNA, 17 nt, Pseudomonas putida KT2440
gaccugcugggucagcg

SEQ ID NO: 1625400 - RNA, 16 nt, Pseudomonas putida KT2440
gaccugugcugaauuu

SEQ ID NO: 1625401 - RNA, 21 nt, Pseudomonas putida KT2440
gaccugugggagcgggcaugc

SEQ ID NO: 1625402 - RNA, 22 nt, Pseudomonas putida KT2440
gaccuggcucuucaacaccagc

SEQ ID NO: 1625403 - RNA, 15 nt, Pseudomonas putida KT2440
gaccugguccagcuu

SEQ ID NO: 1625404 - RNA, 20 nt, Pseudomonas putida KT2440
gaccgugaucaucagcgccg

SEQ ID NO: 1625405 - RNA, 17 nt, Pseudomonas putida KT2440
gaccucgaccaggcgcu

SEQ ID NO: 1625406 - RNA, 24 nt, Pseudomonas putida KT2440
gaccuccgucugcucugccaucuc

SEQ ID NO: 1625407 - RNA, 15 nt, Pseudomonas putida KT2440
gaccucacagccuuc

SEQ ID NO: 1625408 - RNA, 17 nt, Pseudomonas putida KT2440
gaccucacagccuucag

SEQ ID NO: 1625409 - RNA, 13 nt, Pseudomonas putida KT2440
gaccucacgcagg

SEQ ID NO: 1625410 - RNA, 18 nt, Pseudomonas putida KT2440
gaccgggacgcaggcgca

SEQ ID NO: 1625411 - RNA, 12 nt, Pseudomonas putida KT2440
gaccggucagcc

SEQ ID NO: 1625412 - RNA, 18 nt, Pseudomonas putida KT2440
gaccggucagcccggcuu

SEQ ID NO: 1625413 - RNA, 13 nt, Pseudomonas putida KT2440
gaccggcacugca

SEQ ID NO: 1625414 - RNA, 11 nt, Pseudomonas putida KT2440
gaccgccgccc

SEQ ID NO: 1625415 - RNA, 18 nt, Pseudomonas putida KT2440
gaccgccgcccaggucau

SEQ ID NO: 1625416 - RNA, 23 nt, Pseudomonas putida KT2440
gaccgccgaucgaagcagcagcu

SEQ ID NO: 1625417 - RNA, 11 nt, Pseudomonas putida KT2440
gaccgccgcca

SEQ ID NO: 1625418 - RNA, 14 nt, Pseudomonas putida KT2440
gaccgccugcgcac

SEQ ID NO: 1625419 - RNA, 21 nt, Pseudomonas putida KT2440
gaccgccgccuggcucaccuu

SEQ ID NO: 1625420 - RNA, 19 nt, Pseudomonas putida KT2440
gaccgccgggcccaggcau

SEQ ID NO: 1625421 - RNA, 18 nt, Pseudomonas putida KT2440
cguucagcuugucgacca

SEQ ID NO: 1625422 - RNA, 20 nt, Pseudomonas putida KT2440
cguucagcuugucgaccagg

SEQ ID NO: 1625423 - RNA, 18 nt, Pseudomonas putida KT2440
cguuauccagcugcaaca

SEQ ID NO: 1625424 - RNA, 20 nt, Pseudomonas putida KT2440
cgucaugguggugccguugg

SEQ ID NO: 1625425 - RNA, 14 nt, Pseudomonas putida KT2440
cguccacaaacccc

SEQ ID NO: 1625426 - RNA, 14 nt, Pseudomonas putida KT2440
cguccaacgggcgg

SEQ ID NO: 1625427 - RNA, 14 nt, Pseudomonas putida KT2440
cguucauccccucg

SEQ ID NO: 1625428 - RNA, 15 nt, Pseudomonas putida KT2440
cguucaucgaaggcc

SEQ ID NO: 1625429 - RNA, 13 nt, Pseudomonas putida KT2440
cguuccggcaaac

SEQ ID NO: 1625430 - RNA, 22 nt, Pseudomonas putida KT2440
cguugcggaacauacgcaucag

SEQ ID NO: 1625431 - RNA, 12 nt, Pseudomonas putida KT2440
cguugcagcccc

SEQ ID NO: 1625432 - RNA, 14 nt, Pseudomonas putida KT2440
cguucggugcacgg

SEQ ID NO: 1625433 - RNA, 23 nt, Pseudomonas putida KT2440
cguucgucaagcucgacccgcgu

SEQ ID NO: 1625434 - RNA, 19 nt, Pseudomonas putida KT2440
cguugaccgacucuacugc

SEQ ID NO: 1625435 - RNA, 12 nt, Pseudomonas putida KT2440
cguucuccagcu

SEQ ID NO: 1625436 - RNA, 22 nt, Pseudomonas putida KT2440
cguugaagcgguugaccgccgc

SEQ ID NO: 1625437 - RNA, 16 nt, Pseudomonas putida KT2440
cguugaugaucugcuc

SEQ ID NO: 1625438 - RNA, 21 nt, Pseudomonas putida KT2440
cguugaugaugcgcaccggag

SEQ ID NO: 1625439 - RNA, 23 nt, Pseudomonas putida KT2440
cguugaccagguuuaccggccgc

SEQ ID NO: 1625440 - RNA, 23 nt, Pseudomonas putida KT2440
cguuuuucucgaugaugcugguc

SEQ ID NO: 1625441 - RNA, 17 nt, Pseudomonas putida KT2440
cuaaagccgcaccuaca

SEQ ID NO: 1625442 - RNA, 20 nt, Pseudomonas putida KT2440
cguugucgcccgcccagccc

SEQ ID NO: 1625443 - RNA, 19 nt, Pseudomonas putida KT2440
cguugucggcccacugcac

SEQ ID NO: 1625444 - RNA, 23 nt, Pseudomonas putida KT2440
cguugcuccagcucacagcacuc

SEQ ID NO: 1625445 - RNA, 18 nt, Pseudomonas putida KT2440
cguuucguugaccccgcc

SEQ ID NO: 1625446 - RNA, 18 nt, Pseudomonas putida KT2440
cguuguucgaucagccgu

SEQ ID NO: 1625447 - RNA, 21 nt, Pseudomonas putida KT2440
cguuuauugguuugacgcugc

SEQ ID NO: 1625448 - RNA, 13 nt, Pseudomonas putida KT2440
cuaagggcuagau

SEQ ID NO: 1625449 - RNA, 15 nt, Pseudomonas putida KT2440
cuaaaucgaccugca

SEQ ID NO: 1625450 - RNA, 22 nt, Pseudomonas putida KT2440
cuaaaucgaccugcaggcccug

SEQ ID NO: 1625451 - RNA, 14 nt, Pseudomonas putida KT2440
cuaaucgggcagau

SEQ ID NO: 1625452 - RNA, 14 nt, Pseudomonas putida KT2440
cuaauggcgcgccu

SEQ ID NO: 1625453 - RNA, 17 nt, Pseudomonas putida KT2440
cuacaacggcugugccg

SEQ ID NO: 1625454 - RNA, 18 nt, Pseudomonas putida KT2440
cuacaacauaccgcuggg

SEQ ID NO: 1625455 - RNA, 17 nt, Pseudomonas putida KT2440
cuaauugcccgagcgcu

SEQ ID NO: 1625456 - RNA, 20 nt, Pseudomonas putida KT2440
cuaccaaccugccaugcagg

SEQ ID NO: 1625457 - RNA, 20 nt, Pseudomonas putida KT2440
cuaccaaucuguaccuugcu

SEQ ID NO: 1625458 - RNA, 15 nt, Pseudomonas putida KT2440
cuaccaacgcagcau

SEQ ID NO: 1625459 - RNA, 22 nt, Pseudomonas putida KT2440
cuacauggaucgcauugccccu

SEQ ID NO: 1625460 - RNA, 19 nt, Pseudomonas putida KT2440
cuaccagcaguuggcugcc

SEQ ID NO: 1625461 - RNA, 24 nt, Pseudomonas putida KT2440
cuaccagcuugccgcgugcgaugu

SEQ ID NO: 1625462 - RNA, 16 nt, Pseudomonas putida KT2440
cuaccacgccgcugcc

SEQ ID NO: 1625463 - RNA, 15 nt, Pseudomonas putida KT2440
cuaccacguuaucca

SEQ ID NO: 1625464 - RNA, 23 nt, Pseudomonas putida KT2440
cuacccaaacucuugagcuggcc

SEQ ID NO: 1625465 - RNA, 20 nt, Pseudomonas putida KT2440
cuaccaggcccaacagcgcg

SEQ ID NO: 1625466 - RNA, 14 nt, Pseudomonas putida KT2440
cuacaggccgcccu

SEQ ID NO: 1625467 - RNA, 20 nt, Pseudomonas putida KT2440
cuacaggaaucugucagccu

SEQ ID NO: 1625468 - RNA, 15 nt, Pseudomonas putida KT2440
cuacagguucugcgc

SEQ ID NO: 1625469 - RNA, 12 nt, Pseudomonas putida KT2440
cuacagccccuu

SEQ ID NO: 1625470 - RNA, 22 nt, Pseudomonas putida KT2440
cucaguggaccucuggcgugca

SEQ ID NO: 1625471 - RNA, 14 nt, Pseudomonas putida KT2440
cucauagcucagcu

SEQ ID NO: 1625472 - RNA, 21 nt, Pseudomonas putida KT2440
cucauagaaauggcuuccggc

SEQ ID NO: 1625473 - RNA, 17 nt, Pseudomonas putida KT2440
cucauaggcgcugaaac

SEQ ID NO: 1625474 - RNA, 20 nt, Pseudomonas putida KT2440
cucauaggcgcugaaacugu

SEQ ID NO: 1625475 - RNA, 16 nt, Pseudomonas putida KT2440
cucaggccaguuccuc

SEQ ID NO: 1625476 - RNA, 16 nt, Pseudomonas putida KT2440
cucaggccaugcugcg

SEQ ID NO: 1625477 - RNA, 22 nt, Pseudomonas putida KT2440
cucaggccaugcugcgccagga

SEQ ID NO: 1625478 - RNA, 19 nt, Pseudomonas putida KT2440
cucaggcaccagcgcugcc

SEQ ID NO: 1625479 - RNA, 14 nt, Pseudomonas putida KT2440
cucaggccuugccg

SEQ ID NO: 1625480 - RNA, 17 nt, Pseudomonas putida KT2440
cucaggcucuugaacug

SEQ ID NO: 1625481 - RNA, 14 nt, Pseudomonas putida KT2440
cucaggcgcuccag

SEQ ID NO: 1625482 - RNA, 22 nt, Pseudomonas putida KT2440
cucaggcgcuggcgccagccgc

SEQ ID NO: 1625483 - RNA, 15 nt, Pseudomonas putida KT2440
cucaggcggccaaac

SEQ ID NO: 1625484 - RNA, 21 nt, Pseudomonas putida KT2440
cucaggcggccaaacuggaug

SEQ ID NO: 1625485 - RNA, 11 nt, Pseudomonas putida KT2440
cucaggcucag

SEQ ID NO: 1625486 - RNA, 16 nt, Pseudomonas putida KT2440
cucaggcucagcucca

SEQ ID NO: 1625487 - RNA, 16 nt, Pseudomonas putida KT2440
cucagcggcuggcccu

SEQ ID NO: 1625488 - RNA, 16 nt, Pseudomonas putida KT2440
cucagcgcuugccgcu

SEQ ID NO: 1625489 - RNA, 14 nt, Pseudomonas putida KT2440
cucacugcgaugaa

SEQ ID NO: 1625490 - RNA, 13 nt, Pseudomonas putida KT2440
cucacugaccagg

SEQ ID NO: 1625491 - RNA, 19 nt, Pseudomonas putida KT2440
cucaugcagcaccuccugc

SEQ ID NO: 1625492 - RNA, 14 nt, Pseudomonas putida KT2440
cucaugccccgcac

SEQ ID NO: 1625493 - RNA, 12 nt, Pseudomonas putida KT2440
cucauccagcgu

SEQ ID NO: 1625494 - RNA, 12 nt, Pseudomonas putida KT2440
cucauccaggcu

SEQ ID NO: 1625495 - RNA, 15 nt, Pseudomonas putida KT2440
cucauccacccccgc

SEQ ID NO: 1625496 - RNA, 21 nt, Pseudomonas putida KT2440
cucaucaggccgaaggccagc

SEQ ID NO: 1625497 - RNA, 21 nt, Pseudomonas putida KT2440
cucauuguuuugccugggggu

SEQ ID NO: 1625498 - RNA, 22 nt, Pseudomonas putida KT2440
cuccaaagccagcgcuaaaccu

SEQ ID NO: 1625499 - RNA, 14 nt, Pseudomonas putida KT2440
cuccaaccccagcg

SEQ ID NO: 1625500 - RNA, 19 nt, Pseudomonas putida KT2440
cucaacgccucccccaccc

SEQ ID NO: 1625501 - RNA, 21 nt, Pseudomonas putida KT2440
cucaaccuuugcggcacaucu

SEQ ID NO: 1625502 - RNA, 21 nt, Pseudomonas putida KT2440
cucaacgcaacugcggccccu

SEQ ID NO: 1625503 - RNA, 22 nt, Pseudomonas putida KT2440
cucaacgcaacugcggccccug

SEQ ID NO: 1625504 - RNA, 21 nt, Pseudomonas putida KT2440
cucaacgccagggcaaucgcc

SEQ ID NO: 1625505 - RNA, 16 nt, Pseudomonas putida KT2440
cucaacaccaucuuca

SEQ ID NO: 1625506 - RNA, 23 nt, Pseudomonas putida KT2440
cucaacaccaucuucaugcaaua

SEQ ID NO: 1625507 - RNA, 21 nt, Pseudomonas putida KT2440
cucaacuucccucugccugcc

SEQ ID NO: 1625508 - RNA, 13 nt, Pseudomonas putida KT2440
cucaagcccugcc

SEQ ID NO: 1625509 - RNA, 17 nt, Pseudomonas putida KT2440
cucaagccugccaaauc

SEQ ID NO: 1625510 - RNA, 18 nt, Pseudomonas putida KT2440
cucaagcgaggugacugc

SEQ ID NO: 1625511 - RNA, 15 nt, Pseudomonas putida KT2440
cucaaaugcuggcaa

SEQ ID NO: 1625512 - RNA, 14 nt, Pseudomonas putida KT2440
cuauugagagcaga

SEQ ID NO: 1625513 - RNA, 20 nt, Pseudomonas putida KT2440
cuauugagagcagaugacuc

SEQ ID NO: 1625514 - RNA, 12 nt, Pseudomonas putida KT2440
cucacaucaucg

SEQ ID NO: 1625515 - RNA, 20 nt, Pseudomonas putida KT2440
cucacagcacucguugaagc

SEQ ID NO: 1625516 - RNA, 15 nt, Pseudomonas putida KT2440
cucacacccaggcuc

SEQ ID NO: 1625517 - RNA, 16 nt, Pseudomonas putida KT2440
cucacaaagcccuugu

SEQ ID NO: 1625518 - RNA, 10 nt, Pseudomonas putida KT2440
cucaauagcg

SEQ ID NO: 1625519 - RNA, 13 nt, Pseudomonas putida KT2440
cucaagcggccuc

SEQ ID NO: 1625520 - RNA, 19 nt, Pseudomonas putida KT2440
cucacggccauccugcugu

SEQ ID NO: 1625521 - RNA, 21 nt, Pseudomonas putida KT2440
cucacgcaagcggcccugauc

SEQ ID NO: 1625522 - RNA, 20 nt, Pseudomonas putida KT2440
cucacgcucguuguccagca

SEQ ID NO: 1625523 - RNA, 22 nt, Pseudomonas putida KT2440
cucacgcgccacauagcuggca

SEQ ID NO: 1625524 - RNA, 16 nt, Pseudomonas putida KT2440
cucacgccccuuggca

SEQ ID NO: 1625525 - RNA, 13 nt, Pseudomonas putida KT2440
cucacgcuugcca

SEQ ID NO: 1625526 - RNA, 15 nt, Pseudomonas putida KT2440
cucaccgacccacag

SEQ ID NO: 1625527 - RNA, 22 nt, Pseudomonas putida KT2440
cucacccgccccacgcccgacc

SEQ ID NO: 1625528 - RNA, 13 nt, Pseudomonas putida KT2440
cucacccgaccag

SEQ ID NO: 1625529 - RNA, 20 nt, Pseudomonas putida KT2440
cucacccgaccagaucaggc

SEQ ID NO: 1625530 - RNA, 22 nt, Pseudomonas putida KT2440
cucacccgaccagaucaggccg

SEQ ID NO: 1625531 - RNA, 14 nt, Pseudomonas putida KT2440
cucaccgccgcccc

SEQ ID NO: 1625532 - RNA, 16 nt, Pseudomonas putida KT2440
cucaccgccgccccgc

SEQ ID NO: 1625533 - RNA, 16 nt, Pseudomonas putida KT2440
cucaccgcagcccagc

SEQ ID NO: 1625534 - RNA, 14 nt, Pseudomonas putida KT2440
cucacgcagcccuu

SEQ ID NO: 1625535 - RNA, 20 nt, Pseudomonas putida KT2440
cucacgaugacccuuccagc

SEQ ID NO: 1625536 - RNA, 21 nt, Pseudomonas putida KT2440
cucacgaugacccuuccagcc

SEQ ID NO: 1625537 - RNA, 22 nt, Pseudomonas putida KT2440
cucacgaugacccuuccagccc

SEQ ID NO: 1625538 - RNA, 17 nt, Pseudomonas putida KT2440
cuaucaggagcaacuac

SEQ ID NO: 1625539 - RNA, 13 nt, Pseudomonas putida KT2440
cuaucccccuuug

SEQ ID NO: 1625540 - RNA, 18 nt, Pseudomonas putida KT2440
cuaugccggucagcagca

SEQ ID NO: 1625541 - RNA, 22 nt, Pseudomonas putida KT2440
cuaugcccggcucaccgcagcc

SEQ ID NO: 1625542 - RNA, 13 nt, Pseudomonas putida KT2440
cuaugccaccugu

SEQ ID NO: 1625543 - RNA, 20 nt, Pseudomonas putida KT2440
cuaugccaccuguugccgcu

SEQ ID NO: 1625544 - RNA, 15 nt, Pseudomonas putida KT2440
cuaucggccagcaaa

SEQ ID NO: 1625545 - RNA, 16 nt, Pseudomonas putida KT2440
cuagucgaaaaaccga

SEQ ID NO: 1625546 - RNA, 18 nt, Pseudomonas putida KT2440
cuaguaugguguuuugca

SEQ ID NO: 1625547 - RNA, 14 nt, Pseudomonas putida KT2440
cuagucaagcugcg

SEQ ID NO: 1625548 - RNA, 15 nt, Pseudomonas putida KT2440
cuaguacuuuuucag

SEQ ID NO: 1625549 - RNA, 18 nt, Pseudomonas putida KT2440
cuaguacuuuuucagguu

SEQ ID NO: 1625550 - RNA, 23 nt, Pseudomonas putida KT2440
cuaccccgaugcgcugaucgugc

SEQ ID NO: 1625551 - RNA, 13 nt, Pseudomonas putida KT2440
cuacccaggccaa

SEQ ID NO: 1625552 - RNA, 17 nt, Pseudomonas putida KT2440
cuacccacuccccacuc

SEQ ID NO: 1625553 - RNA, 18 nt, Pseudomonas putida KT2440
cuaccccuucauccgcgg

SEQ ID NO: 1625554 - RNA, 18 nt, Pseudomonas putida KT2440
cuaccgccaacgaaucag

SEQ ID NO: 1625555 - RNA, 16 nt, Pseudomonas putida KT2440
cugaaaccccgcccca

SEQ ID NO: 1625556 - RNA, 22 nt, Pseudomonas putida KT2440
cugaaacgcaaaaacgccccuc

SEQ ID NO: 1625557 - RNA, 17 nt, Pseudomonas putida KT2440
cugaaaguucagcgccu

SEQ ID NO: 1625558 - RNA, 18 nt, Pseudomonas putida KT2440
cugaagauuuucagccaa

SEQ ID NO: 1625559 - RNA, 15 nt, Pseudomonas putida KT2440
cugaagcccuggaug

SEQ ID NO: 1625560 - RNA, 15 nt, Pseudomonas putida KT2440
cugaacuucaaccgc

SEQ ID NO: 1625561 - RNA, 22 nt, Pseudomonas putida KT2440
cugaacuucaaccgcacccgca

SEQ ID NO: 1625562 - RNA, 23 nt, Pseudomonas putida KT2440
cugaacggugaagucaaccaacu

SEQ ID NO: 1625563 - RNA, 20 nt, Pseudomonas putida KT2440
cugaacauugcagggcggcc

SEQ ID NO: 1625564 - RNA, 16 nt, Pseudomonas putida KT2440
cugaacacgcaggucu

SEQ ID NO: 1625565 - RNA, 21 nt, Pseudomonas putida KT2440
cugaacacgcucaugaacagc

SEQ ID NO: 1625566 - RNA, 17 nt, Pseudomonas putida KT2440
cugaaauuuuugaaauu

SEQ ID NO: 1625567 - RNA, 21 nt, Pseudomonas putida KT2440
cugaaauuuuugaaauuuuug

SEQ ID NO: 1625568 - RNA, 14 nt, Pseudomonas putida KT2440
cugaacaccugcca

SEQ ID NO: 1625569 - RNA, 20 nt, Pseudomonas putida KT2440
cugaacaccugccagccccg

SEQ ID NO: 1625570 - RNA, 21 nt, Pseudomonas putida KT2440
cugaacaccugccagccccgc

SEQ ID NO: 1625571 - RNA, 18 nt, Pseudomonas putida KT2440
cugaacaaggccuggccc

SEQ ID NO: 1625572 - RNA, 19 nt, Pseudomonas putida KT2440
cugaaauccagccgcccga

SEQ ID NO: 1625573 - RNA, 22 nt, Pseudomonas putida KT2440
cucuugagcuggccguccagcu

SEQ ID NO: 1625574 - RNA, 17 nt, Pseudomonas putida KT2440
cucuugcagcgagugcg

SEQ ID NO: 1625575 - RNA, 13 nt, Pseudomonas putida KT2440
cucuugcccggcc

SEQ ID NO: 1625576 - RNA, 15 nt, Pseudomonas putida KT2440
cucuucuucaaggcu

SEQ ID NO: 1625577 - RNA, 20 nt, Pseudomonas putida KT2440
cucuucuucaaggcugcucu

SEQ ID NO: 1625578 - RNA, 19 nt, Pseudomonas putida KT2440
cucuugaacugggcaucca

SEQ ID NO: 1625579 - RNA, 22 nt, Pseudomonas putida KT2440
cucuugaacugggcauccagcu

SEQ ID NO: 1625580 - RNA, 22 nt, Pseudomonas putida KT2440
cucuucgcgggcucgcccacuc

SEQ ID NO: 1625581 - RNA, 17 nt, Pseudomonas putida KT2440
cucuucggccaguuuca

SEQ ID NO: 1625582 - RNA, 20 nt, Pseudomonas putida KT2440
cucuugcugcaacagcucca

SEQ ID NO: 1625583 - RNA, 22 nt, Pseudomonas putida KT2440
cucuuccugcaccugguugcca

SEQ ID NO: 1625584 - RNA, 13 nt, Pseudomonas putida KT2440
cucuuccuggcug

SEQ ID NO: 1625585 - RNA, 14 nt, Pseudomonas putida KT2440
cucuuccuugaucu

SEQ ID NO: 1625586 - RNA, 14 nt, Pseudomonas putida KT2440
cucuucgcagcaca

SEQ ID NO: 1625587 - RNA, 17 nt, Pseudomonas putida KT2440
cucuucgauccgcgcca

SEQ ID NO: 1625588 - RNA, 20 nt, Pseudomonas putida KT2440
cucuucccaccaccagcgcc

SEQ ID NO: 1625589 - RNA, 12 nt, Pseudomonas putida KT2440
cucuuccagcuc

SEQ ID NO: 1625590 - RNA, 22 nt, Pseudomonas putida KT2440
cucuuccgcacgggucaccuca

SEQ ID NO: 1625591 - RNA, 15 nt, Pseudomonas putida KT2440
cucuucaacaccagc

SEQ ID NO: 1625592 - RNA, 22 nt, Pseudomonas putida KT2440
cucuucaaccaguucagcgccc

SEQ ID NO: 1625593 - RNA, 21 nt, Pseudomonas putida KT2440
cucuucaaccuguuccggccu

SEQ ID NO: 1625594 - RNA, 23 nt, Pseudomonas putida KT2440
cucuucaaccuguuccggccucu

SEQ ID NO: 1625595 - RNA, 13 nt, Pseudomonas putida KT2440
cucuucacugcuc

SEQ ID NO: 1625596 - RNA, 22 nt, Pseudomonas putida KT2440
cucuguuccauuucacuggcuu

SEQ ID NO: 1625597 - RNA, 14 nt, Pseudomonas putida KT2440
cucuguuucugccc

SEQ ID NO: 1625598 - RNA, 19 nt, Pseudomonas putida KT2440
cugagcgacagcaucugca

SEQ ID NO: 1625599 - RNA, 16 nt, Pseudomonas putida KT2440
cugagcgccauccacc

SEQ ID NO: 1625600 - RNA, 17 nt, Pseudomonas putida KT2440
cugagcgccauccaccu

SEQ ID NO: 1625601 - RNA, 22 nt, Pseudomonas putida KT2440
cugagccuugucaguucugcuc

SEQ ID NO: 1625602 - RNA, 19 nt, Pseudomonas putida KT2440
cugagccuuguucgcgcag

SEQ ID NO: 1625603 - RNA, 20 nt, Pseudomonas putida KT2440
cugagccuuguucgcgcagg

SEQ ID NO: 1625604 - RNA, 17 nt, Pseudomonas putida KT2440
cugagccggucggagag

SEQ ID NO: 1625605 - RNA, 15 nt, Pseudomonas putida KT2440
cugagccaaggccgc

SEQ ID NO: 1625606 - RNA, 13 nt, Pseudomonas putida KT2440
cugagcagcggug

SEQ ID NO: 1625607 - RNA, 14 nt, Pseudomonas putida KT2440
cugagaccaguucu

SEQ ID NO: 1625608 - RNA, 19 nt, Pseudomonas putida KT2440
cugacuuccagcagcacac

SEQ ID NO: 1625609 - RNA, 12 nt, Pseudomonas putida KT2440
cugacugucucg

SEQ ID NO: 1625610 - RNA, 15 nt, Pseudomonas putida KT2440
cugacugugagcucu

SEQ ID NO: 1625611 - RNA, 21 nt, Pseudomonas putida KT2440
cugacugugagcucuacaccu

SEQ ID NO: 1625612 - RNA, 15 nt, Pseudomonas putida KT2440
cugacuggcagcaag

SEQ ID NO: 1625613 - RNA, 17 nt, Pseudomonas putida KT2440
cugacuggcagcaaggc

SEQ ID NO: 1625614 - RNA, 20 nt, Pseudomonas putida KT2440
cugacuggcagcaaggccau

SEQ ID NO: 1625615 - RNA, 18 nt, Pseudomonas putida KT2440
cugacgcagggccucgau

SEQ ID NO: 1625616 - RNA, 15 nt, Pseudomonas putida KT2440
cugaccuuggacagg

SEQ ID NO: 1625617 - RNA, 15 nt, Pseudomonas putida KT2440
cugaccuugcugcuc

SEQ ID NO: 1625618 - RNA, 16 nt, Pseudomonas putida KT2440
cugacgaagcgccugg

SEQ ID NO: 1625619 - RNA, 14 nt, Pseudomonas putida KT2440
cugacgaacaacgc

SEQ ID NO: 1625620 - RNA, 19 nt, Pseudomonas putida KT2440
cugacgaacaacgccaccg

SEQ ID NO: 1625621 - RNA, 19 nt, Pseudomonas putida KT2440
cugaccugugcugaauuuu

SEQ ID NO: 1625622 - RNA, 15 nt, Pseudomonas putida KT2440
cugacgggccucuuc

SEQ ID NO: 1625623 - RNA, 17 nt, Pseudomonas putida KT2440
cugacgcugcacuucca

SEQ ID NO: 1625624 - RNA, 22 nt, Pseudomonas putida KT2440
cugacgcugcacuuccacaccc

SEQ ID NO: 1625625 - RNA, 23 nt, Pseudomonas putida KT2440
cugacgcugcacuuccacacccg

SEQ ID NO: 1625626 - RNA, 18 nt, Pseudomonas putida KT2440
cugacgucuggaucugag

SEQ ID NO: 1625627 - RNA, 16 nt, Pseudomonas putida KT2440
cugacguaguccuugu

SEQ ID NO: 1625628 - RNA, 20 nt, Pseudomonas putida KT2440
cugacucgaccgccgcacag

SEQ ID NO: 1625629 - RNA, 21 nt, Pseudomonas putida KT2440
cugacucagcccugagggcuc

SEQ ID NO: 1625630 - RNA, 17 nt, Pseudomonas putida KT2440
cugacucagcggccuuu

SEQ ID NO: 1625631 - RNA, 22 nt, Pseudomonas putida KT2440
cugacucagcggccuuucugcu

SEQ ID NO: 1625632 - RNA, 20 nt, Pseudomonas putida KT2440
cugaagggccgaaaggugca

SEQ ID NO: 1625633 - RNA, 17 nt, Pseudomonas putida KT2440
cugaagcucuccagcag

SEQ ID NO: 1625634 - RNA, 18 nt, Pseudomonas putida KT2440
cugaaggccgcuccugcg

SEQ ID NO: 1625635 - RNA, 22 nt, Pseudomonas putida KT2440
cugaauacaccagcuugaugcu

SEQ ID NO: 1625636 - RNA, 21 nt, Pseudomonas putida KT2440
cugaauacagccaauggcaaa

SEQ ID NO: 1625637 - RNA, 18 nt, Pseudomonas putida KT2440
cugaaucagcaaaccgac

SEQ ID NO: 1625638 - RNA, 13 nt, Pseudomonas putida KT2440
cugaaucuggcuc

SEQ ID NO: 1625639 - RNA, 15 nt, Pseudomonas putida KT2440
cugaaucuggcucug

SEQ ID NO: 1625640 - RNA, 20 nt, Pseudomonas putida KT2440
cugaaucuggcucugcagcg

SEQ ID NO: 1625641 - RNA, 13 nt, Pseudomonas putida KT2440
cugaaugaaaaag

SEQ ID NO: 1625642 - RNA, 21 nt, Pseudomonas putida KT2440
cugaaugaaaaagccccgcca

SEQ ID NO: 1625643 - RNA, 23 nt, Pseudomonas putida KT2440
cugaauuggccggcgcugagcga

SEQ ID NO: 1625644 - RNA, 21 nt, Pseudomonas putida KT2440
cugaauugucggggaaaugcc

SEQ ID NO: 1625645 - RNA, 21 nt, Pseudomonas putida KT2440
cugaauucguauauguauuug

SEQ ID NO: 1625646 - RNA, 15 nt, Pseudomonas putida KT2440
cugaccaauccagcc

SEQ ID NO: 1625647 - RNA, 17 nt, Pseudomonas putida KT2440
cugaccaauccagcccu

SEQ ID NO: 1625648 - RNA, 16 nt, Pseudomonas putida KT2440
cugaccaacaggcugg

SEQ ID NO: 1625649 - RNA, 14 nt, Pseudomonas putida KT2440
cugaccagcccggc

SEQ ID NO: 1625650 - RNA, 13 nt, Pseudomonas putida KT2440
cugaccaguugcu

SEQ ID NO: 1625651 - RNA, 15 nt, Pseudomonas putida KT2440
cugaccauaccuccc

SEQ ID NO: 1625652 - RNA, 15 nt, Pseudomonas putida KT2440
cugacccucaagugc

SEQ ID NO: 1625653 - RNA, 21 nt, Pseudomonas putida KT2440
cugaccgggacgcaggcgcaa

SEQ ID NO: 1625654 - RNA, 23 nt, Pseudomonas putida KT2440
cugaccgaugaucugccgggcca

SEQ ID NO: 1625655 - RNA, 21 nt, Pseudomonas putida KT2440
cugaccgcgcauuugcuccag

SEQ ID NO: 1625656 - RNA, 16 nt, Pseudomonas putida KT2440
cugaccgccugcgcac

SEQ ID NO: 1625657 - RNA, 19 nt, Pseudomonas putida KT2440
cugacaggcgaucagucag

SEQ ID NO: 1625658 - RNA, 16 nt, Pseudomonas putida KT2440
cugacaaagccugcac

SEQ ID NO: 1625659 - RNA, 23 nt, Pseudomonas putida KT2440
cugacaaagccugcacccagcgu

SEQ ID NO: 1625660 - RNA, 20 nt, Pseudomonas putida KT2440
cucuccauugcgccugucac

SEQ ID NO: 1625661 - RNA, 21 nt, Pseudomonas putida KT2440
cucuccacguccacuaccucc

SEQ ID NO: 1625662 - RNA, 16 nt, Pseudomonas putida KT2440
cucuccgaggccgggc

SEQ ID NO: 1625663 - RNA, 18 nt, Pseudomonas putida KT2440
cucuccucucccaccagc

SEQ ID NO: 1625664 - RNA, 13 nt, Pseudomonas putida KT2440
cucucgucaccug

SEQ ID NO: 1625665 - RNA, 13 nt, Pseudomonas putida KT2440
cucugccgagagg

SEQ ID NO: 1625666 - RNA, 15 nt, Pseudomonas putida KT2440
cucugccgagaggau

SEQ ID NO: 1625667 - RNA, 24 nt, Pseudomonas putida KT2440
cucugccgcaccagguccaccagc

SEQ ID NO: 1625668 - RNA, 18 nt, Pseudomonas putida KT2440
cucugccgccccuccacc

SEQ ID NO: 1625669 - RNA, 14 nt, Pseudomonas putida KT2440
cucugaucaauuca

SEQ ID NO: 1625670 - RNA, 17 nt, Pseudomonas putida KT2440
cucugcaaugccgccaa

SEQ ID NO: 1625671 - RNA, 22 nt, Pseudomonas putida KT2440
cucugacauaacaagaacaaca

SEQ ID NO: 1625672 - RNA, 17 nt, Pseudomonas putida KT2440
cucugaacacaugccau

SEQ ID NO: 1625673 - RNA, 15 nt, Pseudomonas putida KT2440
cucugguacaacaac

SEQ ID NO: 1625674 - RNA, 22 nt, Pseudomonas putida KT2440
cucugguacaacaacaaaaaaa

SEQ ID NO: 1625675 - RNA, 20 nt, Pseudomonas putida KT2440
cucugcuucgggaauaccag

SEQ ID NO: 1625676 - RNA, 14 nt, Pseudomonas putida KT2440
cucugccugcccau

SEQ ID NO: 1625677 - RNA, 11 nt, Pseudomonas putida KT2440
cucugcugcuc

SEQ ID NO: 1625678 - RNA, 21 nt, Pseudomonas putida KT2440
cucugcugcucugccgccgca

SEQ ID NO: 1625679 - RNA, 22 nt, Pseudomonas putida KT2440
cucugcugcggauacagcgccc

SEQ ID NO: 1625680 - RNA, 14 nt, Pseudomonas putida KT2440
cucugcuccagcug

SEQ ID NO: 1625681 - RNA, 12 nt, Pseudomonas putida KT2440
cucugcggccuu

SEQ ID NO: 1625682 - RNA, 16 nt, Pseudomonas putida KT2440
cucgugggucaucuug

SEQ ID NO: 1625683 - RNA, 18 nt, Pseudomonas putida KT2440
cucgugggucaucuugcc

SEQ ID NO: 1625684 - RNA, 16 nt, Pseudomonas putida KT2440
cucguucgcgggcacg

SEQ ID NO: 1625685 - RNA, 15 nt, Pseudomonas putida KT2440
cucggugcugcugcc

SEQ ID NO: 1625686 - RNA, 13 nt, Pseudomonas putida KT2440
cucggugcuccuu

SEQ ID NO: 1625687 - RNA, 15 nt, Pseudomonas putida KT2440
cucgguggcucuccu

SEQ ID NO: 1625688 - RNA, 17 nt, Pseudomonas putida KT2440
cucgucaugcagcgcca

SEQ ID NO: 1625689 - RNA, 15 nt, Pseudomonas putida KT2440
cucgucagccccuag

SEQ ID NO: 1625690 - RNA, 16 nt, Pseudomonas putida KT2440
cucgucagccccuagc

SEQ ID NO: 1625691 - RNA, 19 nt, Pseudomonas putida KT2440
cucgucaauaccggugccc

SEQ ID NO: 1625692 - RNA, 17 nt, Pseudomonas putida KT2440
cucggcgaugccgcgcg

SEQ ID NO: 1625693 - RNA, 18 nt, Pseudomonas putida KT2440
cucgguacccgccagcaa

SEQ ID NO: 1625694 - RNA, 18 nt, Pseudomonas putida KT2440
cucgguaucggccagccg

SEQ ID NO: 1625695 - RNA, 23 nt, Pseudomonas putida KT2440
cucgggguagaacaagucgcgca

SEQ ID NO: 1625696 - RNA, 15 nt, Pseudomonas putida KT2440
cucggcguacuccag

SEQ ID NO: 1625697 - RNA, 22 nt, Pseudomonas putida KT2440
cucgggcuuggcuucggcggcu

SEQ ID NO: 1625698 - RNA, 15 nt, Pseudomonas putida KT2440
cucggcaaucugcuu

SEQ ID NO: 1625699 - RNA, 17 nt, Pseudomonas putida KT2440
cucggcaaucagcauca

SEQ ID NO: 1625700 - RNA, 17 nt, Pseudomonas putida KT2440
cucgcgauccaucuuca

SEQ ID NO: 1625701 - RNA, 14 nt, Pseudomonas putida KT2440
cucgccucacagcg

SEQ ID NO: 1625702 - RNA, 11 nt, Pseudomonas putida KT2440
cucggcacgcg

SEQ ID NO: 1625703 - RNA, 13 nt, Pseudomonas putida KT2440
cucggccacccgc

SEQ ID NO: 1625704 - RNA, 18 nt, Pseudomonas putida KT2440
cucggcauguucaucacc

SEQ ID NO: 1625705 - RNA, 14 nt, Pseudomonas putida KT2440
cucggccucagccg

SEQ ID NO: 1625706 - RNA, 18 nt, Pseudomonas putida KT2440
cucggccucagccggcuu

SEQ ID NO: 1625707 - RNA, 22 nt, Pseudomonas putida KT2440
cucggccguaaaguccgugccc

SEQ ID NO: 1625708 - RNA, 16 nt, Pseudomonas putida KT2440
cucggcgagccgccag

SEQ ID NO: 1625709 - RNA, 20 nt, Pseudomonas putida KT2440
cucggccuugucuggcacca

SEQ ID NO: 1625710 - RNA, 21 nt, Pseudomonas putida KT2440
cucgaucaugcggcaagccaa

SEQ ID NO: 1625711 - RNA, 17 nt, Pseudomonas putida KT2440
cucgacgcgcgcagccu

SEQ ID NO: 1625712 - RNA, 22 nt, Pseudomonas putida KT2440
cucgacgcggacccggcauccu

SEQ ID NO: 1625713 - RNA, 17 nt, Pseudomonas putida KT2440
cucgagcccgccagcag

SEQ ID NO: 1625714 - RNA, 16 nt, Pseudomonas putida KT2440
cucgaucugccugccu

SEQ ID NO: 1625715 - RNA, 21 nt, Pseudomonas putida KT2440
cucgaugaagucgcacaugaa

SEQ ID NO: 1625716 - RNA, 15 nt, Pseudomonas putida KT2440
cucgaucccgccgcc

SEQ ID NO: 1625717 - RNA, 16 nt, Pseudomonas putida KT2440
cucgaucucacaggcg

SEQ ID NO: 1625718 - RNA, 18 nt, Pseudomonas putida KT2440
cucgaugcccuccagccc

SEQ ID NO: 1625719 - RNA, 20 nt, Pseudomonas putida KT2440
cucgcacgcauguccuuggc

SEQ ID NO: 1625720 - RNA, 22 nt, Pseudomonas putida KT2440
cucgcacgcauguccuuggccc

SEQ ID NO: 1625721 - RNA, 13 nt, Pseudomonas putida KT2440
cucgcacuccgcc

SEQ ID NO: 1625722 - RNA, 12 nt, Pseudomonas putida KT2440
cucgcagcagca

SEQ ID NO: 1625723 - RNA, 21 nt, Pseudomonas putida KT2440
cucgcccgcgaagaagcuaac

SEQ ID NO: 1625724 - RNA, 21 nt, Pseudomonas putida KT2440
cucgcccggcacggcgugcuc

SEQ ID NO: 1625725 - RNA, 19 nt, Pseudomonas putida KT2440
cucgcccuuguccaugaag

SEQ ID NO: 1625726 - RNA, 22 nt, Pseudomonas putida KT2440
cucgccgcccaguggcacacca

SEQ ID NO: 1625727 - RNA, 16 nt, Pseudomonas putida KT2440
cucgaacgcugugccg

SEQ ID NO: 1625728 - RNA, 22 nt, Pseudomonas putida KT2440
cucgaagcugccacugcgcgca

SEQ ID NO: 1625729 - RNA, 23 nt, Pseudomonas putida KT2440
cucgaacuugcccggggugcaga

SEQ ID NO: 1625730 - RNA, 16 nt, Pseudomonas putida KT2440
cucgaacucaugcucc

SEQ ID NO: 1625731 - RNA, 19 nt, Pseudomonas putida KT2440
cucgaacugaugaccggcc

SEQ ID NO: 1625732 - RNA, 23 nt, Pseudomonas putida KT2440
cucgaacugaugaccggccuggu

SEQ ID NO: 1625733 - RNA, 21 nt, Pseudomonas putida KT2440
cucgaauacacgggacaggcu

SEQ ID NO: 1625734 - RNA, 18 nt, Pseudomonas putida KT2440
cucgaaugccgcugcugg

SEQ ID NO: 1625735 - RNA, 18 nt, Pseudomonas putida KT2440
cuccuuggacagcaauuc

SEQ ID NO: 1625736 - RNA, 23 nt, Pseudomonas putida KT2440
cuccuugauguacuccugcacca

SEQ ID NO: 1625737 - RNA, 11 nt, Pseudomonas putida KT2440
cuccuugagau

SEQ ID NO: 1625738 - RNA, 15 nt, Pseudomonas putida KT2440
cuccuggccgcccgc

SEQ ID NO: 1625739 - RNA, 16 nt, Pseudomonas putida KT2440
cuccugggcuggccuu

SEQ ID NO: 1625740 - RNA, 20 nt, Pseudomonas putida KT2440
cuccuggcucaguggcugca

SEQ ID NO: 1625741 - RNA, 15 nt, Pseudomonas putida KT2440
cuccugugccggccu

SEQ ID NO: 1625742 - RNA, 17 nt, Pseudomonas putida KT2440
cuccugcuggucgcagu

SEQ ID NO: 1625743 - RNA, 14 nt, Pseudomonas putida KT2440
cuccugcugcagcu

SEQ ID NO: 1625744 - RNA, 12 nt, Pseudomonas putida KT2440
cuccugcugcug

SEQ ID NO: 1625745 - RNA, 23 nt, Pseudomonas putida KT2440
cuccugaacggugaagucaacca

SEQ ID NO: 1625746 - RNA, 15 nt, Pseudomonas putida KT2440
cuccugcgcaugcaa

SEQ ID NO: 1625747 - RNA, 13 nt, Pseudomonas putida KT2440
cuccugcgccacc

SEQ ID NO: 1625748 - RNA, 21 nt, Pseudomonas putida KT2440
cuccggcaaggcauccagaaa

SEQ ID NO: 1625749 - RNA, 17 nt, Pseudomonas putida KT2440
cuccggaucguugcggg

SEQ ID NO: 1625750 - RNA, 12 nt, Pseudomonas putida KT2440
cuccguguccgu

SEQ ID NO: 1625751 - RNA, 19 nt, Pseudomonas putida KT2440
cuccgguucugccggggca

SEQ ID NO: 1625752 - RNA, 14 nt, Pseudomonas putida KT2440
cucccggcauugcc

SEQ ID NO: 1625753 - RNA, 13 nt, Pseudomonas putida KT2440
cuccgaggccggg

SEQ ID NO: 1625754 - RNA, 15 nt, Pseudomonas putida KT2440
cuccgcgagcauuca

SEQ ID NO: 1625755 - RNA, 20 nt, Pseudomonas putida KT2440
cuccgccuaccgcgucgcca

SEQ ID NO: 1625756 - RNA, 17 nt, Pseudomonas putida KT2440
cuccacaaucucgcccu

SEQ ID NO: 1625757 - RNA, 23 nt, Pseudomonas putida KT2440
cuccacaauguagucgucggccg

SEQ ID NO: 1625758 - RNA, 11 nt, Pseudomonas putida KT2440
cuccaccacca

SEQ ID NO: 1625759 - RNA, 13 nt, Pseudomonas putida KT2440
cuccaccaccacu

SEQ ID NO: 1625760 - RNA, 20 nt, Pseudomonas putida KT2440
cuccaccagcccaccgagcu

SEQ ID NO: 1625761 - RNA, 18 nt, Pseudomonas putida KT2440
cuccaccgauccuuggcg

SEQ ID NO: 1625762 - RNA, 19 nt, Pseudomonas putida KT2440
cuccaccgauccuuggcga

SEQ ID NO: 1625763 - RNA, 17 nt, Pseudomonas putida KT2440
cuccaccccgcaggccg

SEQ ID NO: 1625764 - RNA, 18 nt, Pseudomonas putida KT2440
cuccaccccgcaggccgc

SEQ ID NO: 1625765 - RNA, 12 nt, Pseudomonas putida KT2440
cuccaccccuuc

SEQ ID NO: 1625766 - RNA, 17 nt, Pseudomonas putida KT2440
cuccacccaccuuggcc

SEQ ID NO: 1625767 - RNA, 18 nt, Pseudomonas putida KT2440
cuccacccaccuuggccc

SEQ ID NO: 1625768 - RNA, 18 nt, Pseudomonas putida KT2440
cuccacccggucccgccc

SEQ ID NO: 1625769 - RNA, 16 nt, Pseudomonas putida KT2440
cuccccucagacagag

SEQ ID NO: 1625770 - RNA, 15 nt, Pseudomonas putida KT2440
cugugcuggccucuu

SEQ ID NO: 1625771 - RNA, 21 nt, Pseudomonas putida KT2440
cugugcuggggccagccggcg

SEQ ID NO: 1625772 - RNA, 14 nt, Pseudomonas putida KT2440
cuguggaagcgggc

SEQ ID NO: 1625773 - RNA, 14 nt, Pseudomonas putida KT2440
cuguggguaacccu

SEQ ID NO: 1625774 - RNA, 16 nt, Pseudomonas putida KT2440
cugugggagcggccuu

SEQ ID NO: 1625775 - RNA, 18 nt, Pseudomonas putida KT2440
cugugggagcggccuugc

SEQ ID NO: 1625776 - RNA, 20 nt, Pseudomonas putida KT2440
cugugggagcgggcaugccc

SEQ ID NO: 1625777 - RNA, 19 nt, Pseudomonas putida KT2440
cugugggagcgggcgugcc

SEQ ID NO: 1625778 - RNA, 22 nt, Pseudomonas putida KT2440
cugugggagcgggggcgcguca

SEQ ID NO: 1625779 - RNA, 20 nt, Pseudomonas putida KT2440
cuguggcagcggcuuggccg

SEQ ID NO: 1625780 - RNA, 15 nt, Pseudomonas putida KT2440
cugugguggcugcuu

SEQ ID NO: 1625781 - RNA, 23 nt, Pseudomonas putida KT2440
cuguguuuucccaauccucagcg

SEQ ID NO: 1625782 - RNA, 23 nt, Pseudomonas putida KT2440
cugugcccugaucgccuccaggc

SEQ ID NO: 1625783 - RNA, 19 nt, Pseudomonas putida KT2440
cugugccgcuuuggcagca

SEQ ID NO: 1625784 - RNA, 13 nt, Pseudomonas putida KT2440
cugugccggccgc

SEQ ID NO: 1625785 - RNA, 15 nt, Pseudomonas putida KT2440
cugugccggccucuu

SEQ ID NO: 1625786 - RNA, 14 nt, Pseudomonas putida KT2440
cugugccgggccau

SEQ ID NO: 1625787 - RNA, 16 nt, Pseudomonas putida KT2440
cugugcaacagcgccu

SEQ ID NO: 1625788 - RNA, 18 nt, Pseudomonas putida KT2440
cugugcaacagcgccugg

SEQ ID NO: 1625789 - RNA, 20 nt, Pseudomonas putida KT2440
cugugcacccgugccugccu

SEQ ID NO: 1625790 - RNA, 21 nt, Pseudomonas putida KT2440
cugugcacccgugccugccug

SEQ ID NO: 1625791 - RNA, 16 nt, Pseudomonas putida KT2440
cugugcaugcgccccc

SEQ ID NO: 1625792 - RNA, 18 nt, Pseudomonas putida KT2440
cugugcauguccagucag

SEQ ID NO: 1625793 - RNA, 15 nt, Pseudomonas putida KT2440
cugugcagcgaccau

SEQ ID NO: 1625794 - RNA, 19 nt, Pseudomonas putida KT2440
cugugcagcgaccaucacc

SEQ ID NO: 1625795 - RNA, 20 nt, Pseudomonas putida KT2440
cuguccggcgugaaauccuc

SEQ ID NO: 1625796 - RNA, 21 nt, Pseudomonas putida KT2440
cuguccggcgugaaauccuca

SEQ ID NO: 1625797 - RNA, 19 nt, Pseudomonas putida KT2440
cugucgaagcgcucccagg

SEQ ID NO: 1625798 - RNA, 21 nt, Pseudomonas putida KT2440
cugucgaagcgcucccaggcc

SEQ ID NO: 1625799 - RNA, 23 nt, Pseudomonas putida KT2440
cugucgauuuccagugccgccac

SEQ ID NO: 1625800 - RNA, 12 nt, Pseudomonas putida KT2440
cugucuucuuuc

SEQ ID NO: 1625801 - RNA, 20 nt, Pseudomonas putida KT2440
cugugaaugcgaugguggcu

SEQ ID NO: 1625802 - RNA, 20 nt, Pseudomonas putida KT2440
cugugaagccagggcaagca

SEQ ID NO: 1625803 - RNA, 14 nt, Pseudomonas putida KT2440
cuguacugcggcug

SEQ ID NO: 1625804 - RNA, 20 nt, Pseudomonas putida KT2440
cuguaaucaggcuguccaca

SEQ ID NO: 1625805 - RNA, 18 nt, Pseudomonas putida KT2440
cuguccagauuacaaaag

SEQ ID NO: 1625806 - RNA, 13 nt, Pseudomonas putida KT2440
cuguccagcaagg

SEQ ID NO: 1625807 - RNA, 19 nt, Pseudomonas putida KT2440
cuguccagcaagggccugu

SEQ ID NO: 1625808 - RNA, 12 nt, Pseudomonas putida KT2440
cuguccaggcaa

SEQ ID NO: 1625809 - RNA, 17 nt, Pseudomonas putida KT2440
cuguaugauucgccucc

SEQ ID NO: 1625810 - RNA, 15 nt, Pseudomonas putida KT2440
cuggugucggccagg

SEQ ID NO: 1625811 - RNA, 12 nt, Pseudomonas putida KT2440
cugguggccacg

SEQ ID NO: 1625812 - RNA, 22 nt, Pseudomonas putida KT2440
cuggguuuuuuuaugggcagca

SEQ ID NO: 1625813 - RNA, 23 nt, Pseudomonas putida KT2440
cuggguuuauuucucuuccuggc

SEQ ID NO: 1625814 - RNA, 15 nt, Pseudomonas putida KT2440
cugggucagcgcuga

SEQ ID NO: 1625815 - RNA, 21 nt, Pseudomonas putida KT2440
cuggguauagguccagcucug

SEQ ID NO: 1625816 - RNA, 17 nt, Pseudomonas putida KT2440
cugggucacccagguga

SEQ ID NO: 1625817 - RNA, 23 nt, Pseudomonas putida KT2440
cugguuacccaacagaccaccug

SEQ ID NO: 1625818 - RNA, 23 nt, Pseudomonas putida KT2440
cugguguugaccucugguuuugu

SEQ ID NO: 1625819 - RNA, 16 nt, Pseudomonas putida KT2440
cugguguggcgccagg

SEQ ID NO: 1625820 - RNA, 14 nt, Pseudomonas putida KT2440
cugguucugcugca

SEQ ID NO: 1625821 - RNA, 18 nt, Pseudomonas putida KT2440
cugguugcccaugcacag

SEQ ID NO: 1625822 - RNA, 21 nt, Pseudomonas putida KT2440
cugguugcguucgucgauguc

SEQ ID NO: 1625823 - RNA, 20 nt, Pseudomonas putida KT2440
cugguuguagcccgggcagc

SEQ ID NO: 1625824 - RNA, 21 nt, Pseudomonas putida KT2440
cugguuugaggaaugugugca

SEQ ID NO: 1625825 - RNA, 23 nt, Pseudomonas putida KT2440
cugggccggugggcaacagcugc

SEQ ID NO: 1625826 - RNA, 18 nt, Pseudomonas putida KT2440
cugggcccgcccagcugg

SEQ ID NO: 1625827 - RNA, 20 nt, Pseudomonas putida KT2440
cugggcccgcccagcuggcu

SEQ ID NO: 1625828 - RNA, 21 nt, Pseudomonas putida KT2440
cugggccaguaccuucuggcu

SEQ ID NO: 1625829 - RNA, 18 nt, Pseudomonas putida KT2440
cugggcgugccaggcuug

SEQ ID NO: 1625830 - RNA, 19 nt, Pseudomonas putida KT2440
cugggcgugccaggcuugg

SEQ ID NO: 1625831 - RNA, 16 nt, Pseudomonas putida KT2440
cuggggcuucugccgg

SEQ ID NO: 1625832 - RNA, 15 nt, Pseudomonas putida KT2440
cugggguuggaccca

SEQ ID NO: 1625833 - RNA, 20 nt, Pseudomonas putida KT2440
cugggcaagggccugcaggc

SEQ ID NO: 1625834 - RNA, 23 nt, Pseudomonas putida KT2440
cugggcaaaaucgaccagggccu

SEQ ID NO: 1625835 - RNA, 13 nt, Pseudomonas putida KT2440
cugggcauccagc

SEQ ID NO: 1625836 - RNA, 20 nt, Pseudomonas putida KT2440
cugggcauccagcuugccac

SEQ ID NO: 1625837 - RNA, 21 nt, Pseudomonas putida KT2440
cugggcaauguucgcugccag

SEQ ID NO: 1625838 - RNA, 17 nt, Pseudomonas putida KT2440
cugggaauccagugcag

SEQ ID NO: 1625839 - RNA, 20 nt, Pseudomonas putida KT2440
cugggaaaccgugucgggca

SEQ ID NO: 1625840 - RNA, 15 nt, Pseudomonas putida KT2440
cuggcgccagccgcc

SEQ ID NO: 1625841 - RNA, 14 nt, Pseudomonas putida KT2440
cuggcgcccggcau

SEQ ID NO: 1625842 - RNA, 22 nt, Pseudomonas putida KT2440
cuggcgcacguacuccaccaag

SEQ ID NO: 1625843 - RNA, 17 nt, Pseudomonas putida KT2440
cuggcgcagcaggucca

SEQ ID NO: 1625844 - RNA, 23 nt, Pseudomonas putida KT2440
cuggcgcagcagguccagcuccg

SEQ ID NO: 1625845 - RNA, 21 nt, Pseudomonas putida KT2440
cuggcgcaguucguccaggcu

SEQ ID NO: 1625846 - RNA, 19 nt, Pseudomonas putida KT2440
cuggcgcaggaagucuucc

SEQ ID NO: 1625847 - RNA, 23 nt, Pseudomonas putida KT2440
cuggcgcaggaagucuuccuggu

SEQ ID NO: 1625848 - RNA, 19 nt, Pseudomonas putida KT2440
cuggcucgcugccccaguc

SEQ ID NO: 1625849 - RNA, 16 nt, Pseudomonas putida KT2440
cuggcucgaucacgaa

SEQ ID NO: 1625850 - RNA, 24 nt, Pseudomonas putida KT2440
cuggcucaguggcugcacuucgau

SEQ ID NO: 1625851 - RNA, 19 nt, Pseudomonas putida KT2440
cuggcuauccuucugccgu

SEQ ID NO: 1625852 - RNA, 16 nt, Pseudomonas putida KT2440
cuggcugucgaaggcu

SEQ ID NO: 1625853 - RNA, 20 nt, Pseudomonas putida KT2440
cuggcugucgaaggcuugca

SEQ ID NO: 1625854 - RNA, 23 nt, Pseudomonas putida KT2440
cuggcuuacaucaugccgcccau

SEQ ID NO: 1625855 - RNA, 17 nt, Pseudomonas putida KT2440
cuggcuuucccccagcc

SEQ ID NO: 1625856 - RNA, 18 nt, Pseudomonas putida KT2440
cuggcuuucccccagcca

SEQ ID NO: 1625857 - RNA, 14 nt, Pseudomonas putida KT2440
cuggcuuccucuuc

SEQ ID NO: 1625858 - RNA, 16 nt, Pseudomonas putida KT2440
cuggcuuccucuucaa

SEQ ID NO: 1625859 - RNA, 16 nt, Pseudomonas putida KT2440
cuggcuuccucacggc

SEQ ID NO: 1625860 - RNA, 17 nt, Pseudomonas putida KT2440
cuggcuguaccggccuc

SEQ ID NO: 1625861 - RNA, 13 nt, Pseudomonas putida KT2440
cuggcucuucaac

SEQ ID NO: 1625862 - RNA, 19 nt, Pseudomonas putida KT2440
cuggcucuucaacaccagc

SEQ ID NO: 1625863 - RNA, 18 nt, Pseudomonas putida KT2440
cuggcugaccagugucug

SEQ ID NO: 1625864 - RNA, 22 nt, Pseudomonas putida KT2440
cuggcugcaagguccaggcgug

SEQ ID NO: 1625865 - RNA, 16 nt, Pseudomonas putida KT2440
cuggcugcacugggcg

SEQ ID NO: 1625866 - RNA, 21 nt, Pseudomonas putida KT2440
cuggcugaucucacggccauc

SEQ ID NO: 1625867 - RNA, 12 nt, Pseudomonas putida KT2440
cuggcugcugcg

SEQ ID NO: 1625868 - RNA, 20 nt, Pseudomonas putida KT2440
cuggccauaguugaccagca

SEQ ID NO: 1625869 - RNA, 18 nt, Pseudomonas putida KT2440
cuggccagcagauggcuc

SEQ ID NO: 1625870 - RNA, 20 nt, Pseudomonas putida KT2440
cuggccagcaagugccccug

SEQ ID NO: 1625871 - RNA, 11 nt, Pseudomonas putida KT2440
cuggcccuucg

SEQ ID NO: 1625872 - RNA, 13 nt, Pseudomonas putida KT2440
cuggcccuugcca

SEQ ID NO: 1625873 - RNA, 14 nt, Pseudomonas putida KT2440
cuggcccuugccau

SEQ ID NO: 1625874 - RNA, 20 nt, Pseudomonas putida KT2440
cuggccaucgacccgcugcc

SEQ ID NO: 1625875 - RNA, 22 nt, Pseudomonas putida KT2440
cuggccauugaccuuggugauc

SEQ ID NO: 1625876 - RNA, 21 nt, Pseudomonas putida KT2440
cuggccacuguugcagcgcca

SEQ ID NO: 1625877 - RNA, 14 nt, Pseudomonas putida KT2440
cuggcagcgggcug

SEQ ID NO: 1625878 - RNA, 12 nt, Pseudomonas putida KT2440
cuggcagccgcc

SEQ ID NO: 1625879 - RNA, 15 nt, Pseudomonas putida KT2440
cuggcagcaaggcca

SEQ ID NO: 1625880 - RNA, 15 nt, Pseudomonas putida KT2440
cuggcacgcccggca

SEQ ID NO: 1625881 - RNA, 12 nt, Pseudomonas putida KT2440
cuggcacugaca

SEQ ID NO: 1625882 - RNA, 17 nt, Pseudomonas putida KT2440
cuggcacucucgcggug

SEQ ID NO: 1625883 - RNA, 14 nt, Pseudomonas putida KT2440
cuggccgccuccca

SEQ ID NO: 1625884 - RNA, 14 nt, Pseudomonas putida KT2440
cuggccgccacggu

SEQ ID NO: 1625885 - RNA, 19 nt, Pseudomonas putida KT2440
cuggccgcugcgcccgccu

SEQ ID NO: 1625886 - RNA, 15 nt, Pseudomonas putida KT2440
cuggccgguguggcc

SEQ ID NO: 1625887 - RNA, 17 nt, Pseudomonas putida KT2440
cuggccuugcggcaagc

SEQ ID NO: 1625888 - RNA, 17 nt, Pseudomonas putida KT2440
cuggccuuggacaccag

SEQ ID NO: 1625889 - RNA, 19 nt, Pseudomonas putida KT2440
cuggcgaauacgcucagcc

SEQ ID NO: 1625890 - RNA, 18 nt, Pseudomonas putida KT2440
cuggcgcaaucuugccac

SEQ ID NO: 1625891 - RNA, 17 nt, Pseudomonas putida KT2440
cuggauaugcuccaugu

SEQ ID NO: 1625892 - RNA, 16 nt, Pseudomonas putida KT2440
cugcuucgcgggcacg

SEQ ID NO: 1625893 - RNA, 18 nt, Pseudomonas putida KT2440
cugcuucgggaauaccag

SEQ ID NO: 1625894 - RNA, 15 nt, Pseudomonas putida KT2440
cugcuucugagccag

SEQ ID NO: 1625895 - RNA, 14 nt, Pseudomonas putida KT2440
cugcuucaggccuu

SEQ ID NO: 1625896 - RNA, 16 nt, Pseudomonas putida KT2440
cugcuuaccagcuugg

SEQ ID NO: 1625897 - RNA, 18 nt, Pseudomonas putida KT2440
cuggcaacccgccuccug

SEQ ID NO: 1625898 - RNA, 15 nt, Pseudomonas putida KT2440
cuggaucugaugcuu

SEQ ID NO: 1625899 - RNA, 19 nt, Pseudomonas putida KT2440
cuggaugauccagcccacc

SEQ ID NO: 1625900 - RNA, 21 nt, Pseudomonas putida KT2440
cuggaugacgccgcagccggg

SEQ ID NO: 1625901 - RNA, 13 nt, Pseudomonas putida KT2440
cuggaugaagccc

SEQ ID NO: 1625902 - RNA, 17 nt, Pseudomonas putida KT2440
cugcucgcccgcccgcu

SEQ ID NO: 1625903 - RNA, 16 nt, Pseudomonas putida KT2440
cugcgucgacucuucc

SEQ ID NO: 1625904 - RNA, 22 nt, Pseudomonas putida KT2440
cugcgucgacucuucccaccac

SEQ ID NO: 1625905 - RNA, 15 nt, Pseudomonas putida KT2440
cugcuccagcugcuc

SEQ ID NO: 1625906 - RNA, 20 nt, Pseudomonas putida KT2440
cugcuccaggcagccugcca

SEQ ID NO: 1625907 - RNA, 17 nt, Pseudomonas putida KT2440
cugcuccaugggcaggc

SEQ ID NO: 1625908 - RNA, 20 nt, Pseudomonas putida KT2440
cugcuccaugggcaggccca

SEQ ID NO: 1625909 - RNA, 14 nt, Pseudomonas putida KT2440
cugcucccccaggc

SEQ ID NO: 1625910 - RNA, 15 nt, Pseudomonas putida KT2440
cugcuccggccggcc

SEQ ID NO: 1625911 - RNA, 15 nt, Pseudomonas putida KT2440
cugcucgcucaggcu

SEQ ID NO: 1625912 - RNA, 16 nt, Pseudomonas putida KT2440
cugcucgcuggcuugu

SEQ ID NO: 1625913 - RNA, 16 nt, Pseudomonas putida KT2440
cugcucgucguccucg

SEQ ID NO: 1625914 - RNA, 21 nt, Pseudomonas putida KT2440
cugcugaccucgacccgcccg

SEQ ID NO: 1625915 - RNA, 13 nt, Pseudomonas putida KT2440
cugcucucggcgc

SEQ ID NO: 1625916 - RNA, 20 nt, Pseudomonas putida KT2440
cugcucuaccaacugagcua

SEQ ID NO: 1625917 - RNA, 13 nt, Pseudomonas putida KT2440
cugcucuucgccg

SEQ ID NO: 1625918 - RNA, 17 nt, Pseudomonas putida KT2440
cugcucugccgccgcag

SEQ ID NO: 1625919 - RNA, 14 nt, Pseudomonas putida KT2440
cugcugcuggcacg

SEQ ID NO: 1625920 - RNA, 14 nt, Pseudomonas putida KT2440
cugcugcucguuga

SEQ ID NO: 1625921 - RNA, 15 nt, Pseudomonas putida KT2440
cugcugcgucagcau

SEQ ID NO: 1625922 - RNA, 13 nt, Pseudomonas putida KT2440
cugcugcucccca

SEQ ID NO: 1625923 - RNA, 20 nt, Pseudomonas putida KT2440
cugcugcggauacagcgccc

SEQ ID NO: 1625924 - RNA, 23 nt, Pseudomonas putida KT2440
cugcugcggcaccucguccaggu

SEQ ID NO: 1625925 - RNA, 17 nt, Pseudomonas putida KT2440
cugcugcggcaggcugg

SEQ ID NO: 1625926 - RNA, 23 nt, Pseudomonas putida KT2440
cugcugcccguugcgcaucaccu

SEQ ID NO: 1625927 - RNA, 14 nt, Pseudomonas putida KT2440
cugcugccaggccg

SEQ ID NO: 1625928 - RNA, 16 nt, Pseudomonas putida KT2440
cugcugccauccuuga

SEQ ID NO: 1625929 - RNA, 20 nt, Pseudomonas putida KT2440
cugcugccauccuugaagaa

SEQ ID NO: 1625930 - RNA, 22 nt, Pseudomonas putida KT2440
cugcugccauccuugaagaaca

SEQ ID NO: 1625931 - RNA, 15 nt, Pseudomonas putida KT2440
cugcugcgcagcccc

SEQ ID NO: 1625932 - RNA, 14 nt, Pseudomonas putida KT2440
cugcugcagcuccg

SEQ ID NO: 1625933 - RNA, 19 nt, Pseudomonas putida KT2440
cugcugcaggcucugaaug

SEQ ID NO: 1625934 - RNA, 19 nt, Pseudomonas putida KT2440
cugcugcagcacugccugc

SEQ ID NO: 1625935 - RNA, 16 nt, Pseudomonas putida KT2440
cugcugcagccaaccu

SEQ ID NO: 1625936 - RNA, 19 nt, Pseudomonas putida KT2440
cugcugcagccaaccuuca

SEQ ID NO: 1625937 - RNA, 16 nt, Pseudomonas putida KT2440
cugcugguacagccgg

SEQ ID NO: 1625938 - RNA, 22 nt, Pseudomonas putida KT2440
cugcuguaaaugaaaacgcccc

SEQ ID NO: 1625939 - RNA, 16 nt, Pseudomonas putida KT2440
cugcugugcggcuggc

SEQ ID NO: 1625940 - RNA, 18 nt, Pseudomonas putida KT2440
cugcugugcggcuggcgu

SEQ ID NO: 1625941 - RNA, 17 nt, Pseudomonas putida KT2440
cugcuguggaacagccu

SEQ ID NO: 1625942 - RNA, 23 nt, Pseudomonas putida KT2440
cugcuggcccgcgaugccgacag

SEQ ID NO: 1625943 - RNA, 20 nt, Pseudomonas putida KT2440
cugcuggccgcgcaggaaga

SEQ ID NO: 1625944 - RNA, 14 nt, Pseudomonas putida KT2440
cugcuggcacgccu

SEQ ID NO: 1625945 - RNA, 21 nt, Pseudomonas putida KT2440
cugcugggcgaugaucgccug

SEQ ID NO: 1625946 - RNA, 17 nt, Pseudomonas putida KT2440
cugcugggcgucggcaa

SEQ ID NO: 1625947 - RNA, 15 nt, Pseudomonas putida KT2440
cugcuggauacccag

SEQ ID NO: 1625948 - RNA, 17 nt, Pseudomonas putida KT2440
cugcugcuucucaagcc

SEQ ID NO: 1625949 - RNA, 15 nt, Pseudomonas putida KT2440
cugccuucgcucagg

SEQ ID NO: 1625950 - RNA, 13 nt, Pseudomonas putida KT2440
cugccuucucugu

SEQ ID NO: 1625951 - RNA, 23 nt, Pseudomonas putida KT2440
cugccuuccaaccagccagccac

SEQ ID NO: 1625952 - RNA, 22 nt, Pseudomonas putida KT2440
cugcgaaacgaaacccugcugg

SEQ ID NO: 1625953 - RNA, 23 nt, Pseudomonas putida KT2440
cugcgaaacgaaacccugcuggg

SEQ ID NO: 1625954 - RNA, 18 nt, Pseudomonas putida KT2440
cugcgaagcccaguucgc

SEQ ID NO: 1625955 - RNA, 15 nt, Pseudomonas putida KT2440
cugccuugcccagcu

SEQ ID NO: 1625956 - RNA, 14 nt, Pseudomonas putida KT2440
cugccuugcccugc

SEQ ID NO: 1625957 - RNA, 21 nt, Pseudomonas putida KT2440
cugccuuuggccgccagcggc

SEQ ID NO: 1625958 - RNA, 18 nt, Pseudomonas putida KT2440
cugccuuuuccugcugca

SEQ ID NO: 1625959 - RNA, 23 nt, Pseudomonas putida KT2440
cugccgccuuggcagccucgucc

SEQ ID NO: 1625960 - RNA, 20 nt, Pseudomonas putida KT2440
cugccgccgcagcaaucugc

SEQ ID NO: 1625961 - RNA, 16 nt, Pseudomonas putida KT2440
cugccgccccuccacc

SEQ ID NO: 1625962 - RNA, 17 nt, Pseudomonas putida KT2440
cugccgccccuccaccc

SEQ ID NO: 1625963 - RNA, 13 nt, Pseudomonas putida KT2440
cugccgcagcugg

SEQ ID NO: 1625964 - RNA, 13 nt, Pseudomonas putida KT2440
cugcgaguucagg

SEQ ID NO: 1625965 - RNA, 20 nt, Pseudomonas putida KT2440
cugcgaaugggcugcaaagc

SEQ ID NO: 1625966 - RNA, 16 nt, Pseudomonas putida KT2440
cugcgaccacacugcu

SEQ ID NO: 1625967 - RNA, 23 nt, Pseudomonas putida KT2440
cugcgauuuaugcuugcgggccc

SEQ ID NO: 1625968 - RNA, 20 nt, Pseudomonas putida KT2440
cugcgauugcgauccgcccc

SEQ ID NO: 1625969 - RNA, 16 nt, Pseudomonas putida KT2440
cugcgcacggaaggca

SEQ ID NO: 1625970 - RNA, 15 nt, Pseudomonas putida KT2440
cugcgccacggcgcu

SEQ ID NO: 1625971 - RNA, 14 nt, Pseudomonas putida KT2440
cugcgccgcucugc

SEQ ID NO: 1625972 - RNA, 15 nt, Pseudomonas putida KT2440
cugcgccgccuccac

SEQ ID NO: 1625973 - RNA, 18 nt, Pseudomonas putida KT2440
cugcgccaggcauugcuc

SEQ ID NO: 1625974 - RNA, 20 nt, Pseudomonas putida KT2440
cugcgcugagaccgaggggc

SEQ ID NO: 1625975 - RNA, 14 nt, Pseudomonas putida KT2440
cugcgcuggccaau

SEQ ID NO: 1625976 - RNA, 13 nt, Pseudomonas putida KT2440
cugcgcuccagca

SEQ ID NO: 1625977 - RNA, 14 nt, Pseudomonas putida KT2440
cugcgcuccagcag

SEQ ID NO: 1625978 - RNA, 14 nt, Pseudomonas putida KT2440
cugcgcucaaccag

SEQ ID NO: 1625979 - RNA, 17 nt, Pseudomonas putida KT2440
cugcggcacaccacgcc

SEQ ID NO: 1625980 - RNA, 15 nt, Pseudomonas putida KT2440
cugcggcaggcuggc

SEQ ID NO: 1625981 - RNA, 18 nt, Pseudomonas putida KT2440
cugcggcagguaggccca

SEQ ID NO: 1625982 - RNA, 21 nt, Pseudomonas putida KT2440
cugcggcaugaaggcccagcu

SEQ ID NO: 1625983 - RNA, 16 nt, Pseudomonas putida KT2440
cugcggccaccgccuc

SEQ ID NO: 1625984 - RNA, 13 nt, Pseudomonas putida KT2440
cugcggccgcgcc

SEQ ID NO: 1625985 - RNA, 23 nt, Pseudomonas putida KT2440
cugcggccuucaagcuccccagc

SEQ ID NO: 1625986 - RNA, 13 nt, Pseudomonas putida KT2440
cugcggcgaaagc

SEQ ID NO: 1625987 - RNA, 19 nt, Pseudomonas putida KT2440
cugcggcgugcgcccggca

SEQ ID NO: 1625988 - RNA, 23 nt, Pseudomonas putida KT2440
cugcggcugcucgaucagguuga

SEQ ID NO: 1625989 - RNA, 16 nt, Pseudomonas putida KT2440
cugaugagguuugcca

SEQ ID NO: 1625990 - RNA, 16 nt, Pseudomonas putida KT2440
cugaugcccaugccaa

SEQ ID NO: 1625991 - RNA, 19 nt, Pseudomonas putida KT2440
cugaugccuuguaccgaga

SEQ ID NO: 1625992 - RNA, 12 nt, Pseudomonas putida KT2440
cugaugcagcag

SEQ ID NO: 1625993 - RNA, 22 nt, Pseudomonas putida KT2440
cugaugcagcagugccagcaac

SEQ ID NO: 1625994 - RNA, 15 nt, Pseudomonas putida KT2440
cugauggauuccucg

SEQ ID NO: 1625995 - RNA, 22 nt, Pseudomonas putida KT2440
cugaugguggucggcagcucaa

SEQ ID NO: 1625996 - RNA, 14 nt, Pseudomonas putida KT2440
cugcacccgccagc

SEQ ID NO: 1625997 - RNA, 19 nt, Pseudomonas putida KT2440
cugcacccgugcagggcug

SEQ ID NO: 1625998 - RNA, 19 nt, Pseudomonas putida KT2440
cugcacccucuuccuugug

SEQ ID NO: 1625999 - RNA, 16 nt, Pseudomonas putida KT2440
cugcacccgcgcgccc

SEQ ID NO: 1626000 - RNA, 18 nt, Pseudomonas putida KT2440
cugcacccgcgcgcccgc

SEQ ID NO: 1626001 - RNA, 22 nt, Pseudomonas putida KT2440
cugcaccgaccgugcauacacc

SEQ ID NO: 1626002 - RNA, 15 nt, Pseudomonas putida KT2440
cugcaccgcagcccc

SEQ ID NO: 1626003 - RNA, 16 nt, Pseudomonas putida KT2440
cugcaccgcagcccca

SEQ ID NO: 1626004 - RNA, 18 nt, Pseudomonas putida KT2440
cugcaccgccaccccggc

SEQ ID NO: 1626005 - RNA, 20 nt, Pseudomonas putida KT2440
cugcaccucccgccacggcc

SEQ ID NO: 1626006 - RNA, 12 nt, Pseudomonas putida KT2440
cugcaccuggcu

SEQ ID NO: 1626007 - RNA, 15 nt, Pseudomonas putida KT2440
cugcagcaggcuggc

SEQ ID NO: 1626008 - RNA, 13 nt, Pseudomonas putida KT2440
cugcagcagcuuc

SEQ ID NO: 1626009 - RNA, 20 nt, Pseudomonas putida KT2440
cugcagcagcuuccugugcc

SEQ ID NO: 1626010 - RNA, 14 nt, Pseudomonas putida KT2440
cugcagcacugccu

SEQ ID NO: 1626011 - RNA, 15 nt, Pseudomonas putida KT2440
cugcagcacugccug

SEQ ID NO: 1626012 - RNA, 18 nt, Pseudomonas putida KT2440
cugcaacagaaaaugccc

SEQ ID NO: 1626013 - RNA, 15 nt, Pseudomonas putida KT2440
cugcaacagcuccag

SEQ ID NO: 1626014 - RNA, 14 nt, Pseudomonas putida KT2440
cugcacacugcgcu

SEQ ID NO: 1626015 - RNA, 20 nt, Pseudomonas putida KT2440
cugcacagcgcggaacacac

SEQ ID NO: 1626016 - RNA, 20 nt, Pseudomonas putida KT2440
cugcacaucggccaccgccg

SEQ ID NO: 1626017 - RNA, 24 nt, Pseudomonas putida KT2440
cugcaccaccugcuccugguccug

SEQ ID NO: 1626018 - RNA, 23 nt, Pseudomonas putida KT2440
cugcacccagcguauagccaccg

SEQ ID NO: 1626019 - RNA, 18 nt, Pseudomonas putida KT2440
cugcaccaguuccuggcg

SEQ ID NO: 1626020 - RNA, 20 nt, Pseudomonas putida KT2440
cugcaccaguuccuggcgcu

SEQ ID NO: 1626021 - RNA, 15 nt, Pseudomonas putida KT2440
cugccaacgcaccga

SEQ ID NO: 1626022 - RNA, 16 nt, Pseudomonas putida KT2440
cugccaaucaacccgu

SEQ ID NO: 1626023 - RNA, 20 nt, Pseudomonas putida KT2440
cugccaaucgaucacuucca

SEQ ID NO: 1626024 - RNA, 22 nt, Pseudomonas putida KT2440
cugccaaucgaucacuuccagg

SEQ ID NO: 1626025 - RNA, 17 nt, Pseudomonas putida KT2440
cugcaugucggcagucu

SEQ ID NO: 1626026 - RNA, 14 nt, Pseudomonas putida KT2440
cugcauguccagcc

SEQ ID NO: 1626027 - RNA, 16 nt, Pseudomonas putida KT2440
cugcauugcagcccca

SEQ ID NO: 1626028 - RNA, 21 nt, Pseudomonas putida KT2440
cugcauugcagccccaauggu

SEQ ID NO: 1626029 - RNA, 14 nt, Pseudomonas putida KT2440
cugcauuggccacg

SEQ ID NO: 1626030 - RNA, 13 nt, Pseudomonas putida KT2440
cugcaugcgugcc

SEQ ID NO: 1626031 - RNA, 20 nt, Pseudomonas putida KT2440
cugcagcauggcgucggcga

SEQ ID NO: 1626032 - RNA, 17 nt, Pseudomonas putida KT2440
cugcagccgcaccugcc

SEQ ID NO: 1626033 - RNA, 18 nt, Pseudomonas putida KT2440
cugcagcccggcaaacuc

SEQ ID NO: 1626034 - RNA, 21 nt, Pseudomonas putida KT2440
cugcagccugacgcgccgcca

SEQ ID NO: 1626035 - RNA, 15 nt, Pseudomonas putida KT2440
cugcagcggcaaggu

SEQ ID NO: 1626036 - RNA, 15 nt, Pseudomonas putida KT2440
cugcagcucagccag

SEQ ID NO: 1626037 - RNA, 18 nt, Pseudomonas putida KT2440
cugcagcuuuugcgcagc

SEQ ID NO: 1626038 - RNA, 23 nt, Pseudomonas putida KT2440
cugcagcucgaaaaucucguuca

SEQ ID NO: 1626039 - RNA, 10 nt, Pseudomonas putida KT2440
cugcagcuuc

SEQ ID NO: 1626040 - RNA, 21 nt, Pseudomonas putida KT2440
cugcagcuucccggccuggcg

SEQ ID NO: 1626041 - RNA, 16 nt, Pseudomonas putida KT2440
cugcauaugcagggcc

SEQ ID NO: 1626042 - RNA, 19 nt, Pseudomonas putida KT2440
cugcauaugcagggccuuu

SEQ ID NO: 1626043 - RNA, 13 nt, Pseudomonas putida KT2440
cugcauaggcgcu

SEQ ID NO: 1626044 - RNA, 22 nt, Pseudomonas putida KT2440
cugcauaggugucgaacaccac

SEQ ID NO: 1626045 - RNA, 13 nt, Pseudomonas putida KT2440
cugcauccgcccc

SEQ ID NO: 1626046 - RNA, 19 nt, Pseudomonas putida KT2440
cugcauccgccccaggugg

SEQ ID NO: 1626047 - RNA, 20 nt, Pseudomonas putida KT2440
cugcauccguucggcgcgcu

SEQ ID NO: 1626048 - RNA, 19 nt, Pseudomonas putida KT2440
cugcaucagguagcugggc

SEQ ID NO: 1626049 - RNA, 16 nt, Pseudomonas putida KT2440
cugcauccacaccagc

SEQ ID NO: 1626050 - RNA, 18 nt, Pseudomonas putida KT2440
cugcccgagagcaguucc

SEQ ID NO: 1626051 - RNA, 15 nt, Pseudomonas putida KT2440
cugcccgcccucacu

SEQ ID NO: 1626052 - RNA, 16 nt, Pseudomonas putida KT2440
cugcccguccggcaug

SEQ ID NO: 1626053 - RNA, 19 nt, Pseudomonas putida KT2440
cugcccgccccccaccugg

SEQ ID NO: 1626054 - RNA, 21 nt, Pseudomonas putida KT2440
cugcccgccccccaccuggcc

SEQ ID NO: 1626055 - RNA, 21 nt, Pseudomonas putida KT2440
cugcccguugcgcaucaccuc

SEQ ID NO: 1626056 - RNA, 17 nt, Pseudomonas putida KT2440
cugcccucgacaaucgc

SEQ ID NO: 1626057 - RNA, 22 nt, Pseudomonas putida KT2440
cugcccucgacaaucgccaggu

SEQ ID NO: 1626058 - RNA, 19 nt, Pseudomonas putida KT2440
cugcccucggccggggcca

SEQ ID NO: 1626059 - RNA, 22 nt, Pseudomonas putida KT2440
cugcccucggccggggccaggc

SEQ ID NO: 1626060 - RNA, 13 nt, Pseudomonas putida KT2440
cugccagcagggc

SEQ ID NO: 1626061 - RNA, 13 nt, Pseudomonas putida KT2440
cugccagcacgau

SEQ ID NO: 1626062 - RNA, 14 nt, Pseudomonas putida KT2440
cugccagcaccagc

SEQ ID NO: 1626063 - RNA, 13 nt, Pseudomonas putida KT2440
cugccagccccgc

SEQ ID NO: 1626064 - RNA, 14 nt, Pseudomonas putida KT2440
cugccagccccgca

SEQ ID NO: 1626065 - RNA, 15 nt, Pseudomonas putida KT2440
cugccagccccgcac

SEQ ID NO: 1626066 - RNA, 22 nt, Pseudomonas putida KT2440
cugccacagguacugcgcaauc

SEQ ID NO: 1626067 - RNA, 18 nt, Pseudomonas putida KT2440
cugccacacacccgggcc

SEQ ID NO: 1626068 - RNA, 21 nt, Pseudomonas putida KT2440
cugccacacacccgggcccgc

SEQ ID NO: 1626069 - RNA, 21 nt, Pseudomonas putida KT2440
cugcccccaaugggcaccggc

SEQ ID NO: 1626070 - RNA, 13 nt, Pseudomonas putida KT2440
cugccagcuccug

SEQ ID NO: 1626071 - RNA, 16 nt, Pseudomonas putida KT2440
cugccagcuccuggcu

SEQ ID NO: 1626072 - RNA, 14 nt, Pseudomonas putida KT2440
cugccagcgccuca

SEQ ID NO: 1626073 - RNA, 13 nt, Pseudomonas putida KT2440
cugccagcgcgcu

SEQ ID NO: 1626074 - RNA, 12 nt, Pseudomonas putida KT2440
cuucagaagccu

SEQ ID NO: 1626075 - RNA, 21 nt, Pseudomonas putida KT2440
cuucagaagccuuggccuugg

SEQ ID NO: 1626076 - RNA, 23 nt, Pseudomonas putida KT2440
cuucaucgccggguccaccagcc

SEQ ID NO: 1626077 - RNA, 20 nt, Pseudomonas putida KT2440
cuucaugaaguacuuggcgc

SEQ ID NO: 1626078 - RNA, 19 nt, Pseudomonas putida KT2440
cuucaugaagucagccagg

SEQ ID NO: 1626079 - RNA, 19 nt, Pseudomonas putida KT2440
cuucaucugcgccugugca

SEQ ID NO: 1626080 - RNA, 18 nt, Pseudomonas putida KT2440
cuucaucugucagcgcca

SEQ ID NO: 1626081 - RNA, 16 nt, Pseudomonas putida KT2440
cuuccaaccagccagc

SEQ ID NO: 1626082 - RNA, 18 nt, Pseudomonas putida KT2440
cuuccagcccgccugcuc

SEQ ID NO: 1626083 - RNA, 15 nt, Pseudomonas putida KT2440
cuuccagccugcagc

SEQ ID NO: 1626084 - RNA, 18 nt, Pseudomonas putida KT2440
cuuccagcaggacccggc

SEQ ID NO: 1626085 - RNA, 20 nt, Pseudomonas putida KT2440
cuuccagcagcacacgcuug

SEQ ID NO: 1626086 - RNA, 14 nt, Pseudomonas putida KT2440
cuuccagaacggcg

SEQ ID NO: 1626087 - RNA, 13 nt, Pseudomonas putida KT2440
cuuccaccugcgc

SEQ ID NO: 1626088 - RNA, 16 nt, Pseudomonas putida KT2440
cuuccaccugcgccuu

SEQ ID NO: 1626089 - RNA, 18 nt, Pseudomonas putida KT2440
cuuccaccugcgccuugc

SEQ ID NO: 1626090 - RNA, 20 nt, Pseudomonas putida KT2440
cuuccaccgggaagcagguc

SEQ ID NO: 1626091 - RNA, 22 nt, Pseudomonas putida KT2440
cuuccaccgguacauugcgcac

SEQ ID NO: 1626092 - RNA, 15 nt, Pseudomonas putida KT2440
cuuccacccgccugc

SEQ ID NO: 1626093 - RNA, 12 nt, Pseudomonas putida KT2440
cuuccaccaccu

SEQ ID NO: 1626094 - RNA, 15 nt, Pseudomonas putida KT2440
cuuccaccaccucca

SEQ ID NO: 1626095 - RNA, 18 nt, Pseudomonas putida KT2440
cuuccaccaccuccaucu

SEQ ID NO: 1626096 - RNA, 13 nt, Pseudomonas putida KT2440
cuuccuggcuggc

SEQ ID NO: 1626097 - RNA, 20 nt, Pseudomonas putida KT2440
cuuccuggcuggcagccggc

SEQ ID NO: 1626098 - RNA, 18 nt, Pseudomonas putida KT2440
cuucccgccauugcacca

SEQ ID NO: 1626099 - RNA, 18 nt, Pseudomonas putida KT2440
cuuccaggaaggccucgc

SEQ ID NO: 1626100 - RNA, 14 nt, Pseudomonas putida KT2440
cuuccagcuccuuc

SEQ ID NO: 1626101 - RNA, 15 nt, Pseudomonas putida KT2440
cuuccagcugcggcu

SEQ ID NO: 1626102 - RNA, 14 nt, Pseudomonas putida KT2440
cuuccagcugucau

SEQ ID NO: 1626103 - RNA, 15 nt, Pseudomonas putida KT2440
cuucccauccacuuc

SEQ ID NO: 1626104 - RNA, 16 nt, Pseudomonas putida KT2440
cuuccccccuggccug

SEQ ID NO: 1626105 - RNA, 20 nt, Pseudomonas putida KT2440
cuuccccccuggccuggcca

SEQ ID NO: 1626106 - RNA, 13 nt, Pseudomonas putida KT2440
cuuccccaggccg

SEQ ID NO: 1626107 - RNA, 18 nt, Pseudomonas putida KT2440
cuucccccaaucuccagc

SEQ ID NO: 1626108 - RNA, 13 nt, Pseudomonas putida KT2440
cuuccccgcccaa

SEQ ID NO: 1626109 - RNA, 14 nt, Pseudomonas putida KT2440
cuucccgcguccag

SEQ ID NO: 1626110 - RNA, 14 nt, Pseudomonas putida KT2440
cuucccggcaccgc

SEQ ID NO: 1626111 - RNA, 18 nt, Pseudomonas putida KT2440
cuucggucuggccgagcu

SEQ ID NO: 1626112 - RNA, 19 nt, Pseudomonas putida KT2440
cuucggugugcuccagcuc

SEQ ID NO: 1626113 - RNA, 21 nt, Pseudomonas putida KT2440
cuucggugugcuccagcucca

SEQ ID NO: 1626114 - RNA, 19 nt, Pseudomonas putida KT2440
cuucgugcucggcacugcu

SEQ ID NO: 1626115 - RNA, 13 nt, Pseudomonas putida KT2440
cuucuagcaaugc

SEQ ID NO: 1626116 - RNA, 22 nt, Pseudomonas putida KT2440
cuucuagcaaugccagccgcag

SEQ ID NO: 1626117 - RNA, 19 nt, Pseudomonas putida KT2440
cuucuauuaaugcacgccu

SEQ ID NO: 1626118 - RNA, 22 nt, Pseudomonas putida KT2440
cuuccuugggggugaagcccug

SEQ ID NO: 1626119 - RNA, 14 nt, Pseudomonas putida KT2440
cuuccuugucaguc

SEQ ID NO: 1626120 - RNA, 15 nt, Pseudomonas putida KT2440
cuucgaucagcgccu

SEQ ID NO: 1626121 - RNA, 23 nt, Pseudomonas putida KT2440
cuucgcuguaaccugguuguagc

SEQ ID NO: 1626122 - RNA, 17 nt, Pseudomonas putida KT2440
cuucgcucaucacuacu

SEQ ID NO: 1626123 - RNA, 23 nt, Pseudomonas putida KT2440
cuucgcucaucacuacuccucgc

SEQ ID NO: 1626124 - RNA, 22 nt, Pseudomonas putida KT2440
cuucggagguagccaccugaug

SEQ ID NO: 1626125 - RNA, 16 nt, Pseudomonas putida KT2440
cuucgcuucgcgcacu

SEQ ID NO: 1626126 - RNA, 19 nt, Pseudomonas putida KT2440
cuucggcaaucaccgccag

SEQ ID NO: 1626127 - RNA, 22 nt, Pseudomonas putida KT2440
cuucggcgacaggugccucugc

SEQ ID NO: 1626128 - RNA, 14 nt, Pseudomonas putida KT2440
cuucggcugaucuc

SEQ ID NO: 1626129 - RNA, 18 nt, Pseudomonas putida KT2440
cuucggcgggguuuuuuc

SEQ ID NO: 1626130 - RNA, 20 nt, Pseudomonas putida KT2440
cuucggcgggguuuuuucua

SEQ ID NO: 1626131 - RNA, 15 nt, Pseudomonas putida KT2440
cuucgggaauaccag

SEQ ID NO: 1626132 - RNA, 19 nt, Pseudomonas putida KT2440
cuucaacaccaacuugcca

SEQ ID NO: 1626133 - RNA, 22 nt, Pseudomonas putida KT2440
cuucaaaucgcugcgcaugaaa

SEQ ID NO: 1626134 - RNA, 20 nt, Pseudomonas putida KT2440
cuucaacaaaucggccuugc

SEQ ID NO: 1626135 - RNA, 23 nt, Pseudomonas putida KT2440
cuucaaccuguuccggccucuuc

SEQ ID NO: 1626136 - RNA, 15 nt, Pseudomonas putida KT2440
cuucaaccaguucag

SEQ ID NO: 1626137 - RNA, 17 nt, Pseudomonas putida KT2440
cuucaagcaccgcgcac

SEQ ID NO: 1626138 - RNA, 15 nt, Pseudomonas putida KT2440
cuucaaggccaccac

SEQ ID NO: 1626139 - RNA, 15 nt, Pseudomonas putida KT2440
cuucaaggcccaguu

SEQ ID NO: 1626140 - RNA, 17 nt, Pseudomonas putida KT2440
cuucaagcuccccagca

SEQ ID NO: 1626141 - RNA, 14 nt, Pseudomonas putida KT2440
cuucaaggggcccc

SEQ ID NO: 1626142 - RNA, 15 nt, Pseudomonas putida KT2440
cuucaagguuggggc

SEQ ID NO: 1626143 - RNA, 13 nt, Pseudomonas putida KT2440
cuucaacuccacc

SEQ ID NO: 1626144 - RNA, 20 nt, Pseudomonas putida KT2440
cuucaacuccaccaucaagu

SEQ ID NO: 1626145 - RNA, 21 nt, Pseudomonas putida KT2440
cuucaacuccaccaucaaguc

SEQ ID NO: 1626146 - RNA, 19 nt, Pseudomonas putida KT2440
cuucaacucggacaaccaa

SEQ ID NO: 1626147 - RNA, 17 nt, Pseudomonas putida KT2440
cuucacucaaccaccgc

SEQ ID NO: 1626148 - RNA, 14 nt, Pseudomonas putida KT2440
cuucaccuugccug

SEQ ID NO: 1626149 - RNA, 15 nt, Pseudomonas putida KT2440
cuucaccgucggcgc

SEQ ID NO: 1626150 - RNA, 16 nt, Pseudomonas putida KT2440
cuucaccgcgcaccuc

SEQ ID NO: 1626151 - RNA, 21 nt, Pseudomonas putida KT2440
cuucaccgcgcaccuccugcg

SEQ ID NO: 1626152 - RNA, 13 nt, Pseudomonas putida KT2440
cuucaccagcuuc

SEQ ID NO: 1626153 - RNA, 19 nt, Pseudomonas putida KT2440
cuucacccaaugcaugcau

SEQ ID NO: 1626154 - RNA, 16 nt, Pseudomonas putida KT2440
cuucaccccguggccc

SEQ ID NO: 1626155 - RNA, 20 nt, Pseudomonas putida KT2440
cuucaaguuuggcuuugccc

SEQ ID NO: 1626156 - RNA, 13 nt, Pseudomonas putida KT2440
cuucaaauagaag

SEQ ID NO: 1626157 - RNA, 14 nt, Pseudomonas putida KT2440
cuucaaaaccagau

SEQ ID NO: 1626158 - RNA, 13 nt, Pseudomonas putida KT2440
cuuauaagcagca

SEQ ID NO: 1626159 - RNA, 16 nt, Pseudomonas putida KT2440
cuuauaagcagcaagc

SEQ ID NO: 1626160 - RNA, 13 nt, Pseudomonas putida KT2440
cuguuccacagca

SEQ ID NO: 1626161 - RNA, 14 nt, Pseudomonas putida KT2440
cuguuccagcccgg

SEQ ID NO: 1626162 - RNA, 15 nt, Pseudomonas putida KT2440
cuuaacgcuuggcca

SEQ ID NO: 1626163 - RNA, 16 nt, Pseudomonas putida KT2440
cuuaacgcuuggccag

SEQ ID NO: 1626164 - RNA, 23 nt, Pseudomonas putida KT2440
cuuagacgguuacgugcaggcgc

SEQ ID NO: 1626165 - RNA, 18 nt, Pseudomonas putida KT2440
cuuucugcuucgcugcca

SEQ ID NO: 1626166 - RNA, 22 nt, Pseudomonas putida KT2440
cuuucugcuucgcugccaggaa

SEQ ID NO: 1626167 - RNA, 23 nt, Pseudomonas putida KT2440
cuuucuggggcuaaaagaugugu

SEQ ID NO: 1626168 - RNA, 12 nt, Pseudomonas putida KT2440
cuuuccacgccu

SEQ ID NO: 1626169 - RNA, 21 nt, Pseudomonas putida KT2440
cuuuccaaaccugcgaccaca

SEQ ID NO: 1626170 - RNA, 23 nt, Pseudomonas putida KT2440
cuuuccagcuguacgcuggccaa

SEQ ID NO: 1626171 - RNA, 18 nt, Pseudomonas putida KT2440
cuuugaggcucaugacac

SEQ ID NO: 1626172 - RNA, 15 nt, Pseudomonas putida KT2440
cuuucuuaugccugg

SEQ ID NO: 1626173 - RNA, 20 nt, Pseudomonas putida KT2440
cuuuggcugcaggucggcca

SEQ ID NO: 1626174 - RNA, 17 nt, Pseudomonas putida KT2440
cuuuggcuaucagccgu

SEQ ID NO: 1626175 - RNA, 14 nt, Pseudomonas putida KT2440
cuuuggcagcagcc

SEQ ID NO: 1626176 - RNA, 17 nt, Pseudomonas putida KT2440
cuuugcuuuugaauaaa

SEQ ID NO: 1626177 - RNA, 20 nt, Pseudomonas putida KT2440
cuuugcuuuugaauaaagaa

SEQ ID NO: 1626178 - RNA, 13 nt, Pseudomonas putida KT2440
cuuugcgggcacg

SEQ ID NO: 1626179 - RNA, 20 nt, Pseudomonas putida KT2440
cuuugcugccugugccggcc

SEQ ID NO: 1626180 - RNA, 14 nt, Pseudomonas putida KT2440
cuuugccccugauc

SEQ ID NO: 1626181 - RNA, 20 nt, Pseudomonas putida KT2440
cuuugccauucucgccgccg

SEQ ID NO: 1626182 - RNA, 18 nt, Pseudomonas putida KT2440
cuuugcacugaagauuuu

SEQ ID NO: 1626183 - RNA, 22 nt, Pseudomonas putida KT2440
cuuugcagcccuucgccggcac

SEQ ID NO: 1626184 - RNA, 16 nt, Pseudomonas putida KT2440
cuuguccuugagcgcc

SEQ ID NO: 1626185 - RNA, 15 nt, Pseudomonas putida KT2440
cuugucagcaaccac

SEQ ID NO: 1626186 - RNA, 14 nt, Pseudomonas putida KT2440
cuugucgaccuggu

SEQ ID NO: 1626187 - RNA, 15 nt, Pseudomonas putida KT2440
cuugucgaccugguc

SEQ ID NO: 1626188 - RNA, 22 nt, Pseudomonas putida KT2440
cuugucggcgaaggcuggccuc

SEQ ID NO: 1626189 - RNA, 22 nt, Pseudomonas putida KT2440
cuugucuggcaccaccagggcg

SEQ ID NO: 1626190 - RNA, 17 nt, Pseudomonas putida KT2440
cuugucuguacugcggc

SEQ ID NO: 1626191 - RNA, 18 nt, Pseudomonas putida KT2440
cuugucucugaacacaug

SEQ ID NO: 1626192 - RNA, 15 nt, Pseudomonas putida KT2440
cuuuacaccgaugcc

SEQ ID NO: 1626193 - RNA, 15 nt, Pseudomonas putida KT2440
cuuucaacagcuggc

SEQ ID NO: 1626194 - RNA, 18 nt, Pseudomonas putida KT2440
cuuucagcgcccagaaca

SEQ ID NO: 1626195 - RNA, 16 nt, Pseudomonas putida KT2440
cuuucagcgccugccu

SEQ ID NO: 1626196 - RNA, 21 nt, Pseudomonas putida KT2440
cuuucagcgccugccuggccc

SEQ ID NO: 1626197 - RNA, 19 nt, Pseudomonas putida KT2440
cuuucaggcgcagcacaag

SEQ ID NO: 1626198 - RNA, 15 nt, Pseudomonas putida KT2440
cuugcuggaacugcu

SEQ ID NO: 1626199 - RNA, 13 nt, Pseudomonas putida KT2440
cuugcgcaucuuu

SEQ ID NO: 1626200 - RNA, 18 nt, Pseudomonas putida KT2440
cuugcgcauggccgccac

SEQ ID NO: 1626201 - RNA, 16 nt, Pseudomonas putida KT2440
cuugcugcagggcacg

SEQ ID NO: 1626202 - RNA, 20 nt, Pseudomonas putida KT2440
cuugcugcagggcacgccaa

SEQ ID NO: 1626203 - RNA, 20 nt, Pseudomonas putida KT2440
cuugcgcacgcgcucugcaa

SEQ ID NO: 1626204 - RNA, 23 nt, Pseudomonas putida KT2440
cuugcgcacgcgcuuuuccagca

SEQ ID NO: 1626205 - RNA, 18 nt, Pseudomonas putida KT2440
cuugcgcacguaggcggg

SEQ ID NO: 1626206 - RNA, 17 nt, Pseudomonas putida KT2440
cuugccuuucaucaucg

SEQ ID NO: 1626207 - RNA, 20 nt, Pseudomonas putida KT2440
cuugccuuccucggccaugc

SEQ ID NO: 1626208 - RNA, 17 nt, Pseudomonas putida KT2440
cuugcgaccgaugccca

SEQ ID NO: 1626209 - RNA, 18 nt, Pseudomonas putida KT2440
cuugcgaccgaugcccaa

SEQ ID NO: 1626210 - RNA, 14 nt, Pseudomonas putida KT2440
cuugcccggcucca

SEQ ID NO: 1626211 - RNA, 17 nt, Pseudomonas putida KT2440
cuugccgaucagcgagu

SEQ ID NO: 1626212 - RNA, 17 nt, Pseudomonas putida KT2440
cuugccgccccgugccc

SEQ ID NO: 1626213 - RNA, 15 nt, Pseudomonas putida KT2440
cuuggcgaacagaag

SEQ ID NO: 1626214 - RNA, 17 nt, Pseudomonas putida KT2440
cuuggccugcucacccg

SEQ ID NO: 1626215 - RNA, 13 nt, Pseudomonas putida KT2440
cuuggccuggggc

SEQ ID NO: 1626216 - RNA, 20 nt, Pseudomonas putida KT2440
cuuggcgcccuccaucaauc

SEQ ID NO: 1626217 - RNA, 22 nt, Pseudomonas putida KT2440
cuuggccaaaccgggaaagucu

SEQ ID NO: 1626218 - RNA, 22 nt, Pseudomonas putida KT2440
cuuggcauuggugccagcgcca

SEQ ID NO: 1626219 - RNA, 23 nt, Pseudomonas putida KT2440
cuuggcauuggugccagcgccaa

SEQ ID NO: 1626220 - RNA, 18 nt, Pseudomonas putida KT2440
cuuggcccuguagagcgc

SEQ ID NO: 1626221 - RNA, 19 nt, Pseudomonas putida KT2440
cuuggcccuguagagcgcc

SEQ ID NO: 1626222 - RNA, 14 nt, Pseudomonas putida KT2440
cuuggccagggccu

SEQ ID NO: 1626223 - RNA, 23 nt, Pseudomonas putida KT2440
cuugcuguagcccaccaggucau

SEQ ID NO: 1626224 - RNA, 20 nt, Pseudomonas putida KT2440
cuugcuuggcagcggcuggc

SEQ ID NO: 1626225 - RNA, 17 nt, Pseudomonas putida KT2440
cuuggcacgcuggcugu

SEQ ID NO: 1626226 - RNA, 22 nt, Pseudomonas putida KT2440
cuuggcaccuaucgcugccgcc

SEQ ID NO: 1626227 - RNA, 23 nt, Pseudomonas putida KT2440
cuuggcacgaaacgccacgccca

SEQ ID NO: 1626228 - RNA, 17 nt, Pseudomonas putida KT2440
cuuggcagcggcuggcg

SEQ ID NO: 1626229 - RNA, 22 nt, Pseudomonas putida KT2440
cuuggaucuuuucgggcaaggc

SEQ ID NO: 1626230 - RNA, 14 nt, Pseudomonas putida KT2440
cuuggucagggcaa

SEQ ID NO: 1626231 - RNA, 16 nt, Pseudomonas putida KT2440
cuuggucucgaucagc

SEQ ID NO: 1626232 - RNA, 22 nt, Pseudomonas putida KT2440
cuuggucucguugcuuugaagu

SEQ ID NO: 1626233 - RNA, 23 nt, Pseudomonas putida KT2440
cuuggucccccacuucugccggu

SEQ ID NO: 1626234 - RNA, 23 nt, Pseudomonas putida KT2440
cuugguccggucacugcgcggcc

SEQ ID NO: 1626235 - RNA, 19 nt, Pseudomonas putida KT2440
cuuguagauauugaccagc

SEQ ID NO: 1626236 - RNA, 14 nt, Pseudomonas putida KT2440
cuuguagccggcag

SEQ ID NO: 1626237 - RNA, 13 nt, Pseudomonas putida KT2440
cuuguagcucagg

SEQ ID NO: 1626238 - RNA, 15 nt, Pseudomonas putida KT2440
cuuguauuggccaag

SEQ ID NO: 1626239 - RNA, 17 nt, Pseudomonas putida KT2440
cuuguauuggccaagaa

SEQ ID NO: 1626240 - RNA, 15 nt, Pseudomonas putida KT2440
cuuguaguucaucuu

SEQ ID NO: 1626241 - RNA, 15 nt, Pseudomonas putida KT2440
cuuguaucccaggcg

SEQ ID NO: 1626242 - RNA, 23 nt, Pseudomonas putida KT2440
cuugggaaugugucagggcugca

SEQ ID NO: 1626243 - RNA, 14 nt, Pseudomonas putida KT2440
cuuggcugccggcc

SEQ ID NO: 1626244 - RNA, 17 nt, Pseudomonas putida KT2440
cuuggcugccggccugu

SEQ ID NO: 1626245 - RNA, 14 nt, Pseudomonas putida KT2440
cuuggcguccaggu

SEQ ID NO: 1626246 - RNA, 19 nt, Pseudomonas putida KT2440
cuuggcguuggcugccgcu

SEQ ID NO: 1626247 - RNA, 23 nt, Pseudomonas putida KT2440
cuugggcucagccgccacaugcc

SEQ ID NO: 1626248 - RNA, 24 nt, Pseudomonas putida KT2440
cuugguaccgucgaucagcuucug

SEQ ID NO: 1626249 - RNA, 23 nt, Pseudomonas putida KT2440
cuugggggugaagcccugcugcu

SEQ ID NO: 1626250 - RNA, 16 nt, Pseudomonas putida KT2440
cuugcaucaaauuuag

SEQ ID NO: 1626251 - RNA, 21 nt, Pseudomonas putida KT2440
cuugccaccaucgaccuggcc

SEQ ID NO: 1626252 - RNA, 22 nt, Pseudomonas putida KT2440
cuugccaccaucgaccuggccc

SEQ ID NO: 1626253 - RNA, 16 nt, Pseudomonas putida KT2440
cuugcaguucuugauc

SEQ ID NO: 1626254 - RNA, 19 nt, Pseudomonas putida KT2440
cuugcaguuguccaggcug

SEQ ID NO: 1626255 - RNA, 22 nt, Pseudomonas putida KT2440
cuugccauaacuccagcgccag

SEQ ID NO: 1626256 - RNA, 12 nt, Pseudomonas putida KT2440
cuugccagcaug

SEQ ID NO: 1626257 - RNA, 21 nt, Pseudomonas putida KT2440
cuugccagcuuggucagggca

SEQ ID NO: 1626258 - RNA, 15 nt, Pseudomonas putida KT2440
cuugcccagcuccag

SEQ ID NO: 1626259 - RNA, 16 nt, Pseudomonas putida KT2440
cuugcccagcuccagc

SEQ ID NO: 1626260 - RNA, 14 nt, Pseudomonas putida KT2440
cuugcccucauucg

SEQ ID NO: 1626261 - RNA, 23 nt, Pseudomonas putida KT2440
cuugcccgcgaagaggccggcac

SEQ ID NO: 1626262 - RNA, 18 nt, Pseudomonas putida KT2440
cuugcccgcgaaucgccu

SEQ ID NO: 1626263 - RNA, 18 nt, Pseudomonas putida KT2440
cuugcccgcgaauggccu

SEQ ID NO: 1626264 - RNA, 14 nt, Pseudomonas putida KT2440
cuugccgagcagcg

SEQ ID NO: 1626265 - RNA, 15 nt, Pseudomonas putida KT2440
cuugccgagcagcgc

SEQ ID NO: 1626266 - RNA, 16 nt, Pseudomonas putida KT2440
cuugccgagcagcgcg

SEQ ID NO: 1626267 - RNA, 19 nt, Pseudomonas putida KT2440
cuugacgggugaccaggcc

SEQ ID NO: 1626268 - RNA, 21 nt, Pseudomonas putida KT2440
cuugaucaggcccugcugcuu

SEQ ID NO: 1626269 - RNA, 23 nt, Pseudomonas putida KT2440
cuugagaucagcaaccugcuggg

SEQ ID NO: 1626270 - RNA, 18 nt, Pseudomonas putida KT2440
cuugaucaggggccgcgc

SEQ ID NO: 1626271 - RNA, 21 nt, Pseudomonas putida KT2440
cuugaucaggguuugcagcuc

SEQ ID NO: 1626272 - RNA, 23 nt, Pseudomonas putida KT2440
cuugaucaggguuugcagcucac

SEQ ID NO: 1626273 - RNA, 20 nt, Pseudomonas putida KT2440
cuugaucgcguuacccacca

SEQ ID NO: 1626274 - RNA, 14 nt, Pseudomonas putida KT2440
cuugaucugccagg

SEQ ID NO: 1626275 - RNA, 18 nt, Pseudomonas putida KT2440
cuugaucuugguggucag

SEQ ID NO: 1626276 - RNA, 17 nt, Pseudomonas putida KT2440
cuugaacugggcaucca

SEQ ID NO: 1626277 - RNA, 21 nt, Pseudomonas putida KT2440
cuugaacugggcauccagcuu

SEQ ID NO: 1626278 - RNA, 15 nt, Pseudomonas putida KT2440
cuugaacggcauuuc

SEQ ID NO: 1626279 - RNA, 23 nt, Pseudomonas putida KT2440
cuugaacggccgucaccuuuucc

SEQ ID NO: 1626280 - RNA, 20 nt, Pseudomonas putida KT2440
cuugaacucagugccuggcg

SEQ ID NO: 1626281 - RNA, 20 nt, Pseudomonas putida KT2440
cuucuuugaaaguggccaag

SEQ ID NO: 1626282 - RNA, 14 nt, Pseudomonas putida KT2440
cuucucaggcacca

SEQ ID NO: 1626283 - RNA, 20 nt, Pseudomonas putida KT2440
cuucucaggcaccagcgcug

SEQ ID NO: 1626284 - RNA, 16 nt, Pseudomonas putida KT2440
cuugaccguuugcagc

SEQ ID NO: 1626285 - RNA, 16 nt, Pseudomonas putida KT2440
cuugacgaucgccagc

SEQ ID NO: 1626286 - RNA, 16 nt, Pseudomonas putida KT2440
cuugacccgcuggacc

SEQ ID NO: 1626287 - RNA, 21 nt, Pseudomonas putida KT2440
cuugaccagcaacggccgcgc

SEQ ID NO: 1626288 - RNA, 14 nt, Pseudomonas putida KT2440
cuugacccccuucg

SEQ ID NO: 1626289 - RNA, 12 nt, Pseudomonas putida KT2440
cuugaagcggcc

SEQ ID NO: 1626290 - RNA, 22 nt, Pseudomonas putida KT2440
cuugaccacuucgacauggcug

SEQ ID NO: 1626291 - RNA, 14 nt, Pseudomonas putida KT2440
cuugaauccccuua

SEQ ID NO: 1626292 - RNA, 12 nt, Pseudomonas putida KT2440
cgcgaaucacca

SEQ ID NO: 1626293 - RNA, 22 nt, Pseudomonas putida KT2440
cgcgaaugaucauguccuugcu

SEQ ID NO: 1626294 - RNA, 19 nt, Pseudomonas putida KT2440
cgcgaaugggucaggaugc

SEQ ID NO: 1626295 - RNA, 16 nt, Pseudomonas putida KT2440
cgcgaaggcuccagca

SEQ ID NO: 1626296 - RNA, 20 nt, Pseudomonas putida KT2440
cgcgaagggcugccgcgcag

SEQ ID NO: 1626297 - RNA, 22 nt, Pseudomonas putida KT2440
cgcgaaggggccggcacaggcu

SEQ ID NO: 1626298 - RNA, 18 nt, Pseudomonas putida KT2440
cgcgaagcaggcgacgca

SEQ ID NO: 1626299 - RNA, 18 nt, Pseudomonas putida KT2440
cgcgaagaagccggcauc

SEQ ID NO: 1626300 - RNA, 16 nt, Pseudomonas putida KT2440
cgcgaagaggccagca

SEQ ID NO: 1626301 - RNA, 19 nt, Pseudomonas putida KT2440
cgcgaagaggccagcacag

SEQ ID NO: 1626302 - RNA, 22 nt, Pseudomonas putida KT2440
cgcgaacaccggcagagccggu

SEQ ID NO: 1626303 - RNA, 15 nt, Pseudomonas putida KT2440
cgcgaaagggccgca

SEQ ID NO: 1626304 - RNA, 15 nt, Pseudomonas putida KT2440
cgcgaaagggccgcg

SEQ ID NO: 1626305 - RNA, 15 nt, Pseudomonas putida KT2440
cgcgaaacacagcag

SEQ ID NO: 1626306 - RNA, 13 nt, Pseudomonas putida KT2440
cgccuucgcccga

SEQ ID NO: 1626307 - RNA, 22 nt, Pseudomonas putida KT2440
cgccuucgcccgaccgccagcc

SEQ ID NO: 1626308 - RNA, 20 nt, Pseudomonas putida KT2440
cgccuugauuaccagcgccc

SEQ ID NO: 1626309 - RNA, 14 nt, Pseudomonas putida KT2440
cgccuuggcagccu

SEQ ID NO: 1626310 - RNA, 14 nt, Pseudomonas putida KT2440
cgccuggccggccg

SEQ ID NO: 1626311 - RNA, 19 nt, Pseudomonas putida KT2440
cgccuggcgccugcgccag

SEQ ID NO: 1626312 - RNA, 14 nt, Pseudomonas putida KT2440
cgccuggccugcag

SEQ ID NO: 1626313 - RNA, 18 nt, Pseudomonas putida KT2440
cgccuucagcgccccauc

SEQ ID NO: 1626314 - RNA, 22 nt, Pseudomonas putida KT2440
cgccuucagcgccccaucauuu

SEQ ID NO: 1626315 - RNA, 13 nt, Pseudomonas putida KT2440
cgccuucacugcg

SEQ ID NO: 1626316 - RNA, 22 nt, Pseudomonas putida KT2440
cgccuucauaggcggccacggc

SEQ ID NO: 1626317 - RNA, 18 nt, Pseudomonas putida KT2440
cgccugugagaucgagcg

SEQ ID NO: 1626318 - RNA, 14 nt, Pseudomonas putida KT2440
cgccugcagggccu

SEQ ID NO: 1626319 - RNA, 14 nt, Pseudomonas putida KT2440
cgccugcgcacggc

SEQ ID NO: 1626320 - RNA, 17 nt, Pseudomonas putida KT2440
cgccugcgcacggcgcu

SEQ ID NO: 1626321 - RNA, 13 nt, Pseudomonas putida KT2440
cgccugcgccagc

SEQ ID NO: 1626322 - RNA, 22 nt, Pseudomonas putida KT2440
cgccugccgggucaaggccagc

SEQ ID NO: 1626323 - RNA, 14 nt, Pseudomonas putida KT2440
cgccugcuuggccg

SEQ ID NO: 1626324 - RNA, 22 nt, Pseudomonas putida KT2440
cgccugcugccaggccgcacgc

SEQ ID NO: 1626325 - RNA, 14 nt, Pseudomonas putida KT2440
cgccugcggcauca

SEQ ID NO: 1626326 - RNA, 18 nt, Pseudomonas putida KT2440
cgccguucaggcgccugc

SEQ ID NO: 1626327 - RNA, 15 nt, Pseudomonas putida KT2440
cgccuacgacggccu

SEQ ID NO: 1626328 - RNA, 22 nt, Pseudomonas putida KT2440
cgccuacaacauaccgcugggc

SEQ ID NO: 1626329 - RNA, 15 nt, Pseudomonas putida KT2440
cgccuacagcggccu

SEQ ID NO: 1626330 - RNA, 21 nt, Pseudomonas putida KT2440
cgccuaugaaaccgagcgccg

SEQ ID NO: 1626331 - RNA, 15 nt, Pseudomonas putida KT2440
cgccucacagcgccg

SEQ ID NO: 1626332 - RNA, 17 nt, Pseudomonas putida KT2440
cgccgugcuacggccgu

SEQ ID NO: 1626333 - RNA, 15 nt, Pseudomonas putida KT2440
cgccgugcucggccu

SEQ ID NO: 1626334 - RNA, 18 nt, Pseudomonas putida KT2440
cgccucgggggcaucauu

SEQ ID NO: 1626335 - RNA, 14 nt, Pseudomonas putida KT2440
cgccucgggcgcuc

SEQ ID NO: 1626336 - RNA, 18 nt, Pseudomonas putida KT2440
cgccucuaccacgccgcu

SEQ ID NO: 1626337 - RNA, 23 nt, Pseudomonas putida KT2440
cgccucguuggcgaagucggccu

SEQ ID NO: 1626338 - RNA, 22 nt, Pseudomonas putida KT2440
cgccucguugcgaagcggccug

SEQ ID NO: 1626339 - RNA, 20 nt, Pseudomonas putida KT2440
cgccucggcuacgccgccgc

SEQ ID NO: 1626340 - RNA, 22 nt, Pseudomonas putida KT2440
cgccucggcuacgccgccgcug

SEQ ID NO: 1626341 - RNA, 20 nt, Pseudomonas putida KT2440
cgccucgcuggcgguguaga

SEQ ID NO: 1626342 - RNA, 20 nt, Pseudomonas putida KT2440
cgccucuugcaccuguccca

SEQ ID NO: 1626343 - RNA, 21 nt, Pseudomonas putida KT2440
cgccugacgccgccagcgcuc

SEQ ID NO: 1626344 - RNA, 23 nt, Pseudomonas putida KT2440
cgccugacgccgccagcgcucca

SEQ ID NO: 1626345 - RNA, 16 nt, Pseudomonas putida KT2440
cgccugauuacccugc

SEQ ID NO: 1626346 - RNA, 18 nt, Pseudomonas putida KT2440
cgccugauuacccugcgc

SEQ ID NO: 1626347 - RNA, 19 nt, Pseudomonas putida KT2440
cgccugaacagcaucagcc

SEQ ID NO: 1626348 - RNA, 19 nt, Pseudomonas putida KT2440
cgccugcaccugacgagcg

SEQ ID NO: 1626349 - RNA, 17 nt, Pseudomonas putida KT2440
cgccucgaaguaggcaa

SEQ ID NO: 1626350 - RNA, 13 nt, Pseudomonas putida KT2440
cgccuccugcugc

SEQ ID NO: 1626351 - RNA, 18 nt, Pseudomonas putida KT2440
cgccucgaacaccugcgc

SEQ ID NO: 1626352 - RNA, 22 nt, Pseudomonas putida KT2440
cgccucauccucgcccaccagc

SEQ ID NO: 1626353 - RNA, 13 nt, Pseudomonas putida KT2440
cgccucagcgcca

SEQ ID NO: 1626354 - RNA, 13 nt, Pseudomonas putida KT2440
cgccuccagcagc

SEQ ID NO: 1626355 - RNA, 14 nt, Pseudomonas putida KT2440
cgccucaugcagca

SEQ ID NO: 1626356 - RNA, 22 nt, Pseudomonas putida KT2440
cgccucaugcagcaccuccugc

SEQ ID NO: 1626357 - RNA, 13 nt, Pseudomonas putida KT2440
cgccucccccagc

SEQ ID NO: 1626358 - RNA, 16 nt, Pseudomonas putida KT2440
cgcgccagcggccagc

SEQ ID NO: 1626359 - RNA, 21 nt, Pseudomonas putida KT2440
cgcgccaggucggcggggccc

SEQ ID NO: 1626360 - RNA, 18 nt, Pseudomonas putida KT2440
cgcgccaguuccacgacc

SEQ ID NO: 1626361 - RNA, 15 nt, Pseudomonas putida KT2440
cgcgccauccgccac

SEQ ID NO: 1626362 - RNA, 20 nt, Pseudomonas putida KT2440
cgcgccauuggccgcgcgcc

SEQ ID NO: 1626363 - RNA, 21 nt, Pseudomonas putida KT2440
cgcgcccacagugucccggcc

SEQ ID NO: 1626364 - RNA, 18 nt, Pseudomonas putida KT2440
cgcgcccggcuugcccgg

SEQ ID NO: 1626365 - RNA, 20 nt, Pseudomonas putida KT2440
cgcgcccggcuugcccgggc

SEQ ID NO: 1626366 - RNA, 16 nt, Pseudomonas putida KT2440
cgcgcccacgcggguc

SEQ ID NO: 1626367 - RNA, 13 nt, Pseudomonas putida KT2440
cgcgccgaccagu

SEQ ID NO: 1626368 - RNA, 14 nt, Pseudomonas putida KT2440
cgcgcccucuuccg

SEQ ID NO: 1626369 - RNA, 21 nt, Pseudomonas putida KT2440
cgcgcccugcucauccagcaa

SEQ ID NO: 1626370 - RNA, 14 nt, Pseudomonas putida KT2440
cgcgccgccaaccc

SEQ ID NO: 1626371 - RNA, 15 nt, Pseudomonas putida KT2440
cgcgccgccaacccc

SEQ ID NO: 1626372 - RNA, 12 nt, Pseudomonas putida KT2440
cgcgccgccagg

SEQ ID NO: 1626373 - RNA, 13 nt, Pseudomonas putida KT2440
cgcgccgccaggc

SEQ ID NO: 1626374 - RNA, 12 nt, Pseudomonas putida KT2440
cgcgccgccgcu

SEQ ID NO: 1626375 - RNA, 22 nt, Pseudomonas putida KT2440
cgcgccgccgcugcugcgccuc

SEQ ID NO: 1626376 - RNA, 14 nt, Pseudomonas putida KT2440
cgcgcagccuuuga

SEQ ID NO: 1626377 - RNA, 13 nt, Pseudomonas putida KT2440
cgcgcagcggccc

SEQ ID NO: 1626378 - RNA, 15 nt, Pseudomonas putida KT2440
cgcgcagcggccccu

SEQ ID NO: 1626379 - RNA, 19 nt, Pseudomonas putida KT2440
cgcgcagcggccccuuuca

SEQ ID NO: 1626380 - RNA, 14 nt, Pseudomonas putida KT2440
cgcgcagggcaucg

SEQ ID NO: 1626381 - RNA, 16 nt, Pseudomonas putida KT2440
cgcgcaggguuuucag

SEQ ID NO: 1626382 - RNA, 14 nt, Pseudomonas putida KT2440
cgcgcaggcgcugc

SEQ ID NO: 1626383 - RNA, 15 nt, Pseudomonas putida KT2440
cgcgcagcacuuccu

SEQ ID NO: 1626384 - RNA, 15 nt, Pseudomonas putida KT2440
cgcgcagagaagccg

SEQ ID NO: 1626385 - RNA, 15 nt, Pseudomonas putida KT2440
cgcgcaccuccugcg

SEQ ID NO: 1626386 - RNA, 22 nt, Pseudomonas putida KT2440
cgcgccaaccgcgccagcaaug

SEQ ID NO: 1626387 - RNA, 21 nt, Pseudomonas putida KT2440
cgcgccacuucuuccacgcgc

SEQ ID NO: 1626388 - RNA, 13 nt, Pseudomonas putida KT2440
cgcgccagcagcg

SEQ ID NO: 1626389 - RNA, 13 nt, Pseudomonas putida KT2440
cgcgccagccugg

SEQ ID NO: 1626390 - RNA, 20 nt, Pseudomonas putida KT2440
cgcgcaucagccgcgcccuc

SEQ ID NO: 1626391 - RNA, 17 nt, Pseudomonas putida KT2440
cgcgcauuucguccagg

SEQ ID NO: 1626392 - RNA, 18 nt, Pseudomonas putida KT2440
cgcgcauuucguccaggc

SEQ ID NO: 1626393 - RNA, 20 nt, Pseudomonas putida KT2440
cgcgcauuucguccaggcuc

SEQ ID NO: 1626394 - RNA, 22 nt, Pseudomonas putida KT2440
cgcgcauuucguccaggcucag

SEQ ID NO: 1626395 - RNA, 22 nt, Pseudomonas putida KT2440
cgcgcaugaaggacaucaccag

SEQ ID NO: 1626396 - RNA, 20 nt, Pseudomonas putida KT2440
cgcgcauccuccgcccugcc

SEQ ID NO: 1626397 - RNA, 23 nt, Pseudomonas putida KT2440
cgcgcauccuccgcccugcccuc

SEQ ID NO: 1626398 - RNA, 19 nt, Pseudomonas putida KT2440
cgcgacgauggacagccca

SEQ ID NO: 1626399 - RNA, 15 nt, Pseudomonas putida KT2440
cgcgacgcagcagcg

SEQ ID NO: 1626400 - RNA, 19 nt, Pseudomonas putida KT2440
cgcgaccaucaccgccagc

SEQ ID NO: 1626401 - RNA, 15 nt, Pseudomonas putida KT2440
cgcgacagggcgccc

SEQ ID NO: 1626402 - RNA, 18 nt, Pseudomonas putida KT2440
cgcgacaguucgccaccc

SEQ ID NO: 1626403 - RNA, 21 nt, Pseudomonas putida KT2440
cgcgacagcguugcuccagcu

SEQ ID NO: 1626404 - RNA, 22 nt, Pseudomonas putida KT2440
cgcgacuggugcucugcaggca

SEQ ID NO: 1626405 - RNA, 14 nt, Pseudomonas putida KT2440
cgcgacgggcugcu

SEQ ID NO: 1626406 - RNA, 18 nt, Pseudomonas putida KT2440
cgcgacgggcugcucccg

SEQ ID NO: 1626407 - RNA, 14 nt, Pseudomonas putida KT2440
cgcgacgggaagug

SEQ ID NO: 1626408 - RNA, 19 nt, Pseudomonas putida KT2440
cgcgagcgucucgccaaac

SEQ ID NO: 1626409 - RNA, 20 nt, Pseudomonas putida KT2440
cgcgagcgucucgccaaacu

SEQ ID NO: 1626410 - RNA, 19 nt, Pseudomonas putida KT2440
cgcgagcguuaccaacagu

SEQ ID NO: 1626411 - RNA, 17 nt, Pseudomonas putida KT2440
cgcgaggaaacccgcgc

SEQ ID NO: 1626412 - RNA, 18 nt, Pseudomonas putida KT2440
cgcgaucccugugggagc

SEQ ID NO: 1626413 - RNA, 14 nt, Pseudomonas putida KT2440
cgcgaucggcagcg

SEQ ID NO: 1626414 - RNA, 15 nt, Pseudomonas putida KT2440
cgcgaugcgccgcgc

SEQ ID NO: 1626415 - RNA, 19 nt, Pseudomonas putida KT2440
cgcgaugcgccgcgcgggc

SEQ ID NO: 1626416 - RNA, 19 nt, Pseudomonas putida KT2440
cgcgauagggcugcggggc

SEQ ID NO: 1626417 - RNA, 16 nt, Pseudomonas putida KT2440
cgcgauaucagcgcca

SEQ ID NO: 1626418 - RNA, 19 nt, Pseudomonas putida KT2440
cgcgaguaaagccagcagc

SEQ ID NO: 1626419 - RNA, 18 nt, Pseudomonas putida KT2440
cgcgaguaacgcccuuca

SEQ ID NO: 1626420 - RNA, 14 nt, Pseudomonas putida KT2440
cgcgcaagcaggug

SEQ ID NO: 1626421 - RNA, 19 nt, Pseudomonas putida KT2440
cgcgcaagcguucgagcau

SEQ ID NO: 1626422 - RNA, 12 nt, Pseudomonas putida KT2440
cgcgcaacugcc

SEQ ID NO: 1626423 - RNA, 20 nt, Pseudomonas putida KT2440
cgcgcaaaugcuugcccgcc

SEQ ID NO: 1626424 - RNA, 22 nt, Pseudomonas putida KT2440
cgcgcaaaugcuugcccgccuu

SEQ ID NO: 1626425 - RNA, 14 nt, Pseudomonas putida KT2440
cgcgcaacaccgcc

SEQ ID NO: 1626426 - RNA, 17 nt, Pseudomonas putida KT2440
cgcgcaacaccgccagc

SEQ ID NO: 1626427 - RNA, 19 nt, Pseudomonas putida KT2440
cgcgcaacaccgccagcgg

SEQ ID NO: 1626428 - RNA, 14 nt, Pseudomonas putida KT2440
cgccggccgcacuu

SEQ ID NO: 1626429 - RNA, 15 nt, Pseudomonas putida KT2440
cgccggcgccgugcu

SEQ ID NO: 1626430 - RNA, 18 nt, Pseudomonas putida KT2440
cgccggcgucggcgcgca

SEQ ID NO: 1626431 - RNA, 14 nt, Pseudomonas putida KT2440
cgccgggcgcacca

SEQ ID NO: 1626432 - RNA, 16 nt, Pseudomonas putida KT2440
cgccgggaugguaacg

SEQ ID NO: 1626433 - RNA, 17 nt, Pseudomonas putida KT2440
cgccgguggcggccgca

SEQ ID NO: 1626434 - RNA, 21 nt, Pseudomonas putida KT2440
cgccgguggcggccgcagccc

SEQ ID NO: 1626435 - RNA, 14 nt, Pseudomonas putida KT2440
cgccgguugcgcag

SEQ ID NO: 1626436 - RNA, 16 nt, Pseudomonas putida KT2440
cgccggugugcauuuu

SEQ ID NO: 1626437 - RNA, 16 nt, Pseudomonas putida KT2440
cgccgguuucucgcag

SEQ ID NO: 1626438 - RNA, 20 nt, Pseudomonas putida KT2440
cgccgguuucucgcagcagc

SEQ ID NO: 1626439 - RNA, 22 nt, Pseudomonas putida KT2440
cgccgguuucucgcagcagcac

SEQ ID NO: 1626440 - RNA, 18 nt, Pseudomonas putida KT2440
cgccgguaucacccagua

SEQ ID NO: 1626441 - RNA, 19 nt, Pseudomonas putida KT2440
cgccggguugcucauccac

SEQ ID NO: 1626442 - RNA, 16 nt, Pseudomonas putida KT2440
cgccggguccaccagc

SEQ ID NO: 1626443 - RNA, 14 nt, Pseudomonas putida KT2440
cgccggcaacuccu

SEQ ID NO: 1626444 - RNA, 19 nt, Pseudomonas putida KT2440
cgccggcaacuccuccagc

SEQ ID NO: 1626445 - RNA, 16 nt, Pseudomonas putida KT2440
cgccggauuucuucca

SEQ ID NO: 1626446 - RNA, 22 nt, Pseudomonas putida KT2440
cgccggccauugccgcgccgca

SEQ ID NO: 1626447 - RNA, 19 nt, Pseudomonas putida KT2440
cgccggcaucgccuccagc

SEQ ID NO: 1626448 - RNA, 21 nt, Pseudomonas putida KT2440
cgccggcaucgccuccagcgc

SEQ ID NO: 1626449 - RNA, 22 nt, Pseudomonas putida KT2440
cgccggcacgcuaccaccuggc

SEQ ID NO: 1626450 - RNA, 13 nt, Pseudomonas putida KT2440
cgccggcacuucc

SEQ ID NO: 1626451 - RNA, 20 nt, Pseudomonas putida KT2440
cgccgcugcugcgccucgca

SEQ ID NO: 1626452 - RNA, 13 nt, Pseudomonas putida KT2440
cgccgcugccugg

SEQ ID NO: 1626453 - RNA, 14 nt, Pseudomonas putida KT2440
cgccgcugccuggg

SEQ ID NO: 1626454 - RNA, 18 nt, Pseudomonas putida KT2440
cgccgcuguacaccagga

SEQ ID NO: 1626455 - RNA, 19 nt, Pseudomonas putida KT2440
cgccgcugguacaggguca

SEQ ID NO: 1626456 - RNA, 19 nt, Pseudomonas putida KT2440
cgccgcugccaaccggcuu

SEQ ID NO: 1626457 - RNA, 16 nt, Pseudomonas putida KT2440
cgccgcugccagcagg

SEQ ID NO: 1626458 - RNA, 22 nt, Pseudomonas putida KT2440
cgccgcuuuguuugcuggcaug

SEQ ID NO: 1626459 - RNA, 20 nt, Pseudomonas putida KT2440
cgccgcgcggcuugcucgcg

SEQ ID NO: 1626460 - RNA, 19 nt, Pseudomonas putida KT2440
cgccgcgcgggcggcgcuu

SEQ ID NO: 1626461 - RNA, 15 nt, Pseudomonas putida KT2440
cgccgccuccaccgg

SEQ ID NO: 1626462 - RNA, 12 nt, Pseudomonas putida KT2440
cgcccuggcaug

SEQ ID NO: 1626463 - RNA, 17 nt, Pseudomonas putida KT2440
cgcccugggcgagcagg

SEQ ID NO: 1626464 - RNA, 21 nt, Pseudomonas putida KT2440
cgcccugagccaaggccgccc

SEQ ID NO: 1626465 - RNA, 14 nt, Pseudomonas putida KT2440
cgcccugcgccugc

SEQ ID NO: 1626466 - RNA, 16 nt, Pseudomonas putida KT2440
cgcccuucgcggaagc

SEQ ID NO: 1626467 - RNA, 20 nt, Pseudomonas putida KT2440
cgcccuucauacagcgccuc

SEQ ID NO: 1626468 - RNA, 22 nt, Pseudomonas putida KT2440
cgcccuguaccgccucgggggc

SEQ ID NO: 1626469 - RNA, 19 nt, Pseudomonas putida KT2440
cgcccuugucagccgccgc

SEQ ID NO: 1626470 - RNA, 20 nt, Pseudomonas putida KT2440
cgcccguaugcauccgccau

SEQ ID NO: 1626471 - RNA, 21 nt, Pseudomonas putida KT2440
cgcccgguuuggccugacgcu

SEQ ID NO: 1626472 - RNA, 16 nt, Pseudomonas putida KT2440
cgcccucuucgcgggc

SEQ ID NO: 1626473 - RNA, 14 nt, Pseudomonas putida KT2440
cgcccuccagccgc

SEQ ID NO: 1626474 - RNA, 19 nt, Pseudomonas putida KT2440
cgccgaccaguaccacagc

SEQ ID NO: 1626475 - RNA, 16 nt, Pseudomonas putida KT2440
cgccgaacucuggcaa

SEQ ID NO: 1626476 - RNA, 17 nt, Pseudomonas putida KT2440
cgccgaagcgcgccugg

SEQ ID NO: 1626477 - RNA, 14 nt, Pseudomonas putida KT2440
cgccgaaccccacc

SEQ ID NO: 1626478 - RNA, 12 nt, Pseudomonas putida KT2440
cgccgaccgcgc

SEQ ID NO: 1626479 - RNA, 14 nt, Pseudomonas putida KT2440
cgccgaccgcgcgc

SEQ ID NO: 1626480 - RNA, 19 nt, Pseudomonas putida KT2440
cgccgaccgcgcgcacggu

SEQ ID NO: 1626481 - RNA, 18 nt, Pseudomonas putida KT2440
cgccgacccugugggagc

SEQ ID NO: 1626482 - RNA, 19 nt, Pseudomonas putida KT2440
cgccgaccgaaccggcgcu

SEQ ID NO: 1626483 - RNA, 21 nt, Pseudomonas putida KT2440
cgccgacggcauggccgaagc

SEQ ID NO: 1626484 - RNA, 18 nt, Pseudomonas putida KT2440
cgccgacgauaccgccca

SEQ ID NO: 1626485 - RNA, 20 nt, Pseudomonas putida KT2440
cgccgagcauccgcgccacu

SEQ ID NO: 1626486 - RNA, 19 nt, Pseudomonas putida KT2440
cgccgagcauuacaggcag

SEQ ID NO: 1626487 - RNA, 20 nt, Pseudomonas putida KT2440
cgccgagcgagugaccuugg

SEQ ID NO: 1626488 - RNA, 15 nt, Pseudomonas putida KT2440
cgccgagaggcgcug

SEQ ID NO: 1626489 - RNA, 21 nt, Pseudomonas putida KT2440
cgccgccagaccaccucaucc

SEQ ID NO: 1626490 - RNA, 22 nt, Pseudomonas putida KT2440
cgccgccagaccaccucauccc

SEQ ID NO: 1626491 - RNA, 11 nt, Pseudomonas putida KT2440
cgccgccaccu

SEQ ID NO: 1626492 - RNA, 13 nt, Pseudomonas putida KT2440
cgccgccagcggc

SEQ ID NO: 1626493 - RNA, 13 nt, Pseudomonas putida KT2440
cgccgccagggca

SEQ ID NO: 1626494 - RNA, 19 nt, Pseudomonas putida KT2440
cgccgccccacucgcgcag

SEQ ID NO: 1626495 - RNA, 15 nt, Pseudomonas putida KT2440
cgccgccgaacucug

SEQ ID NO: 1626496 - RNA, 22 nt, Pseudomonas putida KT2440
cgccgcccuuggugcaccagcu

SEQ ID NO: 1626497 - RNA, 15 nt, Pseudomonas putida KT2440
cgccgcccuggaugc

SEQ ID NO: 1626498 - RNA, 20 nt, Pseudomonas putida KT2440
cgccgccgguuucucgcagc

SEQ ID NO: 1626499 - RNA, 17 nt, Pseudomonas putida KT2440
cgccgccgagugcgcgg

SEQ ID NO: 1626500 - RNA, 12 nt, Pseudomonas putida KT2440
cgccgccgccuc

SEQ ID NO: 1626501 - RNA, 13 nt, Pseudomonas putida KT2440
cgccgccgccucg

SEQ ID NO: 1626502 - RNA, 18 nt, Pseudomonas putida KT2440
cgccgcaaccgccgcgcc

SEQ ID NO: 1626503 - RNA, 19 nt, Pseudomonas putida KT2440
cgccgcaaccgccgcgccu

SEQ ID NO: 1626504 - RNA, 22 nt, Pseudomonas putida KT2440
cgccgcaaccgccgcgccucgc

SEQ ID NO: 1626505 - RNA, 21 nt, Pseudomonas putida KT2440
cgccgccaaaaaauccgccug

SEQ ID NO: 1626506 - RNA, 21 nt, Pseudomonas putida KT2440
cgccgcaucguuauccagcac

SEQ ID NO: 1626507 - RNA, 19 nt, Pseudomonas putida KT2440
cgccgccaccagcgccgcc

SEQ ID NO: 1626508 - RNA, 19 nt, Pseudomonas putida KT2440
cgccgauaaagcgucgccc

SEQ ID NO: 1626509 - RNA, 20 nt, Pseudomonas putida KT2440
cgccgauaccgaacaccagu

SEQ ID NO: 1626510 - RNA, 15 nt, Pseudomonas putida KT2440
cgccgauagcagcac

SEQ ID NO: 1626511 - RNA, 14 nt, Pseudomonas putida KT2440
cgccgaucauugcu

SEQ ID NO: 1626512 - RNA, 20 nt, Pseudomonas putida KT2440
cgccgaucauugcugcggua

SEQ ID NO: 1626513 - RNA, 15 nt, Pseudomonas putida KT2440
cgccgaucagcuggg

SEQ ID NO: 1626514 - RNA, 21 nt, Pseudomonas putida KT2440
cgccgauguuggucaccacgu

SEQ ID NO: 1626515 - RNA, 14 nt, Pseudomonas putida KT2440
cgccagcgcaugca

SEQ ID NO: 1626516 - RNA, 13 nt, Pseudomonas putida KT2440
cgccagcgccugg

SEQ ID NO: 1626517 - RNA, 20 nt, Pseudomonas putida KT2440
cgccagcggcaguugcaggc

SEQ ID NO: 1626518 - RNA, 21 nt, Pseudomonas putida KT2440
cgccagcggcaaacacacccu

SEQ ID NO: 1626519 - RNA, 13 nt, Pseudomonas putida KT2440
cgccagcgcucca

SEQ ID NO: 1626520 - RNA, 18 nt, Pseudomonas putida KT2440
cgccagcgcuccagcaac

SEQ ID NO: 1626521 - RNA, 18 nt, Pseudomonas putida KT2440
cgccagcgguugagauga

SEQ ID NO: 1626522 - RNA, 21 nt, Pseudomonas putida KT2440
cgccagcgggcuggcauucaa

SEQ ID NO: 1626523 - RNA, 23 nt, Pseudomonas putida KT2440
cgccagcggcguguaguagcucc

SEQ ID NO: 1626524 - RNA, 19 nt, Pseudomonas putida KT2440
cgccagcggcucgaccaag

SEQ ID NO: 1626525 - RNA, 15 nt, Pseudomonas putida KT2440
cgccagcggcucgau

SEQ ID NO: 1626526 - RNA, 12 nt, Pseudomonas putida KT2440
cgccagcugcug

SEQ ID NO: 1626527 - RNA, 17 nt, Pseudomonas putida KT2440
cgccaggcucuccagcc

SEQ ID NO: 1626528 - RNA, 19 nt, Pseudomonas putida KT2440
cgccaggcucuccagccgc

SEQ ID NO: 1626529 - RNA, 20 nt, Pseudomonas putida KT2440
cgccaggcucuccagccgcu

SEQ ID NO: 1626530 - RNA, 15 nt, Pseudomonas putida KT2440
cgccaggcagcagac

SEQ ID NO: 1626531 - RNA, 15 nt, Pseudomonas putida KT2440
cgccaggcauugcuc

SEQ ID NO: 1626532 - RNA, 21 nt, Pseudomonas putida KT2440
cgccagugggugcuguggcgc

SEQ ID NO: 1626533 - RNA, 16 nt, Pseudomonas putida KT2440
cgccagugcaaacugg

SEQ ID NO: 1626534 - RNA, 18 nt, Pseudomonas putida KT2440
cgccaguucgacgcugcu

SEQ ID NO: 1626535 - RNA, 14 nt, Pseudomonas putida KT2440
cgccauaggccgcc

SEQ ID NO: 1626536 - RNA, 19 nt, Pseudomonas putida KT2440
cgccagggcucaagacagu

SEQ ID NO: 1626537 - RNA, 19 nt, Pseudomonas putida KT2440
cgccagggcaucgaccagu

SEQ ID NO: 1626538 - RNA, 17 nt, Pseudomonas putida KT2440
cgccaggguuugcaagc

SEQ ID NO: 1626539 - RNA, 21 nt, Pseudomonas putida KT2440
cgccaggugauuuccucuuca

SEQ ID NO: 1626540 - RNA, 17 nt, Pseudomonas putida KT2440
cgccaggugccgucggg

SEQ ID NO: 1626541 - RNA, 14 nt, Pseudomonas putida KT2440
cgccaggucggcgg

SEQ ID NO: 1626542 - RNA, 17 nt, Pseudomonas putida KT2440
cgccagguuggcccuga

SEQ ID NO: 1626543 - RNA, 19 nt, Pseudomonas putida KT2440
cgccaguacggccaucagc

SEQ ID NO: 1626544 - RNA, 18 nt, Pseudomonas putida KT2440
cgccaguagcaaucaggu

SEQ ID NO: 1626545 - RNA, 22 nt, Pseudomonas putida KT2440
cgccaccagccccaaucccaac

SEQ ID NO: 1626546 - RNA, 15 nt, Pseudomonas putida KT2440
cgccacccccgccgc

SEQ ID NO: 1626547 - RNA, 13 nt, Pseudomonas putida KT2440
cgccaccccaggc

SEQ ID NO: 1626548 - RNA, 20 nt, Pseudomonas putida KT2440
cgccaccaugcucaccgcca

SEQ ID NO: 1626549 - RNA, 22 nt, Pseudomonas putida KT2440
cgccaccaugcucaccgccaac

SEQ ID NO: 1626550 - RNA, 21 nt, Pseudomonas putida KT2440
cgccaccaugcucggccagcu

SEQ ID NO: 1626551 - RNA, 21 nt, Pseudomonas putida KT2440
cgccaccacgaacaguggccc

SEQ ID NO: 1626552 - RNA, 19 nt, Pseudomonas putida KT2440
cgccaccacgaugccuggg

SEQ ID NO: 1626553 - RNA, 14 nt, Pseudomonas putida KT2440
cgccaccgcgcggu

SEQ ID NO: 1626554 - RNA, 19 nt, Pseudomonas putida KT2440
cgccaccggcauucccggc

SEQ ID NO: 1626555 - RNA, 22 nt, Pseudomonas putida KT2440
cgccaccgggcgcgauugccuu

SEQ ID NO: 1626556 - RNA, 14 nt, Pseudomonas putida KT2440
cgccaccaaucugu

SEQ ID NO: 1626557 - RNA, 16 nt, Pseudomonas putida KT2440
cgccacaugcccgcgg

SEQ ID NO: 1626558 - RNA, 16 nt, Pseudomonas putida KT2440
cgccacauccgcgcau

SEQ ID NO: 1626559 - RNA, 20 nt, Pseudomonas putida KT2440
cgccacaggugacaagcugc

SEQ ID NO: 1626560 - RNA, 18 nt, Pseudomonas putida KT2440
cgccacacccgcuacacc

SEQ ID NO: 1626561 - RNA, 14 nt, Pseudomonas putida KT2440
cgccacaccacagc

SEQ ID NO: 1626562 - RNA, 18 nt, Pseudomonas putida KT2440
cgccacaccacagcugca

SEQ ID NO: 1626563 - RNA, 20 nt, Pseudomonas putida KT2440
cgcagucagccacauccucu

SEQ ID NO: 1626564 - RNA, 21 nt, Pseudomonas putida KT2440
cgccacaacccaucacggccu

SEQ ID NO: 1626565 - RNA, 16 nt, Pseudomonas putida KT2440
cgccacugaccagccc

SEQ ID NO: 1626566 - RNA, 21 nt, Pseudomonas putida KT2440
cgccagcaccaucaggcacag

SEQ ID NO: 1626567 - RNA, 15 nt, Pseudomonas putida KT2440
cgccagcaggccgcc

SEQ ID NO: 1626568 - RNA, 17 nt, Pseudomonas putida KT2440
cgccagcaggccgccga

SEQ ID NO: 1626569 - RNA, 17 nt, Pseudomonas putida KT2440
cgccagcagcgcuccgc

SEQ ID NO: 1626570 - RNA, 22 nt, Pseudomonas putida KT2440
cgccagcagcgcuccgccaaac

SEQ ID NO: 1626571 - RNA, 22 nt, Pseudomonas putida KT2440
cgccagcagcggguuccccagc

SEQ ID NO: 1626572 - RNA, 20 nt, Pseudomonas putida KT2440
cgccaccuuguucgagcgcc

SEQ ID NO: 1626573 - RNA, 21 nt, Pseudomonas putida KT2440
cgccaccuuguucgagcgcca

SEQ ID NO: 1626574 - RNA, 24 nt, Pseudomonas putida KT2440
cgccaccuuguucgagcgccauga

SEQ ID NO: 1626575 - RNA, 22 nt, Pseudomonas putida KT2440
cgccacgaucgacaaccccagc

SEQ ID NO: 1626576 - RNA, 16 nt, Pseudomonas putida KT2440
cgccacggcgcugacc

SEQ ID NO: 1626577 - RNA, 21 nt, Pseudomonas putida KT2440
cgccacgguacgggcaaagcc

SEQ ID NO: 1626578 - RNA, 15 nt, Pseudomonas putida KT2440
cgccagccgccacga

SEQ ID NO: 1626579 - RNA, 17 nt, Pseudomonas putida KT2440
cgccagccguugcgccg

SEQ ID NO: 1626580 - RNA, 14 nt, Pseudomonas putida KT2440
cgccagccugcagc

SEQ ID NO: 1626581 - RNA, 13 nt, Pseudomonas putida KT2440
cgccagccgcggg

SEQ ID NO: 1626582 - RNA, 17 nt, Pseudomonas putida KT2440
cgccagccgcucagcca

SEQ ID NO: 1626583 - RNA, 24 nt, Pseudomonas putida KT2440
cgccagccgcucagccaccugugg

SEQ ID NO: 1626584 - RNA, 16 nt, Pseudomonas putida KT2440
cgccagcagccgggcc

SEQ ID NO: 1626585 - RNA, 23 nt, Pseudomonas putida KT2440
cgccagcaguuucagcggccgcu

SEQ ID NO: 1626586 - RNA, 13 nt, Pseudomonas putida KT2440
cgccagcauggcc

SEQ ID NO: 1626587 - RNA, 16 nt, Pseudomonas putida KT2440
cgccagcaucacgccg

SEQ ID NO: 1626588 - RNA, 19 nt, Pseudomonas putida KT2440
cgccagcaucacgccgcgc

SEQ ID NO: 1626589 - RNA, 20 nt, Pseudomonas putida KT2440
cgccagcaucacgccgcgcu

SEQ ID NO: 1626590 - RNA, 13 nt, Pseudomonas putida KT2440
cgccagccccagc

SEQ ID NO: 1626591 - RNA, 18 nt, Pseudomonas putida KT2440
cgccagccaguacggcag

SEQ ID NO: 1626592 - RNA, 15 nt, Pseudomonas putida KT2440
cgcccaucucaggcc

SEQ ID NO: 1626593 - RNA, 16 nt, Pseudomonas putida KT2440
cgcccaucucaggccc

SEQ ID NO: 1626594 - RNA, 19 nt, Pseudomonas putida KT2440
cgcccaugaaguucaucca

SEQ ID NO: 1626595 - RNA, 17 nt, Pseudomonas putida KT2440
cgcccaugcgcgugcgu

SEQ ID NO: 1626596 - RNA, 14 nt, Pseudomonas putida KT2440
cgcccaguagcgcc

SEQ ID NO: 1626597 - RNA, 20 nt, Pseudomonas putida KT2440
cgcccaguagcgccaccauc

SEQ ID NO: 1626598 - RNA, 12 nt, Pseudomonas putida KT2440
cgcccagugccu

SEQ ID NO: 1626599 - RNA, 15 nt, Pseudomonas putida KT2440
cgcccaggccgccga

SEQ ID NO: 1626600 - RNA, 17 nt, Pseudomonas putida KT2440
cgcccaggcgccgcagc

SEQ ID NO: 1626601 - RNA, 22 nt, Pseudomonas putida KT2440
cgcccagguuacgcagaauauu

SEQ ID NO: 1626602 - RNA, 22 nt, Pseudomonas putida KT2440
cgcccagguuauacgccgccga

SEQ ID NO: 1626603 - RNA, 16 nt, Pseudomonas putida KT2440
cgcccaggucaaucuu

SEQ ID NO: 1626604 - RNA, 19 nt, Pseudomonas putida KT2440
cgcccaggucaaucuugug

SEQ ID NO: 1626605 - RNA, 12 nt, Pseudomonas putida KT2440
cgcccagcugga

SEQ ID NO: 1626606 - RNA, 18 nt, Pseudomonas putida KT2440
cgcccagcuggagacgaa

SEQ ID NO: 1626607 - RNA, 18 nt, Pseudomonas putida KT2440
cgcccagcuucuccagca

SEQ ID NO: 1626608 - RNA, 14 nt, Pseudomonas putida KT2440
cgcccacucacgca

SEQ ID NO: 1626609 - RNA, 15 nt, Pseudomonas putida KT2440
cgcccacgccgcugg

SEQ ID NO: 1626610 - RNA, 16 nt, Pseudomonas putida KT2440
cgcccacgccggcaac

SEQ ID NO: 1626611 - RNA, 17 nt, Pseudomonas putida KT2440
cgcccacgaucucacgc

SEQ ID NO: 1626612 - RNA, 22 nt, Pseudomonas putida KT2440
cgcccacgaucucacgcgccac

SEQ ID NO: 1626613 - RNA, 13 nt, Pseudomonas putida KT2440
cgcccacgcgggu

SEQ ID NO: 1626614 - RNA, 15 nt, Pseudomonas putida KT2440
cgcccaccaccagcc

SEQ ID NO: 1626615 - RNA, 12 nt, Pseudomonas putida KT2440
cgcccaccacca

SEQ ID NO: 1626616 - RNA, 13 nt, Pseudomonas putida KT2440
cgcccaccaccag

SEQ ID NO: 1626617 - RNA, 14 nt, Pseudomonas putida KT2440
cgcccaccaccagc

SEQ ID NO: 1626618 - RNA, 11 nt, Pseudomonas putida KT2440
cgcccagcagc

SEQ ID NO: 1626619 - RNA, 22 nt, Pseudomonas putida KT2440
cgcccagcaacaugccggccca

SEQ ID NO: 1626620 - RNA, 16 nt, Pseudomonas putida KT2440
cgcccagcagccaacg

SEQ ID NO: 1626621 - RNA, 21 nt, Pseudomonas putida KT2440
cgccaugcagcccgcaccggc

SEQ ID NO: 1626622 - RNA, 19 nt, Pseudomonas putida KT2440
cgccaugagugcaggcaua

SEQ ID NO: 1626623 - RNA, 18 nt, Pseudomonas putida KT2440
cgccauggcgacaauggc

SEQ ID NO: 1626624 - RNA, 19 nt, Pseudomonas putida KT2440
cgccauguaccgggcggcc

SEQ ID NO: 1626625 - RNA, 16 nt, Pseudomonas putida KT2440
cgccauucaccagcuu

SEQ ID NO: 1626626 - RNA, 20 nt, Pseudomonas putida KT2440
cgccauguugcgcagcaauc

SEQ ID NO: 1626627 - RNA, 16 nt, Pseudomonas putida KT2440
cgccauugcaccacgc

SEQ ID NO: 1626628 - RNA, 14 nt, Pseudomonas putida KT2440
cgcccaaucgggua

SEQ ID NO: 1626629 - RNA, 22 nt, Pseudomonas putida KT2440
cgcccaaugcagccgcccgccc

SEQ ID NO: 1626630 - RNA, 15 nt, Pseudomonas putida KT2440
cgcccacacggcaag

SEQ ID NO: 1626631 - RNA, 16 nt, Pseudomonas putida KT2440
cgcccaagccggccgg

SEQ ID NO: 1626632 - RNA, 16 nt, Pseudomonas putida KT2440
cgccauugcccagccu

SEQ ID NO: 1626633 - RNA, 17 nt, Pseudomonas putida KT2440
cgccauugcccagccug

SEQ ID NO: 1626634 - RNA, 21 nt, Pseudomonas putida KT2440
cgccauugcccaguucgucca

SEQ ID NO: 1626635 - RNA, 15 nt, Pseudomonas putida KT2440
cgccaucggccucuc

SEQ ID NO: 1626636 - RNA, 21 nt, Pseudomonas putida KT2440
cgccaucggccucucucagca

SEQ ID NO: 1626637 - RNA, 14 nt, Pseudomonas putida KT2440
cgccaucgcgcagg

SEQ ID NO: 1626638 - RNA, 16 nt, Pseudomonas putida KT2440
cgccaucgccccgcgc

SEQ ID NO: 1626639 - RNA, 17 nt, Pseudomonas putida KT2440
cgccaucgcccgucagc

SEQ ID NO: 1626640 - RNA, 15 nt, Pseudomonas putida KT2440
cgccauccccccagc

SEQ ID NO: 1626641 - RNA, 22 nt, Pseudomonas putida KT2440
cgccauccccccagcccuugcg

SEQ ID NO: 1626642 - RNA, 17 nt, Pseudomonas putida KT2440
cgcccgcgccgcccagc

SEQ ID NO: 1626643 - RNA, 17 nt, Pseudomonas putida KT2440
cgcccgcgcagcuucca

SEQ ID NO: 1626644 - RNA, 23 nt, Pseudomonas putida KT2440
cgcccgccguguucccagcaccc

SEQ ID NO: 1626645 - RNA, 19 nt, Pseudomonas putida KT2440
cgcccgccucgccauaagc

SEQ ID NO: 1626646 - RNA, 20 nt, Pseudomonas putida KT2440
cgcccgcguccggcuugaga

SEQ ID NO: 1626647 - RNA, 12 nt, Pseudomonas putida KT2440
cgcccgcggccc

SEQ ID NO: 1626648 - RNA, 15 nt, Pseudomonas putida KT2440
cgcccgcgcggcgcu

SEQ ID NO: 1626649 - RNA, 12 nt, Pseudomonas putida KT2440
cgcccgcgcggc

SEQ ID NO: 1626650 - RNA, 19 nt, Pseudomonas putida KT2440
cgcccgcagugcacgcggg

SEQ ID NO: 1626651 - RNA, 20 nt, Pseudomonas putida KT2440
cgcccgcaaccucggccgca

SEQ ID NO: 1626652 - RNA, 15 nt, Pseudomonas putida KT2440
cgcccgcaccgccgc

SEQ ID NO: 1626653 - RNA, 12 nt, Pseudomonas putida KT2440
cgcccgccgccc

SEQ ID NO: 1626654 - RNA, 14 nt, Pseudomonas putida KT2440
cgcccgccgcccgc

SEQ ID NO: 1626655 - RNA, 13 nt, Pseudomonas putida KT2440
cgcccgccggcac

SEQ ID NO: 1626656 - RNA, 16 nt, Pseudomonas putida KT2440
cgcccgccggcacuuc

SEQ ID NO: 1626657 - RNA, 18 nt, Pseudomonas putida KT2440
cgcccgccggcacuuccu

SEQ ID NO: 1626658 - RNA, 16 nt, Pseudomonas putida KT2440
cgcccgcccgacgcuu

SEQ ID NO: 1626659 - RNA, 13 nt, Pseudomonas putida KT2440
cgcccggccaggu

SEQ ID NO: 1626660 - RNA, 15 nt, Pseudomonas putida KT2440
cgcccggcaaacaca

SEQ ID NO: 1626661 - RNA, 20 nt, Pseudomonas putida KT2440
cgcccggcaaacacauccac

SEQ ID NO: 1626662 - RNA, 17 nt, Pseudomonas putida KT2440
cgcccggauggggcgug

SEQ ID NO: 1626663 - RNA, 16 nt, Pseudomonas putida KT2440
cgcccgcugcaugcuc

SEQ ID NO: 1626664 - RNA, 16 nt, Pseudomonas putida KT2440
cgcccgcugcgccgcu

SEQ ID NO: 1626665 - RNA, 15 nt, Pseudomonas putida KT2440
cgcccgcucccacag

SEQ ID NO: 1626666 - RNA, 18 nt, Pseudomonas putida KT2440
cgcccggcuugcccgggc

SEQ ID NO: 1626667 - RNA, 13 nt, Pseudomonas putida KT2440
cgcccgggccagg

SEQ ID NO: 1626668 - RNA, 18 nt, Pseudomonas putida KT2440
cgcccgggccaggccccu

SEQ ID NO: 1626669 - RNA, 20 nt, Pseudomonas putida KT2440
cgcccgggccaugcuuucca

SEQ ID NO: 1626670 - RNA, 17 nt, Pseudomonas putida KT2440
cgcccgaccgccagccc

SEQ ID NO: 1626671 - RNA, 13 nt, Pseudomonas putida KT2440
cgcccgaccuugg

SEQ ID NO: 1626672 - RNA, 13 nt, Pseudomonas putida KT2440
cgccccugccagc

SEQ ID NO: 1626673 - RNA, 14 nt, Pseudomonas putida KT2440
cgcccgacuggcug

SEQ ID NO: 1626674 - RNA, 13 nt, Pseudomonas putida KT2440
cgccccgcgccgc

SEQ ID NO: 1626675 - RNA, 14 nt, Pseudomonas putida KT2440
cgccccgcgccgcc

SEQ ID NO: 1626676 - RNA, 17 nt, Pseudomonas putida KT2440
cgccccgcgccgccauc

SEQ ID NO: 1626677 - RNA, 12 nt, Pseudomonas putida KT2440
cgccccgccagc

SEQ ID NO: 1626678 - RNA, 20 nt, Pseudomonas putida KT2440
cgcccccaugaugaccacca

SEQ ID NO: 1626679 - RNA, 13 nt, Pseudomonas putida KT2440
cgcccccagcccg

SEQ ID NO: 1626680 - RNA, 13 nt, Pseudomonas putida KT2440
cgccccagcgcgc

SEQ ID NO: 1626681 - RNA, 12 nt, Pseudomonas putida KT2440
cgccccaggccg

SEQ ID NO: 1626682 - RNA, 17 nt, Pseudomonas putida KT2440
cgccccauagccugcug

SEQ ID NO: 1626683 - RNA, 12 nt, Pseudomonas putida KT2440
cgcccccaaacc

SEQ ID NO: 1626684 - RNA, 13 nt, Pseudomonas putida KT2440
cgcccccugggcg

SEQ ID NO: 1626685 - RNA, 22 nt, Pseudomonas putida KT2440
cgccccccaccuggcccugcuc

SEQ ID NO: 1626686 - RNA, 18 nt, Pseudomonas putida KT2440
cgcccccgaccacccggu

SEQ ID NO: 1626687 - RNA, 19 nt, Pseudomonas putida KT2440
cgccccagaaucaucaacg

SEQ ID NO: 1626688 - RNA, 15 nt, Pseudomonas putida KT2440
cgccccacuuccagc

SEQ ID NO: 1626689 - RNA, 16 nt, Pseudomonas putida KT2440
cgccccagcagcgcuu

SEQ ID NO: 1626690 - RNA, 20 nt, Pseudomonas putida KT2440
cgccccagcaguucgcgcac

SEQ ID NO: 1626691 - RNA, 14 nt, Pseudomonas putida KT2440
cgccccaccucuuc

SEQ ID NO: 1626692 - RNA, 21 nt, Pseudomonas putida KT2440
cgauaguggcguuuuucacac

SEQ ID NO: 1626693 - RNA, 20 nt, Pseudomonas putida KT2440
cgauacggucuuuuccccuu

SEQ ID NO: 1626694 - RNA, 21 nt, Pseudomonas putida KT2440
cgauacggucuuuuccccuua

SEQ ID NO: 1626695 - RNA, 15 nt, Pseudomonas putida KT2440
ccuuccaaccagcca

SEQ ID NO: 1626696 - RNA, 20 nt, Pseudomonas putida KT2440
ccuucauacagcgccuccag

SEQ ID NO: 1626697 - RNA, 18 nt, Pseudomonas putida KT2440
ccuucaucacgcaccagg

SEQ ID NO: 1626698 - RNA, 18 nt, Pseudomonas putida KT2440
ccuucauagaacuuaaau

SEQ ID NO: 1626699 - RNA, 21 nt, Pseudomonas putida KT2440
ccuucauaggcggccacggcc

SEQ ID NO: 1626700 - RNA, 23 nt, Pseudomonas putida KT2440
cgaucccgaugcgcuugaggcuu

SEQ ID NO: 1626701 - RNA, 21 nt, Pseudomonas putida KT2440
cgaucccgaggucagcagugg

SEQ ID NO: 1626702 - RNA, 14 nt, Pseudomonas putida KT2440
cgauccaggaucac

SEQ ID NO: 1626703 - RNA, 22 nt, Pseudomonas putida KT2440
cgauccuuggcgaaggcugccu

SEQ ID NO: 1626704 - RNA, 17 nt, Pseudomonas putida KT2440
cgauccucaucguccac

SEQ ID NO: 1626705 - RNA, 22 nt, Pseudomonas putida KT2440
cgaucgaggcgacgaucaucgc

SEQ ID NO: 1626706 - RNA, 20 nt, Pseudomonas putida KT2440
cgaucgacaaccccagcccg

SEQ ID NO: 1626707 - RNA, 18 nt, Pseudomonas putida KT2440
cgaucgaugaacucaccc

SEQ ID NO: 1626708 - RNA, 15 nt, Pseudomonas putida KT2440
cgaucgccggcagcu

SEQ ID NO: 1626709 - RNA, 13 nt, Pseudomonas putida KT2440
cgaucgccgccac

SEQ ID NO: 1626710 - RNA, 14 nt, Pseudomonas putida KT2440
cgaucgccagcccc

SEQ ID NO: 1626711 - RNA, 15 nt, Pseudomonas putida KT2440
cgaucaggcucuguu

SEQ ID NO: 1626712 - RNA, 12 nt, Pseudomonas putida KT2440
cgaucagcuucu

SEQ ID NO: 1626713 - RNA, 16 nt, Pseudomonas putida KT2440
cgaucaggaagccccg

SEQ ID NO: 1626714 - RNA, 13 nt, Pseudomonas putida KT2440
cgaucaggaaggc

SEQ ID NO: 1626715 - RNA, 17 nt, Pseudomonas putida KT2440
cgaucaggaaggcacca

SEQ ID NO: 1626716 - RNA, 16 nt, Pseudomonas putida KT2440
cgaucaggcaggccag

SEQ ID NO: 1626717 - RNA, 17 nt, Pseudomonas putida KT2440
cgaucagcgcacgaccc

SEQ ID NO: 1626718 - RNA, 17 nt, Pseudomonas putida KT2440
cgaucagacgcuccaga

SEQ ID NO: 1626719 - RNA, 20 nt, Pseudomonas putida KT2440
cgaugaaauucaccugccgg

SEQ ID NO: 1626720 - RNA, 18 nt, Pseudomonas putida KT2440
cgaugaacacgccgucga

SEQ ID NO: 1626721 - RNA, 13 nt, Pseudomonas putida KT2440
cgaugaagcaggc

SEQ ID NO: 1626722 - RNA, 13 nt, Pseudomonas putida KT2440
cgaucuuggccag

SEQ ID NO: 1626723 - RNA, 15 nt, Pseudomonas putida KT2440
cgaucuucaggcuga

SEQ ID NO: 1626724 - RNA, 18 nt, Pseudomonas putida KT2440
cgaucuggaucacugcca

SEQ ID NO: 1626725 - RNA, 21 nt, Pseudomonas putida KT2440
cgaugacccuuccagcccgcc

SEQ ID NO: 1626726 - RNA, 23 nt, Pseudomonas putida KT2440
cgaugacccuuccagcccgccug

SEQ ID NO: 1626727 - RNA, 21 nt, Pseudomonas putida KT2440
cgaugaccugcgucaggaccu

SEQ ID NO: 1626728 - RNA, 23 nt, Pseudomonas putida KT2440
cgaucguugguccgcgaguggua

SEQ ID NO: 1626729 - RNA, 14 nt, Pseudomonas putida KT2440
cgaucuccaggugc

SEQ ID NO: 1626730 - RNA, 22 nt, Pseudomonas putida KT2440
cgaucuaugcccggcucaccgc

SEQ ID NO: 1626731 - RNA, 15 nt, Pseudomonas putida KT2440
cgaucucggccagca

SEQ ID NO: 1626732 - RNA, 17 nt, Pseudomonas putida KT2440
cgaucucgccagccugc

SEQ ID NO: 1626733 - RNA, 22 nt, Pseudomonas putida KT2440
cgaucugaaucuucggugccca

SEQ ID NO: 1626734 - RNA, 15 nt, Pseudomonas putida KT2440
cgaucugccugccuc

SEQ ID NO: 1626735 - RNA, 14 nt, Pseudomonas putida KT2440
cgaucggcgcgccu

SEQ ID NO: 1626736 - RNA, 12 nt, Pseudomonas putida KT2440
cgaugcccaccu

SEQ ID NO: 1626737 - RNA, 16 nt, Pseudomonas putida KT2440
cgaugcccgucccuuc

SEQ ID NO: 1626738 - RNA, 21 nt, Pseudomonas putida KT2440
cgaugcaucaauggcuggggg

SEQ ID NO: 1626739 - RNA, 16 nt, Pseudomonas putida KT2440
cgaugaugcuggucgg

SEQ ID NO: 1626740 - RNA, 17 nt, Pseudomonas putida KT2440
cgaugaugugcgccggc

SEQ ID NO: 1626741 - RNA, 17 nt, Pseudomonas putida KT2440
cgaugaucgccuggccg

SEQ ID NO: 1626742 - RNA, 23 nt, Pseudomonas putida KT2440
cgaugaugauaccgaacagcacc

SEQ ID NO: 1626743 - RNA, 14 nt, Pseudomonas putida KT2440
cgauggccaccagg

SEQ ID NO: 1626744 - RNA, 18 nt, Pseudomonas putida KT2440
cgaugcggugcucaugca

SEQ ID NO: 1626745 - RNA, 20 nt, Pseudomonas putida KT2440
cgauggccuugaucaggccc

SEQ ID NO: 1626746 - RNA, 22 nt, Pseudomonas putida KT2440
cgauguacucaggggcauugcg

SEQ ID NO: 1626747 - RNA, 23 nt, Pseudomonas putida KT2440
cgauguacaccccgaccaaggcc

SEQ ID NO: 1626748 - RNA, 19 nt, Pseudomonas putida KT2440
cgcaaacugauucacgccc

SEQ ID NO: 1626749 - RNA, 18 nt, Pseudomonas putida KT2440
cgcaaagcggcccccagc

SEQ ID NO: 1626750 - RNA, 21 nt, Pseudomonas putida KT2440
cgauuacaagggccugugccg

SEQ ID NO: 1626751 - RNA, 21 nt, Pseudomonas putida KT2440
cgcaacacauuauccaccagg

SEQ ID NO: 1626752 - RNA, 18 nt, Pseudomonas putida KT2440
cgcaacaccugccgcagc

SEQ ID NO: 1626753 - RNA, 16 nt, Pseudomonas putida KT2440
cgcaaaugcaccccug

SEQ ID NO: 1626754 - RNA, 15 nt, Pseudomonas putida KT2440
cgcaaaugcuugccc

SEQ ID NO: 1626755 - RNA, 20 nt, Pseudomonas putida KT2440
cgcaaaugcuugcccgccuu

SEQ ID NO: 1626756 - RNA, 13 nt, Pseudomonas putida KT2440
cgcaacaaccccg

SEQ ID NO: 1626757 - RNA, 13 nt, Pseudomonas putida KT2440
cgcaacaaccugg

SEQ ID NO: 1626758 - RNA, 23 nt, Pseudomonas putida KT2440
cgcaaggugccaacaggcagcau

SEQ ID NO: 1626759 - RNA, 22 nt, Pseudomonas putida KT2440
cgcaagguggcauuggcgugcu

SEQ ID NO: 1626760 - RNA, 13 nt, Pseudomonas putida KT2440
cgcaaggcggccc

SEQ ID NO: 1626761 - RNA, 21 nt, Pseudomonas putida KT2440
cgcacucaguuaaucagcaac

SEQ ID NO: 1626762 - RNA, 23 nt, Pseudomonas putida KT2440
cgcacgcgcuuuuccagcaaagu

SEQ ID NO: 1626763 - RNA, 21 nt, Pseudomonas putida KT2440
cgcacgcugcccaggugccag

SEQ ID NO: 1626764 - RNA, 23 nt, Pseudomonas putida KT2440
cgcacgcugcccaggugccaggc

SEQ ID NO: 1626765 - RNA, 14 nt, Pseudomonas putida KT2440
cgcaccuguuucaa

SEQ ID NO: 1626766 - RNA, 14 nt, Pseudomonas putida KT2440
cgcaccugcccgcc

SEQ ID NO: 1626767 - RNA, 15 nt, Pseudomonas putida KT2440
cgcaccugcccgccc

SEQ ID NO: 1626768 - RNA, 18 nt, Pseudomonas putida KT2440
cgcaccugccugacgcgg

SEQ ID NO: 1626769 - RNA, 15 nt, Pseudomonas putida KT2440
cgcaccucacaacgc

SEQ ID NO: 1626770 - RNA, 13 nt, Pseudomonas putida KT2440
cgcaccuccugcg

SEQ ID NO: 1626771 - RNA, 21 nt, Pseudomonas putida KT2440
cgcaccucggccaugucguac

SEQ ID NO: 1626772 - RNA, 20 nt, Pseudomonas putida KT2440
cgcacagguccagccgccau

SEQ ID NO: 1626773 - RNA, 18 nt, Pseudomonas putida KT2440
cgcaccacgaucacgccc

SEQ ID NO: 1626774 - RNA, 22 nt, Pseudomonas putida KT2440
cgcaccacgaucacgcccgggc

SEQ ID NO: 1626775 - RNA, 16 nt, Pseudomonas putida KT2440
cgcacacgaccuugga

SEQ ID NO: 1626776 - RNA, 17 nt, Pseudomonas putida KT2440
cgcacagcaucacccgc

SEQ ID NO: 1626777 - RNA, 16 nt, Pseudomonas putida KT2440
cgcacaggcgcagcag

SEQ ID NO: 1626778 - RNA, 23 nt, Pseudomonas putida KT2440
cgcacaggcgcagcagcuugacc

SEQ ID NO: 1626779 - RNA, 18 nt, Pseudomonas putida KT2440
cgcaccagggcuggcagc

SEQ ID NO: 1626780 - RNA, 22 nt, Pseudomonas putida KT2440
cgcaccaucggcuccagcgcac

SEQ ID NO: 1626781 - RNA, 12 nt, Pseudomonas putida KT2440
cgcaccagcucc

SEQ ID NO: 1626782 - RNA, 14 nt, Pseudomonas putida KT2440
cgcacccaggccac

SEQ ID NO: 1626783 - RNA, 13 nt, Pseudomonas putida KT2440
cgcacccaggugc

SEQ ID NO: 1626784 - RNA, 14 nt, Pseudomonas putida KT2440
cgcacccaccgcag

SEQ ID NO: 1626785 - RNA, 19 nt, Pseudomonas putida KT2440
cgcacccaccgcaggucac

SEQ ID NO: 1626786 - RNA, 13 nt, Pseudomonas putida KT2440
cgcacccagcagg

SEQ ID NO: 1626787 - RNA, 16 nt, Pseudomonas putida KT2440
cgcacccgaccacccu

SEQ ID NO: 1626788 - RNA, 12 nt, Pseudomonas putida KT2440
cgcacccgcgau

SEQ ID NO: 1626789 - RNA, 15 nt, Pseudomonas putida KT2440
cgcacuguagcgccc

SEQ ID NO: 1626790 - RNA, 22 nt, Pseudomonas putida KT2440
cgcacuggucaaccccuugcgg

SEQ ID NO: 1626791 - RNA, 19 nt, Pseudomonas putida KT2440
cgcacuuccacacccagcg

SEQ ID NO: 1626792 - RNA, 17 nt, Pseudomonas putida KT2440
cgcacuucguagcgccc

SEQ ID NO: 1626793 - RNA, 12 nt, Pseudomonas putida KT2440
cgcacugcugcc

SEQ ID NO: 1626794 - RNA, 18 nt, Pseudomonas putida KT2440
cgcacugcugccgcccuc

SEQ ID NO: 1626795 - RNA, 14 nt, Pseudomonas putida KT2440
cgcacucucccgca

SEQ ID NO: 1626796 - RNA, 17 nt, Pseudomonas putida KT2440
cgcacugaacagcgccu

SEQ ID NO: 1626797 - RNA, 13 nt, Pseudomonas putida KT2440
cgcacuccccauc

SEQ ID NO: 1626798 - RNA, 21 nt, Pseudomonas putida KT2440
cgcacuccccaucagcagcug

SEQ ID NO: 1626799 - RNA, 10 nt, Pseudomonas putida KT2440
cgcagcagca

SEQ ID NO: 1626800 - RNA, 13 nt, Pseudomonas putida KT2440
cgcagcagcaccg

SEQ ID NO: 1626801 - RNA, 15 nt, Pseudomonas putida KT2440
cgcagcagcaccggc

SEQ ID NO: 1626802 - RNA, 15 nt, Pseudomonas putida KT2440
cgcacuuguuccagc

SEQ ID NO: 1626803 - RNA, 19 nt, Pseudomonas putida KT2440
cgcacuuguuccagccgcg

SEQ ID NO: 1626804 - RNA, 16 nt, Pseudomonas putida KT2440
cgcacuuggccugcug

SEQ ID NO: 1626805 - RNA, 21 nt, Pseudomonas putida KT2440
cgcagccaaugcugaugaagc

SEQ ID NO: 1626806 - RNA, 13 nt, Pseudomonas putida KT2440
cgcagccaccagc

SEQ ID NO: 1626807 - RNA, 14 nt, Pseudomonas putida KT2440
cgcagccaccagcu

SEQ ID NO: 1626808 - RNA, 15 nt, Pseudomonas putida KT2440
cgcagccaccagcuu

SEQ ID NO: 1626809 - RNA, 20 nt, Pseudomonas putida KT2440
cgcagcaucuuccugccacu

SEQ ID NO: 1626810 - RNA, 22 nt, Pseudomonas putida KT2440
cgcagcaucuuccugccacucg

SEQ ID NO: 1626811 - RNA, 17 nt, Pseudomonas putida KT2440
cgcagcccacggccgcc

SEQ ID NO: 1626812 - RNA, 16 nt, Pseudomonas putida KT2440
cgcagccaugccgccg

SEQ ID NO: 1626813 - RNA, 17 nt, Pseudomonas putida KT2440
cgcagccaugccgccga

SEQ ID NO: 1626814 - RNA, 21 nt, Pseudomonas putida KT2440
cgcagccaugccgccgacgau

SEQ ID NO: 1626815 - RNA, 18 nt, Pseudomonas putida KT2440
cgcagccauaguuuugug

SEQ ID NO: 1626816 - RNA, 16 nt, Pseudomonas putida KT2440
cgcagccccgccgccc

SEQ ID NO: 1626817 - RNA, 18 nt, Pseudomonas putida KT2440
cgcagccccgccgccccc

SEQ ID NO: 1626818 - RNA, 12 nt, Pseudomonas putida KT2440
cgcagccccagc

SEQ ID NO: 1626819 - RNA, 11 nt, Pseudomonas putida KT2440
cgcagcccugu

SEQ ID NO: 1626820 - RNA, 19 nt, Pseudomonas putida KT2440
cgcagcccugucacgacag

SEQ ID NO: 1626821 - RNA, 16 nt, Pseudomonas putida KT2440
cgcagccggcaccgcc

SEQ ID NO: 1626822 - RNA, 21 nt, Pseudomonas putida KT2440
cgcagccucuucggccagcaa

SEQ ID NO: 1626823 - RNA, 23 nt, Pseudomonas putida KT2440
cgcagccucuucggccagcaacu

SEQ ID NO: 1626824 - RNA, 17 nt, Pseudomonas putida KT2440
cgcagccuugucucuga

SEQ ID NO: 1626825 - RNA, 24 nt, Pseudomonas putida KT2440
cgcagcgcuucgaucagcgccugc

SEQ ID NO: 1626826 - RNA, 23 nt, Pseudomonas putida KT2440
cgcagcggccgaaggggcgggug

SEQ ID NO: 1626827 - RNA, 19 nt, Pseudomonas putida KT2440
cgcagcgcaugcucgcggg

SEQ ID NO: 1626828 - RNA, 23 nt, Pseudomonas putida KT2440
cgcagcgcaugcucgcgggccug

SEQ ID NO: 1626829 - RNA, 14 nt, Pseudomonas putida KT2440
cgcagcgacgaccu

SEQ ID NO: 1626830 - RNA, 14 nt, Pseudomonas putida KT2440
cgcagcuggcgcaa

SEQ ID NO: 1626831 - RNA, 16 nt, Pseudomonas putida KT2440
cgcagcuuccaccauu

SEQ ID NO: 1626832 - RNA, 18 nt, Pseudomonas putida KT2440
cgcagcuuccgccaccac

SEQ ID NO: 1626833 - RNA, 21 nt, Pseudomonas putida KT2440
cgcagcggggauucaacagcg

SEQ ID NO: 1626834 - RNA, 22 nt, Pseudomonas putida KT2440
cgcagcugcggucgagcugccc

SEQ ID NO: 1626835 - RNA, 21 nt, Pseudomonas putida KT2440
cgcagcuucaacuccaccauc

SEQ ID NO: 1626836 - RNA, 13 nt, Pseudomonas putida KT2440
cgcaggcaccgca

SEQ ID NO: 1626837 - RNA, 17 nt, Pseudomonas putida KT2440
cgcaggcaccgcacccg

SEQ ID NO: 1626838 - RNA, 17 nt, Pseudomonas putida KT2440
cgcaggauauccacacc

SEQ ID NO: 1626839 - RNA, 19 nt, Pseudomonas putida KT2440
cgcaggcugucgaacaggc

SEQ ID NO: 1626840 - RNA, 15 nt, Pseudomonas putida KT2440
cgcaggcucuccacg

SEQ ID NO: 1626841 - RNA, 21 nt, Pseudomonas putida KT2440
cgcagggaagguggccggcaa

SEQ ID NO: 1626842 - RNA, 15 nt, Pseudomonas putida KT2440
cgcaggcuccaaagc

SEQ ID NO: 1626843 - RNA, 21 nt, Pseudomonas putida KT2440
cgcaggcuaugccggucagca

SEQ ID NO: 1626844 - RNA, 23 nt, Pseudomonas putida KT2440
cgcaggcuaugccggucagcagc

SEQ ID NO: 1626845 - RNA, 20 nt, Pseudomonas putida KT2440
cgcagucccguuggcccgcc

SEQ ID NO: 1626846 - RNA, 23 nt, Pseudomonas putida KT2440
cgcagucccguuggcccgccagu

SEQ ID NO: 1626847 - RNA, 21 nt, Pseudomonas putida KT2440
cgcaguucguccaggcuuucg

SEQ ID NO: 1626848 - RNA, 22 nt, Pseudomonas putida KT2440
cgcagguuguucggcaggcucu

SEQ ID NO: 1626849 - RNA, 19 nt, Pseudomonas putida KT2440
cgcagguucgaauccugcu

SEQ ID NO: 1626850 - RNA, 14 nt, Pseudomonas putida KT2440
cgcaguacaggcug

SEQ ID NO: 1626851 - RNA, 22 nt, Pseudomonas putida KT2440
cgcagucaccacacggcagccc

SEQ ID NO: 1626852 - RNA, 16 nt, Pseudomonas putida KT2440
cggagcuccccucaga

SEQ ID NO: 1626853 - RNA, 12 nt, Pseudomonas putida KT2440
cggaacugcucu

SEQ ID NO: 1626854 - RNA, 14 nt, Pseudomonas putida KT2440
cggaacugcucuuc

SEQ ID NO: 1626855 - RNA, 14 nt, Pseudomonas putida KT2440
cggagauuggccag

SEQ ID NO: 1626856 - RNA, 15 nt, Pseudomonas putida KT2440
cggaaaggucggcgg

SEQ ID NO: 1626857 - RNA, 18 nt, Pseudomonas putida KT2440
cggaaauaccagacgcag

SEQ ID NO: 1626858 - RNA, 14 nt, Pseudomonas putida KT2440
cggaucucaagcaa

SEQ ID NO: 1626859 - RNA, 18 nt, Pseudomonas putida KT2440
cggaucguugcgggucag

SEQ ID NO: 1626860 - RNA, 16 nt, Pseudomonas putida KT2440
cggaucuggcagcuuc

SEQ ID NO: 1626861 - RNA, 20 nt, Pseudomonas putida KT2440
cggaucgugacggucugccg

SEQ ID NO: 1626862 - RNA, 21 nt, Pseudomonas putida KT2440
cggaugccacgcugaacacgc

SEQ ID NO: 1626863 - RNA, 14 nt, Pseudomonas putida KT2440
cggauguuggccac

SEQ ID NO: 1626864 - RNA, 16 nt, Pseudomonas putida KT2440
cggauggugugcagca

SEQ ID NO: 1626865 - RNA, 23 nt, Pseudomonas putida KT2440
cggcaaacaaaaagcaccucuug

SEQ ID NO: 1626866 - RNA, 16 nt, Pseudomonas putida KT2440
cggcaaacacacccuc

SEQ ID NO: 1626867 - RNA, 20 nt, Pseudomonas putida KT2440
cggcaaacacauccaccagg

SEQ ID NO: 1626868 - RNA, 22 nt, Pseudomonas putida KT2440
cggcaaacacauccagcgccgc

SEQ ID NO: 1626869 - RNA, 15 nt, Pseudomonas putida KT2440
cggauuucgccaccc

SEQ ID NO: 1626870 - RNA, 18 nt, Pseudomonas putida KT2440
cggcagaaucagguucag

SEQ ID NO: 1626871 - RNA, 23 nt, Pseudomonas putida KT2440
cggcacuggcuacagaucagcca

SEQ ID NO: 1626872 - RNA, 14 nt, Pseudomonas putida KT2440
cggcacugcacagc

SEQ ID NO: 1626873 - RNA, 16 nt, Pseudomonas putida KT2440
cggcacgcccagcaac

SEQ ID NO: 1626874 - RNA, 16 nt, Pseudomonas putida KT2440
cggcaccucguccagg

SEQ ID NO: 1626875 - RNA, 18 nt, Pseudomonas putida KT2440
cggcaccugugcaggcgu

SEQ ID NO: 1626876 - RNA, 13 nt, Pseudomonas putida KT2440
cggcaccgccagc

SEQ ID NO: 1626877 - RNA, 19 nt, Pseudomonas putida KT2440
cggcaccccuuucuccagc

SEQ ID NO: 1626878 - RNA, 14 nt, Pseudomonas putida KT2440
cggcaaaggccucu

SEQ ID NO: 1626879 - RNA, 15 nt, Pseudomonas putida KT2440
cggcaaaggccucuu

SEQ ID NO: 1626880 - RNA, 15 nt, Pseudomonas putida KT2440
cggcaaaugcggcgc

SEQ ID NO: 1626881 - RNA, 21 nt, Pseudomonas putida KT2440
cggcaacauucaccagccagg

SEQ ID NO: 1626882 - RNA, 15 nt, Pseudomonas putida KT2440
cggcaaccaccaaca

SEQ ID NO: 1626883 - RNA, 15 nt, Pseudomonas putida KT2440
cggcaaccauggcuu

SEQ ID NO: 1626884 - RNA, 17 nt, Pseudomonas putida KT2440
cggcaacccuucggcca

SEQ ID NO: 1626885 - RNA, 12 nt, Pseudomonas putida KT2440
cggcaccagcac

SEQ ID NO: 1626886 - RNA, 15 nt, Pseudomonas putida KT2440
cggcaccagcaccag

SEQ ID NO: 1626887 - RNA, 19 nt, Pseudomonas putida KT2440
cggcagucuugcugaucac

SEQ ID NO: 1626888 - RNA, 17 nt, Pseudomonas putida KT2440
cggcagguugcuggccu

SEQ ID NO: 1626889 - RNA, 20 nt, Pseudomonas putida KT2440
cggcagguugcuggccuugg

SEQ ID NO: 1626890 - RNA, 22 nt, Pseudomonas putida KT2440
cggcaguacauagaacagcauc

SEQ ID NO: 1626891 - RNA, 20 nt, Pseudomonas putida KT2440
cggcagguaggcccagccca

SEQ ID NO: 1626892 - RNA, 19 nt, Pseudomonas putida KT2440
cggcaggucauuggcgcca

SEQ ID NO: 1626893 - RNA, 17 nt, Pseudomonas putida KT2440
cggcaguugcaggcgca

SEQ ID NO: 1626894 - RNA, 23 nt, Pseudomonas putida KT2440
cggcaguugcaggcgcagggugu

SEQ ID NO: 1626895 - RNA, 14 nt, Pseudomonas putida KT2440
cggcauacagcucc

SEQ ID NO: 1626896 - RNA, 16 nt, Pseudomonas putida KT2440
cggcaggccggccacc

SEQ ID NO: 1626897 - RNA, 19 nt, Pseudomonas putida KT2440
cggcaggccggccaccagu

SEQ ID NO: 1626898 - RNA, 20 nt, Pseudomonas putida KT2440
cggcaggcgcuucagguaag

SEQ ID NO: 1626899 - RNA, 19 nt, Pseudomonas putida KT2440
cggcaggcucugcuccagc

SEQ ID NO: 1626900 - RNA, 18 nt, Pseudomonas putida KT2440
cggcagcgaucagcgcag

SEQ ID NO: 1626901 - RNA, 13 nt, Pseudomonas putida KT2440
cggcagcgaugcc

SEQ ID NO: 1626902 - RNA, 19 nt, Pseudomonas putida KT2440
cggccgguacggccaaugc

SEQ ID NO: 1626903 - RNA, 22 nt, Pseudomonas putida KT2440
cggccgggucgauagccagccc

SEQ ID NO: 1626904 - RNA, 14 nt, Pseudomonas putida KT2440
cggccgugaacacg

SEQ ID NO: 1626905 - RNA, 15 nt, Pseudomonas putida KT2440
cggccuccaccaccu

SEQ ID NO: 1626906 - RNA, 13 nt, Pseudomonas putida KT2440
cggccuacccggg

SEQ ID NO: 1626907 - RNA, 20 nt, Pseudomonas putida KT2440
cggccucgguacccgccagc

SEQ ID NO: 1626908 - RNA, 19 nt, Pseudomonas putida KT2440
cggccugcauccacaccag

SEQ ID NO: 1626909 - RNA, 22 nt, Pseudomonas putida KT2440
cggccugcagcuuuugcgcagc

SEQ ID NO: 1626910 - RNA, 16 nt, Pseudomonas putida KT2440
cggccucuucgcgggc

SEQ ID NO: 1626911 - RNA, 14 nt, Pseudomonas putida KT2440
cggccuggcauuug

SEQ ID NO: 1626912 - RNA, 20 nt, Pseudomonas putida KT2440
cggccugcgcuccagcagcu

SEQ ID NO: 1626913 - RNA, 22 nt, Pseudomonas putida KT2440
cggccgcagccccaccucggcg

SEQ ID NO: 1626914 - RNA, 19 nt, Pseudomonas putida KT2440
cggccgccaauagcccgcu

SEQ ID NO: 1626915 - RNA, 20 nt, Pseudomonas putida KT2440
cggccgccgccagaccaccu

SEQ ID NO: 1626916 - RNA, 18 nt, Pseudomonas putida KT2440
cggccgcgccaccgggcg

SEQ ID NO: 1626917 - RNA, 20 nt, Pseudomonas putida KT2440
cggccggggcaaccugggug

SEQ ID NO: 1626918 - RNA, 16 nt, Pseudomonas putida KT2440
cggccgggcguagcag

SEQ ID NO: 1626919 - RNA, 12 nt, Pseudomonas putida KT2440
cggccggccccc

SEQ ID NO: 1626920 - RNA, 23 nt, Pseudomonas putida KT2440
cggccgcuugaucuuguccugga

SEQ ID NO: 1626921 - RNA, 21 nt, Pseudomonas putida KT2440
cggcccucgguggcucuccuc

SEQ ID NO: 1626922 - RNA, 17 nt, Pseudomonas putida KT2440
cggcccggcauccuugg

SEQ ID NO: 1626923 - RNA, 17 nt, Pseudomonas putida KT2440
cggcccggccaacaacg

SEQ ID NO: 1626924 - RNA, 16 nt, Pseudomonas putida KT2440
cggccccggcgccgcc

SEQ ID NO: 1626925 - RNA, 15 nt, Pseudomonas putida KT2440
cggcccagcccagua

SEQ ID NO: 1626926 - RNA, 17 nt, Pseudomonas putida KT2440
cggcccgaucagccaga

SEQ ID NO: 1626927 - RNA, 15 nt, Pseudomonas putida KT2440
cggccagcaggucag

SEQ ID NO: 1626928 - RNA, 11 nt, Pseudomonas putida KT2440
cggccagcagg

SEQ ID NO: 1626929 - RNA, 14 nt, Pseudomonas putida KT2440
cggccagccgccgc

SEQ ID NO: 1626930 - RNA, 16 nt, Pseudomonas putida KT2440
cggccagccgccgccg

SEQ ID NO: 1626931 - RNA, 17 nt, Pseudomonas putida KT2440
cggcaucggccuggggc

SEQ ID NO: 1626932 - RNA, 14 nt, Pseudomonas putida KT2440
cggcaucgggcgcg

SEQ ID NO: 1626933 - RNA, 12 nt, Pseudomonas putida KT2440
cggcaucagggc

SEQ ID NO: 1626934 - RNA, 20 nt, Pseudomonas putida KT2440
cggcauccuugggguacacc

SEQ ID NO: 1626935 - RNA, 13 nt, Pseudomonas putida KT2440
cggccagcgccug

SEQ ID NO: 1626936 - RNA, 14 nt, Pseudomonas putida KT2440
cggccagcgccugc

SEQ ID NO: 1626937 - RNA, 22 nt, Pseudomonas putida KT2440
cggccaguaccaggucgccagc

SEQ ID NO: 1626938 - RNA, 14 nt, Pseudomonas putida KT2440
cggccagugcgccc

SEQ ID NO: 1626939 - RNA, 19 nt, Pseudomonas putida KT2440
cggccagugcgcccgaggc

SEQ ID NO: 1626940 - RNA, 14 nt, Pseudomonas putida KT2440
cggccauucaucau

SEQ ID NO: 1626941 - RNA, 18 nt, Pseudomonas putida KT2440
cggccagugaagcucgau

SEQ ID NO: 1626942 - RNA, 14 nt, Pseudomonas putida KT2440
cggcccacugcacg

SEQ ID NO: 1626943 - RNA, 14 nt, Pseudomonas putida KT2440
cggcccagccgcga

SEQ ID NO: 1626944 - RNA, 19 nt, Pseudomonas putida KT2440
cggcccagccgcgacugga

SEQ ID NO: 1626945 - RNA, 17 nt, Pseudomonas putida KT2440
cggcccccacgccgacc

SEQ ID NO: 1626946 - RNA, 13 nt, Pseudomonas putida KT2440
cggcccccagcaa

SEQ ID NO: 1626947 - RNA, 18 nt, Pseudomonas putida KT2440
cggcccacagugcuucca

SEQ ID NO: 1626948 - RNA, 14 nt, Pseudomonas putida KT2440
cgcgucgcccagac

SEQ ID NO: 1626949 - RNA, 19 nt, Pseudomonas putida KT2440
cgcguccuggacccgcagc

SEQ ID NO: 1626950 - RNA, 16 nt, Pseudomonas putida KT2440
cgcgucauccgccaac

SEQ ID NO: 1626951 - RNA, 14 nt, Pseudomonas putida KT2440
cgcguccagcccgg

SEQ ID NO: 1626952 - RNA, 22 nt, Pseudomonas putida KT2440
cgcgucauacucuucgcgggcu

SEQ ID NO: 1626953 - RNA, 22 nt, Pseudomonas putida KT2440
cgcggugcaacauguccacacc

SEQ ID NO: 1626954 - RNA, 23 nt, Pseudomonas putida KT2440
cgcggucuuguaucccaggcgcu

SEQ ID NO: 1626955 - RNA, 20 nt, Pseudomonas putida KT2440
cgcggugaccagcggcagca

SEQ ID NO: 1626956 - RNA, 17 nt, Pseudomonas putida KT2440
cgcggucugcggcagca

SEQ ID NO: 1626957 - RNA, 19 nt, Pseudomonas putida KT2440
cgcggucggucagcaccug

SEQ ID NO: 1626958 - RNA, 13 nt, Pseudomonas putida KT2440
cgcgguaccugga

SEQ ID NO: 1626959 - RNA, 12 nt, Pseudomonas putida KT2440
cgcucaacacgu

SEQ ID NO: 1626960 - RNA, 20 nt, Pseudomonas putida KT2440
cgcucaacacgucggcuggc

SEQ ID NO: 1626961 - RNA, 15 nt, Pseudomonas putida KT2440
cgcucaaccagccgc

SEQ ID NO: 1626962 - RNA, 16 nt, Pseudomonas putida KT2440
cgcucacgcagcccuu

SEQ ID NO: 1626963 - RNA, 16 nt, Pseudomonas putida KT2440
cgcucaacuccauggc

SEQ ID NO: 1626964 - RNA, 14 nt, Pseudomonas putida KT2440
cgcucagcgggcgu

SEQ ID NO: 1626965 - RNA, 22 nt, Pseudomonas putida KT2440
cgcuaccugugggagcgggcgu

SEQ ID NO: 1626966 - RNA, 14 nt, Pseudomonas putida KT2440
cgcuacgccgcccc

SEQ ID NO: 1626967 - RNA, 13 nt, Pseudomonas putida KT2440
cgcgugccccccc

SEQ ID NO: 1626968 - RNA, 13 nt, Pseudomonas putida KT2440
cgcgucgcggccc

SEQ ID NO: 1626969 - RNA, 22 nt, Pseudomonas putida KT2440
cgcgggccagguggccuucccu

SEQ ID NO: 1626970 - RNA, 16 nt, Pseudomonas putida KT2440
cgcgggcaagcccgcg

SEQ ID NO: 1626971 - RNA, 17 nt, Pseudomonas putida KT2440
cgcgggcagaugaggaa

SEQ ID NO: 1626972 - RNA, 21 nt, Pseudomonas putida KT2440
cgcggguaaacccccuccuga

SEQ ID NO: 1626973 - RNA, 22 nt, Pseudomonas putida KT2440
cgcggguaaacccccuccugau

SEQ ID NO: 1626974 - RNA, 16 nt, Pseudomonas putida KT2440
cgcggguaaacccgcc

SEQ ID NO: 1626975 - RNA, 17 nt, Pseudomonas putida KT2440
cgcggguaaacccgcgc

SEQ ID NO: 1626976 - RNA, 17 nt, Pseudomonas putida KT2440
cgcggguaaacccgcuc

SEQ ID NO: 1626977 - RNA, 23 nt, Pseudomonas putida KT2440
cgcggguaaacccgcuccuacga

SEQ ID NO: 1626978 - RNA, 19 nt, Pseudomonas putida KT2440
cgcggguccagcgcggcca

SEQ ID NO: 1626979 - RNA, 17 nt, Pseudomonas putida KT2440
cgcggguagacccgcuc

SEQ ID NO: 1626980 - RNA, 17 nt, Pseudomonas putida KT2440
cgcgggucuuccaccac

SEQ ID NO: 1626981 - RNA, 16 nt, Pseudomonas putida KT2440
cgcggguuuacccgcg

SEQ ID NO: 1626982 - RNA, 13 nt, Pseudomonas putida KT2440
cgcggcugaacac

SEQ ID NO: 1626983 - RNA, 16 nt, Pseudomonas putida KT2440
cgcggcuggugucggc

SEQ ID NO: 1626984 - RNA, 20 nt, Pseudomonas putida KT2440
cgcggcgcuuauggcgccgc

SEQ ID NO: 1626985 - RNA, 12 nt, Pseudomonas putida KT2440
cgcggcgcgccc

SEQ ID NO: 1626986 - RNA, 17 nt, Pseudomonas putida KT2440
cgcggcgcccagcaaca

SEQ ID NO: 1626987 - RNA, 16 nt, Pseudomonas putida KT2440
cgcggaucugcugcuu

SEQ ID NO: 1626988 - RNA, 16 nt, Pseudomonas putida KT2440
cgcggcaaagguggca

SEQ ID NO: 1626989 - RNA, 17 nt, Pseudomonas putida KT2440
cgcggcaaaugcggcgc

SEQ ID NO: 1626990 - RNA, 16 nt, Pseudomonas putida KT2440
cgcggccuacccgggc

SEQ ID NO: 1626991 - RNA, 18 nt, Pseudomonas putida KT2440
cgcggccuacccgggcgc

SEQ ID NO: 1626992 - RNA, 23 nt, Pseudomonas putida KT2440
cgcggccuacccgggcgcagggg

SEQ ID NO: 1626993 - RNA, 23 nt, Pseudomonas putida KT2440
cgcggccggucacccccaucagc

SEQ ID NO: 1626994 - RNA, 19 nt, Pseudomonas putida KT2440
cgcggcccaguuucgccag

SEQ ID NO: 1626995 - RNA, 23 nt, Pseudomonas putida KT2440
cgcugucgucgucagcuuccgcu

SEQ ID NO: 1626996 - RNA, 15 nt, Pseudomonas putida KT2440
cgcuguccagcgcau

SEQ ID NO: 1626997 - RNA, 14 nt, Pseudomonas putida KT2440
cgcuguugagcagc

SEQ ID NO: 1626998 - RNA, 22 nt, Pseudomonas putida KT2440
cgcuguugagcagcagcccuuc

SEQ ID NO: 1626999 - RNA, 18 nt, Pseudomonas putida KT2440
cgcuguugcgcaccuugu

SEQ ID NO: 1627000 - RNA, 19 nt, Pseudomonas putida KT2440
cgcugucuucugccagagg

SEQ ID NO: 1627001 - RNA, 16 nt, Pseudomonas putida KT2440
cgcuguuacugcuggu

SEQ ID NO: 1627002 - RNA, 23 nt, Pseudomonas putida KT2440
cgcugugggaguaacggcccuug

SEQ ID NO: 1627003 - RNA, 15 nt, Pseudomonas putida KT2440
cgcuggcugccgcgg

SEQ ID NO: 1627004 - RNA, 21 nt, Pseudomonas putida KT2440
cgcuggugcaguggcuguacc

SEQ ID NO: 1627005 - RNA, 20 nt, Pseudomonas putida KT2440
cgcugguuuaucagcagcuc

SEQ ID NO: 1627006 - RNA, 16 nt, Pseudomonas putida KT2440
cgcuguaaccugguug

SEQ ID NO: 1627007 - RNA, 21 nt, Pseudomonas putida KT2440
cgcugguucauugccaacagc

SEQ ID NO: 1627008 - RNA, 18 nt, Pseudomonas putida KT2440
cgcuggucaaucugugag

SEQ ID NO: 1627009 - RNA, 23 nt, Pseudomonas putida KT2440
cgcuggucgcgcagauggcagac

SEQ ID NO: 1627010 - RNA, 23 nt, Pseudomonas putida KT2440
cgcuugccaaggcuagccacggc

SEQ ID NO: 1627011 - RNA, 13 nt, Pseudomonas putida KT2440
cgcuugcccggcu

SEQ ID NO: 1627012 - RNA, 17 nt, Pseudomonas putida KT2440
cgcuugccgcugcggau

SEQ ID NO: 1627013 - RNA, 19 nt, Pseudomonas putida KT2440
cgcuugccuuccucggcca

SEQ ID NO: 1627014 - RNA, 23 nt, Pseudomonas putida KT2440
cgcuugcgaaggagaauccacuu

SEQ ID NO: 1627015 - RNA, 18 nt, Pseudomonas putida KT2440
cgcuugcgaccgaugccc

SEQ ID NO: 1627016 - RNA, 20 nt, Pseudomonas putida KT2440
cgcuugcgcauggccgccac

SEQ ID NO: 1627017 - RNA, 15 nt, Pseudomonas putida KT2440
cgcuugagcgcgccg

SEQ ID NO: 1627018 - RNA, 19 nt, Pseudomonas putida KT2440
cggaaacucacgcgccagg

SEQ ID NO: 1627019 - RNA, 12 nt, Pseudomonas putida KT2440
cgcuuuucaggg

SEQ ID NO: 1627020 - RNA, 16 nt, Pseudomonas putida KT2440
cgcuuuuccaguuccu

SEQ ID NO: 1627021 - RNA, 19 nt, Pseudomonas putida KT2440
cgcuuuuggcugugcaccc

SEQ ID NO: 1627022 - RNA, 19 nt, Pseudomonas putida KT2440
cgcuggccgcacccagcag

SEQ ID NO: 1627023 - RNA, 14 nt, Pseudomonas putida KT2440
cgcuggccaggcuu

SEQ ID NO: 1627024 - RNA, 19 nt, Pseudomonas putida KT2440
cgcuggccaggcuugguuu

SEQ ID NO: 1627025 - RNA, 14 nt, Pseudomonas putida KT2440
cgcuggccugcccc

SEQ ID NO: 1627026 - RNA, 21 nt, Pseudomonas putida KT2440
cgcuggcgcagagggucuugg

SEQ ID NO: 1627027 - RNA, 12 nt, Pseudomonas putida KT2440
cgcuggcgccug

SEQ ID NO: 1627028 - RNA, 17 nt, Pseudomonas putida KT2440
cgcuggcgccugcggca

SEQ ID NO: 1627029 - RNA, 14 nt, Pseudomonas putida KT2440
cgcuggacuugccu

SEQ ID NO: 1627030 - RNA, 14 nt, Pseudomonas putida KT2440
cgcuggaucaccac

SEQ ID NO: 1627031 - RNA, 22 nt, Pseudomonas putida KT2440
cgcuggaucugaugcuucugcu

SEQ ID NO: 1627032 - RNA, 12 nt, Pseudomonas putida KT2440
cgcuggaagugc

SEQ ID NO: 1627033 - RNA, 21 nt, Pseudomonas putida KT2440
cgcuggaauuauuggccagca

SEQ ID NO: 1627034 - RNA, 15 nt, Pseudomonas putida KT2440
cgcugcggucaucac

SEQ ID NO: 1627035 - RNA, 21 nt, Pseudomonas putida KT2440
cgcugcggucaucaccacccc

SEQ ID NO: 1627036 - RNA, 15 nt, Pseudomonas putida KT2440
cgcugcggccgucgg

SEQ ID NO: 1627037 - RNA, 20 nt, Pseudomonas putida KT2440
cgcugcggcacaccacgcca

SEQ ID NO: 1627038 - RNA, 20 nt, Pseudomonas putida KT2440
cgcugcgcaucacccgcccc

SEQ ID NO: 1627039 - RNA, 13 nt, Pseudomonas putida KT2440
cgcugcgcaaggc

SEQ ID NO: 1627040 - RNA, 19 nt, Pseudomonas putida KT2440
cgcugcgaggaucagcgca

SEQ ID NO: 1627041 - RNA, 15 nt, Pseudomonas putida KT2440
cgcugcgaggcccca

SEQ ID NO: 1627042 - RNA, 16 nt, Pseudomonas putida KT2440
cgcugcgaggccccag

SEQ ID NO: 1627043 - RNA, 22 nt, Pseudomonas putida KT2440
cgcugaggauugggaaaacaca

SEQ ID NO: 1627044 - RNA, 18 nt, Pseudomonas putida KT2440
cgcugaccaacaggcugg

SEQ ID NO: 1627045 - RNA, 16 nt, Pseudomonas putida KT2440
cgcugccagcagggca

SEQ ID NO: 1627046 - RNA, 17 nt, Pseudomonas putida KT2440
cgcugccacccacaggc

SEQ ID NO: 1627047 - RNA, 17 nt, Pseudomonas putida KT2440
cgcugaucaagcccgcu

SEQ ID NO: 1627048 - RNA, 15 nt, Pseudomonas putida KT2440
cgcugaugcgccgcu

SEQ ID NO: 1627049 - RNA, 17 nt, Pseudomonas putida KT2440
cgcugccaccuuccagg

SEQ ID NO: 1627050 - RNA, 13 nt, Pseudomonas putida KT2440
cgcugcccgggca

SEQ ID NO: 1627051 - RNA, 18 nt, Pseudomonas putida KT2440
cgcugcccgggcaaagca

SEQ ID NO: 1627052 - RNA, 14 nt, Pseudomonas putida KT2440
cgcugcccguccgg

SEQ ID NO: 1627053 - RNA, 14 nt, Pseudomonas putida KT2440
cgcucaggccaugc

SEQ ID NO: 1627054 - RNA, 23 nt, Pseudomonas putida KT2440
cgcucaggccaugcugcgccagg

SEQ ID NO: 1627055 - RNA, 22 nt, Pseudomonas putida KT2440
cgcucaggcgcagcgcaugcuc

SEQ ID NO: 1627056 - RNA, 17 nt, Pseudomonas putida KT2440
cgcucaggcucuugaac

SEQ ID NO: 1627057 - RNA, 23 nt, Pseudomonas putida KT2440
cgcucagggcgucaugcucaugc

SEQ ID NO: 1627058 - RNA, 18 nt, Pseudomonas putida KT2440
cgcucgucgaacucgcgc

SEQ ID NO: 1627059 - RNA, 14 nt, Pseudomonas putida KT2440
cgcucguagagcuu

SEQ ID NO: 1627060 - RNA, 18 nt, Pseudomonas putida KT2440
cgcucggguaaaucaucg

SEQ ID NO: 1627061 - RNA, 16 nt, Pseudomonas putida KT2440
cgcucgguaucggcca

SEQ ID NO: 1627062 - RNA, 17 nt, Pseudomonas putida KT2440
cgcugaaccucaccgcc

SEQ ID NO: 1627063 - RNA, 20 nt, Pseudomonas putida KT2440
cgcugaaccucaccgccggc

SEQ ID NO: 1627064 - RNA, 14 nt, Pseudomonas putida KT2440
cgcucugcgccugc

SEQ ID NO: 1627065 - RNA, 15 nt, Pseudomonas putida KT2440
cgggcggccaccggc

SEQ ID NO: 1627066 - RNA, 13 nt, Pseudomonas putida KT2440
cgggcgcugaagc

SEQ ID NO: 1627067 - RNA, 15 nt, Pseudomonas putida KT2440
cgggcgcccuggcau

SEQ ID NO: 1627068 - RNA, 23 nt, Pseudomonas putida KT2440
cgggcgucuuccagguggccgcc

SEQ ID NO: 1627069 - RNA, 22 nt, Pseudomonas putida KT2440
cgggcgugcguuugcgaaccuc

SEQ ID NO: 1627070 - RNA, 20 nt, Pseudomonas putida KT2440
cgggcgguugucgaccuggc

SEQ ID NO: 1627071 - RNA, 21 nt, Pseudomonas putida KT2440
cgggcucaccugguaccccuc

SEQ ID NO: 1627072 - RNA, 16 nt, Pseudomonas putida KT2440
cgggcucggccggggc

SEQ ID NO: 1627073 - RNA, 22 nt, Pseudomonas putida KT2440
cgggcucggccggggcaaccug

SEQ ID NO: 1627074 - RNA, 22 nt, Pseudomonas putida KT2440
cgggcuaacguagggaagcgga

SEQ ID NO: 1627075 - RNA, 21 nt, Pseudomonas putida KT2440
cgggcuacgcaaaccaaacgc

SEQ ID NO: 1627076 - RNA, 22 nt, Pseudomonas putida KT2440
cgggguagaacaagucgcgcac

SEQ ID NO: 1627077 - RNA, 21 nt, Pseudomonas putida KT2440
cgggguggccggcacugacca

SEQ ID NO: 1627078 - RNA, 17 nt, Pseudomonas putida KT2440
cggguacuucucgacca

SEQ ID NO: 1627079 - RNA, 22 nt, Pseudomonas putida KT2440
cggguagaucauuaccugcagg

SEQ ID NO: 1627080 - RNA, 21 nt, Pseudomonas putida KT2440
cggguagaagggggcaaugcg

SEQ ID NO: 1627081 - RNA, 16 nt, Pseudomonas putida KT2440
cggguacuccaccacc

SEQ ID NO: 1627082 - RNA, 17 nt, Pseudomonas putida KT2440
cggguacuccaccacca

SEQ ID NO: 1627083 - RNA, 14 nt, Pseudomonas putida KT2440
cggguaguccggca

SEQ ID NO: 1627084 - RNA, 17 nt, Pseudomonas putida KT2440
cggguaguccuccaaca

SEQ ID NO: 1627085 - RNA, 19 nt, Pseudomonas putida KT2440
cggguaggucaccaucagc

SEQ ID NO: 1627086 - RNA, 19 nt, Pseudomonas putida KT2440
cgggucaaggccagcgccu

SEQ ID NO: 1627087 - RNA, 20 nt, Pseudomonas putida KT2440
cggguauuucaaagaucucg

SEQ ID NO: 1627088 - RNA, 19 nt, Pseudomonas putida KT2440
cgggucacgcuccuucgcc

SEQ ID NO: 1627089 - RNA, 23 nt, Pseudomonas putida KT2440
cgggcuugcccaugaagcggccg

SEQ ID NO: 1627090 - RNA, 18 nt, Pseudomonas putida KT2440
cgggcuugcccgcgaagc

SEQ ID NO: 1627091 - RNA, 15 nt, Pseudomonas putida KT2440
cgggcuuacccgcga

SEQ ID NO: 1627092 - RNA, 22 nt, Pseudomonas putida KT2440
cggggcgaaauggcgaaucagc

SEQ ID NO: 1627093 - RNA, 12 nt, Pseudomonas putida KT2440
cgggggggcgca

SEQ ID NO: 1627094 - RNA, 14 nt, Pseudomonas putida KT2440
cgggccaugugcug

SEQ ID NO: 1627095 - RNA, 14 nt, Pseudomonas putida KT2440
cgggcaucaucaaa

SEQ ID NO: 1627096 - RNA, 14 nt, Pseudomonas putida KT2440
cgggccaucugcuu

SEQ ID NO: 1627097 - RNA, 13 nt, Pseudomonas putida KT2440
cgggccagucccu

SEQ ID NO: 1627098 - RNA, 21 nt, Pseudomonas putida KT2440
cgggaagucgcuuugcgggca

SEQ ID NO: 1627099 - RNA, 16 nt, Pseudomonas putida KT2440
cgggaagcgcccgccc

SEQ ID NO: 1627100 - RNA, 20 nt, Pseudomonas putida KT2440
cgggaaguuaccgcccgccc

SEQ ID NO: 1627101 - RNA, 16 nt, Pseudomonas putida KT2440
cgggaauaccaggccc

SEQ ID NO: 1627102 - RNA, 11 nt, Pseudomonas putida KT2440
cgggaagcagg

SEQ ID NO: 1627103 - RNA, 16 nt, Pseudomonas putida KT2440
cgggcacaggcccagc

SEQ ID NO: 1627104 - RNA, 20 nt, Pseudomonas putida KT2440
cgggcacaucaccagcagcu

SEQ ID NO: 1627105 - RNA, 22 nt, Pseudomonas putida KT2440
cgggcaauggccacacgcugcu

SEQ ID NO: 1627106 - RNA, 19 nt, Pseudomonas putida KT2440
cgggcaggccccugcaaca

SEQ ID NO: 1627107 - RNA, 18 nt, Pseudomonas putida KT2440
cgggcacgaucagcagca

SEQ ID NO: 1627108 - RNA, 20 nt, Pseudomonas putida KT2440
cgggcacgcccgcucccaca

SEQ ID NO: 1627109 - RNA, 17 nt, Pseudomonas putida KT2440
cgggccgucaccgcugc

SEQ ID NO: 1627110 - RNA, 18 nt, Pseudomonas putida KT2440
cgggccgcuugcucaggc

SEQ ID NO: 1627111 - RNA, 20 nt, Pseudomonas putida KT2440
cgggccgccguggugccggu

SEQ ID NO: 1627112 - RNA, 13 nt, Pseudomonas putida KT2440
cgggccgccgaac

SEQ ID NO: 1627113 - RNA, 15 nt, Pseudomonas putida KT2440
cgggcgagcgcgcag

SEQ ID NO: 1627114 - RNA, 17 nt, Pseudomonas putida KT2440
cgggcgagcgcgcaggc

SEQ ID NO: 1627115 - RNA, 18 nt, Pseudomonas putida KT2440
cgggcgcaggcagcacau

SEQ ID NO: 1627116 - RNA, 16 nt, Pseudomonas putida KT2440
cgggccuucaaccuca

SEQ ID NO: 1627117 - RNA, 13 nt, Pseudomonas putida KT2440
cgggccugcuggc

SEQ ID NO: 1627118 - RNA, 12 nt, Pseudomonas putida KT2440
cgggccuggagc

SEQ ID NO: 1627119 - RNA, 19 nt, Pseudomonas putida KT2440
cgggccuuugggccaaccc

SEQ ID NO: 1627120 - RNA, 23 nt, Pseudomonas putida KT2440
cgggcgaagcccgugccauccac

SEQ ID NO: 1627121 - RNA, 24 nt, Pseudomonas putida KT2440
cgggcgaagcccgugccauccacc

SEQ ID NO: 1627122 - RNA, 15 nt, Pseudomonas putida KT2440
cggcuguuccucgcc

SEQ ID NO: 1627123 - RNA, 15 nt, Pseudomonas putida KT2440
cggcuguucgcagca

SEQ ID NO: 1627124 - RNA, 17 nt, Pseudomonas putida KT2440
cggcuucgaugcccggc

SEQ ID NO: 1627125 - RNA, 21 nt, Pseudomonas putida KT2440
cggcuucgacgcuuuccuggu

SEQ ID NO: 1627126 - RNA, 21 nt, Pseudomonas putida KT2440
cggcuuguucagcuggugggc

SEQ ID NO: 1627127 - RNA, 21 nt, Pseudomonas putida KT2440
cggcuuguucuguuucaccag

SEQ ID NO: 1627128 - RNA, 13 nt, Pseudomonas putida KT2440
cggcuggcugccg

SEQ ID NO: 1627129 - RNA, 15 nt, Pseudomonas putida KT2440
cggcugggugccauc

SEQ ID NO: 1627130 - RNA, 21 nt, Pseudomonas putida KT2440
cggcugccuacccaggcaacg

SEQ ID NO: 1627131 - RNA, 21 nt, Pseudomonas putida KT2440
cggcugcaguagucgccaggc

SEQ ID NO: 1627132 - RNA, 16 nt, Pseudomonas putida KT2440
cggcucgaccaagccu

SEQ ID NO: 1627133 - RNA, 15 nt, Pseudomonas putida KT2440
cggcucaccgcagcc

SEQ ID NO: 1627134 - RNA, 14 nt, Pseudomonas putida KT2440
cggcucacgccccg

SEQ ID NO: 1627135 - RNA, 19 nt, Pseudomonas putida KT2440
cggcucacugcucaucggc

SEQ ID NO: 1627136 - RNA, 18 nt, Pseudomonas putida KT2440
cggcuccggcguguccag

SEQ ID NO: 1627137 - RNA, 22 nt, Pseudomonas putida KT2440
cggcucgccauugaugcucagg

SEQ ID NO: 1627138 - RNA, 20 nt, Pseudomonas putida KT2440
cggcucgcaugagccggggc

SEQ ID NO: 1627139 - RNA, 19 nt, Pseudomonas putida KT2440
cggcuaccgcugcgcacca

SEQ ID NO: 1627140 - RNA, 17 nt, Pseudomonas putida KT2440
cggcuaucucaggccag

SEQ ID NO: 1627141 - RNA, 16 nt, Pseudomonas putida KT2440
cggcuaucggccagca

SEQ ID NO: 1627142 - RNA, 22 nt, Pseudomonas putida KT2440
cggcguguaguagcuccagccc

SEQ ID NO: 1627143 - RNA, 15 nt, Pseudomonas putida KT2440
cggcguguccagcag

SEQ ID NO: 1627144 - RNA, 21 nt, Pseudomonas putida KT2440
cggcuaccccgaugcgcugau

SEQ ID NO: 1627145 - RNA, 22 nt, Pseudomonas putida KT2440
cggcguuaccccguugcgcagc

SEQ ID NO: 1627146 - RNA, 20 nt, Pseudomonas putida KT2440
cggcgguucuucaacuccug

SEQ ID NO: 1627147 - RNA, 23 nt, Pseudomonas putida KT2440
cggcgguuggugcgccuccagca

SEQ ID NO: 1627148 - RNA, 21 nt, Pseudomonas putida KT2440
cggcggcuuccagggcugguu

SEQ ID NO: 1627149 - RNA, 17 nt, Pseudomonas putida KT2440
cggcgcugaccgaugau

SEQ ID NO: 1627150 - RNA, 22 nt, Pseudomonas putida KT2440
cggcgcugaugcggacccagcg

SEQ ID NO: 1627151 - RNA, 18 nt, Pseudomonas putida KT2440
cggcggauguuggccacg

SEQ ID NO: 1627152 - RNA, 19 nt, Pseudomonas putida KT2440
cggccuucaagcuccccag

SEQ ID NO: 1627153 - RNA, 20 nt, Pseudomonas putida KT2440
cggccuggggcaggcccggc

SEQ ID NO: 1627154 - RNA, 14 nt, Pseudomonas putida KT2440
cggccuugaccacu

SEQ ID NO: 1627155 - RNA, 14 nt, Pseudomonas putida KT2440
cggcgcggccugcu

SEQ ID NO: 1627156 - RNA, 15 nt, Pseudomonas putida KT2440
cggcgcggccugcuc

SEQ ID NO: 1627157 - RNA, 17 nt, Pseudomonas putida KT2440
cggcgcgcugcugggcg

SEQ ID NO: 1627158 - RNA, 21 nt, Pseudomonas putida KT2440
cggcgcggaauucgcggcggc

SEQ ID NO: 1627159 - RNA, 20 nt, Pseudomonas putida KT2440
cgucacccguggcagccccc

SEQ ID NO: 1627160 - RNA, 16 nt, Pseudomonas putida KT2440
cgucacccacuucaau

SEQ ID NO: 1627161 - RNA, 14 nt, Pseudomonas putida KT2440
cgucaccugacaca

SEQ ID NO: 1627162 - RNA, 20 nt, Pseudomonas putida KT2440
cgucaccugacacauaggca

SEQ ID NO: 1627163 - RNA, 15 nt, Pseudomonas putida KT2440
cgucaccgccccagc

SEQ ID NO: 1627164 - RNA, 18 nt, Pseudomonas putida KT2440
cgucaccgccccagcgcg

SEQ ID NO: 1627165 - RNA, 21 nt, Pseudomonas putida KT2440
cgucaccgccccagcgcgcca

SEQ ID NO: 1627166 - RNA, 16 nt, Pseudomonas putida KT2440
cgucacugcagaucac

SEQ ID NO: 1627167 - RNA, 19 nt, Pseudomonas putida KT2440
cgucaaccaggcgcagcag

SEQ ID NO: 1627168 - RNA, 20 nt, Pseudomonas putida KT2440
cgucaaccaggcgcagcagc

SEQ ID NO: 1627169 - RNA, 16 nt, Pseudomonas putida KT2440
cgucaaccacagcccg

SEQ ID NO: 1627170 - RNA, 24 nt, Pseudomonas putida KT2440
cgucaacggguauuucaaagaucu

SEQ ID NO: 1627171 - RNA, 13 nt, Pseudomonas putida KT2440
cgucaagcucuuc

SEQ ID NO: 1627172 - RNA, 21 nt, Pseudomonas putida KT2440
cgucaaggaagcuccaggcga

SEQ ID NO: 1627173 - RNA, 17 nt, Pseudomonas putida KT2440
cgucaagguugcucagg

SEQ ID NO: 1627174 - RNA, 23 nt, Pseudomonas putida KT2440
cgucaagguugcucagggcggca

SEQ ID NO: 1627175 - RNA, 22 nt, Pseudomonas putida KT2440
cgucaaguacuugcaggugcag

SEQ ID NO: 1627176 - RNA, 14 nt, Pseudomonas putida KT2440
cgucaccaccaacc

SEQ ID NO: 1627177 - RNA, 19 nt, Pseudomonas putida KT2440
cgucacaugcgccacaccc

SEQ ID NO: 1627178 - RNA, 22 nt, Pseudomonas putida KT2440
cgucaauaccggugccccgguc

SEQ ID NO: 1627179 - RNA, 18 nt, Pseudomonas putida KT2440
cgucaugcgguacagcac

SEQ ID NO: 1627180 - RNA, 23 nt, Pseudomonas putida KT2440
cgucaucgacuucaaugcccagg

SEQ ID NO: 1627181 - RNA, 15 nt, Pseudomonas putida KT2440
cgucauccaccgccc

SEQ ID NO: 1627182 - RNA, 16 nt, Pseudomonas putida KT2440
cgucauccaccgcccc

SEQ ID NO: 1627183 - RNA, 17 nt, Pseudomonas putida KT2440
cgucauccaccgcccca

SEQ ID NO: 1627184 - RNA, 18 nt, Pseudomonas putida KT2440
cgucaguugcagacgcgc

SEQ ID NO: 1627185 - RNA, 20 nt, Pseudomonas putida KT2440
cgucagccaccaccagcucc

SEQ ID NO: 1627186 - RNA, 13 nt, Pseudomonas putida KT2440
cgucaggcucagc

SEQ ID NO: 1627187 - RNA, 16 nt, Pseudomonas putida KT2440
cgucaggccaugcccu

SEQ ID NO: 1627188 - RNA, 14 nt, Pseudomonas putida KT2440
cgucagcuugcaac

SEQ ID NO: 1627189 - RNA, 18 nt, Pseudomonas putida KT2440
cgucagcggcaacaccag

SEQ ID NO: 1627190 - RNA, 13 nt, Pseudomonas putida KT2440
cgucagcguggua

SEQ ID NO: 1627191 - RNA, 18 nt, Pseudomonas putida KT2440
cgucagcucaggccuugc

SEQ ID NO: 1627192 - RNA, 13 nt, Pseudomonas putida KT2440
cguauggcuucac

SEQ ID NO: 1627193 - RNA, 21 nt, Pseudomonas putida KT2440
cguaggucacggucuuggccg

SEQ ID NO: 1627194 - RNA, 19 nt, Pseudomonas putida KT2440
cguaggucaugcgggccgg

SEQ ID NO: 1627195 - RNA, 13 nt, Pseudomonas putida KT2440
cguaggucagguc

SEQ ID NO: 1627196 - RNA, 18 nt, Pseudomonas putida KT2440
cguaguaacggcggaugu

SEQ ID NO: 1627197 - RNA, 15 nt, Pseudomonas putida KT2440
cguaguacuccagca

SEQ ID NO: 1627198 - RNA, 16 nt, Pseudomonas putida KT2440
cguaguacuccagcag

SEQ ID NO: 1627199 - RNA, 20 nt, Pseudomonas putida KT2440
cguaguacuccagcagcgca

SEQ ID NO: 1627200 - RNA, 18 nt, Pseudomonas putida KT2440
cguagcagguacgcgcag

SEQ ID NO: 1627201 - RNA, 22 nt, Pseudomonas putida KT2440
cguagcagguacgcgcaggcag

SEQ ID NO: 1627202 - RNA, 15 nt, Pseudomonas putida KT2440
cguagcccucgaugu

SEQ ID NO: 1627203 - RNA, 22 nt, Pseudomonas putida KT2440
cguaggagcgggcuugcccgcg

SEQ ID NO: 1627204 - RNA, 14 nt, Pseudomonas putida KT2440
cguaggagcggguu

SEQ ID NO: 1627205 - RNA, 16 nt, Pseudomonas putida KT2440
cguaggccagguacag

SEQ ID NO: 1627206 - RNA, 22 nt, Pseudomonas putida KT2440
cguaggcacucggucggcuggc

SEQ ID NO: 1627207 - RNA, 21 nt, Pseudomonas putida KT2440
cguagcgcccggacaacuugg

SEQ ID NO: 1627208 - RNA, 18 nt, Pseudomonas putida KT2440
cguagcuguugcgcuggg

SEQ ID NO: 1627209 - RNA, 19 nt, Pseudomonas putida KT2440
cguagcuguugcgcugggc

SEQ ID NO: 1627210 - RNA, 18 nt, Pseudomonas putida KT2440
cguagcggucaugcagcg

SEQ ID NO: 1627211 - RNA, 18 nt, Pseudomonas putida KT2440
cggucguuacccaccagc

SEQ ID NO: 1627212 - RNA, 17 nt, Pseudomonas putida KT2440
cggugaccagcggcagc

SEQ ID NO: 1627213 - RNA, 21 nt, Pseudomonas putida KT2440
cggucucgaucuaugcccggc

SEQ ID NO: 1627214 - RNA, 20 nt, Pseudomonas putida KT2440
cggugacgaccucggccagg

SEQ ID NO: 1627215 - RNA, 17 nt, Pseudomonas putida KT2440
cggugacgaucaccagg

SEQ ID NO: 1627216 - RNA, 22 nt, Pseudomonas putida KT2440
cggucgccaaauucgaccagca

SEQ ID NO: 1627217 - RNA, 23 nt, Pseudomonas putida KT2440
cggucgccaaauucgaccagcag

SEQ ID NO: 1627218 - RNA, 18 nt, Pseudomonas putida KT2440
cggucgccaaccccacgc

SEQ ID NO: 1627219 - RNA, 21 nt, Pseudomonas putida KT2440
cggucggcguccacugcaccc

SEQ ID NO: 1627220 - RNA, 23 nt, Pseudomonas putida KT2440
cggucggaaggggccgcaaagcg

SEQ ID NO: 1627221 - RNA, 17 nt, Pseudomonas putida KT2440
cggucggccccucgacc

SEQ ID NO: 1627222 - RNA, 18 nt, Pseudomonas putida KT2440
cggucggccccucgacca

SEQ ID NO: 1627223 - RNA, 17 nt, Pseudomonas putida KT2440
cggucgcggcggcaacg

SEQ ID NO: 1627224 - RNA, 14 nt, Pseudomonas putida KT2440
cggucggagagacc

SEQ ID NO: 1627225 - RNA, 17 nt, Pseudomonas putida KT2440
cggucgaaaagccgcgg

SEQ ID NO: 1627226 - RNA, 19 nt, Pseudomonas putida KT2440
cggucgaacauguagaacg

SEQ ID NO: 1627227 - RNA, 11 nt, Pseudomonas putida KT2440
cgguccuccuu

SEQ ID NO: 1627228 - RNA, 17 nt, Pseudomonas putida KT2440
cggucccgcccggccug

SEQ ID NO: 1627229 - RNA, 16 nt, Pseudomonas putida KT2440
cgguccgcccuugcca

SEQ ID NO: 1627230 - RNA, 17 nt, Pseudomonas putida KT2440
cgguccgcccuugccac

SEQ ID NO: 1627231 - RNA, 22 nt, Pseudomonas putida KT2440
cggucauggucaacagcccggu

SEQ ID NO: 1627232 - RNA, 15 nt, Pseudomonas putida KT2440
cgguccaccgccagu

SEQ ID NO: 1627233 - RNA, 18 nt, Pseudomonas putida KT2440
cgguccaccgccagugcg

SEQ ID NO: 1627234 - RNA, 16 nt, Pseudomonas putida KT2440
cggucaccucgcaacc

SEQ ID NO: 1627235 - RNA, 14 nt, Pseudomonas putida KT2440
cggucaccugcaac

SEQ ID NO: 1627236 - RNA, 20 nt, Pseudomonas putida KT2440
cggucacgauccccaccagc

SEQ ID NO: 1627237 - RNA, 22 nt, Pseudomonas putida KT2440
cggucacgauccccaccagcau

SEQ ID NO: 1627238 - RNA, 23 nt, Pseudomonas putida KT2440
cggucacgauccccaccagcauc

SEQ ID NO: 1627239 - RNA, 20 nt, Pseudomonas putida KT2440
cggucagggcggcagcgauc

SEQ ID NO: 1627240 - RNA, 16 nt, Pseudomonas putida KT2440
cggucagggcacggcu

SEQ ID NO: 1627241 - RNA, 16 nt, Pseudomonas putida KT2440
cggucaggcgcagcgu

SEQ ID NO: 1627242 - RNA, 12 nt, Pseudomonas putida KT2440
cggucaucacca

SEQ ID NO: 1627243 - RNA, 20 nt, Pseudomonas putida KT2440
cggucaucaccacccccagc

SEQ ID NO: 1627244 - RNA, 16 nt, Pseudomonas putida KT2440
cggucauccagcagcu

SEQ ID NO: 1627245 - RNA, 21 nt, Pseudomonas putida KT2440
cgggucgauagccagcccggu

SEQ ID NO: 1627246 - RNA, 20 nt, Pseudomonas putida KT2440
cgggucgaccugggccaggu

SEQ ID NO: 1627247 - RNA, 13 nt, Pseudomonas putida KT2440
cgggucgacgcgc

SEQ ID NO: 1627248 - RNA, 22 nt, Pseudomonas putida KT2440
cggucaauuggagcggccuugu

SEQ ID NO: 1627249 - RNA, 17 nt, Pseudomonas putida KT2440
cggugcacggccugcau

SEQ ID NO: 1627250 - RNA, 18 nt, Pseudomonas putida KT2440
cggugcagcaccuccacc

SEQ ID NO: 1627251 - RNA, 21 nt, Pseudomonas putida KT2440
cggugcacccacuggccgaca

SEQ ID NO: 1627252 - RNA, 15 nt, Pseudomonas putida KT2440
cggugcagcggcaga

SEQ ID NO: 1627253 - RNA, 18 nt, Pseudomonas putida KT2440
cggugcauccaacgcugc

SEQ ID NO: 1627254 - RNA, 11 nt, Pseudomonas putida KT2440
cggugcaugcg

SEQ ID NO: 1627255 - RNA, 13 nt, Pseudomonas putida KT2440
cggugccacccaa

SEQ ID NO: 1627256 - RNA, 12 nt, Pseudomonas putida KT2440
cggugccccggu

SEQ ID NO: 1627257 - RNA, 17 nt, Pseudomonas putida KT2440
cggugcccuugccgccc

SEQ ID NO: 1627258 - RNA, 22 nt, Pseudomonas putida KT2440
cggugcccuugccgccccgugc

SEQ ID NO: 1627259 - RNA, 22 nt, Pseudomonas putida KT2440
cggugccauccaccgcgccagc

SEQ ID NO: 1627260 - RNA, 17 nt, Pseudomonas putida KT2440
cgguggaguaccugugg

SEQ ID NO: 1627261 - RNA, 20 nt, Pseudomonas putida KT2440
cgguggccgcguaccagcag

SEQ ID NO: 1627262 - RNA, 18 nt, Pseudomonas putida KT2440
cggugggcaacagcugcg

SEQ ID NO: 1627263 - RNA, 18 nt, Pseudomonas putida KT2440
cgguggggugucuggugu

SEQ ID NO: 1627264 - RNA, 13 nt, Pseudomonas putida KT2440
cgguggucagcuc

SEQ ID NO: 1627265 - RNA, 20 nt, Pseudomonas putida KT2440
cggugugcggaucgccgccg

SEQ ID NO: 1627266 - RNA, 15 nt, Pseudomonas putida KT2440
cggugucggccagcu

SEQ ID NO: 1627267 - RNA, 21 nt, Pseudomonas putida KT2440
cgguuuguccuggccgaugcg

SEQ ID NO: 1627268 - RNA, 16 nt, Pseudomonas putida KT2440
cgguuucgucaggaag

SEQ ID NO: 1627269 - RNA, 19 nt, Pseudomonas putida KT2440
cgguuucccgaugaagaau

SEQ ID NO: 1627270 - RNA, 20 nt, Pseudomonas putida KT2440
cgguuguagaucgccggcag

SEQ ID NO: 1627271 - RNA, 17 nt, Pseudomonas putida KT2440
cccgccugacgccgcca

SEQ ID NO: 1627272 - RNA, 21 nt, Pseudomonas putida KT2440
cccgccgcuucgcggccaagc

SEQ ID NO: 1627273 - RNA, 12 nt, Pseudomonas putida KT2440
cccgccgccccc

SEQ ID NO: 1627274 - RNA, 16 nt, Pseudomonas putida KT2440
cccgccgccccccagu

SEQ ID NO: 1627275 - RNA, 15 nt, Pseudomonas putida KT2440
cccgccgccaccagc

SEQ ID NO: 1627276 - RNA, 22 nt, Pseudomonas putida KT2440
cccgccgccaccagcgccgcca

SEQ ID NO: 1627277 - RNA, 13 nt, Pseudomonas putida KT2440
cccgcgccgccau

SEQ ID NO: 1627278 - RNA, 18 nt, Pseudomonas putida KT2440
cccgcgcauccuccgccc

SEQ ID NO: 1627279 - RNA, 14 nt, Pseudomonas putida KT2440
cccgcgcaugcugc

SEQ ID NO: 1627280 - RNA, 14 nt, Pseudomonas putida KT2440
cccgcgccaccagc

SEQ ID NO: 1627281 - RNA, 19 nt, Pseudomonas putida KT2440
cccgcgcaaaugcaccccu

SEQ ID NO: 1627282 - RNA, 21 nt, Pseudomonas putida KT2440
cccgcgaugccgacagccacc

SEQ ID NO: 1627283 - RNA, 23 nt, Pseudomonas putida KT2440
cccgcgaagcguuuacugcugau

SEQ ID NO: 1627284 - RNA, 18 nt, Pseudomonas putida KT2440
cccgcgaagggccgccaa

SEQ ID NO: 1627285 - RNA, 18 nt, Pseudomonas putida KT2440
cccgcgaagggccgcuag

SEQ ID NO: 1627286 - RNA, 17 nt, Pseudomonas putida KT2440
cccgcgaagggcugccg

SEQ ID NO: 1627287 - RNA, 22 nt, Pseudomonas putida KT2440
cccgcgaagggcugccgcgcag

SEQ ID NO: 1627288 - RNA, 19 nt, Pseudomonas putida KT2440
cccgcgaaggggccggccc

SEQ ID NO: 1627289 - RNA, 21 nt, Pseudomonas putida KT2440
cccgcgaauacggucgcggcg

SEQ ID NO: 1627290 - RNA, 22 nt, Pseudomonas putida KT2440
cccgcgaaugcgguagcggcug

SEQ ID NO: 1627291 - RNA, 14 nt, Pseudomonas putida KT2440
cccgcgaauggccu

SEQ ID NO: 1627292 - RNA, 18 nt, Pseudomonas putida KT2440
cccgcgaaugggccgcca

SEQ ID NO: 1627293 - RNA, 19 nt, Pseudomonas putida KT2440
cccgcgaaugggccgccaa

SEQ ID NO: 1627294 - RNA, 23 nt, Pseudomonas putida KT2440
cccgcgaaugggccgccaagcgg

SEQ ID NO: 1627295 - RNA, 16 nt, Pseudomonas putida KT2440
cccgcgaaugggcugc

SEQ ID NO: 1627296 - RNA, 22 nt, Pseudomonas putida KT2440
cccgcgaaugggcugcaaagca

SEQ ID NO: 1627297 - RNA, 14 nt, Pseudomonas putida KT2440
cccgccuggcgccu

SEQ ID NO: 1627298 - RNA, 18 nt, Pseudomonas putida KT2440
cccgccugggggucgccc

SEQ ID NO: 1627299 - RNA, 19 nt, Pseudomonas putida KT2440
cccgccuggugccagcggc

SEQ ID NO: 1627300 - RNA, 20 nt, Pseudomonas putida KT2440
cccgcgaagaagacaccgcg

SEQ ID NO: 1627301 - RNA, 23 nt, Pseudomonas putida KT2440
cccgcgaagaagccggcaucgcc

SEQ ID NO: 1627302 - RNA, 12 nt, Pseudomonas putida KT2440
cccgcgaagagg

SEQ ID NO: 1627303 - RNA, 17 nt, Pseudomonas putida KT2440
cccgcgaagaggccagc

SEQ ID NO: 1627304 - RNA, 18 nt, Pseudomonas putida KT2440
cccgcgaagaggccagga

SEQ ID NO: 1627305 - RNA, 23 nt, Pseudomonas putida KT2440
cccgcgaagaggccaguaccagc

SEQ ID NO: 1627306 - RNA, 17 nt, Pseudomonas putida KT2440
cccgcgaagaggccggc

SEQ ID NO: 1627307 - RNA, 18 nt, Pseudomonas putida KT2440
cccgcgaagaggccggca

SEQ ID NO: 1627308 - RNA, 18 nt, Pseudomonas putida KT2440
cccgcgaagaggccggcc

SEQ ID NO: 1627309 - RNA, 19 nt, Pseudomonas putida KT2440
cccgcgaagaggccggccc

SEQ ID NO: 1627310 - RNA, 20 nt, Pseudomonas putida KT2440
cccgcgaagaggccggcccc

SEQ ID NO: 1627311 - RNA, 22 nt, Pseudomonas putida KT2440
cccgcgaagaggccgguacagc

SEQ ID NO: 1627312 - RNA, 15 nt, Pseudomonas putida KT2440
cccgcgaagcggcca

SEQ ID NO: 1627313 - RNA, 18 nt, Pseudomonas putida KT2440
cccgcgaaagggccagua

SEQ ID NO: 1627314 - RNA, 19 nt, Pseudomonas putida KT2440
cccgcgaaagggccgggcc

SEQ ID NO: 1627315 - RNA, 20 nt, Pseudomonas putida KT2440
cccgcgaaaugcccaaagcc

SEQ ID NO: 1627316 - RNA, 24 nt, Pseudomonas putida KT2440
cccgcgaacaaggcucagcugaug

SEQ ID NO: 1627317 - RNA, 16 nt, Pseudomonas putida KT2440
cccgcgaacaggcccu

SEQ ID NO: 1627318 - RNA, 13 nt, Pseudomonas putida KT2440
cccgcccgggcuu

SEQ ID NO: 1627319 - RNA, 12 nt, Pseudomonas putida KT2440
cccgccccaaag

SEQ ID NO: 1627320 - RNA, 14 nt, Pseudomonas putida KT2440
cccgccccaauggc

SEQ ID NO: 1627321 - RNA, 16 nt, Pseudomonas putida KT2440
cccgccccccaccugg

SEQ ID NO: 1627322 - RNA, 12 nt, Pseudomonas putida KT2440
cccgcccagcag

SEQ ID NO: 1627323 - RNA, 19 nt, Pseudomonas putida KT2440
cccgccauguugcgcagca

SEQ ID NO: 1627324 - RNA, 12 nt, Pseudomonas putida KT2440
cccgcccaccac

SEQ ID NO: 1627325 - RNA, 14 nt, Pseudomonas putida KT2440
cccgcccaccacca

SEQ ID NO: 1627326 - RNA, 21 nt, Pseudomonas putida KT2440
cccgcccaauuuggccagcuu

SEQ ID NO: 1627327 - RNA, 19 nt, Pseudomonas putida KT2440
cccgccauaucaggauugc

SEQ ID NO: 1627328 - RNA, 19 nt, Pseudomonas putida KT2440
cccgccaguuugcacuggc

SEQ ID NO: 1627329 - RNA, 16 nt, Pseudomonas putida KT2440
cccgccaggcgcaagc

SEQ ID NO: 1627330 - RNA, 19 nt, Pseudomonas putida KT2440
cccgccaguaggcugcagc

SEQ ID NO: 1627331 - RNA, 21 nt, Pseudomonas putida KT2440
cccgccaguaggcugcagccu

SEQ ID NO: 1627332 - RNA, 22 nt, Pseudomonas putida KT2440
cccgccaguaggcugcagccuu

SEQ ID NO: 1627333 - RNA, 15 nt, Pseudomonas putida KT2440
cccgccaccgccucg

SEQ ID NO: 1627334 - RNA, 20 nt, Pseudomonas putida KT2440
cccgccagcaggccaccggc

SEQ ID NO: 1627335 - RNA, 16 nt, Pseudomonas putida KT2440
cccgccagcaauugcg

SEQ ID NO: 1627336 - RNA, 16 nt, Pseudomonas putida KT2440
cccgcaucguuugaug

SEQ ID NO: 1627337 - RNA, 12 nt, Pseudomonas putida KT2440
cccgcaugcaac

SEQ ID NO: 1627338 - RNA, 14 nt, Pseudomonas putida KT2440
cccgcagggccccc

SEQ ID NO: 1627339 - RNA, 15 nt, Pseudomonas putida KT2440
cccgcaggccgcagc

SEQ ID NO: 1627340 - RNA, 23 nt, Pseudomonas putida KT2440
cccgccacaggugacaagcugcg

SEQ ID NO: 1627341 - RNA, 21 nt, Pseudomonas putida KT2440
cccgcauuggguggccccggc

SEQ ID NO: 1627342 - RNA, 22 nt, Pseudomonas putida KT2440
cccgcauuggguggccccggcc

SEQ ID NO: 1627343 - RNA, 14 nt, Pseudomonas putida KT2440
cccggcagccaccg

SEQ ID NO: 1627344 - RNA, 19 nt, Pseudomonas putida KT2440
cccggcagaucgagcgccg

SEQ ID NO: 1627345 - RNA, 21 nt, Pseudomonas putida KT2440
cccggcagaucgagcgccgcc

SEQ ID NO: 1627346 - RNA, 18 nt, Pseudomonas putida KT2440
cccggauggugugcagca

SEQ ID NO: 1627347 - RNA, 19 nt, Pseudomonas putida KT2440
cccggcacauagaccauuu

SEQ ID NO: 1627348 - RNA, 18 nt, Pseudomonas putida KT2440
cccggccaggccggcggu

SEQ ID NO: 1627349 - RNA, 20 nt, Pseudomonas putida KT2440
cccggccagugaagcucgau

SEQ ID NO: 1627350 - RNA, 13 nt, Pseudomonas putida KT2440
cccggcccagccg

SEQ ID NO: 1627351 - RNA, 14 nt, Pseudomonas putida KT2440
cccggcccagccgc

SEQ ID NO: 1627352 - RNA, 13 nt, Pseudomonas putida KT2440
cccggccaacaac

SEQ ID NO: 1627353 - RNA, 13 nt, Pseudomonas putida KT2440
cccggccagcagg

SEQ ID NO: 1627354 - RNA, 15 nt, Pseudomonas putida KT2440
cccggccagcagguc

SEQ ID NO: 1627355 - RNA, 11 nt, Pseudomonas putida KT2440
cccggccagcg

SEQ ID NO: 1627356 - RNA, 16 nt, Pseudomonas putida KT2440
cccggccagcgacccu

SEQ ID NO: 1627357 - RNA, 15 nt, Pseudomonas putida KT2440
cccggacugcaccag

SEQ ID NO: 1627358 - RNA, 15 nt, Pseudomonas putida KT2440
cccggaccagcgccg

SEQ ID NO: 1627359 - RNA, 17 nt, Pseudomonas putida KT2440
cccggaccagcgccgca

SEQ ID NO: 1627360 - RNA, 19 nt, Pseudomonas putida KT2440
cccggaaugcccgggcgca

SEQ ID NO: 1627361 - RNA, 24 nt, Pseudomonas putida KT2440
cccggaagcuucucgagcggccug

SEQ ID NO: 1627362 - RNA, 12 nt, Pseudomonas putida KT2440
cccgcuugcugu

SEQ ID NO: 1627363 - RNA, 12 nt, Pseudomonas putida KT2440
cccgcuuggcca

SEQ ID NO: 1627364 - RNA, 21 nt, Pseudomonas putida KT2440
cccgcuguugagcagcagccc

SEQ ID NO: 1627365 - RNA, 21 nt, Pseudomonas putida KT2440
cccgcuucgccagcgccaccg

SEQ ID NO: 1627366 - RNA, 17 nt, Pseudomonas putida KT2440
cccgcgucucgccgcug

SEQ ID NO: 1627367 - RNA, 20 nt, Pseudomonas putida KT2440
cccgcgucagcucaagcgcu

SEQ ID NO: 1627368 - RNA, 13 nt, Pseudomonas putida KT2440
cccgcguccaggg

SEQ ID NO: 1627369 - RNA, 17 nt, Pseudomonas putida KT2440
cccgcguccagggcagg

SEQ ID NO: 1627370 - RNA, 23 nt, Pseudomonas putida KT2440
cccgcguucaugccggccccaga

SEQ ID NO: 1627371 - RNA, 18 nt, Pseudomonas putida KT2440
cccgcggucuggcacaga

SEQ ID NO: 1627372 - RNA, 19 nt, Pseudomonas putida KT2440
cccgcggucuggcacagaa

SEQ ID NO: 1627373 - RNA, 16 nt, Pseudomonas putida KT2440
cccgcggcucacccac

SEQ ID NO: 1627374 - RNA, 13 nt, Pseudomonas putida KT2440
cccgcgcggcgca

SEQ ID NO: 1627375 - RNA, 21 nt, Pseudomonas putida KT2440
cccgcgccuacaggcaaccgc

SEQ ID NO: 1627376 - RNA, 16 nt, Pseudomonas putida KT2440
cccgcugggcuucuuc

SEQ ID NO: 1627377 - RNA, 20 nt, Pseudomonas putida KT2440
cccgcugcgccgcucugccc

SEQ ID NO: 1627378 - RNA, 18 nt, Pseudomonas putida KT2440
cccgcugcacaggccagc

SEQ ID NO: 1627379 - RNA, 22 nt, Pseudomonas putida KT2440
cccgcugcacaggccagcccca

SEQ ID NO: 1627380 - RNA, 12 nt, Pseudomonas putida KT2440
cccgcugcugcg

SEQ ID NO: 1627381 - RNA, 15 nt, Pseudomonas putida KT2440
cccgcugcuuccggc

SEQ ID NO: 1627382 - RNA, 15 nt, Pseudomonas putida KT2440
cccgcugccacccac

SEQ ID NO: 1627383 - RNA, 16 nt, Pseudomonas putida KT2440
cccgcugccacccaca

SEQ ID NO: 1627384 - RNA, 17 nt, Pseudomonas putida KT2440
cccgcugccacccacag

SEQ ID NO: 1627385 - RNA, 22 nt, Pseudomonas putida KT2440
cccgcuccuacaggauggccgc

SEQ ID NO: 1627386 - RNA, 14 nt, Pseudomonas putida KT2440
cccgcuccuaccac

SEQ ID NO: 1627387 - RNA, 21 nt, Pseudomonas putida KT2440
cccgcuccuacgggcaaccgc

SEQ ID NO: 1627388 - RNA, 22 nt, Pseudomonas putida KT2440
cccgcucucacagggaccgugc

SEQ ID NO: 1627389 - RNA, 21 nt, Pseudomonas putida KT2440
cccgcucccacagaaggcugc

SEQ ID NO: 1627390 - RNA, 18 nt, Pseudomonas putida KT2440
cccgcucccacaggaauu

SEQ ID NO: 1627391 - RNA, 18 nt, Pseudomonas putida KT2440
cccgcucccacaggccaa

SEQ ID NO: 1627392 - RNA, 16 nt, Pseudomonas putida KT2440
cccgcuacaccggccu

SEQ ID NO: 1627393 - RNA, 16 nt, Pseudomonas putida KT2440
cccgucgccucaccuc

SEQ ID NO: 1627394 - RNA, 13 nt, Pseudomonas putida KT2440
cccguccacagcg

SEQ ID NO: 1627395 - RNA, 16 nt, Pseudomonas putida KT2440
cccguccagccccaag

SEQ ID NO: 1627396 - RNA, 15 nt, Pseudomonas putida KT2440
cccgucagcggcaac

SEQ ID NO: 1627397 - RNA, 15 nt, Pseudomonas putida KT2440
cccgguuggcgcuuc

SEQ ID NO: 1627398 - RNA, 21 nt, Pseudomonas putida KT2440
cccgguuggggacggcagccg

SEQ ID NO: 1627399 - RNA, 14 nt, Pseudomonas putida KT2440
cccguggcagcccc

SEQ ID NO: 1627400 - RNA, 19 nt, Pseudomonas putida KT2440
cccgugcaggggucugugc

SEQ ID NO: 1627401 - RNA, 18 nt, Pseudomonas putida KT2440
cccgugcaucugcucccc

SEQ ID NO: 1627402 - RNA, 17 nt, Pseudomonas putida KT2440
cccgugccauccaccgc

SEQ ID NO: 1627403 - RNA, 12 nt, Pseudomonas putida KT2440
cccgucgcugcc

SEQ ID NO: 1627404 - RNA, 17 nt, Pseudomonas putida KT2440
cccguugguguccuugu

SEQ ID NO: 1627405 - RNA, 21 nt, Pseudomonas putida KT2440
cccguugaggguggcaaugcu

SEQ ID NO: 1627406 - RNA, 22 nt, Pseudomonas putida KT2440
cccuacgaacaaauccgcgccg

SEQ ID NO: 1627407 - RNA, 24 nt, Pseudomonas putida KT2440
cccucaaugcugccuccgccaagc

SEQ ID NO: 1627408 - RNA, 16 nt, Pseudomonas putida KT2440
cccuccacccaccuug

SEQ ID NO: 1627409 - RNA, 19 nt, Pseudomonas putida KT2440
cccuccacccaccuuggcc

SEQ ID NO: 1627410 - RNA, 14 nt, Pseudomonas putida KT2440
cccuccacccgguc

SEQ ID NO: 1627411 - RNA, 22 nt, Pseudomonas putida KT2440
cccuccacccggucccgcccgg

SEQ ID NO: 1627412 - RNA, 22 nt, Pseudomonas putida KT2440
cccuccagccgcgaacgccccg

SEQ ID NO: 1627413 - RNA, 12 nt, Pseudomonas putida KT2440
cccucaggcaca

SEQ ID NO: 1627414 - RNA, 14 nt, Pseudomonas putida KT2440
cccucacucaccgc

SEQ ID NO: 1627415 - RNA, 19 nt, Pseudomonas putida KT2440
cccucacgaugacccuucc

SEQ ID NO: 1627416 - RNA, 18 nt, Pseudomonas putida KT2440
cccucgaccacgcacagc

SEQ ID NO: 1627417 - RNA, 15 nt, Pseudomonas putida KT2440
cccucgaacagcgcc

SEQ ID NO: 1627418 - RNA, 19 nt, Pseudomonas putida KT2440
cccuccuccagcauggcga

SEQ ID NO: 1627419 - RNA, 12 nt, Pseudomonas putida KT2440
cccuccuaaggg

SEQ ID NO: 1627420 - RNA, 18 nt, Pseudomonas putida KT2440
cccuccgguucugccggg

SEQ ID NO: 1627421 - RNA, 14 nt, Pseudomonas putida KT2440
cccgggugcagccg

SEQ ID NO: 1627422 - RNA, 18 nt, Pseudomonas putida KT2440
cccgggugcagccgcacc

SEQ ID NO: 1627423 - RNA, 14 nt, Pseudomonas putida KT2440
cccggguccaccuc

SEQ ID NO: 1627424 - RNA, 19 nt, Pseudomonas putida KT2440
cccgguaacgggccagccg

SEQ ID NO: 1627425 - RNA, 23 nt, Pseudomonas putida KT2440
cccgguaacgggccagccgcgcc

SEQ ID NO: 1627426 - RNA, 21 nt, Pseudomonas putida KT2440
cccggggugcagauccaggug

SEQ ID NO: 1627427 - RNA, 16 nt, Pseudomonas putida KT2440
cccggcuugcuccaag

SEQ ID NO: 1627428 - RNA, 21 nt, Pseudomonas putida KT2440
cccgggaacggcugccguccc

SEQ ID NO: 1627429 - RNA, 12 nt, Pseudomonas putida KT2440
cccgggcagccg

SEQ ID NO: 1627430 - RNA, 17 nt, Pseudomonas putida KT2440
cccgggcaaagcaccau

SEQ ID NO: 1627431 - RNA, 19 nt, Pseudomonas putida KT2440
cccgggaaaagccugccag

SEQ ID NO: 1627432 - RNA, 14 nt, Pseudomonas putida KT2440
cccgggccaggccc

SEQ ID NO: 1627433 - RNA, 19 nt, Pseudomonas putida KT2440
cccggugcccuugccgccc

SEQ ID NO: 1627434 - RNA, 14 nt, Pseudomonas putida KT2440
cccgguggcgcggc

SEQ ID NO: 1627435 - RNA, 23 nt, Pseudomonas putida KT2440
cccgguacgguacgugcacggcc

SEQ ID NO: 1627436 - RNA, 13 nt, Pseudomonas putida KT2440
cccggucaacgcu

SEQ ID NO: 1627437 - RNA, 16 nt, Pseudomonas putida KT2440
cccgguccagcacacu

SEQ ID NO: 1627438 - RNA, 11 nt, Pseudomonas putida KT2440
cccggucccgc

SEQ ID NO: 1627439 - RNA, 13 nt, Pseudomonas putida KT2440
cccggucccgccc

SEQ ID NO: 1627440 - RNA, 16 nt, Pseudomonas putida KT2440
cccggucccgcugccg

SEQ ID NO: 1627441 - RNA, 15 nt, Pseudomonas putida KT2440
cccggcgccaugccc

SEQ ID NO: 1627442 - RNA, 20 nt, Pseudomonas putida KT2440
cccggcgccaugccccccgc

SEQ ID NO: 1627443 - RNA, 15 nt, Pseudomonas putida KT2440
cccggccuggcgcag

SEQ ID NO: 1627444 - RNA, 16 nt, Pseudomonas putida KT2440
cccggccuggcgcagg

SEQ ID NO: 1627445 - RNA, 15 nt, Pseudomonas putida KT2440
cccggccucggccgg

SEQ ID NO: 1627446 - RNA, 18 nt, Pseudomonas putida KT2440
cccggccucggccggguu

SEQ ID NO: 1627447 - RNA, 14 nt, Pseudomonas putida KT2440
cccggcguucagcc

SEQ ID NO: 1627448 - RNA, 19 nt, Pseudomonas putida KT2440
cccggcgcugaucagcugg

SEQ ID NO: 1627449 - RNA, 13 nt, Pseudomonas putida KT2440
cccggcgccgccg

SEQ ID NO: 1627450 - RNA, 13 nt, Pseudomonas putida KT2440
cccggcgccgcca

SEQ ID NO: 1627451 - RNA, 14 nt, Pseudomonas putida KT2440
ccauugcccagccu

SEQ ID NO: 1627452 - RNA, 15 nt, Pseudomonas putida KT2440
ccauugcccagccug

SEQ ID NO: 1627453 - RNA, 12 nt, Pseudomonas putida KT2440
ccauugcccagu

SEQ ID NO: 1627454 - RNA, 17 nt, Pseudomonas putida KT2440
ccauugcccaguucguc

SEQ ID NO: 1627455 - RNA, 15 nt, Pseudomonas putida KT2440
ccauugaucaccucc

SEQ ID NO: 1627456 - RNA, 14 nt, Pseudomonas putida KT2440
ccaucuuuggcagg

SEQ ID NO: 1627457 - RNA, 21 nt, Pseudomonas putida KT2440
ccauuucacuggcuuccucuu

SEQ ID NO: 1627458 - RNA, 17 nt, Pseudomonas putida KT2440
ccauuucgcgggucagg

SEQ ID NO: 1627459 - RNA, 14 nt, Pseudomonas putida KT2440
ccauuucuucagca

SEQ ID NO: 1627460 - RNA, 19 nt, Pseudomonas putida KT2440
ccauuucuucagcaggaag

SEQ ID NO: 1627461 - RNA, 21 nt, Pseudomonas putida KT2440
cccaaacagcaucaaugcagg

SEQ ID NO: 1627462 - RNA, 21 nt, Pseudomonas putida KT2440
cccaccacgaacgcccccagc

SEQ ID NO: 1627463 - RNA, 22 nt, Pseudomonas putida KT2440
cccaccaagggugucaacaggc

SEQ ID NO: 1627464 - RNA, 23 nt, Pseudomonas putida KT2440
cccaccaauuacucggcccauuc

SEQ ID NO: 1627465 - RNA, 23 nt, Pseudomonas putida KT2440
cccaccacaaaccacagcggcca

SEQ ID NO: 1627466 - RNA, 13 nt, Pseudomonas putida KT2440
cccaccagcucca

SEQ ID NO: 1627467 - RNA, 14 nt, Pseudomonas putida KT2440
cccaccagcuccau

SEQ ID NO: 1627468 - RNA, 18 nt, Pseudomonas putida KT2440
cccaccagcugcaccacc

SEQ ID NO: 1627469 - RNA, 19 nt, Pseudomonas putida KT2440
cccaccagcugcaccaccu

SEQ ID NO: 1627470 - RNA, 20 nt, Pseudomonas putida KT2440
cccaccaggauuggccgcaa

SEQ ID NO: 1627471 - RNA, 12 nt, Pseudomonas putida KT2440
cccaccaggcac

SEQ ID NO: 1627472 - RNA, 15 nt, Pseudomonas putida KT2440
cccaccagcacugcc

SEQ ID NO: 1627473 - RNA, 12 nt, Pseudomonas putida KT2440
cccacgccggca

SEQ ID NO: 1627474 - RNA, 19 nt, Pseudomonas putida KT2440
cccaccggccgccgccaga

SEQ ID NO: 1627475 - RNA, 20 nt, Pseudomonas putida KT2440
cccaccggccgccgccagac

SEQ ID NO: 1627476 - RNA, 18 nt, Pseudomonas putida KT2440
cccaccggcuccaccugc

SEQ ID NO: 1627477 - RNA, 15 nt, Pseudomonas putida KT2440
cccaccggcaccauc

SEQ ID NO: 1627478 - RNA, 19 nt, Pseudomonas putida KT2440
cccaccgcguuggccaggu

SEQ ID NO: 1627479 - RNA, 13 nt, Pseudomonas putida KT2440
cccaaccaccgac

SEQ ID NO: 1627480 - RNA, 16 nt, Pseudomonas putida KT2440
cccaaccucaacgccu

SEQ ID NO: 1627481 - RNA, 13 nt, Pseudomonas putida KT2440
cccaacccagcca

SEQ ID NO: 1627482 - RNA, 18 nt, Pseudomonas putida KT2440
cccacacggcaagccacg

SEQ ID NO: 1627483 - RNA, 13 nt, Pseudomonas putida KT2440
cccacagagccgc

SEQ ID NO: 1627484 - RNA, 18 nt, Pseudomonas putida KT2440
cccacagauauugcaccg

SEQ ID NO: 1627485 - RNA, 17 nt, Pseudomonas putida KT2440
cccacagcggccccauc

SEQ ID NO: 1627486 - RNA, 20 nt, Pseudomonas putida KT2440
cccacagcgccugcugcugg

SEQ ID NO: 1627487 - RNA, 18 nt, Pseudomonas putida KT2440
cccagccccgcaugcucg

SEQ ID NO: 1627488 - RNA, 23 nt, Pseudomonas putida KT2440
cccagccccgcaugcucgcugcu

SEQ ID NO: 1627489 - RNA, 22 nt, Pseudomonas putida KT2440
cccagcccggacugcaccaggu

SEQ ID NO: 1627490 - RNA, 15 nt, Pseudomonas putida KT2440
cccagcccggcgccg

SEQ ID NO: 1627491 - RNA, 19 nt, Pseudomonas putida KT2440
cccagcaguucgcgcacca

SEQ ID NO: 1627492 - RNA, 18 nt, Pseudomonas putida KT2440
cccagcaucaacgcugcc

SEQ ID NO: 1627493 - RNA, 21 nt, Pseudomonas putida KT2440
cccagcagcgggcacaggccg

SEQ ID NO: 1627494 - RNA, 22 nt, Pseudomonas putida KT2440
cccagcagcgggcacaggccgc

SEQ ID NO: 1627495 - RNA, 16 nt, Pseudomonas putida KT2440
cccagcagguacagca

SEQ ID NO: 1627496 - RNA, 23 nt, Pseudomonas putida KT2440
cccagcagguacagcaccccguc

SEQ ID NO: 1627497 - RNA, 18 nt, Pseudomonas putida KT2440
cccagcaggugcccaagc

SEQ ID NO: 1627498 - RNA, 15 nt, Pseudomonas putida KT2440
cccagcagccaacgc

SEQ ID NO: 1627499 - RNA, 14 nt, Pseudomonas putida KT2440
cccagcagccccac

SEQ ID NO: 1627500 - RNA, 15 nt, Pseudomonas putida KT2440
cccagccucagcugg

SEQ ID NO: 1627501 - RNA, 23 nt, Pseudomonas putida KT2440
cccagccugggcgugaaagcagg

SEQ ID NO: 1627502 - RNA, 18 nt, Pseudomonas putida KT2440
cccagccuucaacccuuc

SEQ ID NO: 1627503 - RNA, 16 nt, Pseudomonas putida KT2440
cccagccuucagcagg

SEQ ID NO: 1627504 - RNA, 17 nt, Pseudomonas putida KT2440
cccagccuucagcaggc

SEQ ID NO: 1627505 - RNA, 16 nt, Pseudomonas putida KT2440
cccagccugcccgccg

SEQ ID NO: 1627506 - RNA, 16 nt, Pseudomonas putida KT2440
cccagccggucaucac

SEQ ID NO: 1627507 - RNA, 19 nt, Pseudomonas putida KT2440
cccagccggucauccagca

SEQ ID NO: 1627508 - RNA, 19 nt, Pseudomonas putida KT2440
cccagcacgaaggccagca

SEQ ID NO: 1627509 - RNA, 16 nt, Pseudomonas putida KT2440
cccacucacgcaacuc

SEQ ID NO: 1627510 - RNA, 19 nt, Pseudomonas putida KT2440
cccagcaccacccaccagc

SEQ ID NO: 1627511 - RNA, 13 nt, Pseudomonas putida KT2440
cccacggccgcca

SEQ ID NO: 1627512 - RNA, 14 nt, Pseudomonas putida KT2440
cccacggcguccag

SEQ ID NO: 1627513 - RNA, 18 nt, Pseudomonas putida KT2440
cccacggcguccaggccc

SEQ ID NO: 1627514 - RNA, 16 nt, Pseudomonas putida KT2440
cccagcgaccagcugc

SEQ ID NO: 1627515 - RNA, 18 nt, Pseudomonas putida KT2440
cccagcgaccagcugcca

SEQ ID NO: 1627516 - RNA, 15 nt, Pseudomonas putida KT2440
cccagcgccaccggc

SEQ ID NO: 1627517 - RNA, 19 nt, Pseudomonas putida KT2440
cccagcgccuuggccugcu

SEQ ID NO: 1627518 - RNA, 23 nt, Pseudomonas putida KT2440
cccagcgccuuggccugcucacc

SEQ ID NO: 1627519 - RNA, 15 nt, Pseudomonas putida KT2440
cccagcgcgccagca

SEQ ID NO: 1627520 - RNA, 20 nt, Pseudomonas putida KT2440
cccagcgcggucugcggcag

SEQ ID NO: 1627521 - RNA, 22 nt, Pseudomonas putida KT2440
cccagcgcucguaggcuucacg

SEQ ID NO: 1627522 - RNA, 21 nt, Pseudomonas putida KT2440
cccagcgcugucccccagccc

SEQ ID NO: 1627523 - RNA, 16 nt, Pseudomonas putida KT2440
cccagcgcgcgcagac

SEQ ID NO: 1627524 - RNA, 13 nt, Pseudomonas putida KT2440
cccaggccgccca

SEQ ID NO: 1627525 - RNA, 22 nt, Pseudomonas putida KT2440
cccaggccgacacgggguguug

SEQ ID NO: 1627526 - RNA, 23 nt, Pseudomonas putida KT2440
cccagggcccucaacccucgccc

SEQ ID NO: 1627527 - RNA, 12 nt, Pseudomonas putida KT2440
cccagggcugcu

SEQ ID NO: 1627528 - RNA, 16 nt, Pseudomonas putida KT2440
cccagggcugcuucac

SEQ ID NO: 1627529 - RNA, 14 nt, Pseudomonas putida KT2440
cccaggggcagguc

SEQ ID NO: 1627530 - RNA, 17 nt, Pseudomonas putida KT2440
cccagggggcagcugcu

SEQ ID NO: 1627531 - RNA, 23 nt, Pseudomonas putida KT2440
cccagcggucagcaucuucuucc

SEQ ID NO: 1627532 - RNA, 20 nt, Pseudomonas putida KT2440
cccagcuacgcgagccaccg

SEQ ID NO: 1627533 - RNA, 15 nt, Pseudomonas putida KT2440
cccaggcagccucca

SEQ ID NO: 1627534 - RNA, 17 nt, Pseudomonas putida KT2440
cccaggaucacuggccu

SEQ ID NO: 1627535 - RNA, 19 nt, Pseudomonas putida KT2440
cccaggaucacuggccugg

SEQ ID NO: 1627536 - RNA, 15 nt, Pseudomonas putida KT2440
ccccacgccgaccgc

SEQ ID NO: 1627537 - RNA, 17 nt, Pseudomonas putida KT2440
ccccacuccugugcggc

SEQ ID NO: 1627538 - RNA, 15 nt, Pseudomonas putida KT2440
ccccagccagcagau

SEQ ID NO: 1627539 - RNA, 18 nt, Pseudomonas putida KT2440
cccccaaucuccagcccg

SEQ ID NO: 1627540 - RNA, 20 nt, Pseudomonas putida KT2440
cccccaaucuccagcccgaa

SEQ ID NO: 1627541 - RNA, 19 nt, Pseudomonas putida KT2440
cccccaaugggcaccggcc

SEQ ID NO: 1627542 - RNA, 12 nt, Pseudomonas putida KT2440
cccccaccggcc

SEQ ID NO: 1627543 - RNA, 16 nt, Pseudomonas putida KT2440
cccccacgcuaauacc

SEQ ID NO: 1627544 - RNA, 18 nt, Pseudomonas putida KT2440
cccccagccaacgcccca

SEQ ID NO: 1627545 - RNA, 23 nt, Pseudomonas putida KT2440
cccccagccaacgccccacccgc

SEQ ID NO: 1627546 - RNA, 20 nt, Pseudomonas putida KT2440
cccccagcgaccagcugcca

SEQ ID NO: 1627547 - RNA, 12 nt, Pseudomonas putida KT2440
cccccagcccug

SEQ ID NO: 1627548 - RNA, 23 nt, Pseudomonas putida KT2440
cccccaggcugccaaaccgcccc

SEQ ID NO: 1627549 - RNA, 18 nt, Pseudomonas putida KT2440
cccccagcgccuccaccu

SEQ ID NO: 1627550 - RNA, 17 nt, Pseudomonas putida KT2440
cccccaugagccgccca

SEQ ID NO: 1627551 - RNA, 19 nt, Pseudomonas putida KT2440
cccccgaagcagccgccgc

SEQ ID NO: 1627552 - RNA, 22 nt, Pseudomonas putida KT2440
cccccgaaucagugcaccggca

SEQ ID NO: 1627553 - RNA, 12 nt, Pseudomonas putida KT2440
ccccccuccuca

SEQ ID NO: 1627554 - RNA, 13 nt, Pseudomonas putida KT2440
ccccccugcacca

SEQ ID NO: 1627555 - RNA, 13 nt, Pseudomonas putida KT2440
ccccccggcucca

SEQ ID NO: 1627556 - RNA, 21 nt, Pseudomonas putida KT2440
ccccgacugacgcuacgccgc

SEQ ID NO: 1627557 - RNA, 12 nt, Pseudomonas putida KT2440
ccccgcaccgcg

SEQ ID NO: 1627558 - RNA, 13 nt, Pseudomonas putida KT2440
ccccgccaacaac

SEQ ID NO: 1627559 - RNA, 13 nt, Pseudomonas putida KT2440
ccccgccaacccc

SEQ ID NO: 1627560 - RNA, 12 nt, Pseudomonas putida KT2440
ccccgccacccc

SEQ ID NO: 1627561 - RNA, 22 nt, Pseudomonas putida KT2440
ccccgauacagcgcgccgccga

SEQ ID NO: 1627562 - RNA, 13 nt, Pseudomonas putida KT2440
ccccgcccuagcg

SEQ ID NO: 1627563 - RNA, 12 nt, Pseudomonas putida KT2440
ccccgccgcccc

SEQ ID NO: 1627564 - RNA, 13 nt, Pseudomonas putida KT2440
ccccgccgccccc

SEQ ID NO: 1627565 - RNA, 14 nt, Pseudomonas putida KT2440
ccccgccgcccccc

SEQ ID NO: 1627566 - RNA, 17 nt, Pseudomonas putida KT2440
ccccgccccugcuugac

SEQ ID NO: 1627567 - RNA, 12 nt, Pseudomonas putida KT2440
ccccgccccacc

SEQ ID NO: 1627568 - RNA, 19 nt, Pseudomonas putida KT2440
cccaugcccagcucgcugg

SEQ ID NO: 1627569 - RNA, 22 nt, Pseudomonas putida KT2440
cccagguaacugccgaccuugg

SEQ ID NO: 1627570 - RNA, 15 nt, Pseudomonas putida KT2440
cccaugaucuugcug

SEQ ID NO: 1627571 - RNA, 16 nt, Pseudomonas putida KT2440
cccaggugaugcaggc

SEQ ID NO: 1627572 - RNA, 18 nt, Pseudomonas putida KT2440
cccaggugaugcaggcaa

SEQ ID NO: 1627573 - RNA, 21 nt, Pseudomonas putida KT2440
cccaugcugcagaaccgccag

SEQ ID NO: 1627574 - RNA, 16 nt, Pseudomonas putida KT2440
cccauggcuccaccca

SEQ ID NO: 1627575 - RNA, 22 nt, Pseudomonas putida KT2440
cccauggccagcguggccgcca

SEQ ID NO: 1627576 - RNA, 20 nt, Pseudomonas putida KT2440
cccauggcgguauucacacc

SEQ ID NO: 1627577 - RNA, 15 nt, Pseudomonas putida KT2440
cccauguggcgcagc

SEQ ID NO: 1627578 - RNA, 18 nt, Pseudomonas putida KT2440
cccauguagaccaccagc

SEQ ID NO: 1627579 - RNA, 19 nt, Pseudomonas putida KT2440
cccauguagaccaccagcg

SEQ ID NO: 1627580 - RNA, 18 nt, Pseudomonas putida KT2440
cccaugucgaucagcggc

SEQ ID NO: 1627581 - RNA, 23 nt, Pseudomonas putida KT2440
ccccaccucggcgaucagcuuca

SEQ ID NO: 1627582 - RNA, 13 nt, Pseudomonas putida KT2440
ccccaccucuuca

SEQ ID NO: 1627583 - RNA, 13 nt, Pseudomonas putida KT2440
ccccaccagcacu

SEQ ID NO: 1627584 - RNA, 20 nt, Pseudomonas putida KT2440
ccccaccagcacugccuugc

SEQ ID NO: 1627585 - RNA, 22 nt, Pseudomonas putida KT2440
ccccaauugcuucaaccguggu

SEQ ID NO: 1627586 - RNA, 17 nt, Pseudomonas putida KT2440
ccccacaacggccgcaa

SEQ ID NO: 1627587 - RNA, 12 nt, Pseudomonas putida KT2440
ccccaacccggu

SEQ ID NO: 1627588 - RNA, 15 nt, Pseudomonas putida KT2440
ccccaacccgguccc

SEQ ID NO: 1627589 - RNA, 15 nt, Pseudomonas putida KT2440
ccccaaaccaggccg

SEQ ID NO: 1627590 - RNA, 13 nt, Pseudomonas putida KT2440
ccccaagcgccug

SEQ ID NO: 1627591 - RNA, 17 nt, Pseudomonas putida KT2440
ccccaacugcauccgcc

SEQ ID NO: 1627592 - RNA, 20 nt, Pseudomonas putida KT2440
ccccaacugcauccgcccca

SEQ ID NO: 1627593 - RNA, 22 nt, Pseudomonas putida KT2440
ccccaaugggcaccggccacca

SEQ ID NO: 1627594 - RNA, 16 nt, Pseudomonas putida KT2440
ccccaaggcugccaau

SEQ ID NO: 1627595 - RNA, 14 nt, Pseudomonas putida KT2440
cccgcaagccagcc

SEQ ID NO: 1627596 - RNA, 17 nt, Pseudomonas putida KT2440
cccgcaagccagccucc

SEQ ID NO: 1627597 - RNA, 12 nt, Pseudomonas putida KT2440
cccgcaagcgcc

SEQ ID NO: 1627598 - RNA, 19 nt, Pseudomonas putida KT2440
cccgaugcgcuugaggcuu

SEQ ID NO: 1627599 - RNA, 22 nt, Pseudomonas putida KT2440
cccgaugcgcuugaggcuuuca

SEQ ID NO: 1627600 - RNA, 20 nt, Pseudomonas putida KT2440
cccgauuccuugcagcgccg

SEQ ID NO: 1627601 - RNA, 13 nt, Pseudomonas putida KT2440
cccgcacccacag

SEQ ID NO: 1627602 - RNA, 15 nt, Pseudomonas putida KT2440
cccgcacaugccugc

SEQ ID NO: 1627603 - RNA, 18 nt, Pseudomonas putida KT2440
cccgcacauuucacagca

SEQ ID NO: 1627604 - RNA, 22 nt, Pseudomonas putida KT2440
cccgcaaucgucgaccaccgcc

SEQ ID NO: 1627605 - RNA, 14 nt, Pseudomonas putida KT2440
cccgcacccggcgg

SEQ ID NO: 1627606 - RNA, 15 nt, Pseudomonas putida KT2440
cccgcacccggcgga

SEQ ID NO: 1627607 - RNA, 21 nt, Pseudomonas putida KT2440
cccgcaccgcggaugcgccug

SEQ ID NO: 1627608 - RNA, 12 nt, Pseudomonas putida KT2440
cccgcacugcug

SEQ ID NO: 1627609 - RNA, 18 nt, Pseudomonas putida KT2440
cccgagcaaagcccgccc

SEQ ID NO: 1627610 - RNA, 19 nt, Pseudomonas putida KT2440
cccgagcaaagcccgcccc

SEQ ID NO: 1627611 - RNA, 12 nt, Pseudomonas putida KT2440
cccgaggcaauc

SEQ ID NO: 1627612 - RNA, 17 nt, Pseudomonas putida KT2440
cccgauacagcgcgccg

SEQ ID NO: 1627613 - RNA, 19 nt, Pseudomonas putida KT2440
cccgauacagcgcgccgcc

SEQ ID NO: 1627614 - RNA, 21 nt, Pseudomonas putida KT2440
cccgaguaaucgaugaaauuc

SEQ ID NO: 1627615 - RNA, 23 nt, Pseudomonas putida KT2440
cccgaucuccccaccaucaauac

SEQ ID NO: 1627616 - RNA, 23 nt, Pseudomonas putida KT2440
ccccgcugcacaggccagcccca

SEQ ID NO: 1627617 - RNA, 22 nt, Pseudomonas putida KT2440
ccccucgaccacgcacagcugu

SEQ ID NO: 1627618 - RNA, 16 nt, Pseudomonas putida KT2440
ccccgcucgccuggcc

SEQ ID NO: 1627619 - RNA, 12 nt, Pseudomonas putida KT2440
ccccgccgugca

SEQ ID NO: 1627620 - RNA, 13 nt, Pseudomonas putida KT2440
ccccgccgugcag

SEQ ID NO: 1627621 - RNA, 14 nt, Pseudomonas putida KT2440
ccccgcgccgccga

SEQ ID NO: 1627622 - RNA, 13 nt, Pseudomonas putida KT2440
ccccugauguggc

SEQ ID NO: 1627623 - RNA, 14 nt, Pseudomonas putida KT2440
ccccugcaacaggg

SEQ ID NO: 1627624 - RNA, 15 nt, Pseudomonas putida KT2440
ccccugccagcacca

SEQ ID NO: 1627625 - RNA, 13 nt, Pseudomonas putida KT2440
ccccucgcugccc

SEQ ID NO: 1627626 - RNA, 20 nt, Pseudomonas putida KT2440
ccccuugcaguaucgccccg

SEQ ID NO: 1627627 - RNA, 10 nt, Pseudomonas putida KT2440
ccccuuggcc

SEQ ID NO: 1627628 - RNA, 18 nt, Pseudomonas putida KT2440
ccccuuggcgacgugccc

SEQ ID NO: 1627629 - RNA, 21 nt, Pseudomonas putida KT2440
ccccuuuacuggccauccagu

SEQ ID NO: 1627630 - RNA, 13 nt, Pseudomonas putida KT2440
cccgacgccaccu

SEQ ID NO: 1627631 - RNA, 12 nt, Pseudomonas putida KT2440
cccgacagcaau

SEQ ID NO: 1627632 - RNA, 20 nt, Pseudomonas putida KT2440
cccgaccaaggccaacugcg

SEQ ID NO: 1627633 - RNA, 18 nt, Pseudomonas putida KT2440
cccgaccaccgccucgau

SEQ ID NO: 1627634 - RNA, 17 nt, Pseudomonas putida KT2440
cccgaccgccagcccgc

SEQ ID NO: 1627635 - RNA, 17 nt, Pseudomonas putida KT2440
cccgaagcgcaggucca

SEQ ID NO: 1627636 - RNA, 17 nt, Pseudomonas putida KT2440
cccgaagcuaucgccag

SEQ ID NO: 1627637 - RNA, 21 nt, Pseudomonas putida KT2440
cccgaagcuaucgccagcagg

SEQ ID NO: 1627638 - RNA, 19 nt, Pseudomonas putida KT2440
cccgaauugguaguuccug

SEQ ID NO: 1627639 - RNA, 16 nt, Pseudomonas putida KT2440
cccgacaacagcugca

SEQ ID NO: 1627640 - RNA, 21 nt, Pseudomonas putida KT2440
ccccuuuggccuaccgcccgc

SEQ ID NO: 1627641 - RNA, 15 nt, Pseudomonas putida KT2440
ccagcggcagcagca

SEQ ID NO: 1627642 - RNA, 15 nt, Pseudomonas putida KT2440
ccagcgucaccccuc

SEQ ID NO: 1627643 - RNA, 18 nt, Pseudomonas putida KT2440
ccagcgucaccccucggc

SEQ ID NO: 1627644 - RNA, 23 nt, Pseudomonas putida KT2440
ccagcgucacccguggcagcccc

SEQ ID NO: 1627645 - RNA, 18 nt, Pseudomonas putida KT2440
ccagcggcucgcucaggc

SEQ ID NO: 1627646 - RNA, 21 nt, Pseudomonas putida KT2440
ccagcggcucgcucaggcgca

SEQ ID NO: 1627647 - RNA, 17 nt, Pseudomonas putida KT2440
ccagcgcgguagcugcc

SEQ ID NO: 1627648 - RNA, 23 nt, Pseudomonas putida KT2440
ccagcgcuugagaccaggccugg

SEQ ID NO: 1627649 - RNA, 18 nt, Pseudomonas putida KT2440
ccagcgcucguaggcuuc

SEQ ID NO: 1627650 - RNA, 21 nt, Pseudomonas putida KT2440
ccagcgcugucccccagcccu

SEQ ID NO: 1627651 - RNA, 13 nt, Pseudomonas putida KT2440
ccagcggcaagcc

SEQ ID NO: 1627652 - RNA, 14 nt, Pseudomonas putida KT2440
ccagcguuccuggg

SEQ ID NO: 1627653 - RNA, 16 nt, Pseudomonas putida KT2440
ccagcguuccugggcg

SEQ ID NO: 1627654 - RNA, 23 nt, Pseudomonas putida KT2440
ccagcgucguguucgccuguccg

SEQ ID NO: 1627655 - RNA, 13 nt, Pseudomonas putida KT2440
ccagcgucccggu

SEQ ID NO: 1627656 - RNA, 21 nt, Pseudomonas putida KT2440
ccagcguuuguaaguaggcgc

SEQ ID NO: 1627657 - RNA, 14 nt, Pseudomonas putida KT2440
ccagcguuuccggg

SEQ ID NO: 1627658 - RNA, 14 nt, Pseudomonas putida KT2440
ccagcucgccgccc

SEQ ID NO: 1627659 - RNA, 16 nt, Pseudomonas putida KT2440
ccagcucgccaacacc

SEQ ID NO: 1627660 - RNA, 14 nt, Pseudomonas putida KT2440
ccagcuccuggccc

SEQ ID NO: 1627661 - RNA, 23 nt, Pseudomonas putida KT2440
ccagcuccuggcccgcgcccuug

SEQ ID NO: 1627662 - RNA, 19 nt, Pseudomonas putida KT2440
ccagcuccuggccgcccgc

SEQ ID NO: 1627663 - RNA, 23 nt, Pseudomonas putida KT2440
ccagcgcaugcaucugcgccccg

SEQ ID NO: 1627664 - RNA, 15 nt, Pseudomonas putida KT2440
ccagcgccagcagcc

SEQ ID NO: 1627665 - RNA, 17 nt, Pseudomonas putida KT2440
ccagcgccacccaggca

SEQ ID NO: 1627666 - RNA, 15 nt, Pseudomonas putida KT2440
ccagcgccaaucgca

SEQ ID NO: 1627667 - RNA, 20 nt, Pseudomonas putida KT2440
ccagcgccugcugccaggcc

SEQ ID NO: 1627668 - RNA, 17 nt, Pseudomonas putida KT2440
ccagcgcggccacgccc

SEQ ID NO: 1627669 - RNA, 19 nt, Pseudomonas putida KT2440
ccagcgcggcaaaugcggc

SEQ ID NO: 1627670 - RNA, 17 nt, Pseudomonas putida KT2440
ccagcgcgcugagcagg

SEQ ID NO: 1627671 - RNA, 13 nt, Pseudomonas putida KT2440
ccagcucaacgcg

SEQ ID NO: 1627672 - RNA, 12 nt, Pseudomonas putida KT2440
ccagcugcauca

SEQ ID NO: 1627673 - RNA, 14 nt, Pseudomonas putida KT2440
ccagcugcaacagc

SEQ ID NO: 1627674 - RNA, 13 nt, Pseudomonas putida KT2440
ccagcugcgccug

SEQ ID NO: 1627675 - RNA, 20 nt, Pseudomonas putida KT2440
ccagcugccauacagccaga

SEQ ID NO: 1627676 - RNA, 19 nt, Pseudomonas putida KT2440
ccagcugcaccaccugcuc

SEQ ID NO: 1627677 - RNA, 19 nt, Pseudomonas putida KT2440
ccagcuggagacgaacagc

SEQ ID NO: 1627678 - RNA, 22 nt, Pseudomonas putida KT2440
ccaggaagaucacgucggccug

SEQ ID NO: 1627679 - RNA, 12 nt, Pseudomonas putida KT2440
ccagcugcugcg

SEQ ID NO: 1627680 - RNA, 12 nt, Pseudomonas putida KT2440
ccaggacggugg

SEQ ID NO: 1627681 - RNA, 21 nt, Pseudomonas putida KT2440
ccaggacaagccgacaaaaac

SEQ ID NO: 1627682 - RNA, 23 nt, Pseudomonas putida KT2440
ccagcuggccaucgacccgcugc

SEQ ID NO: 1627683 - RNA, 19 nt, Pseudomonas putida KT2440
ccaggaagcuggccagccg

SEQ ID NO: 1627684 - RNA, 13 nt, Pseudomonas putida KT2440
ccaggcccaccac

SEQ ID NO: 1627685 - RNA, 19 nt, Pseudomonas putida KT2440
ccaggcccgcaagggucug

SEQ ID NO: 1627686 - RNA, 20 nt, Pseudomonas putida KT2440
ccaggcccgcaagggucugg

SEQ ID NO: 1627687 - RNA, 13 nt, Pseudomonas putida KT2440
ccaggcccgccag

SEQ ID NO: 1627688 - RNA, 16 nt, Pseudomonas putida KT2440
ccaggccccuuggcca

SEQ ID NO: 1627689 - RNA, 21 nt, Pseudomonas putida KT2440
ccaggcccugacgccagcgcu

SEQ ID NO: 1627690 - RNA, 15 nt, Pseudomonas putida KT2440
ccaggcccagccccg

SEQ ID NO: 1627691 - RNA, 21 nt, Pseudomonas putida KT2440
ccaggcccagccccgcaugcu

SEQ ID NO: 1627692 - RNA, 17 nt, Pseudomonas putida KT2440
ccaggccaucagcagcu

SEQ ID NO: 1627693 - RNA, 20 nt, Pseudomonas putida KT2440
ccaggcauuccccggucagc

SEQ ID NO: 1627694 - RNA, 18 nt, Pseudomonas putida KT2440
ccaggcauugcaaggucc

SEQ ID NO: 1627695 - RNA, 22 nt, Pseudomonas putida KT2440
ccaggcauugcaagguccuugu

SEQ ID NO: 1627696 - RNA, 23 nt, Pseudomonas putida KT2440
ccaggcaaaguugagcgccgcga

SEQ ID NO: 1627697 - RNA, 21 nt, Pseudomonas putida KT2440
ccaggauggcuuugccauucu

SEQ ID NO: 1627698 - RNA, 16 nt, Pseudomonas putida KT2440
ccaggcaaaaaaaagg

SEQ ID NO: 1627699 - RNA, 18 nt, Pseudomonas putida KT2440
ccaggcaaagaaaaaccc

SEQ ID NO: 1627700 - RNA, 12 nt, Pseudomonas putida KT2440
ccaggcuggcca

SEQ ID NO: 1627701 - RNA, 12 nt, Pseudomonas putida KT2440
ccaggcugagcc

SEQ ID NO: 1627702 - RNA, 19 nt, Pseudomonas putida KT2440
ccaggcugccaaaccgccc

SEQ ID NO: 1627703 - RNA, 21 nt, Pseudomonas putida KT2440
ccaggcuggcgcuuccuuccu

SEQ ID NO: 1627704 - RNA, 14 nt, Pseudomonas putida KT2440
ccaggcuggccagc

SEQ ID NO: 1627705 - RNA, 14 nt, Pseudomonas putida KT2440
ccaggcugcgcauc

SEQ ID NO: 1627706 - RNA, 14 nt, Pseudomonas putida KT2440
ccaggcuggccacc

SEQ ID NO: 1627707 - RNA, 16 nt, Pseudomonas putida KT2440
ccaggcuggccaccac

SEQ ID NO: 1627708 - RNA, 12 nt, Pseudomonas putida KT2440
ccaggucaggac

SEQ ID NO: 1627709 - RNA, 18 nt, Pseudomonas putida KT2440
ccaggucacccuggucac

SEQ ID NO: 1627710 - RNA, 18 nt, Pseudomonas putida KT2440
ccagguccgguaacuggc

SEQ ID NO: 1627711 - RNA, 21 nt, Pseudomonas putida KT2440
ccagguccgguaacuggccca

SEQ ID NO: 1627712 - RNA, 19 nt, Pseudomonas putida KT2440
ccagguccaccagcaggcu

SEQ ID NO: 1627713 - RNA, 18 nt, Pseudomonas putida KT2440
ccagguaucgcaccgugc

SEQ ID NO: 1627714 - RNA, 13 nt, Pseudomonas putida KT2440
ccagguauggcca

SEQ ID NO: 1627715 - RNA, 14 nt, Pseudomonas putida KT2440
ccagguauucggca

SEQ ID NO: 1627716 - RNA, 22 nt, Pseudomonas putida KT2440
ccaggguggcgauccacagcgg

SEQ ID NO: 1627717 - RNA, 20 nt, Pseudomonas putida KT2440
ccaggccgcacgcgccucuu

SEQ ID NO: 1627718 - RNA, 20 nt, Pseudomonas putida KT2440
ccaggccgaucaccagcacc

SEQ ID NO: 1627719 - RNA, 17 nt, Pseudomonas putida KT2440
ccaggccgcccacccac

SEQ ID NO: 1627720 - RNA, 18 nt, Pseudomonas putida KT2440
ccaggccgcccacccacc

SEQ ID NO: 1627721 - RNA, 14 nt, Pseudomonas putida KT2440
ccaggcggucgccc

SEQ ID NO: 1627722 - RNA, 17 nt, Pseudomonas putida KT2440
ccaggcggucggccagc

SEQ ID NO: 1627723 - RNA, 16 nt, Pseudomonas putida KT2440
ccaggcggccagccaa

SEQ ID NO: 1627724 - RNA, 17 nt, Pseudomonas putida KT2440
ccaggcguaaacccagg

SEQ ID NO: 1627725 - RNA, 15 nt, Pseudomonas putida KT2440
ccaggcucucagccc

SEQ ID NO: 1627726 - RNA, 14 nt, Pseudomonas putida KT2440
ccaggcucuccagc

SEQ ID NO: 1627727 - RNA, 15 nt, Pseudomonas putida KT2440
ccaggcucuccagcc

SEQ ID NO: 1627728 - RNA, 21 nt, Pseudomonas putida KT2440
ccaggcucuccagccgcugcu

SEQ ID NO: 1627729 - RNA, 13 nt, Pseudomonas putida KT2440
ccaggcucagcuc

SEQ ID NO: 1627730 - RNA, 14 nt, Pseudomonas putida KT2440
ccaggcucagcucg

SEQ ID NO: 1627731 - RNA, 23 nt, Pseudomonas putida KT2440
ccaggcguauucggccaccagcc

SEQ ID NO: 1627732 - RNA, 20 nt, Pseudomonas putida KT2440
ccaguccgccucgucgaugu

SEQ ID NO: 1627733 - RNA, 20 nt, Pseudomonas putida KT2440
ccagucgaugggcccgagcc

SEQ ID NO: 1627734 - RNA, 18 nt, Pseudomonas putida KT2440
ccagucgcacagguccag

SEQ ID NO: 1627735 - RNA, 21 nt, Pseudomonas putida KT2440
ccagucgcgcaacugcccagg

SEQ ID NO: 1627736 - RNA, 17 nt, Pseudomonas putida KT2440
ccaguccuuggccaaug

SEQ ID NO: 1627737 - RNA, 15 nt, Pseudomonas putida KT2440
ccagucggcauccuc

SEQ ID NO: 1627738 - RNA, 22 nt, Pseudomonas putida KT2440
ccagucggcauccucaagcugc

SEQ ID NO: 1627739 - RNA, 21 nt, Pseudomonas putida KT2440
ccagugaagcucgaucugccu

SEQ ID NO: 1627740 - RNA, 14 nt, Pseudomonas putida KT2440
ccagucugcucagc

SEQ ID NO: 1627741 - RNA, 23 nt, Pseudomonas putida KT2440
ccagucugcucagccaaccgccc

SEQ ID NO: 1627742 - RNA, 18 nt, Pseudomonas putida KT2440
ccagucugcuccaccgca

SEQ ID NO: 1627743 - RNA, 16 nt, Pseudomonas putida KT2440
ccaguagcacagugcg

SEQ ID NO: 1627744 - RNA, 20 nt, Pseudomonas putida KT2440
ccaggucggcggggcccgga

SEQ ID NO: 1627745 - RNA, 12 nt, Pseudomonas putida KT2440
ccaggucggaca

SEQ ID NO: 1627746 - RNA, 16 nt, Pseudomonas putida KT2440
ccaggucggacagggu

SEQ ID NO: 1627747 - RNA, 16 nt, Pseudomonas putida KT2440
ccaggucgccagcacc

SEQ ID NO: 1627748 - RNA, 18 nt, Pseudomonas putida KT2440
ccaggucgccagcaccau

SEQ ID NO: 1627749 - RNA, 15 nt, Pseudomonas putida KT2440
ccagucauccgggcc

SEQ ID NO: 1627750 - RNA, 20 nt, Pseudomonas putida KT2440
ccagucaggccguagcgcug

SEQ ID NO: 1627751 - RNA, 18 nt, Pseudomonas putida KT2440
ccaguaguucucgacagc

SEQ ID NO: 1627752 - RNA, 23 nt, Pseudomonas putida KT2440
ccaguauucgcuaaccucugcau

SEQ ID NO: 1627753 - RNA, 20 nt, Pseudomonas putida KT2440
ccagugccugaccggucagc

SEQ ID NO: 1627754 - RNA, 16 nt, Pseudomonas putida KT2440
ccagugccggguccag

SEQ ID NO: 1627755 - RNA, 17 nt, Pseudomonas putida KT2440
ccagugcgaucugagua

SEQ ID NO: 1627756 - RNA, 21 nt, Pseudomonas putida KT2440
ccagugcgcgcaacagugccc

SEQ ID NO: 1627757 - RNA, 15 nt, Pseudomonas putida KT2440
ccagugcgugcagug

SEQ ID NO: 1627758 - RNA, 17 nt, Pseudomonas putida KT2440
ccaguucgcgcaagcag

SEQ ID NO: 1627759 - RNA, 20 nt, Pseudomonas putida KT2440
ccagugcugccugcugcagc

SEQ ID NO: 1627760 - RNA, 16 nt, Pseudomonas putida KT2440
ccagugcuucacugcc

SEQ ID NO: 1627761 - RNA, 19 nt, Pseudomonas putida KT2440
ccagugcuucacugccggc

SEQ ID NO: 1627762 - RNA, 17 nt, Pseudomonas putida KT2440
ccaguucggacaggcgc

SEQ ID NO: 1627763 - RNA, 22 nt, Pseudomonas putida KT2440
ccagugccaugaacaccaccgc

SEQ ID NO: 1627764 - RNA, 15 nt, Pseudomonas putida KT2440
ccagugccgcaagca

SEQ ID NO: 1627765 - RNA, 21 nt, Pseudomonas putida KT2440
ccagugccgcaagcaguccca

SEQ ID NO: 1627766 - RNA, 13 nt, Pseudomonas putida KT2440
ccagugccgccac

SEQ ID NO: 1627767 - RNA, 15 nt, Pseudomonas putida KT2440
ccaguugcuucugca

SEQ ID NO: 1627768 - RNA, 19 nt, Pseudomonas putida KT2440
ccaguugaucaacccgugc

SEQ ID NO: 1627769 - RNA, 23 nt, Pseudomonas putida KT2440
ccaguugcaggucggcacgcggg

SEQ ID NO: 1627770 - RNA, 18 nt, Pseudomonas putida KT2440
ccaguugcuccaccugcc

SEQ ID NO: 1627771 - RNA, 22 nt, Pseudomonas putida KT2440
ccaguugcuccaccugccaccc

SEQ ID NO: 1627772 - RNA, 15 nt, Pseudomonas putida KT2440
ccauaaaccccagcc

SEQ ID NO: 1627773 - RNA, 17 nt, Pseudomonas putida KT2440
ccaguuguugggcagcc

SEQ ID NO: 1627774 - RNA, 14 nt, Pseudomonas putida KT2440
ccaucaucugcuga

SEQ ID NO: 1627775 - RNA, 18 nt, Pseudomonas putida KT2440
ccaucaugcgacaggcgu

SEQ ID NO: 1627776 - RNA, 22 nt, Pseudomonas putida KT2440
ccaucauucgauagccugcaaa

SEQ ID NO: 1627777 - RNA, 13 nt, Pseudomonas putida KT2440
ccaucccgcuucg

SEQ ID NO: 1627778 - RNA, 18 nt, Pseudomonas putida KT2440
ccaucccgcuucgccagc

SEQ ID NO: 1627779 - RNA, 16 nt, Pseudomonas putida KT2440
ccaucgaccuggcccg

SEQ ID NO: 1627780 - RNA, 12 nt, Pseudomonas putida KT2440
ccauccgccagg

SEQ ID NO: 1627781 - RNA, 13 nt, Pseudomonas putida KT2440
ccaucggccagga

SEQ ID NO: 1627782 - RNA, 23 nt, Pseudomonas putida KT2440
ccaucgcagggucgcgccccaag

SEQ ID NO: 1627783 - RNA, 18 nt, Pseudomonas putida KT2440
ccaucgcaauccccuccg

SEQ ID NO: 1627784 - RNA, 19 nt, Pseudomonas putida KT2440
ccaucgauauggaucccac

SEQ ID NO: 1627785 - RNA, 18 nt, Pseudomonas putida KT2440
ccaucgaguaucgccucg

SEQ ID NO: 1627786 - RNA, 20 nt, Pseudomonas putida KT2440
ccaucgaguaucgccucgau

SEQ ID NO: 1627787 - RNA, 22 nt, Pseudomonas putida KT2440
ccaucuucgaauaccaguaaug

SEQ ID NO: 1627788 - RNA, 20 nt, Pseudomonas putida KT2440
ccaucuucugcagccaccac

SEQ ID NO: 1627789 - RNA, 23 nt, Pseudomonas putida KT2440
ccaucuugcgugcaugggccagg

SEQ ID NO: 1627790 - RNA, 12 nt, Pseudomonas putida KT2440
ccaucuugcugc

SEQ ID NO: 1627791 - RNA, 13 nt, Pseudomonas putida KT2440
ccaucuugcugcu

SEQ ID NO: 1627792 - RNA, 16 nt, Pseudomonas putida KT2440
ccaucggugccgugca

SEQ ID NO: 1627793 - RNA, 20 nt, Pseudomonas putida KT2440
ccaucggugccgugcagggg

SEQ ID NO: 1627794 - RNA, 16 nt, Pseudomonas putida KT2440
ccaucagccgcgggcu

SEQ ID NO: 1627795 - RNA, 12 nt, Pseudomonas putida KT2440
ccaucagcagcu

SEQ ID NO: 1627796 - RNA, 17 nt, Pseudomonas putida KT2440
ccaucaggcacaggcca

SEQ ID NO: 1627797 - RNA, 21 nt, Pseudomonas putida KT2440
ccaucaggcacaggccagcca

SEQ ID NO: 1627798 - RNA, 21 nt, Pseudomonas putida KT2440
ccaucaauacgcuggaucacc

SEQ ID NO: 1627799 - RNA, 19 nt, Pseudomonas putida KT2440
ccauacaagaucaagcccc

SEQ ID NO: 1627800 - RNA, 12 nt, Pseudomonas putida KT2440
ccauaucccgcc

SEQ ID NO: 1627801 - RNA, 14 nt, Pseudomonas putida KT2440
ccagaucagcagca

SEQ ID NO: 1627802 - RNA, 23 nt, Pseudomonas putida KT2440
ccagaugcgccgggacagcacca

SEQ ID NO: 1627803 - RNA, 20 nt, Pseudomonas putida KT2440
ccagauugcaggaacaaccu

SEQ ID NO: 1627804 - RNA, 16 nt, Pseudomonas putida KT2440
ccagauucaagcccgg

SEQ ID NO: 1627805 - RNA, 17 nt, Pseudomonas putida KT2440
ccagauucaagcccggc

SEQ ID NO: 1627806 - RNA, 18 nt, Pseudomonas putida KT2440
ccagauuacaaaagcgcc

SEQ ID NO: 1627807 - RNA, 20 nt, Pseudomonas putida KT2440
ccagcaaacccucggccucg

SEQ ID NO: 1627808 - RNA, 18 nt, Pseudomonas putida KT2440
ccagcaaaaguuggcuga

SEQ ID NO: 1627809 - RNA, 22 nt, Pseudomonas putida KT2440
ccagaucacuuccaccugcgcc

SEQ ID NO: 1627810 - RNA, 16 nt, Pseudomonas putida KT2440
ccagcaccacccacca

SEQ ID NO: 1627811 - RNA, 23 nt, Pseudomonas putida KT2440
ccagcacagauaaaccugccacc

SEQ ID NO: 1627812 - RNA, 16 nt, Pseudomonas putida KT2440
ccagcaacagcugccg

SEQ ID NO: 1627813 - RNA, 13 nt, Pseudomonas putida KT2440
ccagcaacaagcu

SEQ ID NO: 1627814 - RNA, 18 nt, Pseudomonas putida KT2440
ccagcaaagugcgcaugc

SEQ ID NO: 1627815 - RNA, 20 nt, Pseudomonas putida KT2440
ccagcaccuggcggcccgcc

SEQ ID NO: 1627816 - RNA, 18 nt, Pseudomonas putida KT2440
ccagcacgaacagcaaca

SEQ ID NO: 1627817 - RNA, 18 nt, Pseudomonas putida KT2440
ccagcacgaaggccagca

SEQ ID NO: 1627818 - RNA, 12 nt, Pseudomonas putida KT2440
ccagcaccagcg

SEQ ID NO: 1627819 - RNA, 16 nt, Pseudomonas putida KT2440
ccagcagcacaucccg

SEQ ID NO: 1627820 - RNA, 17 nt, Pseudomonas putida KT2440
ccagcagcaccugccgc

SEQ ID NO: 1627821 - RNA, 20 nt, Pseudomonas putida KT2440
ccagcagcacacgcuugucu

SEQ ID NO: 1627822 - RNA, 13 nt, Pseudomonas putida KT2440
ccagcagcagcgc

SEQ ID NO: 1627823 - RNA, 14 nt, Pseudomonas putida KT2440
ccagcagcagcgca

SEQ ID NO: 1627824 - RNA, 12 nt, Pseudomonas putida KT2440
ccagcagcuuca

SEQ ID NO: 1627825 - RNA, 16 nt, Pseudomonas putida KT2440
ccagcagcuucuucac

SEQ ID NO: 1627826 - RNA, 18 nt, Pseudomonas putida KT2440
ccagcagcuccauaccaa

SEQ ID NO: 1627827 - RNA, 20 nt, Pseudomonas putida KT2440
ccagcagcggguuccccagc

SEQ ID NO: 1627828 - RNA, 13 nt, Pseudomonas putida KT2440
ccagcaggccacc

SEQ ID NO: 1627829 - RNA, 23 nt, Pseudomonas putida KT2440
ccagcaggccaccggcagcaccu

SEQ ID NO: 1627830 - RNA, 21 nt, Pseudomonas putida KT2440
ccagcgauaaaccagcagcgc

SEQ ID NO: 1627831 - RNA, 19 nt, Pseudomonas putida KT2440
ccagcgauggcggaucagc

SEQ ID NO: 1627832 - RNA, 13 nt, Pseudomonas putida KT2440
ccagcgcacagcu

SEQ ID NO: 1627833 - RNA, 17 nt, Pseudomonas putida KT2440
ccagcgcacagcugccg

SEQ ID NO: 1627834 - RNA, 16 nt, Pseudomonas putida KT2440
ccagcgcaccacuguu

SEQ ID NO: 1627835 - RNA, 23 nt, Pseudomonas putida KT2440
ccagcgacccugagucuggcgcc

SEQ ID NO: 1627836 - RNA, 16 nt, Pseudomonas putida KT2440
ccagcgaccagcugcc

SEQ ID NO: 1627837 - RNA, 17 nt, Pseudomonas putida KT2440
ccagccuucagcaggcg

SEQ ID NO: 1627838 - RNA, 13 nt, Pseudomonas putida KT2440
ccagccucuucuu

SEQ ID NO: 1627839 - RNA, 22 nt, Pseudomonas putida KT2440
ccagccucuucuucaaggcugc

SEQ ID NO: 1627840 - RNA, 12 nt, Pseudomonas putida KT2440
ccagccugcagc

SEQ ID NO: 1627841 - RNA, 16 nt, Pseudomonas putida KT2440
ccagccugcagcaccc

SEQ ID NO: 1627842 - RNA, 18 nt, Pseudomonas putida KT2440
ccagccugcccgccgucc

SEQ ID NO: 1627843 - RNA, 13 nt, Pseudomonas putida KT2440
ccagccucagcug

SEQ ID NO: 1627844 - RNA, 21 nt, Pseudomonas putida KT2440
ccagccggcgcaucagugccg

SEQ ID NO: 1627845 - RNA, 19 nt, Pseudomonas putida KT2440
ccagccggcgcuggacagc

SEQ ID NO: 1627846 - RNA, 19 nt, Pseudomonas putida KT2440
ccagccggucauccagcag

SEQ ID NO: 1627847 - RNA, 13 nt, Pseudomonas putida KT2440
ccagccguccucg

SEQ ID NO: 1627848 - RNA, 21 nt, Pseudomonas putida KT2440
ccagccguuguacaagcuggc

SEQ ID NO: 1627849 - RNA, 15 nt, Pseudomonas putida KT2440
ccagccuccggccca

SEQ ID NO: 1627850 - RNA, 20 nt, Pseudomonas putida KT2440
ccagcaguuggcugccggcc

SEQ ID NO: 1627851 - RNA, 23 nt, Pseudomonas putida KT2440
ccagcaguuggcugccggccucg

SEQ ID NO: 1627852 - RNA, 15 nt, Pseudomonas putida KT2440
ccagcagugccgugg

SEQ ID NO: 1627853 - RNA, 20 nt, Pseudomonas putida KT2440
ccagcaggucagcacgcgcu

SEQ ID NO: 1627854 - RNA, 15 nt, Pseudomonas putida KT2440
ccagcagguuggaca

SEQ ID NO: 1627855 - RNA, 17 nt, Pseudomonas putida KT2440
ccagcagguacaccgcc

SEQ ID NO: 1627856 - RNA, 21 nt, Pseudomonas putida KT2440
ccagcagguacaccgccucgg

SEQ ID NO: 1627857 - RNA, 15 nt, Pseudomonas putida KT2440
ccagccauuccaggc

SEQ ID NO: 1627858 - RNA, 20 nt, Pseudomonas putida KT2440
ccagccauuccaggcuagcc

SEQ ID NO: 1627859 - RNA, 12 nt, Pseudomonas putida KT2440
ccagcccaccac

SEQ ID NO: 1627860 - RNA, 13 nt, Pseudomonas putida KT2440
ccagcccaccacg

SEQ ID NO: 1627861 - RNA, 15 nt, Pseudomonas putida KT2440
ccagcccaaggaaga

SEQ ID NO: 1627862 - RNA, 16 nt, Pseudomonas putida KT2440
ccagcccagcccggac

SEQ ID NO: 1627863 - RNA, 14 nt, Pseudomonas putida KT2440
ccagcccaggcugg

SEQ ID NO: 1627864 - RNA, 21 nt, Pseudomonas putida KT2440
ccagcccaguagaucgcgcca

SEQ ID NO: 1627865 - RNA, 18 nt, Pseudomonas putida KT2440
ccagcccauccagggcuu

SEQ ID NO: 1627866 - RNA, 19 nt, Pseudomonas putida KT2440
ccagcccauccagggcuuc

SEQ ID NO: 1627867 - RNA, 19 nt, Pseudomonas putida KT2440
ccagccccaacccaccagc

SEQ ID NO: 1627868 - RNA, 14 nt, Pseudomonas putida KT2440
ccagccggcccggc

SEQ ID NO: 1627869 - RNA, 18 nt, Pseudomonas putida KT2440
ccagccgcgccacuccca

SEQ ID NO: 1627870 - RNA, 23 nt, Pseudomonas putida KT2440
ccagcccggacugcaccaggucc

SEQ ID NO: 1627871 - RNA, 11 nt, Pseudomonas putida KT2440
ccagcccggcc

SEQ ID NO: 1627872 - RNA, 15 nt, Pseudomonas putida KT2440
ccagcccggcggcca

SEQ ID NO: 1627873 - RNA, 17 nt, Pseudomonas putida KT2440
ccagcccuuccaccaca

SEQ ID NO: 1627874 - RNA, 12 nt, Pseudomonas putida KT2440
ccaccggacaga

SEQ ID NO: 1627875 - RNA, 13 nt, Pseudomonas putida KT2440
ccaccggcaagcc

SEQ ID NO: 1627876 - RNA, 15 nt, Pseudomonas putida KT2440
ccaccggcaccaucu

SEQ ID NO: 1627877 - RNA, 18 nt, Pseudomonas putida KT2440
ccaccgcucaaacccggc

SEQ ID NO: 1627878 - RNA, 15 nt, Pseudomonas putida KT2440
ccaccggcagcaccu

SEQ ID NO: 1627879 - RNA, 22 nt, Pseudomonas putida KT2440
ccaccggcagcaccugccagcc

SEQ ID NO: 1627880 - RNA, 18 nt, Pseudomonas putida KT2440
ccaccgcgaaacacagca

SEQ ID NO: 1627881 - RNA, 14 nt, Pseudomonas putida KT2440
ccaccgccgugccg

SEQ ID NO: 1627882 - RNA, 22 nt, Pseudomonas putida KT2440
ccaccgccgugccggucacugg

SEQ ID NO: 1627883 - RNA, 15 nt, Pseudomonas putida KT2440
ccaccgccucggcua

SEQ ID NO: 1627884 - RNA, 22 nt, Pseudomonas putida KT2440
ccaccgccgggugggugaagaa

SEQ ID NO: 1627885 - RNA, 23 nt, Pseudomonas putida KT2440
ccaccgccggccauucaucaucg

SEQ ID NO: 1627886 - RNA, 18 nt, Pseudomonas putida KT2440
ccaccgaucucgccagcc

SEQ ID NO: 1627887 - RNA, 20 nt, Pseudomonas putida KT2440
ccaccgccacugaccagccc

SEQ ID NO: 1627888 - RNA, 20 nt, Pseudomonas putida KT2440
ccaccgcacucugcugcucu

SEQ ID NO: 1627889 - RNA, 15 nt, Pseudomonas putida KT2440
ccaccgcaggugcag

SEQ ID NO: 1627890 - RNA, 16 nt, Pseudomonas putida KT2440
ccaccgcaggugcagg

SEQ ID NO: 1627891 - RNA, 18 nt, Pseudomonas putida KT2440
ccacccggcugaaauggc

SEQ ID NO: 1627892 - RNA, 17 nt, Pseudomonas putida KT2440
ccacccggucggccagc

SEQ ID NO: 1627893 - RNA, 13 nt, Pseudomonas putida KT2440
ccacccgcucaaa

SEQ ID NO: 1627894 - RNA, 15 nt, Pseudomonas putida KT2440
ccacccggaccagcg

SEQ ID NO: 1627895 - RNA, 16 nt, Pseudomonas putida KT2440
ccacccgccugcaacc

SEQ ID NO: 1627896 - RNA, 16 nt, Pseudomonas putida KT2440
ccacccgacgccaccu

SEQ ID NO: 1627897 - RNA, 15 nt, Pseudomonas putida KT2440
ccaccuggccuucca

SEQ ID NO: 1627898 - RNA, 21 nt, Pseudomonas putida KT2440
ccaccugggcgcuuugcaccc

SEQ ID NO: 1627899 - RNA, 22 nt, Pseudomonas putida KT2440
ccaccuggcucggugugcaccu

SEQ ID NO: 1627900 - RNA, 20 nt, Pseudomonas putida KT2440
ccaccuggcugcgggugccc

SEQ ID NO: 1627901 - RNA, 14 nt, Pseudomonas putida KT2440
ccaccugggccagu

SEQ ID NO: 1627902 - RNA, 17 nt, Pseudomonas putida KT2440
ccacgaacgcccccagc

SEQ ID NO: 1627903 - RNA, 17 nt, Pseudomonas putida KT2440
ccaccuguugccgcuuc

SEQ ID NO: 1627904 - RNA, 13 nt, Pseudomonas putida KT2440
ccacgaaccugug

SEQ ID NO: 1627905 - RNA, 23 nt, Pseudomonas putida KT2440
ccacgaccggcucaacagcaggu

SEQ ID NO: 1627906 - RNA, 22 nt, Pseudomonas putida KT2440
ccaccugauguacaaggaccuc

SEQ ID NO: 1627907 - RNA, 20 nt, Pseudomonas putida KT2440
ccaccucgucaugcagcgcc

SEQ ID NO: 1627908 - RNA, 19 nt, Pseudomonas putida KT2440
ccaccucuaucaccuguuc

SEQ ID NO: 1627909 - RNA, 14 nt, Pseudomonas putida KT2440
ccaccucugcggcc

SEQ ID NO: 1627910 - RNA, 14 nt, Pseudomonas putida KT2440
ccaccugcccgggc

SEQ ID NO: 1627911 - RNA, 17 nt, Pseudomonas putida KT2440
ccaccugcagggucagg

SEQ ID NO: 1627912 - RNA, 22 nt, Pseudomonas putida KT2440
ccaccuggaauucgcugcgcau

SEQ ID NO: 1627913 - RNA, 17 nt, Pseudomonas putida KT2440
ccaccuggccacccggc

SEQ ID NO: 1627914 - RNA, 21 nt, Pseudomonas putida KT2440
ccaccuggcccugcucacgca

SEQ ID NO: 1627915 - RNA, 20 nt, Pseudomonas putida KT2440
ccaccgggaucuuggcguug

SEQ ID NO: 1627916 - RNA, 12 nt, Pseudomonas putida KT2440
ccaccgggcgag

SEQ ID NO: 1627917 - RNA, 21 nt, Pseudomonas putida KT2440
ccacgccgauguccuugcugg

SEQ ID NO: 1627918 - RNA, 18 nt, Pseudomonas putida KT2440
ccacgccgcugguacagg

SEQ ID NO: 1627919 - RNA, 11 nt, Pseudomonas putida KT2440
ccacgccgcca

SEQ ID NO: 1627920 - RNA, 13 nt, Pseudomonas putida KT2440
ccacgccugcgcc

SEQ ID NO: 1627921 - RNA, 14 nt, Pseudomonas putida KT2440
ccacgccuuccacc

SEQ ID NO: 1627922 - RNA, 16 nt, Pseudomonas putida KT2440
ccacgccuuccaccgg

SEQ ID NO: 1627923 - RNA, 22 nt, Pseudomonas putida KT2440
ccacgcacaucguccgccgcgc

SEQ ID NO: 1627924 - RNA, 16 nt, Pseudomonas putida KT2440
ccacgcaucugcaccu

SEQ ID NO: 1627925 - RNA, 17 nt, Pseudomonas putida KT2440
ccacgcaucugcaccug

SEQ ID NO: 1627926 - RNA, 21 nt, Pseudomonas putida KT2440
ccacgcaugccuaucucuucc

SEQ ID NO: 1627927 - RNA, 23 nt, Pseudomonas putida KT2440
ccacgcccuuuuucaccaggcgg

SEQ ID NO: 1627928 - RNA, 20 nt, Pseudomonas putida KT2440
ccacugcuucugagccagcc

SEQ ID NO: 1627929 - RNA, 19 nt, Pseudomonas putida KT2440
ccacuggaugacgccgcag

SEQ ID NO: 1627930 - RNA, 16 nt, Pseudomonas putida KT2440
ccacugcaggugcagg

SEQ ID NO: 1627931 - RNA, 20 nt, Pseudomonas putida KT2440
ccacugaugcgcguccagcc

SEQ ID NO: 1627932 - RNA, 13 nt, Pseudomonas putida KT2440
ccacugcaccaau

SEQ ID NO: 1627933 - RNA, 16 nt, Pseudomonas putida KT2440
ccacugcaccaaugac

SEQ ID NO: 1627934 - RNA, 19 nt, Pseudomonas putida KT2440
ccacugucaaucuugcgca

SEQ ID NO: 1627935 - RNA, 15 nt, Pseudomonas putida KT2440
ccacuguugcagcgc

SEQ ID NO: 1627936 - RNA, 16 nt, Pseudomonas putida KT2440
ccacuguugcagcgcc

SEQ ID NO: 1627937 - RNA, 14 nt, Pseudomonas putida KT2440
ccacugucugccag

SEQ ID NO: 1627938 - RNA, 17 nt, Pseudomonas putida KT2440
ccacuggcgacuucggc

SEQ ID NO: 1627939 - RNA, 21 nt, Pseudomonas putida KT2440
ccagaacacggugacaaaggc

SEQ ID NO: 1627940 - RNA, 15 nt, Pseudomonas putida KT2440
ccagaacagccacag

SEQ ID NO: 1627941 - RNA, 20 nt, Pseudomonas putida KT2440
ccagaacaugccacggccuu

SEQ ID NO: 1627942 - RNA, 23 nt, Pseudomonas putida KT2440
ccacuucacugacaaagccugca

SEQ ID NO: 1627943 - RNA, 17 nt, Pseudomonas putida KT2440
ccacuucaugggccacg

SEQ ID NO: 1627944 - RNA, 20 nt, Pseudomonas putida KT2440
ccacuugguggcguccacga

SEQ ID NO: 1627945 - RNA, 15 nt, Pseudomonas putida KT2440
ccacuugucccggcc

SEQ ID NO: 1627946 - RNA, 20 nt, Pseudomonas putida KT2440
ccacuugucccggcccagcc

SEQ ID NO: 1627947 - RNA, 22 nt, Pseudomonas putida KT2440
ccacuugcucggugcugcugcc

SEQ ID NO: 1627948 - RNA, 14 nt, Pseudomonas putida KT2440
ccacgcgcaggcca

SEQ ID NO: 1627949 - RNA, 15 nt, Pseudomonas putida KT2440
ccacgcggguccagc

SEQ ID NO: 1627950 - RNA, 14 nt, Pseudomonas putida KT2440
ccacgguucuggca

SEQ ID NO: 1627951 - RNA, 17 nt, Pseudomonas putida KT2440
ccacggugucggacagg

SEQ ID NO: 1627952 - RNA, 13 nt, Pseudomonas putida KT2440
ccacguuuucgcg

SEQ ID NO: 1627953 - RNA, 20 nt, Pseudomonas putida KT2440
ccacguuugagcaguucguc

SEQ ID NO: 1627954 - RNA, 19 nt, Pseudomonas putida KT2440
ccacguccacuaccuccag

SEQ ID NO: 1627955 - RNA, 11 nt, Pseudomonas putida KT2440
ccacuccagcc

SEQ ID NO: 1627956 - RNA, 22 nt, Pseudomonas putida KT2440
ccacuccgggugaucauucagg

SEQ ID NO: 1627957 - RNA, 16 nt, Pseudomonas putida KT2440
ccacucaccggcaucg

SEQ ID NO: 1627958 - RNA, 14 nt, Pseudomonas putida KT2440
ccacucgcgcagca

SEQ ID NO: 1627959 - RNA, 22 nt, Pseudomonas putida KT2440
ccacucgcgcagcacaucacac

SEQ ID NO: 1627960 - RNA, 19 nt, Pseudomonas putida KT2440
ccacucguccgggcgccag

SEQ ID NO: 1627961 - RNA, 17 nt, Pseudomonas putida KT2440
ccacugaccagcccggc

SEQ ID NO: 1627962 - RNA, 19 nt, Pseudomonas putida KT2440
ccacugaggcguagcacaa

SEQ ID NO: 1627963 - RNA, 18 nt, Pseudomonas putida KT2440
ccuggcugcagugaagaa

SEQ ID NO: 1627964 - RNA, 14 nt, Pseudomonas putida KT2440
ccuggcuuuccagg

SEQ ID NO: 1627965 - RNA, 20 nt, Pseudomonas putida KT2440
ccugggaagcugcagcagcu

SEQ ID NO: 1627966 - RNA, 22 nt, Pseudomonas putida KT2440
ccugggaagcugcagcagcuuc

SEQ ID NO: 1627967 - RNA, 16 nt, Pseudomonas putida KT2440
ccuggucaugcagcgg

SEQ ID NO: 1627968 - RNA, 20 nt, Pseudomonas putida KT2440
ccuggcucuucaacaccagc

SEQ ID NO: 1627969 - RNA, 22 nt, Pseudomonas putida KT2440
ccuggcucaccuuaucggccgg

SEQ ID NO: 1627970 - RNA, 20 nt, Pseudomonas putida KT2440
ccuggcugcugugguuuggc

SEQ ID NO: 1627971 - RNA, 15 nt, Pseudomonas putida KT2440
ccuggucgcgggcca

SEQ ID NO: 1627972 - RNA, 15 nt, Pseudomonas putida KT2440
ccuggucgccgccac

SEQ ID NO: 1627973 - RNA, 21 nt, Pseudomonas putida KT2440
ccuggucuucguuacgcccgg

SEQ ID NO: 1627974 - RNA, 16 nt, Pseudomonas putida KT2440
ccuggugaucaacaaa

SEQ ID NO: 1627975 - RNA, 15 nt, Pseudomonas putida KT2440
ccugguuauccaggu

SEQ ID NO: 1627976 - RNA, 15 nt, Pseudomonas putida KT2440
ccuggcgcuccucca

SEQ ID NO: 1627977 - RNA, 17 nt, Pseudomonas putida KT2440
ccuggcgccugcgccag

SEQ ID NO: 1627978 - RNA, 21 nt, Pseudomonas putida KT2440
ccuggcgacacuugguccagg

SEQ ID NO: 1627979 - RNA, 22 nt, Pseudomonas putida KT2440
ccuggccgugacgccgugggcu

SEQ ID NO: 1627980 - RNA, 14 nt, Pseudomonas putida KT2440
ccuggccuggccaa

SEQ ID NO: 1627981 - RNA, 22 nt, Pseudomonas putida KT2440
ccuggccgguguggccaaggcg

SEQ ID NO: 1627982 - RNA, 20 nt, Pseudomonas putida KT2440
ccuggccacuguugcagcgc

SEQ ID NO: 1627983 - RNA, 23 nt, Pseudomonas putida KT2440
ccuggccacuguugcagcgccag

SEQ ID NO: 1627984 - RNA, 16 nt, Pseudomonas putida KT2440
ccuggacccgcagcag

SEQ ID NO: 1627985 - RNA, 20 nt, Pseudomonas putida KT2440
ccuggacaaucucggcaaaa

SEQ ID NO: 1627986 - RNA, 22 nt, Pseudomonas putida KT2440
ccuggcccuuucgcgggcacgc

SEQ ID NO: 1627987 - RNA, 14 nt, Pseudomonas putida KT2440
ccuggcccgcagcg

SEQ ID NO: 1627988 - RNA, 17 nt, Pseudomonas putida KT2440
ccuggaaccccauccac

SEQ ID NO: 1627989 - RNA, 19 nt, Pseudomonas putida KT2440
ccuggcccaguacgccacc

SEQ ID NO: 1627990 - RNA, 17 nt, Pseudomonas putida KT2440
ccugcucauccagcaaa

SEQ ID NO: 1627991 - RNA, 11 nt, Pseudomonas putida KT2440
ccugccccagc

SEQ ID NO: 1627992 - RNA, 13 nt, Pseudomonas putida KT2440
ccugccccagcau

SEQ ID NO: 1627993 - RNA, 16 nt, Pseudomonas putida KT2440
ccugccccagcgucac

SEQ ID NO: 1627994 - RNA, 14 nt, Pseudomonas putida KT2440
ccugcuccagcacc

SEQ ID NO: 1627995 - RNA, 16 nt, Pseudomonas putida KT2440
ccugcuccagcacccg

SEQ ID NO: 1627996 - RNA, 16 nt, Pseudomonas putida KT2440
ccugcuccagcaccug

SEQ ID NO: 1627997 - RNA, 14 nt, Pseudomonas putida KT2440
ccugcuccacaauc

SEQ ID NO: 1627998 - RNA, 15 nt, Pseudomonas putida KT2440
ccugcuccacccgug

SEQ ID NO: 1627999 - RNA, 14 nt, Pseudomonas putida KT2440
ccugcuccuggucc

SEQ ID NO: 1628000 - RNA, 22 nt, Pseudomonas putida KT2440
ccugcucgacaagccgcugggc

SEQ ID NO: 1628001 - RNA, 18 nt, Pseudomonas putida KT2440
ccugccaugcaggucgac

SEQ ID NO: 1628002 - RNA, 12 nt, Pseudomonas putida KT2440
ccugccagcccc

SEQ ID NO: 1628003 - RNA, 15 nt, Pseudomonas putida KT2440
ccugccagccccgca

SEQ ID NO: 1628004 - RNA, 15 nt, Pseudomonas putida KT2440
ccugccagcaccagc

SEQ ID NO: 1628005 - RNA, 13 nt, Pseudomonas putida KT2440
ccugccagccgca

SEQ ID NO: 1628006 - RNA, 22 nt, Pseudomonas putida KT2440
ccugcuggcggcugagccggcu

SEQ ID NO: 1628007 - RNA, 14 nt, Pseudomonas putida KT2440
ccugcugguacagc

SEQ ID NO: 1628008 - RNA, 15 nt, Pseudomonas putida KT2440
ccugcuguagcgccc

SEQ ID NO: 1628009 - RNA, 16 nt, Pseudomonas putida KT2440
ccugcuguagcgccca

SEQ ID NO: 1628010 - RNA, 21 nt, Pseudomonas putida KT2440
ccugcuguagcgcccacaagu

SEQ ID NO: 1628011 - RNA, 22 nt, Pseudomonas putida KT2440
ccugcugcuccccaaccaccuc

SEQ ID NO: 1628012 - RNA, 15 nt, Pseudomonas putida KT2440
ccugcuggccgcgca

SEQ ID NO: 1628013 - RNA, 18 nt, Pseudomonas putida KT2440
ccugcuugaucaggcccg

SEQ ID NO: 1628014 - RNA, 19 nt, Pseudomonas putida KT2440
ccugcuucgcgggcacgcc

SEQ ID NO: 1628015 - RNA, 20 nt, Pseudomonas putida KT2440
ccugcuugccgggugcaucg

SEQ ID NO: 1628016 - RNA, 20 nt, Pseudomonas putida KT2440
ccuggaagcgaaagcuuucg

SEQ ID NO: 1628017 - RNA, 13 nt, Pseudomonas putida KT2440
ccuggaaccgugg

SEQ ID NO: 1628018 - RNA, 22 nt, Pseudomonas putida KT2440
ccuucacuguggucauccaggc

SEQ ID NO: 1628019 - RNA, 17 nt, Pseudomonas putida KT2440
ccuucacgcucaugcug

SEQ ID NO: 1628020 - RNA, 16 nt, Pseudomonas putida KT2440
ccuucacgccagccgu

SEQ ID NO: 1628021 - RNA, 21 nt, Pseudomonas putida KT2440
ccuucagcgggucgagccagg

SEQ ID NO: 1628022 - RNA, 19 nt, Pseudomonas putida KT2440
ccuucagcgggucgagcca

SEQ ID NO: 1628023 - RNA, 17 nt, Pseudomonas putida KT2440
ccuucagcggccgcgca

SEQ ID NO: 1628024 - RNA, 17 nt, Pseudomonas putida KT2440
ccuucagguugcucuga

SEQ ID NO: 1628025 - RNA, 18 nt, Pseudomonas putida KT2440
ccuucagguugcucugau

SEQ ID NO: 1628026 - RNA, 20 nt, Pseudomonas putida KT2440
ccuucagguaauccaccagc

SEQ ID NO: 1628027 - RNA, 15 nt, Pseudomonas putida KT2440
ccuucaacaccaacu

SEQ ID NO: 1628028 - RNA, 18 nt, Pseudomonas putida KT2440
ccuucaagcuccccagca

SEQ ID NO: 1628029 - RNA, 15 nt, Pseudomonas putida KT2440
ccuuacagaugcugc

SEQ ID NO: 1628030 - RNA, 20 nt, Pseudomonas putida KT2440
ccuuaaggucaaucagggau

SEQ ID NO: 1628031 - RNA, 14 nt, Pseudomonas putida KT2440
ccuguuccagcccc

SEQ ID NO: 1628032 - RNA, 15 nt, Pseudomonas putida KT2440
ccuguuccagccccu

SEQ ID NO: 1628033 - RNA, 12 nt, Pseudomonas putida KT2440
ccugguuguagc

SEQ ID NO: 1628034 - RNA, 22 nt, Pseudomonas putida KT2440
ccugguuguagcccgggcagcc

SEQ ID NO: 1628035 - RNA, 23 nt, Pseudomonas putida KT2440
ccugguuguagcccgggcagccg

SEQ ID NO: 1628036 - RNA, 21 nt, Pseudomonas putida KT2440
ccugguugcguucgucgaugu

SEQ ID NO: 1628037 - RNA, 18 nt, Pseudomonas putida KT2440
ccugguuuucgcucgccg

SEQ ID NO: 1628038 - RNA, 22 nt, Pseudomonas putida KT2440
ccugugagaucgagcgccgccc

SEQ ID NO: 1628039 - RNA, 19 nt, Pseudomonas putida KT2440
ccugugaaugcgauggugg

SEQ ID NO: 1628040 - RNA, 15 nt, Pseudomonas putida KT2440
ccucgaucacacccu

SEQ ID NO: 1628041 - RNA, 19 nt, Pseudomonas putida KT2440
ccucgaucucgaagcugcc

SEQ ID NO: 1628042 - RNA, 23 nt, Pseudomonas putida KT2440
ccucauagcuuucaggcgcagca

SEQ ID NO: 1628043 - RNA, 17 nt, Pseudomonas putida KT2440
ccucauaaugcuccgcc

SEQ ID NO: 1628044 - RNA, 19 nt, Pseudomonas putida KT2440
ccucgagcgcuuucagccg

SEQ ID NO: 1628045 - RNA, 20 nt, Pseudomonas putida KT2440
ccucagggguaaugccccag

SEQ ID NO: 1628046 - RNA, 23 nt, Pseudomonas putida KT2440
ccucagggguaaugccccagccg

SEQ ID NO: 1628047 - RNA, 21 nt, Pseudomonas putida KT2440
ccucaguaccggucauggcgc

SEQ ID NO: 1628048 - RNA, 21 nt, Pseudomonas putida KT2440
ccucagggauaacgucacagg

SEQ ID NO: 1628049 - RNA, 14 nt, Pseudomonas putida KT2440
ccucagcgcgugcu

SEQ ID NO: 1628050 - RNA, 15 nt, Pseudomonas putida KT2440
ccucagccaggcuga

SEQ ID NO: 1628051 - RNA, 21 nt, Pseudomonas putida KT2440
ccucagcccaguaccacuucc

SEQ ID NO: 1628052 - RNA, 20 nt, Pseudomonas putida KT2440
ccucgaugucuuccagacca

SEQ ID NO: 1628053 - RNA, 21 nt, Pseudomonas putida KT2440
ccucgaugugcgugaacacug

SEQ ID NO: 1628054 - RNA, 15 nt, Pseudomonas putida KT2440
ccucgccccgcgcaa

SEQ ID NO: 1628055 - RNA, 17 nt, Pseudomonas putida KT2440
ccucgcccaggccgccg

SEQ ID NO: 1628056 - RNA, 14 nt, Pseudomonas putida KT2440
ccucgcccagguca

SEQ ID NO: 1628057 - RNA, 15 nt, Pseudomonas putida KT2440
ccucgcccaggucaa

SEQ ID NO: 1628058 - RNA, 21 nt, Pseudomonas putida KT2440
ccucgcccagaaucucaacca

SEQ ID NO: 1628059 - RNA, 23 nt, Pseudomonas putida KT2440
ccucgcccagaaucucaaccacc

SEQ ID NO: 1628060 - RNA, 20 nt, Pseudomonas putida KT2440
ccucgcugccuuuggccgcc

SEQ ID NO: 1628061 - RNA, 22 nt, Pseudomonas putida KT2440
ccucgcugccuuuggccgccag

SEQ ID NO: 1628062 - RNA, 18 nt, Pseudomonas putida KT2440
ccucgcugcccaacgccu

SEQ ID NO: 1628063 - RNA, 18 nt, Pseudomonas putida KT2440
ccucgcugaccaguugcu

SEQ ID NO: 1628064 - RNA, 17 nt, Pseudomonas putida KT2440
ccucuaccacgccgcug

SEQ ID NO: 1628065 - RNA, 17 nt, Pseudomonas putida KT2440
ccucugccaucucaauc

SEQ ID NO: 1628066 - RNA, 16 nt, Pseudomonas putida KT2440
ccucuaugccaccugu

SEQ ID NO: 1628067 - RNA, 13 nt, Pseudomonas putida KT2440
ccucugcccgcag

SEQ ID NO: 1628068 - RNA, 15 nt, Pseudomonas putida KT2440
ccucugcccgcagcu

SEQ ID NO: 1628069 - RNA, 19 nt, Pseudomonas putida KT2440
ccucugcggccuucaagcu

SEQ ID NO: 1628070 - RNA, 21 nt, Pseudomonas putida KT2440
ccucuggguagccaccuuuga

SEQ ID NO: 1628071 - RNA, 16 nt, Pseudomonas putida KT2440
ccucuguaacugcgca

SEQ ID NO: 1628072 - RNA, 22 nt, Pseudomonas putida KT2440
ccucugcugcggauacagcgcc

SEQ ID NO: 1628073 - RNA, 18 nt, Pseudomonas putida KT2440
ccucuggcgugcaccugu

SEQ ID NO: 1628074 - RNA, 14 nt, Pseudomonas putida KT2440
ccucggccaugucg

SEQ ID NO: 1628075 - RNA, 16 nt, Pseudomonas putida KT2440
ccucggccggguuuuu

SEQ ID NO: 1628076 - RNA, 22 nt, Pseudomonas putida KT2440
ccucggccucgguacccgccag

SEQ ID NO: 1628077 - RNA, 13 nt, Pseudomonas putida KT2440
ccucggcacugca

SEQ ID NO: 1628078 - RNA, 16 nt, Pseudomonas putida KT2440
ccucggcaccgcacca

SEQ ID NO: 1628079 - RNA, 19 nt, Pseudomonas putida KT2440
ccucguccggugccgccug

SEQ ID NO: 1628080 - RNA, 18 nt, Pseudomonas putida KT2440
ccugcaggaaccuccguu

SEQ ID NO: 1628081 - RNA, 16 nt, Pseudomonas putida KT2440
ccugcagcuucccggc

SEQ ID NO: 1628082 - RNA, 21 nt, Pseudomonas putida KT2440
ccugcagggaacugcgcgagc

SEQ ID NO: 1628083 - RNA, 18 nt, Pseudomonas putida KT2440
ccugcaggcgcggugccg

SEQ ID NO: 1628084 - RNA, 22 nt, Pseudomonas putida KT2440
ccugcaggcgcggugccggcag

SEQ ID NO: 1628085 - RNA, 20 nt, Pseudomonas putida KT2440
ccugccacucguccgggcgc

SEQ ID NO: 1628086 - RNA, 14 nt, Pseudomonas putida KT2440
ccugccacugcgcu

SEQ ID NO: 1628087 - RNA, 18 nt, Pseudomonas putida KT2440
ccugccacacacccgggc

SEQ ID NO: 1628088 - RNA, 20 nt, Pseudomonas putida KT2440
ccugccacacacccgggccc

SEQ ID NO: 1628089 - RNA, 14 nt, Pseudomonas putida KT2440
ccugccaacgcacc

SEQ ID NO: 1628090 - RNA, 19 nt, Pseudomonas putida KT2440
ccugccaacgcaccgacca

SEQ ID NO: 1628091 - RNA, 16 nt, Pseudomonas putida KT2440
ccugcagguacagcag

SEQ ID NO: 1628092 - RNA, 21 nt, Pseudomonas putida KT2440
ccugcagggcgagcacacccg

SEQ ID NO: 1628093 - RNA, 15 nt, Pseudomonas putida KT2440
ccugcaaccccugga

SEQ ID NO: 1628094 - RNA, 21 nt, Pseudomonas putida KT2440
ccugcaacccgucagugcucg

SEQ ID NO: 1628095 - RNA, 19 nt, Pseudomonas putida KT2440
ccugcaaaggcaugggcca

SEQ ID NO: 1628096 - RNA, 13 nt, Pseudomonas putida KT2440
ccugcaaaggccc

SEQ ID NO: 1628097 - RNA, 20 nt, Pseudomonas putida KT2440
ccugcagccguugcugggcu

SEQ ID NO: 1628098 - RNA, 18 nt, Pseudomonas putida KT2440
ccugcagccgcaccugcc

SEQ ID NO: 1628099 - RNA, 23 nt, Pseudomonas putida KT2440
ccugcagcgcggcgaucaacgca

SEQ ID NO: 1628100 - RNA, 14 nt, Pseudomonas putida KT2440
ccugcagcgcguca

SEQ ID NO: 1628101 - RNA, 22 nt, Pseudomonas putida KT2440
ccugcagcgcgucauccgccaa

SEQ ID NO: 1628102 - RNA, 17 nt, Pseudomonas putida KT2440
ccugcagcucagccagc

SEQ ID NO: 1628103 - RNA, 20 nt, Pseudomonas putida KT2440
ccugauuggcaucgcugccc

SEQ ID NO: 1628104 - RNA, 15 nt, Pseudomonas putida KT2440
ccugaucauucacga

SEQ ID NO: 1628105 - RNA, 23 nt, Pseudomonas putida KT2440
ccugaucaagguuucagcagcgu

SEQ ID NO: 1628106 - RNA, 16 nt, Pseudomonas putida KT2440
ccugaucagacuuugc

SEQ ID NO: 1628107 - RNA, 19 nt, Pseudomonas putida KT2440
ccugaucgguuggguuggc

SEQ ID NO: 1628108 - RNA, 23 nt, Pseudomonas putida KT2440
ccugaucgaugagcgagcccgcg

SEQ ID NO: 1628109 - RNA, 16 nt, Pseudomonas putida KT2440
ccugaucgccuccagg

SEQ ID NO: 1628110 - RNA, 17 nt, Pseudomonas putida KT2440
ccugaucgccuccaggc

SEQ ID NO: 1628111 - RNA, 16 nt, Pseudomonas putida KT2440
ccugaugcagcagugc

SEQ ID NO: 1628112 - RNA, 21 nt, Pseudomonas putida KT2440
ccugaugcagcagugccagca

SEQ ID NO: 1628113 - RNA, 20 nt, Pseudomonas putida KT2440
ccugauguucggugcucagg

SEQ ID NO: 1628114 - RNA, 23 nt, Pseudomonas putida KT2440
ccugauguccaaauugggcuggg

SEQ ID NO: 1628115 - RNA, 18 nt, Pseudomonas putida KT2440
ccugagucaggcgcccug

SEQ ID NO: 1628116 - RNA, 19 nt, Pseudomonas putida KT2440
ccugauaguugcgcccgug

SEQ ID NO: 1628117 - RNA, 17 nt, Pseudomonas putida KT2440
ccugauagcgcuuuucc

SEQ ID NO: 1628118 - RNA, 14 nt, Pseudomonas putida KT2440
ccugauaggacugc

SEQ ID NO: 1628119 - RNA, 16 nt, Pseudomonas putida KT2440
ccugauaggacugcuu

SEQ ID NO: 1628120 - RNA, 14 nt, Pseudomonas putida KT2440
ccugagcuucaacg

SEQ ID NO: 1628121 - RNA, 21 nt, Pseudomonas putida KT2440
ccugagcuucaaucaugaagc

SEQ ID NO: 1628122 - RNA, 20 nt, Pseudomonas putida KT2440
ccugagggcucauccacccc

SEQ ID NO: 1628123 - RNA, 14 nt, Pseudomonas putida KT2440
ccugacccgcgccu

SEQ ID NO: 1628124 - RNA, 16 nt, Pseudomonas putida KT2440
ccugacauccugcucc

SEQ ID NO: 1628125 - RNA, 22 nt, Pseudomonas putida KT2440
ccucuucgcgggcaagcccgcu

SEQ ID NO: 1628126 - RNA, 19 nt, Pseudomonas putida KT2440
ccugacgcugcacuuccac

SEQ ID NO: 1628127 - RNA, 19 nt, Pseudomonas putida KT2440
ccugacucgaccgccgcac

SEQ ID NO: 1628128 - RNA, 14 nt, Pseudomonas putida KT2440
ccugaccuugcugc

SEQ ID NO: 1628129 - RNA, 22 nt, Pseudomonas putida KT2440
ccugacgcaagcgcgccgccac

SEQ ID NO: 1628130 - RNA, 18 nt, Pseudomonas putida KT2440
ccguccaccaucuccagc

SEQ ID NO: 1628131 - RNA, 19 nt, Pseudomonas putida KT2440
ccguccagguagcgcucga

SEQ ID NO: 1628132 - RNA, 22 nt, Pseudomonas putida KT2440
ccguccaguuccggcaggucga

SEQ ID NO: 1628133 - RNA, 16 nt, Pseudomonas putida KT2440
ccguccggcaaucugc

SEQ ID NO: 1628134 - RNA, 19 nt, Pseudomonas putida KT2440
ccgucaguuugggcgggcu

SEQ ID NO: 1628135 - RNA, 18 nt, Pseudomonas putida KT2440
ccgucaucgauccccagu

SEQ ID NO: 1628136 - RNA, 19 nt, Pseudomonas putida KT2440
ccgucaucgauccccaguu

SEQ ID NO: 1628137 - RNA, 19 nt, Pseudomonas putida KT2440
ccguccaacgggcggaacu

SEQ ID NO: 1628138 - RNA, 19 nt, Pseudomonas putida KT2440
ccgucaccagcgucacccc

SEQ ID NO: 1628139 - RNA, 19 nt, Pseudomonas putida KT2440
ccguaccuucggcgacagg

SEQ ID NO: 1628140 - RNA, 19 nt, Pseudomonas putida KT2440
ccguacccuuccuggagac

SEQ ID NO: 1628141 - RNA, 20 nt, Pseudomonas putida KT2440
ccguauggcguugcucaaca

SEQ ID NO: 1628142 - RNA, 14 nt, Pseudomonas putida KT2440
ccgguucgccgccg

SEQ ID NO: 1628143 - RNA, 20 nt, Pseudomonas putida KT2440
ccgguguuuccacagguacc

SEQ ID NO: 1628144 - RNA, 17 nt, Pseudomonas putida KT2440
ccgguugcaggcgagcu

SEQ ID NO: 1628145 - RNA, 23 nt, Pseudomonas putida KT2440
ccggugcguacucgaccacuguc

SEQ ID NO: 1628146 - RNA, 22 nt, Pseudomonas putida KT2440
ccggugcgcgggcgucggucgc

SEQ ID NO: 1628147 - RNA, 19 nt, Pseudomonas putida KT2440
ccgguggcgcggccgggcu

SEQ ID NO: 1628148 - RNA, 21 nt, Pseudomonas putida KT2440
ccggugguaauuggccggcag

SEQ ID NO: 1628149 - RNA, 20 nt, Pseudomonas putida KT2440
ccgguggugaccucgaugcc

SEQ ID NO: 1628150 - RNA, 13 nt, Pseudomonas putida KT2440
ccggugugcauuu

SEQ ID NO: 1628151 - RNA, 19 nt, Pseudomonas putida KT2440
ccgguguaccauccaguac

SEQ ID NO: 1628152 - RNA, 13 nt, Pseudomonas putida KT2440
ccggucagcccgg

SEQ ID NO: 1628153 - RNA, 13 nt, Pseudomonas putida KT2440
ccggucagcagca

SEQ ID NO: 1628154 - RNA, 14 nt, Pseudomonas putida KT2440
ccgguaggacaaaa

SEQ ID NO: 1628155 - RNA, 15 nt, Pseudomonas putida KT2440
ccgguagcgcgccug

SEQ ID NO: 1628156 - RNA, 15 nt, Pseudomonas putida KT2440
ccgguacugcccaua

SEQ ID NO: 1628157 - RNA, 13 nt, Pseudomonas putida KT2440
ccgguacggccaa

SEQ ID NO: 1628158 - RNA, 12 nt, Pseudomonas putida KT2440
ccggucagggug

SEQ ID NO: 1628159 - RNA, 13 nt, Pseudomonas putida KT2440
ccgguccagugca

SEQ ID NO: 1628160 - RNA, 19 nt, Pseudomonas putida KT2440
ccggugccgcgccauugcc

SEQ ID NO: 1628161 - RNA, 22 nt, Pseudomonas putida KT2440
ccggucgggcaaggccagugcc

SEQ ID NO: 1628162 - RNA, 23 nt, Pseudomonas putida KT2440
ccggucgggcaaggccagugccg

SEQ ID NO: 1628163 - RNA, 20 nt, Pseudomonas putida KT2440
ccggucggaaggggccgcaa

SEQ ID NO: 1628164 - RNA, 16 nt, Pseudomonas putida KT2440
ccggucccgcccggcc

SEQ ID NO: 1628165 - RNA, 14 nt, Pseudomonas putida KT2440
ccggucccgcccuc

SEQ ID NO: 1628166 - RNA, 18 nt, Pseudomonas putida KT2440
ccggucccgcccuccagc

SEQ ID NO: 1628167 - RNA, 13 nt, Pseudomonas putida KT2440
ccgggucuucagg

SEQ ID NO: 1628168 - RNA, 21 nt, Pseudomonas putida KT2440
ccgggucgcuugucgccaccc

SEQ ID NO: 1628169 - RNA, 18 nt, Pseudomonas putida KT2440
ccgggucggcgccaggcc

SEQ ID NO: 1628170 - RNA, 22 nt, Pseudomonas putida KT2440
ccgggucgccguugucgcccgc

SEQ ID NO: 1628171 - RNA, 15 nt, Pseudomonas putida KT2440
ccggguccagugccg

SEQ ID NO: 1628172 - RNA, 14 nt, Pseudomonas putida KT2440
ccggguccaccagc

SEQ ID NO: 1628173 - RNA, 22 nt, Pseudomonas putida KT2440
ccggguccaccagcccguccgc

SEQ ID NO: 1628174 - RNA, 18 nt, Pseudomonas putida KT2440
ccggguccaccucugcgg

SEQ ID NO: 1628175 - RNA, 18 nt, Pseudomonas putida KT2440
ccgggucgaccugggcca

SEQ ID NO: 1628176 - RNA, 14 nt, Pseudomonas putida KT2440
ccgggucgacgcgc

SEQ ID NO: 1628177 - RNA, 19 nt, Pseudomonas putida KT2440
ccgggucgauagccagccc

SEQ ID NO: 1628178 - RNA, 23 nt, Pseudomonas putida KT2440
ccgggugcuggcucgcugcccca

SEQ ID NO: 1628179 - RNA, 15 nt, Pseudomonas putida KT2440
ccgggugcaucggca

SEQ ID NO: 1628180 - RNA, 14 nt, Pseudomonas putida KT2440
ccgguaccagcagg

SEQ ID NO: 1628181 - RNA, 20 nt, Pseudomonas putida KT2440
ccgguacccaaggccagccc

SEQ ID NO: 1628182 - RNA, 17 nt, Pseudomonas putida KT2440
ccgggccuuucaccgcu

SEQ ID NO: 1628183 - RNA, 14 nt, Pseudomonas putida KT2440
ccgggccuucaacc

SEQ ID NO: 1628184 - RNA, 15 nt, Pseudomonas putida KT2440
ccgggguaauggcgc

SEQ ID NO: 1628185 - RNA, 21 nt, Pseudomonas putida KT2440
ccgggggugcuuaaguuucau

SEQ ID NO: 1628186 - RNA, 20 nt, Pseudomonas putida KT2440
ccggggguggcgagcagguc

SEQ ID NO: 1628187 - RNA, 21 nt, Pseudomonas putida KT2440
ccggggugcagauccaggugc

SEQ ID NO: 1628188 - RNA, 20 nt, Pseudomonas putida KT2440
ccgggcaggccaugcccgcc

SEQ ID NO: 1628189 - RNA, 18 nt, Pseudomonas putida KT2440
ccgggcagcgggcucgcc

SEQ ID NO: 1628190 - RNA, 12 nt, Pseudomonas putida KT2440
ccgggcacauca

SEQ ID NO: 1628191 - RNA, 10 nt, Pseudomonas putida KT2440
ccgggcacug

SEQ ID NO: 1628192 - RNA, 11 nt, Pseudomonas putida KT2440
ccgggcacugc

SEQ ID NO: 1628193 - RNA, 13 nt, Pseudomonas putida KT2440
ccgggcacugccc

SEQ ID NO: 1628194 - RNA, 14 nt, Pseudomonas putida KT2440
ccgggcacugcccg

SEQ ID NO: 1628195 - RNA, 12 nt, Pseudomonas putida KT2440
ccgggaugcucu

SEQ ID NO: 1628196 - RNA, 19 nt, Pseudomonas putida KT2440
ccgggauggcggcgccugc

SEQ ID NO: 1628197 - RNA, 18 nt, Pseudomonas putida KT2440
ccgggaucgagaucaggu

SEQ ID NO: 1628198 - RNA, 14 nt, Pseudomonas putida KT2440
ccgggaucaccgca

SEQ ID NO: 1628199 - RNA, 14 nt, Pseudomonas putida KT2440
ccgggcaauggcgc

SEQ ID NO: 1628200 - RNA, 19 nt, Pseudomonas putida KT2440
ccgggauucgacuaucagg

SEQ ID NO: 1628201 - RNA, 15 nt, Pseudomonas putida KT2440
ccucagaagucgaag

SEQ ID NO: 1628202 - RNA, 15 nt, Pseudomonas putida KT2440
ccucacgcacaaccg

SEQ ID NO: 1628203 - RNA, 14 nt, Pseudomonas putida KT2440
ccucaccuccaccg

SEQ ID NO: 1628204 - RNA, 13 nt, Pseudomonas putida KT2440
ccucacgcgccag

SEQ ID NO: 1628205 - RNA, 19 nt, Pseudomonas putida KT2440
ccucaaggccggcagccag

SEQ ID NO: 1628206 - RNA, 19 nt, Pseudomonas putida KT2440
ccucaagguaggggcagcc

SEQ ID NO: 1628207 - RNA, 13 nt, Pseudomonas putida KT2440
ccucacacagcau

SEQ ID NO: 1628208 - RNA, 16 nt, Pseudomonas putida KT2440
ccucacauucaccgcc

SEQ ID NO: 1628209 - RNA, 16 nt, Pseudomonas putida KT2440
ccucaccgacccacag

SEQ ID NO: 1628210 - RNA, 18 nt, Pseudomonas putida KT2440
ccucaccgacccacaggc

SEQ ID NO: 1628211 - RNA, 11 nt, Pseudomonas putida KT2440
ccucaccaacu

SEQ ID NO: 1628212 - RNA, 14 nt, Pseudomonas putida KT2440
ccucaacgccuccc

SEQ ID NO: 1628213 - RNA, 21 nt, Pseudomonas putida KT2440
ccucaacgccucccccacccc

SEQ ID NO: 1628214 - RNA, 19 nt, Pseudomonas putida KT2440
ccucaagccucgcgcaaca

SEQ ID NO: 1628215 - RNA, 18 nt, Pseudomonas putida KT2440
ccuacaagggugaaguac

SEQ ID NO: 1628216 - RNA, 17 nt, Pseudomonas putida KT2440
ccuacacgacccaccau

SEQ ID NO: 1628217 - RNA, 17 nt, Pseudomonas putida KT2440
ccuagcaaggccuccag

SEQ ID NO: 1628218 - RNA, 13 nt, Pseudomonas putida KT2440
ccuaugaaaccga

SEQ ID NO: 1628219 - RNA, 13 nt, Pseudomonas putida KT2440
ccgugcaggucag

SEQ ID NO: 1628220 - RNA, 13 nt, Pseudomonas putida KT2440
ccgugcagggcug

SEQ ID NO: 1628221 - RNA, 21 nt, Pseudomonas putida KT2440
ccgugcaggggucugugcagc

SEQ ID NO: 1628222 - RNA, 14 nt, Pseudomonas putida KT2440
ccgugcauacaccc

SEQ ID NO: 1628223 - RNA, 18 nt, Pseudomonas putida KT2440
ccgugcaccagcaccacc

SEQ ID NO: 1628224 - RNA, 17 nt, Pseudomonas putida KT2440
ccgugcaaacaacuccg

SEQ ID NO: 1628225 - RNA, 21 nt, Pseudomonas putida KT2440
ccgugcaaaugccccgggcag

SEQ ID NO: 1628226 - RNA, 14 nt, Pseudomonas putida KT2440
ccgucgccgcuucg

SEQ ID NO: 1628227 - RNA, 18 nt, Pseudomonas putida KT2440
ccguccucgacccaguca

SEQ ID NO: 1628228 - RNA, 15 nt, Pseudomonas putida KT2440
ccguguucccagcac

SEQ ID NO: 1628229 - RNA, 13 nt, Pseudomonas putida KT2440
ccguggcugggga

SEQ ID NO: 1628230 - RNA, 18 nt, Pseudomonas putida KT2440
ccguuauggaugccaauu

SEQ ID NO: 1628231 - RNA, 14 nt, Pseudomonas putida KT2440
ccguucggcgcgcu

SEQ ID NO: 1628232 - RNA, 13 nt, Pseudomonas putida KT2440
ccguuggccagca

SEQ ID NO: 1628233 - RNA, 14 nt, Pseudomonas putida KT2440
ccguuggcccgcca

SEQ ID NO: 1628234 - RNA, 23 nt, Pseudomonas putida KT2440
ccguuggucagcgacugccaaug

SEQ ID NO: 1628235 - RNA, 23 nt, Pseudomonas putida KT2440
ccguugguaucgaucaggaaggc

SEQ ID NO: 1628236 - RNA, 14 nt, Pseudomonas putida KT2440
ccguugguguccuu

SEQ ID NO: 1628237 - RNA, 19 nt, Pseudomonas putida KT2440
ccggauuucuuccauggcc

SEQ ID NO: 1628238 - RNA, 13 nt, Pseudomonas putida KT2440
ccggcaaacacau

SEQ ID NO: 1628239 - RNA, 17 nt, Pseudomonas putida KT2440
ccggcaaacacauccac

SEQ ID NO: 1628240 - RNA, 16 nt, Pseudomonas putida KT2440
ccggcaguagaaaguc

SEQ ID NO: 1628241 - RNA, 19 nt, Pseudomonas putida KT2440
ccggcaguccacuugcguu

SEQ ID NO: 1628242 - RNA, 22 nt, Pseudomonas putida KT2440
ccggcaggucgaugaucgccgc

SEQ ID NO: 1628243 - RNA, 22 nt, Pseudomonas putida KT2440
ccggcaucacuacccaggccaa

SEQ ID NO: 1628244 - RNA, 20 nt, Pseudomonas putida KT2440
ccggcaucauccugcuggcc

SEQ ID NO: 1628245 - RNA, 15 nt, Pseudomonas putida KT2440
ccggcccagccgcga

SEQ ID NO: 1628246 - RNA, 14 nt, Pseudomonas putida KT2440
ccggcccaucccgc

SEQ ID NO: 1628247 - RNA, 23 nt, Pseudomonas putida KT2440
ccggcccaucccgcuucgccagc

SEQ ID NO: 1628248 - RNA, 16 nt, Pseudomonas putida KT2440
ccggcauccgccucau

SEQ ID NO: 1628249 - RNA, 15 nt, Pseudomonas putida KT2440
ccggccagcagguca

SEQ ID NO: 1628250 - RNA, 12 nt, Pseudomonas putida KT2440
ccggccagaccu

SEQ ID NO: 1628251 - RNA, 17 nt, Pseudomonas putida KT2440
ccggccccccagccagc

SEQ ID NO: 1628252 - RNA, 20 nt, Pseudomonas putida KT2440
ccggccccccagccagcaga

SEQ ID NO: 1628253 - RNA, 17 nt, Pseudomonas putida KT2440
ccggcccggcuggccac

SEQ ID NO: 1628254 - RNA, 16 nt, Pseudomonas putida KT2440
ccggcccgguuggcgc

SEQ ID NO: 1628255 - RNA, 16 nt, Pseudomonas putida KT2440
ccggaccugccgcagc

SEQ ID NO: 1628256 - RNA, 15 nt, Pseudomonas putida KT2440
ccgcuugcugaucaa

SEQ ID NO: 1628257 - RNA, 17 nt, Pseudomonas putida KT2440
ccgcuucggcaugcacg

SEQ ID NO: 1628258 - RNA, 16 nt, Pseudomonas putida KT2440
ccgcuucguccaggua

SEQ ID NO: 1628259 - RNA, 21 nt, Pseudomonas putida KT2440
ccgcuugacgaucgccagccc

SEQ ID NO: 1628260 - RNA, 12 nt, Pseudomonas putida KT2440
ccggaggacaca

SEQ ID NO: 1628261 - RNA, 16 nt, Pseudomonas putida KT2440
ccggauggggcgugca

SEQ ID NO: 1628262 - RNA, 17 nt, Pseudomonas putida KT2440
ccggcgcgcgcgaccgc

SEQ ID NO: 1628263 - RNA, 14 nt, Pseudomonas putida KT2440
ccggcgccuccagc

SEQ ID NO: 1628264 - RNA, 22 nt, Pseudomonas putida KT2440
ccggcgccgccgaacucuggca

SEQ ID NO: 1628265 - RNA, 17 nt, Pseudomonas putida KT2440
ccggcgccaugcccccc

SEQ ID NO: 1628266 - RNA, 18 nt, Pseudomonas putida KT2440
ccggcgccaugccccccg

SEQ ID NO: 1628267 - RNA, 14 nt, Pseudomonas putida KT2440
ccggcgcaagccgg

SEQ ID NO: 1628268 - RNA, 21 nt, Pseudomonas putida KT2440
ccggcgccaaacgccagggcc

SEQ ID NO: 1628269 - RNA, 22 nt, Pseudomonas putida KT2440
ccggcgccaaacgccagggccg

SEQ ID NO: 1628270 - RNA, 17 nt, Pseudomonas putida KT2440
ccggccgccaggauggc

SEQ ID NO: 1628271 - RNA, 21 nt, Pseudomonas putida KT2440
ccggccgcuugcaaccgacgc

SEQ ID NO: 1628272 - RNA, 14 nt, Pseudomonas putida KT2440
ccggccgcuccagc

SEQ ID NO: 1628273 - RNA, 15 nt, Pseudomonas putida KT2440
ccggccgcgccaccg

SEQ ID NO: 1628274 - RNA, 15 nt, Pseudomonas putida KT2440
ccggccggcucgcca

SEQ ID NO: 1628275 - RNA, 22 nt, Pseudomonas putida KT2440
ccggccucuucgcgggcaagcc

SEQ ID NO: 1628276 - RNA, 19 nt, Pseudomonas putida KT2440
ccggcgaauccagccggcc

SEQ ID NO: 1628277 - RNA, 15 nt, Pseudomonas putida KT2440
ccggcgacagcucaa

SEQ ID NO: 1628278 - RNA, 22 nt, Pseudomonas putida KT2440
ccggcgacguucuugccggugg

SEQ ID NO: 1628279 - RNA, 14 nt, Pseudomonas putida KT2440
ccggcgaacagcaa

SEQ ID NO: 1628280 - RNA, 22 nt, Pseudomonas putida KT2440
ccggcgaagcacugucgauggc

SEQ ID NO: 1628281 - RNA, 18 nt, Pseudomonas putida KT2440
ccggccuuuucauccggc

SEQ ID NO: 1628282 - RNA, 21 nt, Pseudomonas putida KT2440
ccggccuguugcgcacugccg

SEQ ID NO: 1628283 - RNA, 16 nt, Pseudomonas putida KT2440
ccggccuugccguaga

SEQ ID NO: 1628284 - RNA, 19 nt, Pseudomonas putida KT2440
ccggccuugcgcaaggcaa

SEQ ID NO: 1628285 - RNA, 21 nt, Pseudomonas putida KT2440
ccgcgcaugaugaaguggcgc

SEQ ID NO: 1628286 - RNA, 17 nt, Pseudomonas putida KT2440
ccgcgcaucauccacca

SEQ ID NO: 1628287 - RNA, 21 nt, Pseudomonas putida KT2440
ccgcgcaucauccaccacccu

SEQ ID NO: 1628288 - RNA, 12 nt, Pseudomonas putida KT2440
ccgcgcaggaag

SEQ ID NO: 1628289 - RNA, 21 nt, Pseudomonas putida KT2440
ccgcgcaaaugcaccccugcc

SEQ ID NO: 1628290 - RNA, 17 nt, Pseudomonas putida KT2440
ccgcgccaccagcccca

SEQ ID NO: 1628291 - RNA, 16 nt, Pseudomonas putida KT2440
ccgcgccagcggccag

SEQ ID NO: 1628292 - RNA, 13 nt, Pseudomonas putida KT2440
ccgcgccagcucc

SEQ ID NO: 1628293 - RNA, 19 nt, Pseudomonas putida KT2440
ccgcgccagcuccgacagg

SEQ ID NO: 1628294 - RNA, 20 nt, Pseudomonas putida KT2440
ccgcgcggcuugcucgcggc

SEQ ID NO: 1628295 - RNA, 15 nt, Pseudomonas putida KT2440
ccgcgcgggcggcgc

SEQ ID NO: 1628296 - RNA, 15 nt, Pseudomonas putida KT2440
ccgcgcucgguugau

SEQ ID NO: 1628297 - RNA, 14 nt, Pseudomonas putida KT2440
ccgcgcguccaugg

SEQ ID NO: 1628298 - RNA, 20 nt, Pseudomonas putida KT2440
ccgcgcuuugugcacaagcu

SEQ ID NO: 1628299 - RNA, 19 nt, Pseudomonas putida KT2440
ccgcgcuuugugugcccac

SEQ ID NO: 1628300 - RNA, 22 nt, Pseudomonas putida KT2440
ccgcgcugguaagccucgagcg

SEQ ID NO: 1628301 - RNA, 14 nt, Pseudomonas putida KT2440
ccgcgcuggcgcgc

SEQ ID NO: 1628302 - RNA, 15 nt, Pseudomonas putida KT2440
ccgcgcuggcgcgcu

SEQ ID NO: 1628303 - RNA, 19 nt, Pseudomonas putida KT2440
ccgcgcuguggcgcccggc

SEQ ID NO: 1628304 - RNA, 15 nt, Pseudomonas putida KT2440
ccgccgccccgcacc

SEQ ID NO: 1628305 - RNA, 23 nt, Pseudomonas putida KT2440
ccgccgauguagucguccugccc

SEQ ID NO: 1628306 - RNA, 13 nt, Pseudomonas putida KT2440
ccgccgaugcgcu

SEQ ID NO: 1628307 - RNA, 17 nt, Pseudomonas putida KT2440
ccgccgaugcgcuucca

SEQ ID NO: 1628308 - RNA, 11 nt, Pseudomonas putida KT2440
ccgccuggccg

SEQ ID NO: 1628309 - RNA, 21 nt, Pseudomonas putida KT2440
ccgccuggccgcugcgcccgc

SEQ ID NO: 1628310 - RNA, 19 nt, Pseudomonas putida KT2440
ccgcgaaacacagcaggcc

SEQ ID NO: 1628311 - RNA, 23 nt, Pseudomonas putida KT2440
ccgcgaaugaucauguccuugcu

SEQ ID NO: 1628312 - RNA, 22 nt, Pseudomonas putida KT2440
ccgcgaauacgguagcggcagc

SEQ ID NO: 1628313 - RNA, 20 nt, Pseudomonas putida KT2440
ccgcgaacaaggcucagcug

SEQ ID NO: 1628314 - RNA, 14 nt, Pseudomonas putida KT2440
ccgcgaacaccggc

SEQ ID NO: 1628315 - RNA, 15 nt, Pseudomonas putida KT2440
ccgcgaagaggcccg

SEQ ID NO: 1628316 - RNA, 22 nt, Pseudomonas putida KT2440
ccgcgaagaggccggaccugcu

SEQ ID NO: 1628317 - RNA, 18 nt, Pseudomonas putida KT2440
ccgcgaagaggccggcac

SEQ ID NO: 1628318 - RNA, 19 nt, Pseudomonas putida KT2440
ccgcgaagaggccggcccc

SEQ ID NO: 1628319 - RNA, 14 nt, Pseudomonas putida KT2440
ccgcgaagcggccc

SEQ ID NO: 1628320 - RNA, 15 nt, Pseudomonas putida KT2440
ccgcgaagcaggcga

SEQ ID NO: 1628321 - RNA, 15 nt, Pseudomonas putida KT2440
ccgcgaagcaggcug

SEQ ID NO: 1628322 - RNA, 15 nt, Pseudomonas putida KT2440
ccgcgaagggccgcg

SEQ ID NO: 1628323 - RNA, 18 nt, Pseudomonas putida KT2440
ccgcgaaggggccggcac

SEQ ID NO: 1628324 - RNA, 23 nt, Pseudomonas putida KT2440
ccgcgaugaugauaccgaacagc

SEQ ID NO: 1628325 - RNA, 24 nt, Pseudomonas putida KT2440
ccgcgacgaaacccaguacggcgc

SEQ ID NO: 1628326 - RNA, 22 nt, Pseudomonas putida KT2440
ccgcgauagcucagucgguaga

SEQ ID NO: 1628327 - RNA, 19 nt, Pseudomonas putida KT2440
ccgcgauaucagcgccagc

SEQ ID NO: 1628328 - RNA, 21 nt, Pseudomonas putida KT2440
ccgcugcugcaguucuuccag

SEQ ID NO: 1628329 - RNA, 14 nt, Pseudomonas putida KT2440
ccgcugcugcgccu

SEQ ID NO: 1628330 - RNA, 16 nt, Pseudomonas putida KT2440
ccgcugcugcggcaac

SEQ ID NO: 1628331 - RNA, 20 nt, Pseudomonas putida KT2440
ccgcugcuggcgcuccaugu

SEQ ID NO: 1628332 - RNA, 22 nt, Pseudomonas putida KT2440
ccgcugcgccgagaggcgcugc

SEQ ID NO: 1628333 - RNA, 15 nt, Pseudomonas putida KT2440
ccgcugcgccugccg

SEQ ID NO: 1628334 - RNA, 19 nt, Pseudomonas putida KT2440
ccgcugcgccugccgggcc

SEQ ID NO: 1628335 - RNA, 13 nt, Pseudomonas putida KT2440
ccgcugcgcacca

SEQ ID NO: 1628336 - RNA, 11 nt, Pseudomonas putida KT2440
ccgcugccugg

SEQ ID NO: 1628337 - RNA, 17 nt, Pseudomonas putida KT2440
ccgcugccugggcacca

SEQ ID NO: 1628338 - RNA, 16 nt, Pseudomonas putida KT2440
ccgcugcacgucgcgc

SEQ ID NO: 1628339 - RNA, 16 nt, Pseudomonas putida KT2440
ccgcugguggcguggc

SEQ ID NO: 1628340 - RNA, 20 nt, Pseudomonas putida KT2440
ccgcuucgccagcgccaccg

SEQ ID NO: 1628341 - RNA, 15 nt, Pseudomonas putida KT2440
ccgcuucgcgaccca

SEQ ID NO: 1628342 - RNA, 19 nt, Pseudomonas putida KT2440
ccgcuccgacaaaugcacc

SEQ ID NO: 1628343 - RNA, 14 nt, Pseudomonas putida KT2440
ccgcucgccuggcc

SEQ ID NO: 1628344 - RNA, 16 nt, Pseudomonas putida KT2440
ccgcucgcccagcagc

SEQ ID NO: 1628345 - RNA, 13 nt, Pseudomonas putida KT2440
ccgcucccgcccc

SEQ ID NO: 1628346 - RNA, 14 nt, Pseudomonas putida KT2440
ccgcuccuacacag

SEQ ID NO: 1628347 - RNA, 18 nt, Pseudomonas putida KT2440
ccgcuccuacacagguca

SEQ ID NO: 1628348 - RNA, 21 nt, Pseudomonas putida KT2440
ccgcuccuacagguucugcgc

SEQ ID NO: 1628349 - RNA, 21 nt, Pseudomonas putida KT2440
ccgcuccuacgaaagccgcgu

SEQ ID NO: 1628350 - RNA, 20 nt, Pseudomonas putida KT2440
ccgcuccuacgcggggcagc

SEQ ID NO: 1628351 - RNA, 23 nt, Pseudomonas putida KT2440
ccgcuccuacgggcaaccgcauc

SEQ ID NO: 1628352 - RNA, 18 nt, Pseudomonas putida KT2440
ccgcuccugcggucagcc

SEQ ID NO: 1628353 - RNA, 16 nt, Pseudomonas putida KT2440
ccgcugauaaccugca

SEQ ID NO: 1628354 - RNA, 17 nt, Pseudomonas putida KT2440
ccgcugcacaggccagc

SEQ ID NO: 1628355 - RNA, 22 nt, Pseudomonas putida KT2440
ccgcugcacaggccagccccag

SEQ ID NO: 1628356 - RNA, 23 nt, Pseudomonas putida KT2440
ccgcugauggccaauaccgcugc

SEQ ID NO: 1628357 - RNA, 20 nt, Pseudomonas putida KT2440
ccgcggcgaacacagcggcc

SEQ ID NO: 1628358 - RNA, 20 nt, Pseudomonas putida KT2440
ccgcggaugcgccuggcccg

SEQ ID NO: 1628359 - RNA, 22 nt, Pseudomonas putida KT2440
ccgcggcacccaauagcccacc

SEQ ID NO: 1628360 - RNA, 15 nt, Pseudomonas putida KT2440
ccgcuacgcgccccu

SEQ ID NO: 1628361 - RNA, 15 nt, Pseudomonas putida KT2440
ccgcucccacaggaa

SEQ ID NO: 1628362 - RNA, 22 nt, Pseudomonas putida KT2440
ccgcucccacaggaauggcacc

SEQ ID NO: 1628363 - RNA, 15 nt, Pseudomonas putida KT2440
ccgcucccacaggga

SEQ ID NO: 1628364 - RNA, 21 nt, Pseudomonas putida KT2440
ccgcuccaaauaaagaucuac

SEQ ID NO: 1628365 - RNA, 13 nt, Pseudomonas putida KT2440
ccgcucagugccg

SEQ ID NO: 1628366 - RNA, 17 nt, Pseudomonas putida KT2440
ccgaugcugugccgggc

SEQ ID NO: 1628367 - RNA, 18 nt, Pseudomonas putida KT2440
ccgaugcggugcagcacc

SEQ ID NO: 1628368 - RNA, 22 nt, Pseudomonas putida KT2440
ccgaugcgcuuccacuuggugg

SEQ ID NO: 1628369 - RNA, 19 nt, Pseudomonas putida KT2440
ccgaucgaagcagcagcuu

SEQ ID NO: 1628370 - RNA, 13 nt, Pseudomonas putida KT2440
ccgauagcagcac

SEQ ID NO: 1628371 - RNA, 15 nt, Pseudomonas putida KT2440
ccgauagccagcugg

SEQ ID NO: 1628372 - RNA, 18 nt, Pseudomonas putida KT2440
ccgauaccgcccacuucu

SEQ ID NO: 1628373 - RNA, 22 nt, Pseudomonas putida KT2440
ccgaggccggguuuuucaugaa

SEQ ID NO: 1628374 - RNA, 16 nt, Pseudomonas putida KT2440
ccgagcgcggcgccca

SEQ ID NO: 1628375 - RNA, 21 nt, Pseudomonas putida KT2440
ccgaggacaacaaggacugcc

SEQ ID NO: 1628376 - RNA, 23 nt, Pseudomonas putida KT2440
ccgaggacauaccacacacccca

SEQ ID NO: 1628377 - RNA, 18 nt, Pseudomonas putida KT2440
ccgacuggcgcaccagcg

SEQ ID NO: 1628378 - RNA, 15 nt, Pseudomonas putida KT2440
ccgacuuccccggcg

SEQ ID NO: 1628379 - RNA, 17 nt, Pseudomonas putida KT2440
ccgacucuucaccagcu

SEQ ID NO: 1628380 - RNA, 21 nt, Pseudomonas putida KT2440
ccgacugacgcuacgccgccc

SEQ ID NO: 1628381 - RNA, 20 nt, Pseudomonas putida KT2440
ccgacucuacugcccgcagc

SEQ ID NO: 1628382 - RNA, 13 nt, Pseudomonas putida KT2440
ccgagcggagcug

SEQ ID NO: 1628383 - RNA, 14 nt, Pseudomonas putida KT2440
ccgacggcauggcc

SEQ ID NO: 1628384 - RNA, 17 nt, Pseudomonas putida KT2440
ccgacggcggugauaug

SEQ ID NO: 1628385 - RNA, 16 nt, Pseudomonas putida KT2440
ccgacggauuggaaaa

SEQ ID NO: 1628386 - RNA, 15 nt, Pseudomonas putida KT2440
ccgaccugcaacguc

SEQ ID NO: 1628387 - RNA, 14 nt, Pseudomonas putida KT2440
ccgacccugcugcu

SEQ ID NO: 1628388 - RNA, 14 nt, Pseudomonas putida KT2440
ccgaccgccagccc

SEQ ID NO: 1628389 - RNA, 22 nt, Pseudomonas putida KT2440
ccgaccgcaccggccaccgugg

SEQ ID NO: 1628390 - RNA, 22 nt, Pseudomonas putida KT2440
ccgaccgguggccugagccggu

SEQ ID NO: 1628391 - RNA, 19 nt, Pseudomonas putida KT2440
ccgacacagucgucggcac

SEQ ID NO: 1628392 - RNA, 19 nt, Pseudomonas putida KT2440
ccgacacgcggcaauccgc

SEQ ID NO: 1628393 - RNA, 13 nt, Pseudomonas putida KT2440
ccgacaaaaacaa

SEQ ID NO: 1628394 - RNA, 19 nt, Pseudomonas putida KT2440
ccgacaaagaagcgccgca

SEQ ID NO: 1628395 - RNA, 22 nt, Pseudomonas putida KT2440
ccgaaggggcggguggaggugc

SEQ ID NO: 1628396 - RNA, 15 nt, Pseudomonas putida KT2440
ccgaaggccgccggc

SEQ ID NO: 1628397 - RNA, 18 nt, Pseudomonas putida KT2440
ccgaaggccuucauggug

SEQ ID NO: 1628398 - RNA, 12 nt, Pseudomonas putida KT2440
ccgaccaaauga

SEQ ID NO: 1628399 - RNA, 14 nt, Pseudomonas putida KT2440
ccgaccaaggccaa

SEQ ID NO: 1628400 - RNA, 15 nt, Pseudomonas putida KT2440
ccgaccaccgccucg

SEQ ID NO: 1628401 - RNA, 23 nt, Pseudomonas putida KT2440
ccgaccacuucgaugguguucug

SEQ ID NO: 1628402 - RNA, 21 nt, Pseudomonas putida KT2440
ccgacccacaggcacaggccc

SEQ ID NO: 1628403 - RNA, 15 nt, Pseudomonas putida KT2440
ccgacaggguuacca

SEQ ID NO: 1628404 - RNA, 19 nt, Pseudomonas putida KT2440
ccgacagcuugcccagcug

SEQ ID NO: 1628405 - RNA, 13 nt, Pseudomonas putida KT2440
ccgacaaugccag

SEQ ID NO: 1628406 - RNA, 22 nt, Pseudomonas putida KT2440
ccgacaguguugccggcgagcg

SEQ ID NO: 1628407 - RNA, 22 nt, Pseudomonas putida KT2440
ccgacaguucgaaaccacccug

SEQ ID NO: 1628408 - RNA, 16 nt, Pseudomonas putida KT2440
cccuuuuaucugguug

SEQ ID NO: 1628409 - RNA, 20 nt, Pseudomonas putida KT2440
cccuuuguuuuuaucaggug

SEQ ID NO: 1628410 - RNA, 17 nt, Pseudomonas putida KT2440
cccuuugguacugcgcc

SEQ ID NO: 1628411 - RNA, 15 nt, Pseudomonas putida KT2440
ccgaaacgcgacagg

SEQ ID NO: 1628412 - RNA, 14 nt, Pseudomonas putida KT2440
ccgaacaaaacccu

SEQ ID NO: 1628413 - RNA, 17 nt, Pseudomonas putida KT2440
ccgaacuccccaccagg

SEQ ID NO: 1628414 - RNA, 16 nt, Pseudomonas putida KT2440
ccgaacucuggcaaca

SEQ ID NO: 1628415 - RNA, 21 nt, Pseudomonas putida KT2440
ccgaacgcgguaagcaccacc

SEQ ID NO: 1628416 - RNA, 23 nt, Pseudomonas putida KT2440
cccuuucgcgggagacccguucc

SEQ ID NO: 1628417 - RNA, 21 nt, Pseudomonas putida KT2440
cccuuucgcggguaaacccgc

SEQ ID NO: 1628418 - RNA, 15 nt, Pseudomonas putida KT2440
cccuugggcucagcc

SEQ ID NO: 1628419 - RNA, 18 nt, Pseudomonas putida KT2440
cccucgcccacucacgca

SEQ ID NO: 1628420 - RNA, 22 nt, Pseudomonas putida KT2440
cccucgcccagaaucucaacca

SEQ ID NO: 1628421 - RNA, 15 nt, Pseudomonas putida KT2440
cccucgcaccacagu

SEQ ID NO: 1628422 - RNA, 18 nt, Pseudomonas putida KT2440
cccuuggcagcgcugcaa

SEQ ID NO: 1628423 - RNA, 10 nt, Pseudomonas putida KT2440
cccuuggcca

SEQ ID NO: 1628424 - RNA, 20 nt, Pseudomonas putida KT2440
cccuuggccaccuucacccc

SEQ ID NO: 1628425 - RNA, 20 nt, Pseudomonas putida KT2440
cccucggccggggccaggcg

SEQ ID NO: 1628426 - RNA, 22 nt, Pseudomonas putida KT2440
cccucggccaccuggccuucca

SEQ ID NO: 1628427 - RNA, 18 nt, Pseudomonas putida KT2440
ccgcaugcucgcugcugc

SEQ ID NO: 1628428 - RNA, 20 nt, Pseudomonas putida KT2440
ccgcaugcucgcugcugccu

SEQ ID NO: 1628429 - RNA, 18 nt, Pseudomonas putida KT2440
ccgcauugcaggccagcg

SEQ ID NO: 1628430 - RNA, 17 nt, Pseudomonas putida KT2440
ccgcauucuuggccagg

SEQ ID NO: 1628431 - RNA, 12 nt, Pseudomonas putida KT2440
ccgcauccugcg

SEQ ID NO: 1628432 - RNA, 14 nt, Pseudomonas putida KT2440
ccgcauccugcgug

SEQ ID NO: 1628433 - RNA, 16 nt, Pseudomonas putida KT2440
ccgcauccugcgugcu

SEQ ID NO: 1628434 - RNA, 19 nt, Pseudomonas putida KT2440
ccgcauccagcacugccug

SEQ ID NO: 1628435 - RNA, 15 nt, Pseudomonas putida KT2440
ccgcauccgcacccc

SEQ ID NO: 1628436 - RNA, 15 nt, Pseudomonas putida KT2440
ccgcauccccggccu

SEQ ID NO: 1628437 - RNA, 16 nt, Pseudomonas putida KT2440
ccgccaagcggcccca

SEQ ID NO: 1628438 - RNA, 17 nt, Pseudomonas putida KT2440
ccgccaagcggccccaa

SEQ ID NO: 1628439 - RNA, 21 nt, Pseudomonas putida KT2440
ccgccaagggucgacaccagg

SEQ ID NO: 1628440 - RNA, 16 nt, Pseudomonas putida KT2440
ccgccaagguaaucug

SEQ ID NO: 1628441 - RNA, 19 nt, Pseudomonas putida KT2440
ccgccaagguaaucuggcu

SEQ ID NO: 1628442 - RNA, 19 nt, Pseudomonas putida KT2440
ccgccaacuguuucugcuc

SEQ ID NO: 1628443 - RNA, 14 nt, Pseudomonas putida KT2440
ccgccaagcacgca

SEQ ID NO: 1628444 - RNA, 11 nt, Pseudomonas putida KT2440
ccgccaacagc

SEQ ID NO: 1628445 - RNA, 17 nt, Pseudomonas putida KT2440
ccgccaacaccaccucc

SEQ ID NO: 1628446 - RNA, 21 nt, Pseudomonas putida KT2440
ccgccaaaaaauccgccuggc

SEQ ID NO: 1628447 - RNA, 15 nt, Pseudomonas putida KT2440
ccgccaaaccccagc

SEQ ID NO: 1628448 - RNA, 11 nt, Pseudomonas putida KT2440
ccgccaccaga

SEQ ID NO: 1628449 - RNA, 13 nt, Pseudomonas putida KT2440
ccgccacccccgc

SEQ ID NO: 1628450 - RNA, 18 nt, Pseudomonas putida KT2440
ccgccaccaucggccagg

SEQ ID NO: 1628451 - RNA, 12 nt, Pseudomonas putida KT2440
ccgccacccacc

SEQ ID NO: 1628452 - RNA, 14 nt, Pseudomonas putida KT2440
ccgccacaccgaag

SEQ ID NO: 1628453 - RNA, 17 nt, Pseudomonas putida KT2440
ccgccaauugcgccagc

SEQ ID NO: 1628454 - RNA, 18 nt, Pseudomonas putida KT2440
ccgccaauugcgccagcc

SEQ ID NO: 1628455 - RNA, 11 nt, Pseudomonas putida KT2440
ccgccaccacg

SEQ ID NO: 1628456 - RNA, 17 nt, Pseudomonas putida KT2440
ccgcacgauccccggcc

SEQ ID NO: 1628457 - RNA, 23 nt, Pseudomonas putida KT2440
ccgcagcaacaguuucuugccuu

SEQ ID NO: 1628458 - RNA, 15 nt, Pseudomonas putida KT2440
ccgcagcgcuucgau

SEQ ID NO: 1628459 - RNA, 20 nt, Pseudomonas putida KT2440
ccgcagccucuucggccagc

SEQ ID NO: 1628460 - RNA, 16 nt, Pseudomonas putida KT2440
ccgcagcaaucugcug

SEQ ID NO: 1628461 - RNA, 17 nt, Pseudomonas putida KT2440
ccgcagcaaucugcugg

SEQ ID NO: 1628462 - RNA, 17 nt, Pseudomonas putida KT2440
ccgauggcgcaaacccu

SEQ ID NO: 1628463 - RNA, 18 nt, Pseudomonas putida KT2440
ccgcacaaggccgcuccc

SEQ ID NO: 1628464 - RNA, 16 nt, Pseudomonas putida KT2440
ccgcaccugcccgccc

SEQ ID NO: 1628465 - RNA, 12 nt, Pseudomonas putida KT2440
ccgcacccggcg

SEQ ID NO: 1628466 - RNA, 15 nt, Pseudomonas putida KT2440
ccgccagcggcaagc

SEQ ID NO: 1628467 - RNA, 14 nt, Pseudomonas putida KT2440
ccgccagcauggcc

SEQ ID NO: 1628468 - RNA, 15 nt, Pseudomonas putida KT2440
ccgccagcccgccac

SEQ ID NO: 1628469 - RNA, 17 nt, Pseudomonas putida KT2440
ccgccagcccgccacac

SEQ ID NO: 1628470 - RNA, 15 nt, Pseudomonas putida KT2440
ccgccagcuccacca

SEQ ID NO: 1628471 - RNA, 20 nt, Pseudomonas putida KT2440
ccgccagcgugcccgccaca

SEQ ID NO: 1628472 - RNA, 15 nt, Pseudomonas putida KT2440
ccgccagcggcgugu

SEQ ID NO: 1628473 - RNA, 16 nt, Pseudomonas putida KT2440
ccgccaggcucuccag

SEQ ID NO: 1628474 - RNA, 19 nt, Pseudomonas putida KT2440
ccgccaggcucuccagccg

SEQ ID NO: 1628475 - RNA, 18 nt, Pseudomonas putida KT2440
ccgccaggcccaccaccg

SEQ ID NO: 1628476 - RNA, 22 nt, Pseudomonas putida KT2440
ccgccagguauucggcaaugcg

SEQ ID NO: 1628477 - RNA, 21 nt, Pseudomonas putida KT2440
ccgccaguagcaaucagguca

SEQ ID NO: 1628478 - RNA, 20 nt, Pseudomonas putida KT2440
ccgccaguaggcugcagccu

SEQ ID NO: 1628479 - RNA, 14 nt, Pseudomonas putida KT2440
ccgccagaucaucg

SEQ ID NO: 1628480 - RNA, 19 nt, Pseudomonas putida KT2440
ccgccagagcauggccagc

SEQ ID NO: 1628481 - RNA, 23 nt, Pseudomonas putida KT2440
ccgccagagcauggccagccggc

SEQ ID NO: 1628482 - RNA, 19 nt, Pseudomonas putida KT2440
ccgccagaaaauucucccg

SEQ ID NO: 1628483 - RNA, 21 nt, Pseudomonas putida KT2440
ccgccagaaaauucucccggg

SEQ ID NO: 1628484 - RNA, 21 nt, Pseudomonas putida KT2440
ccgccacugaccagcccggcu

SEQ ID NO: 1628485 - RNA, 14 nt, Pseudomonas putida KT2440
ccgccacggugccg

SEQ ID NO: 1628486 - RNA, 22 nt, Pseudomonas putida KT2440
ccgccaccuuguucgagcgcca

SEQ ID NO: 1628487 - RNA, 23 nt, Pseudomonas putida KT2440
ccgccacgaucgacaaccccagc

SEQ ID NO: 1628488 - RNA, 13 nt, Pseudomonas putida KT2440
ccgccaccgccuc

SEQ ID NO: 1628489 - RNA, 15 nt, Pseudomonas putida KT2440
ccgcccgcgcggcgc

SEQ ID NO: 1628490 - RNA, 19 nt, Pseudomonas putida KT2440
ccgccgaacucuggcaaca

SEQ ID NO: 1628491 - RNA, 15 nt, Pseudomonas putida KT2440
ccgccgaagccauga

SEQ ID NO: 1628492 - RNA, 17 nt, Pseudomonas putida KT2440
ccgccgaacaggccggc

SEQ ID NO: 1628493 - RNA, 19 nt, Pseudomonas putida KT2440
ccgccgauagcagcaccga

SEQ ID NO: 1628494 - RNA, 20 nt, Pseudomonas putida KT2440
ccgccgaucgaagcagcagc

SEQ ID NO: 1628495 - RNA, 18 nt, Pseudomonas putida KT2440
ccgccagugcaaacuggc

SEQ ID NO: 1628496 - RNA, 21 nt, Pseudomonas putida KT2440
ccgcccaaagaaaagcccgca

SEQ ID NO: 1628497 - RNA, 18 nt, Pseudomonas putida KT2440
ccgcccaauuuggccagc

SEQ ID NO: 1628498 - RNA, 21 nt, Pseudomonas putida KT2440
ccgcccaauuuggccagcuuc

SEQ ID NO: 1628499 - RNA, 16 nt, Pseudomonas putida KT2440
ccgcccaagcggcaga

SEQ ID NO: 1628500 - RNA, 13 nt, Pseudomonas putida KT2440
ccgcccacccacc

SEQ ID NO: 1628501 - RNA, 14 nt, Pseudomonas putida KT2440
ccgcccacccacca

SEQ ID NO: 1628502 - RNA, 13 nt, Pseudomonas putida KT2440
ccgcccaccacca

SEQ ID NO: 1628503 - RNA, 17 nt, Pseudomonas putida KT2440
ccgcccaccaccagccc

SEQ ID NO: 1628504 - RNA, 20 nt, Pseudomonas putida KT2440
cauccucaaaggcagccucg

SEQ ID NO: 1628505 - RNA, 17 nt, Pseudomonas putida KT2440
cauccucaagcugcacc

SEQ ID NO: 1628506 - RNA, 15 nt, Pseudomonas putida KT2440
cauccuccgcccugc

SEQ ID NO: 1628507 - RNA, 18 nt, Pseudomonas putida KT2440
cauccuccgcccugcccu

SEQ ID NO: 1628508 - RNA, 13 nt, Pseudomonas putida KT2440
caucgacaggucc

SEQ ID NO: 1628509 - RNA, 20 nt, Pseudomonas putida KT2440
caucgacagguccaccgcuu

SEQ ID NO: 1628510 - RNA, 17 nt, Pseudomonas putida KT2440
caucgacaaucggcuca

SEQ ID NO: 1628511 - RNA, 23 nt, Pseudomonas putida KT2440
caucgacaaucggcucaacagcc

SEQ ID NO: 1628512 - RNA, 14 nt, Pseudomonas putida KT2440
caucgcccauugcc

SEQ ID NO: 1628513 - RNA, 18 nt, Pseudomonas putida KT2440
caucgccccaggagggcu

SEQ ID NO: 1628514 - RNA, 17 nt, Pseudomonas putida KT2440
caucgccccgcgccgcc

SEQ ID NO: 1628515 - RNA, 17 nt, Pseudomonas putida KT2440
caucgccagcagcgcuc

SEQ ID NO: 1628516 - RNA, 20 nt, Pseudomonas putida KT2440
caucgaccugccacugcgcu

SEQ ID NO: 1628517 - RNA, 19 nt, Pseudomonas putida KT2440
caucgacccuggcauagca

SEQ ID NO: 1628518 - RNA, 14 nt, Pseudomonas putida KT2440
caucgacucacgcu

SEQ ID NO: 1628519 - RNA, 15 nt, Pseudomonas putida KT2440
caucgaggcgcgcgc

SEQ ID NO: 1628520 - RNA, 13 nt, Pseudomonas putida KT2440
caucgaggaaagg

SEQ ID NO: 1628521 - RNA, 16 nt, Pseudomonas putida KT2440
caucgaggaaagggca

SEQ ID NO: 1628522 - RNA, 15 nt, Pseudomonas putida KT2440
caucggcggcaaugu

SEQ ID NO: 1628523 - RNA, 14 nt, Pseudomonas putida KT2440
caucuuccugccac

SEQ ID NO: 1628524 - RNA, 18 nt, Pseudomonas putida KT2440
caucuuccugccacucgu

SEQ ID NO: 1628525 - RNA, 16 nt, Pseudomonas putida KT2440
caucuucgacaguuca

SEQ ID NO: 1628526 - RNA, 21 nt, Pseudomonas putida KT2440
caucuucgacaguucaagcac

SEQ ID NO: 1628527 - RNA, 17 nt, Pseudomonas putida KT2440
caucuucgaggucaucg

SEQ ID NO: 1628528 - RNA, 21 nt, Pseudomonas putida KT2440
caucuuccggcaccccuuucu

SEQ ID NO: 1628529 - RNA, 16 nt, Pseudomonas putida KT2440
caucuucuuccccguc

SEQ ID NO: 1628530 - RNA, 18 nt, Pseudomonas putida KT2440
caucuucuugcaguucuu

SEQ ID NO: 1628531 - RNA, 16 nt, Pseudomonas putida KT2440
caucuugcugcucugc

SEQ ID NO: 1628532 - RNA, 15 nt, Pseudomonas putida KT2440
caucugcucccccag

SEQ ID NO: 1628533 - RNA, 20 nt, Pseudomonas putida KT2440
caucugucagcgccagcggc

SEQ ID NO: 1628534 - RNA, 16 nt, Pseudomonas putida KT2440
caucuucacggcaagc

SEQ ID NO: 1628535 - RNA, 13 nt, Pseudomonas putida KT2440
caucuuccagccu

SEQ ID NO: 1628536 - RNA, 16 nt, Pseudomonas putida KT2440
caucuuccagccugca

SEQ ID NO: 1628537 - RNA, 18 nt, Pseudomonas putida KT2440
caucucgcaaacggucaa

SEQ ID NO: 1628538 - RNA, 15 nt, Pseudomonas putida KT2440
caucucgcccaugcg

SEQ ID NO: 1628539 - RNA, 19 nt, Pseudomonas putida KT2440
caucucuuugagaugcccu

SEQ ID NO: 1628540 - RNA, 22 nt, Pseudomonas putida KT2440
caucugccgggucggccugcuc

SEQ ID NO: 1628541 - RNA, 21 nt, Pseudomonas putida KT2440
caucugcgccccgcucgccug

SEQ ID NO: 1628542 - RNA, 13 nt, Pseudomonas putida KT2440
caucugcugaucu

SEQ ID NO: 1628543 - RNA, 24 nt, Pseudomonas putida KT2440
caucgguuucgccgguguucuuca

SEQ ID NO: 1628544 - RNA, 19 nt, Pseudomonas putida KT2440
caucaccuuggccgcccgg

SEQ ID NO: 1628545 - RNA, 17 nt, Pseudomonas putida KT2440
caucaccgcccgcgccg

SEQ ID NO: 1628546 - RNA, 14 nt, Pseudomonas putida KT2440
caucacgaaauccu

SEQ ID NO: 1628547 - RNA, 17 nt, Pseudomonas putida KT2440
caucacgccgcgcuggc

SEQ ID NO: 1628548 - RNA, 19 nt, Pseudomonas putida KT2440
caucagcgcagcaucuucc

SEQ ID NO: 1628549 - RNA, 16 nt, Pseudomonas putida KT2440
caucagccgcgcccuc

SEQ ID NO: 1628550 - RNA, 17 nt, Pseudomonas putida KT2440
caucagccgcgcccucu

SEQ ID NO: 1628551 - RNA, 19 nt, Pseudomonas putida KT2440
caucagccgcgcccucuuc

SEQ ID NO: 1628552 - RNA, 15 nt, Pseudomonas putida KT2440
caucagccgcgggcu

SEQ ID NO: 1628553 - RNA, 13 nt, Pseudomonas putida KT2440
caucacggccugc

SEQ ID NO: 1628554 - RNA, 16 nt, Pseudomonas putida KT2440
caucacggcgcaggcc

SEQ ID NO: 1628555 - RNA, 14 nt, Pseudomonas putida KT2440
caucagugcccccg

SEQ ID NO: 1628556 - RNA, 16 nt, Pseudomonas putida KT2440
caucagugcccccgcc

SEQ ID NO: 1628557 - RNA, 21 nt, Pseudomonas putida KT2440
caucaggccgaugccaagcac

SEQ ID NO: 1628558 - RNA, 23 nt, Pseudomonas putida KT2440
caucaggccgaugccaagcaccg

SEQ ID NO: 1628559 - RNA, 18 nt, Pseudomonas putida KT2440
caucaggugcagcaacag

SEQ ID NO: 1628560 - RNA, 19 nt, Pseudomonas putida KT2440
caucaggugcagcaacagg

SEQ ID NO: 1628561 - RNA, 16 nt, Pseudomonas putida KT2440
caucagguagcugggc

SEQ ID NO: 1628562 - RNA, 14 nt, Pseudomonas putida KT2440
caucaucugcugau

SEQ ID NO: 1628563 - RNA, 13 nt, Pseudomonas putida KT2440
cauccaccacccu

SEQ ID NO: 1628564 - RNA, 14 nt, Pseudomonas putida KT2440
cauccaccagcccc

SEQ ID NO: 1628565 - RNA, 18 nt, Pseudomonas putida KT2440
cauccacggcguugcccc

SEQ ID NO: 1628566 - RNA, 14 nt, Pseudomonas putida KT2440
cauccaccgcccca

SEQ ID NO: 1628567 - RNA, 23 nt, Pseudomonas putida KT2440
cauccaccgccccaagcgccuga

SEQ ID NO: 1628568 - RNA, 21 nt, Pseudomonas putida KT2440
cauccaccgcggugucuucuu

SEQ ID NO: 1628569 - RNA, 22 nt, Pseudomonas putida KT2440
cauccaccgcggugucuucuuc

SEQ ID NO: 1628570 - RNA, 18 nt, Pseudomonas putida KT2440
cauccaccgcucgcgccg

SEQ ID NO: 1628571 - RNA, 19 nt, Pseudomonas putida KT2440
caucauccaccacccuggc

SEQ ID NO: 1628572 - RNA, 12 nt, Pseudomonas putida KT2440
caucaucaucuu

SEQ ID NO: 1628573 - RNA, 13 nt, Pseudomonas putida KT2440
caucaucaucuuc

SEQ ID NO: 1628574 - RNA, 14 nt, Pseudomonas putida KT2440
caucauccugcugg

SEQ ID NO: 1628575 - RNA, 22 nt, Pseudomonas putida KT2440
caucauccgagcugagcagcgg

SEQ ID NO: 1628576 - RNA, 19 nt, Pseudomonas putida KT2440
caucaagcggcugguauug

SEQ ID NO: 1628577 - RNA, 22 nt, Pseudomonas putida KT2440
caucacccgggaacagcagcac

SEQ ID NO: 1628578 - RNA, 11 nt, Pseudomonas putida KT2440
caucacccagu

SEQ ID NO: 1628579 - RNA, 12 nt, Pseudomonas putida KT2440
caucacccgccc

SEQ ID NO: 1628580 - RNA, 14 nt, Pseudomonas putida KT2440
caucaaaccagaua

SEQ ID NO: 1628581 - RNA, 16 nt, Pseudomonas putida KT2440
caucaaaagccccccu

SEQ ID NO: 1628582 - RNA, 23 nt, Pseudomonas putida KT2440
cauauggcgcuuucacuggcgau

SEQ ID NO: 1628583 - RNA, 14 nt, Pseudomonas putida KT2440
cauaugccccaggc

SEQ ID NO: 1628584 - RNA, 14 nt, Pseudomonas putida KT2440
cauaugcagggccu

SEQ ID NO: 1628585 - RNA, 19 nt, Pseudomonas putida KT2440
cauaugcagggccuuuuca

SEQ ID NO: 1628586 - RNA, 20 nt, Pseudomonas putida KT2440
cauugcaccacccccagcgc

SEQ ID NO: 1628587 - RNA, 21 nt, Pseudomonas putida KT2440
cauugcaccacccccagcgcc

SEQ ID NO: 1628588 - RNA, 13 nt, Pseudomonas putida KT2440
cauugcagcccca

SEQ ID NO: 1628589 - RNA, 17 nt, Pseudomonas putida KT2440
cauugcaagguccuugu

SEQ ID NO: 1628590 - RNA, 14 nt, Pseudomonas putida KT2440
cauugaugaacgac

SEQ ID NO: 1628591 - RNA, 20 nt, Pseudomonas putida KT2440
cauuggcaaacgccuguuuc

SEQ ID NO: 1628592 - RNA, 19 nt, Pseudomonas putida KT2440
cauugccuguuccggcccu

SEQ ID NO: 1628593 - RNA, 21 nt, Pseudomonas putida KT2440
cauuggaaaaugaugcagaug

SEQ ID NO: 1628594 - RNA, 16 nt, Pseudomonas putida KT2440
cauuggacgauuguaa

SEQ ID NO: 1628595 - RNA, 17 nt, Pseudomonas putida KT2440
cauuggccaaccagccg

SEQ ID NO: 1628596 - RNA, 21 nt, Pseudomonas putida KT2440
cauuggccaaccagccggcaa

SEQ ID NO: 1628597 - RNA, 16 nt, Pseudomonas putida KT2440
cauuguucgccucguc

SEQ ID NO: 1628598 - RNA, 12 nt, Pseudomonas putida KT2440
cauugaagaagc

SEQ ID NO: 1628599 - RNA, 18 nt, Pseudomonas putida KT2440
cauugacccgcuugcagu

SEQ ID NO: 1628600 - RNA, 22 nt, Pseudomonas putida KT2440
cauugacccgcuugcaguuguc

SEQ ID NO: 1628601 - RNA, 20 nt, Pseudomonas putida KT2440
cauugagcuguuucaugcug

SEQ ID NO: 1628602 - RNA, 15 nt, Pseudomonas putida KT2440
cauuugcagcacaag

SEQ ID NO: 1628603 - RNA, 21 nt, Pseudomonas putida KT2440
cauuuggcgccggugugcauu

SEQ ID NO: 1628604 - RNA, 21 nt, Pseudomonas putida KT2440
cauuuucggcaaggcgaccug

SEQ ID NO: 1628605 - RNA, 15 nt, Pseudomonas putida KT2440
cauuuucaucaaaag

SEQ ID NO: 1628606 - RNA, 22 nt, Pseudomonas putida KT2440
cauuuuggauuuuuuguagauu

SEQ ID NO: 1628607 - RNA, 15 nt, Pseudomonas putida KT2440
cauuaccauccauca

SEQ ID NO: 1628608 - RNA, 18 nt, Pseudomonas putida KT2440
cauuacccggcagaauca

SEQ ID NO: 1628609 - RNA, 23 nt, Pseudomonas putida KT2440
cauggucgcguuguucagcagcg

SEQ ID NO: 1628610 - RNA, 16 nt, Pseudomonas putida KT2440
cauggugauggucugg

SEQ ID NO: 1628611 - RNA, 18 nt, Pseudomonas putida KT2440
cauggucaacagcccggu

SEQ ID NO: 1628612 - RNA, 15 nt, Pseudomonas putida KT2440
cauggucaccacgcc

SEQ ID NO: 1628613 - RNA, 17 nt, Pseudomonas putida KT2440
cauggugggucguguag

SEQ ID NO: 1628614 - RNA, 21 nt, Pseudomonas putida KT2440
caugguguugggcaggguguc

SEQ ID NO: 1628615 - RNA, 16 nt, Pseudomonas putida KT2440
caugugcgccacuucc

SEQ ID NO: 1628616 - RNA, 20 nt, Pseudomonas putida KT2440
caugugcacuggcaggccuu

SEQ ID NO: 1628617 - RNA, 18 nt, Pseudomonas putida KT2440
cauguugucacccagcac

SEQ ID NO: 1628618 - RNA, 15 nt, Pseudomonas putida KT2440
cauguugugcuggcg

SEQ ID NO: 1628619 - RNA, 17 nt, Pseudomonas putida KT2440
cauguugcgcagcaauc

SEQ ID NO: 1628620 - RNA, 14 nt, Pseudomonas putida KT2440
caugcacuuccagg

SEQ ID NO: 1628621 - RNA, 23 nt, Pseudomonas putida KT2440
caugcaacggcacacgcaccacc

SEQ ID NO: 1628622 - RNA, 19 nt, Pseudomonas putida KT2440
caugaaaaacaacaaccaa

SEQ ID NO: 1628623 - RNA, 17 nt, Pseudomonas putida KT2440
caugcccgcgaagggcu

SEQ ID NO: 1628624 - RNA, 17 nt, Pseudomonas putida KT2440
caugcccgcucccacag

SEQ ID NO: 1628625 - RNA, 16 nt, Pseudomonas putida KT2440
caugcccauggccagc

SEQ ID NO: 1628626 - RNA, 21 nt, Pseudomonas putida KT2440
caugccccgggugcagccgca

SEQ ID NO: 1628627 - RNA, 21 nt, Pseudomonas putida KT2440
caugccccucgaacagcgccg

SEQ ID NO: 1628628 - RNA, 16 nt, Pseudomonas putida KT2440
caugccguaagccgca

SEQ ID NO: 1628629 - RNA, 22 nt, Pseudomonas putida KT2440
caugccguaagccgcaggccaa

SEQ ID NO: 1628630 - RNA, 23 nt, Pseudomonas putida KT2440
caugccguaagccgcaggccaau

SEQ ID NO: 1628631 - RNA, 14 nt, Pseudomonas putida KT2440
caugcgcggguccg

SEQ ID NO: 1628632 - RNA, 14 nt, Pseudomonas putida KT2440
caugcgccgcugcu

SEQ ID NO: 1628633 - RNA, 21 nt, Pseudomonas putida KT2440
caugcgcgcgcgguucaccag

SEQ ID NO: 1628634 - RNA, 15 nt, Pseudomonas putida KT2440
caugcgcgacagcau

SEQ ID NO: 1628635 - RNA, 16 nt, Pseudomonas putida KT2440
caugcgccacacccgc

SEQ ID NO: 1628636 - RNA, 19 nt, Pseudomonas putida KT2440
caugcgcacggucuccggc

SEQ ID NO: 1628637 - RNA, 17 nt, Pseudomonas putida KT2440
caugcgcccuggcggcc

SEQ ID NO: 1628638 - RNA, 18 nt, Pseudomonas putida KT2440
caugccugugauuuacgc

SEQ ID NO: 1628639 - RNA, 17 nt, Pseudomonas putida KT2440
caugccuuccugcaccu

SEQ ID NO: 1628640 - RNA, 14 nt, Pseudomonas putida KT2440
caugcgaccaguac

SEQ ID NO: 1628641 - RNA, 18 nt, Pseudomonas putida KT2440
caugcgaugguacagcuc

SEQ ID NO: 1628642 - RNA, 24 nt, Pseudomonas putida KT2440
caugcgaugguacagcucacuggc

SEQ ID NO: 1628643 - RNA, 15 nt, Pseudomonas putida KT2440
cauggaucagcucau

SEQ ID NO: 1628644 - RNA, 17 nt, Pseudomonas putida KT2440
cauggcaaacagcacca

SEQ ID NO: 1628645 - RNA, 22 nt, Pseudomonas putida KT2440
cauggcuugcguuucuucaucc

SEQ ID NO: 1628646 - RNA, 20 nt, Pseudomonas putida KT2440
cauggggucaguucagccag

SEQ ID NO: 1628647 - RNA, 23 nt, Pseudomonas putida KT2440
cauggguuguggcuuggcccagu

SEQ ID NO: 1628648 - RNA, 16 nt, Pseudomonas putida KT2440
caugguaaaagccgcc

SEQ ID NO: 1628649 - RNA, 20 nt, Pseudomonas putida KT2440
cauggaaauaacgcgggcaa

SEQ ID NO: 1628650 - RNA, 14 nt, Pseudomonas putida KT2440
caugcggcaccgcc

SEQ ID NO: 1628651 - RNA, 19 nt, Pseudomonas putida KT2440
caugcgcgugcgugucugu

SEQ ID NO: 1628652 - RNA, 19 nt, Pseudomonas putida KT2440
caugcggcucuguuucugc

SEQ ID NO: 1628653 - RNA, 23 nt, Pseudomonas putida KT2440
caugcggcucuguuucugccccu

SEQ ID NO: 1628654 - RNA, 19 nt, Pseudomonas putida KT2440
caugcggcuacccagccgg

SEQ ID NO: 1628655 - RNA, 16 nt, Pseudomonas putida KT2440
caugcgguacagcacu

SEQ ID NO: 1628656 - RNA, 17 nt, Pseudomonas putida KT2440
caugcgguacagcacug

SEQ ID NO: 1628657 - RNA, 13 nt, Pseudomonas putida KT2440
caugcguucgcua

SEQ ID NO: 1628658 - RNA, 13 nt, Pseudomonas putida KT2440
cauaccucccgca

SEQ ID NO: 1628659 - RNA, 22 nt, Pseudomonas putida KT2440
cauaccucccgcacugcugccg

SEQ ID NO: 1628660 - RNA, 14 nt, Pseudomonas putida KT2440
cauaccgcugggca

SEQ ID NO: 1628661 - RNA, 16 nt, Pseudomonas putida KT2440
cauaccgagaaugaaa

SEQ ID NO: 1628662 - RNA, 15 nt, Pseudomonas putida KT2440
cauacgcaugaaguc

SEQ ID NO: 1628663 - RNA, 15 nt, Pseudomonas putida KT2440
cauaccuucggggau

SEQ ID NO: 1628664 - RNA, 14 nt, Pseudomonas putida KT2440
cauaccccuccggc

SEQ ID NO: 1628665 - RNA, 20 nt, Pseudomonas putida KT2440
cauaccccuccggccccggu

SEQ ID NO: 1628666 - RNA, 16 nt, Pseudomonas putida KT2440
cauaccacacacccca

SEQ ID NO: 1628667 - RNA, 18 nt, Pseudomonas putida KT2440
cauacagcgccuccagca

SEQ ID NO: 1628668 - RNA, 18 nt, Pseudomonas putida KT2440
cauacagccagaaagcca

SEQ ID NO: 1628669 - RNA, 21 nt, Pseudomonas putida KT2440
cauacagggauagagccgccu

SEQ ID NO: 1628670 - RNA, 21 nt, Pseudomonas putida KT2440
cauacagcgcacucucccgca

SEQ ID NO: 1628671 - RNA, 13 nt, Pseudomonas putida KT2440
cauaacggcuggc

SEQ ID NO: 1628672 - RNA, 14 nt, Pseudomonas putida KT2440
cauacaccccgcgc

SEQ ID NO: 1628673 - RNA, 18 nt, Pseudomonas putida KT2440
caguugguaaaacacauu

SEQ ID NO: 1628674 - RNA, 22 nt, Pseudomonas putida KT2440
caguuggcguauuuuggcaggu

SEQ ID NO: 1628675 - RNA, 12 nt, Pseudomonas putida KT2440
caguuggcugcc

SEQ ID NO: 1628676 - RNA, 14 nt, Pseudomonas putida KT2440
caguuggccaucaa

SEQ ID NO: 1628677 - RNA, 16 nt, Pseudomonas putida KT2440
caguuggccggcaugg

SEQ ID NO: 1628678 - RNA, 15 nt, Pseudomonas putida KT2440
caguuguugggcagc

SEQ ID NO: 1628679 - RNA, 17 nt, Pseudomonas putida KT2440
caguugugacuagagga

SEQ ID NO: 1628680 - RNA, 12 nt, Pseudomonas putida KT2440
caguuguacucg

SEQ ID NO: 1628681 - RNA, 13 nt, Pseudomonas putida KT2440
caguugcagcaac

SEQ ID NO: 1628682 - RNA, 15 nt, Pseudomonas putida KT2440
caguugccugccuug

SEQ ID NO: 1628683 - RNA, 16 nt, Pseudomonas putida KT2440
caguugcgggaagguc

SEQ ID NO: 1628684 - RNA, 14 nt, Pseudomonas putida KT2440
caguugcuccuuga

SEQ ID NO: 1628685 - RNA, 22 nt, Pseudomonas putida KT2440
caguucuaccguuggcaucugc

SEQ ID NO: 1628686 - RNA, 17 nt, Pseudomonas putida KT2440
caguucugcucagcuac

SEQ ID NO: 1628687 - RNA, 22 nt, Pseudomonas putida KT2440
caguucugcucagcuacgcugg

SEQ ID NO: 1628688 - RNA, 15 nt, Pseudomonas putida KT2440
caguucuuccagcgg

SEQ ID NO: 1628689 - RNA, 16 nt, Pseudomonas putida KT2440
caguucuuccagcggc

SEQ ID NO: 1628690 - RNA, 23 nt, Pseudomonas putida KT2440
caguucuuccagcggcaagguca

SEQ ID NO: 1628691 - RNA, 18 nt, Pseudomonas putida KT2440
cagugugcaaacacccag

SEQ ID NO: 1628692 - RNA, 14 nt, Pseudomonas putida KT2440
caguguggcaaggg

SEQ ID NO: 1628693 - RNA, 16 nt, Pseudomonas putida KT2440
cagugucugcgccugc

SEQ ID NO: 1628694 - RNA, 17 nt, Pseudomonas putida KT2440
cagugucugcgccugcu

SEQ ID NO: 1628695 - RNA, 19 nt, Pseudomonas putida KT2440
cagugucugcgccugcugg

SEQ ID NO: 1628696 - RNA, 15 nt, Pseudomonas putida KT2440
cauaaccccccaccc

SEQ ID NO: 1628697 - RNA, 17 nt, Pseudomonas putida KT2440
cauaaccccccacccag

SEQ ID NO: 1628698 - RNA, 14 nt, Pseudomonas putida KT2440
cauaaccaccaccg

SEQ ID NO: 1628699 - RNA, 15 nt, Pseudomonas putida KT2440
caggugcgcgcgcga

SEQ ID NO: 1628700 - RNA, 17 nt, Pseudomonas putida KT2440
caggugcgcacgcugcc

SEQ ID NO: 1628701 - RNA, 19 nt, Pseudomonas putida KT2440
caggugcuugcggaacacc

SEQ ID NO: 1628702 - RNA, 13 nt, Pseudomonas putida KT2440
caggugcucacca

SEQ ID NO: 1628703 - RNA, 15 nt, Pseudomonas putida KT2440
caggugcucagccac

SEQ ID NO: 1628704 - RNA, 18 nt, Pseudomonas putida KT2440
cagguggcugucugggaa

SEQ ID NO: 1628705 - RNA, 23 nt, Pseudomonas putida KT2440
cagguggccuucccucuguaacu

SEQ ID NO: 1628706 - RNA, 19 nt, Pseudomonas putida KT2440
cagguggaucagccgcgcu

SEQ ID NO: 1628707 - RNA, 18 nt, Pseudomonas putida KT2440
cagggugucgacgacagu

SEQ ID NO: 1628708 - RNA, 15 nt, Pseudomonas putida KT2440
caggguucgcugucc

SEQ ID NO: 1628709 - RNA, 21 nt, Pseudomonas putida KT2440
caggguucgcuguccugaugu

SEQ ID NO: 1628710 - RNA, 20 nt, Pseudomonas putida KT2440
cagggugucgguggcggcca

SEQ ID NO: 1628711 - RNA, 22 nt, Pseudomonas putida KT2440
cagggugucgguggcggccagc

SEQ ID NO: 1628712 - RNA, 23 nt, Pseudomonas putida KT2440
cagggugucgguggcggccagcg

SEQ ID NO: 1628713 - RNA, 21 nt, Pseudomonas putida KT2440
caggguuguggugagcccugu

SEQ ID NO: 1628714 - RNA, 19 nt, Pseudomonas putida KT2440
caggguuuucagcgccgca

SEQ ID NO: 1628715 - RNA, 17 nt, Pseudomonas putida KT2440
cagguaaaaaucaugca

SEQ ID NO: 1628716 - RNA, 19 nt, Pseudomonas putida KT2440
caggugccguuccggcaaa

SEQ ID NO: 1628717 - RNA, 16 nt, Pseudomonas putida KT2440
caggugguaacuggcc

SEQ ID NO: 1628718 - RNA, 18 nt, Pseudomonas putida KT2440
caggugguaguccuugcc

SEQ ID NO: 1628719 - RNA, 14 nt, Pseudomonas putida KT2440
caggugugccacuu

SEQ ID NO: 1628720 - RNA, 23 nt, Pseudomonas putida KT2440
caggugugccacuucaugggcca

SEQ ID NO: 1628721 - RNA, 21 nt, Pseudomonas putida KT2440
cagguguguagguucacagaa

SEQ ID NO: 1628722 - RNA, 23 nt, Pseudomonas putida KT2440
cagguguuguugcaaccaggcgc

SEQ ID NO: 1628723 - RNA, 13 nt, Pseudomonas putida KT2440
cagguugcccagc

SEQ ID NO: 1628724 - RNA, 20 nt, Pseudomonas putida KT2440
cagguugcccucggccaccu

SEQ ID NO: 1628725 - RNA, 16 nt, Pseudomonas putida KT2440
cagguugcggccaucg

SEQ ID NO: 1628726 - RNA, 23 nt, Pseudomonas putida KT2440
cagguugcgugccucgcccaggu

SEQ ID NO: 1628727 - RNA, 14 nt, Pseudomonas putida KT2440
cagguugccucauc

SEQ ID NO: 1628728 - RNA, 18 nt, Pseudomonas putida KT2440
cagguugccucaucaccu

SEQ ID NO: 1628729 - RNA, 14 nt, Pseudomonas putida KT2440
cagguugcgcgccg

SEQ ID NO: 1628730 - RNA, 17 nt, Pseudomonas putida KT2440
cagguugcgcgccgcca

SEQ ID NO: 1628731 - RNA, 16 nt, Pseudomonas putida KT2440
cagguuggccgccgcc

SEQ ID NO: 1628732 - RNA, 20 nt, Pseudomonas putida KT2440
cagguuggugcaauugcagu

SEQ ID NO: 1628733 - RNA, 17 nt, Pseudomonas putida KT2440
caguacaugaucggguu

SEQ ID NO: 1628734 - RNA, 22 nt, Pseudomonas putida KT2440
caguacaggcaauacaaggcuc

SEQ ID NO: 1628735 - RNA, 14 nt, Pseudomonas putida KT2440
caguaccagcagca

SEQ ID NO: 1628736 - RNA, 16 nt, Pseudomonas putida KT2440
caguaccgcgccucca

SEQ ID NO: 1628737 - RNA, 14 nt, Pseudomonas putida KT2440
caguaccuaggguu

SEQ ID NO: 1628738 - RNA, 14 nt, Pseudomonas putida KT2440
caguacuugcugga

SEQ ID NO: 1628739 - RNA, 23 nt, Pseudomonas putida KT2440
caguaauaggugcguggcuguuc

SEQ ID NO: 1628740 - RNA, 21 nt, Pseudomonas putida KT2440
caguaaggaucgcgcagcagc

SEQ ID NO: 1628741 - RNA, 20 nt, Pseudomonas putida KT2440
caguagagcccccagcacag

SEQ ID NO: 1628742 - RNA, 14 nt, Pseudomonas putida KT2440
caguagaagcccag

SEQ ID NO: 1628743 - RNA, 16 nt, Pseudomonas putida KT2440
caguagaaaguccauc

SEQ ID NO: 1628744 - RNA, 21 nt, Pseudomonas putida KT2440
cagucaccacacggcagcccc

SEQ ID NO: 1628745 - RNA, 20 nt, Pseudomonas putida KT2440
cagugacaggcagucauggg

SEQ ID NO: 1628746 - RNA, 18 nt, Pseudomonas putida KT2440
cagugagaaugcggaugu

SEQ ID NO: 1628747 - RNA, 18 nt, Pseudomonas putida KT2440
cagugaagcucgaucugc

SEQ ID NO: 1628748 - RNA, 18 nt, Pseudomonas putida KT2440
cagugaauuccuugcugg

SEQ ID NO: 1628749 - RNA, 21 nt, Pseudomonas putida KT2440
cagugaauuccuugcuggugu

SEQ ID NO: 1628750 - RNA, 16 nt, Pseudomonas putida KT2440
cagugcaggugcacug

SEQ ID NO: 1628751 - RNA, 13 nt, Pseudomonas putida KT2440
cagugccagcaac

SEQ ID NO: 1628752 - RNA, 19 nt, Pseudomonas putida KT2440
cagugcugucacccuuggg

SEQ ID NO: 1628753 - RNA, 22 nt, Pseudomonas putida KT2440
cagugcuuccagcaggacccgg

SEQ ID NO: 1628754 - RNA, 14 nt, Pseudomonas putida KT2440
caguggaccucugg

SEQ ID NO: 1628755 - RNA, 16 nt, Pseudomonas putida KT2440
caguggcaagccgagc

SEQ ID NO: 1628756 - RNA, 19 nt, Pseudomonas putida KT2440
caguggcacaccaugggca

SEQ ID NO: 1628757 - RNA, 19 nt, Pseudomonas putida KT2440
caguggcagguucgaccac

SEQ ID NO: 1628758 - RNA, 15 nt, Pseudomonas putida KT2440
caguggcccgaugau

SEQ ID NO: 1628759 - RNA, 23 nt, Pseudomonas putida KT2440
caguggcccgaugaucaggccgc

SEQ ID NO: 1628760 - RNA, 19 nt, Pseudomonas putida KT2440
caguggccgaguuggcuuc

SEQ ID NO: 1628761 - RNA, 22 nt, Pseudomonas putida KT2440
cagugguugugcuggcccuuuc

SEQ ID NO: 1628762 - RNA, 22 nt, Pseudomonas putida KT2440
caguguaaauagcugccaucca

SEQ ID NO: 1628763 - RNA, 17 nt, Pseudomonas putida KT2440
cagugucagcccaucca

SEQ ID NO: 1628764 - RNA, 19 nt, Pseudomonas putida KT2440
cagugucccggccagggcu

SEQ ID NO: 1628765 - RNA, 13 nt, Pseudomonas putida KT2440
cagucagcgccga

SEQ ID NO: 1628766 - RNA, 20 nt, Pseudomonas putida KT2440
cagucagccacauccucugc

SEQ ID NO: 1628767 - RNA, 17 nt, Pseudomonas putida KT2440
cagucagccagugcugc

SEQ ID NO: 1628768 - RNA, 16 nt, Pseudomonas putida KT2440
cagucauccagaaagc

SEQ ID NO: 1628769 - RNA, 21 nt, Pseudomonas putida KT2440
cagucaccuugcuccaccagg

SEQ ID NO: 1628770 - RNA, 22 nt, Pseudomonas putida KT2440
cagucaccguucuugauccagc

SEQ ID NO: 1628771 - RNA, 13 nt, Pseudomonas putida KT2440
cagucagaagcag

SEQ ID NO: 1628772 - RNA, 18 nt, Pseudomonas putida KT2440
cagucgccgauacccgca

SEQ ID NO: 1628773 - RNA, 23 nt, Pseudomonas putida KT2440
cagucgccccgccagcgccuggc

SEQ ID NO: 1628774 - RNA, 19 nt, Pseudomonas putida KT2440
cagucgagucgacagugac

SEQ ID NO: 1628775 - RNA, 19 nt, Pseudomonas putida KT2440
cagucgaucccgaggucag

SEQ ID NO: 1628776 - RNA, 17 nt, Pseudomonas putida KT2440
cagucgaccgggcagac

SEQ ID NO: 1628777 - RNA, 19 nt, Pseudomonas putida KT2440
cagucgaccgggcagaccu

SEQ ID NO: 1628778 - RNA, 18 nt, Pseudomonas putida KT2440
cagucgcgcaacugccca

SEQ ID NO: 1628779 - RNA, 21 nt, Pseudomonas putida KT2440
cagucgcgcaacugcccagga

SEQ ID NO: 1628780 - RNA, 15 nt, Pseudomonas putida KT2440
cagucugcuccaccg

SEQ ID NO: 1628781 - RNA, 16 nt, Pseudomonas putida KT2440
cagucucuuucaacag

SEQ ID NO: 1628782 - RNA, 22 nt, Pseudomonas putida KT2440
cagucucuuucaacagcuggcu

SEQ ID NO: 1628783 - RNA, 21 nt, Pseudomonas putida KT2440
caggaucugcugcagcauggc

SEQ ID NO: 1628784 - RNA, 15 nt, Pseudomonas putida KT2440
caggaucucgcuguc

SEQ ID NO: 1628785 - RNA, 19 nt, Pseudomonas putida KT2440
caggaucgagaccuugccu

SEQ ID NO: 1628786 - RNA, 17 nt, Pseudomonas putida KT2440
caggaucuucaugccau

SEQ ID NO: 1628787 - RNA, 20 nt, Pseudomonas putida KT2440
caggaucuucucggcgcgga

SEQ ID NO: 1628788 - RNA, 17 nt, Pseudomonas putida KT2440
caggauggugacugcca

SEQ ID NO: 1628789 - RNA, 21 nt, Pseudomonas putida KT2440
caggagcggccuucagggccg

SEQ ID NO: 1628790 - RNA, 23 nt, Pseudomonas putida KT2440
caggaggucagcgguucgauccc

SEQ ID NO: 1628791 - RNA, 19 nt, Pseudomonas putida KT2440
caggagucuacggaccucc

SEQ ID NO: 1628792 - RNA, 22 nt, Pseudomonas putida KT2440
caggacggauacaccagaaagc

SEQ ID NO: 1628793 - RNA, 20 nt, Pseudomonas putida KT2440
caggaagccccgcgcgucca

SEQ ID NO: 1628794 - RNA, 14 nt, Pseudomonas putida KT2440
caggaagcaggcgu

SEQ ID NO: 1628795 - RNA, 15 nt, Pseudomonas putida KT2440
caggaagaaggcauc

SEQ ID NO: 1628796 - RNA, 22 nt, Pseudomonas putida KT2440
caggaagaaggcauccagggcg

SEQ ID NO: 1628797 - RNA, 14 nt, Pseudomonas putida KT2440
caggaagauguguu

SEQ ID NO: 1628798 - RNA, 17 nt, Pseudomonas putida KT2440
caggaagcugggaaucc

SEQ ID NO: 1628799 - RNA, 23 nt, Pseudomonas putida KT2440
caggaaggccuugaagcgcggca

SEQ ID NO: 1628800 - RNA, 23 nt, Pseudomonas putida KT2440
caggaaggcgucguacaggccua

SEQ ID NO: 1628801 - RNA, 21 nt, Pseudomonas putida KT2440
caggaaggcaccacggaaggc

SEQ ID NO: 1628802 - RNA, 17 nt, Pseudomonas putida KT2440
caggaaccgcucccagg

SEQ ID NO: 1628803 - RNA, 21 nt, Pseudomonas putida KT2440
cagcuugccaccaucgaccug

SEQ ID NO: 1628804 - RNA, 19 nt, Pseudomonas putida KT2440
cagcuugccauucuugucc

SEQ ID NO: 1628805 - RNA, 15 nt, Pseudomonas putida KT2440
cagcuugcccagcag

SEQ ID NO: 1628806 - RNA, 16 nt, Pseudomonas putida KT2440
cagcuugcccagcagg

SEQ ID NO: 1628807 - RNA, 21 nt, Pseudomonas putida KT2440
cagcuugcccaucaccucguc

SEQ ID NO: 1628808 - RNA, 14 nt, Pseudomonas putida KT2440
cagcuugcagcgcc

SEQ ID NO: 1628809 - RNA, 19 nt, Pseudomonas putida KT2440
cagcuugcagcgccgagcg

SEQ ID NO: 1628810 - RNA, 19 nt, Pseudomonas putida KT2440
caggaaccuccguugcugc

SEQ ID NO: 1628811 - RNA, 14 nt, Pseudomonas putida KT2440
caggaauggcacca

SEQ ID NO: 1628812 - RNA, 23 nt, Pseudomonas putida KT2440
caggaaucaccagaccuggaggu

SEQ ID NO: 1628813 - RNA, 17 nt, Pseudomonas putida KT2440
caggacaaaccagcggu

SEQ ID NO: 1628814 - RNA, 21 nt, Pseudomonas putida KT2440
caggacaagccgacaaaaaca

SEQ ID NO: 1628815 - RNA, 23 nt, Pseudomonas putida KT2440
caggacaagccgacaaaaacaac

SEQ ID NO: 1628816 - RNA, 17 nt, Pseudomonas putida KT2440
caggaauuacgcaggcu

SEQ ID NO: 1628817 - RNA, 22 nt, Pseudomonas putida KT2440
cagcuggcgcaaauugcccggc

SEQ ID NO: 1628818 - RNA, 23 nt, Pseudomonas putida KT2440
cagcuggcgcaaauugcccggcc

SEQ ID NO: 1628819 - RNA, 13 nt, Pseudomonas putida KT2440
cagcuggccaccu

SEQ ID NO: 1628820 - RNA, 18 nt, Pseudomonas putida KT2440
cagcugcugaccucgacc

SEQ ID NO: 1628821 - RNA, 22 nt, Pseudomonas putida KT2440
cagcugcugaccucgacccgcc

SEQ ID NO: 1628822 - RNA, 20 nt, Pseudomonas putida KT2440
cagcugcugcggcaccucgu

SEQ ID NO: 1628823 - RNA, 14 nt, Pseudomonas putida KT2440
cagcucguggguca

SEQ ID NO: 1628824 - RNA, 17 nt, Pseudomonas putida KT2440
cagcucgugggucaucu

SEQ ID NO: 1628825 - RNA, 19 nt, Pseudomonas putida KT2440
cagcucgugggucaucuug

SEQ ID NO: 1628826 - RNA, 20 nt, Pseudomonas putida KT2440
cagcucgugggucaucuugc

SEQ ID NO: 1628827 - RNA, 15 nt, Pseudomonas putida KT2440
cagcucgucagccac

SEQ ID NO: 1628828 - RNA, 14 nt, Pseudomonas putida KT2440
cagcucguccaugu

SEQ ID NO: 1628829 - RNA, 18 nt, Pseudomonas putida KT2440
cagcucggccgaugccag

SEQ ID NO: 1628830 - RNA, 23 nt, Pseudomonas putida KT2440
cagcucggccuugcgagccuggg

SEQ ID NO: 1628831 - RNA, 13 nt, Pseudomonas putida KT2440
cagcucggccacc

SEQ ID NO: 1628832 - RNA, 14 nt, Pseudomonas putida KT2440
cagcucggccaccc

SEQ ID NO: 1628833 - RNA, 16 nt, Pseudomonas putida KT2440
cagcucgcgcugccag

SEQ ID NO: 1628834 - RNA, 14 nt, Pseudomonas putida KT2440
cagcuucuucacac

SEQ ID NO: 1628835 - RNA, 17 nt, Pseudomonas putida KT2440
cagcuucuugcaccgcu

SEQ ID NO: 1628836 - RNA, 17 nt, Pseudomonas putida KT2440
cagcuucaacuccacca

SEQ ID NO: 1628837 - RNA, 18 nt, Pseudomonas putida KT2440
cagcuucaacuccaccau

SEQ ID NO: 1628838 - RNA, 20 nt, Pseudomonas putida KT2440
cagcuucaacuccaccauca

SEQ ID NO: 1628839 - RNA, 20 nt, Pseudomonas putida KT2440
cagcuguacgcuggccaagg

SEQ ID NO: 1628840 - RNA, 14 nt, Pseudomonas putida KT2440
cagcuguugcuguu

SEQ ID NO: 1628841 - RNA, 21 nt, Pseudomonas putida KT2440
cagcuuaacgcuuggccagac

SEQ ID NO: 1628842 - RNA, 22 nt, Pseudomonas putida KT2440
cagcggccgcgcaauugccggu

SEQ ID NO: 1628843 - RNA, 17 nt, Pseudomonas putida KT2440
cagcggcgucaccuucc

SEQ ID NO: 1628844 - RNA, 14 nt, Pseudomonas putida KT2440
cagcggcuggcccu

SEQ ID NO: 1628845 - RNA, 15 nt, Pseudomonas putida KT2440
cagcuacgcgagcca

SEQ ID NO: 1628846 - RNA, 18 nt, Pseudomonas putida KT2440
cagcuacgcgagccaccg

SEQ ID NO: 1628847 - RNA, 19 nt, Pseudomonas putida KT2440
cagcuacgcgagccaccgu

SEQ ID NO: 1628848 - RNA, 20 nt, Pseudomonas putida KT2440
cagcuacgcgagccaccguc

SEQ ID NO: 1628849 - RNA, 19 nt, Pseudomonas putida KT2440
cagcuacgcgagucaacaa

SEQ ID NO: 1628850 - RNA, 15 nt, Pseudomonas putida KT2440
cagcuaucucccagc

SEQ ID NO: 1628851 - RNA, 23 nt, Pseudomonas putida KT2440
cagcuccaacaagucuuccccuu

SEQ ID NO: 1628852 - RNA, 22 nt, Pseudomonas putida KT2440
cagcuccacacucgacgcugcc

SEQ ID NO: 1628853 - RNA, 15 nt, Pseudomonas putida KT2440
cagcucauccaggcu

SEQ ID NO: 1628854 - RNA, 18 nt, Pseudomonas putida KT2440
cagcucauccaggcugca

SEQ ID NO: 1628855 - RNA, 19 nt, Pseudomonas putida KT2440
cagcucauccaggcugcac

SEQ ID NO: 1628856 - RNA, 19 nt, Pseudomonas putida KT2440
cagcucauccaucaccugc

SEQ ID NO: 1628857 - RNA, 16 nt, Pseudomonas putida KT2440
cagcucauccagccgc

SEQ ID NO: 1628858 - RNA, 20 nt, Pseudomonas putida KT2440
cagcuauugagagcagauga

SEQ ID NO: 1628859 - RNA, 19 nt, Pseudomonas putida KT2440
cagcucaaccauugcugga

SEQ ID NO: 1628860 - RNA, 15 nt, Pseudomonas putida KT2440
cagcucaacccgccu

SEQ ID NO: 1628861 - RNA, 13 nt, Pseudomonas putida KT2440
cagcucaagcccu

SEQ ID NO: 1628862 - RNA, 21 nt, Pseudomonas putida KT2440
cagcucaagcccugccgccuu

SEQ ID NO: 1628863 - RNA, 13 nt, Pseudomonas putida KT2440
cagcuccauggca

SEQ ID NO: 1628864 - RNA, 18 nt, Pseudomonas putida KT2440
cagcuccagcagugccgu

SEQ ID NO: 1628865 - RNA, 14 nt, Pseudomonas putida KT2440
cagcuccagccaga

SEQ ID NO: 1628866 - RNA, 15 nt, Pseudomonas putida KT2440
cagcuccaccuucca

SEQ ID NO: 1628867 - RNA, 16 nt, Pseudomonas putida KT2440
cagcuccaccuuccac

SEQ ID NO: 1628868 - RNA, 14 nt, Pseudomonas putida KT2440
cagcuccacuggaa

SEQ ID NO: 1628869 - RNA, 17 nt, Pseudomonas putida KT2440
cagcuccacuggaacuc

SEQ ID NO: 1628870 - RNA, 13 nt, Pseudomonas putida KT2440
cagcucgccaaac

SEQ ID NO: 1628871 - RNA, 19 nt, Pseudomonas putida KT2440
cagcucgccaacaccgccc

SEQ ID NO: 1628872 - RNA, 17 nt, Pseudomonas putida KT2440
cagcucgaugccuuugc

SEQ ID NO: 1628873 - RNA, 12 nt, Pseudomonas putida KT2440
cagcucgauggc

SEQ ID NO: 1628874 - RNA, 20 nt, Pseudomonas putida KT2440
cagcucgauggccaggaaca

SEQ ID NO: 1628875 - RNA, 20 nt, Pseudomonas putida KT2440
cagcucccucguaggagcgg

SEQ ID NO: 1628876 - RNA, 20 nt, Pseudomonas putida KT2440
cagcuccgacaggcugugug

SEQ ID NO: 1628877 - RNA, 14 nt, Pseudomonas putida KT2440
cagcucccgagcca

SEQ ID NO: 1628878 - RNA, 16 nt, Pseudomonas putida KT2440
cagcucccgcgcaugc

SEQ ID NO: 1628879 - RNA, 12 nt, Pseudomonas putida KT2440
cagggccgcgcu

SEQ ID NO: 1628880 - RNA, 18 nt, Pseudomonas putida KT2440
cagggccaggccgauggc

SEQ ID NO: 1628881 - RNA, 13 nt, Pseudomonas putida KT2440
cagggcccagcca

SEQ ID NO: 1628882 - RNA, 17 nt, Pseudomonas putida KT2440
cagggcccccgauucca

SEQ ID NO: 1628883 - RNA, 14 nt, Pseudomonas putida KT2440
cagggcgaugcccu

SEQ ID NO: 1628884 - RNA, 14 nt, Pseudomonas putida KT2440
cagggccugaccgc

SEQ ID NO: 1628885 - RNA, 20 nt, Pseudomonas putida KT2440
cagggcgcguguagcccgcu

SEQ ID NO: 1628886 - RNA, 22 nt, Pseudomonas putida KT2440
cagggcgcguguagcccgcuga

SEQ ID NO: 1628887 - RNA, 19 nt, Pseudomonas putida KT2440
cagggccuuggccuggggc

SEQ ID NO: 1628888 - RNA, 16 nt, Pseudomonas putida KT2440
cagggccuuuucauau

SEQ ID NO: 1628889 - RNA, 15 nt, Pseudomonas putida KT2440
cagggccuugcucgu

SEQ ID NO: 1628890 - RNA, 12 nt, Pseudomonas putida KT2440
cagggaagggca

SEQ ID NO: 1628891 - RNA, 21 nt, Pseudomonas putida KT2440
cagggaagggcaaugaucagc

SEQ ID NO: 1628892 - RNA, 22 nt, Pseudomonas putida KT2440
cagggaagaauugcugguugau

SEQ ID NO: 1628893 - RNA, 22 nt, Pseudomonas putida KT2440
cagggacgaacccuugaccuug

SEQ ID NO: 1628894 - RNA, 16 nt, Pseudomonas putida KT2440
caggcucgacggcgca

SEQ ID NO: 1628895 - RNA, 16 nt, Pseudomonas putida KT2440
caggcucagcuccaug

SEQ ID NO: 1628896 - RNA, 15 nt, Pseudomonas putida KT2440
cagggcagcaacgcc

SEQ ID NO: 1628897 - RNA, 18 nt, Pseudomonas putida KT2440
cagggcagcaacgccgag

SEQ ID NO: 1628898 - RNA, 23 nt, Pseudomonas putida KT2440
cagggcaacggcaauggccgggu

SEQ ID NO: 1628899 - RNA, 16 nt, Pseudomonas putida KT2440
cagggcaucggacagg

SEQ ID NO: 1628900 - RNA, 19 nt, Pseudomonas putida KT2440
cagggcaucggcgccccgc

SEQ ID NO: 1628901 - RNA, 18 nt, Pseudomonas putida KT2440
cagggcgucgaacacggc

SEQ ID NO: 1628902 - RNA, 19 nt, Pseudomonas putida KT2440
cagggcugguuaugagccu

SEQ ID NO: 1628903 - RNA, 15 nt, Pseudomonas putida KT2440
cagggcugguuccug

SEQ ID NO: 1628904 - RNA, 16 nt, Pseudomonas putida KT2440
cagggcgucaugcuca

SEQ ID NO: 1628905 - RNA, 16 nt, Pseudomonas putida KT2440
cagggcuuucuucucu

SEQ ID NO: 1628906 - RNA, 19 nt, Pseudomonas putida KT2440
caggggagggcgugaaaaa

SEQ ID NO: 1628907 - RNA, 13 nt, Pseudomonas putida KT2440
caggggacagcca

SEQ ID NO: 1628908 - RNA, 15 nt, Pseudomonas putida KT2440
caggggacagccaca

SEQ ID NO: 1628909 - RNA, 15 nt, Pseudomonas putida KT2440
caggggucugugcag

SEQ ID NO: 1628910 - RNA, 20 nt, Pseudomonas putida KT2440
caggggucuuugaacgaggu

SEQ ID NO: 1628911 - RNA, 17 nt, Pseudomonas putida KT2440
cagggggguaaggcugg

SEQ ID NO: 1628912 - RNA, 22 nt, Pseudomonas putida KT2440
caggggcguuuaaaccuucaac

SEQ ID NO: 1628913 - RNA, 15 nt, Pseudomonas putida KT2440
caggggcgcagagcg

SEQ ID NO: 1628914 - RNA, 16 nt, Pseudomonas putida KT2440
caggggccgcgcagcc

SEQ ID NO: 1628915 - RNA, 14 nt, Pseudomonas putida KT2440
cagggugccggcca

SEQ ID NO: 1628916 - RNA, 19 nt, Pseudomonas putida KT2440
cagggugccggccagcggc

SEQ ID NO: 1628917 - RNA, 20 nt, Pseudomonas putida KT2440
cagggugccggccagcggca

SEQ ID NO: 1628918 - RNA, 16 nt, Pseudomonas putida KT2440
cagggugccgccaugu

SEQ ID NO: 1628919 - RNA, 16 nt, Pseudomonas putida KT2440
cagggugccagaccac

SEQ ID NO: 1628920 - RNA, 23 nt, Pseudomonas putida KT2440
cagggugaucgcgcuggcacugc

SEQ ID NO: 1628921 - RNA, 16 nt, Pseudomonas putida KT2440
cagggucgggcacagg

SEQ ID NO: 1628922 - RNA, 22 nt, Pseudomonas putida KT2440
cagggucgggcacaggcccagc

SEQ ID NO: 1628923 - RNA, 15 nt, Pseudomonas putida KT2440
cagggucgcgcccca

SEQ ID NO: 1628924 - RNA, 18 nt, Pseudomonas putida KT2440
cagggucgcgccccaagc

SEQ ID NO: 1628925 - RNA, 19 nt, Pseudomonas putida KT2440
cagggguucgaguccccua

SEQ ID NO: 1628926 - RNA, 16 nt, Pseudomonas putida KT2440
cagggguucgccccgc

SEQ ID NO: 1628927 - RNA, 14 nt, Pseudomonas putida KT2440
caggguagccccga

SEQ ID NO: 1628928 - RNA, 18 nt, Pseudomonas putida KT2440
caggguaccgccguccac

SEQ ID NO: 1628929 - RNA, 20 nt, Pseudomonas putida KT2440
caggguaccgccguccacca

SEQ ID NO: 1628930 - RNA, 20 nt, Pseudomonas putida KT2440
caggcgccgcagcaguuggc

SEQ ID NO: 1628931 - RNA, 15 nt, Pseudomonas putida KT2440
caggcgcccugcgcc

SEQ ID NO: 1628932 - RNA, 21 nt, Pseudomonas putida KT2440
caggcgccgagcgcggcgccc

SEQ ID NO: 1628933 - RNA, 21 nt, Pseudomonas putida KT2440
caggcgcagggugugcugcug

SEQ ID NO: 1628934 - RNA, 22 nt, Pseudomonas putida KT2440
caggcgcaggugcagccagccc

SEQ ID NO: 1628935 - RNA, 19 nt, Pseudomonas putida KT2440
caggcgcaggcucuccacg

SEQ ID NO: 1628936 - RNA, 16 nt, Pseudomonas putida KT2440
caggcgcggcagcaug

SEQ ID NO: 1628937 - RNA, 19 nt, Pseudomonas putida KT2440
caggcgcucaccccgcccc

SEQ ID NO: 1628938 - RNA, 21 nt, Pseudomonas putida KT2440
caggcgcucaccuacugccgu

SEQ ID NO: 1628939 - RNA, 23 nt, Pseudomonas putida KT2440
caggcgcgcuaccggacugcgcu

SEQ ID NO: 1628940 - RNA, 21 nt, Pseudomonas putida KT2440
caggcguguuagccguggggc

SEQ ID NO: 1628941 - RNA, 18 nt, Pseudomonas putida KT2440
caggcguggaaaaggcgc

SEQ ID NO: 1628942 - RNA, 20 nt, Pseudomonas putida KT2440
caggcuacgcagcacccggu

SEQ ID NO: 1628943 - RNA, 18 nt, Pseudomonas putida KT2440
caggcuaauggcgcgccu

SEQ ID NO: 1628944 - RNA, 14 nt, Pseudomonas putida KT2440
caggcgcuccagca

SEQ ID NO: 1628945 - RNA, 14 nt, Pseudomonas putida KT2440
caggccggccacca

SEQ ID NO: 1628946 - RNA, 18 nt, Pseudomonas putida KT2440
caggccgccgacgaucag

SEQ ID NO: 1628947 - RNA, 21 nt, Pseudomonas putida KT2440
caggccgccugaccugugcug

SEQ ID NO: 1628948 - RNA, 16 nt, Pseudomonas putida KT2440
caggccgcggccgaaa

SEQ ID NO: 1628949 - RNA, 17 nt, Pseudomonas putida KT2440
caggccgcugaacaacu

SEQ ID NO: 1628950 - RNA, 22 nt, Pseudomonas putida KT2440
caggccgcugaacaacuccggg

SEQ ID NO: 1628951 - RNA, 20 nt, Pseudomonas putida KT2440
caggccgaugccaagcaccg

SEQ ID NO: 1628952 - RNA, 19 nt, Pseudomonas putida KT2440
caggccgaugcggucgaag

SEQ ID NO: 1628953 - RNA, 17 nt, Pseudomonas putida KT2440
caggccgaugggcaggc

SEQ ID NO: 1628954 - RNA, 22 nt, Pseudomonas putida KT2440
caggccgaugggcaggccauuc

SEQ ID NO: 1628955 - RNA, 20 nt, Pseudomonas putida KT2440
caggccgaucaccagcaccc

SEQ ID NO: 1628956 - RNA, 17 nt, Pseudomonas putida KT2440
caggccgcacgcgccuc

SEQ ID NO: 1628957 - RNA, 13 nt, Pseudomonas putida KT2440
caggccgcagccu

SEQ ID NO: 1628958 - RNA, 22 nt, Pseudomonas putida KT2440
caggccgcauuucgacgcagag

SEQ ID NO: 1628959 - RNA, 15 nt, Pseudomonas putida KT2440
caggccgacaacagc

SEQ ID NO: 1628960 - RNA, 19 nt, Pseudomonas putida KT2440
caggccgaaggccagccga

SEQ ID NO: 1628961 - RNA, 15 nt, Pseudomonas putida KT2440
caggcaguaggccac

SEQ ID NO: 1628962 - RNA, 17 nt, Pseudomonas putida KT2440
caggcaguaggccaccg

SEQ ID NO: 1628963 - RNA, 17 nt, Pseudomonas putida KT2440
caggcaggaacuggcug

SEQ ID NO: 1628964 - RNA, 20 nt, Pseudomonas putida KT2440
caggcaggaacuggcugccg

SEQ ID NO: 1628965 - RNA, 17 nt, Pseudomonas putida KT2440
caggcagccugccaggu

SEQ ID NO: 1628966 - RNA, 23 nt, Pseudomonas putida KT2440
caggcagcgaucagugccuugac

SEQ ID NO: 1628967 - RNA, 15 nt, Pseudomonas putida KT2440
caggcagcgauggcc

SEQ ID NO: 1628968 - RNA, 18 nt, Pseudomonas putida KT2440
caggcagaucgaaagaca

SEQ ID NO: 1628969 - RNA, 20 nt, Pseudomonas putida KT2440
caggcagaucgaaagacagc

SEQ ID NO: 1628970 - RNA, 12 nt, Pseudomonas putida KT2440
cacuuucgcggc

SEQ ID NO: 1628971 - RNA, 15 nt, Pseudomonas putida KT2440
cacuuucagcgccug

SEQ ID NO: 1628972 - RNA, 20 nt, Pseudomonas putida KT2440
cacuugcacuuugccgcccg

SEQ ID NO: 1628973 - RNA, 22 nt, Pseudomonas putida KT2440
cacuugcacuuugccgcccgcu

SEQ ID NO: 1628974 - RNA, 15 nt, Pseudomonas putida KT2440
cacuugcagaaacgc

SEQ ID NO: 1628975 - RNA, 15 nt, Pseudomonas putida KT2440
cacuugccgcccucc

SEQ ID NO: 1628976 - RNA, 14 nt, Pseudomonas putida KT2440
cacuugcuggguac

SEQ ID NO: 1628977 - RNA, 19 nt, Pseudomonas putida KT2440
cacuugggaucgaugcacg

SEQ ID NO: 1628978 - RNA, 22 nt, Pseudomonas putida KT2440
cacuugguggcguccacgaccg

SEQ ID NO: 1628979 - RNA, 17 nt, Pseudomonas putida KT2440
cagaaaaaacagugccg

SEQ ID NO: 1628980 - RNA, 13 nt, Pseudomonas putida KT2440
cacuuucuugaaa

SEQ ID NO: 1628981 - RNA, 12 nt, Pseudomonas putida KT2440
cacuuucugcgc

SEQ ID NO: 1628982 - RNA, 17 nt, Pseudomonas putida KT2440
cacuuccggcugcagca

SEQ ID NO: 1628983 - RNA, 17 nt, Pseudomonas putida KT2440
cacuucgauacccagcc

SEQ ID NO: 1628984 - RNA, 18 nt, Pseudomonas putida KT2440
cacuucgauacccagcca

SEQ ID NO: 1628985 - RNA, 20 nt, Pseudomonas putida KT2440
cacuucgaucaggcagucuu

SEQ ID NO: 1628986 - RNA, 20 nt, Pseudomonas putida KT2440
cacuucugcggccagggcau

SEQ ID NO: 1628987 - RNA, 12 nt, Pseudomonas putida KT2440
cacuugaagacc

SEQ ID NO: 1628988 - RNA, 15 nt, Pseudomonas putida KT2440
cacuucaaguucguu

SEQ ID NO: 1628989 - RNA, 15 nt, Pseudomonas putida KT2440
cacuuccagcagcuu

SEQ ID NO: 1628990 - RNA, 15 nt, Pseudomonas putida KT2440
cacuuccaacacccg

SEQ ID NO: 1628991 - RNA, 11 nt, Pseudomonas putida KT2440
cacuuccacac

SEQ ID NO: 1628992 - RNA, 13 nt, Pseudomonas putida KT2440
cacuuccauggca

SEQ ID NO: 1628993 - RNA, 16 nt, Pseudomonas putida KT2440
cacuuccaggaaggcc

SEQ ID NO: 1628994 - RNA, 21 nt, Pseudomonas putida KT2440
cacuuccaggaaggccucgcc

SEQ ID NO: 1628995 - RNA, 19 nt, Pseudomonas putida KT2440
cacuucaggcugcgccgcc

SEQ ID NO: 1628996 - RNA, 23 nt, Pseudomonas putida KT2440
cacuggcgauguagcaauggccc

SEQ ID NO: 1628997 - RNA, 19 nt, Pseudomonas putida KT2440
cacuggcugauagccgcca

SEQ ID NO: 1628998 - RNA, 12 nt, Pseudomonas putida KT2440
cacuggcuuccu

SEQ ID NO: 1628999 - RNA, 17 nt, Pseudomonas putida KT2440
cacuggcuuucccccag

SEQ ID NO: 1629000 - RNA, 18 nt, Pseudomonas putida KT2440
cacuggcuuucccccagc

SEQ ID NO: 1629001 - RNA, 19 nt, Pseudomonas putida KT2440
cacuggcuuucccccagcc

SEQ ID NO: 1629002 - RNA, 15 nt, Pseudomonas putida KT2440
cacuggcgacagccc

SEQ ID NO: 1629003 - RNA, 21 nt, Pseudomonas putida KT2440
cacugcguauuuuugcgccag

SEQ ID NO: 1629004 - RNA, 21 nt, Pseudomonas putida KT2440
cacugcguucaucgaacugca

SEQ ID NO: 1629005 - RNA, 20 nt, Pseudomonas putida KT2440
cacugcucaucggcgccggc

SEQ ID NO: 1629006 - RNA, 22 nt, Pseudomonas putida KT2440
cacugcuucugagccagccgcg

SEQ ID NO: 1629007 - RNA, 13 nt, Pseudomonas putida KT2440
cacuggaacucga

SEQ ID NO: 1629008 - RNA, 15 nt, Pseudomonas putida KT2440
cacugcugccgcccu

SEQ ID NO: 1629009 - RNA, 21 nt, Pseudomonas putida KT2440
cacuggaugacgccgcagccg

SEQ ID NO: 1629010 - RNA, 20 nt, Pseudomonas putida KT2440
cacuggcaggcucagggcag

SEQ ID NO: 1629011 - RNA, 21 nt, Pseudomonas putida KT2440
cacuggccacauggaucagcu

SEQ ID NO: 1629012 - RNA, 13 nt, Pseudomonas putida KT2440
cacuggccacccc

SEQ ID NO: 1629013 - RNA, 14 nt, Pseudomonas putida KT2440
cacuggccaccccc

SEQ ID NO: 1629014 - RNA, 13 nt, Pseudomonas putida KT2440
cacugugcagggg

SEQ ID NO: 1629015 - RNA, 16 nt, Pseudomonas putida KT2440
cacugugcaggggagg

SEQ ID NO: 1629016 - RNA, 19 nt, Pseudomonas putida KT2440
cacugugcccgccaggcgc

SEQ ID NO: 1629017 - RNA, 15 nt, Pseudomonas putida KT2440
cacuguggucaucca

SEQ ID NO: 1629018 - RNA, 14 nt, Pseudomonas putida KT2440
cacuguagcgcccu

SEQ ID NO: 1629019 - RNA, 22 nt, Pseudomonas putida KT2440
cacuguaggagauucuauggcc

SEQ ID NO: 1629020 - RNA, 15 nt, Pseudomonas putida KT2440
cacuguaggcaaaca

SEQ ID NO: 1629021 - RNA, 17 nt, Pseudomonas putida KT2440
cacugucccgaucaggu

SEQ ID NO: 1629022 - RNA, 19 nt, Pseudomonas putida KT2440
cacugucccggcacaaccg

SEQ ID NO: 1629023 - RNA, 15 nt, Pseudomonas putida KT2440
cacuguugcagcgcc

SEQ ID NO: 1629024 - RNA, 21 nt, Pseudomonas putida KT2440
cacuuacacgcaagccccccg

SEQ ID NO: 1629025 - RNA, 21 nt, Pseudomonas putida KT2440
caaugucacuucuuucagcuc

SEQ ID NO: 1629026 - RNA, 16 nt, Pseudomonas putida KT2440
caaugucguauugagc

SEQ ID NO: 1629027 - RNA, 14 nt, Pseudomonas putida KT2440
caauguugaagaug

SEQ ID NO: 1629028 - RNA, 18 nt, Pseudomonas putida KT2440
caauguugaagaugacug

SEQ ID NO: 1629029 - RNA, 23 nt, Pseudomonas putida KT2440
cacugcaccaaugacuccgcccc

SEQ ID NO: 1629030 - RNA, 17 nt, Pseudomonas putida KT2440
cacugcacccucuuccu

SEQ ID NO: 1629031 - RNA, 22 nt, Pseudomonas putida KT2440
cacugaugcgccaguacgccag

SEQ ID NO: 1629032 - RNA, 15 nt, Pseudomonas putida KT2440
cacugcgaagcccag

SEQ ID NO: 1629033 - RNA, 19 nt, Pseudomonas putida KT2440
cacugcgcagcccucccag

SEQ ID NO: 1629034 - RNA, 22 nt, Pseudomonas putida KT2440
cacugcgcuugcgaccgaugcc

SEQ ID NO: 1629035 - RNA, 14 nt, Pseudomonas putida KT2440
cacugccugcaugc

SEQ ID NO: 1629036 - RNA, 22 nt, Pseudomonas putida KT2440
cacugccgugaucgccgggcgc

SEQ ID NO: 1629037 - RNA, 23 nt, Pseudomonas putida KT2440
cacugccuugcccugcagcuucc

SEQ ID NO: 1629038 - RNA, 13 nt, Pseudomonas putida KT2440
cacugccagcgcc

SEQ ID NO: 1629039 - RNA, 17 nt, Pseudomonas putida KT2440
cacugccagcccggcgg

SEQ ID NO: 1629040 - RNA, 21 nt, Pseudomonas putida KT2440
cacugccagcccggcggccag

SEQ ID NO: 1629041 - RNA, 19 nt, Pseudomonas putida KT2440
cacugcccaagccauccac

SEQ ID NO: 1629042 - RNA, 19 nt, Pseudomonas putida KT2440
cacugcccagcagccccac

SEQ ID NO: 1629043 - RNA, 13 nt, Pseudomonas putida KT2440
cacugcccagcag

SEQ ID NO: 1629044 - RNA, 12 nt, Pseudomonas putida KT2440
cacugccaccgu

SEQ ID NO: 1629045 - RNA, 17 nt, Pseudomonas putida KT2440
cacugccaccgugagca

SEQ ID NO: 1629046 - RNA, 13 nt, Pseudomonas putida KT2440
cacugccagcacc

SEQ ID NO: 1629047 - RNA, 16 nt, Pseudomonas putida KT2440
cacugccagcaccugg

SEQ ID NO: 1629048 - RNA, 17 nt, Pseudomonas putida KT2440
cacugccagcaccuggc

SEQ ID NO: 1629049 - RNA, 23 nt, Pseudomonas putida KT2440
cacugcagaucaccagcucgccc

SEQ ID NO: 1629050 - RNA, 23 nt, Pseudomonas putida KT2440
cacugcaggugcagguucgacca

SEQ ID NO: 1629051 - RNA, 18 nt, Pseudomonas putida KT2440
cacugcauuggccacgcc

SEQ ID NO: 1629052 - RNA, 19 nt, Pseudomonas putida KT2440
cacugcauuggccacgccc

SEQ ID NO: 1629053 - RNA, 15 nt, Pseudomonas putida KT2440
cagaacagccacagc

SEQ ID NO: 1629054 - RNA, 19 nt, Pseudomonas putida KT2440
cagaacauggccgagcuga

SEQ ID NO: 1629055 - RNA, 15 nt, Pseudomonas putida KT2440
cagaacaauaaaacu

SEQ ID NO: 1629056 - RNA, 19 nt, Pseudomonas putida KT2440
cagaaaguuugguuuuuuc

SEQ ID NO: 1629057 - RNA, 21 nt, Pseudomonas putida KT2440
cagaaaguuugguuuuuucac

SEQ ID NO: 1629058 - RNA, 23 nt, Pseudomonas putida KT2440
cagaaagugcguuggcugcugaa

SEQ ID NO: 1629059 - RNA, 11 nt, Pseudomonas putida KT2440
cagaaagccac

SEQ ID NO: 1629060 - RNA, 23 nt, Pseudomonas putida KT2440
cagaaacgagcaagccugccguu

SEQ ID NO: 1629061 - RNA, 19 nt, Pseudomonas putida KT2440
cagaaacggcuugaacccg

SEQ ID NO: 1629062 - RNA, 21 nt, Pseudomonas putida KT2440
cagaaacucguuuucgcugau

SEQ ID NO: 1629063 - RNA, 20 nt, Pseudomonas putida KT2440
cagaaacgccaucagugccc

SEQ ID NO: 1629064 - RNA, 15 nt, Pseudomonas putida KT2440
cagaaaaucaggggu

SEQ ID NO: 1629065 - RNA, 23 nt, Pseudomonas putida KT2440
cagaaccccggcccugugccggg

SEQ ID NO: 1629066 - RNA, 21 nt, Pseudomonas putida KT2440
cagaacggcacgcccauuucc

SEQ ID NO: 1629067 - RNA, 16 nt, Pseudomonas putida KT2440
cagaacgccuuguucc

SEQ ID NO: 1629068 - RNA, 18 nt, Pseudomonas putida KT2440
cagaacguacuggccgcu

SEQ ID NO: 1629069 - RNA, 19 nt, Pseudomonas putida KT2440
cagaagccuguacacagcc

SEQ ID NO: 1629070 - RNA, 20 nt, Pseudomonas putida KT2440
cagaagccuguacacagccc

SEQ ID NO: 1629071 - RNA, 20 nt, Pseudomonas putida KT2440
cagaagcgcugacugccagg

SEQ ID NO: 1629072 - RNA, 22 nt, Pseudomonas putida KT2440
cagaaggaagauugaaggggca

SEQ ID NO: 1629073 - RNA, 14 nt, Pseudomonas putida KT2440
cagacaacaucaaa

SEQ ID NO: 1629074 - RNA, 17 nt, Pseudomonas putida KT2440
cagacaacuggccaggg

SEQ ID NO: 1629075 - RNA, 20 nt, Pseudomonas putida KT2440
cagacaaguccuucaucugu

SEQ ID NO: 1629076 - RNA, 22 nt, Pseudomonas putida KT2440
cagaauagcaagcgccaauugg

SEQ ID NO: 1629077 - RNA, 17 nt, Pseudomonas putida KT2440
cagaaucucaaccaccu

SEQ ID NO: 1629078 - RNA, 14 nt, Pseudomonas putida KT2440
cagaccgccgaucg

SEQ ID NO: 1629079 - RNA, 19 nt, Pseudomonas putida KT2440
cagaccagcagcaguggca

SEQ ID NO: 1629080 - RNA, 21 nt, Pseudomonas putida KT2440
cagaccaccucaucccccggc

SEQ ID NO: 1629081 - RNA, 22 nt, Pseudomonas putida KT2440
cagaccaccucaucccccggcc

SEQ ID NO: 1629082 - RNA, 17 nt, Pseudomonas putida KT2440
cagacaccacaaaaccu

SEQ ID NO: 1629083 - RNA, 20 nt, Pseudomonas putida KT2440
cagacauugugagucccugu

SEQ ID NO: 1629084 - RNA, 17 nt, Pseudomonas putida KT2440
cagacauugaagaagcc

SEQ ID NO: 1629085 - RNA, 18 nt, Pseudomonas putida KT2440
cagacuucgcugucuucc

SEQ ID NO: 1629086 - RNA, 18 nt, Pseudomonas putida KT2440
cagacuuucccacaugua

SEQ ID NO: 1629087 - RNA, 20 nt, Pseudomonas putida KT2440
cagagcaaccagcagaucau

SEQ ID NO: 1629088 - RNA, 17 nt, Pseudomonas putida KT2440
cagacggugcgccugaa

SEQ ID NO: 1629089 - RNA, 17 nt, Pseudomonas putida KT2440
cagacucagcugcugcu

SEQ ID NO: 1629090 - RNA, 18 nt, Pseudomonas putida KT2440
cagacucagcugcugcuc

SEQ ID NO: 1629091 - RNA, 18 nt, Pseudomonas putida KT2440
cagacucaaucaggcagc

SEQ ID NO: 1629092 - RNA, 22 nt, Pseudomonas putida KT2440
cagacgcggaacuggcugacca

SEQ ID NO: 1629093 - RNA, 13 nt, Pseudomonas putida KT2440
cagacgaucaggu

SEQ ID NO: 1629094 - RNA, 15 nt, Pseudomonas putida KT2440
cagacgaccagcaug

SEQ ID NO: 1629095 - RNA, 17 nt, Pseudomonas putida KT2440
cagaucacccuuggcca

SEQ ID NO: 1629096 - RNA, 19 nt, Pseudomonas putida KT2440
cagaucacccuuggccacc

SEQ ID NO: 1629097 - RNA, 15 nt, Pseudomonas putida KT2440
cagaucacgcaaccu

SEQ ID NO: 1629098 - RNA, 16 nt, Pseudomonas putida KT2440
cagaucacgcaaccuc

SEQ ID NO: 1629099 - RNA, 22 nt, Pseudomonas putida KT2440
cagaucacuuccaccugcgccu

SEQ ID NO: 1629100 - RNA, 18 nt, Pseudomonas putida KT2440
cagaucagaacgaggcgu

SEQ ID NO: 1629101 - RNA, 15 nt, Pseudomonas putida KT2440
cagaucaucaucggc

SEQ ID NO: 1629102 - RNA, 19 nt, Pseudomonas putida KT2440
cagaucaucaugcccaaug

SEQ ID NO: 1629103 - RNA, 19 nt, Pseudomonas putida KT2440
cagauaacguccagagggc

SEQ ID NO: 1629104 - RNA, 20 nt, Pseudomonas putida KT2440
cagauacgcuucgaacaccc

SEQ ID NO: 1629105 - RNA, 13 nt, Pseudomonas putida KT2440
cagauacugcacc

SEQ ID NO: 1629106 - RNA, 16 nt, Pseudomonas putida KT2440
cagauaaaccugccac

SEQ ID NO: 1629107 - RNA, 21 nt, Pseudomonas putida KT2440
cagauaaaccugccacccauu

SEQ ID NO: 1629108 - RNA, 20 nt, Pseudomonas putida KT2440
cagauaaaaguaauacguaa

SEQ ID NO: 1629109 - RNA, 21 nt, Pseudomonas putida KT2440
cagagugggucaguuugacgg

SEQ ID NO: 1629110 - RNA, 21 nt, Pseudomonas putida KT2440
cagaggcccccuuauggacuu

SEQ ID NO: 1629111 - RNA, 23 nt, Pseudomonas putida KT2440
cagaggcgauggcauccacacgc

SEQ ID NO: 1629112 - RNA, 20 nt, Pseudomonas putida KT2440
cagaggcguagcaagcagau

SEQ ID NO: 1629113 - RNA, 19 nt, Pseudomonas putida KT2440
cagagcgugaagcggacag

SEQ ID NO: 1629114 - RNA, 23 nt, Pseudomonas putida KT2440
cagagcgucaaccaggcgcagca

SEQ ID NO: 1629115 - RNA, 20 nt, Pseudomonas putida KT2440
cagagcggcccugagccuug

SEQ ID NO: 1629116 - RNA, 16 nt, Pseudomonas putida KT2440
cagagcgccagcaagc

SEQ ID NO: 1629117 - RNA, 14 nt, Pseudomonas putida KT2440
cagagcgccccggc

SEQ ID NO: 1629118 - RNA, 15 nt, Pseudomonas putida KT2440
cagagccugcaccca

SEQ ID NO: 1629119 - RNA, 18 nt, Pseudomonas putida KT2440
cagagccugcacccaggc

SEQ ID NO: 1629120 - RNA, 21 nt, Pseudomonas putida KT2440
cagagccugcacccaggcucu

SEQ ID NO: 1629121 - RNA, 12 nt, Pseudomonas putida KT2440
cagagcgcgcca

SEQ ID NO: 1629122 - RNA, 23 nt, Pseudomonas putida KT2440
cagagcgcgccacgcaccagggc

SEQ ID NO: 1629123 - RNA, 11 nt, Pseudomonas putida KT2440
cagagccgcaa

SEQ ID NO: 1629124 - RNA, 19 nt, Pseudomonas putida KT2440
cagcaacggccgcgccgcg

SEQ ID NO: 1629125 - RNA, 15 nt, Pseudomonas putida KT2440
cagcaagaccagaaa

SEQ ID NO: 1629126 - RNA, 14 nt, Pseudomonas putida KT2440
cagcaacugcgccc

SEQ ID NO: 1629127 - RNA, 23 nt, Pseudomonas putida KT2440
cagcaacugcgccguggccgcca

SEQ ID NO: 1629128 - RNA, 13 nt, Pseudomonas putida KT2440
cagcaagggccug

SEQ ID NO: 1629129 - RNA, 18 nt, Pseudomonas putida KT2440
cagcaagggccugugccg

SEQ ID NO: 1629130 - RNA, 22 nt, Pseudomonas putida KT2440
cagcaagccgccgaccaggugg

SEQ ID NO: 1629131 - RNA, 22 nt, Pseudomonas putida KT2440
cagcaagcuggcaccggcgcca

SEQ ID NO: 1629132 - RNA, 21 nt, Pseudomonas putida KT2440
cagcaaggcaauaccgauggc

SEQ ID NO: 1629133 - RNA, 23 nt, Pseudomonas putida KT2440
cagcaaggcaaucgugaucaucc

SEQ ID NO: 1629134 - RNA, 23 nt, Pseudomonas putida KT2440
cagcaacacauacuccaccgcca

SEQ ID NO: 1629135 - RNA, 18 nt, Pseudomonas putida KT2440
cagcaacacgcagucgaa

SEQ ID NO: 1629136 - RNA, 23 nt, Pseudomonas putida KT2440
cagcaacagccccaucaccagcc

SEQ ID NO: 1629137 - RNA, 19 nt, Pseudomonas putida KT2440
cagcaacaucgcccccgcu

SEQ ID NO: 1629138 - RNA, 19 nt, Pseudomonas putida KT2440
cagcaacaugccggcccaa

SEQ ID NO: 1629139 - RNA, 22 nt, Pseudomonas putida KT2440
cagcaacaugccggcccaaggc

SEQ ID NO: 1629140 - RNA, 17 nt, Pseudomonas putida KT2440
cagcaacccggccaggc

SEQ ID NO: 1629141 - RNA, 16 nt, Pseudomonas putida KT2440
cagcaccagcuccugg

SEQ ID NO: 1629142 - RNA, 17 nt, Pseudomonas putida KT2440
cagcaccagcuccuggc

SEQ ID NO: 1629143 - RNA, 14 nt, Pseudomonas putida KT2440
cagcaccagcucau

SEQ ID NO: 1629144 - RNA, 11 nt, Pseudomonas putida KT2440
cagcaccagcg

SEQ ID NO: 1629145 - RNA, 18 nt, Pseudomonas putida KT2440
cagcaccagcgacugcaa

SEQ ID NO: 1629146 - RNA, 11 nt, Pseudomonas putida KT2440
cagcaccaccc

SEQ ID NO: 1629147 - RNA, 19 nt, Pseudomonas putida KT2440
cagcaccacccaccagcag

SEQ ID NO: 1629148 - RNA, 13 nt, Pseudomonas putida KT2440
cagcaccaaccgc

SEQ ID NO: 1629149 - RNA, 19 nt, Pseudomonas putida KT2440
cagcacauucagcagcgcc

SEQ ID NO: 1629150 - RNA, 14 nt, Pseudomonas putida KT2440
cagcacaucacaca

SEQ ID NO: 1629151 - RNA, 18 nt, Pseudomonas putida KT2440
cagcacagauaaaccugc

SEQ ID NO: 1629152 - RNA, 14 nt, Pseudomonas putida KT2440
cagcaaucccgccc

SEQ ID NO: 1629153 - RNA, 23 nt, Pseudomonas putida KT2440
cagcaaucccgccccaaaggaag

SEQ ID NO: 1629154 - RNA, 12 nt, Pseudomonas putida KT2440
cagcaaucggca

SEQ ID NO: 1629155 - RNA, 12 nt, Pseudomonas putida KT2440
cagcaauuccaa

SEQ ID NO: 1629156 - RNA, 23 nt, Pseudomonas putida KT2440
cagcaaugaugaaagcaggucag

SEQ ID NO: 1629157 - RNA, 13 nt, Pseudomonas putida KT2440
cagcacaccgcuc

SEQ ID NO: 1629158 - RNA, 22 nt, Pseudomonas putida KT2440
cagcacaaggcucaagcgcagc

SEQ ID NO: 1629159 - RNA, 23 nt, Pseudomonas putida KT2440
cagcacaaggcucaagcgcagcc

SEQ ID NO: 1629160 - RNA, 20 nt, Pseudomonas putida KT2440
cagcacaaggcugcgcuuga

SEQ ID NO: 1629161 - RNA, 17 nt, Pseudomonas putida KT2440
cagcacaaggcuguucc

SEQ ID NO: 1629162 - RNA, 22 nt, Pseudomonas putida KT2440
cagcacaaggcuguuccacagc

SEQ ID NO: 1629163 - RNA, 16 nt, Pseudomonas putida KT2440
cagcaaaccgaccagg

SEQ ID NO: 1629164 - RNA, 15 nt, Pseudomonas putida KT2440
cagauugcuuauucu

SEQ ID NO: 1629165 - RNA, 13 nt, Pseudomonas putida KT2440
cagaugucuggca

SEQ ID NO: 1629166 - RNA, 16 nt, Pseudomonas putida KT2440
cagaugucuggcauca

SEQ ID NO: 1629167 - RNA, 18 nt, Pseudomonas putida KT2440
cagauggugaugccccug

SEQ ID NO: 1629168 - RNA, 16 nt, Pseudomonas putida KT2440
cagauucgccaaggcc

SEQ ID NO: 1629169 - RNA, 19 nt, Pseudomonas putida KT2440
cagaucgagcgccgcccgg

SEQ ID NO: 1629170 - RNA, 13 nt, Pseudomonas putida KT2440
cagauccugcagc

SEQ ID NO: 1629171 - RNA, 18 nt, Pseudomonas putida KT2440
cagauccugcagccgcac

SEQ ID NO: 1629172 - RNA, 20 nt, Pseudomonas putida KT2440
cagauccugcagccgcaccu

SEQ ID NO: 1629173 - RNA, 23 nt, Pseudomonas putida KT2440
cagaucucgcgcuuuucaucuuc

SEQ ID NO: 1629174 - RNA, 15 nt, Pseudomonas putida KT2440
cagaugaccaaagau

SEQ ID NO: 1629175 - RNA, 16 nt, Pseudomonas putida KT2440
cagaugcugcugcagu

SEQ ID NO: 1629176 - RNA, 21 nt, Pseudomonas putida KT2440
cagaugcuccaaccccagcgc

SEQ ID NO: 1629177 - RNA, 20 nt, Pseudomonas putida KT2440
cagauggcagacaaguccuu

SEQ ID NO: 1629178 - RNA, 22 nt, Pseudomonas putida KT2440
cagauggccgcuugcugaucaa

SEQ ID NO: 1629179 - RNA, 17 nt, Pseudomonas putida KT2440
cagaugccgccgcugcc

SEQ ID NO: 1629180 - RNA, 19 nt, Pseudomonas putida KT2440
cagaugccgccgcugccag

SEQ ID NO: 1629181 - RNA, 20 nt, Pseudomonas putida KT2440
cagaugccgccgcugccagc

SEQ ID NO: 1629182 - RNA, 22 nt, Pseudomonas putida KT2440
cagccaacacccucacccacuc

SEQ ID NO: 1629183 - RNA, 20 nt, Pseudomonas putida KT2440
cagccaacccucgaccucga

SEQ ID NO: 1629184 - RNA, 16 nt, Pseudomonas putida KT2440
cagccaaccgccccac

SEQ ID NO: 1629185 - RNA, 23 nt, Pseudomonas putida KT2440
cagccaaaucagcuguuugaagc

SEQ ID NO: 1629186 - RNA, 20 nt, Pseudomonas putida KT2440
cagcauuucuucgaccugcg

SEQ ID NO: 1629187 - RNA, 22 nt, Pseudomonas putida KT2440
cagccaaaaaaaccccagggca

SEQ ID NO: 1629188 - RNA, 16 nt, Pseudomonas putida KT2440
cagccacauccucugc

SEQ ID NO: 1629189 - RNA, 24 nt, Pseudomonas putida KT2440
cagccaccaccagcuccaccuucc

SEQ ID NO: 1629190 - RNA, 15 nt, Pseudomonas putida KT2440
cagccaccacggugg

SEQ ID NO: 1629191 - RNA, 20 nt, Pseudomonas putida KT2440
cagccacauugauaguagcc

SEQ ID NO: 1629192 - RNA, 19 nt, Pseudomonas putida KT2440
cagccaccgcacucugcug

SEQ ID NO: 1629193 - RNA, 19 nt, Pseudomonas putida KT2440
cagccaccgacgaacaggg

SEQ ID NO: 1629194 - RNA, 22 nt, Pseudomonas putida KT2440
cagccaccgacgaacagggccg

SEQ ID NO: 1629195 - RNA, 11 nt, Pseudomonas putida KT2440
cagcauggccg

SEQ ID NO: 1629196 - RNA, 22 nt, Pseudomonas putida KT2440
cagcauggccgaaaccagcccc

SEQ ID NO: 1629197 - RNA, 23 nt, Pseudomonas putida KT2440
cagcauggccgaaaccagccccu

SEQ ID NO: 1629198 - RNA, 15 nt, Pseudomonas putida KT2440
cagcauguccugcug

SEQ ID NO: 1629199 - RNA, 19 nt, Pseudomonas putida KT2440
cagcauguccugcugcagg

SEQ ID NO: 1629200 - RNA, 21 nt, Pseudomonas putida KT2440
cagcauguccugcugcaggcu

SEQ ID NO: 1629201 - RNA, 22 nt, Pseudomonas putida KT2440
cagcauguccugcugcaggcuc

SEQ ID NO: 1629202 - RNA, 19 nt, Pseudomonas putida KT2440
cagcauuggauacugcccg

SEQ ID NO: 1629203 - RNA, 17 nt, Pseudomonas putida KT2440
cagcauuacgcggcagc

SEQ ID NO: 1629204 - RNA, 21 nt, Pseudomonas putida KT2440
cagcauuacgcggcagcagca

SEQ ID NO: 1629205 - RNA, 23 nt, Pseudomonas putida KT2440
cagcaucagcacacccagcacga

SEQ ID NO: 1629206 - RNA, 18 nt, Pseudomonas putida KT2440
cagcaucagcacacgccc

SEQ ID NO: 1629207 - RNA, 20 nt, Pseudomonas putida KT2440
cagcaucaaucgcuccaggc

SEQ ID NO: 1629208 - RNA, 16 nt, Pseudomonas putida KT2440
cagcaucaacgcugcc

SEQ ID NO: 1629209 - RNA, 21 nt, Pseudomonas putida KT2440
cagcaucaacgcugccaugcg

SEQ ID NO: 1629210 - RNA, 15 nt, Pseudomonas putida KT2440
cagcaucaccacgcc

SEQ ID NO: 1629211 - RNA, 16 nt, Pseudomonas putida KT2440
cagcaucaccacgccc

SEQ ID NO: 1629212 - RNA, 13 nt, Pseudomonas putida KT2440
cagcaucaccgcg

SEQ ID NO: 1629213 - RNA, 23 nt, Pseudomonas putida KT2440
cagcaucaccgcgccggucacuu

SEQ ID NO: 1629214 - RNA, 20 nt, Pseudomonas putida KT2440
cagcaucaccgcgucgauac

SEQ ID NO: 1629215 - RNA, 16 nt, Pseudomonas putida KT2440
cagcaucaucaggccg

SEQ ID NO: 1629216 - RNA, 14 nt, Pseudomonas putida KT2440
cagcaucagugcag

SEQ ID NO: 1629217 - RNA, 15 nt, Pseudomonas putida KT2440
cagcaucagugcagg

SEQ ID NO: 1629218 - RNA, 23 nt, Pseudomonas putida KT2440
cagcaucagugcaggugcacugu

SEQ ID NO: 1629219 - RNA, 23 nt, Pseudomonas putida KT2440
cagcauccaacccugcgcccagu

SEQ ID NO: 1629220 - RNA, 16 nt, Pseudomonas putida KT2440
cagcaugcgggggccc

SEQ ID NO: 1629221 - RNA, 18 nt, Pseudomonas putida KT2440
cagcaugcgggggcccca

SEQ ID NO: 1629222 - RNA, 16 nt, Pseudomonas putida KT2440
cagcaugcgcuugagc

SEQ ID NO: 1629223 - RNA, 13 nt, Pseudomonas putida KT2440
cagcaugcccagc

SEQ ID NO: 1629224 - RNA, 16 nt, Pseudomonas putida KT2440
cagcaugcccagcgcc

SEQ ID NO: 1629225 - RNA, 23 nt, Pseudomonas putida KT2440
cagcaugccccgggugcagccgc

SEQ ID NO: 1629226 - RNA, 17 nt, Pseudomonas putida KT2440
cagcaucugcaccagga

SEQ ID NO: 1629227 - RNA, 20 nt, Pseudomonas putida KT2440
cagcaucugcaccaggaagc

SEQ ID NO: 1629228 - RNA, 20 nt, Pseudomonas putida KT2440
cagcaucuucuucacgucca

SEQ ID NO: 1629229 - RNA, 16 nt, Pseudomonas putida KT2440
cagcaugaaccgcucc

SEQ ID NO: 1629230 - RNA, 19 nt, Pseudomonas putida KT2440
cagcaugaauagcgcacug

SEQ ID NO: 1629231 - RNA, 18 nt, Pseudomonas putida KT2440
cagcaucggcaggucauu

SEQ ID NO: 1629232 - RNA, 15 nt, Pseudomonas putida KT2440
cagcaucgaccugcc

SEQ ID NO: 1629233 - RNA, 23 nt, Pseudomonas putida KT2440
cagcccacggccgccaauagccc

SEQ ID NO: 1629234 - RNA, 12 nt, Pseudomonas putida KT2440
cagcccagcgcc

SEQ ID NO: 1629235 - RNA, 18 nt, Pseudomonas putida KT2440
cagcccagcgccgccggc

SEQ ID NO: 1629236 - RNA, 12 nt, Pseudomonas putida KT2440
cagcccaaggcc

SEQ ID NO: 1629237 - RNA, 16 nt, Pseudomonas putida KT2440
cagccauuggcccacg

SEQ ID NO: 1629238 - RNA, 12 nt, Pseudomonas putida KT2440
cagcccauccag

SEQ ID NO: 1629239 - RNA, 14 nt, Pseudomonas putida KT2440
cagcccaggcuggc

SEQ ID NO: 1629240 - RNA, 17 nt, Pseudomonas putida KT2440
cagcccauuucaccugc

SEQ ID NO: 1629241 - RNA, 19 nt, Pseudomonas putida KT2440
cagcccauuucaccugcuc

SEQ ID NO: 1629242 - RNA, 18 nt, Pseudomonas putida KT2440
cagccccaaaagcccacu

SEQ ID NO: 1629243 - RNA, 12 nt, Pseudomonas putida KT2440
cagccccagccu

SEQ ID NO: 1629244 - RNA, 19 nt, Pseudomonas putida KT2440
cagccccagccucagcugg

SEQ ID NO: 1629245 - RNA, 22 nt, Pseudomonas putida KT2440
cagccccagccucagcuggccg

SEQ ID NO: 1629246 - RNA, 17 nt, Pseudomonas putida KT2440
cagccccacgcccaggc

SEQ ID NO: 1629247 - RNA, 16 nt, Pseudomonas putida KT2440
cagcccauucgcgggu

SEQ ID NO: 1629248 - RNA, 13 nt, Pseudomonas putida KT2440
cagccccccuucc

SEQ ID NO: 1629249 - RNA, 15 nt, Pseudomonas putida KT2440
cagccccgccgcccc

SEQ ID NO: 1629250 - RNA, 11 nt, Pseudomonas putida KT2440
cagccccaggg

SEQ ID NO: 1629251 - RNA, 15 nt, Pseudomonas putida KT2440
cagccccagggcccu

SEQ ID NO: 1629252 - RNA, 20 nt, Pseudomonas putida KT2440
cagccccagggcccucaacc

SEQ ID NO: 1629253 - RNA, 17 nt, Pseudomonas putida KT2440
cagccccaucaccagcc

SEQ ID NO: 1629254 - RNA, 18 nt, Pseudomonas putida KT2440
cagccccaucaccagccc

SEQ ID NO: 1629255 - RNA, 16 nt, Pseudomonas putida KT2440
cagcccccccaaggcg

SEQ ID NO: 1629256 - RNA, 16 nt, Pseudomonas putida KT2440
cagcccccaccgggcu

SEQ ID NO: 1629257 - RNA, 17 nt, Pseudomonas putida KT2440
cagccccucaggcacau

SEQ ID NO: 1629258 - RNA, 17 nt, Pseudomonas putida KT2440
cagccccuuccccaggc

SEQ ID NO: 1629259 - RNA, 19 nt, Pseudomonas putida KT2440
cagccccuuccccaggccg

SEQ ID NO: 1629260 - RNA, 16 nt, Pseudomonas putida KT2440
cagcccgaagccggca

SEQ ID NO: 1629261 - RNA, 18 nt, Pseudomonas putida KT2440
cagcccgaagccggcaug

SEQ ID NO: 1629262 - RNA, 16 nt, Pseudomonas putida KT2440
cagcccgaagcgcagg

SEQ ID NO: 1629263 - RNA, 21 nt, Pseudomonas putida KT2440
cagcccgacgauuucucccca

SEQ ID NO: 1629264 - RNA, 21 nt, Pseudomonas putida KT2440
cagccaggguguacuucaccu

SEQ ID NO: 1629265 - RNA, 17 nt, Pseudomonas putida KT2440
cagccagguauggccag

SEQ ID NO: 1629266 - RNA, 20 nt, Pseudomonas putida KT2440
cagccagguauggccagagc

SEQ ID NO: 1629267 - RNA, 14 nt, Pseudomonas putida KT2440
cagccagguucgga

SEQ ID NO: 1629268 - RNA, 20 nt, Pseudomonas putida KT2440
cagccagccggcgcaucagu

SEQ ID NO: 1629269 - RNA, 14 nt, Pseudomonas putida KT2440
cagccagcgacagc

SEQ ID NO: 1629270 - RNA, 13 nt, Pseudomonas putida KT2440
cagccagccucuu

SEQ ID NO: 1629271 - RNA, 17 nt, Pseudomonas putida KT2440
cagccagccucuucuuc

SEQ ID NO: 1629272 - RNA, 18 nt, Pseudomonas putida KT2440
cagccagccucuucuuca

SEQ ID NO: 1629273 - RNA, 13 nt, Pseudomonas putida KT2440
cagccaggcacag

SEQ ID NO: 1629274 - RNA, 17 nt, Pseudomonas putida KT2440
cagccaggcacuggcca

SEQ ID NO: 1629275 - RNA, 19 nt, Pseudomonas putida KT2440
cagccagaaagccacugca

SEQ ID NO: 1629276 - RNA, 16 nt, Pseudomonas putida KT2440
cagccacuuggcccca

SEQ ID NO: 1629277 - RNA, 20 nt, Pseudomonas putida KT2440
cagccacuuggccccaggga

SEQ ID NO: 1629278 - RNA, 19 nt, Pseudomonas putida KT2440
cagccacgucgccagcggc

SEQ ID NO: 1629279 - RNA, 20 nt, Pseudomonas putida KT2440
cagccacgucgccagcggca

SEQ ID NO: 1629280 - RNA, 13 nt, Pseudomonas putida KT2440
cagccaccgccgg

SEQ ID NO: 1629281 - RNA, 14 nt, Pseudomonas putida KT2440
cagccaccuguggg

SEQ ID NO: 1629282 - RNA, 18 nt, Pseudomonas putida KT2440
cagccagcaucucggcca

SEQ ID NO: 1629283 - RNA, 16 nt, Pseudomonas putida KT2440
cagccagccaccacca

SEQ ID NO: 1629284 - RNA, 16 nt, Pseudomonas putida KT2440
cagccagcagcguacc

SEQ ID NO: 1629285 - RNA, 22 nt, Pseudomonas putida KT2440
cagccagcagcguacccagcuc

SEQ ID NO: 1629286 - RNA, 19 nt, Pseudomonas putida KT2440
cagcagugaucaucacacu

SEQ ID NO: 1629287 - RNA, 14 nt, Pseudomonas putida KT2440
cagcagugcaccca

SEQ ID NO: 1629288 - RNA, 21 nt, Pseudomonas putida KT2440
cagcagugcaucgaagcaggc

SEQ ID NO: 1629289 - RNA, 17 nt, Pseudomonas putida KT2440
cagcagugccagcaaca

SEQ ID NO: 1629290 - RNA, 14 nt, Pseudomonas putida KT2440
cagcagugccgccu

SEQ ID NO: 1629291 - RNA, 23 nt, Pseudomonas putida KT2440
cagcaguucgcggucgccgugca

SEQ ID NO: 1629292 - RNA, 16 nt, Pseudomonas putida KT2440
cagcaguuucagcggc

SEQ ID NO: 1629293 - RNA, 22 nt, Pseudomonas putida KT2440
cagcaguugcugcugccagugg

SEQ ID NO: 1629294 - RNA, 20 nt, Pseudomonas putida KT2440
cagcagguucaacggcgccc

SEQ ID NO: 1629295 - RNA, 23 nt, Pseudomonas putida KT2440
cagcagguugaacagcagcgccg

SEQ ID NO: 1629296 - RNA, 15 nt, Pseudomonas putida KT2440
cagcagguacaccgc

SEQ ID NO: 1629297 - RNA, 18 nt, Pseudomonas putida KT2440
cagcaggucagcacgcgc

SEQ ID NO: 1629298 - RNA, 16 nt, Pseudomonas putida KT2440
cagcaggugcccaagc

SEQ ID NO: 1629299 - RNA, 14 nt, Pseudomonas putida KT2440
cagcaggcgcggcg

SEQ ID NO: 1629300 - RNA, 15 nt, Pseudomonas putida KT2440
cagcaggcgcggcgu

SEQ ID NO: 1629301 - RNA, 22 nt, Pseudomonas putida KT2440
cagcaggcgcggcguggccuca

SEQ ID NO: 1629302 - RNA, 21 nt, Pseudomonas putida KT2440
cagcaggcgcgagccuugcca

SEQ ID NO: 1629303 - RNA, 18 nt, Pseudomonas putida KT2440
cagcaggccgccgacgau

SEQ ID NO: 1629304 - RNA, 13 nt, Pseudomonas putida KT2440
cagcaggccaccg

SEQ ID NO: 1629305 - RNA, 23 nt, Pseudomonas putida KT2440
cagcaggccaccggcagcaccug

SEQ ID NO: 1629306 - RNA, 21 nt, Pseudomonas putida KT2440
cagcaggcaaagaaugccgcc

SEQ ID NO: 1629307 - RNA, 21 nt, Pseudomonas putida KT2440
cagcaggccauauugcugagc

SEQ ID NO: 1629308 - RNA, 14 nt, Pseudomonas putida KT2440
cagcaggcccgcca

SEQ ID NO: 1629309 - RNA, 20 nt, Pseudomonas putida KT2440
cagcaggcccgccaccgccu

SEQ ID NO: 1629310 - RNA, 15 nt, Pseudomonas putida KT2440
cagcaggcccggccc

SEQ ID NO: 1629311 - RNA, 18 nt, Pseudomonas putida KT2440
cagcagggccggcccuuu

SEQ ID NO: 1629312 - RNA, 15 nt, Pseudomonas putida KT2440
cagcaggcuugccag

SEQ ID NO: 1629313 - RNA, 16 nt, Pseudomonas putida KT2440
cagcaggcugcgugcc

SEQ ID NO: 1629314 - RNA, 20 nt, Pseudomonas putida KT2440
cagcaggcugcgugccugcu

SEQ ID NO: 1629315 - RNA, 23 nt, Pseudomonas putida KT2440
cagcaggcugcgugccugcugcu

SEQ ID NO: 1629316 - RNA, 17 nt, Pseudomonas putida KT2440
cagcaggcuggcggcca

SEQ ID NO: 1629317 - RNA, 21 nt, Pseudomonas putida KT2440
cagcagggucgccugaacgcu

SEQ ID NO: 1629318 - RNA, 17 nt, Pseudomonas putida KT2440
cagcaggggcagaugcu

SEQ ID NO: 1629319 - RNA, 19 nt, Pseudomonas putida KT2440
cagcagggccaucaucugc

SEQ ID NO: 1629320 - RNA, 15 nt, Pseudomonas putida KT2440
cagcagcuugcgcgc

SEQ ID NO: 1629321 - RNA, 16 nt, Pseudomonas putida KT2440
cagcagcuucagcuug

SEQ ID NO: 1629322 - RNA, 18 nt, Pseudomonas putida KT2440
cagcagcuucagcuugag

SEQ ID NO: 1629323 - RNA, 17 nt, Pseudomonas putida KT2440
cagcagcucccgagcca

SEQ ID NO: 1629324 - RNA, 20 nt, Pseudomonas putida KT2440
cagcagcucccgagccagga

SEQ ID NO: 1629325 - RNA, 22 nt, Pseudomonas putida KT2440
cagcagcucccgagccaggaag

SEQ ID NO: 1629326 - RNA, 21 nt, Pseudomonas putida KT2440
cagcagcuccacaucuugccc

SEQ ID NO: 1629327 - RNA, 23 nt, Pseudomonas putida KT2440
cagcagcuccacaucuugccccg

SEQ ID NO: 1629328 - RNA, 17 nt, Pseudomonas putida KT2440
cagcaggacccggcugg

SEQ ID NO: 1629329 - RNA, 18 nt, Pseudomonas putida KT2440
cagcaggaaauacgccgc

SEQ ID NO: 1629330 - RNA, 13 nt, Pseudomonas putida KT2440
cagcaggaacagc

SEQ ID NO: 1629331 - RNA, 19 nt, Pseudomonas putida KT2440
cagcaggaacagcggcagc

SEQ ID NO: 1629332 - RNA, 12 nt, Pseudomonas putida KT2440
cagcaggaagcu

SEQ ID NO: 1629333 - RNA, 16 nt, Pseudomonas putida KT2440
cagcagcgcgccgaac

SEQ ID NO: 1629334 - RNA, 14 nt, Pseudomonas putida KT2440
cagcagcgcgugcu

SEQ ID NO: 1629335 - RNA, 16 nt, Pseudomonas putida KT2440
cagcagcgcuccgcca

SEQ ID NO: 1629336 - RNA, 20 nt, Pseudomonas putida KT2440
cagcagccaacgccccaggc

SEQ ID NO: 1629337 - RNA, 21 nt, Pseudomonas putida KT2440
cagcagccacgggugcgggcu

SEQ ID NO: 1629338 - RNA, 17 nt, Pseudomonas putida KT2440
cagcagcaugaauagcg

SEQ ID NO: 1629339 - RNA, 21 nt, Pseudomonas putida KT2440
cagcagcaggcgcgagccuug

SEQ ID NO: 1629340 - RNA, 16 nt, Pseudomonas putida KT2440
cagcagcagccccagc

SEQ ID NO: 1629341 - RNA, 14 nt, Pseudomonas putida KT2440
cagcagcagcgcac

SEQ ID NO: 1629342 - RNA, 15 nt, Pseudomonas putida KT2440
cagcagcaggcccgc

SEQ ID NO: 1629343 - RNA, 22 nt, Pseudomonas putida KT2440
cagcagcaggcccgccaccgcc

SEQ ID NO: 1629344 - RNA, 17 nt, Pseudomonas putida KT2440
cagcagccugugcggcu

SEQ ID NO: 1629345 - RNA, 14 nt, Pseudomonas putida KT2440
cagcagcgccgcca

SEQ ID NO: 1629346 - RNA, 18 nt, Pseudomonas putida KT2440
cagcagcgccgccaggcc

SEQ ID NO: 1629347 - RNA, 16 nt, Pseudomonas putida KT2440
cagcagcgcauccacc

SEQ ID NO: 1629348 - RNA, 20 nt, Pseudomonas putida KT2440
cagcagcgacaccagcgcac

SEQ ID NO: 1629349 - RNA, 20 nt, Pseudomonas putida KT2440
cagcagccccacgcccaggc

SEQ ID NO: 1629350 - RNA, 14 nt, Pseudomonas putida KT2440
cagcagccccagcg

SEQ ID NO: 1629351 - RNA, 22 nt, Pseudomonas putida KT2440
cagcacgccgccgauaccgaac

SEQ ID NO: 1629352 - RNA, 20 nt, Pseudomonas putida KT2440
cagcacgccggcauagaugg

SEQ ID NO: 1629353 - RNA, 18 nt, Pseudomonas putida KT2440
cagcacgcgaucggcagc

SEQ ID NO: 1629354 - RNA, 22 nt, Pseudomonas putida KT2440
cagcagcaaugccgaacaguca

SEQ ID NO: 1629355 - RNA, 17 nt, Pseudomonas putida KT2440
cagcagcaccgccacca

SEQ ID NO: 1629356 - RNA, 24 nt, Pseudomonas putida KT2440
cagcagcaccgccaccaugcucac

SEQ ID NO: 1629357 - RNA, 14 nt, Pseudomonas putida KT2440
cagcagagagauug

SEQ ID NO: 1629358 - RNA, 16 nt, Pseudomonas putida KT2440
cagcacuuccuuguca

SEQ ID NO: 1629359 - RNA, 16 nt, Pseudomonas putida KT2440
cagcacuucgaucagg

SEQ ID NO: 1629360 - RNA, 23 nt, Pseudomonas putida KT2440
cagcacuucgaucaggcagucuu

SEQ ID NO: 1629361 - RNA, 16 nt, Pseudomonas putida KT2440
cagcacuucguccagg

SEQ ID NO: 1629362 - RNA, 17 nt, Pseudomonas putida KT2440
cagcacuucguccaggg

SEQ ID NO: 1629363 - RNA, 17 nt, Pseudomonas putida KT2440
cagcacugcauuggcca

SEQ ID NO: 1629364 - RNA, 19 nt, Pseudomonas putida KT2440
cagcacugcauuggccacg

SEQ ID NO: 1629365 - RNA, 14 nt, Pseudomonas putida KT2440
cagcacugccugca

SEQ ID NO: 1629366 - RNA, 22 nt, Pseudomonas putida KT2440
cagcacugccugcaugcgugcc

SEQ ID NO: 1629367 - RNA, 13 nt, Pseudomonas putida KT2440
cagcacugcugcg

SEQ ID NO: 1629368 - RNA, 21 nt, Pseudomonas putida KT2440
cagcaccaucagagcgccagc

SEQ ID NO: 1629369 - RNA, 16 nt, Pseudomonas putida KT2440
cagcaccccagcacca

SEQ ID NO: 1629370 - RNA, 13 nt, Pseudomonas putida KT2440
cagcaccccgucc

SEQ ID NO: 1629371 - RNA, 19 nt, Pseudomonas putida KT2440
cagcaccccguccagcccc

SEQ ID NO: 1629372 - RNA, 13 nt, Pseudomonas putida KT2440
cagcacccgccca

SEQ ID NO: 1629373 - RNA, 12 nt, Pseudomonas putida KT2440
cagcacccgcuu

SEQ ID NO: 1629374 - RNA, 13 nt, Pseudomonas putida KT2440
cagcacccgcuug

SEQ ID NO: 1629375 - RNA, 17 nt, Pseudomonas putida KT2440
cagcacccgcuuggcca

SEQ ID NO: 1629376 - RNA, 21 nt, Pseudomonas putida KT2440
cagcacccgcuuggccaccac

SEQ ID NO: 1629377 - RNA, 15 nt, Pseudomonas putida KT2440
cagcaccgccaccau

SEQ ID NO: 1629378 - RNA, 20 nt, Pseudomonas putida KT2440
cagcaccgccauggccaggu

SEQ ID NO: 1629379 - RNA, 23 nt, Pseudomonas putida KT2440
cagcaccgaaccggcgaucaggg

SEQ ID NO: 1629380 - RNA, 14 nt, Pseudomonas putida KT2440
cagcaccgugggcg

SEQ ID NO: 1629381 - RNA, 23 nt, Pseudomonas putida KT2440
cagcaccgggcgggugcauggcu

SEQ ID NO: 1629382 - RNA, 14 nt, Pseudomonas putida KT2440
cagcaccggccagg

SEQ ID NO: 1629383 - RNA, 13 nt, Pseudomonas putida KT2440
cagcaccugcagg

SEQ ID NO: 1629384 - RNA, 14 nt, Pseudomonas putida KT2440
cagcaccugccagc

SEQ ID NO: 1629385 - RNA, 17 nt, Pseudomonas putida KT2440
cagcaccugccagccgc

SEQ ID NO: 1629386 - RNA, 20 nt, Pseudomonas putida KT2440
cagcaccugccagccgcaac

SEQ ID NO: 1629387 - RNA, 23 nt, Pseudomonas putida KT2440
cagcaccugggcgucaucacccg

SEQ ID NO: 1629388 - RNA, 23 nt, Pseudomonas putida KT2440
cagcaccugacgcaagcgcgccg

SEQ ID NO: 1629389 - RNA, 15 nt, Pseudomonas putida KT2440
cagcacgcccaucag

SEQ ID NO: 1629390 - RNA, 20 nt, Pseudomonas putida KT2440
cagcacgcccaucagcgccg

SEQ ID NO: 1629391 - RNA, 18 nt, Pseudomonas putida KT2440
cagcacgaucagcgcggc

SEQ ID NO: 1629392 - RNA, 17 nt, Pseudomonas putida KT2440
cagcccggacugcacca

SEQ ID NO: 1629393 - RNA, 12 nt, Pseudomonas putida KT2440
cagcccgccacc

SEQ ID NO: 1629394 - RNA, 14 nt, Pseudomonas putida KT2440
cagcccgccacccg

SEQ ID NO: 1629395 - RNA, 20 nt, Pseudomonas putida KT2440
cagcccgauaaacacgaaca

SEQ ID NO: 1629396 - RNA, 20 nt, Pseudomonas putida KT2440
cagcccggcaaacuccacug

SEQ ID NO: 1629397 - RNA, 14 nt, Pseudomonas putida KT2440
cagcccggcggcca

SEQ ID NO: 1629398 - RNA, 21 nt, Pseudomonas putida KT2440
cagcccggugaagucaccgaa

SEQ ID NO: 1629399 - RNA, 18 nt, Pseudomonas putida KT2440
cagcccggugcccuugcc

SEQ ID NO: 1629400 - RNA, 23 nt, Pseudomonas putida KT2440
cagcccggugcccuugccgcccc

SEQ ID NO: 1629401 - RNA, 16 nt, Pseudomonas putida KT2440
cagcccgguccaugua

SEQ ID NO: 1629402 - RNA, 14 nt, Pseudomonas putida KT2440
cagcccggcgccga

SEQ ID NO: 1629403 - RNA, 12 nt, Pseudomonas putida KT2440
cagcccuuccac

SEQ ID NO: 1629404 - RNA, 15 nt, Pseudomonas putida KT2440
cagcccugaacacgu

SEQ ID NO: 1629405 - RNA, 16 nt, Pseudomonas putida KT2440
cagcccugccgaggcc

SEQ ID NO: 1629406 - RNA, 21 nt, Pseudomonas putida KT2440
cagcccugccgaggccaugug

SEQ ID NO: 1629407 - RNA, 15 nt, Pseudomonas putida KT2440
cagcccugcucgcca

SEQ ID NO: 1629408 - RNA, 14 nt, Pseudomonas putida KT2440
cagcccuggcgacg

SEQ ID NO: 1629409 - RNA, 17 nt, Pseudomonas putida KT2440
cagcccgucacgugccu

SEQ ID NO: 1629410 - RNA, 17 nt, Pseudomonas putida KT2440
cagcccguucuggccuu

SEQ ID NO: 1629411 - RNA, 22 nt, Pseudomonas putida KT2440
cagccgagggguguaacccggg

SEQ ID NO: 1629412 - RNA, 16 nt, Pseudomonas putida KT2440
cagccgagccaaccgc

SEQ ID NO: 1629413 - RNA, 15 nt, Pseudomonas putida KT2440
cagccgaucacuucc

SEQ ID NO: 1629414 - RNA, 20 nt, Pseudomonas putida KT2440
cagcccuugcucggccagcc

SEQ ID NO: 1629415 - RNA, 16 nt, Pseudomonas putida KT2440
cagcccuugcugcagc

SEQ ID NO: 1629416 - RNA, 20 nt, Pseudomonas putida KT2440
cagccgaacuugucuguacu

SEQ ID NO: 1629417 - RNA, 16 nt, Pseudomonas putida KT2440
cagccgcccaguucca

SEQ ID NO: 1629418 - RNA, 18 nt, Pseudomonas putida KT2440
cagccgcacccaggccac

SEQ ID NO: 1629419 - RNA, 19 nt, Pseudomonas putida KT2440
cagccgcacccaggccacg

SEQ ID NO: 1629420 - RNA, 16 nt, Pseudomonas putida KT2440
cagccgcaggcgcccc

SEQ ID NO: 1629421 - RNA, 11 nt, Pseudomonas putida KT2440
cagccgcgaac

SEQ ID NO: 1629422 - RNA, 22 nt, Pseudomonas putida KT2440
cagccgcgcaugcugugcccug

SEQ ID NO: 1629423 - RNA, 13 nt, Pseudomonas putida KT2440
cagccgcccgccc

SEQ ID NO: 1629424 - RNA, 14 nt, Pseudomonas putida KT2440
cagccgccgccugu

SEQ ID NO: 1629425 - RNA, 11 nt, Pseudomonas putida KT2440
cagccgcgcug

SEQ ID NO: 1629426 - RNA, 16 nt, Pseudomonas putida KT2440
cagccgcgcugacgca

SEQ ID NO: 1629427 - RNA, 12 nt, Pseudomonas putida KT2440
cagccgcgggcg

SEQ ID NO: 1629428 - RNA, 14 nt, Pseudomonas putida KT2440
cagccgcgggcucg

SEQ ID NO: 1629429 - RNA, 14 nt, Pseudomonas putida KT2440
cagccgcgccaggu

SEQ ID NO: 1629430 - RNA, 15 nt, Pseudomonas putida KT2440
cagccgcgccacucc

SEQ ID NO: 1629431 - RNA, 17 nt, Pseudomonas putida KT2440
cagccgcgccacuccca

SEQ ID NO: 1629432 - RNA, 12 nt, Pseudomonas putida KT2440
cagccgcgcccu

SEQ ID NO: 1629433 - RNA, 17 nt, Pseudomonas putida KT2440
cagccgcgcccucuucc

SEQ ID NO: 1629434 - RNA, 19 nt, Pseudomonas putida KT2440
cagccggucauccagcagc

SEQ ID NO: 1629435 - RNA, 14 nt, Pseudomonas putida KT2440
cagccgggccaacu

SEQ ID NO: 1629436 - RNA, 19 nt, Pseudomonas putida KT2440
cagccggcccuucugcugc

SEQ ID NO: 1629437 - RNA, 14 nt, Pseudomonas putida KT2440
cagccggcccggcu

SEQ ID NO: 1629438 - RNA, 21 nt, Pseudomonas putida KT2440
cagccgcugcgccugccgggc

SEQ ID NO: 1629439 - RNA, 15 nt, Pseudomonas putida KT2440
cagccgcucagccac

SEQ ID NO: 1629440 - RNA, 17 nt, Pseudomonas putida KT2440
cagccgcggcacccaau

SEQ ID NO: 1629441 - RNA, 13 nt, Pseudomonas putida KT2440
cagccggcagcaa

SEQ ID NO: 1629442 - RNA, 19 nt, Pseudomonas putida KT2440
cagccgcuguucugcaguc

SEQ ID NO: 1629443 - RNA, 13 nt, Pseudomonas putida KT2440
cagcgacugccaa

SEQ ID NO: 1629444 - RNA, 22 nt, Pseudomonas putida KT2440
cagcgacugccaaugcucagug

SEQ ID NO: 1629445 - RNA, 18 nt, Pseudomonas putida KT2440
cagcgaggguuccaggcc

SEQ ID NO: 1629446 - RNA, 15 nt, Pseudomonas putida KT2440
cagcgagcagccugg

SEQ ID NO: 1629447 - RNA, 16 nt, Pseudomonas putida KT2440
cagcgaacgccggggc

SEQ ID NO: 1629448 - RNA, 21 nt, Pseudomonas putida KT2440
cagccuuuuuuuauuuuucug

SEQ ID NO: 1629449 - RNA, 23 nt, Pseudomonas putida KT2440
cagcgaagggcucaacgccaggg

SEQ ID NO: 1629450 - RNA, 12 nt, Pseudomonas putida KT2440
cagcgacccuga

SEQ ID NO: 1629451 - RNA, 16 nt, Pseudomonas putida KT2440
cagcgacaacggcugg

SEQ ID NO: 1629452 - RNA, 13 nt, Pseudomonas putida KT2440
cagcgacaugccg

SEQ ID NO: 1629453 - RNA, 18 nt, Pseudomonas putida KT2440
cagcgacaugccggccac

SEQ ID NO: 1629454 - RNA, 14 nt, Pseudomonas putida KT2440
cagcgacaccagcg

SEQ ID NO: 1629455 - RNA, 19 nt, Pseudomonas putida KT2440
cagcgacaccagcgcacca

SEQ ID NO: 1629456 - RNA, 14 nt, Pseudomonas putida KT2440
cagccuucgccaac

SEQ ID NO: 1629457 - RNA, 24 nt, Pseudomonas putida KT2440
cagccuuaccccccugcaccauca

SEQ ID NO: 1629458 - RNA, 15 nt, Pseudomonas putida KT2440
cagccuucagcaggc

SEQ ID NO: 1629459 - RNA, 19 nt, Pseudomonas putida KT2440
cagccuucagcaggcgcgg

SEQ ID NO: 1629460 - RNA, 23 nt, Pseudomonas putida KT2440
cagccuucaggguuguggugagc

SEQ ID NO: 1629461 - RNA, 20 nt, Pseudomonas putida KT2440
cagccuguaccgcccucuuc

SEQ ID NO: 1629462 - RNA, 21 nt, Pseudomonas putida KT2440
cagccugugcggcuccggcgu

SEQ ID NO: 1629463 - RNA, 17 nt, Pseudomonas putida KT2440
cagccuguggguaugcc

SEQ ID NO: 1629464 - RNA, 18 nt, Pseudomonas putida KT2440
cagccugacgcgccgcca

SEQ ID NO: 1629465 - RNA, 15 nt, Pseudomonas putida KT2440
cagccugcagcaccc

SEQ ID NO: 1629466 - RNA, 15 nt, Pseudomonas putida KT2440
cagccugcagcgcgg

SEQ ID NO: 1629467 - RNA, 15 nt, Pseudomonas putida KT2440
cagccugcccgccgu

SEQ ID NO: 1629468 - RNA, 14 nt, Pseudomonas putida KT2440
cagccguggcaacg

SEQ ID NO: 1629469 - RNA, 21 nt, Pseudomonas putida KT2440
cagccguggcaacgccacacu

SEQ ID NO: 1629470 - RNA, 15 nt, Pseudomonas putida KT2440
cagccgucgccgcuu

SEQ ID NO: 1629471 - RNA, 16 nt, Pseudomonas putida KT2440
cagccgucgccgcuuc

SEQ ID NO: 1629472 - RNA, 21 nt, Pseudomonas putida KT2440
cagccguugauccaggcuugg

SEQ ID NO: 1629473 - RNA, 16 nt, Pseudomonas putida KT2440
cagccguugcgccgcu

SEQ ID NO: 1629474 - RNA, 19 nt, Pseudomonas putida KT2440
cagccggucucccagcgcu

SEQ ID NO: 1629475 - RNA, 18 nt, Pseudomonas putida KT2440
cagccguccucgacccag

SEQ ID NO: 1629476 - RNA, 20 nt, Pseudomonas putida KT2440
cagccucguccaucuugcug

SEQ ID NO: 1629477 - RNA, 17 nt, Pseudomonas putida KT2440
cagccucuucggccagc

SEQ ID NO: 1629478 - RNA, 13 nt, Pseudomonas putida KT2440
cagccucagcugg

SEQ ID NO: 1629479 - RNA, 15 nt, Pseudomonas putida KT2440
cagccucagcuggcc

SEQ ID NO: 1629480 - RNA, 18 nt, Pseudomonas putida KT2440
cagccucagcuggccggc

SEQ ID NO: 1629481 - RNA, 17 nt, Pseudomonas putida KT2440
cagcgccgccaggccca

SEQ ID NO: 1629482 - RNA, 20 nt, Pseudomonas putida KT2440
cagcgccgccaggcccacca

SEQ ID NO: 1629483 - RNA, 21 nt, Pseudomonas putida KT2440
cagcgccgccaggcccaccac

SEQ ID NO: 1629484 - RNA, 19 nt, Pseudomonas putida KT2440
cagcgccgcgccaccgauc

SEQ ID NO: 1629485 - RNA, 16 nt, Pseudomonas putida KT2440
cagcgcccggcgcagc

SEQ ID NO: 1629486 - RNA, 17 nt, Pseudomonas putida KT2440
cagcgcccggcgcagca

SEQ ID NO: 1629487 - RNA, 19 nt, Pseudomonas putida KT2440
cagcgccgaaauaugcagu

SEQ ID NO: 1629488 - RNA, 15 nt, Pseudomonas putida KT2440
cagcgccgauggcca

SEQ ID NO: 1629489 - RNA, 17 nt, Pseudomonas putida KT2440
cagcgccgauggccaau

SEQ ID NO: 1629490 - RNA, 18 nt, Pseudomonas putida KT2440
cagcgccgcaacggccga

SEQ ID NO: 1629491 - RNA, 19 nt, Pseudomonas putida KT2440
cagcgccgcauccagcacu

SEQ ID NO: 1629492 - RNA, 16 nt, Pseudomonas putida KT2440
cagcgccgcaucgcca

SEQ ID NO: 1629493 - RNA, 15 nt, Pseudomonas putida KT2440
cagcgccucccccag

SEQ ID NO: 1629494 - RNA, 14 nt, Pseudomonas putida KT2440
cagcgccuccagca

SEQ ID NO: 1629495 - RNA, 17 nt, Pseudomonas putida KT2440
cagcgccucaccgaccc

SEQ ID NO: 1629496 - RNA, 23 nt, Pseudomonas putida KT2440
cagcgccucaccgacccacaggc

SEQ ID NO: 1629497 - RNA, 12 nt, Pseudomonas putida KT2440
cagcgccuccag

SEQ ID NO: 1629498 - RNA, 11 nt, Pseudomonas putida KT2440
cagcgccgcgg

SEQ ID NO: 1629499 - RNA, 13 nt, Pseudomonas putida KT2440
cagcgccgcuuca

SEQ ID NO: 1629500 - RNA, 17 nt, Pseudomonas putida KT2440
cagcgccgcuucagccu

SEQ ID NO: 1629501 - RNA, 20 nt, Pseudomonas putida KT2440
cagcgccgguagcggcuggg

SEQ ID NO: 1629502 - RNA, 17 nt, Pseudomonas putida KT2440
cagcgccagcagccggg

SEQ ID NO: 1629503 - RNA, 16 nt, Pseudomonas putida KT2440
cagcgccaccggcagc

SEQ ID NO: 1629504 - RNA, 14 nt, Pseudomonas putida KT2440
cagcgccccgccgc

SEQ ID NO: 1629505 - RNA, 15 nt, Pseudomonas putida KT2440
cagcgcccagaacac

SEQ ID NO: 1629506 - RNA, 20 nt, Pseudomonas putida KT2440
cagcgcccagaucagcagca

SEQ ID NO: 1629507 - RNA, 23 nt, Pseudomonas putida KT2440
cagcgcccagaucagcagcaccg

SEQ ID NO: 1629508 - RNA, 18 nt, Pseudomonas putida KT2440
cagcgccaguuacccugu

SEQ ID NO: 1629509 - RNA, 14 nt, Pseudomonas putida KT2440
cagcgcaucggcca

SEQ ID NO: 1629510 - RNA, 14 nt, Pseudomonas putida KT2440
cagcgcauaggcca

SEQ ID NO: 1629511 - RNA, 17 nt, Pseudomonas putida KT2440
cagcgcagucaccacac

SEQ ID NO: 1629512 - RNA, 13 nt, Pseudomonas putida KT2440
cagcgcagcuucu

SEQ ID NO: 1629513 - RNA, 12 nt, Pseudomonas putida KT2440
cagcgcagccac

SEQ ID NO: 1629514 - RNA, 15 nt, Pseudomonas putida KT2440
cagcgcagccaccag

SEQ ID NO: 1629515 - RNA, 17 nt, Pseudomonas putida KT2440
cagcgccaauaccgcgc

SEQ ID NO: 1629516 - RNA, 18 nt, Pseudomonas putida KT2440
cagcgccaacgcccccgc

SEQ ID NO: 1629517 - RNA, 20 nt, Pseudomonas putida KT2440
cagcgcaugguccugguaac

SEQ ID NO: 1629518 - RNA, 18 nt, Pseudomonas putida KT2440
cagcgcaaauccccaacc

SEQ ID NO: 1629519 - RNA, 21 nt, Pseudomonas putida KT2440
cagcgcaccgugcaccagcac

SEQ ID NO: 1629520 - RNA, 23 nt, Pseudomonas putida KT2440
cagcgcaccgugcaccagcacca

SEQ ID NO: 1629521 - RNA, 18 nt, Pseudomonas putida KT2440
cagcgcacugaacagcgc

SEQ ID NO: 1629522 - RNA, 17 nt, Pseudomonas putida KT2440
cagcgcaaucaccgccg

SEQ ID NO: 1629523 - RNA, 15 nt, Pseudomonas putida KT2440
cagcgaugccggggc

SEQ ID NO: 1629524 - RNA, 22 nt, Pseudomonas putida KT2440
cagcgauaaaccagcagcgccu

SEQ ID NO: 1629525 - RNA, 17 nt, Pseudomonas putida KT2440
cagcgcggaacacacgc

SEQ ID NO: 1629526 - RNA, 14 nt, Pseudomonas putida KT2440
cagcgcggagaggu

SEQ ID NO: 1629527 - RNA, 18 nt, Pseudomonas putida KT2440
cagcgcggagagguggca

SEQ ID NO: 1629528 - RNA, 19 nt, Pseudomonas putida KT2440
cagcgcggcaaagguggca

SEQ ID NO: 1629529 - RNA, 21 nt, Pseudomonas putida KT2440
cagcgcggcaaccugcucgcu

SEQ ID NO: 1629530 - RNA, 20 nt, Pseudomonas putida KT2440
cagcgcggucugcggcagca

SEQ ID NO: 1629531 - RNA, 20 nt, Pseudomonas putida KT2440
cagcgcggugaccagcggca

SEQ ID NO: 1629532 - RNA, 21 nt, Pseudomonas putida KT2440
cagcgcggugaccagcggcag

SEQ ID NO: 1629533 - RNA, 22 nt, Pseudomonas putida KT2440
cagcgcggugaccagcggcagc

SEQ ID NO: 1629534 - RNA, 17 nt, Pseudomonas putida KT2440
cagcgcgucauccgcca

SEQ ID NO: 1629535 - RNA, 16 nt, Pseudomonas putida KT2440
cagcgcguccagcaac

SEQ ID NO: 1629536 - RNA, 13 nt, Pseudomonas putida KT2440
cagcgccugcagc

SEQ ID NO: 1629537 - RNA, 12 nt, Pseudomonas putida KT2440
cagcgccugcuc

SEQ ID NO: 1629538 - RNA, 17 nt, Pseudomonas putida KT2440
cagcgccugcucaucca

SEQ ID NO: 1629539 - RNA, 21 nt, Pseudomonas putida KT2440
cagcgccugcucauccaccac

SEQ ID NO: 1629540 - RNA, 15 nt, Pseudomonas putida KT2440
cagcgccugccuggc

SEQ ID NO: 1629541 - RNA, 17 nt, Pseudomonas putida KT2440
cagcgccugcugcugga

SEQ ID NO: 1629542 - RNA, 23 nt, Pseudomonas putida KT2440
cagcgcgaaacccucacgcgcca

SEQ ID NO: 1629543 - RNA, 23 nt, Pseudomonas putida KT2440
cagcgcgaagcccagcuugccca

SEQ ID NO: 1629544 - RNA, 15 nt, Pseudomonas putida KT2440
cagcgcgaucaccag

SEQ ID NO: 1629545 - RNA, 20 nt, Pseudomonas putida KT2440
cagcgcgaucaccagccccu

SEQ ID NO: 1629546 - RNA, 14 nt, Pseudomonas putida KT2440
cagcggcaguugca

SEQ ID NO: 1629547 - RNA, 23 nt, Pseudomonas putida KT2440
cagcggcaccuaccccuccugac

SEQ ID NO: 1629548 - RNA, 19 nt, Pseudomonas putida KT2440
cagcggcacggccaccaug

SEQ ID NO: 1629549 - RNA, 16 nt, Pseudomonas putida KT2440
cagcggcaaacacacc

SEQ ID NO: 1629550 - RNA, 22 nt, Pseudomonas putida KT2440
cagcgcuucgaucagcgccugc

SEQ ID NO: 1629551 - RNA, 13 nt, Pseudomonas putida KT2440
cagcgcugccgcc

SEQ ID NO: 1629552 - RNA, 23 nt, Pseudomonas putida KT2440
cagcgcucgagaaaugccucggc

SEQ ID NO: 1629553 - RNA, 17 nt, Pseudomonas putida KT2440
cagcgcucaaaaaaaua

SEQ ID NO: 1629554 - RNA, 20 nt, Pseudomonas putida KT2440
cagcgcucggguugcccugu

SEQ ID NO: 1629555 - RNA, 18 nt, Pseudomonas putida KT2440
cagcgcugacucagcggc

SEQ ID NO: 1629556 - RNA, 23 nt, Pseudomonas putida KT2440
cagcgcugacucagcggccuuuc

SEQ ID NO: 1629557 - RNA, 13 nt, Pseudomonas putida KT2440
caaccaggcgccg

SEQ ID NO: 1629558 - RNA, 15 nt, Pseudomonas putida KT2440
caaccagucauccuc

SEQ ID NO: 1629559 - RNA, 14 nt, Pseudomonas putida KT2440
caacccagccagcg

SEQ ID NO: 1629560 - RNA, 22 nt, Pseudomonas putida KT2440
caacccaccagcacugcugcgc

SEQ ID NO: 1629561 - RNA, 21 nt, Pseudomonas putida KT2440
caacccgggguaaccgccuga

SEQ ID NO: 1629562 - RNA, 20 nt, Pseudomonas putida KT2440
caacccggccaggccgugcu

SEQ ID NO: 1629563 - RNA, 21 nt, Pseudomonas putida KT2440
caacccggccaggccgugcuu

SEQ ID NO: 1629564 - RNA, 22 nt, Pseudomonas putida KT2440
caacccggccuuggccgcuggc

SEQ ID NO: 1629565 - RNA, 20 nt, Pseudomonas putida KT2440
caacccgaucaggugcagga

SEQ ID NO: 1629566 - RNA, 22 nt, Pseudomonas putida KT2440
caacccgauuccuugcagcgcc

SEQ ID NO: 1629567 - RNA, 15 nt, Pseudomonas putida KT2440
caacccccacagggc

SEQ ID NO: 1629568 - RNA, 15 nt, Pseudomonas putida KT2440
caaccccacgccugu

SEQ ID NO: 1629569 - RNA, 15 nt, Pseudomonas putida KT2440
caaccccagcccgaa

SEQ ID NO: 1629570 - RNA, 20 nt, Pseudomonas putida KT2440
caaccggcuuguagccggca

SEQ ID NO: 1629571 - RNA, 16 nt, Pseudomonas putida KT2440
caaccggaaucugcuc

SEQ ID NO: 1629572 - RNA, 19 nt, Pseudomonas putida KT2440
caaccgcuuucacuucauc

SEQ ID NO: 1629573 - RNA, 18 nt, Pseudomonas putida KT2440
caaccggugcaacugcca

SEQ ID NO: 1629574 - RNA, 15 nt, Pseudomonas putida KT2440
caaccggguuugaag

SEQ ID NO: 1629575 - RNA, 17 nt, Pseudomonas putida KT2440
caacccuucggccagca

SEQ ID NO: 1629576 - RNA, 21 nt, Pseudomonas putida KT2440
caacccuugcagcgccuguga

SEQ ID NO: 1629577 - RNA, 24 nt, Pseudomonas putida KT2440
caacccuugcagcgccugugagau

SEQ ID NO: 1629578 - RNA, 24 nt, Pseudomonas putida KT2440
caacccuugcagugccugugagau

SEQ ID NO: 1629579 - RNA, 12 nt, Pseudomonas putida KT2440
caaccgaccagc

SEQ ID NO: 1629580 - RNA, 23 nt, Pseudomonas putida KT2440
caaccgaaaaggccaaccacccg

SEQ ID NO: 1629581 - RNA, 17 nt, Pseudomonas putida KT2440
caaccgccgcgccucgc

SEQ ID NO: 1629582 - RNA, 23 nt, Pseudomonas putida KT2440
caaccgccgcgccucgcggugca

SEQ ID NO: 1629583 - RNA, 13 nt, Pseudomonas putida KT2440
caaccgcaucccc

SEQ ID NO: 1629584 - RNA, 14 nt, Pseudomonas putida KT2440
caaccaccucuauc

SEQ ID NO: 1629585 - RNA, 15 nt, Pseudomonas putida KT2440
caaccaccuccccaa

SEQ ID NO: 1629586 - RNA, 15 nt, Pseudomonas putida KT2440
caaccaacaggcucu

SEQ ID NO: 1629587 - RNA, 16 nt, Pseudomonas putida KT2440
caaccaauccccccuc

SEQ ID NO: 1629588 - RNA, 18 nt, Pseudomonas putida KT2440
caaccaauccccccuccu

SEQ ID NO: 1629589 - RNA, 15 nt, Pseudomonas putida KT2440
caaccaaaggaggcu

SEQ ID NO: 1629590 - RNA, 13 nt, Pseudomonas putida KT2440
caaccagccggca

SEQ ID NO: 1629591 - RNA, 22 nt, Pseudomonas putida KT2440
caaccagccggcaauuuccugc

SEQ ID NO: 1629592 - RNA, 13 nt, Pseudomonas putida KT2440
caacaggcucucc

SEQ ID NO: 1629593 - RNA, 15 nt, Pseudomonas putida KT2440
caacauucaccagcc

SEQ ID NO: 1629594 - RNA, 19 nt, Pseudomonas putida KT2440
caacauggucacaugucga

SEQ ID NO: 1629595 - RNA, 13 nt, Pseudomonas putida KT2440
caacggcucacug

SEQ ID NO: 1629596 - RNA, 16 nt, Pseudomonas putida KT2440
caacggcgcccgggcc

SEQ ID NO: 1629597 - RNA, 20 nt, Pseudomonas putida KT2440
caacggcgcccgggccaugc

SEQ ID NO: 1629598 - RNA, 20 nt, Pseudomonas putida KT2440
caacggccgcgccgcgccca

SEQ ID NO: 1629599 - RNA, 19 nt, Pseudomonas putida KT2440
caacggcgcgcccggcgca

SEQ ID NO: 1629600 - RNA, 23 nt, Pseudomonas putida KT2440
caacgucucgaacggcgccagca

SEQ ID NO: 1629601 - RNA, 22 nt, Pseudomonas putida KT2440
caacgucacaugcgccacaccc

SEQ ID NO: 1629602 - RNA, 13 nt, Pseudomonas putida KT2440
caacggccacgcu

SEQ ID NO: 1629603 - RNA, 17 nt, Pseudomonas putida KT2440
caacggcaacgccagca

SEQ ID NO: 1629604 - RNA, 16 nt, Pseudomonas putida KT2440
caacggacgucccagc

SEQ ID NO: 1629605 - RNA, 18 nt, Pseudomonas putida KT2440
caacggacgucccagcag

SEQ ID NO: 1629606 - RNA, 17 nt, Pseudomonas putida KT2440
caacgcuucggccauga

SEQ ID NO: 1629607 - RNA, 20 nt, Pseudomonas putida KT2440
caacgcgguggcuggcaccg

SEQ ID NO: 1629608 - RNA, 21 nt, Pseudomonas putida KT2440
caacgcugcucggccucgacc

SEQ ID NO: 1629609 - RNA, 19 nt, Pseudomonas putida KT2440
caaccucaggccugcacug

SEQ ID NO: 1629610 - RNA, 21 nt, Pseudomonas putida KT2440
caaccucaggccugcacugca

SEQ ID NO: 1629611 - RNA, 16 nt, Pseudomonas putida KT2440
caacgccaccgaaggc

SEQ ID NO: 1629612 - RNA, 13 nt, Pseudomonas putida KT2440
caacgccacacug

SEQ ID NO: 1629613 - RNA, 17 nt, Pseudomonas putida KT2440
caacgcauuuucaucaa

SEQ ID NO: 1629614 - RNA, 18 nt, Pseudomonas putida KT2440
caacgcccgcgcauagca

SEQ ID NO: 1629615 - RNA, 15 nt, Pseudomonas putida KT2440
caacgcccgccguca

SEQ ID NO: 1629616 - RNA, 23 nt, Pseudomonas putida KT2440
caacgcccgccguguucccagca

SEQ ID NO: 1629617 - RNA, 14 nt, Pseudomonas putida KT2440
caacugugccuggg

SEQ ID NO: 1629618 - RNA, 21 nt, Pseudomonas putida KT2440
caacuguuucugcucuucugc

SEQ ID NO: 1629619 - RNA, 22 nt, Pseudomonas putida KT2440
caacuguuucugcucuucugcc

SEQ ID NO: 1629620 - RNA, 23 nt, Pseudomonas putida KT2440
caacuguuucugcucuucugcca

SEQ ID NO: 1629621 - RNA, 18 nt, Pseudomonas putida KT2440
caacuggcgcaggccgcu

SEQ ID NO: 1629622 - RNA, 14 nt, Pseudomonas putida KT2440
caacuggaucuucu

SEQ ID NO: 1629623 - RNA, 22 nt, Pseudomonas putida KT2440
caacuggcaucggucaccgggu

SEQ ID NO: 1629624 - RNA, 13 nt, Pseudomonas putida KT2440
caacuggccaggg

SEQ ID NO: 1629625 - RNA, 13 nt, Pseudomonas putida KT2440
caacugcgccugg

SEQ ID NO: 1629626 - RNA, 14 nt, Pseudomonas putida KT2440
caacugcgccuggg

SEQ ID NO: 1629627 - RNA, 15 nt, Pseudomonas putida KT2440
caacugcgccuggga

SEQ ID NO: 1629628 - RNA, 15 nt, Pseudomonas putida KT2440
caacugcuccaggca

SEQ ID NO: 1629629 - RNA, 17 nt, Pseudomonas putida KT2440
caacugcuccaggcagc

SEQ ID NO: 1629630 - RNA, 16 nt, Pseudomonas putida KT2440
caacugcggccccugg

SEQ ID NO: 1629631 - RNA, 17 nt, Pseudomonas putida KT2440
caacugcggccccugga

SEQ ID NO: 1629632 - RNA, 22 nt, Pseudomonas putida KT2440
caacugcggccccuggaacccc

SEQ ID NO: 1629633 - RNA, 17 nt, Pseudomonas putida KT2440
caacugcgcccgccccu

SEQ ID NO: 1629634 - RNA, 23 nt, Pseudomonas putida KT2440
caacugagcuaacgacccaaaaa

SEQ ID NO: 1629635 - RNA, 19 nt, Pseudomonas putida KT2440
caacugagcuaacgacccg

SEQ ID NO: 1629636 - RNA, 20 nt, Pseudomonas putida KT2440
caacugcacccgccagccgu

SEQ ID NO: 1629637 - RNA, 16 nt, Pseudomonas putida KT2440
caacuaccaugaaaaa

SEQ ID NO: 1629638 - RNA, 21 nt, Pseudomonas putida KT2440
caacuaccaugaaaaacaaca

SEQ ID NO: 1629639 - RNA, 22 nt, Pseudomonas putida KT2440
caacuaccaugaaaaacaacaa

SEQ ID NO: 1629640 - RNA, 13 nt, Pseudomonas putida KT2440
caacuacccugaa

SEQ ID NO: 1629641 - RNA, 23 nt, Pseudomonas putida KT2440
caacacauacuccaccgccaggg

SEQ ID NO: 1629642 - RNA, 15 nt, Pseudomonas putida KT2440
caacacauuauccac

SEQ ID NO: 1629643 - RNA, 18 nt, Pseudomonas putida KT2440
caacaccagacucagcgc

SEQ ID NO: 1629644 - RNA, 13 nt, Pseudomonas putida KT2440
caacaccagcagc

SEQ ID NO: 1629645 - RNA, 16 nt, Pseudomonas putida KT2440
caacagaccaccugcc

SEQ ID NO: 1629646 - RNA, 11 nt, Pseudomonas putida KT2440
caacagcugcg

SEQ ID NO: 1629647 - RNA, 15 nt, Pseudomonas putida KT2440
caacagcuggcuggu

SEQ ID NO: 1629648 - RNA, 18 nt, Pseudomonas putida KT2440
caacagcucaacccgccu

SEQ ID NO: 1629649 - RNA, 20 nt, Pseudomonas putida KT2440
caacagcucauccaggcugc

SEQ ID NO: 1629650 - RNA, 14 nt, Pseudomonas putida KT2440
caacagcuccagca

SEQ ID NO: 1629651 - RNA, 22 nt, Pseudomonas putida KT2440
caacagcuccagcaacugcgcc

SEQ ID NO: 1629652 - RNA, 16 nt, Pseudomonas putida KT2440
caacacuuccagcauc

SEQ ID NO: 1629653 - RNA, 20 nt, Pseudomonas putida KT2440
caacacuuccagcaucgccc

SEQ ID NO: 1629654 - RNA, 23 nt, Pseudomonas putida KT2440
caaaugcaccacgcgcaaaugcu

SEQ ID NO: 1629655 - RNA, 18 nt, Pseudomonas putida KT2440
caaaugcccccggcuguc

SEQ ID NO: 1629656 - RNA, 15 nt, Pseudomonas putida KT2440
caaaugccccgggca

SEQ ID NO: 1629657 - RNA, 23 nt, Pseudomonas putida KT2440
caaaugccgguuugcggccuucg

SEQ ID NO: 1629658 - RNA, 17 nt, Pseudomonas putida KT2440
caaaucgccaaucaggu

SEQ ID NO: 1629659 - RNA, 16 nt, Pseudomonas putida KT2440
caaagcccgugccgca

SEQ ID NO: 1629660 - RNA, 15 nt, Pseudomonas putida KT2440
caaagcccugccuca

SEQ ID NO: 1629661 - RNA, 14 nt, Pseudomonas putida KT2440
caaagccugcucca

SEQ ID NO: 1629662 - RNA, 17 nt, Pseudomonas putida KT2440
caaagccugcuccagca

SEQ ID NO: 1629663 - RNA, 16 nt, Pseudomonas putida KT2440
caaagcccgccccaau

SEQ ID NO: 1629664 - RNA, 16 nt, Pseudomonas putida KT2440
caaagcccaagggcuc

SEQ ID NO: 1629665 - RNA, 13 nt, Pseudomonas putida KT2440
caaagcagcccca

SEQ ID NO: 1629666 - RNA, 13 nt, Pseudomonas putida KT2440
caaagcagccccc

SEQ ID NO: 1629667 - RNA, 17 nt, Pseudomonas putida KT2440
caaagcagacagcugug

SEQ ID NO: 1629668 - RNA, 16 nt, Pseudomonas putida KT2440
caaagaaaagcccgca

SEQ ID NO: 1629669 - RNA, 21 nt, Pseudomonas putida KT2440
caaagaacagcgugccaugca

SEQ ID NO: 1629670 - RNA, 23 nt, Pseudomonas putida KT2440
caaagccuuuuuucgggcugcug

SEQ ID NO: 1629671 - RNA, 14 nt, Pseudomonas putida KT2440
caaaggucugcugc

SEQ ID NO: 1629672 - RNA, 15 nt, Pseudomonas putida KT2440
caaaggucugcugcg

SEQ ID NO: 1629673 - RNA, 19 nt, Pseudomonas putida KT2440
caaaggugaaagagguucu

SEQ ID NO: 1629674 - RNA, 13 nt, Pseudomonas putida KT2440
caaaguccaaggc

SEQ ID NO: 1629675 - RNA, 21 nt, Pseudomonas putida KT2440
caaaguccugcaaaggcccuu

SEQ ID NO: 1629676 - RNA, 18 nt, Pseudomonas putida KT2440
caaagucuucagccaagg

SEQ ID NO: 1629677 - RNA, 16 nt, Pseudomonas putida KT2440
caagggcgaaccaggu

SEQ ID NO: 1629678 - RNA, 16 nt, Pseudomonas putida KT2440
caaggcggcgaucgac

SEQ ID NO: 1629679 - RNA, 15 nt, Pseudomonas putida KT2440
caaggcgcagccaau

SEQ ID NO: 1629680 - RNA, 19 nt, Pseudomonas putida KT2440
caaggcguaccugcccccc

SEQ ID NO: 1629681 - RNA, 13 nt, Pseudomonas putida KT2440
caagggugaagua

SEQ ID NO: 1629682 - RNA, 21 nt, Pseudomonas putida KT2440
caaggggguguagggugcaau

SEQ ID NO: 1629683 - RNA, 21 nt, Pseudomonas putida KT2440
caaggccgcccaguucagcuc

SEQ ID NO: 1629684 - RNA, 17 nt, Pseudomonas putida KT2440
caaggccuccagguaau

SEQ ID NO: 1629685 - RNA, 14 nt, Pseudomonas putida KT2440
caaggccgccaccu

SEQ ID NO: 1629686 - RNA, 15 nt, Pseudomonas putida KT2440
caaggccgccaccuc

SEQ ID NO: 1629687 - RNA, 14 nt, Pseudomonas putida KT2440
caaggccuggccca

SEQ ID NO: 1629688 - RNA, 20 nt, Pseudomonas putida KT2440
caagguggcauuggcgugcu

SEQ ID NO: 1629689 - RNA, 13 nt, Pseudomonas putida KT2440
caaggugcacacc

SEQ ID NO: 1629690 - RNA, 18 nt, Pseudomonas putida KT2440
caaggugccaacaggcag

SEQ ID NO: 1629691 - RNA, 16 nt, Pseudomonas putida KT2440
caaggucgaugcugcu

SEQ ID NO: 1629692 - RNA, 14 nt, Pseudomonas putida KT2440
caaggucgccgccg

SEQ ID NO: 1629693 - RNA, 16 nt, Pseudomonas putida KT2440
caagguacugaucccu

SEQ ID NO: 1629694 - RNA, 14 nt, Pseudomonas putida KT2440
caaggucagcaagc

SEQ ID NO: 1629695 - RNA, 15 nt, Pseudomonas putida KT2440
caaggucagcaagcc

SEQ ID NO: 1629696 - RNA, 14 nt, Pseudomonas putida KT2440
caagguaggggcag

SEQ ID NO: 1629697 - RNA, 24 nt, Pseudomonas putida KT2440
caagccucgcgcaacaccgccagc

SEQ ID NO: 1629698 - RNA, 18 nt, Pseudomonas putida KT2440
caagccucuacccgccgc

SEQ ID NO: 1629699 - RNA, 16 nt, Pseudomonas putida KT2440
caagcggcacuaccag

SEQ ID NO: 1629700 - RNA, 14 nt, Pseudomonas putida KT2440
caagcggccccaga

SEQ ID NO: 1629701 - RNA, 15 nt, Pseudomonas putida KT2440
caagcggccccagau

SEQ ID NO: 1629702 - RNA, 12 nt, Pseudomonas putida KT2440
caagcggccucg

SEQ ID NO: 1629703 - RNA, 15 nt, Pseudomonas putida KT2440
caagcggccucgacc

SEQ ID NO: 1629704 - RNA, 14 nt, Pseudomonas putida KT2440
caagcgguugcccg

SEQ ID NO: 1629705 - RNA, 20 nt, Pseudomonas putida KT2440
caagcgggccaaggucaucg

SEQ ID NO: 1629706 - RNA, 16 nt, Pseudomonas putida KT2440
caaggaucaccaaggc

SEQ ID NO: 1629707 - RNA, 22 nt, Pseudomonas putida KT2440
caaggcccgcgccgacagccuc

SEQ ID NO: 1629708 - RNA, 14 nt, Pseudomonas putida KT2440
caagccaaaguccu

SEQ ID NO: 1629709 - RNA, 22 nt, Pseudomonas putida KT2440
caagccaaaguccugcaaaggc

SEQ ID NO: 1629710 - RNA, 14 nt, Pseudomonas putida KT2440
caagccacgccaga

SEQ ID NO: 1629711 - RNA, 20 nt, Pseudomonas putida KT2440
caagccaaugguauugcccg

SEQ ID NO: 1629712 - RNA, 23 nt, Pseudomonas putida KT2440
caagccagccuccggcccauccc

SEQ ID NO: 1629713 - RNA, 19 nt, Pseudomonas putida KT2440
caagcccgcguucaugccg

SEQ ID NO: 1629714 - RNA, 15 nt, Pseudomonas putida KT2440
caagcccgcucccac

SEQ ID NO: 1629715 - RNA, 17 nt, Pseudomonas putida KT2440
caagcccgcacccacag

SEQ ID NO: 1629716 - RNA, 17 nt, Pseudomonas putida KT2440
caagccauauucagcuu

SEQ ID NO: 1629717 - RNA, 22 nt, Pseudomonas putida KT2440
caagccauccaccagccccagc

SEQ ID NO: 1629718 - RNA, 13 nt, Pseudomonas putida KT2440
caagccccuccua

SEQ ID NO: 1629719 - RNA, 15 nt, Pseudomonas putida KT2440
caagccaugugccug

SEQ ID NO: 1629720 - RNA, 18 nt, Pseudomonas putida KT2440
caagcccauggcuggcag

SEQ ID NO: 1629721 - RNA, 14 nt, Pseudomonas putida KT2440
caagccgcugccac

SEQ ID NO: 1629722 - RNA, 20 nt, Pseudomonas putida KT2440
caagccggcgaacagcacug

SEQ ID NO: 1629723 - RNA, 17 nt, Pseudomonas putida KT2440
caagccgagcaucuucc

SEQ ID NO: 1629724 - RNA, 15 nt, Pseudomonas putida KT2440
caagccgacaaaaac

SEQ ID NO: 1629725 - RNA, 19 nt, Pseudomonas putida KT2440
caagccgacaaaaacaaca

SEQ ID NO: 1629726 - RNA, 23 nt, Pseudomonas putida KT2440
caagccgacuagauaaccaaccc

SEQ ID NO: 1629727 - RNA, 20 nt, Pseudomonas putida KT2440
caagcacuacaucuaccuga

SEQ ID NO: 1629728 - RNA, 16 nt, Pseudomonas putida KT2440
caagcagguaaccgcu

SEQ ID NO: 1629729 - RNA, 18 nt, Pseudomonas putida KT2440
caagcagguaaccgcugc

SEQ ID NO: 1629730 - RNA, 15 nt, Pseudomonas putida KT2440
caagcagucccagca

SEQ ID NO: 1629731 - RNA, 16 nt, Pseudomonas putida KT2440
caagcagucccagcac

SEQ ID NO: 1629732 - RNA, 18 nt, Pseudomonas putida KT2440
caagcagucccagcaccg

SEQ ID NO: 1629733 - RNA, 15 nt, Pseudomonas putida KT2440
caacuucgguggcuc

SEQ ID NO: 1629734 - RNA, 22 nt, Pseudomonas putida KT2440
caacuucgugcucggcacugcu

SEQ ID NO: 1629735 - RNA, 14 nt, Pseudomonas putida KT2440
caauagccauuccg

SEQ ID NO: 1629736 - RNA, 18 nt, Pseudomonas putida KT2440
caauacaacgaucagcgc

SEQ ID NO: 1629737 - RNA, 18 nt, Pseudomonas putida KT2440
caauaucaucacugccac

SEQ ID NO: 1629738 - RNA, 19 nt, Pseudomonas putida KT2440
caauaacaaguucaagguc

SEQ ID NO: 1629739 - RNA, 23 nt, Pseudomonas putida KT2440
caauaacaaguucaaggucaucg

SEQ ID NO: 1629740 - RNA, 14 nt, Pseudomonas putida KT2440
caauaaaaacaaca

SEQ ID NO: 1629741 - RNA, 19 nt, Pseudomonas putida KT2440
caauaaaaacaacagguaa

SEQ ID NO: 1629742 - RNA, 16 nt, Pseudomonas putida KT2440
caagucaugcucgccg

SEQ ID NO: 1629743 - RNA, 18 nt, Pseudomonas putida KT2440
caaguacggccagcaggu

SEQ ID NO: 1629744 - RNA, 18 nt, Pseudomonas putida KT2440
caaggugggguugaccag

SEQ ID NO: 1629745 - RNA, 22 nt, Pseudomonas putida KT2440
caauggcgguuuugagacgcau

SEQ ID NO: 1629746 - RNA, 14 nt, Pseudomonas putida KT2440
caauggcguaucca

SEQ ID NO: 1629747 - RNA, 16 nt, Pseudomonas putida KT2440
caauggcaaucgccug

SEQ ID NO: 1629748 - RNA, 20 nt, Pseudomonas putida KT2440
caauggcacccucaccaacu

SEQ ID NO: 1629749 - RNA, 16 nt, Pseudomonas putida KT2440
caaugccggcacagcc

SEQ ID NO: 1629750 - RNA, 19 nt, Pseudomonas putida KT2440
caaugccggcacagcccag

SEQ ID NO: 1629751 - RNA, 18 nt, Pseudomonas putida KT2440
caaugcgagacgccacca

SEQ ID NO: 1629752 - RNA, 15 nt, Pseudomonas putida KT2440
caaugcuuucaguug

SEQ ID NO: 1629753 - RNA, 18 nt, Pseudomonas putida KT2440
caaugcuuucaguugagg

SEQ ID NO: 1629754 - RNA, 18 nt, Pseudomonas putida KT2440
caaugcgguccuccuugg

SEQ ID NO: 1629755 - RNA, 17 nt, Pseudomonas putida KT2440
caaugcugccuuuuccu

SEQ ID NO: 1629756 - RNA, 18 nt, Pseudomonas putida KT2440
caaugcugccuuuuccug

SEQ ID NO: 1629757 - RNA, 13 nt, Pseudomonas putida KT2440
caaugcucgccug

SEQ ID NO: 1629758 - RNA, 12 nt, Pseudomonas putida KT2440
caaucuucuuca

SEQ ID NO: 1629759 - RNA, 16 nt, Pseudomonas putida KT2440
caaucuucuucaucac

SEQ ID NO: 1629760 - RNA, 22 nt, Pseudomonas putida KT2440
caaucugguuacccaacagacc

SEQ ID NO: 1629761 - RNA, 13 nt, Pseudomonas putida KT2440
caaugccagcagu

SEQ ID NO: 1629762 - RNA, 21 nt, Pseudomonas putida KT2440
caaugccagcaguucgcagcc

SEQ ID NO: 1629763 - RNA, 20 nt, Pseudomonas putida KT2440
caaugcagcuuugaggcuca

SEQ ID NO: 1629764 - RNA, 23 nt, Pseudomonas putida KT2440
caaugcaggcaguaggccaccgu

SEQ ID NO: 1629765 - RNA, 15 nt, Pseudomonas putida KT2440
caaugcagccccuuc

SEQ ID NO: 1629766 - RNA, 18 nt, Pseudomonas putida KT2440
caaugcagccgcccgccc

SEQ ID NO: 1629767 - RNA, 13 nt, Pseudomonas putida KT2440
caaugcacagcgc

SEQ ID NO: 1629768 - RNA, 16 nt, Pseudomonas putida KT2440
caaugaugaaagcagg

SEQ ID NO: 1629769 - RNA, 11 nt, Pseudomonas putida KT2440
caaugauggca

SEQ ID NO: 1629770 - RNA, 22 nt, Pseudomonas putida KT2440
caauccgccacaaacgccgggc

SEQ ID NO: 1629771 - RNA, 13 nt, Pseudomonas putida KT2440
caaucccgcccca

SEQ ID NO: 1629772 - RNA, 21 nt, Pseudomonas putida KT2440
caaucccuaacggggggcuca

SEQ ID NO: 1629773 - RNA, 13 nt, Pseudomonas putida KT2440
caauccagcccuc

SEQ ID NO: 1629774 - RNA, 17 nt, Pseudomonas putida KT2440
caaucaucgccagcagc

SEQ ID NO: 1629775 - RNA, 18 nt, Pseudomonas putida KT2440
caaucggcucaacagcca

SEQ ID NO: 1629776 - RNA, 14 nt, Pseudomonas putida KT2440
caaucgggccggcg

SEQ ID NO: 1629777 - RNA, 17 nt, Pseudomonas putida KT2440
caaucgcgucagcaccg

SEQ ID NO: 1629778 - RNA, 14 nt, Pseudomonas putida KT2440
caaucgcugugcaa

SEQ ID NO: 1629779 - RNA, 22 nt, Pseudomonas putida KT2440
caaucgcugugcgugauuugaa

SEQ ID NO: 1629780 - RNA, 22 nt, Pseudomonas putida KT2440
caaucgacaacauggucacaug

SEQ ID NO: 1629781 - RNA, 16 nt, Pseudomonas putida KT2440
caaucgagauguaguc

SEQ ID NO: 1629782 - RNA, 16 nt, Pseudomonas putida KT2440
caaucgaucacuucca

SEQ ID NO: 1629783 - RNA, 20 nt, Pseudomonas putida KT2440
caaucucacuuucugcgcug

SEQ ID NO: 1629784 - RNA, 15 nt, Pseudomonas putida KT2440
caaucugcagcagca

SEQ ID NO: 1629785 - RNA, 18 nt, Pseudomonas putida KT2440
caaucucggucugucaac

SEQ ID NO: 1629786 - RNA, 15 nt, Pseudomonas putida KT2440
caaaaaaucggguaa

SEQ ID NO: 1629787 - RNA, 17 nt, Pseudomonas putida KT2440
caaaaaaugugcgcauc

SEQ ID NO: 1629788 - RNA, 22 nt, Pseudomonas putida KT2440
caaaacgguuguuucagccuug

SEQ ID NO: 1629789 - RNA, 23 nt, Pseudomonas putida KT2440
caaaacgguuguuucagccuugg

SEQ ID NO: 1629790 - RNA, 11 nt, Pseudomonas putida KT2440
caaaaccugcc

SEQ ID NO: 1629791 - RNA, 22 nt, Pseudomonas putida KT2440
caaaaccucaguuuuucuccgc

SEQ ID NO: 1629792 - RNA, 17 nt, Pseudomonas putida KT2440
auuugccuuggaaugca

SEQ ID NO: 1629793 - RNA, 17 nt, Pseudomonas putida KT2440
auuugcuccagggcauu

SEQ ID NO: 1629794 - RNA, 13 nt, Pseudomonas putida KT2440
auuugucaacaaa

SEQ ID NO: 1629795 - RNA, 21 nt, Pseudomonas putida KT2440
auuugaagguauggccuuucu

SEQ ID NO: 1629796 - RNA, 14 nt, Pseudomonas putida KT2440
auuucuccccagca

SEQ ID NO: 1629797 - RNA, 16 nt, Pseudomonas putida KT2440
auuuuguucuccagca

SEQ ID NO: 1629798 - RNA, 13 nt, Pseudomonas putida KT2440
auuuucaaugcuu

SEQ ID NO: 1629799 - RNA, 11 nt, Pseudomonas putida KT2440
auuuucaucaa

SEQ ID NO: 1629800 - RNA, 16 nt, Pseudomonas putida KT2440
auuguucgccucgucg

SEQ ID NO: 1629801 - RNA, 20 nt, Pseudomonas putida KT2440
auuguagguacggcgcugag

SEQ ID NO: 1629802 - RNA, 16 nt, Pseudomonas putida KT2440
auugucauugcccaag

SEQ ID NO: 1629803 - RNA, 19 nt, Pseudomonas putida KT2440
auugucaugcgggaagcca

SEQ ID NO: 1629804 - RNA, 22 nt, Pseudomonas putida KT2440
auuguggccggcgcgucucauu

SEQ ID NO: 1629805 - RNA, 14 nt, Pseudomonas putida KT2440
auuucaaagaucuc

SEQ ID NO: 1629806 - RNA, 21 nt, Pseudomonas putida KT2440
auuucauccacauaggccagc

SEQ ID NO: 1629807 - RNA, 14 nt, Pseudomonas putida KT2440
auugcgcaccccuu

SEQ ID NO: 1629808 - RNA, 20 nt, Pseudomonas putida KT2440
auugccugcaaucagcucac

SEQ ID NO: 1629809 - RNA, 22 nt, Pseudomonas putida KT2440
auuggagcugaaacugaucagc

SEQ ID NO: 1629810 - RNA, 17 nt, Pseudomonas putida KT2440
auuggcaaacgccuguu

SEQ ID NO: 1629811 - RNA, 18 nt, Pseudomonas putida KT2440
auuggcaaacgccuguuu

SEQ ID NO: 1629812 - RNA, 20 nt, Pseudomonas putida KT2440
auugagcgacgcugccgcac

SEQ ID NO: 1629813 - RNA, 22 nt, Pseudomonas putida KT2440
auugagguugacggugugcgga

SEQ ID NO: 1629814 - RNA, 21 nt, Pseudomonas putida KT2440
auugagguuggcgcggugaug

SEQ ID NO: 1629815 - RNA, 22 nt, Pseudomonas putida KT2440
auugcccgcgacgaaacccagu

SEQ ID NO: 1629816 - RNA, 15 nt, Pseudomonas putida KT2440
auugccgcagcugcg

SEQ ID NO: 1629817 - RNA, 16 nt, Pseudomonas putida KT2440
auugacggucagugaa

SEQ ID NO: 1629818 - RNA, 17 nt, Pseudomonas putida KT2440
auucaggccuuuucaca

SEQ ID NO: 1629819 - RNA, 20 nt, Pseudomonas putida KT2440
auucaggcacggcaccagca

SEQ ID NO: 1629820 - RNA, 21 nt, Pseudomonas putida KT2440
auucaggcacggcaccagcac

SEQ ID NO: 1629821 - RNA, 16 nt, Pseudomonas putida KT2440
augccggucagcagca

SEQ ID NO: 1629822 - RNA, 20 nt, Pseudomonas putida KT2440
augccguaagccgcaggcca

SEQ ID NO: 1629823 - RNA, 23 nt, Pseudomonas putida KT2440
augccguacaccaugcucaggaa

SEQ ID NO: 1629824 - RNA, 20 nt, Pseudomonas putida KT2440
augccgugcgcggcaucagc

SEQ ID NO: 1629825 - RNA, 14 nt, Pseudomonas putida KT2440
augccguaguagcc

SEQ ID NO: 1629826 - RNA, 15 nt, Pseudomonas putida KT2440
augccguaguagccu

SEQ ID NO: 1629827 - RNA, 17 nt, Pseudomonas putida KT2440
augccggcacagcccag

SEQ ID NO: 1629828 - RNA, 19 nt, Pseudomonas putida KT2440
augccggcacagcccagcu

SEQ ID NO: 1629829 - RNA, 16 nt, Pseudomonas putida KT2440
augccggccaccacac

SEQ ID NO: 1629830 - RNA, 15 nt, Pseudomonas putida KT2440
augccguucuacccu

SEQ ID NO: 1629831 - RNA, 17 nt, Pseudomonas putida KT2440
augccuagauaagcgac

SEQ ID NO: 1629832 - RNA, 23 nt, Pseudomonas putida KT2440
augccuuugcaaagcgcaccgcg

SEQ ID NO: 1629833 - RNA, 18 nt, Pseudomonas putida KT2440
augccuggaaaauccgcu

SEQ ID NO: 1629834 - RNA, 16 nt, Pseudomonas putida KT2440
augccuucgguggcaa

SEQ ID NO: 1629835 - RNA, 22 nt, Pseudomonas putida KT2440
augccuucugugauuuccagcg

SEQ ID NO: 1629836 - RNA, 13 nt, Pseudomonas putida KT2440
augcccuccagcc

SEQ ID NO: 1629837 - RNA, 14 nt, Pseudomonas putida KT2440
augcccgucggcgu

SEQ ID NO: 1629838 - RNA, 18 nt, Pseudomonas putida KT2440
augcccgggccuucaacc

SEQ ID NO: 1629839 - RNA, 16 nt, Pseudomonas putida KT2440
augcccgggcgcaggc

SEQ ID NO: 1629840 - RNA, 21 nt, Pseudomonas putida KT2440
augccgaacgauucugccagc

SEQ ID NO: 1629841 - RNA, 18 nt, Pseudomonas putida KT2440
augccgccgcugccagca

SEQ ID NO: 1629842 - RNA, 22 nt, Pseudomonas putida KT2440
augccgcccaugccacccaugc

SEQ ID NO: 1629843 - RNA, 17 nt, Pseudomonas putida KT2440
augccgaggacauacca

SEQ ID NO: 1629844 - RNA, 19 nt, Pseudomonas putida KT2440
augccgagggugaggugcu

SEQ ID NO: 1629845 - RNA, 19 nt, Pseudomonas putida KT2440
augccgaugucggcgugca

SEQ ID NO: 1629846 - RNA, 20 nt, Pseudomonas putida KT2440
augccauccucggccaggcc

SEQ ID NO: 1629847 - RNA, 16 nt, Pseudomonas putida KT2440
augccaguagaagccc

SEQ ID NO: 1629848 - RNA, 23 nt, Pseudomonas putida KT2440
augcccaccgcauugcaggccag

SEQ ID NO: 1629849 - RNA, 17 nt, Pseudomonas putida KT2440
augcccaccgcugcaau

SEQ ID NO: 1629850 - RNA, 13 nt, Pseudomonas putida KT2440
augcccagguauc

SEQ ID NO: 1629851 - RNA, 17 nt, Pseudomonas putida KT2440
augcccgccccugccag

SEQ ID NO: 1629852 - RNA, 15 nt, Pseudomonas putida KT2440
augccccgggugcag

SEQ ID NO: 1629853 - RNA, 21 nt, Pseudomonas putida KT2440
augcccauggccagcguggcc

SEQ ID NO: 1629854 - RNA, 20 nt, Pseudomonas putida KT2440
augcccauggcgcagcucca

SEQ ID NO: 1629855 - RNA, 17 nt, Pseudomonas putida KT2440
augcagcuuugaggcuc

SEQ ID NO: 1629856 - RNA, 20 nt, Pseudomonas putida KT2440
augcagcguggccuucucuu

SEQ ID NO: 1629857 - RNA, 19 nt, Pseudomonas putida KT2440
augcaggucgaccugccag

SEQ ID NO: 1629858 - RNA, 18 nt, Pseudomonas putida KT2440
augcagguucgaccagaa

SEQ ID NO: 1629859 - RNA, 20 nt, Pseudomonas putida KT2440
augcaggucaucgaacaccu

SEQ ID NO: 1629860 - RNA, 17 nt, Pseudomonas putida KT2440
augcacagcgagcagcc

SEQ ID NO: 1629861 - RNA, 21 nt, Pseudomonas putida KT2440
augcacagcucgcgcugccag

SEQ ID NO: 1629862 - RNA, 19 nt, Pseudomonas putida KT2440
augcaauccgccacaaacg

SEQ ID NO: 1629863 - RNA, 17 nt, Pseudomonas putida KT2440
augccacgcugaacacg

SEQ ID NO: 1629864 - RNA, 15 nt, Pseudomonas putida KT2440
augccacgggcaaac

SEQ ID NO: 1629865 - RNA, 19 nt, Pseudomonas putida KT2440
augccacguacagagauac

SEQ ID NO: 1629866 - RNA, 14 nt, Pseudomonas putida KT2440
augccaagcaccga

SEQ ID NO: 1629867 - RNA, 18 nt, Pseudomonas putida KT2440
augcaguucuaccagcag

SEQ ID NO: 1629868 - RNA, 15 nt, Pseudomonas putida KT2440
augcaguugucugcu

SEQ ID NO: 1629869 - RNA, 13 nt, Pseudomonas putida KT2440
augagugcaggca

SEQ ID NO: 1629870 - RNA, 14 nt, Pseudomonas putida KT2440
augaugaaagcagg

SEQ ID NO: 1629871 - RNA, 19 nt, Pseudomonas putida KT2440
augaugaaguggcgcaggc

SEQ ID NO: 1629872 - RNA, 21 nt, Pseudomonas putida KT2440
augaugaauaaugcuccagcg

SEQ ID NO: 1629873 - RNA, 15 nt, Pseudomonas putida KT2440
augauggcaaucacg

SEQ ID NO: 1629874 - RNA, 23 nt, Pseudomonas putida KT2440
augauugcgggcuuucugguucu

SEQ ID NO: 1629875 - RNA, 15 nt, Pseudomonas putida KT2440
augaccaagcaacgc

SEQ ID NO: 1629876 - RNA, 15 nt, Pseudomonas putida KT2440
augaaguugcaggca

SEQ ID NO: 1629877 - RNA, 22 nt, Pseudomonas putida KT2440
augaauaaccugguuauuuuuu

SEQ ID NO: 1629878 - RNA, 18 nt, Pseudomonas putida KT2440
augagggugaccuuuucu

SEQ ID NO: 1629879 - RNA, 16 nt, Pseudomonas putida KT2440
augaguaaagccgauc

SEQ ID NO: 1629880 - RNA, 16 nt, Pseudomonas putida KT2440
augacuguuaaucauu

SEQ ID NO: 1629881 - RNA, 15 nt, Pseudomonas putida KT2440
augaaauccaccagc

SEQ ID NO: 1629882 - RNA, 17 nt, Pseudomonas putida KT2440
augaagcuaagcaggga

SEQ ID NO: 1629883 - RNA, 17 nt, Pseudomonas putida KT2440
augaaggacaucaccag

SEQ ID NO: 1629884 - RNA, 12 nt, Pseudomonas putida KT2440
augaagcuucaa

SEQ ID NO: 1629885 - RNA, 13 nt, Pseudomonas putida KT2440
augaagcuucaaa

SEQ ID NO: 1629886 - RNA, 13 nt, Pseudomonas putida KT2440
augaagcaggccg

SEQ ID NO: 1629887 - RNA, 20 nt, Pseudomonas putida KT2440
augaagacgcucgacagcaa

SEQ ID NO: 1629888 - RNA, 16 nt, Pseudomonas putida KT2440
aucuuuccggagaugu

SEQ ID NO: 1629889 - RNA, 21 nt, Pseudomonas putida KT2440
augaaaccgagcgccgcgcgg

SEQ ID NO: 1629890 - RNA, 12 nt, Pseudomonas putida KT2440
aucuucuugccg

SEQ ID NO: 1629891 - RNA, 23 nt, Pseudomonas putida KT2440
aucuggggugggguacagucucc

SEQ ID NO: 1629892 - RNA, 14 nt, Pseudomonas putida KT2440
aucuggcucugcag

SEQ ID NO: 1629893 - RNA, 16 nt, Pseudomonas putida KT2440
aucuggcucugcagcg

SEQ ID NO: 1629894 - RNA, 17 nt, Pseudomonas putida KT2440
aucugcguuucgcuggc

SEQ ID NO: 1629895 - RNA, 20 nt, Pseudomonas putida KT2440
aucugcguuucgcuggccug

SEQ ID NO: 1629896 - RNA, 20 nt, Pseudomonas putida KT2440
aucuggcggaaugucggcgu

SEQ ID NO: 1629897 - RNA, 19 nt, Pseudomonas putida KT2440
aucuuguuggucaggccau

SEQ ID NO: 1629898 - RNA, 22 nt, Pseudomonas putida KT2440
aucgcccaucccggucaccugc

SEQ ID NO: 1629899 - RNA, 21 nt, Pseudomonas putida KT2440
aucgcagggucgcgccccaag

SEQ ID NO: 1629900 - RNA, 22 nt, Pseudomonas putida KT2440
aucgcagggucgcgccccaagc

SEQ ID NO: 1629901 - RNA, 14 nt, Pseudomonas putida KT2440
aucgccuccaggcg

SEQ ID NO: 1629902 - RNA, 19 nt, Pseudomonas putida KT2440
aucgcgcaagccuuugcgc

SEQ ID NO: 1629903 - RNA, 22 nt, Pseudomonas putida KT2440
aucgcgcaagccuuugcgccuu

SEQ ID NO: 1629904 - RNA, 15 nt, Pseudomonas putida KT2440
aucgcgcacuugcca

SEQ ID NO: 1629905 - RNA, 14 nt, Pseudomonas putida KT2440
aucgccucgcuggc

SEQ ID NO: 1629906 - RNA, 22 nt, Pseudomonas putida KT2440
aucgaggcguuguacaggaguc

SEQ ID NO: 1629907 - RNA, 15 nt, Pseudomonas putida KT2440
aucgagggacucuug

SEQ ID NO: 1629908 - RNA, 20 nt, Pseudomonas putida KT2440
aucgagccgaacagcaggca

SEQ ID NO: 1629909 - RNA, 17 nt, Pseudomonas putida KT2440
aucgagccgaucaggaa

SEQ ID NO: 1629910 - RNA, 22 nt, Pseudomonas putida KT2440
aucgaaagcugcgcacauugac

SEQ ID NO: 1629911 - RNA, 22 nt, Pseudomonas putida KT2440
aucgagauguggcccgggaagg

SEQ ID NO: 1629912 - RNA, 14 nt, Pseudomonas putida KT2440
aucgagcgccgccc

SEQ ID NO: 1629913 - RNA, 21 nt, Pseudomonas putida KT2440
aucgcaauccccuccgccugc

SEQ ID NO: 1629914 - RNA, 17 nt, Pseudomonas putida KT2440
aucagcucacaggcuca

SEQ ID NO: 1629915 - RNA, 17 nt, Pseudomonas putida KT2440
aucagcucauacgggug

SEQ ID NO: 1629916 - RNA, 21 nt, Pseudomonas putida KT2440
aucagcggcuuguucagcugg

SEQ ID NO: 1629917 - RNA, 12 nt, Pseudomonas putida KT2440
aucgagaucagg

SEQ ID NO: 1629918 - RNA, 16 nt, Pseudomonas putida KT2440
aucgucgacaacgcac

SEQ ID NO: 1629919 - RNA, 19 nt, Pseudomonas putida KT2440
aucguccuugcagggcacc

SEQ ID NO: 1629920 - RNA, 14 nt, Pseudomonas putida KT2440
aucguugcgcgcca

SEQ ID NO: 1629921 - RNA, 20 nt, Pseudomonas putida KT2440
aucggccaccgccggguggg

SEQ ID NO: 1629922 - RNA, 13 nt, Pseudomonas putida KT2440
aucggccagcaaa

SEQ ID NO: 1629923 - RNA, 12 nt, Pseudomonas putida KT2440
aucggccagccg

SEQ ID NO: 1629924 - RNA, 16 nt, Pseudomonas putida KT2440
aucggcaaacacaucc

SEQ ID NO: 1629925 - RNA, 16 nt, Pseudomonas putida KT2440
aucgguacgccgcaaa

SEQ ID NO: 1629926 - RNA, 16 nt, Pseudomonas putida KT2440
aucggugaucgcaaaa

SEQ ID NO: 1629927 - RNA, 16 nt, Pseudomonas putida KT2440
aucggucuuacgggcu

SEQ ID NO: 1629928 - RNA, 20 nt, Pseudomonas putida KT2440
aucgggcgcgucgucauggu

SEQ ID NO: 1629929 - RNA, 19 nt, Pseudomonas putida KT2440
aucggccguggguaccuuc

SEQ ID NO: 1629930 - RNA, 13 nt, Pseudomonas putida KT2440
aucggccucucuc

SEQ ID NO: 1629931 - RNA, 22 nt, Pseudomonas putida KT2440
aucggcuucagguucacuucca

SEQ ID NO: 1629932 - RNA, 23 nt, Pseudomonas putida KT2440
aucggccuguggguaacccugcu

SEQ ID NO: 1629933 - RNA, 19 nt, Pseudomonas putida KT2440
aucggccuugcgcugggca

SEQ ID NO: 1629934 - RNA, 17 nt, Pseudomonas putida KT2440
aucggccuggggcaggc

SEQ ID NO: 1629935 - RNA, 21 nt, Pseudomonas putida KT2440
aucgggauguucaggucgcgc

SEQ ID NO: 1629936 - RNA, 14 nt, Pseudomonas putida KT2440
aucugcaccgccuu

SEQ ID NO: 1629937 - RNA, 17 nt, Pseudomonas putida KT2440
aucugcacacugcgcuu

SEQ ID NO: 1629938 - RNA, 17 nt, Pseudomonas putida KT2440
aucugcacuuucacccc

SEQ ID NO: 1629939 - RNA, 15 nt, Pseudomonas putida KT2440
aucugcgcacggaag

SEQ ID NO: 1629940 - RNA, 20 nt, Pseudomonas putida KT2440
aucugcgccccgcucgccug

SEQ ID NO: 1629941 - RNA, 15 nt, Pseudomonas putida KT2440
aucugcgcgcucacu

SEQ ID NO: 1629942 - RNA, 13 nt, Pseudomonas putida KT2440
aucugccugcugc

SEQ ID NO: 1629943 - RNA, 22 nt, Pseudomonas putida KT2440
aucugccgggucggccugcucg

SEQ ID NO: 1629944 - RNA, 15 nt, Pseudomonas putida KT2440
aucugccggcagggc

SEQ ID NO: 1629945 - RNA, 22 nt, Pseudomonas putida KT2440
aucugccggcagggcuuucuuc

SEQ ID NO: 1629946 - RNA, 18 nt, Pseudomonas putida KT2440
aucugccggcgccuccag

SEQ ID NO: 1629947 - RNA, 22 nt, Pseudomonas putida KT2440
aucugaucuguaauagccucaa

SEQ ID NO: 1629948 - RNA, 19 nt, Pseudomonas putida KT2440
aucugaaaguucagcgccu

SEQ ID NO: 1629949 - RNA, 20 nt, Pseudomonas putida KT2440
aucugaaaguucagcgccuc

SEQ ID NO: 1629950 - RNA, 23 nt, Pseudomonas putida KT2440
aucucugguacaacaacaaaaaa

SEQ ID NO: 1629951 - RNA, 17 nt, Pseudomonas putida KT2440
aucucugccgagaggau

SEQ ID NO: 1629952 - RNA, 15 nt, Pseudomonas putida KT2440
aucucggccagcagg

SEQ ID NO: 1629953 - RNA, 17 nt, Pseudomonas putida KT2440
aucucgcuucauggccc

SEQ ID NO: 1629954 - RNA, 20 nt, Pseudomonas putida KT2440
aucucggucgacaggggcac

SEQ ID NO: 1629955 - RNA, 20 nt, Pseudomonas putida KT2440
aucucgguauggcucagugu

SEQ ID NO: 1629956 - RNA, 15 nt, Pseudomonas putida KT2440
aucucguucaugccc

SEQ ID NO: 1629957 - RNA, 12 nt, Pseudomonas putida KT2440
aucuaccagcuu

SEQ ID NO: 1629958 - RNA, 16 nt, Pseudomonas putida KT2440
aucuaccagcuugccg

SEQ ID NO: 1629959 - RNA, 14 nt, Pseudomonas putida KT2440
aucucaaccaccuc

SEQ ID NO: 1629960 - RNA, 13 nt, Pseudomonas putida KT2440
aucucgcccauga

SEQ ID NO: 1629961 - RNA, 22 nt, Pseudomonas putida KT2440
aucucgcccaugauguggcugg

SEQ ID NO: 1629962 - RNA, 14 nt, Pseudomonas putida KT2440
aucucgccagccug

SEQ ID NO: 1629963 - RNA, 15 nt, Pseudomonas putida KT2440
aucucgccagccugc

SEQ ID NO: 1629964 - RNA, 18 nt, Pseudomonas putida KT2440
aucucgccagccugcagc

SEQ ID NO: 1629965 - RNA, 19 nt, Pseudomonas putida KT2440
aucuccauagguuauccac

SEQ ID NO: 1629966 - RNA, 15 nt, Pseudomonas putida KT2440
aucuccaaaaggugc

SEQ ID NO: 1629967 - RNA, 13 nt, Pseudomonas putida KT2440
aucuccagcccga

SEQ ID NO: 1629968 - RNA, 18 nt, Pseudomonas putida KT2440
aucucacgcgccacauag

SEQ ID NO: 1629969 - RNA, 17 nt, Pseudomonas putida KT2440
aucucacggccauccug

SEQ ID NO: 1629970 - RNA, 18 nt, Pseudomonas putida KT2440
aucucaggcccaccaguc

SEQ ID NO: 1629971 - RNA, 16 nt, Pseudomonas putida KT2440
augugcacuggcaggc

SEQ ID NO: 1629972 - RNA, 21 nt, Pseudomonas putida KT2440
auguggcugguggcaaugcca

SEQ ID NO: 1629973 - RNA, 18 nt, Pseudomonas putida KT2440
auguggggcgugcucggc

SEQ ID NO: 1629974 - RNA, 16 nt, Pseudomonas putida KT2440
auguguuggccggacg

SEQ ID NO: 1629975 - RNA, 21 nt, Pseudomonas putida KT2440
augucuuccagaccagacagc

SEQ ID NO: 1629976 - RNA, 15 nt, Pseudomonas putida KT2440
auguaggagcggguu

SEQ ID NO: 1629977 - RNA, 19 nt, Pseudomonas putida KT2440
auguaaugaaaaucgccuu

SEQ ID NO: 1629978 - RNA, 14 nt, Pseudomonas putida KT2440
auguccagauccuc

SEQ ID NO: 1629979 - RNA, 12 nt, Pseudomonas putida KT2440
auguccagcccg

SEQ ID NO: 1629980 - RNA, 14 nt, Pseudomonas putida KT2440
auguccaggucacc

SEQ ID NO: 1629981 - RNA, 14 nt, Pseudomonas putida KT2440
augucccaguucau

SEQ ID NO: 1629982 - RNA, 14 nt, Pseudomonas putida KT2440
auguccauccaugc

SEQ ID NO: 1629983 - RNA, 19 nt, Pseudomonas putida KT2440
auguccauugagcacucaa

SEQ ID NO: 1629984 - RNA, 15 nt, Pseudomonas putida KT2440
auguaggcagcugcc

SEQ ID NO: 1629985 - RNA, 23 nt, Pseudomonas putida KT2440
auguaucggauuggcgcggcugg

SEQ ID NO: 1629986 - RNA, 18 nt, Pseudomonas putida KT2440
auguaucagcgccuccag

SEQ ID NO: 1629987 - RNA, 23 nt, Pseudomonas putida KT2440
auggcagacaaguccuucaucug

SEQ ID NO: 1629988 - RNA, 13 nt, Pseudomonas putida KT2440
auggcgcggugag

SEQ ID NO: 1629989 - RNA, 15 nt, Pseudomonas putida KT2440
auggcccagccagcg

SEQ ID NO: 1629990 - RNA, 15 nt, Pseudomonas putida KT2440
auggccagagcgcgc

SEQ ID NO: 1629991 - RNA, 19 nt, Pseudomonas putida KT2440
auggccacacgcugcugcu

SEQ ID NO: 1629992 - RNA, 15 nt, Pseudomonas putida KT2440
auggccaccagcacc

SEQ ID NO: 1629993 - RNA, 16 nt, Pseudomonas putida KT2440
auggcuccaccacagc

SEQ ID NO: 1629994 - RNA, 19 nt, Pseudomonas putida KT2440
auggcuccaccacagcugc

SEQ ID NO: 1629995 - RNA, 17 nt, Pseudomonas putida KT2440
auggcucaacuggcagg

SEQ ID NO: 1629996 - RNA, 16 nt, Pseudomonas putida KT2440
auggcucacacccagg

SEQ ID NO: 1629997 - RNA, 17 nt, Pseudomonas putida KT2440
augggccacuucgccgu

SEQ ID NO: 1629998 - RNA, 12 nt, Pseudomonas putida KT2440
augggcaggcca

SEQ ID NO: 1629999 - RNA, 21 nt, Pseudomonas putida KT2440
augggcgucgccugcaugucu

SEQ ID NO: 1630000 - RNA, 14 nt, Pseudomonas putida KT2440
augggcugcaaagc

SEQ ID NO: 1630001 - RNA, 21 nt, Pseudomonas putida KT2440
augggcuuccccagccuucaa

SEQ ID NO: 1630002 - RNA, 16 nt, Pseudomonas putida KT2440
auggucgcguuguuca

SEQ ID NO: 1630003 - RNA, 18 nt, Pseudomonas putida KT2440
auggucgcguuguucagc

SEQ ID NO: 1630004 - RNA, 23 nt, Pseudomonas putida KT2440
augguccuugaacggcauuucca

SEQ ID NO: 1630005 - RNA, 15 nt, Pseudomonas putida KT2440
augguguccggcaug

SEQ ID NO: 1630006 - RNA, 20 nt, Pseudomonas putida KT2440
auguugugggcaaugauggc

SEQ ID NO: 1630007 - RNA, 23 nt, Pseudomonas putida KT2440
auguugugggcaaugauggcaau

SEQ ID NO: 1630008 - RNA, 13 nt, Pseudomonas putida KT2440
auguugcgcagca

SEQ ID NO: 1630009 - RNA, 21 nt, Pseudomonas putida KT2440
auguucaucaccggccagcac

SEQ ID NO: 1630010 - RNA, 21 nt, Pseudomonas putida KT2440
auguucagcaccuucuugccc

SEQ ID NO: 1630011 - RNA, 14 nt, Pseudomonas putida KT2440
auuagcagguaaac

SEQ ID NO: 1630012 - RNA, 16 nt, Pseudomonas putida KT2440
auuacccuucaucgcc

SEQ ID NO: 1630013 - RNA, 12 nt, Pseudomonas putida KT2440
auuaccugcagg

SEQ ID NO: 1630014 - RNA, 16 nt, Pseudomonas putida KT2440
auuacgcaggcuccaa

SEQ ID NO: 1630015 - RNA, 17 nt, Pseudomonas putida KT2440
auuacgcgaaaaagccc

SEQ ID NO: 1630016 - RNA, 20 nt, Pseudomonas putida KT2440
auuacgcgucaucugcgcac

SEQ ID NO: 1630017 - RNA, 14 nt, Pseudomonas putida KT2440
auuacaagggccug

SEQ ID NO: 1630018 - RNA, 13 nt, Pseudomonas putida KT2440
auuacaaaagcgc

SEQ ID NO: 1630019 - RNA, 14 nt, Pseudomonas putida KT2440
auucaccagcuuca

SEQ ID NO: 1630020 - RNA, 15 nt, Pseudomonas putida KT2440
auucaccagcuucag

SEQ ID NO: 1630021 - RNA, 14 nt, Pseudomonas putida KT2440
auucaaagccugcu

SEQ ID NO: 1630022 - RNA, 16 nt, Pseudomonas putida KT2440
auuauccaccaggccg

SEQ ID NO: 1630023 - RNA, 20 nt, Pseudomonas putida KT2440
auuaucgagcuacagccccu

SEQ ID NO: 1630024 - RNA, 20 nt, Pseudomonas putida KT2440
auagugguaugauuucaggg

SEQ ID NO: 1630025 - RNA, 13 nt, Pseudomonas putida KT2440
auaggagcggguu

SEQ ID NO: 1630026 - RNA, 20 nt, Pseudomonas putida KT2440
auagggccagcggcuuuucu

SEQ ID NO: 1630027 - RNA, 15 nt, Pseudomonas putida KT2440
auagguuauccacac

SEQ ID NO: 1630028 - RNA, 18 nt, Pseudomonas putida KT2440
auaggugucgaacaccac

SEQ ID NO: 1630029 - RNA, 20 nt, Pseudomonas putida KT2440
auaguagaagcagaucauca

SEQ ID NO: 1630030 - RNA, 14 nt, Pseudomonas putida KT2440
auaucgcauuucua

SEQ ID NO: 1630031 - RNA, 17 nt, Pseudomonas putida KT2440
auauccagugcuucacu

SEQ ID NO: 1630032 - RNA, 15 nt, Pseudomonas putida KT2440
auaucuggugcaggu

SEQ ID NO: 1630033 - RNA, 20 nt, Pseudomonas putida KT2440
auagcuuucaggcgcagcac

SEQ ID NO: 1630034 - RNA, 14 nt, Pseudomonas putida KT2440
auagcgcuuucugg

SEQ ID NO: 1630035 - RNA, 21 nt, Pseudomonas putida KT2440
auagcccaccgucaggcucag

SEQ ID NO: 1630036 - RNA, 18 nt, Pseudomonas putida KT2440
auagccagcuggccaccu

SEQ ID NO: 1630037 - RNA, 17 nt, Pseudomonas putida KT2440
auagccauugcggcuga

SEQ ID NO: 1630038 - RNA, 17 nt, Pseudomonas putida KT2440
auagcaggaucuagccc

SEQ ID NO: 1630039 - RNA, 19 nt, Pseudomonas putida KT2440
auagcaggaucuagcccaa

SEQ ID NO: 1630040 - RNA, 11 nt, Pseudomonas putida KT2440
auagcaccagc

SEQ ID NO: 1630041 - RNA, 19 nt, Pseudomonas putida KT2440
auagcaccagcgggcccag

SEQ ID NO: 1630042 - RNA, 23 nt, Pseudomonas putida KT2440
auaccgcgcacgcaucugcaccg

SEQ ID NO: 1630043 - RNA, 16 nt, Pseudomonas putida KT2440
auaccggggcaccuug

SEQ ID NO: 1630044 - RNA, 16 nt, Pseudomonas putida KT2440
auaccgggauucgacu

SEQ ID NO: 1630045 - RNA, 22 nt, Pseudomonas putida KT2440
auacggucuuuuccccuuauau

SEQ ID NO: 1630046 - RNA, 12 nt, Pseudomonas putida KT2440
auacgacgcauc

SEQ ID NO: 1630047 - RNA, 23 nt, Pseudomonas putida KT2440
auacgucggggaauggcccagcc

SEQ ID NO: 1630048 - RNA, 14 nt, Pseudomonas putida KT2440
auacugcgcacgaa

SEQ ID NO: 1630049 - RNA, 15 nt, Pseudomonas putida KT2440
aucacacccucugcc

SEQ ID NO: 1630050 - RNA, 12 nt, Pseudomonas putida KT2440
aucacaccggca

SEQ ID NO: 1630051 - RNA, 20 nt, Pseudomonas putida KT2440
aucaaugggccgaucacgaa

SEQ ID NO: 1630052 - RNA, 15 nt, Pseudomonas putida KT2440
aucaagccugcgcag

SEQ ID NO: 1630053 - RNA, 20 nt, Pseudomonas putida KT2440
aucaagccugcgcaggcgcc

SEQ ID NO: 1630054 - RNA, 14 nt, Pseudomonas putida KT2440
aucaagcccgcucg

SEQ ID NO: 1630055 - RNA, 20 nt, Pseudomonas putida KT2440
aucaagcuguacaacgcagc

SEQ ID NO: 1630056 - RNA, 18 nt, Pseudomonas putida KT2440
aucaagguuucacgccgc

SEQ ID NO: 1630057 - RNA, 18 nt, Pseudomonas putida KT2440
aucaagguuucagcagcg

SEQ ID NO: 1630058 - RNA, 12 nt, Pseudomonas putida KT2440
aucacuuccugg

SEQ ID NO: 1630059 - RNA, 14 nt, Pseudomonas putida KT2440
aucacuuccuggcc

SEQ ID NO: 1630060 - RNA, 13 nt, Pseudomonas putida KT2440
aucacuuccaugg

SEQ ID NO: 1630061 - RNA, 16 nt, Pseudomonas putida KT2440
aucacuguugucggcc

SEQ ID NO: 1630062 - RNA, 16 nt, Pseudomonas putida KT2440
aucagauggcccgguc

SEQ ID NO: 1630063 - RNA, 15 nt, Pseudomonas putida KT2440
aucagagcgccagca

SEQ ID NO: 1630064 - RNA, 18 nt, Pseudomonas putida KT2440
aucagagcgccagcaagc

SEQ ID NO: 1630065 - RNA, 22 nt, Pseudomonas putida KT2440
aucagagcgccagcaagcgcau

SEQ ID NO: 1630066 - RNA, 14 nt, Pseudomonas putida KT2440
aucagcggcaggcu

SEQ ID NO: 1630067 - RNA, 16 nt, Pseudomonas putida KT2440
aucagcggcgccaccc

SEQ ID NO: 1630068 - RNA, 21 nt, Pseudomonas putida KT2440
aucagcgcggugaccagcggc

SEQ ID NO: 1630069 - RNA, 14 nt, Pseudomonas putida KT2440
aucagcgccucgcc

SEQ ID NO: 1630070 - RNA, 16 nt, Pseudomonas putida KT2440
aucagcgcagcaucuu

SEQ ID NO: 1630071 - RNA, 18 nt, Pseudomonas putida KT2440
aucagcgccagcacgcag

SEQ ID NO: 1630072 - RNA, 20 nt, Pseudomonas putida KT2440
aucagcgccagcacgcaggc

SEQ ID NO: 1630073 - RNA, 23 nt, Pseudomonas putida KT2440
aucagccgcgcugacgcagggcc

SEQ ID NO: 1630074 - RNA, 14 nt, Pseudomonas putida KT2440
aucagcgcacccuu

SEQ ID NO: 1630075 - RNA, 16 nt, Pseudomonas putida KT2440
aucagcacgccgccga

SEQ ID NO: 1630076 - RNA, 18 nt, Pseudomonas putida KT2440
aucagcaacccggccagg

SEQ ID NO: 1630077 - RNA, 22 nt, Pseudomonas putida KT2440
aucagcaaugaugaaagcaggu

SEQ ID NO: 1630078 - RNA, 18 nt, Pseudomonas putida KT2440
aucaccacgcccuggccc

SEQ ID NO: 1630079 - RNA, 13 nt, Pseudomonas putida KT2440
aucaccagccccc

SEQ ID NO: 1630080 - RNA, 13 nt, Pseudomonas putida KT2440
aucaccagcagcu

SEQ ID NO: 1630081 - RNA, 20 nt, Pseudomonas putida KT2440
aucaccacaaaaccuuccau

SEQ ID NO: 1630082 - RNA, 14 nt, Pseudomonas putida KT2440
aucacauccacagc

SEQ ID NO: 1630083 - RNA, 15 nt, Pseudomonas putida KT2440
aucacauccacagcc

SEQ ID NO: 1630084 - RNA, 18 nt, Pseudomonas putida KT2440
aucacauaaggcagcagc

SEQ ID NO: 1630085 - RNA, 17 nt, Pseudomonas putida KT2440
aucaccucggcaccgca

SEQ ID NO: 1630086 - RNA, 20 nt, Pseudomonas putida KT2440
aucaccucgguaaaggugcc

SEQ ID NO: 1630087 - RNA, 19 nt, Pseudomonas putida KT2440
aucacccgcgaaugcuccg

SEQ ID NO: 1630088 - RNA, 17 nt, Pseudomonas putida KT2440
aucaccgcaagcugcac

SEQ ID NO: 1630089 - RNA, 19 nt, Pseudomonas putida KT2440
aucaccgcaagcugcaccg

SEQ ID NO: 1630090 - RNA, 23 nt, Pseudomonas putida KT2440
aucaccgcaagcugcaccgccac

SEQ ID NO: 1630091 - RNA, 16 nt, Pseudomonas putida KT2440
aucaccgccagcagcu

SEQ ID NO: 1630092 - RNA, 17 nt, Pseudomonas putida KT2440
aucaccgcgaccuucac

SEQ ID NO: 1630093 - RNA, 20 nt, Pseudomonas putida KT2440
aucaccgccaggucgccggu

SEQ ID NO: 1630094 - RNA, 13 nt, Pseudomonas putida KT2440
aucaccgccgccc

SEQ ID NO: 1630095 - RNA, 21 nt, Pseudomonas putida KT2440
aucaccagggcaucggcgccc

SEQ ID NO: 1630096 - RNA, 24 nt, Pseudomonas putida KT2440
aucaccagguugcgugccucgccc

SEQ ID NO: 1630097 - RNA, 18 nt, Pseudomonas putida KT2440
aucaccagguuguggccc

SEQ ID NO: 1630098 - RNA, 14 nt, Pseudomonas putida KT2440
aucaccaguuuuug

SEQ ID NO: 1630099 - RNA, 20 nt, Pseudomonas putida KT2440
aucacccgggaacagcagca

SEQ ID NO: 1630100 - RNA, 17 nt, Pseudomonas putida KT2440
aucacccgucugcagga

SEQ ID NO: 1630101 - RNA, 13 nt, Pseudomonas putida KT2440
aucacgucggccu

SEQ ID NO: 1630102 - RNA, 16 nt, Pseudomonas putida KT2440
aucacuacaugcggcc

SEQ ID NO: 1630103 - RNA, 18 nt, Pseudomonas putida KT2440
aucacuccugguuggcca

SEQ ID NO: 1630104 - RNA, 18 nt, Pseudomonas putida KT2440
aucacugccaccgugagc

SEQ ID NO: 1630105 - RNA, 14 nt, Pseudomonas putida KT2440
aucacugccagcac

SEQ ID NO: 1630106 - RNA, 15 nt, Pseudomonas putida KT2440
aucacugccagcacc

SEQ ID NO: 1630107 - RNA, 23 nt, Pseudomonas putida KT2440
aucacugccagcaccuggcggcc

SEQ ID NO: 1630108 - RNA, 20 nt, Pseudomonas putida KT2440
aucacugcgcagcccuccca

SEQ ID NO: 1630109 - RNA, 19 nt, Pseudomonas putida KT2440
aucaccugggcgaucacau

SEQ ID NO: 1630110 - RNA, 19 nt, Pseudomonas putida KT2440
aucaccugcacaucggcca

SEQ ID NO: 1630111 - RNA, 22 nt, Pseudomonas putida KT2440
aucaccuugaugcgcgagcugg

SEQ ID NO: 1630112 - RNA, 15 nt, Pseudomonas putida KT2440
aucacgcaaccucgu

SEQ ID NO: 1630113 - RNA, 14 nt, Pseudomonas putida KT2440
aucacgcuggccau

SEQ ID NO: 1630114 - RNA, 14 nt, Pseudomonas putida KT2440
aucacgcccgggcc

SEQ ID NO: 1630115 - RNA, 19 nt, Pseudomonas putida KT2440
aucacgcaggcccagcagg

SEQ ID NO: 1630116 - RNA, 22 nt, Pseudomonas putida KT2440
aguuugacggugaauuccuugc

SEQ ID NO: 1630117 - RNA, 14 nt, Pseudomonas putida KT2440
aguuugcccagcgc

SEQ ID NO: 1630118 - RNA, 21 nt, Pseudomonas putida KT2440
aguuucucgcaaaaaacuuca

SEQ ID NO: 1630119 - RNA, 22 nt, Pseudomonas putida KT2440
aguuuuuuuguguacgggacaa

SEQ ID NO: 1630120 - RNA, 11 nt, Pseudomonas putida KT2440
aguugcagcaa

SEQ ID NO: 1630121 - RNA, 17 nt, Pseudomonas putida KT2440
aguugcaggcgcagggu

SEQ ID NO: 1630122 - RNA, 20 nt, Pseudomonas putida KT2440
aguugcaggucggcacgcgg

SEQ ID NO: 1630123 - RNA, 15 nt, Pseudomonas putida KT2440
aguuguuuuauaacg

SEQ ID NO: 1630124 - RNA, 13 nt, Pseudomonas putida KT2440
agugugggggcgg

SEQ ID NO: 1630125 - RNA, 15 nt, Pseudomonas putida KT2440
aguuccuugagcacc

SEQ ID NO: 1630126 - RNA, 16 nt, Pseudomonas putida KT2440
aguucgacgcugcugu

SEQ ID NO: 1630127 - RNA, 16 nt, Pseudomonas putida KT2440
aguuccuggcgcuccu

SEQ ID NO: 1630128 - RNA, 19 nt, Pseudomonas putida KT2440
aguucggcggccccggcgc

SEQ ID NO: 1630129 - RNA, 23 nt, Pseudomonas putida KT2440
aguucguccucgacccacggcug

SEQ ID NO: 1630130 - RNA, 13 nt, Pseudomonas putida KT2440
aguucguccaggc

SEQ ID NO: 1630131 - RNA, 17 nt, Pseudomonas putida KT2440
aguucguuguagcugac

SEQ ID NO: 1630132 - RNA, 16 nt, Pseudomonas putida KT2440
aguuccagggcggcgc

SEQ ID NO: 1630133 - RNA, 19 nt, Pseudomonas putida KT2440
agugggguggaaguuccug

SEQ ID NO: 1630134 - RNA, 17 nt, Pseudomonas putida KT2440
agugggcuugcccgcga

SEQ ID NO: 1630135 - RNA, 17 nt, Pseudomonas putida KT2440
aguggcagaacucccau

SEQ ID NO: 1630136 - RNA, 18 nt, Pseudomonas putida KT2440
agugguugacaagcaaaa

SEQ ID NO: 1630137 - RNA, 22 nt, Pseudomonas putida KT2440
aguggucgugccauucaucgua

SEQ ID NO: 1630138 - RNA, 19 nt, Pseudomonas putida KT2440
agugucgaacuucacuucg

SEQ ID NO: 1630139 - RNA, 16 nt, Pseudomonas putida KT2440
agugucggccggcccc

SEQ ID NO: 1630140 - RNA, 13 nt, Pseudomonas putida KT2440
aguguaaccaugu

SEQ ID NO: 1630141 - RNA, 17 nt, Pseudomonas putida KT2440
agugccguccgcugccu

SEQ ID NO: 1630142 - RNA, 23 nt, Pseudomonas putida KT2440
agugccguccgcugccuuccaac

SEQ ID NO: 1630143 - RNA, 16 nt, Pseudomonas putida KT2440
agugccguggcaggca

SEQ ID NO: 1630144 - RNA, 17 nt, Pseudomonas putida KT2440
agugccguggcaggcag

SEQ ID NO: 1630145 - RNA, 19 nt, Pseudomonas putida KT2440
agugccaagaauucguuuu

SEQ ID NO: 1630146 - RNA, 16 nt, Pseudomonas putida KT2440
agugcguagccuucag

SEQ ID NO: 1630147 - RNA, 14 nt, Pseudomonas putida KT2440
agugcgugcaagag

SEQ ID NO: 1630148 - RNA, 23 nt, Pseudomonas putida KT2440
agugcgucggccaccaccgggug

SEQ ID NO: 1630149 - RNA, 18 nt, Pseudomonas putida KT2440
agugcucgccucacagcg

SEQ ID NO: 1630150 - RNA, 15 nt, Pseudomonas putida KT2440
aguggauauccagcg

SEQ ID NO: 1630151 - RNA, 23 nt, Pseudomonas putida KT2440
agucucuuucaacagcuggcugg

SEQ ID NO: 1630152 - RNA, 14 nt, Pseudomonas putida KT2440
agucguugcgcugg

SEQ ID NO: 1630153 - RNA, 18 nt, Pseudomonas putida KT2440
agucgccgcggguaccac

SEQ ID NO: 1630154 - RNA, 17 nt, Pseudomonas putida KT2440
agucgcccaguuccaug

SEQ ID NO: 1630155 - RNA, 18 nt, Pseudomonas putida KT2440
aguccuugcgugccucag

SEQ ID NO: 1630156 - RNA, 17 nt, Pseudomonas putida KT2440
agucgaaggggaucagc

SEQ ID NO: 1630157 - RNA, 18 nt, Pseudomonas putida KT2440
agucgacaauuuggggcu

SEQ ID NO: 1630158 - RNA, 19 nt, Pseudomonas putida KT2440
agucgacaauuuggggcug

SEQ ID NO: 1630159 - RNA, 20 nt, Pseudomonas putida KT2440
aguccuuggccaaugccagg

SEQ ID NO: 1630160 - RNA, 21 nt, Pseudomonas putida KT2440
aguccuuggccaaugccagga

SEQ ID NO: 1630161 - RNA, 17 nt, Pseudomonas putida KT2440
agucuuccccuuggcga

SEQ ID NO: 1630162 - RNA, 22 nt, Pseudomonas putida KT2440
agugaccgguuuuggcaggccg

SEQ ID NO: 1630163 - RNA, 14 nt, Pseudomonas putida KT2440
agugaauuccuugc

SEQ ID NO: 1630164 - RNA, 19 nt, Pseudomonas putida KT2440
agugaauuccuugcuggug

SEQ ID NO: 1630165 - RNA, 19 nt, Pseudomonas putida KT2440
agugacagguucgcccugu

SEQ ID NO: 1630166 - RNA, 13 nt, Pseudomonas putida KT2440
agucugaaaacaa

SEQ ID NO: 1630167 - RNA, 21 nt, Pseudomonas putida KT2440
agucugcucagccaaccgccc

SEQ ID NO: 1630168 - RNA, 20 nt, Pseudomonas putida KT2440
auaacuacuuagggaagaga

SEQ ID NO: 1630169 - RNA, 14 nt, Pseudomonas putida KT2440
auaacuuacaucug

SEQ ID NO: 1630170 - RNA, 19 nt, Pseudomonas putida KT2440
auaacaccccccagcagcg

SEQ ID NO: 1630171 - RNA, 23 nt, Pseudomonas putida KT2440
auaacaccccccagcagcgggca

SEQ ID NO: 1630172 - RNA, 17 nt, Pseudomonas putida KT2440
auaaaccagcagcgccu

SEQ ID NO: 1630173 - RNA, 13 nt, Pseudomonas putida KT2440
auaaagaucuaca

SEQ ID NO: 1630174 - RNA, 16 nt, Pseudomonas putida KT2440
auaaaccgugcaaaca

SEQ ID NO: 1630175 - RNA, 22 nt, Pseudomonas putida KT2440
auaaaggucuuuuggcucaggu

SEQ ID NO: 1630176 - RNA, 23 nt, Pseudomonas putida KT2440
auaaucuugcuugagucucggcu

SEQ ID NO: 1630177 - RNA, 13 nt, Pseudomonas putida KT2440
auaauaaaaaaag

SEQ ID NO: 1630178 - RNA, 12 nt, Pseudomonas putida KT2440
auaauaaaaaaa

SEQ ID NO: 1630179 - RNA, 13 nt, Pseudomonas putida KT2440
auaaggcagcagc

SEQ ID NO: 1630180 - RNA, 23 nt, Pseudomonas putida KT2440
auaagcccaauacccaacagcau

SEQ ID NO: 1630181 - RNA, 13 nt, Pseudomonas putida KT2440
aggcaaccgcauc

SEQ ID NO: 1630182 - RNA, 18 nt, Pseudomonas putida KT2440
aggcaaccgcauccccug

SEQ ID NO: 1630183 - RNA, 23 nt, Pseudomonas putida KT2440
aggcaaaggucugcugcggccgc

SEQ ID NO: 1630184 - RNA, 19 nt, Pseudomonas putida KT2440
aggcaaaguugagcgccgc

SEQ ID NO: 1630185 - RNA, 19 nt, Pseudomonas putida KT2440
aggcaaagaagucgccaca

SEQ ID NO: 1630186 - RNA, 18 nt, Pseudomonas putida KT2440
aggcacaaaaaagcccgg

SEQ ID NO: 1630187 - RNA, 21 nt, Pseudomonas putida KT2440
aggcaaucgugaucaucccca

SEQ ID NO: 1630188 - RNA, 20 nt, Pseudomonas putida KT2440
aggcaagcccgcuugcugug

SEQ ID NO: 1630189 - RNA, 21 nt, Pseudomonas putida KT2440
aggcaauaccgauggccccgc

SEQ ID NO: 1630190 - RNA, 11 nt, Pseudomonas putida KT2440
aggcaccaacu

SEQ ID NO: 1630191 - RNA, 15 nt, Pseudomonas putida KT2440
aggcaccaacugcac

SEQ ID NO: 1630192 - RNA, 20 nt, Pseudomonas putida KT2440
aggcaccaacugcacccgcc

SEQ ID NO: 1630193 - RNA, 20 nt, Pseudomonas putida KT2440
aggcaccacaagaacugcga

SEQ ID NO: 1630194 - RNA, 22 nt, Pseudomonas putida KT2440
aggcaccgaguaccgucggcac

SEQ ID NO: 1630195 - RNA, 13 nt, Pseudomonas putida KT2440
aggcacccagcca

SEQ ID NO: 1630196 - RNA, 14 nt, Pseudomonas putida KT2440
aggcacccagccag

SEQ ID NO: 1630197 - RNA, 16 nt, Pseudomonas putida KT2440
aggcacaggccagcca

SEQ ID NO: 1630198 - RNA, 17 nt, Pseudomonas putida KT2440
aggcacaggcccagcaa

SEQ ID NO: 1630199 - RNA, 18 nt, Pseudomonas putida KT2440
aggcacauccugcaaggc

SEQ ID NO: 1630200 - RNA, 12 nt, Pseudomonas putida KT2440
aggcacacccgg

SEQ ID NO: 1630201 - RNA, 19 nt, Pseudomonas putida KT2440
aggcacacccggacccugg

SEQ ID NO: 1630202 - RNA, 19 nt, Pseudomonas putida KT2440
aggcacuugggaucgaugc

SEQ ID NO: 1630203 - RNA, 15 nt, Pseudomonas putida KT2440
aggcacuggccagcg

SEQ ID NO: 1630204 - RNA, 18 nt, Pseudomonas putida KT2440
aggcagaucgaaagacag

SEQ ID NO: 1630205 - RNA, 14 nt, Pseudomonas putida KT2440
aggcacggcaccag

SEQ ID NO: 1630206 - RNA, 16 nt, Pseudomonas putida KT2440
aggcacggcaccagca

SEQ ID NO: 1630207 - RNA, 20 nt, Pseudomonas putida KT2440
aggcacucggucggcuggca

SEQ ID NO: 1630208 - RNA, 21 nt, Pseudomonas putida KT2440
aggcacuaagcgaaacaccag

SEQ ID NO: 1630209 - RNA, 23 nt, Pseudomonas putida KT2440
aggcacgacugaacaccugccag

SEQ ID NO: 1630210 - RNA, 19 nt, Pseudomonas putida KT2440
aggauuugcccgcaaagca

SEQ ID NO: 1630211 - RNA, 21 nt, Pseudomonas putida KT2440
aggcaaacgaaaucugccugc

SEQ ID NO: 1630212 - RNA, 18 nt, Pseudomonas putida KT2440
aggcaaagaaacaccagg

SEQ ID NO: 1630213 - RNA, 21 nt, Pseudomonas putida KT2440
aggaucuuuuaugccuagcca

SEQ ID NO: 1630214 - RNA, 22 nt, Pseudomonas putida KT2440
aggaucggguuuacccgcgaag

SEQ ID NO: 1630215 - RNA, 19 nt, Pseudomonas putida KT2440
aggaugcggcugaccccac

SEQ ID NO: 1630216 - RNA, 22 nt, Pseudomonas putida KT2440
aggaugcugaagcucuccagca

SEQ ID NO: 1630217 - RNA, 14 nt, Pseudomonas putida KT2440
aggauggccgcagg

SEQ ID NO: 1630218 - RNA, 17 nt, Pseudomonas putida KT2440
aggcauuguugcaacgc

SEQ ID NO: 1630219 - RNA, 21 nt, Pseudomonas putida KT2440
aggcauuuucaaugcuuugau

SEQ ID NO: 1630220 - RNA, 13 nt, Pseudomonas putida KT2440
aggccaacugcgc

SEQ ID NO: 1630221 - RNA, 14 nt, Pseudomonas putida KT2440
aggccaagguugcc

SEQ ID NO: 1630222 - RNA, 23 nt, Pseudomonas putida KT2440
aggccaagguugccaccagcauc

SEQ ID NO: 1630223 - RNA, 21 nt, Pseudomonas putida KT2440
aggccaaguacggccagcagg

SEQ ID NO: 1630224 - RNA, 19 nt, Pseudomonas putida KT2440
aggccaaugcagcuuugag

SEQ ID NO: 1630225 - RNA, 19 nt, Pseudomonas putida KT2440
aggccaaugcccaugccca

SEQ ID NO: 1630226 - RNA, 16 nt, Pseudomonas putida KT2440
aggcaugccagcagcu

SEQ ID NO: 1630227 - RNA, 17 nt, Pseudomonas putida KT2440
aggcaugccagcagcug

SEQ ID NO: 1630228 - RNA, 20 nt, Pseudomonas putida KT2440
aggcaugcgucuggcggccc

SEQ ID NO: 1630229 - RNA, 12 nt, Pseudomonas putida KT2440
aggcaugggcca

SEQ ID NO: 1630230 - RNA, 15 nt, Pseudomonas putida KT2440
aggcaugggccaggg

SEQ ID NO: 1630231 - RNA, 22 nt, Pseudomonas putida KT2440
aggcaugacaaacgccagcaug

SEQ ID NO: 1630232 - RNA, 15 nt, Pseudomonas putida KT2440
aggcauaucaagaau

SEQ ID NO: 1630233 - RNA, 21 nt, Pseudomonas putida KT2440
aggcauucagcucggccaccc

SEQ ID NO: 1630234 - RNA, 15 nt, Pseudomonas putida KT2440
aggcauucgcgggcg

SEQ ID NO: 1630235 - RNA, 13 nt, Pseudomonas putida KT2440
aggcaggccagca

SEQ ID NO: 1630236 - RNA, 15 nt, Pseudomonas putida KT2440
aggcaggccagcacg

SEQ ID NO: 1630237 - RNA, 21 nt, Pseudomonas putida KT2440
aggcaggccagcacggccagc

SEQ ID NO: 1630238 - RNA, 16 nt, Pseudomonas putida KT2440
aggcagcugccuuggc

SEQ ID NO: 1630239 - RNA, 17 nt, Pseudomonas putida KT2440
aggcagccuccagguuc

SEQ ID NO: 1630240 - RNA, 11 nt, Pseudomonas putida KT2440
aggcagccucg

SEQ ID NO: 1630241 - RNA, 11 nt, Pseudomonas putida KT2440
aggcagcagac

SEQ ID NO: 1630242 - RNA, 14 nt, Pseudomonas putida KT2440
aggcauccagcucg

SEQ ID NO: 1630243 - RNA, 14 nt, Pseudomonas putida KT2440
aggcauccacaccc

SEQ ID NO: 1630244 - RNA, 15 nt, Pseudomonas putida KT2440
aggcauccacacccu

SEQ ID NO: 1630245 - RNA, 16 nt, Pseudomonas putida KT2440
aggcaguaggccaccg

SEQ ID NO: 1630246 - RNA, 23 nt, Pseudomonas putida KT2440
aggcauaaaaaaaccggccacga

SEQ ID NO: 1630247 - RNA, 21 nt, Pseudomonas putida KT2440
aggcauagcgguacagcaccc

SEQ ID NO: 1630248 - RNA, 20 nt, Pseudomonas putida KT2440
aggcauaccgcaacaccugc

SEQ ID NO: 1630249 - RNA, 15 nt, Pseudomonas putida KT2440
aggcauacaggacca

SEQ ID NO: 1630250 - RNA, 17 nt, Pseudomonas putida KT2440
aggcauacaggaccagg

SEQ ID NO: 1630251 - RNA, 15 nt, Pseudomonas putida KT2440
aggcccagcaacagc

SEQ ID NO: 1630252 - RNA, 21 nt, Pseudomonas putida KT2440
aggcccauuucgcgggucagg

SEQ ID NO: 1630253 - RNA, 20 nt, Pseudomonas putida KT2440
aggcccagcagguacagcac

SEQ ID NO: 1630254 - RNA, 13 nt, Pseudomonas putida KT2440
aggcccaccaccg

SEQ ID NO: 1630255 - RNA, 16 nt, Pseudomonas putida KT2440
aggcccgcaagggucu

SEQ ID NO: 1630256 - RNA, 21 nt, Pseudomonas putida KT2440
aggcccgccagagcauggcca

SEQ ID NO: 1630257 - RNA, 14 nt, Pseudomonas putida KT2440
aggccccuuggcca

SEQ ID NO: 1630258 - RNA, 13 nt, Pseudomonas putida KT2440
aggcccugcugcu

SEQ ID NO: 1630259 - RNA, 15 nt, Pseudomonas putida KT2440
aggcccugcugcuuc

SEQ ID NO: 1630260 - RNA, 16 nt, Pseudomonas putida KT2440
aggccgaaaccgcccg

SEQ ID NO: 1630261 - RNA, 18 nt, Pseudomonas putida KT2440
aggccgaaaccgcccggg

SEQ ID NO: 1630262 - RNA, 16 nt, Pseudomonas putida KT2440
aggcccgugguuggag

SEQ ID NO: 1630263 - RNA, 19 nt, Pseudomonas putida KT2440
aggcccugcauaugcaggg

SEQ ID NO: 1630264 - RNA, 20 nt, Pseudomonas putida KT2440
aggcccucaagggcgcugau

SEQ ID NO: 1630265 - RNA, 16 nt, Pseudomonas putida KT2440
aggccgacaacagcau

SEQ ID NO: 1630266 - RNA, 14 nt, Pseudomonas putida KT2440
aggccaccggcagc

SEQ ID NO: 1630267 - RNA, 19 nt, Pseudomonas putida KT2440
aggccaccguugcgcucga

SEQ ID NO: 1630268 - RNA, 22 nt, Pseudomonas putida KT2440
aggccaccguugcgcucgagcc

SEQ ID NO: 1630269 - RNA, 12 nt, Pseudomonas putida KT2440
aggccagcgcac

SEQ ID NO: 1630270 - RNA, 15 nt, Pseudomonas putida KT2440
aggccagcgcacagc

SEQ ID NO: 1630271 - RNA, 15 nt, Pseudomonas putida KT2440
aggccagccgagcca

SEQ ID NO: 1630272 - RNA, 18 nt, Pseudomonas putida KT2440
aggccagcacggccagca

SEQ ID NO: 1630273 - RNA, 20 nt, Pseudomonas putida KT2440
aggccagccagguauggcca

SEQ ID NO: 1630274 - RNA, 19 nt, Pseudomonas putida KT2440
aggccagcccauggcgcug

SEQ ID NO: 1630275 - RNA, 20 nt, Pseudomonas putida KT2440
aggccagcccauggcgcuga

SEQ ID NO: 1630276 - RNA, 22 nt, Pseudomonas putida KT2440
aggccagcccauggcgcugacc

SEQ ID NO: 1630277 - RNA, 11 nt, Pseudomonas putida KT2440
aggccagcccc

SEQ ID NO: 1630278 - RNA, 16 nt, Pseudomonas putida KT2440
aggccagguacaggca

SEQ ID NO: 1630279 - RNA, 23 nt, Pseudomonas putida KT2440
aggcccacggcguccaggcccgc

SEQ ID NO: 1630280 - RNA, 13 nt, Pseudomonas putida KT2440
aggcccaacagcg

SEQ ID NO: 1630281 - RNA, 14 nt, Pseudomonas putida KT2440
aggccaggaacagc

SEQ ID NO: 1630282 - RNA, 15 nt, Pseudomonas putida KT2440
aggccaggaacagcg

SEQ ID NO: 1630283 - RNA, 18 nt, Pseudomonas putida KT2440
aggccaggaacagcgcag

SEQ ID NO: 1630284 - RNA, 23 nt, Pseudomonas putida KT2440
aggccaggaacagcgcagccacc

SEQ ID NO: 1630285 - RNA, 17 nt, Pseudomonas putida KT2440
aggccaggacaggagag

SEQ ID NO: 1630286 - RNA, 13 nt, Pseudomonas putida KT2440
aggccaguuccuc

SEQ ID NO: 1630287 - RNA, 19 nt, Pseudomonas putida KT2440
aggccaguaccagcagcac

SEQ ID NO: 1630288 - RNA, 21 nt, Pseudomonas putida KT2440
aggccaguaccagcagcacau

SEQ ID NO: 1630289 - RNA, 15 nt, Pseudomonas putida KT2440
aggaagucaaccuca

SEQ ID NO: 1630290 - RNA, 18 nt, Pseudomonas putida KT2440
aggaagaaggcauccagg

SEQ ID NO: 1630291 - RNA, 19 nt, Pseudomonas putida KT2440
aggaagaaggcauccaggg

SEQ ID NO: 1630292 - RNA, 14 nt, Pseudomonas putida KT2440
aggaagauguguug

SEQ ID NO: 1630293 - RNA, 22 nt, Pseudomonas putida KT2440
aggaagaugaagaaaccaccgc

SEQ ID NO: 1630294 - RNA, 12 nt, Pseudomonas putida KT2440
aggaagcuggga

SEQ ID NO: 1630295 - RNA, 13 nt, Pseudomonas putida KT2440
aggaagcugggaa

SEQ ID NO: 1630296 - RNA, 15 nt, Pseudomonas putida KT2440
aggaagcuguacagc

SEQ ID NO: 1630297 - RNA, 18 nt, Pseudomonas putida KT2440
aggacaagccgacaaaaa

SEQ ID NO: 1630298 - RNA, 21 nt, Pseudomonas putida KT2440
aggacaagccgacaaaaacaa

SEQ ID NO: 1630299 - RNA, 19 nt, Pseudomonas putida KT2440
aggaacgguguaucggcca

SEQ ID NO: 1630300 - RNA, 15 nt, Pseudomonas putida KT2440
aggaaccgcucccag

SEQ ID NO: 1630301 - RNA, 19 nt, Pseudomonas putida KT2440
aggaacagcggcagcaaca

SEQ ID NO: 1630302 - RNA, 19 nt, Pseudomonas putida KT2440
aggaacagcucgauggcca

SEQ ID NO: 1630303 - RNA, 14 nt, Pseudomonas putida KT2440
aggaacaacuuggu

SEQ ID NO: 1630304 - RNA, 14 nt, Pseudomonas putida KT2440
aggaguccagcugc

SEQ ID NO: 1630305 - RNA, 16 nt, Pseudomonas putida KT2440
aggaguccagcugcau

SEQ ID NO: 1630306 - RNA, 18 nt, Pseudomonas putida KT2440
aggaguucugcacagcgc

SEQ ID NO: 1630307 - RNA, 22 nt, Pseudomonas putida KT2440
aggagcggccuucagggccggu

SEQ ID NO: 1630308 - RNA, 20 nt, Pseudomonas putida KT2440
aggagcgggcuugcccgcga

SEQ ID NO: 1630309 - RNA, 19 nt, Pseudomonas putida KT2440
aggagcggguucacccgcg

SEQ ID NO: 1630310 - RNA, 18 nt, Pseudomonas putida KT2440
aggagcggguuuacccgc

SEQ ID NO: 1630311 - RNA, 19 nt, Pseudomonas putida KT2440
aggagcggguuuacccgcg

SEQ ID NO: 1630312 - RNA, 14 nt, Pseudomonas putida KT2440
aggagcguccgagc

SEQ ID NO: 1630313 - RNA, 18 nt, Pseudomonas putida KT2440
aggagcugauucagcaca

SEQ ID NO: 1630314 - RNA, 21 nt, Pseudomonas putida KT2440
aggagggccguaggacagugc

SEQ ID NO: 1630315 - RNA, 19 nt, Pseudomonas putida KT2440
aggaggcuguuucagcccu

SEQ ID NO: 1630316 - RNA, 19 nt, Pseudomonas putida KT2440
aggauauugccgacuccaa

SEQ ID NO: 1630317 - RNA, 12 nt, Pseudomonas putida KT2440
aggaucacccag

SEQ ID NO: 1630318 - RNA, 20 nt, Pseudomonas putida KT2440
aggaucaccaaggcuugagu

SEQ ID NO: 1630319 - RNA, 19 nt, Pseudomonas putida KT2440
aggauacgacgcaucaggg

SEQ ID NO: 1630320 - RNA, 22 nt, Pseudomonas putida KT2440
aggauaagcaugggucagacuu

SEQ ID NO: 1630321 - RNA, 17 nt, Pseudomonas putida KT2440
aggauaccgcguuguag

SEQ ID NO: 1630322 - RNA, 15 nt, Pseudomonas putida KT2440
aggacugcuucaggc

SEQ ID NO: 1630323 - RNA, 14 nt, Pseudomonas putida KT2440
aggagaacacccag

SEQ ID NO: 1630324 - RNA, 13 nt, Pseudomonas putida KT2440
aggacaucaccag

SEQ ID NO: 1630325 - RNA, 23 nt, Pseudomonas putida KT2440
agcuuggcuuucggcgcacccgg

SEQ ID NO: 1630326 - RNA, 14 nt, Pseudomonas putida KT2440
agcuugcgcgccuu

SEQ ID NO: 1630327 - RNA, 15 nt, Pseudomonas putida KT2440
agcuugcccagcugc

SEQ ID NO: 1630328 - RNA, 17 nt, Pseudomonas putida KT2440
agcuugcccaucaccuc

SEQ ID NO: 1630329 - RNA, 16 nt, Pseudomonas putida KT2440
agcuugccauccuuga

SEQ ID NO: 1630330 - RNA, 19 nt, Pseudomonas putida KT2440
agcuugccauccuugaagu

SEQ ID NO: 1630331 - RNA, 20 nt, Pseudomonas putida KT2440
agcuugccauccuugaagua

SEQ ID NO: 1630332 - RNA, 21 nt, Pseudomonas putida KT2440
agcuugccauccuugaaguag

SEQ ID NO: 1630333 - RNA, 12 nt, Pseudomonas putida KT2440
agcuugccauuc

SEQ ID NO: 1630334 - RNA, 15 nt, Pseudomonas putida KT2440
agcuugccauucuug

SEQ ID NO: 1630335 - RNA, 22 nt, Pseudomonas putida KT2440
agcuugaugcugucgaagcgcu

SEQ ID NO: 1630336 - RNA, 23 nt, Pseudomonas putida KT2440
agcuuuguauugccugugcuggc

SEQ ID NO: 1630337 - RNA, 15 nt, Pseudomonas putida KT2440
agcuuucaggcgcag

SEQ ID NO: 1630338 - RNA, 19 nt, Pseudomonas putida KT2440
agcuuucaggcgcagcaca

SEQ ID NO: 1630339 - RNA, 20 nt, Pseudomonas putida KT2440
agcuucuugugcuuccagcu

SEQ ID NO: 1630340 - RNA, 22 nt, Pseudomonas putida KT2440
agcuucuucacaccggccuugg

SEQ ID NO: 1630341 - RNA, 17 nt, Pseudomonas putida KT2440
agcuucugcuugcucug

SEQ ID NO: 1630342 - RNA, 12 nt, Pseudomonas putida KT2440
agcuucugggca

SEQ ID NO: 1630343 - RNA, 21 nt, Pseudomonas putida KT2440
agcuugagggucuugcccccc

SEQ ID NO: 1630344 - RNA, 17 nt, Pseudomonas putida KT2440
agcuugaggucgccagg

SEQ ID NO: 1630345 - RNA, 18 nt, Pseudomonas putida KT2440
agcuugacuuccagcuug

SEQ ID NO: 1630346 - RNA, 19 nt, Pseudomonas putida KT2440
agcuucucgcgcuuggcca

SEQ ID NO: 1630347 - RNA, 16 nt, Pseudomonas putida KT2440
agcuucugcaacuccu

SEQ ID NO: 1630348 - RNA, 21 nt, Pseudomonas putida KT2440
agcuucuagcaaugccagccg

SEQ ID NO: 1630349 - RNA, 14 nt, Pseudomonas putida KT2440
agcuucccggccug

SEQ ID NO: 1630350 - RNA, 15 nt, Pseudomonas putida KT2440
agcuucaacugcugc

SEQ ID NO: 1630351 - RNA, 15 nt, Pseudomonas putida KT2440
agcuucagccagggc

SEQ ID NO: 1630352 - RNA, 18 nt, Pseudomonas putida KT2440
agcuucagguucugccgg

SEQ ID NO: 1630353 - RNA, 15 nt, Pseudomonas putida KT2440
agcuuccaccauucc

SEQ ID NO: 1630354 - RNA, 20 nt, Pseudomonas putida KT2440
agcuuccaccauucccugca

SEQ ID NO: 1630355 - RNA, 21 nt, Pseudomonas putida KT2440
agcuucaugaaaaacccggcc

SEQ ID NO: 1630356 - RNA, 17 nt, Pseudomonas putida KT2440
agcuucauggcgccgau

SEQ ID NO: 1630357 - RNA, 17 nt, Pseudomonas putida KT2440
agcuuaacgcuuggcca

SEQ ID NO: 1630358 - RNA, 19 nt, Pseudomonas putida KT2440
agcugggcccgcccagcug

SEQ ID NO: 1630359 - RNA, 22 nt, Pseudomonas putida KT2440
agcuggcucaucugccggcgaa

SEQ ID NO: 1630360 - RNA, 16 nt, Pseudomonas putida KT2440
agcuggauagaguacu

SEQ ID NO: 1630361 - RNA, 16 nt, Pseudomonas putida KT2440
agcugcugucgagcau

SEQ ID NO: 1630362 - RNA, 22 nt, Pseudomonas putida KT2440
agcugcuuaccagcuuggcgcc

SEQ ID NO: 1630363 - RNA, 14 nt, Pseudomonas putida KT2440
agcugcgcagguug

SEQ ID NO: 1630364 - RNA, 16 nt, Pseudomonas putida KT2440
agcugcgcacgcagga

SEQ ID NO: 1630365 - RNA, 15 nt, Pseudomonas putida KT2440
agcuguagucaccac

SEQ ID NO: 1630366 - RNA, 16 nt, Pseudomonas putida KT2440
agcugucacccuuggu

SEQ ID NO: 1630367 - RNA, 22 nt, Pseudomonas putida KT2440
agcugucacccuuggucaggau

SEQ ID NO: 1630368 - RNA, 14 nt, Pseudomonas putida KT2440
agcuguugcgcugg

SEQ ID NO: 1630369 - RNA, 20 nt, Pseudomonas putida KT2440
agcugucggucagccagaug

SEQ ID NO: 1630370 - RNA, 20 nt, Pseudomonas putida KT2440
agcugcaccgaccgugcaua

SEQ ID NO: 1630371 - RNA, 13 nt, Pseudomonas putida KT2440
agcugcaccgccg

SEQ ID NO: 1630372 - RNA, 15 nt, Pseudomonas putida KT2440
agcugccacugcgcg

SEQ ID NO: 1630373 - RNA, 23 nt, Pseudomonas putida KT2440
agcugcauuggcggcaggcgcag

SEQ ID NO: 1630374 - RNA, 23 nt, Pseudomonas putida KT2440
agcugcaucagguagcugggccc

SEQ ID NO: 1630375 - RNA, 13 nt, Pseudomonas putida KT2440
agcugcccaccaa

SEQ ID NO: 1630376 - RNA, 18 nt, Pseudomonas putida KT2440
agcugccggccagcgccu

SEQ ID NO: 1630377 - RNA, 11 nt, Pseudomonas putida KT2440
agcugccgggc

SEQ ID NO: 1630378 - RNA, 18 nt, Pseudomonas putida KT2440
agcugccgggccgggcac

SEQ ID NO: 1630379 - RNA, 18 nt, Pseudomonas putida KT2440
agcucugaucaauucagc

SEQ ID NO: 1630380 - RNA, 21 nt, Pseudomonas putida KT2440
agcugaauccauuuguggacg

SEQ ID NO: 1630381 - RNA, 16 nt, Pseudomonas putida KT2440
agcugcacaucuccac

SEQ ID NO: 1630382 - RNA, 14 nt, Pseudomonas putida KT2440
agcugcaccaccug

SEQ ID NO: 1630383 - RNA, 20 nt, Pseudomonas putida KT2440
agcugcaccaccugcuccug

SEQ ID NO: 1630384 - RNA, 18 nt, Pseudomonas putida KT2440
agcucaucaccaggcccg

SEQ ID NO: 1630385 - RNA, 16 nt, Pseudomonas putida KT2440
agcucauccagccgcg

SEQ ID NO: 1630386 - RNA, 16 nt, Pseudomonas putida KT2440
agcucauccaggcugc

SEQ ID NO: 1630387 - RNA, 15 nt, Pseudomonas putida KT2440
agcucauccaucacc

SEQ ID NO: 1630388 - RNA, 18 nt, Pseudomonas putida KT2440
agcucauccaucaccugc

SEQ ID NO: 1630389 - RNA, 12 nt, Pseudomonas putida KT2440
agcucuccagca

SEQ ID NO: 1630390 - RNA, 14 nt, Pseudomonas putida KT2440
agcucagccagcaa

SEQ ID NO: 1630391 - RNA, 21 nt, Pseudomonas putida KT2440
agcucagcgugacgauggcca

SEQ ID NO: 1630392 - RNA, 21 nt, Pseudomonas putida KT2440
agcucagucgguagagcaaau

SEQ ID NO: 1630393 - RNA, 13 nt, Pseudomonas putida KT2440
agcucacuggcca

SEQ ID NO: 1630394 - RNA, 22 nt, Pseudomonas putida KT2440
agcucaccggcaaucgacucaa

SEQ ID NO: 1630395 - RNA, 14 nt, Pseudomonas putida KT2440
agcgcgaucaccag

SEQ ID NO: 1630396 - RNA, 13 nt, Pseudomonas putida KT2440
agcgcgaggcgcg

SEQ ID NO: 1630397 - RNA, 15 nt, Pseudomonas putida KT2440
agcgcgagcuggaga

SEQ ID NO: 1630398 - RNA, 16 nt, Pseudomonas putida KT2440
agauuggucggcaggg

SEQ ID NO: 1630399 - RNA, 18 nt, Pseudomonas putida KT2440
agcgcgcccccgaccacc

SEQ ID NO: 1630400 - RNA, 15 nt, Pseudomonas putida KT2440
agcgcgcaucagccg

SEQ ID NO: 1630401 - RNA, 19 nt, Pseudomonas putida KT2440
agcgcgcaucagccgcgcc

SEQ ID NO: 1630402 - RNA, 18 nt, Pseudomonas putida KT2440
agcgcgccacgcaccagg

SEQ ID NO: 1630403 - RNA, 17 nt, Pseudomonas putida KT2440
agcgcgcgaaucaccac

SEQ ID NO: 1630404 - RNA, 20 nt, Pseudomonas putida KT2440
agcgcggaaauguccgaaua

SEQ ID NO: 1630405 - RNA, 14 nt, Pseudomonas putida KT2440
agcgcggaacacac

SEQ ID NO: 1630406 - RNA, 22 nt, Pseudomonas putida KT2440
agcgcgccuggucgccgccacc

SEQ ID NO: 1630407 - RNA, 16 nt, Pseudomonas putida KT2440
agcgcgccuccagcug

SEQ ID NO: 1630408 - RNA, 21 nt, Pseudomonas putida KT2440
agcgcgccgccgauagcagca

SEQ ID NO: 1630409 - RNA, 16 nt, Pseudomonas putida KT2440
agcgcggugaccagcg

SEQ ID NO: 1630410 - RNA, 12 nt, Pseudomonas putida KT2440
agcgcugagugg

SEQ ID NO: 1630411 - RNA, 19 nt, Pseudomonas putida KT2440
agcgcugcgaggccccaga

SEQ ID NO: 1630412 - RNA, 19 nt, Pseudomonas putida KT2440
agcgcugcaagcgcaccug

SEQ ID NO: 1630413 - RNA, 16 nt, Pseudomonas putida KT2440
agcgcggcgcccagca

SEQ ID NO: 1630414 - RNA, 16 nt, Pseudomonas putida KT2440
agcgcggccacgcccu

SEQ ID NO: 1630415 - RNA, 17 nt, Pseudomonas putida KT2440
agcggccaccugcccca

SEQ ID NO: 1630416 - RNA, 10 nt, Pseudomonas putida KT2440
agcggccaca

SEQ ID NO: 1630417 - RNA, 21 nt, Pseudomonas putida KT2440
agcggccggcacaggcccaaa

SEQ ID NO: 1630418 - RNA, 16 nt, Pseudomonas putida KT2440
agcggccggccccccc

SEQ ID NO: 1630419 - RNA, 13 nt, Pseudomonas putida KT2440
agcggccccuucg

SEQ ID NO: 1630420 - RNA, 22 nt, Pseudomonas putida KT2440
agcggccccuucgauucaggcc

SEQ ID NO: 1630421 - RNA, 16 nt, Pseudomonas putida KT2440
agcggcgccacccaga

SEQ ID NO: 1630422 - RNA, 16 nt, Pseudomonas putida KT2440
agcggaccaggugcag

SEQ ID NO: 1630423 - RNA, 23 nt, Pseudomonas putida KT2440
agcggcucgauuuuccaguauuc

SEQ ID NO: 1630424 - RNA, 12 nt, Pseudomonas putida KT2440
agcggcucucga

SEQ ID NO: 1630425 - RNA, 17 nt, Pseudomonas putida KT2440
agcggcucgcucaggcg

SEQ ID NO: 1630426 - RNA, 24 nt, Pseudomonas putida KT2440
agcggcugccuacccaggcaacga

SEQ ID NO: 1630427 - RNA, 17 nt, Pseudomonas putida KT2440
agcggcgcagcgcugag

SEQ ID NO: 1630428 - RNA, 16 nt, Pseudomonas putida KT2440
agcggcguuguagccg

SEQ ID NO: 1630429 - RNA, 18 nt, Pseudomonas putida KT2440
agcgguccggacuuggac

SEQ ID NO: 1630430 - RNA, 16 nt, Pseudomonas putida KT2440
agcgguggguggcuca

SEQ ID NO: 1630431 - RNA, 15 nt, Pseudomonas putida KT2440
agcgggggcgcguca

SEQ ID NO: 1630432 - RNA, 17 nt, Pseudomonas putida KT2440
agcgggggcgcgucagc

SEQ ID NO: 1630433 - RNA, 13 nt, Pseudomonas putida KT2440
agcgggcuugccc

SEQ ID NO: 1630434 - RNA, 19 nt, Pseudomonas putida KT2440
agcgggcuugcccgcgaag

SEQ ID NO: 1630435 - RNA, 19 nt, Pseudomonas putida KT2440
agcgggcgugcccgcgaag

SEQ ID NO: 1630436 - RNA, 17 nt, Pseudomonas putida KT2440
agcgggcuacacgcgcc

SEQ ID NO: 1630437 - RNA, 12 nt, Pseudomonas putida KT2440
agcgggcucgcc

SEQ ID NO: 1630438 - RNA, 15 nt, Pseudomonas putida KT2440
agcgggcucgcccac

SEQ ID NO: 1630439 - RNA, 18 nt, Pseudomonas putida KT2440
agcgggcucgcccacacg

SEQ ID NO: 1630440 - RNA, 14 nt, Pseudomonas putida KT2440
agcgggcacaggcc

SEQ ID NO: 1630441 - RNA, 17 nt, Pseudomonas putida KT2440
agcgggcacaggccgcg

SEQ ID NO: 1630442 - RNA, 22 nt, Pseudomonas putida KT2440
agcgggcagugcaauaccagcc

SEQ ID NO: 1630443 - RNA, 11 nt, Pseudomonas putida KT2440
agcgggcaugc

SEQ ID NO: 1630444 - RNA, 13 nt, Pseudomonas putida KT2440
agcguacgcaugg

SEQ ID NO: 1630445 - RNA, 12 nt, Pseudomonas putida KT2440
agcguaggggcg

SEQ ID NO: 1630446 - RNA, 22 nt, Pseudomonas putida KT2440
agcguggccgccaacagcgcag

SEQ ID NO: 1630447 - RNA, 18 nt, Pseudomonas putida KT2440
agcguuauaccggcccug

SEQ ID NO: 1630448 - RNA, 14 nt, Pseudomonas putida KT2440
agcguuaccaacag

SEQ ID NO: 1630449 - RNA, 22 nt, Pseudomonas putida KT2440
agcucaaaugcuggcaauccag

SEQ ID NO: 1630450 - RNA, 15 nt, Pseudomonas putida KT2440
agcucaaccagcugc

SEQ ID NO: 1630451 - RNA, 12 nt, Pseudomonas putida KT2440
agcucaacccca

SEQ ID NO: 1630452 - RNA, 23 nt, Pseudomonas putida KT2440
agcucaaccgacaccagacggcc

SEQ ID NO: 1630453 - RNA, 19 nt, Pseudomonas putida KT2440
agcuaucucaagccuugcu

SEQ ID NO: 1630454 - RNA, 17 nt, Pseudomonas putida KT2440
agcuaucucccagccug

SEQ ID NO: 1630455 - RNA, 19 nt, Pseudomonas putida KT2440
agggacauggggacuccgg

SEQ ID NO: 1630456 - RNA, 17 nt, Pseudomonas putida KT2440
agggcaaaaugcagcaa

SEQ ID NO: 1630457 - RNA, 14 nt, Pseudomonas putida KT2440
agggaucgaugccc

SEQ ID NO: 1630458 - RNA, 17 nt, Pseudomonas putida KT2440
agggauuggcaacaaug

SEQ ID NO: 1630459 - RNA, 21 nt, Pseudomonas putida KT2440
agggauuggcaacaauguacc

SEQ ID NO: 1630460 - RNA, 15 nt, Pseudomonas putida KT2440
agggauaacgucaca

SEQ ID NO: 1630461 - RNA, 15 nt, Pseudomonas putida KT2440
aggcuuucggccacc

SEQ ID NO: 1630462 - RNA, 16 nt, Pseudomonas putida KT2440
aggcuuugcugcaggu

SEQ ID NO: 1630463 - RNA, 19 nt, Pseudomonas putida KT2440
aggcuuuccagguccugcu

SEQ ID NO: 1630464 - RNA, 13 nt, Pseudomonas putida KT2440
aggcuugaagcug

SEQ ID NO: 1630465 - RNA, 20 nt, Pseudomonas putida KT2440
aggcuugcuucuugaagcgu

SEQ ID NO: 1630466 - RNA, 21 nt, Pseudomonas putida KT2440
aggcuucaggccgccuuggcu

SEQ ID NO: 1630467 - RNA, 18 nt, Pseudomonas putida KT2440
aggcugcgcaucaggcug

SEQ ID NO: 1630468 - RNA, 15 nt, Pseudomonas putida KT2440
aggcugcgcccgcac

SEQ ID NO: 1630469 - RNA, 18 nt, Pseudomonas putida KT2440
aggcugcgcccgcacagc

SEQ ID NO: 1630470 - RNA, 14 nt, Pseudomonas putida KT2440
aggcugccacggcg

SEQ ID NO: 1630471 - RNA, 20 nt, Pseudomonas putida KT2440
aggcugcccucgggcagccu

SEQ ID NO: 1630472 - RNA, 17 nt, Pseudomonas putida KT2440
aggcugcgcgccauggc

SEQ ID NO: 1630473 - RNA, 13 nt, Pseudomonas putida KT2440
aggcuggcaauca

SEQ ID NO: 1630474 - RNA, 15 nt, Pseudomonas putida KT2440
aggcuggcaaucagc

SEQ ID NO: 1630475 - RNA, 16 nt, Pseudomonas putida KT2440
aggcuguuccauuucc

SEQ ID NO: 1630476 - RNA, 18 nt, Pseudomonas putida KT2440
aggcuguuccauuucccu

SEQ ID NO: 1630477 - RNA, 17 nt, Pseudomonas putida KT2440
aggcugucgaucagacg

SEQ ID NO: 1630478 - RNA, 22 nt, Pseudomonas putida KT2440
aggcuggcgggguggccggcac

SEQ ID NO: 1630479 - RNA, 13 nt, Pseudomonas putida KT2440
aggcuggccagca

SEQ ID NO: 1630480 - RNA, 18 nt, Pseudomonas putida KT2440
aggcuggcgcuaccccug

SEQ ID NO: 1630481 - RNA, 22 nt, Pseudomonas putida KT2440
aggcuggcgucucguacgggug

SEQ ID NO: 1630482 - RNA, 18 nt, Pseudomonas putida KT2440
aggcuggucgcugcccuc

SEQ ID NO: 1630483 - RNA, 15 nt, Pseudomonas putida KT2440
agggcugcaucacuu

SEQ ID NO: 1630484 - RNA, 21 nt, Pseudomonas putida KT2440
agggcugccgcgcagcccaaa

SEQ ID NO: 1630485 - RNA, 15 nt, Pseudomonas putida KT2440
agggcucaacaccag

SEQ ID NO: 1630486 - RNA, 18 nt, Pseudomonas putida KT2440
agggcuuuuuccagcgcc

SEQ ID NO: 1630487 - RNA, 17 nt, Pseudomonas putida KT2440
agggggguaaggcuggc

SEQ ID NO: 1630488 - RNA, 19 nt, Pseudomonas putida KT2440
aggggccgcuuugcggccc

SEQ ID NO: 1630489 - RNA, 13 nt, Pseudomonas putida KT2440
aggggcuaaaacc

SEQ ID NO: 1630490 - RNA, 14 nt, Pseudomonas putida KT2440
aggggcggguggag

SEQ ID NO: 1630491 - RNA, 19 nt, Pseudomonas putida KT2440
aggggcucuucgcggguga

SEQ ID NO: 1630492 - RNA, 13 nt, Pseudomonas putida KT2440
aggguaggggugg

SEQ ID NO: 1630493 - RNA, 18 nt, Pseudomonas putida KT2440
aggguagggguggaucag

SEQ ID NO: 1630494 - RNA, 23 nt, Pseudomonas putida KT2440
aggguagggguggaucaggaaca

SEQ ID NO: 1630495 - RNA, 18 nt, Pseudomonas putida KT2440
aggguaccgccguccacc

SEQ ID NO: 1630496 - RNA, 19 nt, Pseudomonas putida KT2440
aggggugcaaagcgccccc

SEQ ID NO: 1630497 - RNA, 13 nt, Pseudomonas putida KT2440
aggggucgcggcc

SEQ ID NO: 1630498 - RNA, 22 nt, Pseudomonas putida KT2440
agggguaaugccccagccgaac

SEQ ID NO: 1630499 - RNA, 20 nt, Pseudomonas putida KT2440
agggccgcgcuuggcggccc

SEQ ID NO: 1630500 - RNA, 18 nt, Pseudomonas putida KT2440
agggccguuacucccaca

SEQ ID NO: 1630501 - RNA, 17 nt, Pseudomonas putida KT2440
agggccguaggacagug

SEQ ID NO: 1630502 - RNA, 19 nt, Pseudomonas putida KT2440
agggccguaggacagugcg

SEQ ID NO: 1630503 - RNA, 21 nt, Pseudomonas putida KT2440
agggcgaugcccuucaggccc

SEQ ID NO: 1630504 - RNA, 15 nt, Pseudomonas putida KT2440
agggccugugccggg

SEQ ID NO: 1630505 - RNA, 22 nt, Pseudomonas putida KT2440
agggccuggcgcgaaaagcugu

SEQ ID NO: 1630506 - RNA, 20 nt, Pseudomonas putida KT2440
agggccuuuccgcacucagg

SEQ ID NO: 1630507 - RNA, 16 nt, Pseudomonas putida KT2440
agggcgcgaaaagccu

SEQ ID NO: 1630508 - RNA, 20 nt, Pseudomonas putida KT2440
agggcgcgaaaagccugcac

SEQ ID NO: 1630509 - RNA, 19 nt, Pseudomonas putida KT2440
agggccccuucaaggggcc

SEQ ID NO: 1630510 - RNA, 14 nt, Pseudomonas putida KT2440
agggcccucaaccc

SEQ ID NO: 1630511 - RNA, 13 nt, Pseudomonas putida KT2440
agggccgcaaagc

SEQ ID NO: 1630512 - RNA, 17 nt, Pseudomonas putida KT2440
agggccgcaaagcggcc

SEQ ID NO: 1630513 - RNA, 13 nt, Pseudomonas putida KT2440
agggccgcaacgc

SEQ ID NO: 1630514 - RNA, 19 nt, Pseudomonas putida KT2440
agggccgccaagcggcccc

SEQ ID NO: 1630515 - RNA, 21 nt, Pseudomonas putida KT2440
agggcauugaggaugcugaag

SEQ ID NO: 1630516 - RNA, 21 nt, Pseudomonas putida KT2440
agggccagcacaaccacugca

SEQ ID NO: 1630517 - RNA, 20 nt, Pseudomonas putida KT2440
agggccaguccaggccaaca

SEQ ID NO: 1630518 - RNA, 14 nt, Pseudomonas putida KT2440
agggcaggggacag

SEQ ID NO: 1630519 - RNA, 16 nt, Pseudomonas putida KT2440
agggcaucggacaggu

SEQ ID NO: 1630520 - RNA, 17 nt, Pseudomonas putida KT2440
agggcaucggcgccccg

SEQ ID NO: 1630521 - RNA, 20 nt, Pseudomonas putida KT2440
agggcaucggcgugcugcgu

SEQ ID NO: 1630522 - RNA, 14 nt, Pseudomonas putida KT2440
agggcaccuccaga

SEQ ID NO: 1630523 - RNA, 18 nt, Pseudomonas putida KT2440
agggcacuuguggcgccu

SEQ ID NO: 1630524 - RNA, 10 nt, Pseudomonas putida KT2440
aggccgccga

SEQ ID NO: 1630525 - RNA, 20 nt, Pseudomonas putida KT2440
aggccgcccacccaccacaa

SEQ ID NO: 1630526 - RNA, 13 nt, Pseudomonas putida KT2440
aggccgccaccuc

SEQ ID NO: 1630527 - RNA, 22 nt, Pseudomonas putida KT2440
aggccgauguuguggcuguuca

SEQ ID NO: 1630528 - RNA, 10 nt, Pseudomonas putida KT2440
aggccgcagc

SEQ ID NO: 1630529 - RNA, 13 nt, Pseudomonas putida KT2440
aggccgccugccc

SEQ ID NO: 1630530 - RNA, 19 nt, Pseudomonas putida KT2440
aggccgccugcccgccccc

SEQ ID NO: 1630531 - RNA, 12 nt, Pseudomonas putida KT2440
aggccggccacc

SEQ ID NO: 1630532 - RNA, 15 nt, Pseudomonas putida KT2440
aggccggcacagaca

SEQ ID NO: 1630533 - RNA, 14 nt, Pseudomonas putida KT2440
aggccggcacagga

SEQ ID NO: 1630534 - RNA, 19 nt, Pseudomonas putida KT2440
aggccggcacaggaaggca

SEQ ID NO: 1630535 - RNA, 17 nt, Pseudomonas putida KT2440
aggccggcagccagggc

SEQ ID NO: 1630536 - RNA, 14 nt, Pseudomonas putida KT2440
aggccgcuccugcg

SEQ ID NO: 1630537 - RNA, 13 nt, Pseudomonas putida KT2440
aggccgcugugcc

SEQ ID NO: 1630538 - RNA, 16 nt, Pseudomonas putida KT2440
aggccgcugugccagc

SEQ ID NO: 1630539 - RNA, 14 nt, Pseudomonas putida KT2440
aggccugaggcccu

SEQ ID NO: 1630540 - RNA, 14 nt, Pseudomonas putida KT2440
aggccucuucaggc

SEQ ID NO: 1630541 - RNA, 17 nt, Pseudomonas putida KT2440
aggccugaaacccaucc

SEQ ID NO: 1630542 - RNA, 19 nt, Pseudomonas putida KT2440
aggccugaaacccauccac

SEQ ID NO: 1630543 - RNA, 16 nt, Pseudomonas putida KT2440
aggccucgaacagcag

SEQ ID NO: 1630544 - RNA, 15 nt, Pseudomonas putida KT2440
aggccucaaucacug

SEQ ID NO: 1630545 - RNA, 19 nt, Pseudomonas putida KT2440
aggccucacgcaucugcgc

SEQ ID NO: 1630546 - RNA, 16 nt, Pseudomonas putida KT2440
aggccguaggccaggu

SEQ ID NO: 1630547 - RNA, 17 nt, Pseudomonas putida KT2440
aggccguaggccaggua

SEQ ID NO: 1630548 - RNA, 15 nt, Pseudomonas putida KT2440
aggccgucagcagca

SEQ ID NO: 1630549 - RNA, 16 nt, Pseudomonas putida KT2440
aggccgucagcagcag

SEQ ID NO: 1630550 - RNA, 19 nt, Pseudomonas putida KT2440
aggccgucagcagcaggcg

SEQ ID NO: 1630551 - RNA, 18 nt, Pseudomonas putida KT2440
aggccgucaggccucccc

SEQ ID NO: 1630552 - RNA, 24 nt, Pseudomonas putida KT2440
aggccgguugcuccagcguguuca

SEQ ID NO: 1630553 - RNA, 23 nt, Pseudomonas putida KT2440
aggccggucuugucugacagcag

SEQ ID NO: 1630554 - RNA, 19 nt, Pseudomonas putida KT2440
aggccgguacugcccauaa

SEQ ID NO: 1630555 - RNA, 22 nt, Pseudomonas putida KT2440
aggccgguaggugcucaaggca

SEQ ID NO: 1630556 - RNA, 16 nt, Pseudomonas putida KT2440
aggcgaugcagggcug

SEQ ID NO: 1630557 - RNA, 16 nt, Pseudomonas putida KT2440
aggcgauguuugcgau

SEQ ID NO: 1630558 - RNA, 19 nt, Pseudomonas putida KT2440
aggcgcaaaccacuaaacg

SEQ ID NO: 1630559 - RNA, 17 nt, Pseudomonas putida KT2440
aggcgcaacucagcgca

SEQ ID NO: 1630560 - RNA, 13 nt, Pseudomonas putida KT2440
aggcgcagcugcc

SEQ ID NO: 1630561 - RNA, 21 nt, Pseudomonas putida KT2440
aggcgcagcgcaugcucgcgg

SEQ ID NO: 1630562 - RNA, 23 nt, Pseudomonas putida KT2440
aggcgcaggugcagccagcccca

SEQ ID NO: 1630563 - RNA, 23 nt, Pseudomonas putida KT2440
aggcgcagcacaaggcugcgccu

SEQ ID NO: 1630564 - RNA, 12 nt, Pseudomonas putida KT2440
aggcgccgggcu

SEQ ID NO: 1630565 - RNA, 15 nt, Pseudomonas putida KT2440
aggcgcccugcgcca

SEQ ID NO: 1630566 - RNA, 18 nt, Pseudomonas putida KT2440
aggcgccgaugaagcagg

SEQ ID NO: 1630567 - RNA, 17 nt, Pseudomonas putida KT2440
aggcgccgccagcugcu

SEQ ID NO: 1630568 - RNA, 23 nt, Pseudomonas putida KT2440
aggcgccgccagcugcugcccca

SEQ ID NO: 1630569 - RNA, 16 nt, Pseudomonas putida KT2440
aggccugcgaaaggcg

SEQ ID NO: 1630570 - RNA, 16 nt, Pseudomonas putida KT2440
aggccuggaugcguug

SEQ ID NO: 1630571 - RNA, 14 nt, Pseudomonas putida KT2440
aggccuucagguug

SEQ ID NO: 1630572 - RNA, 19 nt, Pseudomonas putida KT2440
aggccuugaagcgcggcau

SEQ ID NO: 1630573 - RNA, 14 nt, Pseudomonas putida KT2440
aggccuugccgcuc

SEQ ID NO: 1630574 - RNA, 15 nt, Pseudomonas putida KT2440
aggccuuggccaccu

SEQ ID NO: 1630575 - RNA, 20 nt, Pseudomonas putida KT2440
aggccuuucagcgcccagaa

SEQ ID NO: 1630576 - RNA, 21 nt, Pseudomonas putida KT2440
aggccuuguuccacgcgcagg

SEQ ID NO: 1630577 - RNA, 23 nt, Pseudomonas putida KT2440
aggccuuguuccacgcgcaggcg

SEQ ID NO: 1630578 - RNA, 18 nt, Pseudomonas putida KT2440
aggcgaccugccagccuu

SEQ ID NO: 1630579 - RNA, 15 nt, Pseudomonas putida KT2440
aggcgacgagccagu

SEQ ID NO: 1630580 - RNA, 21 nt, Pseudomonas putida KT2440
aggcgcucgcuccagggcagg

SEQ ID NO: 1630581 - RNA, 17 nt, Pseudomonas putida KT2440
aggcgcucgaaccaagg

SEQ ID NO: 1630582 - RNA, 22 nt, Pseudomonas putida KT2440
aggcgcucaccccgccccugcu

SEQ ID NO: 1630583 - RNA, 14 nt, Pseudomonas putida KT2440
aggcgcucaccuac

SEQ ID NO: 1630584 - RNA, 14 nt, Pseudomonas putida KT2440
aggcgcuugaagaa

SEQ ID NO: 1630585 - RNA, 17 nt, Pseudomonas putida KT2440
aggcgcuugaagaagcc

SEQ ID NO: 1630586 - RNA, 19 nt, Pseudomonas putida KT2440
aggcgcuugggugccgaga

SEQ ID NO: 1630587 - RNA, 14 nt, Pseudomonas putida KT2440
aggcgguccagcaa

SEQ ID NO: 1630588 - RNA, 19 nt, Pseudomonas putida KT2440
aggcgguccagcaagcuca

SEQ ID NO: 1630589 - RNA, 22 nt, Pseudomonas putida KT2440
aggcgguggaguaccuguggga

SEQ ID NO: 1630590 - RNA, 23 nt, Pseudomonas putida KT2440
aggcguauuugaccagcccgcug

SEQ ID NO: 1630591 - RNA, 16 nt, Pseudomonas putida KT2440
aggcguaccugccccc

SEQ ID NO: 1630592 - RNA, 18 nt, Pseudomonas putida KT2440
aggcguacaucagccucg

SEQ ID NO: 1630593 - RNA, 11 nt, Pseudomonas putida KT2440
aggcggccacg

SEQ ID NO: 1630594 - RNA, 14 nt, Pseudomonas putida KT2440
aggcggccacggcc

SEQ ID NO: 1630595 - RNA, 13 nt, Pseudomonas putida KT2440
aggcggccagcca

SEQ ID NO: 1630596 - RNA, 17 nt, Pseudomonas putida KT2440
aggcggcucuugcagcg

SEQ ID NO: 1630597 - RNA, 20 nt, Pseudomonas putida KT2440
aggcggcucuugcagcgagu

SEQ ID NO: 1630598 - RNA, 22 nt, Pseudomonas putida KT2440
aggcggcucuugcagcgagugc

SEQ ID NO: 1630599 - RNA, 20 nt, Pseudomonas putida KT2440
aggcguucaucgaaggccuu

SEQ ID NO: 1630600 - RNA, 17 nt, Pseudomonas putida KT2440
aggcguuauaggaaagc

SEQ ID NO: 1630601 - RNA, 22 nt, Pseudomonas putida KT2440
aggcguugucggcccacugcac

SEQ ID NO: 1630602 - RNA, 17 nt, Pseudomonas putida KT2440
aggcguuuuuccaugcg

SEQ ID NO: 1630603 - RNA, 14 nt, Pseudomonas putida KT2440
aggcucaacuaccc

SEQ ID NO: 1630604 - RNA, 21 nt, Pseudomonas putida KT2440
aggcuaugccggucagcagca

SEQ ID NO: 1630605 - RNA, 15 nt, Pseudomonas putida KT2440
aggcucagcugaugu

SEQ ID NO: 1630606 - RNA, 17 nt, Pseudomonas putida KT2440
aggcuccaaagccagcg

SEQ ID NO: 1630607 - RNA, 19 nt, Pseudomonas putida KT2440
aggcuccaucuccagcuca

SEQ ID NO: 1630608 - RNA, 21 nt, Pseudomonas putida KT2440
aggcucgacggcgcaauccgu

SEQ ID NO: 1630609 - RNA, 23 nt, Pseudomonas putida KT2440
aggcugaugcgcuggcccuugcc

SEQ ID NO: 1630610 - RNA, 23 nt, Pseudomonas putida KT2440
aggcucugaaugucagcgcucgg

SEQ ID NO: 1630611 - RNA, 19 nt, Pseudomonas putida KT2440
aggcucucagcccauuuca

SEQ ID NO: 1630612 - RNA, 13 nt, Pseudomonas putida KT2440
aguaacggccacg

SEQ ID NO: 1630613 - RNA, 19 nt, Pseudomonas putida KT2440
aguaacggcccuugcucaa

SEQ ID NO: 1630614 - RNA, 17 nt, Pseudomonas putida KT2440
aguaacgcccuucauac

SEQ ID NO: 1630615 - RNA, 18 nt, Pseudomonas putida KT2440
aguaaggaucgcgcagca

SEQ ID NO: 1630616 - RNA, 15 nt, Pseudomonas putida KT2440
aguacaugacaaagc

SEQ ID NO: 1630617 - RNA, 16 nt, Pseudomonas putida KT2440
aguacaccggcagcac

SEQ ID NO: 1630618 - RNA, 12 nt, Pseudomonas putida KT2440
aguacaacugcc

SEQ ID NO: 1630619 - RNA, 18 nt, Pseudomonas putida KT2440
aguacaacugccacccuc

SEQ ID NO: 1630620 - RNA, 19 nt, Pseudomonas putida KT2440
aguaaugcagccggccccu

SEQ ID NO: 1630621 - RNA, 22 nt, Pseudomonas putida KT2440
aguaaucugccggcgccuccag

SEQ ID NO: 1630622 - RNA, 14 nt, Pseudomonas putida KT2440
agguugcacagcau

SEQ ID NO: 1630623 - RNA, 13 nt, Pseudomonas putida KT2440
agguugccaccag

SEQ ID NO: 1630624 - RNA, 15 nt, Pseudomonas putida KT2440
agguugccaccagca

SEQ ID NO: 1630625 - RNA, 15 nt, Pseudomonas putida KT2440
agguugaacagcagc

SEQ ID NO: 1630626 - RNA, 16 nt, Pseudomonas putida KT2440
agguugauccagcccu

SEQ ID NO: 1630627 - RNA, 17 nt, Pseudomonas putida KT2440
agguugcuggccuugga

SEQ ID NO: 1630628 - RNA, 14 nt, Pseudomonas putida KT2440
agguuggccgccgc

SEQ ID NO: 1630629 - RNA, 13 nt, Pseudomonas putida KT2440
agguugcgcaagc

SEQ ID NO: 1630630 - RNA, 20 nt, Pseudomonas putida KT2440
agguucuguagcgcaaugcc

SEQ ID NO: 1630631 - RNA, 16 nt, Pseudomonas putida KT2440
agguucuuaucugggg

SEQ ID NO: 1630632 - RNA, 21 nt, Pseudomonas putida KT2440
agguucgaaucgcucaugccc

SEQ ID NO: 1630633 - RNA, 17 nt, Pseudomonas putida KT2440
agguucgaccaccgcag

SEQ ID NO: 1630634 - RNA, 17 nt, Pseudomonas putida KT2440
agguucgaccacugcag

SEQ ID NO: 1630635 - RNA, 22 nt, Pseudomonas putida KT2440
agguucgaccacugcaggugca

SEQ ID NO: 1630636 - RNA, 21 nt, Pseudomonas putida KT2440
agguuccccccacgcacauca

SEQ ID NO: 1630637 - RNA, 13 nt, Pseudomonas putida KT2440
agguucacuucca

SEQ ID NO: 1630638 - RNA, 14 nt, Pseudomonas putida KT2440
agguguuccagcac

SEQ ID NO: 1630639 - RNA, 22 nt, Pseudomonas putida KT2440
aggugugccacuucaugggcca

SEQ ID NO: 1630640 - RNA, 21 nt, Pseudomonas putida KT2440
aggugucgaacuucuccagcg

SEQ ID NO: 1630641 - RNA, 13 nt, Pseudomonas putida KT2440
agguuucagcagc

SEQ ID NO: 1630642 - RNA, 14 nt, Pseudomonas putida KT2440
agguuuggguuggc

SEQ ID NO: 1630643 - RNA, 15 nt, Pseudomonas putida KT2440
agguuuuccagcccg

SEQ ID NO: 1630644 - RNA, 19 nt, Pseudomonas putida KT2440
aggguucgccgucagccuu

SEQ ID NO: 1630645 - RNA, 14 nt, Pseudomonas putida KT2440
agggucgcgcccca

SEQ ID NO: 1630646 - RNA, 15 nt, Pseudomonas putida KT2440
agggucgcgccccaa

SEQ ID NO: 1630647 - RNA, 16 nt, Pseudomonas putida KT2440
agggucgcgccccaag

SEQ ID NO: 1630648 - RNA, 15 nt, Pseudomonas putida KT2440
agggucgggcacagg

SEQ ID NO: 1630649 - RNA, 17 nt, Pseudomonas putida KT2440
agggucgggcacaggcc

SEQ ID NO: 1630650 - RNA, 17 nt, Pseudomonas putida KT2440
agggugacccagcgcug

SEQ ID NO: 1630651 - RNA, 16 nt, Pseudomonas putida KT2440
agggugaggugcugca

SEQ ID NO: 1630652 - RNA, 17 nt, Pseudomonas putida KT2440
aggguggucuuggccaa

SEQ ID NO: 1630653 - RNA, 17 nt, Pseudomonas putida KT2440
agggugucaacaggcug

SEQ ID NO: 1630654 - RNA, 17 nt, Pseudomonas putida KT2440
agguaguucacuggcca

SEQ ID NO: 1630655 - RNA, 17 nt, Pseudomonas putida KT2440
agguaguuggccgggcc

SEQ ID NO: 1630656 - RNA, 15 nt, Pseudomonas putida KT2440
agguauggccagagc

SEQ ID NO: 1630657 - RNA, 21 nt, Pseudomonas putida KT2440
aggucacguuguagcccacca

SEQ ID NO: 1630658 - RNA, 18 nt, Pseudomonas putida KT2440
aggucaccaucagccgcg

SEQ ID NO: 1630659 - RNA, 23 nt, Pseudomonas putida KT2440
aggucacccuggucacgcaguuc

SEQ ID NO: 1630660 - RNA, 13 nt, Pseudomonas putida KT2440
aggucagcagugg

SEQ ID NO: 1630661 - RNA, 17 nt, Pseudomonas putida KT2440
aggucaaacuccccccc

SEQ ID NO: 1630662 - RNA, 22 nt, Pseudomonas putida KT2440
aggucaacggcaacgccagcaa

SEQ ID NO: 1630663 - RNA, 21 nt, Pseudomonas putida KT2440
agguaccguugcggaucaucg

SEQ ID NO: 1630664 - RNA, 15 nt, Pseudomonas putida KT2440
agguacaguucccgg

SEQ ID NO: 1630665 - RNA, 21 nt, Pseudomonas putida KT2440
agguacgcgcaggcagcucga

SEQ ID NO: 1630666 - RNA, 13 nt, Pseudomonas putida KT2440
agguacagcagcu

SEQ ID NO: 1630667 - RNA, 17 nt, Pseudomonas putida KT2440
agguacagcagcugcau

SEQ ID NO: 1630668 - RNA, 22 nt, Pseudomonas putida KT2440
agguacacccccagguuaucca

SEQ ID NO: 1630669 - RNA, 23 nt, Pseudomonas putida KT2440
agguacacccccagguuauccac

SEQ ID NO: 1630670 - RNA, 15 nt, Pseudomonas putida KT2440
agguaaugcgcaggc

SEQ ID NO: 1630671 - RNA, 22 nt, Pseudomonas putida KT2440
agguaauugguggugcugggca

SEQ ID NO: 1630672 - RNA, 22 nt, Pseudomonas putida KT2440
agguacggguucaagggcaggg

SEQ ID NO: 1630673 - RNA, 16 nt, Pseudomonas putida KT2440
agguacucgccgggcg

SEQ ID NO: 1630674 - RNA, 13 nt, Pseudomonas putida KT2440
agguagcugggcc

SEQ ID NO: 1630675 - RNA, 22 nt, Pseudomonas putida KT2440
agguaggccgucagcagcaggc

SEQ ID NO: 1630676 - RNA, 15 nt, Pseudomonas putida KT2440
aggucgaccugcccg

SEQ ID NO: 1630677 - RNA, 20 nt, Pseudomonas putida KT2440
aggucgacaugcaccacgcc

SEQ ID NO: 1630678 - RNA, 18 nt, Pseudomonas putida KT2440
aggucgaacagcccccgg

SEQ ID NO: 1630679 - RNA, 15 nt, Pseudomonas putida KT2440
aggucgacacccagc

SEQ ID NO: 1630680 - RNA, 16 nt, Pseudomonas putida KT2440
aggucgccgcuguuca

SEQ ID NO: 1630681 - RNA, 23 nt, Pseudomonas putida KT2440
aggucgccgcuguucagcccuug

SEQ ID NO: 1630682 - RNA, 14 nt, Pseudomonas putida KT2440
aggucagcgguucg

SEQ ID NO: 1630683 - RNA, 16 nt, Pseudomonas putida KT2440
aggucagcuucugggu

SEQ ID NO: 1630684 - RNA, 15 nt, Pseudomonas putida KT2440
aggucaugugauacc

SEQ ID NO: 1630685 - RNA, 16 nt, Pseudomonas putida KT2440
agguccaccagcaggc

SEQ ID NO: 1630686 - RNA, 18 nt, Pseudomonas putida KT2440
aggucauuugcagugcuu

SEQ ID NO: 1630687 - RNA, 16 nt, Pseudomonas putida KT2440
aggucauccgcacgca

SEQ ID NO: 1630688 - RNA, 13 nt, Pseudomonas putida KT2440
agguccagccgcc

SEQ ID NO: 1630689 - RNA, 16 nt, Pseudomonas putida KT2440
aggucggcaaccaugg

SEQ ID NO: 1630690 - RNA, 13 nt, Pseudomonas putida KT2440
aggucggacaggg

SEQ ID NO: 1630691 - RNA, 22 nt, Pseudomonas putida KT2440
aggucggcucgucgaacagcau

SEQ ID NO: 1630692 - RNA, 22 nt, Pseudomonas putida KT2440
aggucgcgguucgacugccgcu

SEQ ID NO: 1630693 - RNA, 19 nt, Pseudomonas putida KT2440
aggucgggaauugcagccc

SEQ ID NO: 1630694 - RNA, 15 nt, Pseudomonas putida KT2440
aggucuaaccgcgcu

SEQ ID NO: 1630695 - RNA, 16 nt, Pseudomonas putida KT2440
aggugaaucagcggca

SEQ ID NO: 1630696 - RNA, 20 nt, Pseudomonas putida KT2440
aggugaaucagcggcaggcu

SEQ ID NO: 1630697 - RNA, 18 nt, Pseudomonas putida KT2440
aggugauagacguggcug

SEQ ID NO: 1630698 - RNA, 19 nt, Pseudomonas putida KT2440
aggugauagacguggcugu

SEQ ID NO: 1630699 - RNA, 13 nt, Pseudomonas putida KT2440
aggugaucagcuu

SEQ ID NO: 1630700 - RNA, 24 nt, Pseudomonas putida KT2440
aggugaucguugcgcgccagggca

SEQ ID NO: 1630701 - RNA, 21 nt, Pseudomonas putida KT2440
aggugcacaccuugggcccac

SEQ ID NO: 1630702 - RNA, 17 nt, Pseudomonas putida KT2440
aggugauguugcccggc

SEQ ID NO: 1630703 - RNA, 14 nt, Pseudomonas putida KT2440
aggugaugcaggca

SEQ ID NO: 1630704 - RNA, 18 nt, Pseudomonas putida KT2440
aggugcaggcucggccac

SEQ ID NO: 1630705 - RNA, 19 nt, Pseudomonas putida KT2440
aggugcagguucgaccacc

SEQ ID NO: 1630706 - RNA, 21 nt, Pseudomonas putida KT2440
aggugcagguucgaccaccgc

SEQ ID NO: 1630707 - RNA, 12 nt, Pseudomonas putida KT2440
aggugccaggcu

SEQ ID NO: 1630708 - RNA, 19 nt, Pseudomonas putida KT2440
aggugccaacaggcagcau

SEQ ID NO: 1630709 - RNA, 22 nt, Pseudomonas putida KT2440
aggugcaucgucacauccugcu

SEQ ID NO: 1630710 - RNA, 17 nt, Pseudomonas putida KT2440
agguggacaccauggcc

SEQ ID NO: 1630711 - RNA, 21 nt, Pseudomonas putida KT2440
aggugcuuuuuugugccuggu

SEQ ID NO: 1630712 - RNA, 15 nt, Pseudomonas putida KT2440
aggugcuaccggcgc

SEQ ID NO: 1630713 - RNA, 14 nt, Pseudomonas putida KT2440
aggugcucagccac

SEQ ID NO: 1630714 - RNA, 21 nt, Pseudomonas putida KT2440
aggugcucagccacgcuggca

SEQ ID NO: 1630715 - RNA, 19 nt, Pseudomonas putida KT2440
aggugcgcggcaggucgac

SEQ ID NO: 1630716 - RNA, 21 nt, Pseudomonas putida KT2440
aggugcgcuucaaauagaaga

SEQ ID NO: 1630717 - RNA, 12 nt, Pseudomonas putida KT2440
agguggccggca

SEQ ID NO: 1630718 - RNA, 16 nt, Pseudomonas putida KT2440
agguggcagaacaucg

SEQ ID NO: 1630719 - RNA, 18 nt, Pseudomonas putida KT2440
aggugguagccgugcggc

SEQ ID NO: 1630720 - RNA, 19 nt, Pseudomonas putida KT2440
aggugggguugaccaggca

SEQ ID NO: 1630721 - RNA, 20 nt, Pseudomonas putida KT2440
acggugacaaaggccggcac

SEQ ID NO: 1630722 - RNA, 22 nt, Pseudomonas putida KT2440
acgguggcguggccacgcccgg

SEQ ID NO: 1630723 - RNA, 19 nt, Pseudomonas putida KT2440
acgguggcugccagcgcgc

SEQ ID NO: 1630724 - RNA, 17 nt, Pseudomonas putida KT2440
acggucgaucuucgccg

SEQ ID NO: 1630725 - RNA, 15 nt, Pseudomonas putida KT2440
acggucugccggcac

SEQ ID NO: 1630726 - RNA, 15 nt, Pseudomonas putida KT2440
acggucaugcucagc

SEQ ID NO: 1630727 - RNA, 17 nt, Pseudomonas putida KT2440
acggucaguaccuggcc

SEQ ID NO: 1630728 - RNA, 20 nt, Pseudomonas putida KT2440
acggucagugaagcgaggug

SEQ ID NO: 1630729 - RNA, 15 nt, Pseudomonas putida KT2440
acggucacugagcca

SEQ ID NO: 1630730 - RNA, 17 nt, Pseudomonas putida KT2440
acggucacugagccagg

SEQ ID NO: 1630731 - RNA, 14 nt, Pseudomonas putida KT2440
acgguugacagcac

SEQ ID NO: 1630732 - RNA, 16 nt, Pseudomonas putida KT2440
acgguugcgcccggcg

SEQ ID NO: 1630733 - RNA, 23 nt, Pseudomonas putida KT2440
acgguuucacccuugggcucagc

SEQ ID NO: 1630734 - RNA, 16 nt, Pseudomonas putida KT2440
acggguugaagauggu

SEQ ID NO: 1630735 - RNA, 19 nt, Pseudomonas putida KT2440
acggguuuacccucgggac

SEQ ID NO: 1630736 - RNA, 22 nt, Pseudomonas putida KT2440
acggguuucggaaaaagggcgc

SEQ ID NO: 1630737 - RNA, 14 nt, Pseudomonas putida KT2440
acgggugaccaggc

SEQ ID NO: 1630738 - RNA, 21 nt, Pseudomonas putida KT2440
acgggugaccaggcccagcag

SEQ ID NO: 1630739 - RNA, 17 nt, Pseudomonas putida KT2440
acgggucgagguggaga

SEQ ID NO: 1630740 - RNA, 22 nt, Pseudomonas putida KT2440
acgguaggccuugaccagcuug

SEQ ID NO: 1630741 - RNA, 13 nt, Pseudomonas putida KT2440
acggcggccugcu

SEQ ID NO: 1630742 - RNA, 19 nt, Pseudomonas putida KT2440
acgggcgacggaucggcac

SEQ ID NO: 1630743 - RNA, 16 nt, Pseudomonas putida KT2440
acgggcugucgagcag

SEQ ID NO: 1630744 - RNA, 12 nt, Pseudomonas putida KT2440
acgggggggcgc

SEQ ID NO: 1630745 - RNA, 21 nt, Pseudomonas putida KT2440
acgcaaguucccgugcgccua

SEQ ID NO: 1630746 - RNA, 13 nt, Pseudomonas putida KT2440
acgcaacuccacg

SEQ ID NO: 1630747 - RNA, 12 nt, Pseudomonas putida KT2440
acgcaacugcgg

SEQ ID NO: 1630748 - RNA, 21 nt, Pseudomonas putida KT2440
acgcacaaccgcuuucacuuc

SEQ ID NO: 1630749 - RNA, 18 nt, Pseudomonas putida KT2440
acgcugcucggccucgac

SEQ ID NO: 1630750 - RNA, 18 nt, Pseudomonas putida KT2440
acgcuggcagcuuggcca

SEQ ID NO: 1630751 - RNA, 20 nt, Pseudomonas putida KT2440
acgcugggcgugccaggcuu

SEQ ID NO: 1630752 - RNA, 17 nt, Pseudomonas putida KT2440
acggacgucccagcagg

SEQ ID NO: 1630753 - RNA, 17 nt, Pseudomonas putida KT2440
acggaucaccuggccgu

SEQ ID NO: 1630754 - RNA, 14 nt, Pseudomonas putida KT2440
acggaccuccgagu

SEQ ID NO: 1630755 - RNA, 18 nt, Pseudomonas putida KT2440
acggaaucugcaccgccu

SEQ ID NO: 1630756 - RNA, 17 nt, Pseudomonas putida KT2440
acgcuguuggcagccac

SEQ ID NO: 1630757 - RNA, 17 nt, Pseudomonas putida KT2440
acgcuuaagucuucuca

SEQ ID NO: 1630758 - RNA, 14 nt, Pseudomonas putida KT2440
acggccacgcugcg

SEQ ID NO: 1630759 - RNA, 21 nt, Pseudomonas putida KT2440
acggcacacgcaccaccccgg

SEQ ID NO: 1630760 - RNA, 19 nt, Pseudomonas putida KT2440
acggcaauucgccggcagc

SEQ ID NO: 1630761 - RNA, 16 nt, Pseudomonas putida KT2440
acggcaauugccaccg

SEQ ID NO: 1630762 - RNA, 14 nt, Pseudomonas putida KT2440
acggcaagccacgc

SEQ ID NO: 1630763 - RNA, 16 nt, Pseudomonas putida KT2440
acggcaaucaggcuga

SEQ ID NO: 1630764 - RNA, 17 nt, Pseudomonas putida KT2440
acggcaauggcccgcuc

SEQ ID NO: 1630765 - RNA, 23 nt, Pseudomonas putida KT2440
acggaucggcacacgguuuccag

SEQ ID NO: 1630766 - RNA, 21 nt, Pseudomonas putida KT2440
acggaucacgcuuaagucuuc

SEQ ID NO: 1630767 - RNA, 12 nt, Pseudomonas putida KT2440
acggauuuuguu

SEQ ID NO: 1630768 - RNA, 19 nt, Pseudomonas putida KT2440
acggcaacgccagcaaugc

SEQ ID NO: 1630769 - RNA, 23 nt, Pseudomonas putida KT2440
acggcgcugucggucagcaucug

SEQ ID NO: 1630770 - RNA, 20 nt, Pseudomonas putida KT2440
acggcgaugcgccccccagg

SEQ ID NO: 1630771 - RNA, 18 nt, Pseudomonas putida KT2440
acggccuggccugcaugc

SEQ ID NO: 1630772 - RNA, 20 nt, Pseudomonas putida KT2440
acggccugcgcccgaucacc

SEQ ID NO: 1630773 - RNA, 19 nt, Pseudomonas putida KT2440
acggcccaugucgaucagc

SEQ ID NO: 1630774 - RNA, 18 nt, Pseudomonas putida KT2440
acggccagccagcagcgu

SEQ ID NO: 1630775 - RNA, 16 nt, Pseudomonas putida KT2440
acggccgugcagggcg

SEQ ID NO: 1630776 - RNA, 21 nt, Pseudomonas putida KT2440
acuaucaggggagugucaguu

SEQ ID NO: 1630777 - RNA, 23 nt, Pseudomonas putida KT2440
acuaccagguagccgucuuugag

SEQ ID NO: 1630778 - RNA, 16 nt, Pseudomonas putida KT2440
acuaccgcaaaugcug

SEQ ID NO: 1630779 - RNA, 17 nt, Pseudomonas putida KT2440
acguugcugccugugcc

SEQ ID NO: 1630780 - RNA, 13 nt, Pseudomonas putida KT2440
acguuggccgcca

SEQ ID NO: 1630781 - RNA, 16 nt, Pseudomonas putida KT2440
acguuauccacagcgu

SEQ ID NO: 1630782 - RNA, 14 nt, Pseudomonas putida KT2440
acguuauccagcug

SEQ ID NO: 1630783 - RNA, 16 nt, Pseudomonas putida KT2440
acguuauccagcugca

SEQ ID NO: 1630784 - RNA, 12 nt, Pseudomonas putida KT2440
acguuucgcggc

SEQ ID NO: 1630785 - RNA, 20 nt, Pseudomonas putida KT2440
acguuuccagcaaccgcccc

SEQ ID NO: 1630786 - RNA, 16 nt, Pseudomonas putida KT2440
acguuuggcagugcca

SEQ ID NO: 1630787 - RNA, 18 nt, Pseudomonas putida KT2440
acguuuggcagugccaug

SEQ ID NO: 1630788 - RNA, 18 nt, Pseudomonas putida KT2440
acgugcccguuuuccaac

SEQ ID NO: 1630789 - RNA, 15 nt, Pseudomonas putida KT2440
acgugcccagaucac

SEQ ID NO: 1630790 - RNA, 17 nt, Pseudomonas putida KT2440
acgucguacucggccgg

SEQ ID NO: 1630791 - RNA, 23 nt, Pseudomonas putida KT2440
acgucggggaauggcccagccag

SEQ ID NO: 1630792 - RNA, 21 nt, Pseudomonas putida KT2440
acgucggcguccuucagguag

SEQ ID NO: 1630793 - RNA, 15 nt, Pseudomonas putida KT2440
acguccggccagcaa

SEQ ID NO: 1630794 - RNA, 14 nt, Pseudomonas putida KT2440
acguacacacaucu

SEQ ID NO: 1630795 - RNA, 14 nt, Pseudomonas putida KT2440
acguacagcagcuc

SEQ ID NO: 1630796 - RNA, 16 nt, Pseudomonas putida KT2440
acguacagcagcucac

SEQ ID NO: 1630797 - RNA, 16 nt, Pseudomonas putida KT2440
acuucacgugggucgu

SEQ ID NO: 1630798 - RNA, 22 nt, Pseudomonas putida KT2440
acuucaggcugcgccgccucca

SEQ ID NO: 1630799 - RNA, 13 nt, Pseudomonas putida KT2440
acuucccccuccc

SEQ ID NO: 1630800 - RNA, 13 nt, Pseudomonas putida KT2440
acuuccccggcgc

SEQ ID NO: 1630801 - RNA, 15 nt, Pseudomonas putida KT2440
acuuccccggcgccg

SEQ ID NO: 1630802 - RNA, 20 nt, Pseudomonas putida KT2440
acuucccgcaagccagccuc

SEQ ID NO: 1630803 - RNA, 20 nt, Pseudomonas putida KT2440
acuuauaagcagcaagccug

SEQ ID NO: 1630804 - RNA, 20 nt, Pseudomonas putida KT2440
acuguucagguaggccgcag

SEQ ID NO: 1630805 - RNA, 23 nt, Pseudomonas putida KT2440
acuguuagggaagcucugaucaa

SEQ ID NO: 1630806 - RNA, 19 nt, Pseudomonas putida KT2440
acugucggguuggucgcca

SEQ ID NO: 1630807 - RNA, 21 nt, Pseudomonas putida KT2440
acugucgauggcggugcgcac

SEQ ID NO: 1630808 - RNA, 13 nt, Pseudomonas putida KT2440
acugguucuccag

SEQ ID NO: 1630809 - RNA, 11 nt, Pseudomonas putida KT2440
acuuagucucg

SEQ ID NO: 1630810 - RNA, 22 nt, Pseudomonas putida KT2440
acuggaacucgaucggcacccc

SEQ ID NO: 1630811 - RNA, 17 nt, Pseudomonas putida KT2440
acugcuucugccguuca

SEQ ID NO: 1630812 - RNA, 13 nt, Pseudomonas putida KT2440
acugcuucaugaa

SEQ ID NO: 1630813 - RNA, 14 nt, Pseudomonas putida KT2440
acugcuucaugaag

SEQ ID NO: 1630814 - RNA, 21 nt, Pseudomonas putida KT2440
acugcuuuaucuccaagccgc

SEQ ID NO: 1630815 - RNA, 18 nt, Pseudomonas putida KT2440
acugcucgcugccacgca

SEQ ID NO: 1630816 - RNA, 17 nt, Pseudomonas putida KT2440
acugcugagucagcuug

SEQ ID NO: 1630817 - RNA, 18 nt, Pseudomonas putida KT2440
acugcugagucagcuugu

SEQ ID NO: 1630818 - RNA, 17 nt, Pseudomonas putida KT2440
acugcugacccggaauc

SEQ ID NO: 1630819 - RNA, 22 nt, Pseudomonas putida KT2440
acugcgucuuguaguucaucuu

SEQ ID NO: 1630820 - RNA, 15 nt, Pseudomonas putida KT2440
acugcggccccugga

SEQ ID NO: 1630821 - RNA, 13 nt, Pseudomonas putida KT2440
acugcuccaggca

SEQ ID NO: 1630822 - RNA, 15 nt, Pseudomonas putida KT2440
acugcuccaggcagc

SEQ ID NO: 1630823 - RNA, 21 nt, Pseudomonas putida KT2440
acugcuccaggcagccugcca

SEQ ID NO: 1630824 - RNA, 17 nt, Pseudomonas putida KT2440
acugguggacacugccg

SEQ ID NO: 1630825 - RNA, 20 nt, Pseudomonas putida KT2440
acuggcuuucccccagccaa

SEQ ID NO: 1630826 - RNA, 21 nt, Pseudomonas putida KT2440
acuggcuucgaugaaggcugc

SEQ ID NO: 1630827 - RNA, 15 nt, Pseudomonas putida KT2440
acuggcgcccggcau

SEQ ID NO: 1630828 - RNA, 16 nt, Pseudomonas putida KT2440
acuggcgcccggcauc

SEQ ID NO: 1630829 - RNA, 23 nt, Pseudomonas putida KT2440
acuggcgcaccagcggcuuggca

SEQ ID NO: 1630830 - RNA, 18 nt, Pseudomonas putida KT2440
acuggcuauccuucugcc

SEQ ID NO: 1630831 - RNA, 23 nt, Pseudomonas putida KT2440
acuggcuauccuucugccguuug

SEQ ID NO: 1630832 - RNA, 16 nt, Pseudomonas putida KT2440
acuggccggagcugga

SEQ ID NO: 1630833 - RNA, 19 nt, Pseudomonas putida KT2440
acuggcauccggcagcuca

SEQ ID NO: 1630834 - RNA, 18 nt, Pseudomonas putida KT2440
acuggcccggcgggagga

SEQ ID NO: 1630835 - RNA, 14 nt, Pseudomonas putida KT2440
acuggcccuggcca

SEQ ID NO: 1630836 - RNA, 17 nt, Pseudomonas putida KT2440
acuggccagcagccccc

SEQ ID NO: 1630837 - RNA, 18 nt, Pseudomonas putida KT2440
acuggcccgcgccaggcu

SEQ ID NO: 1630838 - RNA, 17 nt, Pseudomonas putida KT2440
acuggcagcaaggccau

SEQ ID NO: 1630839 - RNA, 16 nt, Pseudomonas putida KT2440
acugcaugugccgcuc

SEQ ID NO: 1630840 - RNA, 16 nt, Pseudomonas putida KT2440
acugcacugccagcgc

SEQ ID NO: 1630841 - RNA, 17 nt, Pseudomonas putida KT2440
acugcaccucccgccac

SEQ ID NO: 1630842 - RNA, 22 nt, Pseudomonas putida KT2440
acugcaccaugaauucccuacu

SEQ ID NO: 1630843 - RNA, 19 nt, Pseudomonas putida KT2440
acugcacccgccagccguu

SEQ ID NO: 1630844 - RNA, 17 nt, Pseudomonas putida KT2440
acugcaagcgaugcacg

SEQ ID NO: 1630845 - RNA, 14 nt, Pseudomonas putida KT2440
acugcaauucguga

SEQ ID NO: 1630846 - RNA, 18 nt, Pseudomonas putida KT2440
acugcccaggaucacugg

SEQ ID NO: 1630847 - RNA, 20 nt, Pseudomonas putida KT2440
acugcccagcagccccacgc

SEQ ID NO: 1630848 - RNA, 20 nt, Pseudomonas putida KT2440
acugcccaagccauccacca

SEQ ID NO: 1630849 - RNA, 22 nt, Pseudomonas putida KT2440
acugcccaagccauccaccagc

SEQ ID NO: 1630850 - RNA, 19 nt, Pseudomonas putida KT2440
acugccaccgugagcaugg

SEQ ID NO: 1630851 - RNA, 12 nt, Pseudomonas putida KT2440
acugccagcacg

SEQ ID NO: 1630852 - RNA, 15 nt, Pseudomonas putida KT2440
acugcgcaaucccug

SEQ ID NO: 1630853 - RNA, 17 nt, Pseudomonas putida KT2440
acugcgcagucauuuuc

SEQ ID NO: 1630854 - RNA, 17 nt, Pseudomonas putida KT2440
acugcgcagcccuccca

SEQ ID NO: 1630855 - RNA, 18 nt, Pseudomonas putida KT2440
acugcgcccaaucgggua

SEQ ID NO: 1630856 - RNA, 22 nt, Pseudomonas putida KT2440
acugcgcccaaucggguaaaac

SEQ ID NO: 1630857 - RNA, 20 nt, Pseudomonas putida KT2440
acugcgcucaaccagccgcc

SEQ ID NO: 1630858 - RNA, 21 nt, Pseudomonas putida KT2440
acugcgcucaaccagccgccu

SEQ ID NO: 1630859 - RNA, 14 nt, Pseudomonas putida KT2440
acugccugaucacc

SEQ ID NO: 1630860 - RNA, 20 nt, Pseudomonas putida KT2440
acugccugcaugcgugccuu

SEQ ID NO: 1630861 - RNA, 14 nt, Pseudomonas putida KT2440
acugccuugcccug

SEQ ID NO: 1630862 - RNA, 16 nt, Pseudomonas putida KT2440
acugagcuaacgaccc

SEQ ID NO: 1630863 - RNA, 16 nt, Pseudomonas putida KT2440
acugagccaggccgac

SEQ ID NO: 1630864 - RNA, 19 nt, Pseudomonas putida KT2440
acugcaaaucgaaggcaua

SEQ ID NO: 1630865 - RNA, 22 nt, Pseudomonas putida KT2440
acugaucccuacccccuccucc

SEQ ID NO: 1630866 - RNA, 17 nt, Pseudomonas putida KT2440
acugaucgggauuacau

SEQ ID NO: 1630867 - RNA, 15 nt, Pseudomonas putida KT2440
acucggcaggaaaca

SEQ ID NO: 1630868 - RNA, 19 nt, Pseudomonas putida KT2440
acucggcaggaaacaccag

SEQ ID NO: 1630869 - RNA, 12 nt, Pseudomonas putida KT2440
acucggcaguga

SEQ ID NO: 1630870 - RNA, 13 nt, Pseudomonas putida KT2440
acucggcagugaa

SEQ ID NO: 1630871 - RNA, 18 nt, Pseudomonas putida KT2440
acucggcagugaacucca

SEQ ID NO: 1630872 - RNA, 17 nt, Pseudomonas putida KT2440
acucggcgagccgccag

SEQ ID NO: 1630873 - RNA, 15 nt, Pseudomonas putida KT2440
acucuaccucacuga

SEQ ID NO: 1630874 - RNA, 13 nt, Pseudomonas putida KT2440
acucugcugcucu

SEQ ID NO: 1630875 - RNA, 14 nt, Pseudomonas putida KT2440
acucugucacccgc

SEQ ID NO: 1630876 - RNA, 21 nt, Pseudomonas putida KT2440
acuccggccggggcucacagc

SEQ ID NO: 1630877 - RNA, 20 nt, Pseudomonas putida KT2440
acuccgcucauuggaaaaug

SEQ ID NO: 1630878 - RNA, 16 nt, Pseudomonas putida KT2440
acucaaccaccgcuca

SEQ ID NO: 1630879 - RNA, 22 nt, Pseudomonas putida KT2440
acucaacgcaacugcggccccu

SEQ ID NO: 1630880 - RNA, 21 nt, Pseudomonas putida KT2440
acuccucgaucaccugcggcc

SEQ ID NO: 1630881 - RNA, 10 nt, Pseudomonas putida KT2440
acuccuccag

SEQ ID NO: 1630882 - RNA, 15 nt, Pseudomonas putida KT2440
acuccuccagccgac

SEQ ID NO: 1630883 - RNA, 20 nt, Pseudomonas putida KT2440
acuccuccagccgacggcca

SEQ ID NO: 1630884 - RNA, 12 nt, Pseudomonas putida KT2440
acuccugcacca

SEQ ID NO: 1630885 - RNA, 19 nt, Pseudomonas putida KT2440
acuccugcguacccagccc

SEQ ID NO: 1630886 - RNA, 16 nt, Pseudomonas putida KT2440
acucgaccgccgcaca

SEQ ID NO: 1630887 - RNA, 22 nt, Pseudomonas putida KT2440
acuccuucucgcccacgaucuc

SEQ ID NO: 1630888 - RNA, 15 nt, Pseudomonas putida KT2440
acucgaacagcuuga

SEQ ID NO: 1630889 - RNA, 16 nt, Pseudomonas putida KT2440
agauuccgggcugcug

SEQ ID NO: 1630890 - RNA, 17 nt, Pseudomonas putida KT2440
agauuccguaccaguuc

SEQ ID NO: 1630891 - RNA, 12 nt, Pseudomonas putida KT2440
agauugagagga

SEQ ID NO: 1630892 - RNA, 13 nt, Pseudomonas putida KT2440
agauugagaggac

SEQ ID NO: 1630893 - RNA, 11 nt, Pseudomonas putida KT2440
agauuggccag

SEQ ID NO: 1630894 - RNA, 21 nt, Pseudomonas putida KT2440
agauuggccagcagggccggc

SEQ ID NO: 1630895 - RNA, 14 nt, Pseudomonas putida KT2440
agauugcuuauucu

SEQ ID NO: 1630896 - RNA, 21 nt, Pseudomonas putida KT2440
agauugcuuauucuucuggcu

SEQ ID NO: 1630897 - RNA, 19 nt, Pseudomonas putida KT2440
agauugaaggggcaaaguu

SEQ ID NO: 1630898 - RNA, 18 nt, Pseudomonas putida KT2440
agaugguuuccagcuccg

SEQ ID NO: 1630899 - RNA, 18 nt, Pseudomonas putida KT2440
agauuacgcgucaucugc

SEQ ID NO: 1630900 - RNA, 18 nt, Pseudomonas putida KT2440
agauggcugucugcagcu

SEQ ID NO: 1630901 - RNA, 21 nt, Pseudomonas putida KT2440
agauggcccggucccgcugcc

SEQ ID NO: 1630902 - RNA, 20 nt, Pseudomonas putida KT2440
agauggcaccccagccgcuc

SEQ ID NO: 1630903 - RNA, 23 nt, Pseudomonas putida KT2440
agauggcagacaaguccuucauc

SEQ ID NO: 1630904 - RNA, 21 nt, Pseudomonas putida KT2440
agaugcuccaaccccagcgca

SEQ ID NO: 1630905 - RNA, 19 nt, Pseudomonas putida KT2440
agaugcgccgggacagcac

SEQ ID NO: 1630906 - RNA, 15 nt, Pseudomonas putida KT2440
agaugcgcgcugcaa

SEQ ID NO: 1630907 - RNA, 14 nt, Pseudomonas putida KT2440
agaucccgcuccuc

SEQ ID NO: 1630908 - RNA, 22 nt, Pseudomonas putida KT2440
agauccgcggcaugugcggguu

SEQ ID NO: 1630909 - RNA, 13 nt, Pseudomonas putida KT2440
agauccugcagcc

SEQ ID NO: 1630910 - RNA, 12 nt, Pseudomonas putida KT2440
agaucaucagcg

SEQ ID NO: 1630911 - RNA, 11 nt, Pseudomonas putida KT2440
agauccaugua

SEQ ID NO: 1630912 - RNA, 21 nt, Pseudomonas putida KT2440
agaucgagcgccgcccgcgcg

SEQ ID NO: 1630913 - RNA, 20 nt, Pseudomonas putida KT2440
agaucgagcgccgcccgcgu

SEQ ID NO: 1630914 - RNA, 17 nt, Pseudomonas putida KT2440
agaugaccggccgggcu

SEQ ID NO: 1630915 - RNA, 23 nt, Pseudomonas putida KT2440
agaugcacaccaguucaccaucc

SEQ ID NO: 1630916 - RNA, 15 nt, Pseudomonas putida KT2440
agaucagccacgggc

SEQ ID NO: 1630917 - RNA, 21 nt, Pseudomonas putida KT2440
agaucagcaaccugcugggca

SEQ ID NO: 1630918 - RNA, 22 nt, Pseudomonas putida KT2440
agauauugguccagccacaauu

SEQ ID NO: 1630919 - RNA, 13 nt, Pseudomonas putida KT2440
agaucaccagcuc

SEQ ID NO: 1630920 - RNA, 17 nt, Pseudomonas putida KT2440
agauauguccauccaug

SEQ ID NO: 1630921 - RNA, 19 nt, Pseudomonas putida KT2440
agauacaggcuguuccauu

SEQ ID NO: 1630922 - RNA, 20 nt, Pseudomonas putida KT2440
agauaggcauugagguugac

SEQ ID NO: 1630923 - RNA, 19 nt, Pseudomonas putida KT2440
agauagaccuugccagcgc

SEQ ID NO: 1630924 - RNA, 18 nt, Pseudomonas putida KT2440
agagauaucgcauuucua

SEQ ID NO: 1630925 - RNA, 17 nt, Pseudomonas putida KT2440
agacuagcagucccauc

SEQ ID NO: 1630926 - RNA, 18 nt, Pseudomonas putida KT2440
agacuaccaacaccggcg

SEQ ID NO: 1630927 - RNA, 16 nt, Pseudomonas putida KT2440
agaguccgaagcgaac

SEQ ID NO: 1630928 - RNA, 15 nt, Pseudomonas putida KT2440
agagguacaccccca

SEQ ID NO: 1630929 - RNA, 19 nt, Pseudomonas putida KT2440
agagggccugcaucgcuga

SEQ ID NO: 1630930 - RNA, 16 nt, Pseudomonas putida KT2440
agagcgaaaugggccg

SEQ ID NO: 1630931 - RNA, 16 nt, Pseudomonas putida KT2440
agagcgacuggugugg

SEQ ID NO: 1630932 - RNA, 18 nt, Pseudomonas putida KT2440
agagcgcgccacgcacca

SEQ ID NO: 1630933 - RNA, 23 nt, Pseudomonas putida KT2440
agaaacggcggcagauacaaccc

SEQ ID NO: 1630934 - RNA, 20 nt, Pseudomonas putida KT2440
agaaagcgauugcccagcgu

SEQ ID NO: 1630935 - RNA, 19 nt, Pseudomonas putida KT2440
agaaacucacgcauggccg

SEQ ID NO: 1630936 - RNA, 18 nt, Pseudomonas putida KT2440
acuucgaagugccacgcc

SEQ ID NO: 1630937 - RNA, 15 nt, Pseudomonas putida KT2440
agaaccgccagcacc

SEQ ID NO: 1630938 - RNA, 23 nt, Pseudomonas putida KT2440
agaaccugaugcgagcuaccuga

SEQ ID NO: 1630939 - RNA, 14 nt, Pseudomonas putida KT2440
agaaaguccaucug

SEQ ID NO: 1630940 - RNA, 14 nt, Pseudomonas putida KT2440
agaacaccugcagc

SEQ ID NO: 1630941 - RNA, 21 nt, Pseudomonas putida KT2440
agaacaagucgcgcaccaccu

SEQ ID NO: 1630942 - RNA, 15 nt, Pseudomonas putida KT2440
agaacaacacggcag

SEQ ID NO: 1630943 - RNA, 16 nt, Pseudomonas putida KT2440
agaacaugaucaagcu

SEQ ID NO: 1630944 - RNA, 19 nt, Pseudomonas putida KT2440
agaaccacuccagggucug

SEQ ID NO: 1630945 - RNA, 19 nt, Pseudomonas putida KT2440
agaaccccacucuccauau

SEQ ID NO: 1630946 - RNA, 22 nt, Pseudomonas putida KT2440
agaacagccacagcugcugcag

SEQ ID NO: 1630947 - RNA, 14 nt, Pseudomonas putida KT2440
agaacaggcggccc

SEQ ID NO: 1630948 - RNA, 15 nt, Pseudomonas putida KT2440
agaacagcuggaugg

SEQ ID NO: 1630949 - RNA, 19 nt, Pseudomonas putida KT2440
agaacagcgugccaugcag

SEQ ID NO: 1630950 - RNA, 15 nt, Pseudomonas putida KT2440
agaacaucacgaagg

SEQ ID NO: 1630951 - RNA, 20 nt, Pseudomonas putida KT2440
agaacacggugacaaaggcc

SEQ ID NO: 1630952 - RNA, 13 nt, Pseudomonas putida KT2440
agaccaccucauc

SEQ ID NO: 1630953 - RNA, 12 nt, Pseudomonas putida KT2440
agaccacggucg

SEQ ID NO: 1630954 - RNA, 15 nt, Pseudomonas putida KT2440
agaccagacagcgcu

SEQ ID NO: 1630955 - RNA, 15 nt, Pseudomonas putida KT2440
agacacggacucaua

SEQ ID NO: 1630956 - RNA, 16 nt, Pseudomonas putida KT2440
agacacggacucauag

SEQ ID NO: 1630957 - RNA, 21 nt, Pseudomonas putida KT2440
agacacggacucauagcucag

SEQ ID NO: 1630958 - RNA, 18 nt, Pseudomonas putida KT2440
agacaacuuuacggcuga

SEQ ID NO: 1630959 - RNA, 11 nt, Pseudomonas putida KT2440
agacaacuggc

SEQ ID NO: 1630960 - RNA, 16 nt, Pseudomonas putida KT2440
agacaacuggccaggg

SEQ ID NO: 1630961 - RNA, 20 nt, Pseudomonas putida KT2440
agacaaguccuucaucuguc

SEQ ID NO: 1630962 - RNA, 22 nt, Pseudomonas putida KT2440
agacaaguccuucaucugucag

SEQ ID NO: 1630963 - RNA, 21 nt, Pseudomonas putida KT2440
agacgggcgacggaucggcac

SEQ ID NO: 1630964 - RNA, 20 nt, Pseudomonas putida KT2440
agacggccuucgaagaacac

SEQ ID NO: 1630965 - RNA, 16 nt, Pseudomonas putida KT2440
agacgucgcaauugau

SEQ ID NO: 1630966 - RNA, 13 nt, Pseudomonas putida KT2440
agacgguggcugc

SEQ ID NO: 1630967 - RNA, 14 nt, Pseudomonas putida KT2440
agacgguggcugcc

SEQ ID NO: 1630968 - RNA, 15 nt, Pseudomonas putida KT2440
agacggugagaggua

SEQ ID NO: 1630969 - RNA, 18 nt, Pseudomonas putida KT2440
agacgguuacgugcaggc

SEQ ID NO: 1630970 - RNA, 21 nt, Pseudomonas putida KT2440
agacgucuuccaugccuucuu

SEQ ID NO: 1630971 - RNA, 21 nt, Pseudomonas putida KT2440
agaccuccgucugcucugcca

SEQ ID NO: 1630972 - RNA, 15 nt, Pseudomonas putida KT2440
agaccaucagguauu

SEQ ID NO: 1630973 - RNA, 16 nt, Pseudomonas putida KT2440
agaccauuucgcgcag

SEQ ID NO: 1630974 - RNA, 18 nt, Pseudomonas putida KT2440
agaccauuucgcgcaggg

SEQ ID NO: 1630975 - RNA, 13 nt, Pseudomonas putida KT2440
agaaucucaacca

SEQ ID NO: 1630976 - RNA, 18 nt, Pseudomonas putida KT2440
agaaucucccgggccaug

SEQ ID NO: 1630977 - RNA, 12 nt, Pseudomonas putida KT2440
agaaucugcaca

SEQ ID NO: 1630978 - RNA, 18 nt, Pseudomonas putida KT2440
agaagcuguagucaccac

SEQ ID NO: 1630979 - RNA, 18 nt, Pseudomonas putida KT2440
agaagcugcagcuucagg

SEQ ID NO: 1630980 - RNA, 19 nt, Pseudomonas putida KT2440
agaagcuaccccacaaccc

SEQ ID NO: 1630981 - RNA, 19 nt, Pseudomonas putida KT2440
agaaguccucccaguacau

SEQ ID NO: 1630982 - RNA, 17 nt, Pseudomonas putida KT2440
agaagaaggagagccuc

SEQ ID NO: 1630983 - RNA, 13 nt, Pseudomonas putida KT2440
agaagcaaccgcu

SEQ ID NO: 1630984 - RNA, 14 nt, Pseudomonas putida KT2440
agaagacaccgcgg

SEQ ID NO: 1630985 - RNA, 16 nt, Pseudomonas putida KT2440
agaagcagaacaucag

SEQ ID NO: 1630986 - RNA, 19 nt, Pseudomonas putida KT2440
agaagcagaucaucaugcc

SEQ ID NO: 1630987 - RNA, 16 nt, Pseudomonas putida KT2440
agaagcauuacuucuu

SEQ ID NO: 1630988 - RNA, 20 nt, Pseudomonas putida KT2440
acagguccagcgcaggcuuc

SEQ ID NO: 1630989 - RNA, 19 nt, Pseudomonas putida KT2440
acagguaggcgccacgccg

SEQ ID NO: 1630990 - RNA, 14 nt, Pseudomonas putida KT2440
acagguaccaggcu

SEQ ID NO: 1630991 - RNA, 22 nt, Pseudomonas putida KT2440
acagguaauacgcugugcucug

SEQ ID NO: 1630992 - RNA, 17 nt, Pseudomonas putida KT2440
acagguaaugcacaagu

SEQ ID NO: 1630993 - RNA, 16 nt, Pseudomonas putida KT2440
acagguaauugguggu

SEQ ID NO: 1630994 - RNA, 19 nt, Pseudomonas putida KT2440
acagguaauugguggugcu

SEQ ID NO: 1630995 - RNA, 19 nt, Pseudomonas putida KT2440
acagggucaggaaccgcuc

SEQ ID NO: 1630996 - RNA, 15 nt, Pseudomonas putida KT2440
acagggcgaugcccu

SEQ ID NO: 1630997 - RNA, 16 nt, Pseudomonas putida KT2440
acagggcgcguguagc

SEQ ID NO: 1630998 - RNA, 21 nt, Pseudomonas putida KT2440
acagggcgcguguagcccgcu

SEQ ID NO: 1630999 - RNA, 19 nt, Pseudomonas putida KT2440
acaggcuuacaacugcucc

SEQ ID NO: 1631000 - RNA, 19 nt, Pseudomonas putida KT2440
acagggaccgugcagggaa

SEQ ID NO: 1631001 - RNA, 17 nt, Pseudomonas putida KT2440
acaggcuucagccuucg

SEQ ID NO: 1631002 - RNA, 17 nt, Pseudomonas putida KT2440
acaggcgcuugaagaag

SEQ ID NO: 1631003 - RNA, 18 nt, Pseudomonas putida KT2440
acaggcguacaucagccu

SEQ ID NO: 1631004 - RNA, 13 nt, Pseudomonas putida KT2440
acagguuaggguc

SEQ ID NO: 1631005 - RNA, 19 nt, Pseudomonas putida KT2440
acagguucggguaguccuc

SEQ ID NO: 1631006 - RNA, 22 nt, Pseudomonas putida KT2440
acagugcggcggcacugaugcc

SEQ ID NO: 1631007 - RNA, 20 nt, Pseudomonas putida KT2440
acagugcuuccagcaggacc

SEQ ID NO: 1631008 - RNA, 15 nt, Pseudomonas putida KT2440
acauaacaagaacaa

SEQ ID NO: 1631009 - RNA, 15 nt, Pseudomonas putida KT2440
acaucgauuucgcca

SEQ ID NO: 1631010 - RNA, 16 nt, Pseudomonas putida KT2440
acaucgauuucgccau

SEQ ID NO: 1631011 - RNA, 17 nt, Pseudomonas putida KT2440
acaucgauuucgccauc

SEQ ID NO: 1631012 - RNA, 22 nt, Pseudomonas putida KT2440
acaucgcgguauccaucaccau

SEQ ID NO: 1631013 - RNA, 19 nt, Pseudomonas putida KT2440
acaucgccgucaucaccac

SEQ ID NO: 1631014 - RNA, 17 nt, Pseudomonas putida KT2440
acaucugcgccagauca

SEQ ID NO: 1631015 - RNA, 13 nt, Pseudomonas putida KT2440
acaucuccacugc

SEQ ID NO: 1631016 - RNA, 22 nt, Pseudomonas putida KT2440
acaucugggguuggacccaggc

SEQ ID NO: 1631017 - RNA, 18 nt, Pseudomonas putida KT2440
acaugccaaagaaggacu

SEQ ID NO: 1631018 - RNA, 22 nt, Pseudomonas putida KT2440
acaugccacggccuucuucacg

SEQ ID NO: 1631019 - RNA, 17 nt, Pseudomonas putida KT2440
acaugcacgccacgccc

SEQ ID NO: 1631020 - RNA, 22 nt, Pseudomonas putida KT2440
acaucacggcgcaggccgacaa

SEQ ID NO: 1631021 - RNA, 14 nt, Pseudomonas putida KT2440
acaucacugcugua

SEQ ID NO: 1631022 - RNA, 15 nt, Pseudomonas putida KT2440
acaucacugcuguaa

SEQ ID NO: 1631023 - RNA, 15 nt, Pseudomonas putida KT2440
acauccaccaggcug

SEQ ID NO: 1631024 - RNA, 16 nt, Pseudomonas putida KT2440
acauccaccaggcugg

SEQ ID NO: 1631025 - RNA, 13 nt, Pseudomonas putida KT2440
acauacaccaacg

SEQ ID NO: 1631026 - RNA, 14 nt, Pseudomonas putida KT2440
acauaccacacacc

SEQ ID NO: 1631027 - RNA, 21 nt, Pseudomonas putida KT2440
acauaccacacaccccagaac

SEQ ID NO: 1631028 - RNA, 15 nt, Pseudomonas putida KT2440
acacuugccgcccuc

SEQ ID NO: 1631029 - RNA, 17 nt, Pseudomonas putida KT2440
acacuugguccagggcc

SEQ ID NO: 1631030 - RNA, 13 nt, Pseudomonas putida KT2440
acacuucgccggu

SEQ ID NO: 1631031 - RNA, 17 nt, Pseudomonas putida KT2440
acagacaccacaaaacc

SEQ ID NO: 1631032 - RNA, 15 nt, Pseudomonas putida KT2440
acagacaccgcaaau

SEQ ID NO: 1631033 - RNA, 22 nt, Pseudomonas putida KT2440
acagaaugcgcucgaaacgccg

SEQ ID NO: 1631034 - RNA, 13 nt, Pseudomonas putida KT2440
acacugccaucuc

SEQ ID NO: 1631035 - RNA, 14 nt, Pseudomonas putida KT2440
acacugucccggca

SEQ ID NO: 1631036 - RNA, 15 nt, Pseudomonas putida KT2440
acacucgacgcugcc

SEQ ID NO: 1631037 - RNA, 23 nt, Pseudomonas putida KT2440
acacucgcccccaucgcaggguc

SEQ ID NO: 1631038 - RNA, 12 nt, Pseudomonas putida KT2440
acagcacccagg

SEQ ID NO: 1631039 - RNA, 18 nt, Pseudomonas putida KT2440
acagcacugcauuggcca

SEQ ID NO: 1631040 - RNA, 20 nt, Pseudomonas putida KT2440
acagcacugccagcccggcg

SEQ ID NO: 1631041 - RNA, 17 nt, Pseudomonas putida KT2440
acagccaugccggcaac

SEQ ID NO: 1631042 - RNA, 12 nt, Pseudomonas putida KT2440
acagccacgccc

SEQ ID NO: 1631043 - RNA, 14 nt, Pseudomonas putida KT2440
acagccacaugcca

SEQ ID NO: 1631044 - RNA, 15 nt, Pseudomonas putida KT2440
acagccacagcugcu

SEQ ID NO: 1631045 - RNA, 16 nt, Pseudomonas putida KT2440
acagccacagcugcug

SEQ ID NO: 1631046 - RNA, 15 nt, Pseudomonas putida KT2440
acagcacaaggcuca

SEQ ID NO: 1631047 - RNA, 15 nt, Pseudomonas putida KT2440
acagcacaccuuccg

SEQ ID NO: 1631048 - RNA, 15 nt, Pseudomonas putida KT2440
acagauggcacccca

SEQ ID NO: 1631049 - RNA, 18 nt, Pseudomonas putida KT2440
acagauuccguaccaguu

SEQ ID NO: 1631050 - RNA, 19 nt, Pseudomonas putida KT2440
acaggccugcggccaggcc

SEQ ID NO: 1631051 - RNA, 20 nt, Pseudomonas putida KT2440
acaggcauaccgcaacaccu

SEQ ID NO: 1631052 - RNA, 14 nt, Pseudomonas putida KT2440
acaggccagcccca

SEQ ID NO: 1631053 - RNA, 18 nt, Pseudomonas putida KT2440
acaggcccugacaggcga

SEQ ID NO: 1631054 - RNA, 17 nt, Pseudomonas putida KT2440
acagcuuuuggagagcg

SEQ ID NO: 1631055 - RNA, 12 nt, Pseudomonas putida KT2440
acaggaccaggc

SEQ ID NO: 1631056 - RNA, 23 nt, Pseudomonas putida KT2440
acaggaauuacgcaggcuccaaa

SEQ ID NO: 1631057 - RNA, 22 nt, Pseudomonas putida KT2440
acaggauggcaaagcgcagcaa

SEQ ID NO: 1631058 - RNA, 19 nt, Pseudomonas putida KT2440
acaggauggccgcaggccc

SEQ ID NO: 1631059 - RNA, 21 nt, Pseudomonas putida KT2440
acaggcagaucgaaagacagc

SEQ ID NO: 1631060 - RNA, 14 nt, Pseudomonas putida KT2440
acaggcaaagaaac

SEQ ID NO: 1631061 - RNA, 18 nt, Pseudomonas putida KT2440
acaggcaaccgcaucccc

SEQ ID NO: 1631062 - RNA, 23 nt, Pseudomonas putida KT2440
acaggaucuccucggccagcggc

SEQ ID NO: 1631063 - RNA, 16 nt, Pseudomonas putida KT2440
acagcuggccuugcgg

SEQ ID NO: 1631064 - RNA, 15 nt, Pseudomonas putida KT2440
acagcugcacaucuc

SEQ ID NO: 1631065 - RNA, 19 nt, Pseudomonas putida KT2440
acagcucuggcagcagugc

SEQ ID NO: 1631066 - RNA, 16 nt, Pseudomonas putida KT2440
acagcucgcgcugcca

SEQ ID NO: 1631067 - RNA, 20 nt, Pseudomonas putida KT2440
acagcucgcgcugccaggcc

SEQ ID NO: 1631068 - RNA, 18 nt, Pseudomonas putida KT2440
acagcucgaaaccggccu

SEQ ID NO: 1631069 - RNA, 20 nt, Pseudomonas putida KT2440
acagcuccagcaacugcgcc

SEQ ID NO: 1631070 - RNA, 18 nt, Pseudomonas putida KT2440
acagcucacuggcaucca

SEQ ID NO: 1631071 - RNA, 16 nt, Pseudomonas putida KT2440
acagcucacuggccaa

SEQ ID NO: 1631072 - RNA, 20 nt, Pseudomonas putida KT2440
acagcucaagcccugccgcc

SEQ ID NO: 1631073 - RNA, 19 nt, Pseudomonas putida KT2440
acagcuucuugcaccgcuc

SEQ ID NO: 1631074 - RNA, 15 nt, Pseudomonas putida KT2440
acagcuugcccagcu

SEQ ID NO: 1631075 - RNA, 17 nt, Pseudomonas putida KT2440
acagcuugcccagcugc

SEQ ID NO: 1631076 - RNA, 15 nt, Pseudomonas putida KT2440
acagcuugcccauca

SEQ ID NO: 1631077 - RNA, 16 nt, Pseudomonas putida KT2440
acagcuugcccaucac

SEQ ID NO: 1631078 - RNA, 14 nt, Pseudomonas putida KT2440
acagcugugcugcc

SEQ ID NO: 1631079 - RNA, 21 nt, Pseudomonas putida KT2440
acagcuuguugccagcggcga

SEQ ID NO: 1631080 - RNA, 12 nt, Pseudomonas putida KT2440
acagcgccucca

SEQ ID NO: 1631081 - RNA, 23 nt, Pseudomonas putida KT2440
acagcgccgcggccaacauucac

SEQ ID NO: 1631082 - RNA, 21 nt, Pseudomonas putida KT2440
acagcgccugcugcuggauca

SEQ ID NO: 1631083 - RNA, 17 nt, Pseudomonas putida KT2440
acagcguugcagaaacu

SEQ ID NO: 1631084 - RNA, 19 nt, Pseudomonas putida KT2440
acagccuaagguugcuccu

SEQ ID NO: 1631085 - RNA, 22 nt, Pseudomonas putida KT2440
acagccuaccaacgcagcaugc

SEQ ID NO: 1631086 - RNA, 16 nt, Pseudomonas putida KT2440
acagccuccaguugcu

SEQ ID NO: 1631087 - RNA, 22 nt, Pseudomonas putida KT2440
acagccuccaguugcuccaccu

SEQ ID NO: 1631088 - RNA, 16 nt, Pseudomonas putida KT2440
acagccgcggcaccca

SEQ ID NO: 1631089 - RNA, 16 nt, Pseudomonas putida KT2440
acagccgcgcaugcug

SEQ ID NO: 1631090 - RNA, 13 nt, Pseudomonas putida KT2440
acagccccaucac

SEQ ID NO: 1631091 - RNA, 15 nt, Pseudomonas putida KT2440
acagccccuucccca

SEQ ID NO: 1631092 - RNA, 18 nt, Pseudomonas putida KT2440
acagccccaucaccagcc

SEQ ID NO: 1631093 - RNA, 15 nt, Pseudomonas putida KT2440
acagcccgggcaugu

SEQ ID NO: 1631094 - RNA, 17 nt, Pseudomonas putida KT2440
accaucaggcacaggcc

SEQ ID NO: 1631095 - RNA, 14 nt, Pseudomonas putida KT2440
accaucagguauug

SEQ ID NO: 1631096 - RNA, 13 nt, Pseudomonas putida KT2440
accauucccugca

SEQ ID NO: 1631097 - RNA, 14 nt, Pseudomonas putida KT2440
acccaccacggccu

SEQ ID NO: 1631098 - RNA, 18 nt, Pseudomonas putida KT2440
acccaccacaaaccacag

SEQ ID NO: 1631099 - RNA, 16 nt, Pseudomonas putida KT2440
acccacaagcgcaggc

SEQ ID NO: 1631100 - RNA, 13 nt, Pseudomonas putida KT2440
acccaccagcagu

SEQ ID NO: 1631101 - RNA, 16 nt, Pseudomonas putida KT2440
acccaccagcagugcc

SEQ ID NO: 1631102 - RNA, 18 nt, Pseudomonas putida KT2440
acccaccagcagugcccc

SEQ ID NO: 1631103 - RNA, 13 nt, Pseudomonas putida KT2440
acccaccagccaa

SEQ ID NO: 1631104 - RNA, 15 nt, Pseudomonas putida KT2440
acccaccagccaaac

SEQ ID NO: 1631105 - RNA, 13 nt, Pseudomonas putida KT2440
acccagaacagcc

SEQ ID NO: 1631106 - RNA, 15 nt, Pseudomonas putida KT2440
acccagaacagccac

SEQ ID NO: 1631107 - RNA, 17 nt, Pseudomonas putida KT2440
acccacuuggaaaacag

SEQ ID NO: 1631108 - RNA, 16 nt, Pseudomonas putida KT2440
acccaauagcccaccg

SEQ ID NO: 1631109 - RNA, 13 nt, Pseudomonas putida KT2440
acccaaucauaua

SEQ ID NO: 1631110 - RNA, 16 nt, Pseudomonas putida KT2440
acccaauaaaaacaac

SEQ ID NO: 1631111 - RNA, 19 nt, Pseudomonas putida KT2440
acccaacagaccaccugcc

SEQ ID NO: 1631112 - RNA, 21 nt, Pseudomonas putida KT2440
acccaacagcauccaaagcca

SEQ ID NO: 1631113 - RNA, 16 nt, Pseudomonas putida KT2440
acccaacuccagcgcg

SEQ ID NO: 1631114 - RNA, 22 nt, Pseudomonas putida KT2440
acccacagcgccugcugcugga

SEQ ID NO: 1631115 - RNA, 19 nt, Pseudomonas putida KT2440
acccagaugcgggcccugg

SEQ ID NO: 1631116 - RNA, 10 nt, Pseudomonas putida KT2440
acccagcagg

SEQ ID NO: 1631117 - RNA, 15 nt, Pseudomonas putida KT2440
accccaccagcacug

SEQ ID NO: 1631118 - RNA, 22 nt, Pseudomonas putida KT2440
accccaccagcacugccuugcc

SEQ ID NO: 1631119 - RNA, 17 nt, Pseudomonas putida KT2440
accccacccuugaagac

SEQ ID NO: 1631120 - RNA, 19 nt, Pseudomonas putida KT2440
acccagcggucagcaucuu

SEQ ID NO: 1631121 - RNA, 20 nt, Pseudomonas putida KT2440
accccaacccggucccgccc

SEQ ID NO: 1631122 - RNA, 22 nt, Pseudomonas putida KT2440
accccaaggcugccaaucaacc

SEQ ID NO: 1631123 - RNA, 15 nt, Pseudomonas putida KT2440
accccagcguuccug

SEQ ID NO: 1631124 - RNA, 21 nt, Pseudomonas putida KT2440
accccagcaugaaccgcuccg

SEQ ID NO: 1631125 - RNA, 20 nt, Pseudomonas putida KT2440
accccagcaccacccaccag

SEQ ID NO: 1631126 - RNA, 21 nt, Pseudomonas putida KT2440
accccagccuucagcaggcgc

SEQ ID NO: 1631127 - RNA, 20 nt, Pseudomonas putida KT2440
accccaguugaucaacccgu

SEQ ID NO: 1631128 - RNA, 23 nt, Pseudomonas putida KT2440
accccaguugaucaacccgugcc

SEQ ID NO: 1631129 - RNA, 12 nt, Pseudomonas putida KT2440
accccauccaca

SEQ ID NO: 1631130 - RNA, 16 nt, Pseudomonas putida KT2440
accccauccacaucgc

SEQ ID NO: 1631131 - RNA, 13 nt, Pseudomonas putida KT2440
acccccagcgccu

SEQ ID NO: 1631132 - RNA, 15 nt, Pseudomonas putida KT2440
acccccagcgccucc

SEQ ID NO: 1631133 - RNA, 13 nt, Pseudomonas putida KT2440
accccccagcagc

SEQ ID NO: 1631134 - RNA, 14 nt, Pseudomonas putida KT2440
accccccugcacca

SEQ ID NO: 1631135 - RNA, 11 nt, Pseudomonas putida KT2440
acccccgcucc

SEQ ID NO: 1631136 - RNA, 18 nt, Pseudomonas putida KT2440
accccgaacuucccccuc

SEQ ID NO: 1631137 - RNA, 17 nt, Pseudomonas putida KT2440
acccccgccgccagggc

SEQ ID NO: 1631138 - RNA, 17 nt, Pseudomonas putida KT2440
acccccuugccagcaug

SEQ ID NO: 1631139 - RNA, 20 nt, Pseudomonas putida KT2440
acccccuucaaugccgggaa

SEQ ID NO: 1631140 - RNA, 17 nt, Pseudomonas putida KT2440
accaggcgcagcagcuc

SEQ ID NO: 1631141 - RNA, 20 nt, Pseudomonas putida KT2440
accagggcuggcagcgggua

SEQ ID NO: 1631142 - RNA, 16 nt, Pseudomonas putida KT2440
accagggcgcgcuggc

SEQ ID NO: 1631143 - RNA, 23 nt, Pseudomonas putida KT2440
accaggguggcgauccacagcgg

SEQ ID NO: 1631144 - RNA, 18 nt, Pseudomonas putida KT2440
accagguaaauggucccc

SEQ ID NO: 1631145 - RNA, 22 nt, Pseudomonas putida KT2440
accaggucauaguucuggcugc

SEQ ID NO: 1631146 - RNA, 22 nt, Pseudomonas putida KT2440
accaggucgcggugcagcggga

SEQ ID NO: 1631147 - RNA, 20 nt, Pseudomonas putida KT2440
accaggugguaacuggccag

SEQ ID NO: 1631148 - RNA, 13 nt, Pseudomonas putida KT2440
accaggugcuugc

SEQ ID NO: 1631149 - RNA, 20 nt, Pseudomonas putida KT2440
accagguuggccgccgccag

SEQ ID NO: 1631150 - RNA, 13 nt, Pseudomonas putida KT2440
accagcgccccgc

SEQ ID NO: 1631151 - RNA, 14 nt, Pseudomonas putida KT2440
accagcgccccgcc

SEQ ID NO: 1631152 - RNA, 15 nt, Pseudomonas putida KT2440
accagcgcccuucac

SEQ ID NO: 1631153 - RNA, 11 nt, Pseudomonas putida KT2440
accagcgcugc

SEQ ID NO: 1631154 - RNA, 15 nt, Pseudomonas putida KT2440
accaggcccagcagg

SEQ ID NO: 1631155 - RNA, 23 nt, Pseudomonas putida KT2440
accaucagccuguggguaugcca

SEQ ID NO: 1631156 - RNA, 17 nt, Pseudomonas putida KT2440
accagugcaacguucac

SEQ ID NO: 1631157 - RNA, 21 nt, Pseudomonas putida KT2440
accaguacgaacuacgcgcca

SEQ ID NO: 1631158 - RNA, 15 nt, Pseudomonas putida KT2440
accaguacugggcgu

SEQ ID NO: 1631159 - RNA, 22 nt, Pseudomonas putida KT2440
accaguaguucucgacagccac

SEQ ID NO: 1631160 - RNA, 15 nt, Pseudomonas putida KT2440
accaguaccgcgccu

SEQ ID NO: 1631161 - RNA, 18 nt, Pseudomonas putida KT2440
accaguaccgcgccucca

SEQ ID NO: 1631162 - RNA, 14 nt, Pseudomonas putida KT2440
accaguuccaccgg

SEQ ID NO: 1631163 - RNA, 18 nt, Pseudomonas putida KT2440
accaguucagcgcccgca

SEQ ID NO: 1631164 - RNA, 15 nt, Pseudomonas putida KT2440
accaguucgggaagu

SEQ ID NO: 1631165 - RNA, 13 nt, Pseudomonas putida KT2440
accaguugcucgc

SEQ ID NO: 1631166 - RNA, 13 nt, Pseudomonas putida KT2440
accacccggggca

SEQ ID NO: 1631167 - RNA, 14 nt, Pseudomonas putida KT2440
accaccccggggcg

SEQ ID NO: 1631168 - RNA, 14 nt, Pseudomonas putida KT2440
accaccgcaggugc

SEQ ID NO: 1631169 - RNA, 16 nt, Pseudomonas putida KT2440
accaccgccaaggcac

SEQ ID NO: 1631170 - RNA, 16 nt, Pseudomonas putida KT2440
accaccgcauccgcac

SEQ ID NO: 1631171 - RNA, 19 nt, Pseudomonas putida KT2440
accacccugaugcagcagu

SEQ ID NO: 1631172 - RNA, 13 nt, Pseudomonas putida KT2440
accaccgaccgca

SEQ ID NO: 1631173 - RNA, 19 nt, Pseudomonas putida KT2440
accaccggccgacccgccu

SEQ ID NO: 1631174 - RNA, 22 nt, Pseudomonas putida KT2440
accaccggacgcuugccaccca

SEQ ID NO: 1631175 - RNA, 14 nt, Pseudomonas putida KT2440
accaccgcucaaac

SEQ ID NO: 1631176 - RNA, 21 nt, Pseudomonas putida KT2440
accaccgcgaaacacagcagg

SEQ ID NO: 1631177 - RNA, 18 nt, Pseudomonas putida KT2440
accacggucggccugcgc

SEQ ID NO: 1631178 - RNA, 15 nt, Pseudomonas putida KT2440
accacggccggggcc

SEQ ID NO: 1631179 - RNA, 17 nt, Pseudomonas putida KT2440
accacggccggggccug

SEQ ID NO: 1631180 - RNA, 15 nt, Pseudomonas putida KT2440
accacggccuggccu

SEQ ID NO: 1631181 - RNA, 13 nt, Pseudomonas putida KT2440
accacggcagugg

SEQ ID NO: 1631182 - RNA, 21 nt, Pseudomonas putida KT2440
accacgaucuuggccagggcc

SEQ ID NO: 1631183 - RNA, 16 nt, Pseudomonas putida KT2440
accacgaugcccaugg

SEQ ID NO: 1631184 - RNA, 17 nt, Pseudomonas putida KT2440
accacggaaggccacgc

SEQ ID NO: 1631185 - RNA, 13 nt, Pseudomonas putida KT2440
accagaccagcag

SEQ ID NO: 1631186 - RNA, 14 nt, Pseudomonas putida KT2440
accagaccagcagc

SEQ ID NO: 1631187 - RNA, 19 nt, Pseudomonas putida KT2440
accagacucagcgcuugcc

SEQ ID NO: 1631188 - RNA, 22 nt, Pseudomonas putida KT2440
accagacgggcaugguggaagu

SEQ ID NO: 1631189 - RNA, 14 nt, Pseudomonas putida KT2440
accacugcaggugc

SEQ ID NO: 1631190 - RNA, 23 nt, Pseudomonas putida KT2440
accacugcuucugagccagccgc

SEQ ID NO: 1631191 - RNA, 21 nt, Pseudomonas putida KT2440
accacuggaugacgccgcagc

SEQ ID NO: 1631192 - RNA, 16 nt, Pseudomonas putida KT2440
accacuggugccggca

SEQ ID NO: 1631193 - RNA, 19 nt, Pseudomonas putida KT2440
accacugcaaauaccccag

SEQ ID NO: 1631194 - RNA, 18 nt, Pseudomonas putida KT2440
accacugaugcgcgucca

SEQ ID NO: 1631195 - RNA, 21 nt, Pseudomonas putida KT2440
accagaugaccaaagaucagc

SEQ ID NO: 1631196 - RNA, 13 nt, Pseudomonas putida KT2440
accagaucagccg

SEQ ID NO: 1631197 - RNA, 19 nt, Pseudomonas putida KT2440
accagauaacguccagagg

SEQ ID NO: 1631198 - RNA, 13 nt, Pseudomonas putida KT2440
accagccagccac

SEQ ID NO: 1631199 - RNA, 20 nt, Pseudomonas putida KT2440
accagcaugcgaagccgcca

SEQ ID NO: 1631200 - RNA, 14 nt, Pseudomonas putida KT2440
accagcaucaacag

SEQ ID NO: 1631201 - RNA, 17 nt, Pseudomonas putida KT2440
accagauucaagcccgg

SEQ ID NO: 1631202 - RNA, 22 nt, Pseudomonas putida KT2440
accagcaggucggcacgcaccu

SEQ ID NO: 1631203 - RNA, 13 nt, Pseudomonas putida KT2440
accagcagugccc

SEQ ID NO: 1631204 - RNA, 23 nt, Pseudomonas putida KT2440
accaagggugucaacaggcuggc

SEQ ID NO: 1631205 - RNA, 23 nt, Pseudomonas putida KT2440
accaagucgauuuucacgcccga

SEQ ID NO: 1631206 - RNA, 23 nt, Pseudomonas putida KT2440
accaaggccaacugcgcccgccc

SEQ ID NO: 1631207 - RNA, 21 nt, Pseudomonas putida KT2440
accaccaacagcaccggccag

SEQ ID NO: 1631208 - RNA, 15 nt, Pseudomonas putida KT2440
accacaaaccacagc

SEQ ID NO: 1631209 - RNA, 19 nt, Pseudomonas putida KT2440
accacaaaccacagcggcc

SEQ ID NO: 1631210 - RNA, 22 nt, Pseudomonas putida KT2440
accaaucaacgguggccagcag

SEQ ID NO: 1631211 - RNA, 23 nt, Pseudomonas putida KT2440
accaaucaacgguggccagcagc

SEQ ID NO: 1631212 - RNA, 18 nt, Pseudomonas putida KT2440
accaaucugguuacccaa

SEQ ID NO: 1631213 - RNA, 20 nt, Pseudomonas putida KT2440
acaugguguugggcagggug

SEQ ID NO: 1631214 - RNA, 14 nt, Pseudomonas putida KT2440
acauguaaugaaaa

SEQ ID NO: 1631215 - RNA, 14 nt, Pseudomonas putida KT2440
acauggaucagcuc

SEQ ID NO: 1631216 - RNA, 14 nt, Pseudomonas putida KT2440
acauuucacagcaa

SEQ ID NO: 1631217 - RNA, 18 nt, Pseudomonas putida KT2440
accaacagcaccggccag

SEQ ID NO: 1631218 - RNA, 22 nt, Pseudomonas putida KT2440
accaacaguugaccaaggaacu

SEQ ID NO: 1631219 - RNA, 18 nt, Pseudomonas putida KT2440
acgaucacgcccgggcca

SEQ ID NO: 1631220 - RNA, 23 nt, Pseudomonas putida KT2440
acgaucagcgccgaaccagcaga

SEQ ID NO: 1631221 - RNA, 14 nt, Pseudomonas putida KT2440
acgauccccaccag

SEQ ID NO: 1631222 - RNA, 14 nt, Pseudomonas putida KT2440
acgaucgccagccc

SEQ ID NO: 1631223 - RNA, 20 nt, Pseudomonas putida KT2440
acgaucgacuucaucaccuc

SEQ ID NO: 1631224 - RNA, 12 nt, Pseudomonas putida KT2440
acgagggcagga

SEQ ID NO: 1631225 - RNA, 24 nt, Pseudomonas putida KT2440
acgaugccguacaccaugcucagg

SEQ ID NO: 1631226 - RNA, 18 nt, Pseudomonas putida KT2440
acgauggccaccagcacc

SEQ ID NO: 1631227 - RNA, 13 nt, Pseudomonas putida KT2440
acgaucuuggcca

SEQ ID NO: 1631228 - RNA, 17 nt, Pseudomonas putida KT2440
acgcaaauccuccugcg

SEQ ID NO: 1631229 - RNA, 22 nt, Pseudomonas putida KT2440
acgcaacaggucgaccugcccg

SEQ ID NO: 1631230 - RNA, 15 nt, Pseudomonas putida KT2440
acgauuucagcggua

SEQ ID NO: 1631231 - RNA, 14 nt, Pseudomonas putida KT2440
acgauucugccagc

SEQ ID NO: 1631232 - RNA, 21 nt, Pseudomonas putida KT2440
acgaaucauccucgacaccca

SEQ ID NO: 1631233 - RNA, 16 nt, Pseudomonas putida KT2440
acgaaucugcagugcc

SEQ ID NO: 1631234 - RNA, 18 nt, Pseudomonas putida KT2440
acgacagcuuguugccag

SEQ ID NO: 1631235 - RNA, 22 nt, Pseudomonas putida KT2440
acgacaagguagcggccagccc

SEQ ID NO: 1631236 - RNA, 20 nt, Pseudomonas putida KT2440
acgacaaacuccuugaaauu

SEQ ID NO: 1631237 - RNA, 11 nt, Pseudomonas putida KT2440
acgaacagugg

SEQ ID NO: 1631238 - RNA, 15 nt, Pseudomonas putida KT2440
acgaacaucagcagg

SEQ ID NO: 1631239 - RNA, 18 nt, Pseudomonas putida KT2440
acgaacaccagccccagc

SEQ ID NO: 1631240 - RNA, 15 nt, Pseudomonas putida KT2440
acgaacccuugaccu

SEQ ID NO: 1631241 - RNA, 21 nt, Pseudomonas putida KT2440
acgaagccguugaggccgaac

SEQ ID NO: 1631242 - RNA, 14 nt, Pseudomonas putida KT2440
acgaagcgcggcaa

SEQ ID NO: 1631243 - RNA, 15 nt, Pseudomonas putida KT2440
acgaaggccagcaaa

SEQ ID NO: 1631244 - RNA, 15 nt, Pseudomonas putida KT2440
acgaaggucuugccg

SEQ ID NO: 1631245 - RNA, 21 nt, Pseudomonas putida KT2440
acgaagccgacccgggccagc

SEQ ID NO: 1631246 - RNA, 22 nt, Pseudomonas putida KT2440
acgaagccaugucuucacgaga

SEQ ID NO: 1631247 - RNA, 19 nt, Pseudomonas putida KT2440
acgacuuguaauugaaguu

SEQ ID NO: 1631248 - RNA, 19 nt, Pseudomonas putida KT2440
acgagacgguggcugccag

SEQ ID NO: 1631249 - RNA, 17 nt, Pseudomonas putida KT2440
acgacgugucagugguc

SEQ ID NO: 1631250 - RNA, 13 nt, Pseudomonas putida KT2440
acgacgcaccagg

SEQ ID NO: 1631251 - RNA, 21 nt, Pseudomonas putida KT2440
acgacggccugcgcccaauca

SEQ ID NO: 1631252 - RNA, 22 nt, Pseudomonas putida KT2440
acgaccaauugguuaaaagcca

SEQ ID NO: 1631253 - RNA, 23 nt, Pseudomonas putida KT2440
acgacccggauaccgacccuaau

SEQ ID NO: 1631254 - RNA, 22 nt, Pseudomonas putida KT2440
acgacgauggccaccagcaccu

SEQ ID NO: 1631255 - RNA, 16 nt, Pseudomonas putida KT2440
acgaaacgccacgccc

SEQ ID NO: 1631256 - RNA, 16 nt, Pseudomonas putida KT2440
acgaacaacgccaccg

SEQ ID NO: 1631257 - RNA, 13 nt, Pseudomonas putida KT2440
acgaaaaagccag

SEQ ID NO: 1631258 - RNA, 19 nt, Pseudomonas putida KT2440
accuuugagugcuucgccc

SEQ ID NO: 1631259 - RNA, 13 nt, Pseudomonas putida KT2440
accuugucagcaa

SEQ ID NO: 1631260 - RNA, 15 nt, Pseudomonas putida KT2440
accuuguccagcagg

SEQ ID NO: 1631261 - RNA, 20 nt, Pseudomonas putida KT2440
accuuggugccaaccuugac

SEQ ID NO: 1631262 - RNA, 23 nt, Pseudomonas putida KT2440
accuuggugccaaccuugaccac

SEQ ID NO: 1631263 - RNA, 18 nt, Pseudomonas putida KT2440
accuugccuuucaucauc

SEQ ID NO: 1631264 - RNA, 20 nt, Pseudomonas putida KT2440
accuugcuggaacugcugca

SEQ ID NO: 1631265 - RNA, 21 nt, Pseudomonas putida KT2440
accuuggcgacauaggcgcgg

SEQ ID NO: 1631266 - RNA, 21 nt, Pseudomonas putida KT2440
accuuggacgcuggcagcuug

SEQ ID NO: 1631267 - RNA, 16 nt, Pseudomonas putida KT2440
accuucacgccagccg

SEQ ID NO: 1631268 - RNA, 15 nt, Pseudomonas putida KT2440
accuuccacucuucc

SEQ ID NO: 1631269 - RNA, 14 nt, Pseudomonas putida KT2440
accuuccagcaaag

SEQ ID NO: 1631270 - RNA, 12 nt, Pseudomonas putida KT2440
accuuccagguc

SEQ ID NO: 1631271 - RNA, 22 nt, Pseudomonas putida KT2440
accuucagcgggucgagccagg

SEQ ID NO: 1631272 - RNA, 23 nt, Pseudomonas putida KT2440
accuuccguuaguucgugcaccc

SEQ ID NO: 1631273 - RNA, 19 nt, Pseudomonas putida KT2440
accuucucggccucagccg

SEQ ID NO: 1631274 - RNA, 14 nt, Pseudomonas putida KT2440
accuucucacugau

SEQ ID NO: 1631275 - RNA, 13 nt, Pseudomonas putida KT2440
accuucuggcagc

SEQ ID NO: 1631276 - RNA, 13 nt, Pseudomonas putida KT2440
accugccgcagcu

SEQ ID NO: 1631277 - RNA, 15 nt, Pseudomonas putida KT2440
accugcggccuggcc

SEQ ID NO: 1631278 - RNA, 23 nt, Pseudomonas putida KT2440
accugcggccuggcccggugcaa

SEQ ID NO: 1631279 - RNA, 13 nt, Pseudomonas putida KT2440
accugcauugcgc

SEQ ID NO: 1631280 - RNA, 13 nt, Pseudomonas putida KT2440
accugccagcccc

SEQ ID NO: 1631281 - RNA, 17 nt, Pseudomonas putida KT2440
accugccagccccgcac

SEQ ID NO: 1631282 - RNA, 18 nt, Pseudomonas putida KT2440
accugccagccccgcaca

SEQ ID NO: 1631283 - RNA, 12 nt, Pseudomonas putida KT2440
accugccaggcc

SEQ ID NO: 1631284 - RNA, 15 nt, Pseudomonas putida KT2440
accugccacugcgcu

SEQ ID NO: 1631285 - RNA, 20 nt, Pseudomonas putida KT2440
accugcacacugcccagcag

SEQ ID NO: 1631286 - RNA, 14 nt, Pseudomonas putida KT2440
accugcaggcgcgg

SEQ ID NO: 1631287 - RNA, 18 nt, Pseudomonas putida KT2440
accugcagguacagcagc

SEQ ID NO: 1631288 - RNA, 22 nt, Pseudomonas putida KT2440
accugcagguacagcagcugca

SEQ ID NO: 1631289 - RNA, 18 nt, Pseudomonas putida KT2440
accuggcucggcugggcu

SEQ ID NO: 1631290 - RNA, 11 nt, Pseudomonas putida KT2440
accuggcucuu

SEQ ID NO: 1631291 - RNA, 15 nt, Pseudomonas putida KT2440
accuggcugcaguga

SEQ ID NO: 1631292 - RNA, 23 nt, Pseudomonas putida KT2440
accugggccaguaccuucuggcu

SEQ ID NO: 1631293 - RNA, 12 nt, Pseudomonas putida KT2440
accuggcugcug

SEQ ID NO: 1631294 - RNA, 18 nt, Pseudomonas putida KT2440
accuggaauaccaccuca

SEQ ID NO: 1631295 - RNA, 19 nt, Pseudomonas putida KT2440
accuggaucgcgccuucau

SEQ ID NO: 1631296 - RNA, 16 nt, Pseudomonas putida KT2440
accuggcccacgccuu

SEQ ID NO: 1631297 - RNA, 22 nt, Pseudomonas putida KT2440
accuggccgcguucgcccaggc

SEQ ID NO: 1631298 - RNA, 19 nt, Pseudomonas putida KT2440
accugcucgcucaggcucu

SEQ ID NO: 1631299 - RNA, 21 nt, Pseudomonas putida KT2440
accugcucgcucaggcucuug

SEQ ID NO: 1631300 - RNA, 19 nt, Pseudomonas putida KT2440
accugcguugcccccagcc

SEQ ID NO: 1631301 - RNA, 15 nt, Pseudomonas putida KT2440
accugcuccagcacc

SEQ ID NO: 1631302 - RNA, 20 nt, Pseudomonas putida KT2440
accugcugggucagcgcuga

SEQ ID NO: 1631303 - RNA, 12 nt, Pseudomonas putida KT2440
accugcuugcug

SEQ ID NO: 1631304 - RNA, 14 nt, Pseudomonas putida KT2440
accugguaccccuc

SEQ ID NO: 1631305 - RNA, 18 nt, Pseudomonas putida KT2440
accugggcgucaucaccc

SEQ ID NO: 1631306 - RNA, 20 nt, Pseudomonas putida KT2440
accugggcgucaucacccgg

SEQ ID NO: 1631307 - RNA, 14 nt, Pseudomonas putida KT2440
accuggcccugcuc

SEQ ID NO: 1631308 - RNA, 21 nt, Pseudomonas putida KT2440
accugggccggguccccggcc

SEQ ID NO: 1631309 - RNA, 14 nt, Pseudomonas putida KT2440
accuggugcgccuu

SEQ ID NO: 1631310 - RNA, 15 nt, Pseudomonas putida KT2440
accugguuguagccc

SEQ ID NO: 1631311 - RNA, 13 nt, Pseudomonas putida KT2440
accugguuugagg

SEQ ID NO: 1631312 - RNA, 18 nt, Pseudomonas putida KT2440
accugguuugaggaaugu

SEQ ID NO: 1631313 - RNA, 20 nt, Pseudomonas putida KT2440
accuguggguugcucggcac

SEQ ID NO: 1631314 - RNA, 12 nt, Pseudomonas putida KT2440
accugugcugaa

SEQ ID NO: 1631315 - RNA, 20 nt, Pseudomonas putida KT2440
accugugcacagccgugccu

SEQ ID NO: 1631316 - RNA, 13 nt, Pseudomonas putida KT2440
accugucgcucuu

SEQ ID NO: 1631317 - RNA, 18 nt, Pseudomonas putida KT2440
accugugguggcugcuuc

SEQ ID NO: 1631318 - RNA, 23 nt, Pseudomonas putida KT2440
accugugguuucacacucgccag

SEQ ID NO: 1631319 - RNA, 15 nt, Pseudomonas putida KT2440
accuguuucuugucu

SEQ ID NO: 1631320 - RNA, 14 nt, Pseudomonas putida KT2440
accuuacuugcaca

SEQ ID NO: 1631321 - RNA, 22 nt, Pseudomonas putida KT2440
accuucaacaccaacuugccaa

SEQ ID NO: 1631322 - RNA, 16 nt, Pseudomonas putida KT2440
accuuaucggccggca

SEQ ID NO: 1631323 - RNA, 17 nt, Pseudomonas putida KT2440
accucugcggccuucaa

SEQ ID NO: 1631324 - RNA, 19 nt, Pseudomonas putida KT2440
accucugguuuugucggcc

SEQ ID NO: 1631325 - RNA, 20 nt, Pseudomonas putida KT2440
accucggccagugcgcccga

SEQ ID NO: 1631326 - RNA, 13 nt, Pseudomonas putida KT2440
accucggccgcau

SEQ ID NO: 1631327 - RNA, 17 nt, Pseudomonas putida KT2440
accucgcucagcuugaa

SEQ ID NO: 1631328 - RNA, 13 nt, Pseudomonas putida KT2440
accugaccaucag

SEQ ID NO: 1631329 - RNA, 17 nt, Pseudomonas putida KT2440
accugaccaucagccug

SEQ ID NO: 1631330 - RNA, 16 nt, Pseudomonas putida KT2440
accugaacaaggccug

SEQ ID NO: 1631331 - RNA, 17 nt, Pseudomonas putida KT2440
accugaacaaggccugg

SEQ ID NO: 1631332 - RNA, 17 nt, Pseudomonas putida KT2440
accugauguacaaggac

SEQ ID NO: 1631333 - RNA, 23 nt, Pseudomonas putida KT2440
accugauguacaaggaccucaag

SEQ ID NO: 1631334 - RNA, 21 nt, Pseudomonas putida KT2440
accugagucaggcgcccugcc

SEQ ID NO: 1631335 - RNA, 13 nt, Pseudomonas putida KT2440
accucgacccgcc

SEQ ID NO: 1631336 - RNA, 14 nt, Pseudomonas putida KT2440
accuccgccaacug

SEQ ID NO: 1631337 - RNA, 19 nt, Pseudomonas putida KT2440
accucccgcacugcugccg

SEQ ID NO: 1631338 - RNA, 22 nt, Pseudomonas putida KT2440
accuccaggucauccgcacgca

SEQ ID NO: 1631339 - RNA, 14 nt, Pseudomonas putida KT2440
accuccagcccggc

SEQ ID NO: 1631340 - RNA, 19 nt, Pseudomonas putida KT2440
accuccagcccggcuucac

SEQ ID NO: 1631341 - RNA, 12 nt, Pseudomonas putida KT2440
accuccaccuuc

SEQ ID NO: 1631342 - RNA, 18 nt, Pseudomonas putida KT2440
accucauaguaaggcugg

SEQ ID NO: 1631343 - RNA, 18 nt, Pseudomonas putida KT2440
accucaggccugcacugc

SEQ ID NO: 1631344 - RNA, 16 nt, Pseudomonas putida KT2440
accucaucggcauugc

SEQ ID NO: 1631345 - RNA, 19 nt, Pseudomonas putida KT2440
accucaucggcauugcuga

SEQ ID NO: 1631346 - RNA, 12 nt, Pseudomonas putida KT2440
accucaccgccg

SEQ ID NO: 1631347 - RNA, 13 nt, Pseudomonas putida KT2440
accucaaguuccc

SEQ ID NO: 1631348 - RNA, 21 nt, Pseudomonas putida KT2440
accucaaaugcgcccugcugc

SEQ ID NO: 1631349 - RNA, 24 nt, Pseudomonas putida KT2440
accuaucaggagcaacuaccauga

SEQ ID NO: 1631350 - RNA, 23 nt, Pseudomonas putida KT2440
accguugcgcucgagcccgccag

SEQ ID NO: 1631351 - RNA, 16 nt, Pseudomonas putida KT2440
accguuggcaucugcu

SEQ ID NO: 1631352 - RNA, 14 nt, Pseudomonas putida KT2440
accuaccccuccug

SEQ ID NO: 1631353 - RNA, 21 nt, Pseudomonas putida KT2440
accuacgaccaauugguuaaa

SEQ ID NO: 1631354 - RNA, 13 nt, Pseudomonas putida KT2440
accguccacaccg

SEQ ID NO: 1631355 - RNA, 15 nt, Pseudomonas putida KT2440
accguauuaaggcaa

SEQ ID NO: 1631356 - RNA, 20 nt, Pseudomonas putida KT2440
accguacugguaaugcucuc

SEQ ID NO: 1631357 - RNA, 16 nt, Pseudomonas putida KT2440
accguacuugcugcag

SEQ ID NO: 1631358 - RNA, 19 nt, Pseudomonas putida KT2440
accgugcccgcccacgccg

SEQ ID NO: 1631359 - RNA, 17 nt, Pseudomonas putida KT2440
accgugcauacacccgg

SEQ ID NO: 1631360 - RNA, 19 nt, Pseudomonas putida KT2440
accgugcauacacccgguc

SEQ ID NO: 1631361 - RNA, 20 nt, Pseudomonas putida KT2440
accgugcaccagcaccaccg

SEQ ID NO: 1631362 - RNA, 18 nt, Pseudomonas putida KT2440
accgugggcgcaacaucg

SEQ ID NO: 1631363 - RNA, 18 nt, Pseudomonas putida KT2440
accguggcguauugcugg

SEQ ID NO: 1631364 - RNA, 19 nt, Pseudomonas putida KT2440
accgugaaaccgaaaaagc

SEQ ID NO: 1631365 - RNA, 16 nt, Pseudomonas putida KT2440
accgguggccugagcc

SEQ ID NO: 1631366 - RNA, 18 nt, Pseudomonas putida KT2440
accggucauggcgcgcca

SEQ ID NO: 1631367 - RNA, 16 nt, Pseudomonas putida KT2440
accggggcaggcugug

SEQ ID NO: 1631368 - RNA, 13 nt, Pseudomonas putida KT2440
accgggucuugaa

SEQ ID NO: 1631369 - RNA, 18 nt, Pseudomonas putida KT2440
accggguaggccccaggg

SEQ ID NO: 1631370 - RNA, 15 nt, Pseudomonas putida KT2440
accggguccagcaac

SEQ ID NO: 1631371 - RNA, 18 nt, Pseudomonas putida KT2440
accgggauggcggcgccu

SEQ ID NO: 1631372 - RNA, 15 nt, Pseudomonas putida KT2440
accggcuuguagccg

SEQ ID NO: 1631373 - RNA, 15 nt, Pseudomonas putida KT2440
accggcuguuggccu

SEQ ID NO: 1631374 - RNA, 19 nt, Pseudomonas putida KT2440
accggcccugaaggccgcu

SEQ ID NO: 1631375 - RNA, 21 nt, Pseudomonas putida KT2440
accggcccugaaggccgcucc

SEQ ID NO: 1631376 - RNA, 21 nt, Pseudomonas putida KT2440
accggccccccagccagcaga

SEQ ID NO: 1631377 - RNA, 22 nt, Pseudomonas putida KT2440
accggccgccgccagaccaccu

SEQ ID NO: 1631378 - RNA, 17 nt, Pseudomonas putida KT2440
accggccgggcuucaac

SEQ ID NO: 1631379 - RNA, 17 nt, Pseudomonas putida KT2440
accggcgaguccugccu

SEQ ID NO: 1631380 - RNA, 18 nt, Pseudomonas putida KT2440
accggcgaguccugccuu

SEQ ID NO: 1631381 - RNA, 14 nt, Pseudomonas putida KT2440
accggccuugcgca

SEQ ID NO: 1631382 - RNA, 13 nt, Pseudomonas putida KT2440
accggcgccgccc

SEQ ID NO: 1631383 - RNA, 23 nt, Pseudomonas putida KT2440
accggcuccaccugcuccagcac

SEQ ID NO: 1631384 - RNA, 23 nt, Pseudomonas putida KT2440
accggcucccccuccacccgguc

SEQ ID NO: 1631385 - RNA, 14 nt, Pseudomonas putida KT2440
accggccagcugcg

SEQ ID NO: 1631386 - RNA, 17 nt, Pseudomonas putida KT2440
accggccacgcgcgccu

SEQ ID NO: 1631387 - RNA, 18 nt, Pseudomonas putida KT2440
accggcaggcgcuucagg

SEQ ID NO: 1631388 - RNA, 13 nt, Pseudomonas putida KT2440
accggcagcaccu

SEQ ID NO: 1631389 - RNA, 21 nt, Pseudomonas putida KT2440
accggcagcaccugccagccg

SEQ ID NO: 1631390 - RNA, 18 nt, Pseudomonas putida KT2440
accggcaguagaaagucc

SEQ ID NO: 1631391 - RNA, 19 nt, Pseudomonas putida KT2440
accgcuucaccgcgcaccu

SEQ ID NO: 1631392 - RNA, 16 nt, Pseudomonas putida KT2440
accggcaagcccaugg

SEQ ID NO: 1631393 - RNA, 17 nt, Pseudomonas putida KT2440
accggcaagcccauggc

SEQ ID NO: 1631394 - RNA, 14 nt, Pseudomonas putida KT2440
accggcaccgccuc

SEQ ID NO: 1631395 - RNA, 18 nt, Pseudomonas putida KT2440
accggcaccugcuugccg

SEQ ID NO: 1631396 - RNA, 12 nt, Pseudomonas putida KT2440
accggcacggca

SEQ ID NO: 1631397 - RNA, 18 nt, Pseudomonas putida KT2440
accggcaaucgacucaag

SEQ ID NO: 1631398 - RNA, 13 nt, Pseudomonas putida KT2440
accggcaccaucu

SEQ ID NO: 1631399 - RNA, 19 nt, Pseudomonas putida KT2440
accgauuaccuguuucuug

SEQ ID NO: 1631400 - RNA, 13 nt, Pseudomonas putida KT2440
accgcacccggcu

SEQ ID NO: 1631401 - RNA, 23 nt, Pseudomonas putida KT2440
accgcacccggcuaccaaucugu

SEQ ID NO: 1631402 - RNA, 17 nt, Pseudomonas putida KT2440
accgcacuccccaucag

SEQ ID NO: 1631403 - RNA, 18 nt, Pseudomonas putida KT2440
accgcacuccccaucagc

SEQ ID NO: 1631404 - RNA, 22 nt, Pseudomonas putida KT2440
accgcacuccccaucagcagcu

SEQ ID NO: 1631405 - RNA, 21 nt, Pseudomonas putida KT2440
accgcacucugcugcucugcc

SEQ ID NO: 1631406 - RNA, 16 nt, Pseudomonas putida KT2440
accgccaacgaaucag

SEQ ID NO: 1631407 - RNA, 16 nt, Pseudomonas putida KT2440
accgcauugcaggcca

SEQ ID NO: 1631408 - RNA, 13 nt, Pseudomonas putida KT2440
accgccaccaucg

SEQ ID NO: 1631409 - RNA, 13 nt, Pseudomonas putida KT2440
accccugcgccug

SEQ ID NO: 1631410 - RNA, 14 nt, Pseudomonas putida KT2440
accccugccaccag

SEQ ID NO: 1631411 - RNA, 16 nt, Pseudomonas putida KT2440
accccugccaccaguu

SEQ ID NO: 1631412 - RNA, 17 nt, Pseudomonas putida KT2440
accgaucucgccagccu

SEQ ID NO: 1631413 - RNA, 13 nt, Pseudomonas putida KT2440
accgaugcugugc

SEQ ID NO: 1631414 - RNA, 20 nt, Pseudomonas putida KT2440
accgauggugugguagcugu

SEQ ID NO: 1631415 - RNA, 18 nt, Pseudomonas putida KT2440
accccgcaggccgcagcc

SEQ ID NO: 1631416 - RNA, 22 nt, Pseudomonas putida KT2440
accccguguacgacugccgccc

SEQ ID NO: 1631417 - RNA, 14 nt, Pseudomonas putida KT2440
accccuccagcaca

SEQ ID NO: 1631418 - RNA, 18 nt, Pseudomonas putida KT2440
accccucgacgccuuggc

SEQ ID NO: 1631419 - RNA, 14 nt, Pseudomonas putida KT2440
accccucgcugccc

SEQ ID NO: 1631420 - RNA, 15 nt, Pseudomonas putida KT2440
accccucgcugccca

SEQ ID NO: 1631421 - RNA, 19 nt, Pseudomonas putida KT2440
accgccggcucgucacugc

SEQ ID NO: 1631422 - RNA, 21 nt, Pseudomonas putida KT2440
accgccggcucgucacugccg

SEQ ID NO: 1631423 - RNA, 16 nt, Pseudomonas putida KT2440
accgccgucaacucgc

SEQ ID NO: 1631424 - RNA, 15 nt, Pseudomonas putida KT2440
accgccguccaccau

SEQ ID NO: 1631425 - RNA, 15 nt, Pseudomonas putida KT2440
accgccccagcgcgc

SEQ ID NO: 1631426 - RNA, 17 nt, Pseudomonas putida KT2440
accgccucgaccuggcc

SEQ ID NO: 1631427 - RNA, 15 nt, Pseudomonas putida KT2440
accgcgaagcaggcu

SEQ ID NO: 1631428 - RNA, 16 nt, Pseudomonas putida KT2440
accgcgaagcaggcug

SEQ ID NO: 1631429 - RNA, 21 nt, Pseudomonas putida KT2440
accgcgaaacacagcaggcca

SEQ ID NO: 1631430 - RNA, 20 nt, Pseudomonas putida KT2440
accgcugguggcguggcugc

SEQ ID NO: 1631431 - RNA, 22 nt, Pseudomonas putida KT2440
accgcugucggucacagcagug

SEQ ID NO: 1631432 - RNA, 15 nt, Pseudomonas putida KT2440
accgcuggccgccac

SEQ ID NO: 1631433 - RNA, 19 nt, Pseudomonas putida KT2440
accgcuggcgccugcggca

SEQ ID NO: 1631434 - RNA, 15 nt, Pseudomonas putida KT2440
accgcugccagcugc

SEQ ID NO: 1631435 - RNA, 20 nt, Pseudomonas putida KT2440
accgcugccagcugcgcugc

SEQ ID NO: 1631436 - RNA, 13 nt, Pseudomonas putida KT2440
accgcuccgggua

SEQ ID NO: 1631437 - RNA, 19 nt, Pseudomonas putida KT2440
accgcuccggguacuucuc

SEQ ID NO: 1631438 - RNA, 20 nt, Pseudomonas putida KT2440
accgcucgaacaagcgcgac

SEQ ID NO: 1631439 - RNA, 22 nt, Pseudomonas putida KT2440
accgcucgaagauauccgccug

SEQ ID NO: 1631440 - RNA, 16 nt, Pseudomonas putida KT2440
accgcuccgacaaaug

SEQ ID NO: 1631441 - RNA, 23 nt, Pseudomonas putida KT2440
accgcgcuuugugugcccaccag

SEQ ID NO: 1631442 - RNA, 19 nt, Pseudomonas putida KT2440
aacccauacgcaugaaguc

SEQ ID NO: 1631443 - RNA, 14 nt, Pseudomonas putida KT2440
aaccaugcaggucg

SEQ ID NO: 1631444 - RNA, 20 nt, Pseudomonas putida KT2440
aaccauggcgucaggcguuu

SEQ ID NO: 1631445 - RNA, 16 nt, Pseudomonas putida KT2440
aaccagucauccucag

SEQ ID NO: 1631446 - RNA, 17 nt, Pseudomonas putida KT2440
aaccacccugaugcagc

SEQ ID NO: 1631447 - RNA, 21 nt, Pseudomonas putida KT2440
aaccacccugaugcagcagug

SEQ ID NO: 1631448 - RNA, 23 nt, Pseudomonas putida KT2440
aaccaccgcucaaacccggcagc

SEQ ID NO: 1631449 - RNA, 14 nt, Pseudomonas putida KT2440
aaccacacacucuu

SEQ ID NO: 1631450 - RNA, 13 nt, Pseudomonas putida KT2440
aaccacagcggcc

SEQ ID NO: 1631451 - RNA, 21 nt, Pseudomonas putida KT2440
aaccacaucggcgcgcccucc

SEQ ID NO: 1631452 - RNA, 14 nt, Pseudomonas putida KT2440
aaccaccaacagca

SEQ ID NO: 1631453 - RNA, 12 nt, Pseudomonas putida KT2440
aaccagccagcc

SEQ ID NO: 1631454 - RNA, 14 nt, Pseudomonas putida KT2440
aaccagcagcgccu

SEQ ID NO: 1631455 - RNA, 22 nt, Pseudomonas putida KT2440
aaccagcagaaccccacucucc

SEQ ID NO: 1631456 - RNA, 15 nt, Pseudomonas putida KT2440
aaccaggcgcagcag

SEQ ID NO: 1631457 - RNA, 15 nt, Pseudomonas putida KT2440
aaccggaaucugcuc

SEQ ID NO: 1631458 - RNA, 19 nt, Pseudomonas putida KT2440
aaccggcaaacgcggucag

SEQ ID NO: 1631459 - RNA, 19 nt, Pseudomonas putida KT2440
aaccgcacccggcuaccaa

SEQ ID NO: 1631460 - RNA, 13 nt, Pseudomonas putida KT2440
aaccgccagcagu

SEQ ID NO: 1631461 - RNA, 12 nt, Pseudomonas putida KT2440
aaccgcgcuggu

SEQ ID NO: 1631462 - RNA, 18 nt, Pseudomonas putida KT2440
aaccgcgcugguaagccu

SEQ ID NO: 1631463 - RNA, 18 nt, Pseudomonas putida KT2440
aaccgcggcugacgaagc

SEQ ID NO: 1631464 - RNA, 17 nt, Pseudomonas putida KT2440
aaccgcgccagcuccac

SEQ ID NO: 1631465 - RNA, 19 nt, Pseudomonas putida KT2440
aaccgcgauaucagcgcca

SEQ ID NO: 1631466 - RNA, 12 nt, Pseudomonas putida KT2440
aaccgccuccac

SEQ ID NO: 1631467 - RNA, 17 nt, Pseudomonas putida KT2440
aaccgccuccacgguca

SEQ ID NO: 1631468 - RNA, 23 nt, Pseudomonas putida KT2440
aacccuucgcggguaaacccgcu

SEQ ID NO: 1631469 - RNA, 14 nt, Pseudomonas putida KT2440
aacccuucucuucc

SEQ ID NO: 1631470 - RNA, 23 nt, Pseudomonas putida KT2440
aacccuugcagcgccugugagau

SEQ ID NO: 1631471 - RNA, 21 nt, Pseudomonas putida KT2440
aacccucgaccucgaucucga

SEQ ID NO: 1631472 - RNA, 15 nt, Pseudomonas putida KT2440
aaccccuggaaaccc

SEQ ID NO: 1631473 - RNA, 18 nt, Pseudomonas putida KT2440
aacccgacaacagcugca

SEQ ID NO: 1631474 - RNA, 22 nt, Pseudomonas putida KT2440
aaccccugauguggcugcaccc

SEQ ID NO: 1631475 - RNA, 19 nt, Pseudomonas putida KT2440
aaccccugcaaggccagcg

SEQ ID NO: 1631476 - RNA, 12 nt, Pseudomonas putida KT2440
aaccccacgccu

SEQ ID NO: 1631477 - RNA, 19 nt, Pseudomonas putida KT2440
aacccagcuugaagcggcc

SEQ ID NO: 1631478 - RNA, 22 nt, Pseudomonas putida KT2440
aacccgguuggggacggcagcc

SEQ ID NO: 1631479 - RNA, 19 nt, Pseudomonas putida KT2440
aacccgauuacaagggccu

SEQ ID NO: 1631480 - RNA, 20 nt, Pseudomonas putida KT2440
aacccgauuucgcuggggcu

SEQ ID NO: 1631481 - RNA, 15 nt, Pseudomonas putida KT2440
aacccggcaaugguc

SEQ ID NO: 1631482 - RNA, 10 nt, Pseudomonas putida KT2440
aacccgcucc

SEQ ID NO: 1631483 - RNA, 21 nt, Pseudomonas putida KT2440
aacccgcuccuacaaagcggc

SEQ ID NO: 1631484 - RNA, 13 nt, Pseudomonas putida KT2440
aacccggccagca

SEQ ID NO: 1631485 - RNA, 19 nt, Pseudomonas putida KT2440
aacccggccagcaggucag

SEQ ID NO: 1631486 - RNA, 13 nt, Pseudomonas putida KT2440
aacccggccaggc

SEQ ID NO: 1631487 - RNA, 14 nt, Pseudomonas putida KT2440
aacccggccaggcc

SEQ ID NO: 1631488 - RNA, 17 nt, Pseudomonas putida KT2440
aacauguuuucaguauc

SEQ ID NO: 1631489 - RNA, 17 nt, Pseudomonas putida KT2440
aacaugccacggccuuc

SEQ ID NO: 1631490 - RNA, 20 nt, Pseudomonas putida KT2440
aacaugccacggccuucuuc

SEQ ID NO: 1631491 - RNA, 23 nt, Pseudomonas putida KT2440
aaccaaggugcuaccggcgccac

SEQ ID NO: 1631492 - RNA, 16 nt, Pseudomonas putida KT2440
aacauucaccagccag

SEQ ID NO: 1631493 - RNA, 19 nt, Pseudomonas putida KT2440
aacauucaccagccaggca

SEQ ID NO: 1631494 - RNA, 23 nt, Pseudomonas putida KT2440
aacaucagcaggaagcagaugaa

SEQ ID NO: 1631495 - RNA, 15 nt, Pseudomonas putida KT2440
aacaucaggucugcc

SEQ ID NO: 1631496 - RNA, 19 nt, Pseudomonas putida KT2440
aacaguggcccgaugauca

SEQ ID NO: 1631497 - RNA, 21 nt, Pseudomonas putida KT2440
aacaguggcccgaugaucagg

SEQ ID NO: 1631498 - RNA, 19 nt, Pseudomonas putida KT2440
aacaguuucuugccuucca

SEQ ID NO: 1631499 - RNA, 17 nt, Pseudomonas putida KT2440
aacaguuuucaaugcug

SEQ ID NO: 1631500 - RNA, 15 nt, Pseudomonas putida KT2440
aacagggaaacaaau

SEQ ID NO: 1631501 - RNA, 20 nt, Pseudomonas putida KT2440
aacaggucgccgcuguucag

SEQ ID NO: 1631502 - RNA, 17 nt, Pseudomonas putida KT2440
aacaggcugauguugau

SEQ ID NO: 1631503 - RNA, 11 nt, Pseudomonas putida KT2440
aacagcugcau

SEQ ID NO: 1631504 - RNA, 15 nt, Pseudomonas putida KT2440
aacaggaacagcgug

SEQ ID NO: 1631505 - RNA, 15 nt, Pseudomonas putida KT2440
aacagcuccagcaac

SEQ ID NO: 1631506 - RNA, 21 nt, Pseudomonas putida KT2440
aacagcgucaugcgguacagc

SEQ ID NO: 1631507 - RNA, 19 nt, Pseudomonas putida KT2440
aacagcucuggcagcagug

SEQ ID NO: 1631508 - RNA, 18 nt, Pseudomonas putida KT2440
aacagcucgauggccagg

SEQ ID NO: 1631509 - RNA, 20 nt, Pseudomonas putida KT2440
aacagcuggcgcaugacuuc

SEQ ID NO: 1631510 - RNA, 12 nt, Pseudomonas putida KT2440
aacagcugcgcg

SEQ ID NO: 1631511 - RNA, 13 nt, Pseudomonas putida KT2440
aacagcuucaaca

SEQ ID NO: 1631512 - RNA, 19 nt, Pseudomonas putida KT2440
aacagcuucaacaaggucu

SEQ ID NO: 1631513 - RNA, 19 nt, Pseudomonas putida KT2440
aacagcgcgcgaaucacca

SEQ ID NO: 1631514 - RNA, 19 nt, Pseudomonas putida KT2440
aacagcgcgacgcagcagc

SEQ ID NO: 1631515 - RNA, 22 nt, Pseudomonas putida KT2440
aacagcgcccagaucagcagca

SEQ ID NO: 1631516 - RNA, 23 nt, Pseudomonas putida KT2440
aacagccuaagguugcuccugca

SEQ ID NO: 1631517 - RNA, 16 nt, Pseudomonas putida KT2440
aacagcaccggccagg

SEQ ID NO: 1631518 - RNA, 17 nt, Pseudomonas putida KT2440
aacagcacccgcccauc

SEQ ID NO: 1631519 - RNA, 11 nt, Pseudomonas putida KT2440
aacagcaccag

SEQ ID NO: 1631520 - RNA, 21 nt, Pseudomonas putida KT2440
aacagccccaucaccagcccg

SEQ ID NO: 1631521 - RNA, 20 nt, Pseudomonas putida KT2440
aacagccgcgcaugcugugc

SEQ ID NO: 1631522 - RNA, 21 nt, Pseudomonas putida KT2440
aacagccgcgcaugcugugcc

SEQ ID NO: 1631523 - RNA, 19 nt, Pseudomonas putida KT2440
aacagcaguugcugcugcc

SEQ ID NO: 1631524 - RNA, 15 nt, Pseudomonas putida KT2440
aacagcauccagcgc

SEQ ID NO: 1631525 - RNA, 12 nt, Pseudomonas putida KT2440
aacagccacagc

SEQ ID NO: 1631526 - RNA, 13 nt, Pseudomonas putida KT2440
aacagccacagcu

SEQ ID NO: 1631527 - RNA, 21 nt, Pseudomonas putida KT2440
aacacgggcgaagcccgugcc

SEQ ID NO: 1631528 - RNA, 18 nt, Pseudomonas putida KT2440
aacacgcucaugaacagc

SEQ ID NO: 1631529 - RNA, 21 nt, Pseudomonas putida KT2440
aacacgacgauggccaccagc

SEQ ID NO: 1631530 - RNA, 23 nt, Pseudomonas putida KT2440
aacacgacgauggccaccagcac

SEQ ID NO: 1631531 - RNA, 14 nt, Pseudomonas putida KT2440
aacacgcaggucuu

SEQ ID NO: 1631532 - RNA, 13 nt, Pseudomonas putida KT2440
aacagacaacauc

SEQ ID NO: 1631533 - RNA, 13 nt, Pseudomonas putida KT2440
aacaccagcagcc

SEQ ID NO: 1631534 - RNA, 14 nt, Pseudomonas putida KT2440
aacaccacacuagc

SEQ ID NO: 1631535 - RNA, 23 nt, Pseudomonas putida KT2440
aacaccaccgcgaaacacagcag

SEQ ID NO: 1631536 - RNA, 17 nt, Pseudomonas putida KT2440
aacacauccucaaaggc

SEQ ID NO: 1631537 - RNA, 11 nt, Pseudomonas putida KT2440
aacacauccag

SEQ ID NO: 1631538 - RNA, 17 nt, Pseudomonas putida KT2440
aacacaggcacaaaaaa

SEQ ID NO: 1631539 - RNA, 16 nt, Pseudomonas putida KT2440
aacacccagucgccuu

SEQ ID NO: 1631540 - RNA, 15 nt, Pseudomonas putida KT2440
aacaccaggguggga

SEQ ID NO: 1631541 - RNA, 21 nt, Pseudomonas putida KT2440
aacaccggccccccagccagc

SEQ ID NO: 1631542 - RNA, 21 nt, Pseudomonas putida KT2440
aacacgaacaucagcaggaag

SEQ ID NO: 1631543 - RNA, 15 nt, Pseudomonas putida KT2440
aacaccugccgcagc

SEQ ID NO: 1631544 - RNA, 19 nt, Pseudomonas putida KT2440
aacaaucucggucugucaa

SEQ ID NO: 1631545 - RNA, 18 nt, Pseudomonas putida KT2440
aacaauuuucgaccaagg

SEQ ID NO: 1631546 - RNA, 12 nt, Pseudomonas putida KT2440
aacacacgcucc

SEQ ID NO: 1631547 - RNA, 20 nt, Pseudomonas putida KT2440
aacaauuuaguauggaaaug

SEQ ID NO: 1631548 - RNA, 14 nt, Pseudomonas putida KT2440
aacaaggcucagcu

SEQ ID NO: 1631549 - RNA, 11 nt, Pseudomonas putida KT2440
aacaaggcacg

SEQ ID NO: 1631550 - RNA, 12 nt, Pseudomonas putida KT2440
aacaaggcacga

SEQ ID NO: 1631551 - RNA, 22 nt, Pseudomonas putida KT2440
aacaacuugguccggucacugc

SEQ ID NO: 1631552 - RNA, 20 nt, Pseudomonas putida KT2440
aacaacuugugcaucaaguc

SEQ ID NO: 1631553 - RNA, 13 nt, Pseudomonas putida KT2440
aacaaccgugaau

SEQ ID NO: 1631554 - RNA, 15 nt, Pseudomonas putida KT2440
aaauuggccagcagg

SEQ ID NO: 1631555 - RNA, 12 nt, Pseudomonas putida KT2440
aagaaaaacccg

SEQ ID NO: 1631556 - RNA, 21 nt, Pseudomonas putida KT2440
aagaagccggcaucgccaaca

SEQ ID NO: 1631557 - RNA, 18 nt, Pseudomonas putida KT2440
aagaagccgacccacuug

SEQ ID NO: 1631558 - RNA, 13 nt, Pseudomonas putida KT2440
aagaaggcgaaua

SEQ ID NO: 1631559 - RNA, 12 nt, Pseudomonas putida KT2440
aagaaggcgagc

SEQ ID NO: 1631560 - RNA, 10 nt, Pseudomonas putida KT2440
aagaaggcau

SEQ ID NO: 1631561 - RNA, 14 nt, Pseudomonas putida KT2440
aagaaggagagccu

SEQ ID NO: 1631562 - RNA, 15 nt, Pseudomonas putida KT2440
aagaacaccugcagc

SEQ ID NO: 1631563 - RNA, 14 nt, Pseudomonas putida KT2440
aagaacagacccau

SEQ ID NO: 1631564 - RNA, 23 nt, Pseudomonas putida KT2440
aacuugcccgcguacucggccag

SEQ ID NO: 1631565 - RNA, 16 nt, Pseudomonas putida KT2440
aacuugacguccagcu

SEQ ID NO: 1631566 - RNA, 17 nt, Pseudomonas putida KT2440
aacuuuacggcugaugg

SEQ ID NO: 1631567 - RNA, 20 nt, Pseudomonas putida KT2440
aacuuacaucugcgacugca

SEQ ID NO: 1631568 - RNA, 15 nt, Pseudomonas putida KT2440
aacuucccucugccu

SEQ ID NO: 1631569 - RNA, 13 nt, Pseudomonas putida KT2440
aacuucuccagcg

SEQ ID NO: 1631570 - RNA, 19 nt, Pseudomonas putida KT2440
aacuggaugauccagccca

SEQ ID NO: 1631571 - RNA, 12 nt, Pseudomonas putida KT2440
aacuggccagca

SEQ ID NO: 1631572 - RNA, 12 nt, Pseudomonas putida KT2440
aacuggccaggg

SEQ ID NO: 1631573 - RNA, 16 nt, Pseudomonas putida KT2440
aacuggccaggguacu

SEQ ID NO: 1631574 - RNA, 15 nt, Pseudomonas putida KT2440
aacuggcccacccgg

SEQ ID NO: 1631575 - RNA, 18 nt, Pseudomonas putida KT2440
aacuggcgcagcaggucc

SEQ ID NO: 1631576 - RNA, 17 nt, Pseudomonas putida KT2440
aacuggucggccuugcc

SEQ ID NO: 1631577 - RNA, 23 nt, Pseudomonas putida KT2440
aacuggggcugcaccgcagcccc

SEQ ID NO: 1631578 - RNA, 15 nt, Pseudomonas putida KT2440
aacuggcgcccggca

SEQ ID NO: 1631579 - RNA, 19 nt, Pseudomonas putida KT2440
aacuguacugacugacguc

SEQ ID NO: 1631580 - RNA, 16 nt, Pseudomonas putida KT2440
aacuguuucugcucuu

SEQ ID NO: 1631581 - RNA, 17 nt, Pseudomonas putida KT2440
aacuguuucugcucuuc

SEQ ID NO: 1631582 - RNA, 23 nt, Pseudomonas putida KT2440
aacuguuucugcucuucugccag

SEQ ID NO: 1631583 - RNA, 13 nt, Pseudomonas putida KT2440
aacugaucagcuu

SEQ ID NO: 1631584 - RNA, 13 nt, Pseudomonas putida KT2440
aacugaugaccgg

SEQ ID NO: 1631585 - RNA, 23 nt, Pseudomonas putida KT2440
aacugccaauugcggacucauag

SEQ ID NO: 1631586 - RNA, 22 nt, Pseudomonas putida KT2440
aacugcccaggaucacuggccu

SEQ ID NO: 1631587 - RNA, 21 nt, Pseudomonas putida KT2440
aacugccgaccuugggccggc

SEQ ID NO: 1631588 - RNA, 23 nt, Pseudomonas putida KT2440
aacugcgcugguacagcaggaac

SEQ ID NO: 1631589 - RNA, 19 nt, Pseudomonas putida KT2440
aacugcgcaccagagggaa

SEQ ID NO: 1631590 - RNA, 15 nt, Pseudomonas putida KT2440
aacucguugaccacg

SEQ ID NO: 1631591 - RNA, 17 nt, Pseudomonas putida KT2440
aacucguuuucgcugau

SEQ ID NO: 1631592 - RNA, 21 nt, Pseudomonas putida KT2440
aacucgccaaaccauggcguc

SEQ ID NO: 1631593 - RNA, 16 nt, Pseudomonas putida KT2440
aacucgcgcauccagc

SEQ ID NO: 1631594 - RNA, 21 nt, Pseudomonas putida KT2440
aacuccucgaucaccugcggc

SEQ ID NO: 1631595 - RNA, 15 nt, Pseudomonas putida KT2440
aacuccaccagccca

SEQ ID NO: 1631596 - RNA, 15 nt, Pseudomonas putida KT2440
aacucuggcaacagc

SEQ ID NO: 1631597 - RNA, 18 nt, Pseudomonas putida KT2440
aacucuggcaacagcuca

SEQ ID NO: 1631598 - RNA, 13 nt, Pseudomonas putida KT2440
aacucuugagcug

SEQ ID NO: 1631599 - RNA, 15 nt, Pseudomonas putida KT2440
aacucaacgcaacug

SEQ ID NO: 1631600 - RNA, 20 nt, Pseudomonas putida KT2440
aacucaccacaucggcggca

SEQ ID NO: 1631601 - RNA, 20 nt, Pseudomonas putida KT2440
aacucaccugguuugaggaa

SEQ ID NO: 1631602 - RNA, 13 nt, Pseudomonas putida KT2440
aacucacccgccc

SEQ ID NO: 1631603 - RNA, 16 nt, Pseudomonas putida KT2440
aacguucccaauguca

SEQ ID NO: 1631604 - RNA, 17 nt, Pseudomonas putida KT2440
aacggucacugagccag

SEQ ID NO: 1631605 - RNA, 20 nt, Pseudomonas putida KT2440
aacggucacugagccaggcc

SEQ ID NO: 1631606 - RNA, 22 nt, Pseudomonas putida KT2440
aacggguucagguacagcagcu

SEQ ID NO: 1631607 - RNA, 17 nt, Pseudomonas putida KT2440
aacgguguggccagugc

SEQ ID NO: 1631608 - RNA, 19 nt, Pseudomonas putida KT2440
aacgguggaaucggcucca

SEQ ID NO: 1631609 - RNA, 17 nt, Pseudomonas putida KT2440
aacggugcugccgaggc

SEQ ID NO: 1631610 - RNA, 12 nt, Pseudomonas putida KT2440
aacggugaacgg

SEQ ID NO: 1631611 - RNA, 14 nt, Pseudomonas putida KT2440
aacguaccagccgc

SEQ ID NO: 1631612 - RNA, 15 nt, Pseudomonas putida KT2440
aacguagaaaggaga

SEQ ID NO: 1631613 - RNA, 15 nt, Pseudomonas putida KT2440
aacggcuaccagcag

SEQ ID NO: 1631614 - RNA, 23 nt, Pseudomonas putida KT2440
aacggcuaccccgaugcgcugau

SEQ ID NO: 1631615 - RNA, 15 nt, Pseudomonas putida KT2440
aacggcggcccggcc

SEQ ID NO: 1631616 - RNA, 22 nt, Pseudomonas putida KT2440
aacggcggcccggccaacaacg

SEQ ID NO: 1631617 - RNA, 18 nt, Pseudomonas putida KT2440
aacggcgcuguccagcgc

SEQ ID NO: 1631618 - RNA, 23 nt, Pseudomonas putida KT2440
aacggcucugacauaacaagaac

SEQ ID NO: 1631619 - RNA, 15 nt, Pseudomonas putida KT2440
aacgggcaaggcugg

SEQ ID NO: 1631620 - RNA, 13 nt, Pseudomonas putida KT2440
aacgcggcaaccu

SEQ ID NO: 1631621 - RNA, 14 nt, Pseudomonas putida KT2440
aacgcugcucggcc

SEQ ID NO: 1631622 - RNA, 17 nt, Pseudomonas putida KT2440
aacgcucgcgcaugaaa

SEQ ID NO: 1631623 - RNA, 23 nt, Pseudomonas putida KT2440
aacgcguuucggcggccugcagc

SEQ ID NO: 1631624 - RNA, 19 nt, Pseudomonas putida KT2440
aacgcuugcccggcuccag

SEQ ID NO: 1631625 - RNA, 14 nt, Pseudomonas putida KT2440
aacgcugccuugcc

SEQ ID NO: 1631626 - RNA, 21 nt, Pseudomonas putida KT2440
aacggaaauaccggggcaccu

SEQ ID NO: 1631627 - RNA, 22 nt, Pseudomonas putida KT2440
aacggaacgacaaacuccuuga

SEQ ID NO: 1631628 - RNA, 18 nt, Pseudomonas putida KT2440
aacggacgucccagcagg

SEQ ID NO: 1631629 - RNA, 21 nt, Pseudomonas putida KT2440
aacgccaggcacccagccagc

SEQ ID NO: 1631630 - RNA, 20 nt, Pseudomonas putida KT2440
aacgcccgcaacaaccuggc

SEQ ID NO: 1631631 - RNA, 15 nt, Pseudomonas putida KT2440
aacgcccccagcccg

SEQ ID NO: 1631632 - RNA, 18 nt, Pseudomonas putida KT2440
aacgcccccgccaccccc

SEQ ID NO: 1631633 - RNA, 14 nt, Pseudomonas putida KT2440
aacgcauccaggcg

SEQ ID NO: 1631634 - RNA, 20 nt, Pseudomonas putida KT2440
aacgccgagcauuacaggca

SEQ ID NO: 1631635 - RNA, 15 nt, Pseudomonas putida KT2440
aacgccgauagccag

SEQ ID NO: 1631636 - RNA, 20 nt, Pseudomonas putida KT2440
aacgccgauagccagcuggc

SEQ ID NO: 1631637 - RNA, 13 nt, Pseudomonas putida KT2440
aacgccgccagcg

SEQ ID NO: 1631638 - RNA, 20 nt, Pseudomonas putida KT2440
aacgccgggagggcuuugcc

SEQ ID NO: 1631639 - RNA, 22 nt, Pseudomonas putida KT2440
aacgccgggcacaucaccagca

SEQ ID NO: 1631640 - RNA, 15 nt, Pseudomonas putida KT2440
aacgcgaaagcgaag

SEQ ID NO: 1631641 - RNA, 12 nt, Pseudomonas putida KT2440
aacgccuuggcc

SEQ ID NO: 1631642 - RNA, 13 nt, Pseudomonas putida KT2440
aacgccuuggccu

SEQ ID NO: 1631643 - RNA, 21 nt, Pseudomonas putida KT2440
aacgaucagcgccgaaccagc

SEQ ID NO: 1631644 - RNA, 22 nt, Pseudomonas putida KT2440
aacgagguggucgaggcaaaga

SEQ ID NO: 1631645 - RNA, 13 nt, Pseudomonas putida KT2440
aacgaggacugca

SEQ ID NO: 1631646 - RNA, 15 nt, Pseudomonas putida KT2440
aacgaggacugcacc

SEQ ID NO: 1631647 - RNA, 22 nt, Pseudomonas putida KT2440
aacgacuucggcaacagccggg

SEQ ID NO: 1631648 - RNA, 20 nt, Pseudomonas putida KT2440
aacgaccggcuugucuucca

SEQ ID NO: 1631649 - RNA, 17 nt, Pseudomonas putida KT2440
aacgauuggcaguccug

SEQ ID NO: 1631650 - RNA, 21 nt, Pseudomonas putida KT2440
aacgcaaauccuccugcgcau

SEQ ID NO: 1631651 - RNA, 16 nt, Pseudomonas putida KT2440
aacgcaagaaggcugc

SEQ ID NO: 1631652 - RNA, 21 nt, Pseudomonas putida KT2440
aacgcacgugggucgggaaca

SEQ ID NO: 1631653 - RNA, 14 nt, Pseudomonas putida KT2440
aacgcagccaggau

SEQ ID NO: 1631654 - RNA, 13 nt, Pseudomonas putida KT2440
aacgcagccggca

SEQ ID NO: 1631655 - RNA, 14 nt, Pseudomonas putida KT2440
aaccgucuuuaccg

SEQ ID NO: 1631656 - RNA, 18 nt, Pseudomonas putida KT2440
aaccguuucaguacagcc

SEQ ID NO: 1631657 - RNA, 16 nt, Pseudomonas putida KT2440
aaccucaacgccuccc

SEQ ID NO: 1631658 - RNA, 20 nt, Pseudomonas putida KT2440
aaccucacggcgaacacccc

SEQ ID NO: 1631659 - RNA, 17 nt, Pseudomonas putida KT2440
aaccugccaugcagguc

SEQ ID NO: 1631660 - RNA, 14 nt, Pseudomonas putida KT2440
aaccugacaagcga

SEQ ID NO: 1631661 - RNA, 16 nt, Pseudomonas putida KT2440
aaccugacccgcgccu

SEQ ID NO: 1631662 - RNA, 20 nt, Pseudomonas putida KT2440
aaccucaguuuuucuccgcc

SEQ ID NO: 1631663 - RNA, 13 nt, Pseudomonas putida KT2440
aaccucacuggca

SEQ ID NO: 1631664 - RNA, 21 nt, Pseudomonas putida KT2440
aaccucgagguacgagucagc

SEQ ID NO: 1631665 - RNA, 14 nt, Pseudomonas putida KT2440
aacgacacggcagg

SEQ ID NO: 1631666 - RNA, 13 nt, Pseudomonas putida KT2440
aacgaaucagcca

SEQ ID NO: 1631667 - RNA, 17 nt, Pseudomonas putida KT2440
aacgaaggccugaaacc

SEQ ID NO: 1631668 - RNA, 12 nt, Pseudomonas putida KT2440
aacgaacggaac

SEQ ID NO: 1631669 - RNA, 15 nt, Pseudomonas putida KT2440
aaccuguugaagcga

SEQ ID NO: 1631670 - RNA, 17 nt, Pseudomonas putida KT2440
aaccugugaagccaggg

SEQ ID NO: 1631671 - RNA, 13 nt, Pseudomonas putida KT2440
aaccuguuccagc

SEQ ID NO: 1631672 - RNA, 18 nt, Pseudomonas putida KT2440
aaucaggcuguccacacc

SEQ ID NO: 1631673 - RNA, 15 nt, Pseudomonas putida KT2440
aaucagcucgucagc

SEQ ID NO: 1631674 - RNA, 15 nt, Pseudomonas putida KT2440
aaucagcuguuugaa

SEQ ID NO: 1631675 - RNA, 20 nt, Pseudomonas putida KT2440
aaucagcuugaacacgaaca

SEQ ID NO: 1631676 - RNA, 14 nt, Pseudomonas putida KT2440
aauccagcccucaa

SEQ ID NO: 1631677 - RNA, 15 nt, Pseudomonas putida KT2440
aauccaccagcucac

SEQ ID NO: 1631678 - RNA, 17 nt, Pseudomonas putida KT2440
aauccagugcaggucua

SEQ ID NO: 1631679 - RNA, 13 nt, Pseudomonas putida KT2440
aauccaucaccac

SEQ ID NO: 1631680 - RNA, 18 nt, Pseudomonas putida KT2440
aaucgucggugaugauca

SEQ ID NO: 1631681 - RNA, 16 nt, Pseudomonas putida KT2440
aaucgggugaggauga

SEQ ID NO: 1631682 - RNA, 13 nt, Pseudomonas putida KT2440
aaucgcugugcaa

SEQ ID NO: 1631683 - RNA, 16 nt, Pseudomonas putida KT2440
aaucgcugugcaacag

SEQ ID NO: 1631684 - RNA, 19 nt, Pseudomonas putida KT2440
aaucgcugcgcaugaaacu

SEQ ID NO: 1631685 - RNA, 15 nt, Pseudomonas putida KT2440
aaucgcucugccgca

SEQ ID NO: 1631686 - RNA, 19 nt, Pseudomonas putida KT2440
aauccgcuguucaggugug

SEQ ID NO: 1631687 - RNA, 15 nt, Pseudomonas putida KT2440
aauccccaaccaugc

SEQ ID NO: 1631688 - RNA, 14 nt, Pseudomonas putida KT2440
aauccgccuggccg

SEQ ID NO: 1631689 - RNA, 18 nt, Pseudomonas putida KT2440
aaucccgccccaaaggaa

SEQ ID NO: 1631690 - RNA, 13 nt, Pseudomonas putida KT2440
aaugcagcaagcu

SEQ ID NO: 1631691 - RNA, 21 nt, Pseudomonas putida KT2440
aaugaugcguacggccuuggc

SEQ ID NO: 1631692 - RNA, 18 nt, Pseudomonas putida KT2440
aaugaucgggcagacgac

SEQ ID NO: 1631693 - RNA, 22 nt, Pseudomonas putida KT2440
aaugaucgccagcgguugagau

SEQ ID NO: 1631694 - RNA, 16 nt, Pseudomonas putida KT2440
aaugaugaaagcaggu

SEQ ID NO: 1631695 - RNA, 21 nt, Pseudomonas putida KT2440
aaugaccuggaucgccaggcu

SEQ ID NO: 1631696 - RNA, 23 nt, Pseudomonas putida KT2440
aaugccgugaugguaucugccag

SEQ ID NO: 1631697 - RNA, 18 nt, Pseudomonas putida KT2440
aaugcgccgcaccaaaga

SEQ ID NO: 1631698 - RNA, 14 nt, Pseudomonas putida KT2440
aaugcgaugguggc

SEQ ID NO: 1631699 - RNA, 18 nt, Pseudomonas putida KT2440
aaugcgacugaggcaccg

SEQ ID NO: 1631700 - RNA, 19 nt, Pseudomonas putida KT2440
aaugccgccuugcagaaag

SEQ ID NO: 1631701 - RNA, 15 nt, Pseudomonas putida KT2440
aauggcgcgaacagg

SEQ ID NO: 1631702 - RNA, 20 nt, Pseudomonas putida KT2440
aaugguuuaguccugcagcg

SEQ ID NO: 1631703 - RNA, 23 nt, Pseudomonas putida KT2440
aauggaggagggcugcaucacuu

SEQ ID NO: 1631704 - RNA, 15 nt, Pseudomonas putida KT2440
aauggcccgcuccag

SEQ ID NO: 1631705 - RNA, 21 nt, Pseudomonas putida KT2440
aaugcgugggucguuccagug

SEQ ID NO: 1631706 - RNA, 17 nt, Pseudomonas putida KT2440
aaugcgguccuccuugg

SEQ ID NO: 1631707 - RNA, 15 nt, Pseudomonas putida KT2440
aauucauaaggauca

SEQ ID NO: 1631708 - RNA, 14 nt, Pseudomonas putida KT2440
aauucccuacugcg

SEQ ID NO: 1631709 - RNA, 13 nt, Pseudomonas putida KT2440
aauuccuugcugg

SEQ ID NO: 1631710 - RNA, 23 nt, Pseudomonas putida KT2440
aauguaggaucaaguaccccuuu

SEQ ID NO: 1631711 - RNA, 13 nt, Pseudomonas putida KT2440
aauuauuggccag

SEQ ID NO: 1631712 - RNA, 13 nt, Pseudomonas putida KT2440
aauucaaugaguu

SEQ ID NO: 1631713 - RNA, 17 nt, Pseudomonas putida KT2440
aauugcgccagccgcuc

SEQ ID NO: 1631714 - RNA, 20 nt, Pseudomonas putida KT2440
aauugcggguguggccacac

SEQ ID NO: 1631715 - RNA, 22 nt, Pseudomonas putida KT2440
aauuggcgagcaggcccgcccc

SEQ ID NO: 1631716 - RNA, 16 nt, Pseudomonas putida KT2440
aauuggcuuccaggug

SEQ ID NO: 1631717 - RNA, 14 nt, Pseudomonas putida KT2440
aagggauguuggaa

SEQ ID NO: 1631718 - RNA, 14 nt, Pseudomonas putida KT2440
aagggcaaugauca

SEQ ID NO: 1631719 - RNA, 14 nt, Pseudomonas putida KT2440
aagggcagggugau

SEQ ID NO: 1631720 - RNA, 22 nt, Pseudomonas putida KT2440
aagggccgcaacgcggcccugg

SEQ ID NO: 1631721 - RNA, 20 nt, Pseudomonas putida KT2440
aagggccgggccugcauuca

SEQ ID NO: 1631722 - RNA, 21 nt, Pseudomonas putida KT2440
aagggccguuacucccacagc

SEQ ID NO: 1631723 - RNA, 18 nt, Pseudomonas putida KT2440
aagggccugcaggcagca

SEQ ID NO: 1631724 - RNA, 19 nt, Pseudomonas putida KT2440
aagggccugcaggcagcau

SEQ ID NO: 1631725 - RNA, 23 nt, Pseudomonas putida KT2440
aagggcgcugaucaagcccgcuc

SEQ ID NO: 1631726 - RNA, 22 nt, Pseudomonas putida KT2440
aagggccgcgacgcggcccugg

SEQ ID NO: 1631727 - RNA, 18 nt, Pseudomonas putida KT2440
aagggcucaacgccaggg

SEQ ID NO: 1631728 - RNA, 15 nt, Pseudomonas putida KT2440
aagggcgucugcucc

SEQ ID NO: 1631729 - RNA, 12 nt, Pseudomonas putida KT2440
aaggggcaaagu

SEQ ID NO: 1631730 - RNA, 16 nt, Pseudomonas putida KT2440
aaggcuagccacggcg

SEQ ID NO: 1631731 - RNA, 12 nt, Pseudomonas putida KT2440
aaggcggcccaa

SEQ ID NO: 1631732 - RNA, 13 nt, Pseudomonas putida KT2440
aaggucagcaagc

SEQ ID NO: 1631733 - RNA, 15 nt, Pseudomonas putida KT2440
aaggucagccagacg

SEQ ID NO: 1631734 - RNA, 17 nt, Pseudomonas putida KT2440
aagggugaugcccgcag

SEQ ID NO: 1631735 - RNA, 16 nt, Pseudomonas putida KT2440
aagguauucgaggauc

SEQ ID NO: 1631736 - RNA, 23 nt, Pseudomonas putida KT2440
aagguauucgaggaucagcgcag

SEQ ID NO: 1631737 - RNA, 14 nt, Pseudomonas putida KT2440
aaguacuugcaggu

SEQ ID NO: 1631738 - RNA, 17 nt, Pseudomonas putida KT2440
aaguacuugcaggugca

SEQ ID NO: 1631739 - RNA, 21 nt, Pseudomonas putida KT2440
aaguacuugcaggugcagggu

SEQ ID NO: 1631740 - RNA, 13 nt, Pseudomonas putida KT2440
aaguacaacugcc

SEQ ID NO: 1631741 - RNA, 20 nt, Pseudomonas putida KT2440
aaguacaacugccacccucc

SEQ ID NO: 1631742 - RNA, 16 nt, Pseudomonas putida KT2440
aaguacaccggcagca

SEQ ID NO: 1631743 - RNA, 13 nt, Pseudomonas putida KT2440
aaguacaccuugg

SEQ ID NO: 1631744 - RNA, 22 nt, Pseudomonas putida KT2440
aaguaguguucgccguuguuca

SEQ ID NO: 1631745 - RNA, 22 nt, Pseudomonas putida KT2440
aagucgccgcggguaccaccug

SEQ ID NO: 1631746 - RNA, 19 nt, Pseudomonas putida KT2440
aagucgccacaccacagcu

SEQ ID NO: 1631747 - RNA, 22 nt, Pseudomonas putida KT2440
aagucgccacaccacagcugca

SEQ ID NO: 1631748 - RNA, 14 nt, Pseudomonas putida KT2440
aagucgaccagcag

SEQ ID NO: 1631749 - RNA, 13 nt, Pseudomonas putida KT2440
aagucgcacauga

SEQ ID NO: 1631750 - RNA, 17 nt, Pseudomonas putida KT2440
aagucgaacuugacguc

SEQ ID NO: 1631751 - RNA, 15 nt, Pseudomonas putida KT2440
aagucauccauggca

SEQ ID NO: 1631752 - RNA, 22 nt, Pseudomonas putida KT2440
aagucauccgccaggcucucca

SEQ ID NO: 1631753 - RNA, 22 nt, Pseudomonas putida KT2440
aagucagguaggugcugaccgc

SEQ ID NO: 1631754 - RNA, 13 nt, Pseudomonas putida KT2440
aagugaccggaau

SEQ ID NO: 1631755 - RNA, 18 nt, Pseudomonas putida KT2440
aagucuguaaucaggcug

SEQ ID NO: 1631756 - RNA, 22 nt, Pseudomonas putida KT2440
aagugauaacgcgccgcugccu

SEQ ID NO: 1631757 - RNA, 17 nt, Pseudomonas putida KT2440
aagugccguccgcugcc

SEQ ID NO: 1631758 - RNA, 12 nt, Pseudomonas putida KT2440
aagcuuccaguu

SEQ ID NO: 1631759 - RNA, 14 nt, Pseudomonas putida KT2440
aagcuguagucacc

SEQ ID NO: 1631760 - RNA, 13 nt, Pseudomonas putida KT2440
aagcuggucaggu

SEQ ID NO: 1631761 - RNA, 19 nt, Pseudomonas putida KT2440
aagcugggaauccagugca

SEQ ID NO: 1631762 - RNA, 15 nt, Pseudomonas putida KT2440
aagcuggcacgugca

SEQ ID NO: 1631763 - RNA, 19 nt, Pseudomonas putida KT2440
aagcuggagucguugcgcu

SEQ ID NO: 1631764 - RNA, 15 nt, Pseudomonas putida KT2440
aagcuucuugcaaaa

SEQ ID NO: 1631765 - RNA, 13 nt, Pseudomonas putida KT2440
aagcguucaugcc

SEQ ID NO: 1631766 - RNA, 19 nt, Pseudomonas putida KT2440
aagcucaaaugcuggcaau

SEQ ID NO: 1631767 - RNA, 13 nt, Pseudomonas putida KT2440
aagcgcagcgcag

SEQ ID NO: 1631768 - RNA, 21 nt, Pseudomonas putida KT2440
aagcgccagcaacgcagccag

SEQ ID NO: 1631769 - RNA, 19 nt, Pseudomonas putida KT2440
aagcgccugacgcagugca

SEQ ID NO: 1631770 - RNA, 16 nt, Pseudomonas putida KT2440
aagcgcgcgcccaccg

SEQ ID NO: 1631771 - RNA, 14 nt, Pseudomonas putida KT2440
aagcgcgccuccag

SEQ ID NO: 1631772 - RNA, 13 nt, Pseudomonas putida KT2440
aagcgguacaccu

SEQ ID NO: 1631773 - RNA, 15 nt, Pseudomonas putida KT2440
aagcgcuccgccaau

SEQ ID NO: 1631774 - RNA, 21 nt, Pseudomonas putida KT2440
aagcgggcagugcaauaccag

SEQ ID NO: 1631775 - RNA, 17 nt, Pseudomonas putida KT2440
aagcgggccaaggucau

SEQ ID NO: 1631776 - RNA, 19 nt, Pseudomonas putida KT2440
aagccccggcucgcaugag

SEQ ID NO: 1631777 - RNA, 19 nt, Pseudomonas putida KT2440
aagcccaguugcuggcugg

SEQ ID NO: 1631778 - RNA, 22 nt, Pseudomonas putida KT2440
aagcccauuucgugggucacgc

SEQ ID NO: 1631779 - RNA, 10 nt, Pseudomonas putida KT2440
aagcccaugg

SEQ ID NO: 1631780 - RNA, 15 nt, Pseudomonas putida KT2440
aagcccgugccgcau

SEQ ID NO: 1631781 - RNA, 15 nt, Pseudomonas putida KT2440
aagccccuggaagcg

SEQ ID NO: 1631782 - RNA, 16 nt, Pseudomonas putida KT2440
aagcccgcucccacag

SEQ ID NO: 1631783 - RNA, 12 nt, Pseudomonas putida KT2440
aagccgccagcg

SEQ ID NO: 1631784 - RNA, 21 nt, Pseudomonas putida KT2440
aagccgccacaugaaggccgu

SEQ ID NO: 1631785 - RNA, 13 nt, Pseudomonas putida KT2440
aagcccugcugcu

SEQ ID NO: 1631786 - RNA, 22 nt, Pseudomonas putida KT2440
aagcccugcugcuggcacgccu

SEQ ID NO: 1631787 - RNA, 14 nt, Pseudomonas putida KT2440
aagccgacaaaaac

SEQ ID NO: 1631788 - RNA, 17 nt, Pseudomonas putida KT2440
aagccgacaaaaacaac

SEQ ID NO: 1631789 - RNA, 22 nt, Pseudomonas putida KT2440
aagcccacacaccgcaacccag

SEQ ID NO: 1631790 - RNA, 20 nt, Pseudomonas putida KT2440
aagcccaauacccaacagca

SEQ ID NO: 1631791 - RNA, 17 nt, Pseudomonas putida KT2440
aagccaugucuucacga

SEQ ID NO: 1631792 - RNA, 22 nt, Pseudomonas putida KT2440
aagccauaucccgccagguccg

SEQ ID NO: 1631793 - RNA, 24 nt, Pseudomonas putida KT2440
aagaaggcugcccucgggcagccu

SEQ ID NO: 1631794 - RNA, 22 nt, Pseudomonas putida KT2440
aagaagucauccggcgcggccu

SEQ ID NO: 1631795 - RNA, 23 nt, Pseudomonas putida KT2440
aagaaguccucccaguacaugau

SEQ ID NO: 1631796 - RNA, 14 nt, Pseudomonas putida KT2440
aagccagcagccug

SEQ ID NO: 1631797 - RNA, 17 nt, Pseudomonas putida KT2440
aagccagcagccugugc

SEQ ID NO: 1631798 - RNA, 16 nt, Pseudomonas putida KT2440
aagccacuggccagca

SEQ ID NO: 1631799 - RNA, 17 nt, Pseudomonas putida KT2440
aagcgcaaaaccaccag

SEQ ID NO: 1631800 - RNA, 17 nt, Pseudomonas putida KT2440
aagcgcaaucaaagcag

SEQ ID NO: 1631801 - RNA, 20 nt, Pseudomonas putida KT2440
aagccuugcugaucagguug

SEQ ID NO: 1631802 - RNA, 14 nt, Pseudomonas putida KT2440
aagcgaaacaccag

SEQ ID NO: 1631803 - RNA, 14 nt, Pseudomonas putida KT2440
aagcgaaagcuuuc

SEQ ID NO: 1631804 - RNA, 23 nt, Pseudomonas putida KT2440
aagccgcucaccccauagggcca

SEQ ID NO: 1631805 - RNA, 15 nt, Pseudomonas putida KT2440
aagccgcuggcccua

SEQ ID NO: 1631806 - RNA, 18 nt, Pseudomonas putida KT2440
aagccguaaagcacacaa

SEQ ID NO: 1631807 - RNA, 19 nt, Pseudomonas putida KT2440
aagccugaggcugcgccga

SEQ ID NO: 1631808 - RNA, 17 nt, Pseudomonas putida KT2440
aauagcgcacugagcaa

SEQ ID NO: 1631809 - RNA, 14 nt, Pseudomonas putida KT2440
aauagcgcuuucug

SEQ ID NO: 1631810 - RNA, 18 nt, Pseudomonas putida KT2440
aauaucaucacugccacc

SEQ ID NO: 1631811 - RNA, 15 nt, Pseudomonas putida KT2440
aauaccgugcuugcg

SEQ ID NO: 1631812 - RNA, 16 nt, Pseudomonas putida KT2440
aauagcccaccuucac

SEQ ID NO: 1631813 - RNA, 12 nt, Pseudomonas putida KT2440
aaguugagcacc

SEQ ID NO: 1631814 - RNA, 17 nt, Pseudomonas putida KT2440
aaguugagugucagaaa

SEQ ID NO: 1631815 - RNA, 12 nt, Pseudomonas putida KT2440
aauaauaaaaaa

SEQ ID NO: 1631816 - RNA, 13 nt, Pseudomonas putida KT2440
aauaauaaaaaaa

SEQ ID NO: 1631817 - RNA, 20 nt, Pseudomonas putida KT2440
aauaauucuuauuaccagaa

SEQ ID NO: 1631818 - RNA, 13 nt, Pseudomonas putida KT2440
uuggucagggcaa

SEQ ID NO: 1631819 - RNA, 13 nt, Pseudomonas putida KT2440
uuggucaggauca

SEQ ID NO: 1631820 - RNA, 17 nt, Pseudomonas putida KT2440
uuggucaggaucaccca

SEQ ID NO: 1631821 - RNA, 13 nt, Pseudomonas putida KT2440
uugguccagggcc

SEQ ID NO: 1631822 - RNA, 23 nt, Pseudomonas putida KT2440
uugguccgggucugauugggccc

SEQ ID NO: 1631823 - RNA, 21 nt, Pseudomonas putida KT2440
uuggucgugcauguagccaau

SEQ ID NO: 1631824 - RNA, 18 nt, Pseudomonas putida KT2440
uuggugccaaccuugacc

SEQ ID NO: 1631825 - RNA, 20 nt, Pseudomonas putida KT2440
uuggugcgccuccagcagcg

SEQ ID NO: 1631826 - RNA, 12 nt, Pseudomonas putida KT2440
uugguuaaaagc

SEQ ID NO: 1631827 - RNA, 19 nt, Pseudomonas putida KT2440
uugggggugaagcccugcu

SEQ ID NO: 1631828 - RNA, 11 nt, Pseudomonas putida KT2440
uugggcccaca

SEQ ID NO: 1631829 - RNA, 21 nt, Pseudomonas putida KT2440
uugggcugggcgucaaccaau

SEQ ID NO: 1631830 - RNA, 14 nt, Pseudomonas putida KT2440
uugggcuucaugca

SEQ ID NO: 1631831 - RNA, 23 nt, Pseudomonas putida KT2440
uuggccggcaggcccggcccuuu

SEQ ID NO: 1631832 - RNA, 16 nt, Pseudomonas putida KT2440
uuggccaucugguugc

SEQ ID NO: 1631833 - RNA, 21 nt, Pseudomonas putida KT2440
uuggccagcagggccggcccu

SEQ ID NO: 1631834 - RNA, 16 nt, Pseudomonas putida KT2440
uuggccacgaaaugca

SEQ ID NO: 1631835 - RNA, 17 nt, Pseudomonas putida KT2440
uuggccacgcccaaccc

SEQ ID NO: 1631836 - RNA, 15 nt, Pseudomonas putida KT2440
uuggccaaugccagg

SEQ ID NO: 1631837 - RNA, 18 nt, Pseudomonas putida KT2440
uuggccaccaccagcaac

SEQ ID NO: 1631838 - RNA, 14 nt, Pseudomonas putida KT2440
uuggcaucugcugg

SEQ ID NO: 1631839 - RNA, 18 nt, Pseudomonas putida KT2440
uuggccuggacuggcccu

SEQ ID NO: 1631840 - RNA, 12 nt, Pseudomonas putida KT2440
uuggccugucca

SEQ ID NO: 1631841 - RNA, 20 nt, Pseudomonas putida KT2440
uuggcuucggcggcuuucag

SEQ ID NO: 1631842 - RNA, 20 nt, Pseudomonas putida KT2440
uuggcuuacaacaggaacag

SEQ ID NO: 1631843 - RNA, 15 nt, Pseudomonas putida KT2440
uuggcggugagaugu

SEQ ID NO: 1631844 - RNA, 16 nt, Pseudomonas putida KT2440
uuggcggcccuaucgc

SEQ ID NO: 1631845 - RNA, 13 nt, Pseudomonas putida KT2440
uuggcggcaggcg

SEQ ID NO: 1631846 - RNA, 16 nt, Pseudomonas putida KT2440
uuggcguccacagcca

SEQ ID NO: 1631847 - RNA, 14 nt, Pseudomonas putida KT2440
uuggcguccaggua

SEQ ID NO: 1631848 - RNA, 18 nt, Pseudomonas putida KT2440
uuggcgucggcaccggcg

SEQ ID NO: 1631849 - RNA, 18 nt, Pseudomonas putida KT2440
uuggcuacgcaaggugcc

SEQ ID NO: 1631850 - RNA, 18 nt, Pseudomonas putida KT2440
uuggcugccggccucgag

SEQ ID NO: 1631851 - RNA, 20 nt, Pseudomonas putida KT2440
uugcuggguaccgugcugca

SEQ ID NO: 1631852 - RNA, 22 nt, Pseudomonas putida KT2440
uugcugguguggcgccagggca

SEQ ID NO: 1631853 - RNA, 19 nt, Pseudomonas putida KT2440
uugcugcucauacugcuga

SEQ ID NO: 1631854 - RNA, 22 nt, Pseudomonas putida KT2440
uugcgucaacucaucacucuug

SEQ ID NO: 1631855 - RNA, 17 nt, Pseudomonas putida KT2440
uugcuuauucuucuggc

SEQ ID NO: 1631856 - RNA, 23 nt, Pseudomonas putida KT2440
uugcuguuggggaggaacuguuu

SEQ ID NO: 1631857 - RNA, 16 nt, Pseudomonas putida KT2440
uugcuugacuauuucu

SEQ ID NO: 1631858 - RNA, 18 nt, Pseudomonas putida KT2440
uugcuugacuauuucuag

SEQ ID NO: 1631859 - RNA, 14 nt, Pseudomonas putida KT2440
uuggcaccuccggu

SEQ ID NO: 1631860 - RNA, 21 nt, Pseudomonas putida KT2440
uuggcacgaaacgccacgccc

SEQ ID NO: 1631861 - RNA, 12 nt, Pseudomonas putida KT2440
uuggcagcagcc

SEQ ID NO: 1631862 - RNA, 17 nt, Pseudomonas putida KT2440
uuggacagcgcccggcg

SEQ ID NO: 1631863 - RNA, 18 nt, Pseudomonas putida KT2440
uuggaguuuuccuaaagc

SEQ ID NO: 1631864 - RNA, 15 nt, Pseudomonas putida KT2440
uuggaaauguucaac

SEQ ID NO: 1631865 - RNA, 12 nt, Pseudomonas putida KT2440
uugccagcgucu

SEQ ID NO: 1631866 - RNA, 19 nt, Pseudomonas putida KT2440
uugccauaacuccagcgcc

SEQ ID NO: 1631867 - RNA, 20 nt, Pseudomonas putida KT2440
uugccauucucgccgccgcu

SEQ ID NO: 1631868 - RNA, 20 nt, Pseudomonas putida KT2440
uugccggggcugcuuugcag

SEQ ID NO: 1631869 - RNA, 20 nt, Pseudomonas putida KT2440
uugccggucacuggcgacag

SEQ ID NO: 1631870 - RNA, 15 nt, Pseudomonas putida KT2440
uugccucaggcccca

SEQ ID NO: 1631871 - RNA, 14 nt, Pseudomonas putida KT2440
uugcgcgccagggc

SEQ ID NO: 1631872 - RNA, 14 nt, Pseudomonas putida KT2440
uugcgcgccgccag

SEQ ID NO: 1631873 - RNA, 14 nt, Pseudomonas putida KT2440
uugcggcccuucgc

SEQ ID NO: 1631874 - RNA, 19 nt, Pseudomonas putida KT2440
uugcggccaucgaacacca

SEQ ID NO: 1631875 - RNA, 21 nt, Pseudomonas putida KT2440
uugcgggucagcagcaccgcc

SEQ ID NO: 1631876 - RNA, 17 nt, Pseudomonas putida KT2440
uugcgcuggcugccgcg

SEQ ID NO: 1631877 - RNA, 20 nt, Pseudomonas putida KT2440
uugcggaacguuuccaggcu

SEQ ID NO: 1631878 - RNA, 20 nt, Pseudomonas putida KT2440
uugcaguugaaugccgccau

SEQ ID NO: 1631879 - RNA, 20 nt, Pseudomonas putida KT2440
uugcaucgcgcacuugccag

SEQ ID NO: 1631880 - RNA, 21 nt, Pseudomonas putida KT2440
uugccagagugggucaguuug

SEQ ID NO: 1631881 - RNA, 17 nt, Pseudomonas putida KT2440
uugccacggcguggagc

SEQ ID NO: 1631882 - RNA, 17 nt, Pseudomonas putida KT2440
uugcagcucacccuucu

SEQ ID NO: 1631883 - RNA, 21 nt, Pseudomonas putida KT2440
uugcagcgccgcauccagcac

SEQ ID NO: 1631884 - RNA, 23 nt, Pseudomonas putida KT2440
uugcagcgccgcauccagcacug

SEQ ID NO: 1631885 - RNA, 12 nt, Pseudomonas putida KT2440
uugcacuuccac

SEQ ID NO: 1631886 - RNA, 15 nt, Pseudomonas putida KT2440
uugcacuuugccgcc

SEQ ID NO: 1631887 - RNA, 14 nt, Pseudomonas putida KT2440
uugcagccccagcc

SEQ ID NO: 1631888 - RNA, 12 nt, Pseudomonas putida KT2440
uugcagccccug

SEQ ID NO: 1631889 - RNA, 13 nt, Pseudomonas putida KT2440
uugcagcccuucg

SEQ ID NO: 1631890 - RNA, 19 nt, Pseudomonas putida KT2440
uugcagcaagcgacauaaa

SEQ ID NO: 1631891 - RNA, 17 nt, Pseudomonas putida KT2440
uugaucucaagcuucau

SEQ ID NO: 1631892 - RNA, 20 nt, Pseudomonas putida KT2440
uugauaccugcuugcugacu

SEQ ID NO: 1631893 - RNA, 17 nt, Pseudomonas putida KT2440
uugagguccgccucgau

SEQ ID NO: 1631894 - RNA, 22 nt, Pseudomonas putida KT2440
uugagcaggucgaacagccccc

SEQ ID NO: 1631895 - RNA, 17 nt, Pseudomonas putida KT2440
uugagcagcagcccuuc

SEQ ID NO: 1631896 - RNA, 17 nt, Pseudomonas putida KT2440
uugagcaguucgguaau

SEQ ID NO: 1631897 - RNA, 20 nt, Pseudomonas putida KT2440
uucuuggagcggccuuugaa

SEQ ID NO: 1631898 - RNA, 15 nt, Pseudomonas putida KT2440
uucuuguucguucag

SEQ ID NO: 1631899 - RNA, 19 nt, Pseudomonas putida KT2440
uuguccacgcuuacaggua

SEQ ID NO: 1631900 - RNA, 13 nt, Pseudomonas putida KT2440
uuguccagcagca

SEQ ID NO: 1631901 - RNA, 22 nt, Pseudomonas putida KT2440
uugucccaggccaucagcagcu

SEQ ID NO: 1631902 - RNA, 16 nt, Pseudomonas putida KT2440
uugucaugccuuggcu

SEQ ID NO: 1631903 - RNA, 18 nt, Pseudomonas putida KT2440
uugucgaugccugcuaau

SEQ ID NO: 1631904 - RNA, 23 nt, Pseudomonas putida KT2440
uugucgacagugaauuccuugcu

SEQ ID NO: 1631905 - RNA, 16 nt, Pseudomonas putida KT2440
uugucgaccuggcucu

SEQ ID NO: 1631906 - RNA, 21 nt, Pseudomonas putida KT2440
uugucgaccuggcucuucaac

SEQ ID NO: 1631907 - RNA, 19 nt, Pseudomonas putida KT2440
uugucgacugcacugccag

SEQ ID NO: 1631908 - RNA, 20 nt, Pseudomonas putida KT2440
uuguccuuguugaccccggg

SEQ ID NO: 1631909 - RNA, 13 nt, Pseudomonas putida KT2440
uugucagccuuca

SEQ ID NO: 1631910 - RNA, 15 nt, Pseudomonas putida KT2440
uugucaguucugcuc

SEQ ID NO: 1631911 - RNA, 22 nt, Pseudomonas putida KT2440
uugucaguucugcucagcuacg

SEQ ID NO: 1631912 - RNA, 13 nt, Pseudomonas putida KT2440
uugucaccccguu

SEQ ID NO: 1631913 - RNA, 14 nt, Pseudomonas putida KT2440
uuguagcucaggua

SEQ ID NO: 1631914 - RNA, 14 nt, Pseudomonas putida KT2440
uuguagcccaccac

SEQ ID NO: 1631915 - RNA, 11 nt, Pseudomonas putida KT2440
uugguuugccu

SEQ ID NO: 1631916 - RNA, 17 nt, Pseudomonas putida KT2440
uuguugcaaccaggcgc

SEQ ID NO: 1631917 - RNA, 19 nt, Pseudomonas putida KT2440
uuguucggcaggcucugcu

SEQ ID NO: 1631918 - RNA, 14 nt, Pseudomonas putida KT2440
uuguucuggccacc

SEQ ID NO: 1631919 - RNA, 17 nt, Pseudomonas putida KT2440
uuguuccgccgcuuugu

SEQ ID NO: 1631920 - RNA, 14 nt, Pseudomonas putida KT2440
uugucggucaggua

SEQ ID NO: 1631921 - RNA, 17 nt, Pseudomonas putida KT2440
uugucugacagcaggaa

SEQ ID NO: 1631922 - RNA, 20 nt, Pseudomonas putida KT2440
uugucugacagcaggaacag

SEQ ID NO: 1631923 - RNA, 17 nt, Pseudomonas putida KT2440
uugucuguacugcggcu

SEQ ID NO: 1631924 - RNA, 13 nt, Pseudomonas putida KT2440
uugucuuccagcu

SEQ ID NO: 1631925 - RNA, 17 nt, Pseudomonas putida KT2440
uugucuccgaacgccuu

SEQ ID NO: 1631926 - RNA, 18 nt, Pseudomonas putida KT2440
uugugcucaucggcggcu

SEQ ID NO: 1631927 - RNA, 16 nt, Pseudomonas putida KT2440
uugugcauccugcacu

SEQ ID NO: 1631928 - RNA, 23 nt, Pseudomonas putida KT2440
uugugcaguucgcacagcucgau

SEQ ID NO: 1631929 - RNA, 20 nt, Pseudomonas putida KT2440
uugugcaacugguucuccag

SEQ ID NO: 1631930 - RNA, 13 nt, Pseudomonas putida KT2440
uucuccagcucgc

SEQ ID NO: 1631931 - RNA, 15 nt, Pseudomonas putida KT2440
uucuccagcucgcca

SEQ ID NO: 1631932 - RNA, 16 nt, Pseudomonas putida KT2440
uucugcucuucugcca

SEQ ID NO: 1631933 - RNA, 20 nt, Pseudomonas putida KT2440
uucugaaucuggcucugcag

SEQ ID NO: 1631934 - RNA, 18 nt, Pseudomonas putida KT2440
uucugaccaauccagccc

SEQ ID NO: 1631935 - RNA, 14 nt, Pseudomonas putida KT2440
uucuccagcguccc

SEQ ID NO: 1631936 - RNA, 12 nt, Pseudomonas putida KT2440
uucucccaggcc

SEQ ID NO: 1631937 - RNA, 14 nt, Pseudomonas putida KT2440
uucuucagcaggaa

SEQ ID NO: 1631938 - RNA, 15 nt, Pseudomonas putida KT2440
uucuucaggcaaaac

SEQ ID NO: 1631939 - RNA, 21 nt, Pseudomonas putida KT2440
uucuucacaccggccuuggcc

SEQ ID NO: 1631940 - RNA, 15 nt, Pseudomonas putida KT2440
uucuucaacuccugc

SEQ ID NO: 1631941 - RNA, 22 nt, Pseudomonas putida KT2440
uucuucgguggcguugucagca

SEQ ID NO: 1631942 - RNA, 24 nt, Pseudomonas putida KT2440
uucuucggugucggccagcugcgc

SEQ ID NO: 1631943 - RNA, 16 nt, Pseudomonas putida KT2440
uucuucgucaguccau

SEQ ID NO: 1631944 - RNA, 19 nt, Pseudomonas putida KT2440
uucugguugaacugcuuga

SEQ ID NO: 1631945 - RNA, 14 nt, Pseudomonas putida KT2440
uucuguuugugcca

SEQ ID NO: 1631946 - RNA, 14 nt, Pseudomonas putida KT2440
uucuguggaaaacc

SEQ ID NO: 1631947 - RNA, 14 nt, Pseudomonas putida KT2440
uucgcggguaaacc

SEQ ID NO: 1631948 - RNA, 23 nt, Pseudomonas putida KT2440
uucgcggucggucagcaccuggc

SEQ ID NO: 1631949 - RNA, 16 nt, Pseudomonas putida KT2440
uucgcgggcaagcccg

SEQ ID NO: 1631950 - RNA, 20 nt, Pseudomonas putida KT2440
uucgcgggcaagcccgcacc

SEQ ID NO: 1631951 - RNA, 19 nt, Pseudomonas putida KT2440
uucgcgggcaagcccgcuc

SEQ ID NO: 1631952 - RNA, 13 nt, Pseudomonas putida KT2440
uucggcaggcucu

SEQ ID NO: 1631953 - RNA, 20 nt, Pseudomonas putida KT2440
uucggcaacauucaccagcc

SEQ ID NO: 1631954 - RNA, 13 nt, Pseudomonas putida KT2440
uucggcaaggcga

SEQ ID NO: 1631955 - RNA, 15 nt, Pseudomonas putida KT2440
uucggcggccugcag

SEQ ID NO: 1631956 - RNA, 16 nt, Pseudomonas putida KT2440
uucggcgggguuuuuu

SEQ ID NO: 1631957 - RNA, 19 nt, Pseudomonas putida KT2440
uucggcggugacacugcca

SEQ ID NO: 1631958 - RNA, 14 nt, Pseudomonas putida KT2440
uucgggcugcugcc

SEQ ID NO: 1631959 - RNA, 21 nt, Pseudomonas putida KT2440
uucgggcuguccucaaucaca

SEQ ID NO: 1631960 - RNA, 16 nt, Pseudomonas putida KT2440
uucgggucgccuuugu

SEQ ID NO: 1631961 - RNA, 18 nt, Pseudomonas putida KT2440
uucgauccgcgccaucag

SEQ ID NO: 1631962 - RNA, 21 nt, Pseudomonas putida KT2440
uucgaucggcgcgccuggcuc

SEQ ID NO: 1631963 - RNA, 18 nt, Pseudomonas putida KT2440
uucgaugguguucugguu

SEQ ID NO: 1631964 - RNA, 15 nt, Pseudomonas putida KT2440
uucgacgcucaaguc

SEQ ID NO: 1631965 - RNA, 13 nt, Pseudomonas putida KT2440
uucgacgcagagg

SEQ ID NO: 1631966 - RNA, 15 nt, Pseudomonas putida KT2440
uucgcgcccgcagug

SEQ ID NO: 1631967 - RNA, 15 nt, Pseudomonas putida KT2440
uucgcgacacaaggc

SEQ ID NO: 1631968 - RNA, 20 nt, Pseudomonas putida KT2440
uucccgggaaaagccugcca

SEQ ID NO: 1631969 - RNA, 18 nt, Pseudomonas putida KT2440
uuccggcaugaacacaua

SEQ ID NO: 1631970 - RNA, 21 nt, Pseudomonas putida KT2440
uuccggggugaugaugcagua

SEQ ID NO: 1631971 - RNA, 19 nt, Pseudomonas putida KT2440
uuccgggcaaugcaggcag

SEQ ID NO: 1631972 - RNA, 19 nt, Pseudomonas putida KT2440
uuccgcacgucagacuuuc

SEQ ID NO: 1631973 - RNA, 23 nt, Pseudomonas putida KT2440
uuccuucuugugcacaaagccca

SEQ ID NO: 1631974 - RNA, 14 nt, Pseudomonas putida KT2440
uucgaagugccacg

SEQ ID NO: 1631975 - RNA, 19 nt, Pseudomonas putida KT2440
uucgaccaaggcuuccgcc

SEQ ID NO: 1631976 - RNA, 13 nt, Pseudomonas putida KT2440
uuccggguccagu

SEQ ID NO: 1631977 - RNA, 22 nt, Pseudomonas putida KT2440
uuccugaguauucuccuucuuc

SEQ ID NO: 1631978 - RNA, 12 nt, Pseudomonas putida KT2440
uucauugccaac

SEQ ID NO: 1631979 - RNA, 18 nt, Pseudomonas putida KT2440
uucauugcgaaucugcau

SEQ ID NO: 1631980 - RNA, 12 nt, Pseudomonas putida KT2440
uuccaaaccugc

SEQ ID NO: 1631981 - RNA, 21 nt, Pseudomonas putida KT2440
uucauuuucuauuuaccuguc

SEQ ID NO: 1631982 - RNA, 19 nt, Pseudomonas putida KT2440
uucaucgguuuuuccaugc

SEQ ID NO: 1631983 - RNA, 21 nt, Pseudomonas putida KT2440
uucagucgguaugcgcccauc

SEQ ID NO: 1631984 - RNA, 17 nt, Pseudomonas putida KT2440
uucagguguuccagcac

SEQ ID NO: 1631985 - RNA, 23 nt, Pseudomonas putida KT2440
uucaguaaaaacgccaucggccu

SEQ ID NO: 1631986 - RNA, 17 nt, Pseudomonas putida KT2440
uucagcgccucuuugcc

SEQ ID NO: 1631987 - RNA, 20 nt, Pseudomonas putida KT2440
uucagcgccugccuggcccu

SEQ ID NO: 1631988 - RNA, 15 nt, Pseudomonas putida KT2440
uucagccuuuuccag

SEQ ID NO: 1631989 - RNA, 17 nt, Pseudomonas putida KT2440
uucagccuuuuccagcu

SEQ ID NO: 1631990 - RNA, 13 nt, Pseudomonas putida KT2440
uucagccuuggcc

SEQ ID NO: 1631991 - RNA, 15 nt, Pseudomonas putida KT2440
uucauacagcgccuc

SEQ ID NO: 1631992 - RNA, 19 nt, Pseudomonas putida KT2440
uucauauccgcuuugcuug

SEQ ID NO: 1631993 - RNA, 21 nt, Pseudomonas putida KT2440
uucaucaaaagccccccugcc

SEQ ID NO: 1631994 - RNA, 22 nt, Pseudomonas putida KT2440
uucauccacauaggccagcucc

SEQ ID NO: 1631995 - RNA, 19 nt, Pseudomonas putida KT2440
uucaucgcgggccaggugg

SEQ ID NO: 1631996 - RNA, 22 nt, Pseudomonas putida KT2440
uucaucgauggucuucgccgcc

SEQ ID NO: 1631997 - RNA, 15 nt, Pseudomonas putida KT2440
uucaucgaacugcaa

SEQ ID NO: 1631998 - RNA, 16 nt, Pseudomonas putida KT2440
uucaucaccagccccc

SEQ ID NO: 1631999 - RNA, 17 nt, Pseudomonas putida KT2440
uucaccagccaggcaca

SEQ ID NO: 1632000 - RNA, 18 nt, Pseudomonas putida KT2440
uucaccagccaggcacag

SEQ ID NO: 1632001 - RNA, 20 nt, Pseudomonas putida KT2440
uucacuggccagcagggccg

SEQ ID NO: 1632002 - RNA, 12 nt, Pseudomonas putida KT2440
uucacugacaaa

SEQ ID NO: 1632003 - RNA, 22 nt, Pseudomonas putida KT2440
uucagauuacgcgucaucugcg

SEQ ID NO: 1632004 - RNA, 17 nt, Pseudomonas putida KT2440
uucagauugcuuauucu

SEQ ID NO: 1632005 - RNA, 23 nt, Pseudomonas putida KT2440
uucaaggcguaccugccccccca

SEQ ID NO: 1632006 - RNA, 12 nt, Pseudomonas putida KT2440
uucaaggucauc

SEQ ID NO: 1632007 - RNA, 22 nt, Pseudomonas putida KT2440
uucaaguccugauagcgcuuuu

SEQ ID NO: 1632008 - RNA, 22 nt, Pseudomonas putida KT2440
uucaaagcgacauuguggggcu

SEQ ID NO: 1632009 - RNA, 13 nt, Pseudomonas putida KT2440
uggcaaucuucuu

SEQ ID NO: 1632010 - RNA, 16 nt, Pseudomonas putida KT2440
uggcaaucuucuugcc

SEQ ID NO: 1632011 - RNA, 21 nt, Pseudomonas putida KT2440
uggcaaugcaacucggcgcgu

SEQ ID NO: 1632012 - RNA, 20 nt, Pseudomonas putida KT2440
uggcaacccgccuccugaag

SEQ ID NO: 1632013 - RNA, 19 nt, Pseudomonas putida KT2440
uggcacgccuucagcagcc

SEQ ID NO: 1632014 - RNA, 14 nt, Pseudomonas putida KT2440
uggcacgcuggcug

SEQ ID NO: 1632015 - RNA, 15 nt, Pseudomonas putida KT2440
uggcacccucaccaa

SEQ ID NO: 1632016 - RNA, 22 nt, Pseudomonas putida KT2440
uggcacccucaccaacugccug

SEQ ID NO: 1632017 - RNA, 11 nt, Pseudomonas putida KT2440
uggcaccgccg

SEQ ID NO: 1632018 - RNA, 16 nt, Pseudomonas putida KT2440
uggcaccgccgcccac

SEQ ID NO: 1632019 - RNA, 18 nt, Pseudomonas putida KT2440
uggcaccggcagcagcaa

SEQ ID NO: 1632020 - RNA, 19 nt, Pseudomonas putida KT2440
uggcaccggcagcagcaau

SEQ ID NO: 1632021 - RNA, 23 nt, Pseudomonas putida KT2440
uggcaccggcgaagacggcagau

SEQ ID NO: 1632022 - RNA, 21 nt, Pseudomonas putida KT2440
uggcacccacagcgccugcug

SEQ ID NO: 1632023 - RNA, 22 nt, Pseudomonas putida KT2440
uggcacccacagcgccugcugc

SEQ ID NO: 1632024 - RNA, 13 nt, Pseudomonas putida KT2440
uggcaccccagcc

SEQ ID NO: 1632025 - RNA, 16 nt, Pseudomonas putida KT2440
uggcacaccaugggca

SEQ ID NO: 1632026 - RNA, 14 nt, Pseudomonas putida KT2440
uggcacagaacaau

SEQ ID NO: 1632027 - RNA, 23 nt, Pseudomonas putida KT2440
ugcguugaccugcugggucagcg

SEQ ID NO: 1632028 - RNA, 16 nt, Pseudomonas putida KT2440
ugcguugcccccagcc

SEQ ID NO: 1632029 - RNA, 17 nt, Pseudomonas putida KT2440
uggcaaagcgcagcaau

SEQ ID NO: 1632030 - RNA, 19 nt, Pseudomonas putida KT2440
uggcaaacgccuguuucuc

SEQ ID NO: 1632031 - RNA, 19 nt, Pseudomonas putida KT2440
uggccgcaggcccaaacau

SEQ ID NO: 1632032 - RNA, 23 nt, Pseudomonas putida KT2440
uggccgccagacaacuggccagg

SEQ ID NO: 1632033 - RNA, 16 nt, Pseudomonas putida KT2440
uggccgccagcggcgu

SEQ ID NO: 1632034 - RNA, 15 nt, Pseudomonas putida KT2440
uggccgagcugaucc

SEQ ID NO: 1632035 - RNA, 22 nt, Pseudomonas putida KT2440
uggccgagcugauccgccuggc

SEQ ID NO: 1632036 - RNA, 20 nt, Pseudomonas putida KT2440
uggccaucaauaccggcaug

SEQ ID NO: 1632037 - RNA, 12 nt, Pseudomonas putida KT2440
uggccagggccu

SEQ ID NO: 1632038 - RNA, 22 nt, Pseudomonas putida KT2440
uggccauaguugaccagcacca

SEQ ID NO: 1632039 - RNA, 12 nt, Pseudomonas putida KT2440
uggccaguuccu

SEQ ID NO: 1632040 - RNA, 16 nt, Pseudomonas putida KT2440
uggccagugccaugaa

SEQ ID NO: 1632041 - RNA, 22 nt, Pseudomonas putida KT2440
uggccagcggcgcggccucguc

SEQ ID NO: 1632042 - RNA, 14 nt, Pseudomonas putida KT2440
uggccagggcaaac

SEQ ID NO: 1632043 - RNA, 17 nt, Pseudomonas putida KT2440
uggccagcuucucggca

SEQ ID NO: 1632044 - RNA, 15 nt, Pseudomonas putida KT2440
uggccagcagggccg

SEQ ID NO: 1632045 - RNA, 18 nt, Pseudomonas putida KT2440
uggccagcagggccgccc

SEQ ID NO: 1632046 - RNA, 13 nt, Pseudomonas putida KT2440
uggccagcagccc

SEQ ID NO: 1632047 - RNA, 14 nt, Pseudomonas putida KT2440
uggccaccaccauc

SEQ ID NO: 1632048 - RNA, 12 nt, Pseudomonas putida KT2440
uggccaccagca

SEQ ID NO: 1632049 - RNA, 16 nt, Pseudomonas putida KT2440
uggccacacgcugcug

SEQ ID NO: 1632050 - RNA, 19 nt, Pseudomonas putida KT2440
uggccacacgcugcugcug

SEQ ID NO: 1632051 - RNA, 22 nt, Pseudomonas putida KT2440
uggccaauggcgaugaacacgc

SEQ ID NO: 1632052 - RNA, 18 nt, Pseudomonas putida KT2440
uggcagcucugcgacuga

SEQ ID NO: 1632053 - RNA, 23 nt, Pseudomonas putida KT2440
uggcagcucugcgacugaauaca

SEQ ID NO: 1632054 - RNA, 17 nt, Pseudomonas putida KT2440
uggcagcggcuuggccg

SEQ ID NO: 1632055 - RNA, 15 nt, Pseudomonas putida KT2440
uggcagcgggcugcc

SEQ ID NO: 1632056 - RNA, 23 nt, Pseudomonas putida KT2440
uggcagcgggcugcccggugccg

SEQ ID NO: 1632057 - RNA, 18 nt, Pseudomonas putida KT2440
uggcagcagccucggccu

SEQ ID NO: 1632058 - RNA, 15 nt, Pseudomonas putida KT2440
uggcagccggcgccg

SEQ ID NO: 1632059 - RNA, 16 nt, Pseudomonas putida KT2440
uggccgugccgaggac

SEQ ID NO: 1632060 - RNA, 13 nt, Pseudomonas putida KT2440
uggccgguggcuu

SEQ ID NO: 1632061 - RNA, 22 nt, Pseudomonas putida KT2440
uggccgguggcuucguggugcu

SEQ ID NO: 1632062 - RNA, 19 nt, Pseudomonas putida KT2440
uggccgguguggccaaggc

SEQ ID NO: 1632063 - RNA, 18 nt, Pseudomonas putida KT2440
uggccguagccaggcauu

SEQ ID NO: 1632064 - RNA, 17 nt, Pseudomonas putida KT2440
uggccgguuucagucag

SEQ ID NO: 1632065 - RNA, 18 nt, Pseudomonas putida KT2440
uggcgaaggcugccuggc

SEQ ID NO: 1632066 - RNA, 18 nt, Pseudomonas putida KT2440
uggcgaagucggccuggg

SEQ ID NO: 1632067 - RNA, 20 nt, Pseudomonas putida KT2440
uggcgaagaccgccgcccag

SEQ ID NO: 1632068 - RNA, 22 nt, Pseudomonas putida KT2440
uggcgaagaccgccgcccaggu

SEQ ID NO: 1632069 - RNA, 12 nt, Pseudomonas putida KT2440
uggccugagccg

SEQ ID NO: 1632070 - RNA, 20 nt, Pseudomonas putida KT2440
uggccuuggacaccaggcug

SEQ ID NO: 1632071 - RNA, 23 nt, Pseudomonas putida KT2440
uggccuuggacaccaggcuggug

SEQ ID NO: 1632072 - RNA, 15 nt, Pseudomonas putida KT2440
uggccuuucugcuuc

SEQ ID NO: 1632073 - RNA, 13 nt, Pseudomonas putida KT2440
uggccgccuccca

SEQ ID NO: 1632074 - RNA, 18 nt, Pseudomonas putida KT2440
uggccgcgcgggugcgag

SEQ ID NO: 1632075 - RNA, 23 nt, Pseudomonas putida KT2440
uggccgcgcgggugcgagaggcg

SEQ ID NO: 1632076 - RNA, 23 nt, Pseudomonas putida KT2440
uggccgcgaagcggcggguagag

SEQ ID NO: 1632077 - RNA, 18 nt, Pseudomonas putida KT2440
uggccgcgcaggaagaag

SEQ ID NO: 1632078 - RNA, 21 nt, Pseudomonas putida KT2440
uggccggcgcugagcgacagc

SEQ ID NO: 1632079 - RNA, 20 nt, Pseudomonas putida KT2440
uggccggaggcaaauuuuca

SEQ ID NO: 1632080 - RNA, 13 nt, Pseudomonas putida KT2440
uggccgcuugcug

SEQ ID NO: 1632081 - RNA, 14 nt, Pseudomonas putida KT2440
uggccggcaacggc

SEQ ID NO: 1632082 - RNA, 19 nt, Pseudomonas putida KT2440
uggccggcaacggccacgc

SEQ ID NO: 1632083 - RNA, 18 nt, Pseudomonas putida KT2440
uggcgagcaggucaugca

SEQ ID NO: 1632084 - RNA, 19 nt, Pseudomonas putida KT2440
uggcgaaucagcaugccca

SEQ ID NO: 1632085 - RNA, 18 nt, Pseudomonas putida KT2440
uggcgauccacagcgggu

SEQ ID NO: 1632086 - RNA, 15 nt, Pseudomonas putida KT2440
uggcgaugaacugcc

SEQ ID NO: 1632087 - RNA, 21 nt, Pseudomonas putida KT2440
uggcgccuugauuaccagcgc

SEQ ID NO: 1632088 - RNA, 14 nt, Pseudomonas putida KT2440
uggcgcuccaugua

SEQ ID NO: 1632089 - RNA, 17 nt, Pseudomonas putida KT2440
uggcgcugaucaucgac

SEQ ID NO: 1632090 - RNA, 12 nt, Pseudomonas putida KT2440
uggcgccgaugu

SEQ ID NO: 1632091 - RNA, 18 nt, Pseudomonas putida KT2440
uggcgccggacuucuuca

SEQ ID NO: 1632092 - RNA, 19 nt, Pseudomonas putida KT2440
uggcgccggauuucuucca

SEQ ID NO: 1632093 - RNA, 22 nt, Pseudomonas putida KT2440
uggcggaaugucggcguuaccc

SEQ ID NO: 1632094 - RNA, 16 nt, Pseudomonas putida KT2440
uggcggaucagcgcgu

SEQ ID NO: 1632095 - RNA, 15 nt, Pseudomonas putida KT2440
uggcgcuuuccagcu

SEQ ID NO: 1632096 - RNA, 16 nt, Pseudomonas putida KT2440
uggcgcuuccuggccu

SEQ ID NO: 1632097 - RNA, 20 nt, Pseudomonas putida KT2440
uggcgguauucacaccugcc

SEQ ID NO: 1632098 - RNA, 17 nt, Pseudomonas putida KT2440
uggcggcauacaccacc

SEQ ID NO: 1632099 - RNA, 22 nt, Pseudomonas putida KT2440
uggcggcauacaccaccggccg

SEQ ID NO: 1632100 - RNA, 16 nt, Pseudomonas putida KT2440
ugguaugauuucaggg

SEQ ID NO: 1632101 - RNA, 17 nt, Pseudomonas putida KT2440
ugguaugauuucagggu

SEQ ID NO: 1632102 - RNA, 16 nt, Pseudomonas putida KT2440
ugguagcgguggcguu

SEQ ID NO: 1632103 - RNA, 15 nt, Pseudomonas putida KT2440
ugguaucugccagca

SEQ ID NO: 1632104 - RNA, 19 nt, Pseudomonas putida KT2440
uggguuacggcggccugcu

SEQ ID NO: 1632105 - RNA, 21 nt, Pseudomonas putida KT2440
uggguuacggcggccugcugc

SEQ ID NO: 1632106 - RNA, 23 nt, Pseudomonas putida KT2440
uggguuuuuuuaugggcagcacc

SEQ ID NO: 1632107 - RNA, 14 nt, Pseudomonas putida KT2440
ugguacaacaacaa

SEQ ID NO: 1632108 - RNA, 20 nt, Pseudomonas putida KT2440
ugguacagcucacgcagcca

SEQ ID NO: 1632109 - RNA, 15 nt, Pseudomonas putida KT2440
ugguacagggucagg

SEQ ID NO: 1632110 - RNA, 12 nt, Pseudomonas putida KT2440
ugguaacucacc

SEQ ID NO: 1632111 - RNA, 20 nt, Pseudomonas putida KT2440
uggucgcguuguucagcagc

SEQ ID NO: 1632112 - RNA, 13 nt, Pseudomonas putida KT2440
uggucgcugcccu

SEQ ID NO: 1632113 - RNA, 19 nt, Pseudomonas putida KT2440
uggucgcugcccucggccg

SEQ ID NO: 1632114 - RNA, 18 nt, Pseudomonas putida KT2440
uggucgcugcggcacacc

SEQ ID NO: 1632115 - RNA, 16 nt, Pseudomonas putida KT2440
uggucgcggcgcuggc

SEQ ID NO: 1632116 - RNA, 15 nt, Pseudomonas putida KT2440
uggucgcgggccagc

SEQ ID NO: 1632117 - RNA, 23 nt, Pseudomonas putida KT2440
uggucgcgggccagcccauccag

SEQ ID NO: 1632118 - RNA, 15 nt, Pseudomonas putida KT2440
uggucgaucccggcu

SEQ ID NO: 1632119 - RNA, 20 nt, Pseudomonas putida KT2440
uggucgccucgacgcagaca

SEQ ID NO: 1632120 - RNA, 22 nt, Pseudomonas putida KT2440
uggucgccucgacgcagacaaa

SEQ ID NO: 1632121 - RNA, 19 nt, Pseudomonas putida KT2440
ugguccgggcccaugccac

SEQ ID NO: 1632122 - RNA, 15 nt, Pseudomonas putida KT2440
ugguccuugcacagu

SEQ ID NO: 1632123 - RNA, 18 nt, Pseudomonas putida KT2440
uggucgaaugcgugcaac

SEQ ID NO: 1632124 - RNA, 23 nt, Pseudomonas putida KT2440
ugguccagaaaauaugcuguugg

SEQ ID NO: 1632125 - RNA, 13 nt, Pseudomonas putida KT2440
ugguccagggcca

SEQ ID NO: 1632126 - RNA, 17 nt, Pseudomonas putida KT2440
ugguccagggccauggc

SEQ ID NO: 1632127 - RNA, 14 nt, Pseudomonas putida KT2440
ugguccccuucguc

SEQ ID NO: 1632128 - RNA, 16 nt, Pseudomonas putida KT2440
uggucagcggaccagg

SEQ ID NO: 1632129 - RNA, 23 nt, Pseudomonas putida KT2440
uggucagucgagucgacagugac

SEQ ID NO: 1632130 - RNA, 16 nt, Pseudomonas putida KT2440
uggucauccaggcugg

SEQ ID NO: 1632131 - RNA, 21 nt, Pseudomonas putida KT2440
uggucauccaggcuggccagc

SEQ ID NO: 1632132 - RNA, 15 nt, Pseudomonas putida KT2440
uggucacccagcgcu

SEQ ID NO: 1632133 - RNA, 20 nt, Pseudomonas putida KT2440
uggucaccuuguccagcagg

SEQ ID NO: 1632134 - RNA, 22 nt, Pseudomonas putida KT2440
uggucacguagaacaggccugc

SEQ ID NO: 1632135 - RNA, 22 nt, Pseudomonas putida KT2440
uggucacgccauccccccagcc

SEQ ID NO: 1632136 - RNA, 14 nt, Pseudomonas putida KT2440
uggucacgcggccg

SEQ ID NO: 1632137 - RNA, 20 nt, Pseudomonas putida KT2440
ugggagucggcucuggcaag

SEQ ID NO: 1632138 - RNA, 20 nt, Pseudomonas putida KT2440
ugggcaccagcuuccagaag

SEQ ID NO: 1632139 - RNA, 22 nt, Pseudomonas putida KT2440
ugggcaaugcgagacgccacca

SEQ ID NO: 1632140 - RNA, 22 nt, Pseudomonas putida KT2440
ugggcaauggcguauccacaua

SEQ ID NO: 1632141 - RNA, 16 nt, Pseudomonas putida KT2440
ugggcaauguccagcc

SEQ ID NO: 1632142 - RNA, 20 nt, Pseudomonas putida KT2440
ugggcaacaccgccagaaaa

SEQ ID NO: 1632143 - RNA, 17 nt, Pseudomonas putida KT2440
uggcuuucccccagcca

SEQ ID NO: 1632144 - RNA, 18 nt, Pseudomonas putida KT2440
uggcuuccugcuggcuca

SEQ ID NO: 1632145 - RNA, 17 nt, Pseudomonas putida KT2440
uggcguugcgaaggcga

SEQ ID NO: 1632146 - RNA, 14 nt, Pseudomonas putida KT2440
uggcguugucagca

SEQ ID NO: 1632147 - RNA, 20 nt, Pseudomonas putida KT2440
uggcgucggcgauggcgucc

SEQ ID NO: 1632148 - RNA, 23 nt, Pseudomonas putida KT2440
ugggcagcaccgcguaucaggca

SEQ ID NO: 1632149 - RNA, 19 nt, Pseudomonas putida KT2440
ugggcgugccaggcuuggc

SEQ ID NO: 1632150 - RNA, 21 nt, Pseudomonas putida KT2440
ugggcgucgauaaaagggucu

SEQ ID NO: 1632151 - RNA, 22 nt, Pseudomonas putida KT2440
ugggcggcgugaccagcccggc

SEQ ID NO: 1632152 - RNA, 23 nt, Pseudomonas putida KT2440
ugggcucagccgccacaugcccg

SEQ ID NO: 1632153 - RNA, 15 nt, Pseudomonas putida KT2440
ugggcguucugacaa

SEQ ID NO: 1632154 - RNA, 18 nt, Pseudomonas putida KT2440
uggggcugcugcgcagcc

SEQ ID NO: 1632155 - RNA, 23 nt, Pseudomonas putida KT2440
ugggggugaagcccugcugcugg

SEQ ID NO: 1632156 - RNA, 15 nt, Pseudomonas putida KT2440
uggguggugucgcug

SEQ ID NO: 1632157 - RNA, 22 nt, Pseudomonas putida KT2440
ugggugugcgccgucaccagcg

SEQ ID NO: 1632158 - RNA, 21 nt, Pseudomonas putida KT2440
ugggugucggcauacagcucc

SEQ ID NO: 1632159 - RNA, 18 nt, Pseudomonas putida KT2440
uggggccgcuuggcggcc

SEQ ID NO: 1632160 - RNA, 16 nt, Pseudomonas putida KT2440
uggggccaaguggcug

SEQ ID NO: 1632161 - RNA, 12 nt, Pseudomonas putida KT2440
uggggcaggccc

SEQ ID NO: 1632162 - RNA, 20 nt, Pseudomonas putida KT2440
uguguacgccgcugucaucc

SEQ ID NO: 1632163 - RNA, 16 nt, Pseudomonas putida KT2440
uguggcgccagggcau

SEQ ID NO: 1632164 - RNA, 14 nt, Pseudomonas putida KT2440
uguggauuucaauu

SEQ ID NO: 1632165 - RNA, 20 nt, Pseudomonas putida KT2440
ugugggagcggccuuguguc

SEQ ID NO: 1632166 - RNA, 19 nt, Pseudomonas putida KT2440
ugugcugccauaagcccaa

SEQ ID NO: 1632167 - RNA, 18 nt, Pseudomonas putida KT2440
ugugcugcggccaccgcc

SEQ ID NO: 1632168 - RNA, 14 nt, Pseudomonas putida KT2440
ugugcgugaacacu

SEQ ID NO: 1632169 - RNA, 15 nt, Pseudomonas putida KT2440
ugugcuccagcucca

SEQ ID NO: 1632170 - RNA, 22 nt, Pseudomonas putida KT2440
uguuaccucccgcacauuucac

SEQ ID NO: 1632171 - RNA, 21 nt, Pseudomonas putida KT2440
ugugacgcuggucggccaccc

SEQ ID NO: 1632172 - RNA, 12 nt, Pseudomonas putida KT2440
ugucugugcccg

SEQ ID NO: 1632173 - RNA, 14 nt, Pseudomonas putida KT2440
ugucugggcacuug

SEQ ID NO: 1632174 - RNA, 16 nt, Pseudomonas putida KT2440
ugugccacuucauggg

SEQ ID NO: 1632175 - RNA, 23 nt, Pseudomonas putida KT2440
ugugccaccuucagcgggucgag

SEQ ID NO: 1632176 - RNA, 20 nt, Pseudomonas putida KT2440
ugugcgauagcggugugaca

SEQ ID NO: 1632177 - RNA, 14 nt, Pseudomonas putida KT2440
ugugcacuggcagg

SEQ ID NO: 1632178 - RNA, 14 nt, Pseudomonas putida KT2440
uguccagcgucugc

SEQ ID NO: 1632179 - RNA, 21 nt, Pseudomonas putida KT2440
uguccagacgccgcagugaca

SEQ ID NO: 1632180 - RNA, 15 nt, Pseudomonas putida KT2440
uguccagcagcagcg

SEQ ID NO: 1632181 - RNA, 19 nt, Pseudomonas putida KT2440
uguccacccccgcuccuac

SEQ ID NO: 1632182 - RNA, 17 nt, Pseudomonas putida KT2440
uguccacaaacucuccu

SEQ ID NO: 1632183 - RNA, 20 nt, Pseudomonas putida KT2440
ugucgcgacgggcugcuccc

SEQ ID NO: 1632184 - RNA, 16 nt, Pseudomonas putida KT2440
ugucggucacagcagu

SEQ ID NO: 1632185 - RNA, 23 nt, Pseudomonas putida KT2440
ugucggucauggucaacagcccg

SEQ ID NO: 1632186 - RNA, 18 nt, Pseudomonas putida KT2440
ugucgguggcggccagcg

SEQ ID NO: 1632187 - RNA, 16 nt, Pseudomonas putida KT2440
ugucgguggugaucac

SEQ ID NO: 1632188 - RNA, 18 nt, Pseudomonas putida KT2440
ugucuagccgccugccgc

SEQ ID NO: 1632189 - RNA, 19 nt, Pseudomonas putida KT2440
ugucagaaaaaacagugcc

SEQ ID NO: 1632190 - RNA, 21 nt, Pseudomonas putida KT2440
ugucagaaaaaacagugccgu

SEQ ID NO: 1632191 - RNA, 13 nt, Pseudomonas putida KT2440
ugucacuccaguc

SEQ ID NO: 1632192 - RNA, 13 nt, Pseudomonas putida KT2440
uguaguagcucca

SEQ ID NO: 1632193 - RNA, 23 nt, Pseudomonas putida KT2440
uguagucaccaccggcuuccagc

SEQ ID NO: 1632194 - RNA, 22 nt, Pseudomonas putida KT2440
uguagcucccucgguuucucac

SEQ ID NO: 1632195 - RNA, 18 nt, Pseudomonas putida KT2440
uggugaaaugguugaaga

SEQ ID NO: 1632196 - RNA, 16 nt, Pseudomonas putida KT2440
uggugaaagucgacca

SEQ ID NO: 1632197 - RNA, 15 nt, Pseudomonas putida KT2440
uggucuucgccgcca

SEQ ID NO: 1632198 - RNA, 23 nt, Pseudomonas putida KT2440
uggucuucgccgccaugguuuug

SEQ ID NO: 1632199 - RNA, 21 nt, Pseudomonas putida KT2440
uggucugguugaccgagaaca

SEQ ID NO: 1632200 - RNA, 14 nt, Pseudomonas putida KT2440
ugguuuaguccugc

SEQ ID NO: 1632201 - RNA, 22 nt, Pseudomonas putida KT2440
ugguuuauccggcacagaaucc

SEQ ID NO: 1632202 - RNA, 18 nt, Pseudomonas putida KT2440
uguaccgggcggccaccg

SEQ ID NO: 1632203 - RNA, 19 nt, Pseudomonas putida KT2440
uguaccagaaccccggccc

SEQ ID NO: 1632204 - RNA, 21 nt, Pseudomonas putida KT2440
uguagaacggcagcaggccaa

SEQ ID NO: 1632205 - RNA, 14 nt, Pseudomonas putida KT2440
uguacgacugccgc

SEQ ID NO: 1632206 - RNA, 15 nt, Pseudomonas putida KT2440
uguuguuugggccug

SEQ ID NO: 1632207 - RNA, 22 nt, Pseudomonas putida KT2440
uguuggccaccaucgccggcac

SEQ ID NO: 1632208 - RNA, 17 nt, Pseudomonas putida KT2440
uguuggcgcgacauguu

SEQ ID NO: 1632209 - RNA, 19 nt, Pseudomonas putida KT2440
uguuggaaaugaacagccg

SEQ ID NO: 1632210 - RNA, 14 nt, Pseudomonas putida KT2440
uguuggcugugaga

SEQ ID NO: 1632211 - RNA, 15 nt, Pseudomonas putida KT2440
uguugggcgggccgc

SEQ ID NO: 1632212 - RNA, 15 nt, Pseudomonas putida KT2440
uguugguguggcagc

SEQ ID NO: 1632213 - RNA, 13 nt, Pseudomonas putida KT2440
uguugucugugcc

SEQ ID NO: 1632214 - RNA, 16 nt, Pseudomonas putida KT2440
uguugucgaagcgcac

SEQ ID NO: 1632215 - RNA, 22 nt, Pseudomonas putida KT2440
uguugccaaugccggcacagcc

SEQ ID NO: 1632216 - RNA, 18 nt, Pseudomonas putida KT2440
uguugcgcaccuugugca

SEQ ID NO: 1632217 - RNA, 13 nt, Pseudomonas putida KT2440
uguugcccggcau

SEQ ID NO: 1632218 - RNA, 15 nt, Pseudomonas putida KT2440
uguugcuugucccag

SEQ ID NO: 1632219 - RNA, 15 nt, Pseudomonas putida KT2440
uguugcuguuggcgc

SEQ ID NO: 1632220 - RNA, 13 nt, Pseudomonas putida KT2440
uguugcugggcga

SEQ ID NO: 1632221 - RNA, 20 nt, Pseudomonas putida KT2440
uguugagcagcagcccuucg

SEQ ID NO: 1632222 - RNA, 14 nt, Pseudomonas putida KT2440
uguucuuguagcug

SEQ ID NO: 1632223 - RNA, 18 nt, Pseudomonas putida KT2440
uguucuugaacucgccgc

SEQ ID NO: 1632224 - RNA, 17 nt, Pseudomonas putida KT2440
uguucuguuucaccagc

SEQ ID NO: 1632225 - RNA, 13 nt, Pseudomonas putida KT2440
uguucuggccacc

SEQ ID NO: 1632226 - RNA, 15 nt, Pseudomonas putida KT2440
uguucggugcucagg

SEQ ID NO: 1632227 - RNA, 17 nt, Pseudomonas putida KT2440
uguucgcgcaggaucca

SEQ ID NO: 1632228 - RNA, 22 nt, Pseudomonas putida KT2440
uguucgauuucaccggcuucua

SEQ ID NO: 1632229 - RNA, 15 nt, Pseudomonas putida KT2440
uguucguucccacaa

SEQ ID NO: 1632230 - RNA, 14 nt, Pseudomonas putida KT2440
uguucucgccgccg

SEQ ID NO: 1632231 - RNA, 12 nt, Pseudomonas putida KT2440
uguuccgcccag

SEQ ID NO: 1632232 - RNA, 20 nt, Pseudomonas putida KT2440
uguuccauuucccuacagcc

SEQ ID NO: 1632233 - RNA, 15 nt, Pseudomonas putida KT2440
uguucccccaccggc

SEQ ID NO: 1632234 - RNA, 20 nt, Pseudomonas putida KT2440
uguuccagccgcgccacucc

SEQ ID NO: 1632235 - RNA, 16 nt, Pseudomonas putida KT2440
uguuccaguucggaaa

SEQ ID NO: 1632236 - RNA, 21 nt, Pseudomonas putida KT2440
uguucauugacggucagugaa

SEQ ID NO: 1632237 - RNA, 22 nt, Pseudomonas putida KT2440
uguucauuccguuggccaccac

SEQ ID NO: 1632238 - RNA, 19 nt, Pseudomonas putida KT2440
uguucagcaccuucuugcc

SEQ ID NO: 1632239 - RNA, 22 nt, Pseudomonas putida KT2440
uguucagcagcgaagggcucaa

SEQ ID NO: 1632240 - RNA, 20 nt, Pseudomonas putida KT2440
uguucagguaggccgcagcc

SEQ ID NO: 1632241 - RNA, 23 nt, Pseudomonas putida KT2440
uguucagcccuugcugcagcagg

SEQ ID NO: 1632242 - RNA, 14 nt, Pseudomonas putida KT2440
uguuauugggacca

SEQ ID NO: 1632243 - RNA, 14 nt, Pseudomonas putida KT2440
uguuucagcccuug

SEQ ID NO: 1632244 - RNA, 15 nt, Pseudomonas putida KT2440
uguuucagccuuggc

SEQ ID NO: 1632245 - RNA, 17 nt, Pseudomonas putida KT2440
uguuucagccuuggccg

SEQ ID NO: 1632246 - RNA, 20 nt, Pseudomonas putida KT2440
uguuuccaccccggcagugc

SEQ ID NO: 1632247 - RNA, 18 nt, Pseudomonas putida KT2440
uguuucugccccuggccc

SEQ ID NO: 1632248 - RNA, 20 nt, Pseudomonas putida KT2440
uguuugagccggcgcugggc

SEQ ID NO: 1632249 - RNA, 11 nt, Pseudomonas putida KT2440
uguuugaccac

SEQ ID NO: 1632250 - RNA, 11 nt, Pseudomonas putida KT2440
uguuugaagcu

SEQ ID NO: 1632251 - RNA, 17 nt, Pseudomonas putida KT2440
uuagccugcacuggccu

SEQ ID NO: 1632252 - RNA, 23 nt, Pseudomonas putida KT2440
uuagacccgcaagcgggcagugc

SEQ ID NO: 1632253 - RNA, 16 nt, Pseudomonas putida KT2440
uuagacauuagaaaau

SEQ ID NO: 1632254 - RNA, 19 nt, Pseudomonas putida KT2440
uuacuagauggcugaaauc

SEQ ID NO: 1632255 - RNA, 15 nt, Pseudomonas putida KT2440
uuacuguuugagccg

SEQ ID NO: 1632256 - RNA, 17 nt, Pseudomonas putida KT2440
uuacgcauugccgacuc

SEQ ID NO: 1632257 - RNA, 14 nt, Pseudomonas putida KT2440
uuacgccagaaggu

SEQ ID NO: 1632258 - RNA, 14 nt, Pseudomonas putida KT2440
uuacgcaggcucca

SEQ ID NO: 1632259 - RNA, 13 nt, Pseudomonas putida KT2440
uuacgcggcagca

SEQ ID NO: 1632260 - RNA, 15 nt, Pseudomonas putida KT2440
uuacgccaggcguug

SEQ ID NO: 1632261 - RNA, 19 nt, Pseudomonas putida KT2440
uuacggcggccugcugccg

SEQ ID NO: 1632262 - RNA, 19 nt, Pseudomonas putida KT2440
uuacgcugggcgugccagg

SEQ ID NO: 1632263 - RNA, 21 nt, Pseudomonas putida KT2440
uuacgcugggcgugccaggcu

SEQ ID NO: 1632264 - RNA, 12 nt, Pseudomonas putida KT2440
uuaacaugcugg

SEQ ID NO: 1632265 - RNA, 21 nt, Pseudomonas putida KT2440
uuaaguauuaauuugaacaau

SEQ ID NO: 1632266 - RNA, 21 nt, Pseudomonas putida KT2440
uuaacacagguaguucacugg

SEQ ID NO: 1632267 - RNA, 13 nt, Pseudomonas putida KT2440
uuaacaaggcacg

SEQ ID NO: 1632268 - RNA, 16 nt, Pseudomonas putida KT2440
aaaugauccccggcga

SEQ ID NO: 1632269 - RNA, 14 nt, Pseudomonas putida KT2440
aaaugaucaagaag

SEQ ID NO: 1632270 - RNA, 23 nt, Pseudomonas putida KT2440
aaaugcaccacgcgcaaaugcuu

SEQ ID NO: 1632271 - RNA, 15 nt, Pseudomonas putida KT2440
ucucaggcaccagcg

SEQ ID NO: 1632272 - RNA, 19 nt, Pseudomonas putida KT2440
ucucagcccauuucaccug

SEQ ID NO: 1632273 - RNA, 14 nt, Pseudomonas putida KT2440
ucucagcaccauuu

SEQ ID NO: 1632274 - RNA, 18 nt, Pseudomonas putida KT2440
aaaugccccgggcaggcc

SEQ ID NO: 1632275 - RNA, 17 nt, Pseudomonas putida KT2440
aaaugccucggcaaagc

SEQ ID NO: 1632276 - RNA, 22 nt, Pseudomonas putida KT2440
ucucacaggcgcugaaacuguc

SEQ ID NO: 1632277 - RNA, 19 nt, Pseudomonas putida KT2440
ucucaaggcuuuccaccug

SEQ ID NO: 1632278 - RNA, 12 nt, Pseudomonas putida KT2440
ucucaagcuuca

SEQ ID NO: 1632279 - RNA, 14 nt, Pseudomonas putida KT2440
ucucaagcaaucca

SEQ ID NO: 1632280 - RNA, 14 nt, Pseudomonas putida KT2440
ucucaagccugcca

SEQ ID NO: 1632281 - RNA, 22 nt, Pseudomonas putida KT2440
ucucaagccugccaaaucccuu

SEQ ID NO: 1632282 - RNA, 17 nt, Pseudomonas putida KT2440
ucuaccacgccgcugcc

SEQ ID NO: 1632283 - RNA, 17 nt, Pseudomonas putida KT2440
aaaugacuguuaaucau

SEQ ID NO: 1632284 - RNA, 22 nt, Pseudomonas putida KT2440
ucuacccgccgcuucgcggcca

SEQ ID NO: 1632285 - RNA, 14 nt, Pseudomonas putida KT2440
ucuaccugagcuuc

SEQ ID NO: 1632286 - RNA, 20 nt, Pseudomonas putida KT2440
ucuaccaaccugccaugcag

SEQ ID NO: 1632287 - RNA, 21 nt, Pseudomonas putida KT2440
ucuaaaaucaucggcaaauga

SEQ ID NO: 1632288 - RNA, 21 nt, Pseudomonas putida KT2440
ucuggcuggagccguccagga

SEQ ID NO: 1632289 - RNA, 15 nt, Pseudomonas putida KT2440
ucuggucaccuucgu

SEQ ID NO: 1632290 - RNA, 18 nt, Pseudomonas putida KT2440
ucuggucaccuucguccu

SEQ ID NO: 1632291 - RNA, 23 nt, Pseudomonas putida KT2440
ucuggucguugguggugcgcccg

SEQ ID NO: 1632292 - RNA, 14 nt, Pseudomonas putida KT2440
ucuggcgugcaccu

SEQ ID NO: 1632293 - RNA, 13 nt, Pseudomonas putida KT2440
ucugcaggucaug

SEQ ID NO: 1632294 - RNA, 21 nt, Pseudomonas putida KT2440
ucugcauguccagcccguucu

SEQ ID NO: 1632295 - RNA, 18 nt, Pseudomonas putida KT2440
ucugccaggcaccacaag

SEQ ID NO: 1632296 - RNA, 20 nt, Pseudomonas putida KT2440
ucugcuuccuugcgcacgcg

SEQ ID NO: 1632297 - RNA, 19 nt, Pseudomonas putida KT2440
ucugcuugcucugugcaug

SEQ ID NO: 1632298 - RNA, 15 nt, Pseudomonas putida KT2440
ucugguugccgccag

SEQ ID NO: 1632299 - RNA, 23 nt, Pseudomonas putida KT2440
ucugguuaccagaguugccacca

SEQ ID NO: 1632300 - RNA, 22 nt, Pseudomonas putida KT2440
ucuguaaucaggcuguccacac

SEQ ID NO: 1632301 - RNA, 20 nt, Pseudomonas putida KT2440
ucuguacaguggcacuggcg

SEQ ID NO: 1632302 - RNA, 15 nt, Pseudomonas putida KT2440
ucuguacugcggcug

SEQ ID NO: 1632303 - RNA, 19 nt, Pseudomonas putida KT2440
ucuuccaaguuggcucugu

SEQ ID NO: 1632304 - RNA, 12 nt, Pseudomonas putida KT2440
ucuuccacgccc

SEQ ID NO: 1632305 - RNA, 22 nt, Pseudomonas putida KT2440
ucuucacucaaccaccgcucaa

SEQ ID NO: 1632306 - RNA, 15 nt, Pseudomonas putida KT2440
ucuucacaccggccu

SEQ ID NO: 1632307 - RNA, 19 nt, Pseudomonas putida KT2440
ucuucaccguacuugcugc

SEQ ID NO: 1632308 - RNA, 14 nt, Pseudomonas putida KT2440
ucuucaccuugccu

SEQ ID NO: 1632309 - RNA, 17 nt, Pseudomonas putida KT2440
ucuucaccuugccuacc

SEQ ID NO: 1632310 - RNA, 17 nt, Pseudomonas putida KT2440
ucuucaccaugggccug

SEQ ID NO: 1632311 - RNA, 14 nt, Pseudomonas putida KT2440
ucuucacugcucau

SEQ ID NO: 1632312 - RNA, 23 nt, Pseudomonas putida KT2440
ucuucacguccagccacuuguuc

SEQ ID NO: 1632313 - RNA, 17 nt, Pseudomonas putida KT2440
ucuucgcgggcaagccc

SEQ ID NO: 1632314 - RNA, 18 nt, Pseudomonas putida KT2440
ucuucgcgggcaagcccg

SEQ ID NO: 1632315 - RNA, 23 nt, Pseudomonas putida KT2440
ucuucgcgggcacgcccgcuccc

SEQ ID NO: 1632316 - RNA, 15 nt, Pseudomonas putida KT2440
ucuucgcgggcaugc

SEQ ID NO: 1632317 - RNA, 23 nt, Pseudomonas putida KT2440
ucuucgcgggcaugcccgcuccc

SEQ ID NO: 1632318 - RNA, 21 nt, Pseudomonas putida KT2440
ucuucgcgggugaacccgcuc

SEQ ID NO: 1632319 - RNA, 16 nt, Pseudomonas putida KT2440
ucuuccucgacccagc

SEQ ID NO: 1632320 - RNA, 23 nt, Pseudomonas putida KT2440
ucuuccggcaggucggcaaccau

SEQ ID NO: 1632321 - RNA, 20 nt, Pseudomonas putida KT2440
ucuuccagcggcaaggucaa

SEQ ID NO: 1632322 - RNA, 20 nt, Pseudomonas putida KT2440
ucuuacgggcuugugcauca

SEQ ID NO: 1632323 - RNA, 20 nt, Pseudomonas putida KT2440
ucuucaaccuguuccggccu

SEQ ID NO: 1632324 - RNA, 14 nt, Pseudomonas putida KT2440
ucuucaaggccacc

SEQ ID NO: 1632325 - RNA, 22 nt, Pseudomonas putida KT2440
ucuucaagcagcgaaugcagcu

SEQ ID NO: 1632326 - RNA, 21 nt, Pseudomonas putida KT2440
ucuucaaccaguucagcgccc

SEQ ID NO: 1632327 - RNA, 22 nt, Pseudomonas putida KT2440
ucugcaacuccucgaucaccug

SEQ ID NO: 1632328 - RNA, 23 nt, Pseudomonas putida KT2440
ucugcaacuccucgaucaccugc

SEQ ID NO: 1632329 - RNA, 14 nt, Pseudomonas putida KT2440
ucugcaacugccca

SEQ ID NO: 1632330 - RNA, 21 nt, Pseudomonas putida KT2440
ucugagcgucauuagccuuca

SEQ ID NO: 1632331 - RNA, 15 nt, Pseudomonas putida KT2440
ucugcaggcacaccc

SEQ ID NO: 1632332 - RNA, 21 nt, Pseudomonas putida KT2440
ucugcagcaccgacuggcgua

SEQ ID NO: 1632333 - RNA, 21 nt, Pseudomonas putida KT2440
ucugcagccugacgcgccgcc

SEQ ID NO: 1632334 - RNA, 12 nt, Pseudomonas putida KT2440
ucugcagcagcg

SEQ ID NO: 1632335 - RNA, 20 nt, Pseudomonas putida KT2440
ucugcagcagcgcgccgaac

SEQ ID NO: 1632336 - RNA, 23 nt, Pseudomonas putida KT2440
ucugcaccggcagcgcaaucacc

SEQ ID NO: 1632337 - RNA, 12 nt, Pseudomonas putida KT2440
ucucuuucaggc

SEQ ID NO: 1632338 - RNA, 21 nt, Pseudomonas putida KT2440
ucugacauaacaagaacaaca

SEQ ID NO: 1632339 - RNA, 12 nt, Pseudomonas putida KT2440
ucugacagcagg

SEQ ID NO: 1632340 - RNA, 15 nt, Pseudomonas putida KT2440
ucugaccggcacugc

SEQ ID NO: 1632341 - RNA, 17 nt, Pseudomonas putida KT2440
ucugaccggcacugcac

SEQ ID NO: 1632342 - RNA, 21 nt, Pseudomonas putida KT2440
ucucuucgguagacuucugcg

SEQ ID NO: 1632343 - RNA, 20 nt, Pseudomonas putida KT2440
ucucugaccggcacugcaca

SEQ ID NO: 1632344 - RNA, 13 nt, Pseudomonas putida KT2440
ucucggccagcag

SEQ ID NO: 1632345 - RNA, 20 nt, Pseudomonas putida KT2440
ucuccugcagggaacugcgc

SEQ ID NO: 1632346 - RNA, 18 nt, Pseudomonas putida KT2440
ucuccggugcaaagcugu

SEQ ID NO: 1632347 - RNA, 19 nt, Pseudomonas putida KT2440
ucuccgugcucaggcggcc

SEQ ID NO: 1632348 - RNA, 21 nt, Pseudomonas putida KT2440
ucuccuuggacagcaauucca

SEQ ID NO: 1632349 - RNA, 13 nt, Pseudomonas putida KT2440
ucucgcagcagca

SEQ ID NO: 1632350 - RNA, 14 nt, Pseudomonas putida KT2440
ucucgcagcagcac

SEQ ID NO: 1632351 - RNA, 20 nt, Pseudomonas putida KT2440
ucucgaugaugcuggucggc

SEQ ID NO: 1632352 - RNA, 19 nt, Pseudomonas putida KT2440
ucucgaucuaugcccggcu

SEQ ID NO: 1632353 - RNA, 15 nt, Pseudomonas putida KT2440
ucucgcggugccuuc

SEQ ID NO: 1632354 - RNA, 19 nt, Pseudomonas putida KT2440
ucucgcggugccuucaggc

SEQ ID NO: 1632355 - RNA, 13 nt, Pseudomonas putida KT2440
ucucgcgcaggcg

SEQ ID NO: 1632356 - RNA, 16 nt, Pseudomonas putida KT2440
ucucccaggccgacac

SEQ ID NO: 1632357 - RNA, 16 nt, Pseudomonas putida KT2440
ucuccgcgcuugcuca

SEQ ID NO: 1632358 - RNA, 15 nt, Pseudomonas putida KT2440
ucuccauugcgccug

SEQ ID NO: 1632359 - RNA, 20 nt, Pseudomonas putida KT2440
ucuccagcaccgccccggcc

SEQ ID NO: 1632360 - RNA, 21 nt, Pseudomonas putida KT2440
ucuccaguuguugggcagcca

SEQ ID NO: 1632361 - RNA, 18 nt, Pseudomonas putida KT2440
ucuccagguucucgcucc

SEQ ID NO: 1632362 - RNA, 17 nt, Pseudomonas putida KT2440
ucuccagcuccuggccc

SEQ ID NO: 1632363 - RNA, 18 nt, Pseudomonas putida KT2440
ucuccagcuccuggcccg

SEQ ID NO: 1632364 - RNA, 20 nt, Pseudomonas putida KT2440
ucuccagccgcugcugcagu

SEQ ID NO: 1632365 - RNA, 22 nt, Pseudomonas putida KT2440
ucuccaacgucaaccgugcccg

SEQ ID NO: 1632366 - RNA, 22 nt, Pseudomonas putida KT2440
ucuccaacuggcgaauacgcuc

SEQ ID NO: 1632367 - RNA, 17 nt, Pseudomonas putida KT2440
ucguuucccgcuccaaa

SEQ ID NO: 1632368 - RNA, 16 nt, Pseudomonas putida KT2440
ucguuguagcugacug

SEQ ID NO: 1632369 - RNA, 14 nt, Pseudomonas putida KT2440
ucguugcgggucag

SEQ ID NO: 1632370 - RNA, 19 nt, Pseudomonas putida KT2440
ucguugaugcgcuugaagu

SEQ ID NO: 1632371 - RNA, 16 nt, Pseudomonas putida KT2440
ucguugaccguccaca

SEQ ID NO: 1632372 - RNA, 21 nt, Pseudomonas putida KT2440
ucguucggcaucgacgaugcc

SEQ ID NO: 1632373 - RNA, 17 nt, Pseudomonas putida KT2440
ucguucgggcacucggg

SEQ ID NO: 1632374 - RNA, 22 nt, Pseudomonas putida KT2440
ucguucggaucgucuggcacug

SEQ ID NO: 1632375 - RNA, 17 nt, Pseudomonas putida KT2440
ucguucaacaccuucuc

SEQ ID NO: 1632376 - RNA, 17 nt, Pseudomonas putida KT2440
ucguuacccaccagcuc

SEQ ID NO: 1632377 - RNA, 17 nt, Pseudomonas putida KT2440
ucguguucgccuguccg

SEQ ID NO: 1632378 - RNA, 21 nt, Pseudomonas putida KT2440
ucgugcaaggcgaugugcgca

SEQ ID NO: 1632379 - RNA, 15 nt, Pseudomonas putida KT2440
ucgugcucacgcccc

SEQ ID NO: 1632380 - RNA, 19 nt, Pseudomonas putida KT2440
ucgugcgccucaugcagca

SEQ ID NO: 1632381 - RNA, 14 nt, Pseudomonas putida KT2440
ucgugagaccugca

SEQ ID NO: 1632382 - RNA, 17 nt, Pseudomonas putida KT2440
ucgucggugcccuucac

SEQ ID NO: 1632383 - RNA, 17 nt, Pseudomonas putida KT2440
ucgucguccgcaguccc

SEQ ID NO: 1632384 - RNA, 14 nt, Pseudomonas putida KT2440
ucguaggcuucacg

SEQ ID NO: 1632385 - RNA, 22 nt, Pseudomonas putida KT2440
ucguagcgguugcgcaaaucgc

SEQ ID NO: 1632386 - RNA, 13 nt, Pseudomonas putida KT2440
ucgucaagcucuu

SEQ ID NO: 1632387 - RNA, 16 nt, Pseudomonas putida KT2440
ucgucaaguacuugca

SEQ ID NO: 1632388 - RNA, 16 nt, Pseudomonas putida KT2440
ucguacucggccgggc

SEQ ID NO: 1632389 - RNA, 19 nt, Pseudomonas putida KT2440
ucguaccgcauuguccucg

SEQ ID NO: 1632390 - RNA, 20 nt, Pseudomonas putida KT2440
ucguacgcgggcagacuucg

SEQ ID NO: 1632391 - RNA, 15 nt, Pseudomonas putida KT2440
ucgucggcaagcuug

SEQ ID NO: 1632392 - RNA, 14 nt, Pseudomonas putida KT2440
ucgucgaacagcau

SEQ ID NO: 1632393 - RNA, 18 nt, Pseudomonas putida KT2440
ucgucgagcaacuugcgc

SEQ ID NO: 1632394 - RNA, 19 nt, Pseudomonas putida KT2440
ucguccucgacccacggcu

SEQ ID NO: 1632395 - RNA, 15 nt, Pseudomonas putida KT2440
ucguccugcccccaa

SEQ ID NO: 1632396 - RNA, 14 nt, Pseudomonas putida KT2440
ucgucacugacccu

SEQ ID NO: 1632397 - RNA, 20 nt, Pseudomonas putida KT2440
ucguccaucuugcugcucug

SEQ ID NO: 1632398 - RNA, 20 nt, Pseudomonas putida KT2440
ucgucccucggcaaggugcu

SEQ ID NO: 1632399 - RNA, 21 nt, Pseudomonas putida KT2440
ucgucccucggcaaggugcuc

SEQ ID NO: 1632400 - RNA, 18 nt, Pseudomonas putida KT2440
ucguccaggcccugcagc

SEQ ID NO: 1632401 - RNA, 21 nt, Pseudomonas putida KT2440
ucguccaggcccugcagcgcu

SEQ ID NO: 1632402 - RNA, 12 nt, Pseudomonas putida KT2440
ucguccaggcuu

SEQ ID NO: 1632403 - RNA, 15 nt, Pseudomonas putida KT2440
ucggcgcggcccagu

SEQ ID NO: 1632404 - RNA, 13 nt, Pseudomonas putida KT2440
ucggcgccggccg

SEQ ID NO: 1632405 - RNA, 20 nt, Pseudomonas putida KT2440
ucggcggcgguaccccgccu

SEQ ID NO: 1632406 - RNA, 16 nt, Pseudomonas putida KT2440
ucgggaauaccaggcc

SEQ ID NO: 1632407 - RNA, 17 nt, Pseudomonas putida KT2440
ucgggaucagcacgccc

SEQ ID NO: 1632408 - RNA, 24 nt, Pseudomonas putida KT2440
ucggcuggcugucgaaggcuugca

SEQ ID NO: 1632409 - RNA, 15 nt, Pseudomonas putida KT2440
ucggcugaucucuuc

SEQ ID NO: 1632410 - RNA, 18 nt, Pseudomonas putida KT2440
ucggcguugcggugcaga

SEQ ID NO: 1632411 - RNA, 15 nt, Pseudomonas putida KT2440
ucggccagcugcgca

SEQ ID NO: 1632412 - RNA, 16 nt, Pseudomonas putida KT2440
ucggccagcugcugcg

SEQ ID NO: 1632413 - RNA, 20 nt, Pseudomonas putida KT2440
ucggccagcugcugcggcac

SEQ ID NO: 1632414 - RNA, 14 nt, Pseudomonas putida KT2440
ucggccagcaguuc

SEQ ID NO: 1632415 - RNA, 18 nt, Pseudomonas putida KT2440
ucggccacuucgcggaag

SEQ ID NO: 1632416 - RNA, 22 nt, Pseudomonas putida KT2440
ucggccacgguguauccagccc

SEQ ID NO: 1632417 - RNA, 22 nt, Pseudomonas putida KT2440
ucggccaugucguaccacacau

SEQ ID NO: 1632418 - RNA, 23 nt, Pseudomonas putida KT2440
ucggccaugucguaccacacauc

SEQ ID NO: 1632419 - RNA, 16 nt, Pseudomonas putida KT2440
ucggccauuugcucga

SEQ ID NO: 1632420 - RNA, 18 nt, Pseudomonas putida KT2440
ucggcccacugcacggca

SEQ ID NO: 1632421 - RNA, 15 nt, Pseudomonas putida KT2440
ucggccccggcccca

SEQ ID NO: 1632422 - RNA, 22 nt, Pseudomonas putida KT2440
ucggcgacgucguugaaggcgu

SEQ ID NO: 1632423 - RNA, 18 nt, Pseudomonas putida KT2440
ucggcgaugccgcgcgcc

SEQ ID NO: 1632424 - RNA, 22 nt, Pseudomonas putida KT2440
ucggcgauauggcuccaccaca

SEQ ID NO: 1632425 - RNA, 15 nt, Pseudomonas putida KT2440
ucggcgaucuggucg

SEQ ID NO: 1632426 - RNA, 15 nt, Pseudomonas putida KT2440
ucggcgccaggaucg

SEQ ID NO: 1632427 - RNA, 14 nt, Pseudomonas putida KT2440
ucggcgccaggccu

SEQ ID NO: 1632428 - RNA, 16 nt, Pseudomonas putida KT2440
ucggccuugucuggca

SEQ ID NO: 1632429 - RNA, 22 nt, Pseudomonas putida KT2440
ucggccuggggcaggcccggca

SEQ ID NO: 1632430 - RNA, 20 nt, Pseudomonas putida KT2440
ucggccugcucgcuggcuug

SEQ ID NO: 1632431 - RNA, 17 nt, Pseudomonas putida KT2440
ucggccucuccgaggcc

SEQ ID NO: 1632432 - RNA, 14 nt, Pseudomonas putida KT2440
ucggugcucaggcu

SEQ ID NO: 1632433 - RNA, 15 nt, Pseudomonas putida KT2440
ucggugcagcggcag

SEQ ID NO: 1632434 - RNA, 22 nt, Pseudomonas putida KT2440
ucggugacgaucaccagggcau

SEQ ID NO: 1632435 - RNA, 14 nt, Pseudomonas putida KT2440
ucggucggccccuc

SEQ ID NO: 1632436 - RNA, 19 nt, Pseudomonas putida KT2440
ucggucucgaaccacagca

SEQ ID NO: 1632437 - RNA, 18 nt, Pseudomonas putida KT2440
ucgguggcguugucagca

SEQ ID NO: 1632438 - RNA, 14 nt, Pseudomonas putida KT2440
ucgguuuuuccaug

SEQ ID NO: 1632439 - RNA, 22 nt, Pseudomonas putida KT2440
ucgguuucgccgguguucuuca

SEQ ID NO: 1632440 - RNA, 14 nt, Pseudomonas putida KT2440
ucgguagggaucac

SEQ ID NO: 1632441 - RNA, 14 nt, Pseudomonas putida KT2440
ucgguauccggcuc

SEQ ID NO: 1632442 - RNA, 23 nt, Pseudomonas putida KT2440
ucgguaccacgcuagucaagcug

SEQ ID NO: 1632443 - RNA, 18 nt, Pseudomonas putida KT2440
ucgguacccgccagcaau

SEQ ID NO: 1632444 - RNA, 16 nt, Pseudomonas putida KT2440
ucgguaaaacagccuu

SEQ ID NO: 1632445 - RNA, 12 nt, Pseudomonas putida KT2440
ucggggcugcuu

SEQ ID NO: 1632446 - RNA, 23 nt, Pseudomonas putida KT2440
ucgggugaaaaggcccucagagu

SEQ ID NO: 1632447 - RNA, 13 nt, Pseudomonas putida KT2440
ucgggcgguuggg

SEQ ID NO: 1632448 - RNA, 13 nt, Pseudomonas putida KT2440
ucgggcugcugcc

SEQ ID NO: 1632449 - RNA, 15 nt, Pseudomonas putida KT2440
ucgggcacucggguu

SEQ ID NO: 1632450 - RNA, 22 nt, Pseudomonas putida KT2440
ucgggcacuuguugguguggca

SEQ ID NO: 1632451 - RNA, 18 nt, Pseudomonas putida KT2440
ucgggcacaggcccagca

SEQ ID NO: 1632452 - RNA, 18 nt, Pseudomonas putida KT2440
ucgggcacgaucagcagc

SEQ ID NO: 1632453 - RNA, 19 nt, Pseudomonas putida KT2440
ucgggcacgaucagcagca

SEQ ID NO: 1632454 - RNA, 17 nt, Pseudomonas putida KT2440
ucgggauggcaccggca

SEQ ID NO: 1632455 - RNA, 15 nt, Pseudomonas putida KT2440
ucggcaaagcggcug

SEQ ID NO: 1632456 - RNA, 23 nt, Pseudomonas putida KT2440
ucggcaaagcguucgguguccuu

SEQ ID NO: 1632457 - RNA, 17 nt, Pseudomonas putida KT2440
ucggcaacauucaccag

SEQ ID NO: 1632458 - RNA, 22 nt, Pseudomonas putida KT2440
ucggcaacgauggucgccacau

SEQ ID NO: 1632459 - RNA, 21 nt, Pseudomonas putida KT2440
ucggcaaccgagaucucggua

SEQ ID NO: 1632460 - RNA, 21 nt, Pseudomonas putida KT2440
ucggcacacgguuuccaggcg

SEQ ID NO: 1632461 - RNA, 16 nt, Pseudomonas putida KT2440
ucggcaaucugcagca

SEQ ID NO: 1632462 - RNA, 15 nt, Pseudomonas putida KT2440
ucggcaaucugcuug

SEQ ID NO: 1632463 - RNA, 21 nt, Pseudomonas putida KT2440
ucggcaaugcgcgcgaaggcc

SEQ ID NO: 1632464 - RNA, 22 nt, Pseudomonas putida KT2440
ucggcaaugcgcgcgaaggccc

SEQ ID NO: 1632465 - RNA, 22 nt, Pseudomonas putida KT2440
ucggcaaucaccgccaggucca

SEQ ID NO: 1632466 - RNA, 23 nt, Pseudomonas putida KT2440
ucggcaaucagcaucagugcagg

SEQ ID NO: 1632467 - RNA, 20 nt, Pseudomonas putida KT2440
ucggcaguguaaauagcugc

SEQ ID NO: 1632468 - RNA, 19 nt, Pseudomonas putida KT2440
ucggcacgcgccagcagcg

SEQ ID NO: 1632469 - RNA, 13 nt, Pseudomonas putida KT2440
ucggcacuguugu

SEQ ID NO: 1632470 - RNA, 18 nt, Pseudomonas putida KT2440
ucggcagcacccgcuugg

SEQ ID NO: 1632471 - RNA, 17 nt, Pseudomonas putida KT2440
ucggcagaauuucaggc

SEQ ID NO: 1632472 - RNA, 21 nt, Pseudomonas putida KT2440
ucggcagaauuucaggcuggg

SEQ ID NO: 1632473 - RNA, 15 nt, Pseudomonas putida KT2440
ucggcagagcgccag

SEQ ID NO: 1632474 - RNA, 16 nt, Pseudomonas putida KT2440
ucggcaucggccuggg

SEQ ID NO: 1632475 - RNA, 20 nt, Pseudomonas putida KT2440
ucggcaucggccuggggcag

SEQ ID NO: 1632476 - RNA, 16 nt, Pseudomonas putida KT2440
ucggcaugcagcggcc

SEQ ID NO: 1632477 - RNA, 21 nt, Pseudomonas putida KT2440
ucggccacccuccgggucagg

SEQ ID NO: 1632478 - RNA, 18 nt, Pseudomonas putida KT2440
ucggccaccacccgcugg

SEQ ID NO: 1632479 - RNA, 22 nt, Pseudomonas putida KT2440
ucggcaucggugcuuucugcug

SEQ ID NO: 1632480 - RNA, 15 nt, Pseudomonas putida KT2440
ucggagguagccacc

SEQ ID NO: 1632481 - RNA, 23 nt, Pseudomonas putida KT2440
ucggacagguagucaccguugag

SEQ ID NO: 1632482 - RNA, 20 nt, Pseudomonas putida KT2440
ucggacaggcgcuugacccg

SEQ ID NO: 1632483 - RNA, 18 nt, Pseudomonas putida KT2440
ucggaaggggccgcaaag

SEQ ID NO: 1632484 - RNA, 13 nt, Pseudomonas putida KT2440
ucgcugugcaaca

SEQ ID NO: 1632485 - RNA, 14 nt, Pseudomonas putida KT2440
ucgcugucuuccag

SEQ ID NO: 1632486 - RNA, 19 nt, Pseudomonas putida KT2440
ucgcuguugcgcaccuugu

SEQ ID NO: 1632487 - RNA, 14 nt, Pseudomonas putida KT2440
ucgcuucuuugcga

SEQ ID NO: 1632488 - RNA, 16 nt, Pseudomonas putida KT2440
ucgcuuugcgggcacg

SEQ ID NO: 1632489 - RNA, 17 nt, Pseudomonas putida KT2440
ucgcgcguaaaucccgc

SEQ ID NO: 1632490 - RNA, 13 nt, Pseudomonas putida KT2440
ucgcggagccaga

SEQ ID NO: 1632491 - RNA, 15 nt, Pseudomonas putida KT2440
ucgcggcccagccca

SEQ ID NO: 1632492 - RNA, 21 nt, Pseudomonas putida KT2440
ucgcgcuugcgguccugcacc

SEQ ID NO: 1632493 - RNA, 21 nt, Pseudomonas putida KT2440
ucgcgcuuggcaccggcagca

SEQ ID NO: 1632494 - RNA, 16 nt, Pseudomonas putida KT2440
ucgcgcuggcacugcg

SEQ ID NO: 1632495 - RNA, 16 nt, Pseudomonas putida KT2440
ucgcgggugaacccgc

SEQ ID NO: 1632496 - RNA, 13 nt, Pseudomonas putida KT2440
ucgcgggcgugcc

SEQ ID NO: 1632497 - RNA, 23 nt, Pseudomonas putida KT2440
ucgcgggcaagcccgcucccaca

SEQ ID NO: 1632498 - RNA, 15 nt, Pseudomonas putida KT2440
ucgcgggcacgcccg

SEQ ID NO: 1632499 - RNA, 18 nt, Pseudomonas putida KT2440
ucgcggccuacccgggcg

SEQ ID NO: 1632500 - RNA, 18 nt, Pseudomonas putida KT2440
ucgcguuguucagcagcg

SEQ ID NO: 1632501 - RNA, 22 nt, Pseudomonas putida KT2440
ucgcucaacacgucggcuggca

SEQ ID NO: 1632502 - RNA, 17 nt, Pseudomonas putida KT2440
ucgcuacugccgucguu

SEQ ID NO: 1632503 - RNA, 15 nt, Pseudomonas putida KT2440
ucgcuagaaaacguc

SEQ ID NO: 1632504 - RNA, 16 nt, Pseudomonas putida KT2440
ucgcuaaccucugcau

SEQ ID NO: 1632505 - RNA, 18 nt, Pseudomonas putida KT2440
ucgcucagguagcgcgcc

SEQ ID NO: 1632506 - RNA, 14 nt, Pseudomonas putida KT2440
ucgcucaggugcac

SEQ ID NO: 1632507 - RNA, 11 nt, Pseudomonas putida KT2440
ucgcucaggcu

SEQ ID NO: 1632508 - RNA, 15 nt, Pseudomonas putida KT2440
ucgcucaggcucuug

SEQ ID NO: 1632509 - RNA, 18 nt, Pseudomonas putida KT2440
ucgcucagcaacugggca

SEQ ID NO: 1632510 - RNA, 15 nt, Pseudomonas putida KT2440
ucgcugcgcuggcca

SEQ ID NO: 1632511 - RNA, 13 nt, Pseudomonas putida KT2440
ucgcugcccgggc

SEQ ID NO: 1632512 - RNA, 13 nt, Pseudomonas putida KT2440
ucgcugccgccuu

SEQ ID NO: 1632513 - RNA, 22 nt, Pseudomonas putida KT2440
ucgcugcgaaccuguugaagcg

SEQ ID NO: 1632514 - RNA, 10 nt, Pseudomonas putida KT2440
ucgcuggcuu

SEQ ID NO: 1632515 - RNA, 19 nt, Pseudomonas putida KT2440
ucgcugauccgcuuucggc

SEQ ID NO: 1632516 - RNA, 14 nt, Pseudomonas putida KT2440
ucgcugaugcgccg

SEQ ID NO: 1632517 - RNA, 12 nt, Pseudomonas putida KT2440
ucgcugaacacg

SEQ ID NO: 1632518 - RNA, 16 nt, Pseudomonas putida KT2440
ucgccagccccagccc

SEQ ID NO: 1632519 - RNA, 14 nt, Pseudomonas putida KT2440
ucgccagcagcgcu

SEQ ID NO: 1632520 - RNA, 18 nt, Pseudomonas putida KT2440
ucgccaggcccagccccg

SEQ ID NO: 1632521 - RNA, 21 nt, Pseudomonas putida KT2440
ucgccaggccccgauacagcg

SEQ ID NO: 1632522 - RNA, 19 nt, Pseudomonas putida KT2440
ucgccagccugcagcgcgg

SEQ ID NO: 1632523 - RNA, 23 nt, Pseudomonas putida KT2440
ucgccagccugcagcgcggcgau

SEQ ID NO: 1632524 - RNA, 18 nt, Pseudomonas putida KT2440
ucgccagguacaguuccc

SEQ ID NO: 1632525 - RNA, 20 nt, Pseudomonas putida KT2440
ucgccaggugcucagccacg

SEQ ID NO: 1632526 - RNA, 18 nt, Pseudomonas putida KT2440
ucgccagugaacaccacu

SEQ ID NO: 1632527 - RNA, 21 nt, Pseudomonas putida KT2440
ucgccaucgccccgcgccgcc

SEQ ID NO: 1632528 - RNA, 16 nt, Pseudomonas putida KT2440
ucgccauaggccgccu

SEQ ID NO: 1632529 - RNA, 19 nt, Pseudomonas putida KT2440
ucgccauaggccgccugcc

SEQ ID NO: 1632530 - RNA, 22 nt, Pseudomonas putida KT2440
ucgccauaagcugucagcaccu

SEQ ID NO: 1632531 - RNA, 21 nt, Pseudomonas putida KT2440
ucgccacccgacgccaccuuc

SEQ ID NO: 1632532 - RNA, 19 nt, Pseudomonas putida KT2440
ucgccaaucucguugcgcc

SEQ ID NO: 1632533 - RNA, 15 nt, Pseudomonas putida KT2440
ucgccacaccacagc

SEQ ID NO: 1632534 - RNA, 19 nt, Pseudomonas putida KT2440
ucgccacaccacagcugca

SEQ ID NO: 1632535 - RNA, 13 nt, Pseudomonas putida KT2440
ucgccacuugcug

SEQ ID NO: 1632536 - RNA, 16 nt, Pseudomonas putida KT2440
ucgccacuggcgacuu

SEQ ID NO: 1632537 - RNA, 21 nt, Pseudomonas putida KT2440
ucgccaaauucgaccagcagu

SEQ ID NO: 1632538 - RNA, 15 nt, Pseudomonas putida KT2440
uccauaccaauggca

SEQ ID NO: 1632539 - RNA, 21 nt, Pseudomonas putida KT2440
ucgcccaugauguggcuggug

SEQ ID NO: 1632540 - RNA, 17 nt, Pseudomonas putida KT2440
ucgcccccgcugcacag

SEQ ID NO: 1632541 - RNA, 12 nt, Pseudomonas putida KT2440
ucgcccgcgaag

SEQ ID NO: 1632542 - RNA, 22 nt, Pseudomonas putida KT2440
ucgcccagacgguucgggaagu

SEQ ID NO: 1632543 - RNA, 15 nt, Pseudomonas putida KT2440
ucgcccaaauguuac

SEQ ID NO: 1632544 - RNA, 21 nt, Pseudomonas putida KT2440
ucgccgccacccaccacggcc

SEQ ID NO: 1632545 - RNA, 15 nt, Pseudomonas putida KT2440
ucgccgccgcugacc

SEQ ID NO: 1632546 - RNA, 23 nt, Pseudomonas putida KT2440
ucgcccuguaccgccucgggggc

SEQ ID NO: 1632547 - RNA, 21 nt, Pseudomonas putida KT2440
ucgccgacggcauggccgaag

SEQ ID NO: 1632548 - RNA, 14 nt, Pseudomonas putida KT2440
ucgccgagaaaugg

SEQ ID NO: 1632549 - RNA, 14 nt, Pseudomonas putida KT2440
ucgccguuguucac

SEQ ID NO: 1632550 - RNA, 13 nt, Pseudomonas putida KT2440
ucgccgugcagca

SEQ ID NO: 1632551 - RNA, 14 nt, Pseudomonas putida KT2440
ucgccgugcagcac

SEQ ID NO: 1632552 - RNA, 16 nt, Pseudomonas putida KT2440
ucgccgugcagcaccg

SEQ ID NO: 1632553 - RNA, 16 nt, Pseudomonas putida KT2440
ucgccggguccaccag

SEQ ID NO: 1632554 - RNA, 14 nt, Pseudomonas putida KT2440
ucgccguagcuguu

SEQ ID NO: 1632555 - RNA, 17 nt, Pseudomonas putida KT2440
ucgccgucgaccaggca

SEQ ID NO: 1632556 - RNA, 14 nt, Pseudomonas putida KT2440
ucgccucccccucc

SEQ ID NO: 1632557 - RNA, 14 nt, Pseudomonas putida KT2440
ucgccggccuuggc

SEQ ID NO: 1632558 - RNA, 15 nt, Pseudomonas putida KT2440
ucgccggcagcacgu

SEQ ID NO: 1632559 - RNA, 17 nt, Pseudomonas putida KT2440
ucgccggcagcugauac

SEQ ID NO: 1632560 - RNA, 21 nt, Pseudomonas putida KT2440
ucgccgcuucggcaugcacgg

SEQ ID NO: 1632561 - RNA, 23 nt, Pseudomonas putida KT2440
ucgcgcagauggcagacaagucc

SEQ ID NO: 1632562 - RNA, 15 nt, Pseudomonas putida KT2440
ucgcgcagcaucugc

SEQ ID NO: 1632563 - RNA, 21 nt, Pseudomonas putida KT2440
ucgcgcagcaucugcacgucg

SEQ ID NO: 1632564 - RNA, 22 nt, Pseudomonas putida KT2440
ucgcgaucacgcaggcccagca

SEQ ID NO: 1632565 - RNA, 13 nt, Pseudomonas putida KT2440
ucgcgaugggcug

SEQ ID NO: 1632566 - RNA, 16 nt, Pseudomonas putida KT2440
ucgcgcaacaccgcca

SEQ ID NO: 1632567 - RNA, 16 nt, Pseudomonas putida KT2440
ucgcgcauggccgcuu

SEQ ID NO: 1632568 - RNA, 16 nt, Pseudomonas putida KT2440
ucgcgcauuucgucca

SEQ ID NO: 1632569 - RNA, 17 nt, Pseudomonas putida KT2440
ucgcgcauuucguccag

SEQ ID NO: 1632570 - RNA, 21 nt, Pseudomonas putida KT2440
ucgcgcagggugccggccagc

SEQ ID NO: 1632571 - RNA, 20 nt, Pseudomonas putida KT2440
ucgcgcccgguggcgcggcc

SEQ ID NO: 1632572 - RNA, 17 nt, Pseudomonas putida KT2440
ucgcgccccaagcgggc

SEQ ID NO: 1632573 - RNA, 21 nt, Pseudomonas putida KT2440
ucgcgccaguucgacgcugcu

SEQ ID NO: 1632574 - RNA, 16 nt, Pseudomonas putida KT2440
ucgcgccagcuuuuag

SEQ ID NO: 1632575 - RNA, 15 nt, Pseudomonas putida KT2440
ucgcgacgcaaggcc

SEQ ID NO: 1632576 - RNA, 17 nt, Pseudomonas putida KT2440
ucgcgacgcaaggccgc

SEQ ID NO: 1632577 - RNA, 15 nt, Pseudomonas putida KT2440
ucgcgacacaaggcc

SEQ ID NO: 1632578 - RNA, 21 nt, Pseudomonas putida KT2440
ucgcgacacaaggccccacaa

SEQ ID NO: 1632579 - RNA, 17 nt, Pseudomonas putida KT2440
ucgcgacacaaggccgc

SEQ ID NO: 1632580 - RNA, 17 nt, Pseudomonas putida KT2440
ucgcgagcgagcgguug

SEQ ID NO: 1632581 - RNA, 17 nt, Pseudomonas putida KT2440
ucgccugcuuggcaccu

SEQ ID NO: 1632582 - RNA, 16 nt, Pseudomonas putida KT2440
ucgccuucguacaucg

SEQ ID NO: 1632583 - RNA, 15 nt, Pseudomonas putida KT2440
ucgcgaaacgcggca

SEQ ID NO: 1632584 - RNA, 14 nt, Pseudomonas putida KT2440
ucgccuuuuuucca

SEQ ID NO: 1632585 - RNA, 18 nt, Pseudomonas putida KT2440
ucgcgaaagggccgcgac

SEQ ID NO: 1632586 - RNA, 13 nt, Pseudomonas putida KT2440
ucgcgaaaggggc

SEQ ID NO: 1632587 - RNA, 16 nt, Pseudomonas putida KT2440
ugaacgaugcccgggc

SEQ ID NO: 1632588 - RNA, 13 nt, Pseudomonas putida KT2440
ugaacgagccagc

SEQ ID NO: 1632589 - RNA, 13 nt, Pseudomonas putida KT2440
ugaacgaucaggg

SEQ ID NO: 1632590 - RNA, 13 nt, Pseudomonas putida KT2440
ugaacuugcgcuc

SEQ ID NO: 1632591 - RNA, 17 nt, Pseudomonas putida KT2440
ugaacuuggccuccagc

SEQ ID NO: 1632592 - RNA, 18 nt, Pseudomonas putida KT2440
ugaagcggccaccugccc

SEQ ID NO: 1632593 - RNA, 11 nt, Pseudomonas putida KT2440
ugaagcccgcc

SEQ ID NO: 1632594 - RNA, 15 nt, Pseudomonas putida KT2440
ugaagcgagagcuuc

SEQ ID NO: 1632595 - RNA, 18 nt, Pseudomonas putida KT2440
ugaagaugguuuccagcu

SEQ ID NO: 1632596 - RNA, 21 nt, Pseudomonas putida KT2440
ugaagaugguuuccagcuccg

SEQ ID NO: 1632597 - RNA, 20 nt, Pseudomonas putida KT2440
ugaagauauugguccagcca

SEQ ID NO: 1632598 - RNA, 14 nt, Pseudomonas putida KT2440
ugaauacaccagcu

SEQ ID NO: 1632599 - RNA, 15 nt, Pseudomonas putida KT2440
ugaauacaccagcuu

SEQ ID NO: 1632600 - RNA, 19 nt, Pseudomonas putida KT2440
ugaacaccuuaauaguuaa

SEQ ID NO: 1632601 - RNA, 19 nt, Pseudomonas putida KT2440
ugaacacauagaacagguu

SEQ ID NO: 1632602 - RNA, 21 nt, Pseudomonas putida KT2440
ugaacacauccucaaaggcag

SEQ ID NO: 1632603 - RNA, 19 nt, Pseudomonas putida KT2440
ugaacacgcaggucuugcc

SEQ ID NO: 1632604 - RNA, 13 nt, Pseudomonas putida KT2440
ugaacacugccaa

SEQ ID NO: 1632605 - RNA, 14 nt, Pseudomonas putida KT2440
ugaaauuaaagguu

SEQ ID NO: 1632606 - RNA, 21 nt, Pseudomonas putida KT2440
ugaaaugcaaccgaugcccag

SEQ ID NO: 1632607 - RNA, 18 nt, Pseudomonas putida KT2440
ucuucgucaguccaucac

SEQ ID NO: 1632608 - RNA, 16 nt, Pseudomonas putida KT2440
ucuucggugucggcca

SEQ ID NO: 1632609 - RNA, 22 nt, Pseudomonas putida KT2440
ucuucggugucggccagcugcg

SEQ ID NO: 1632610 - RNA, 21 nt, Pseudomonas putida KT2440
ucuucguggaacugcagagcg

SEQ ID NO: 1632611 - RNA, 15 nt, Pseudomonas putida KT2440
ucuucggccagcaac

SEQ ID NO: 1632612 - RNA, 22 nt, Pseudomonas putida KT2440
ucuucgguggcguugucagcaa

SEQ ID NO: 1632613 - RNA, 19 nt, Pseudomonas putida KT2440
ucuucguucuugaagauga

SEQ ID NO: 1632614 - RNA, 15 nt, Pseudomonas putida KT2440
ugaaaccgucuuuac

SEQ ID NO: 1632615 - RNA, 22 nt, Pseudomonas putida KT2440
ugaaaccguuggucagcgacug

SEQ ID NO: 1632616 - RNA, 21 nt, Pseudomonas putida KT2440
ugaccagcaacggccgcgccg

SEQ ID NO: 1632617 - RNA, 22 nt, Pseudomonas putida KT2440
ugaccagugucugcaacugccc

SEQ ID NO: 1632618 - RNA, 15 nt, Pseudomonas putida KT2440
ugaccagcggcagca

SEQ ID NO: 1632619 - RNA, 12 nt, Pseudomonas putida KT2440
ugaccagcggca

SEQ ID NO: 1632620 - RNA, 14 nt, Pseudomonas putida KT2440
ugaccugcuggguc

SEQ ID NO: 1632621 - RNA, 16 nt, Pseudomonas putida KT2440
ugaccugugcugaauu

SEQ ID NO: 1632622 - RNA, 19 nt, Pseudomonas putida KT2440
ugaccuguucgcgcaacac

SEQ ID NO: 1632623 - RNA, 22 nt, Pseudomonas putida KT2440
ugaccucgaccaggcgcucgcu

SEQ ID NO: 1632624 - RNA, 15 nt, Pseudomonas putida KT2440
ugaccggcacugcac

SEQ ID NO: 1632625 - RNA, 14 nt, Pseudomonas putida KT2440
ugaccgccugcgca

SEQ ID NO: 1632626 - RNA, 20 nt, Pseudomonas putida KT2440
ugaccgcgcauuugcuccag

SEQ ID NO: 1632627 - RNA, 22 nt, Pseudomonas putida KT2440
ugaccgaugaucugccgggcca

SEQ ID NO: 1632628 - RNA, 18 nt, Pseudomonas putida KT2440
ugaccauuggccaaccag

SEQ ID NO: 1632629 - RNA, 16 nt, Pseudomonas putida KT2440
ugacacauaggcagcc

SEQ ID NO: 1632630 - RNA, 12 nt, Pseudomonas putida KT2440
ugacagcccugc

SEQ ID NO: 1632631 - RNA, 15 nt, Pseudomonas putida KT2440
ugacagcgcuuccaa

SEQ ID NO: 1632632 - RNA, 19 nt, Pseudomonas putida KT2440
ugacaggcgaucagucagu

SEQ ID NO: 1632633 - RNA, 18 nt, Pseudomonas putida KT2440
ugacaacgcccgccguca

SEQ ID NO: 1632634 - RNA, 18 nt, Pseudomonas putida KT2440
ugacaaaggccggcaccg

SEQ ID NO: 1632635 - RNA, 18 nt, Pseudomonas putida KT2440
ugaauuuuuuauagcuuu

SEQ ID NO: 1632636 - RNA, 23 nt, Pseudomonas putida KT2440
ugacaauugucgguacuggcuau

SEQ ID NO: 1632637 - RNA, 15 nt, Pseudomonas putida KT2440
ugaaucagcaaaccg

SEQ ID NO: 1632638 - RNA, 20 nt, Pseudomonas putida KT2440
ugaaucuugcgcgccagcgc

SEQ ID NO: 1632639 - RNA, 22 nt, Pseudomonas putida KT2440
ugaaugccgccauccucggcca

SEQ ID NO: 1632640 - RNA, 12 nt, Pseudomonas putida KT2440
ugaauuccuugc

SEQ ID NO: 1632641 - RNA, 15 nt, Pseudomonas putida KT2440
ugaauuccuugcagc

SEQ ID NO: 1632642 - RNA, 12 nt, Pseudomonas putida KT2440
ugaauuuucuug

SEQ ID NO: 1632643 - RNA, 18 nt, Pseudomonas putida KT2440
ugaauuggagcugaaacu

SEQ ID NO: 1632644 - RNA, 17 nt, Pseudomonas putida KT2440
ugaugguaucugccagc

SEQ ID NO: 1632645 - RNA, 18 nt, Pseudomonas putida KT2440
ugauggucaccuugucca

SEQ ID NO: 1632646 - RNA, 17 nt, Pseudomonas putida KT2440
ugauggugucuuccagg

SEQ ID NO: 1632647 - RNA, 15 nt, Pseudomonas putida KT2440
ugauguaccagaacc

SEQ ID NO: 1632648 - RNA, 11 nt, Pseudomonas putida KT2440
ugaugguugac

SEQ ID NO: 1632649 - RNA, 14 nt, Pseudomonas putida KT2440
ugauguagucgucg

SEQ ID NO: 1632650 - RNA, 23 nt, Pseudomonas putida KT2440
ugauguuacggacgggcguugau

SEQ ID NO: 1632651 - RNA, 20 nt, Pseudomonas putida KT2440
ugauguucggugcucaggcu

SEQ ID NO: 1632652 - RNA, 22 nt, Pseudomonas putida KT2440
ugauuaccagcgccccgccgca

SEQ ID NO: 1632653 - RNA, 21 nt, Pseudomonas putida KT2440
ugauuucagggucugucggug

SEQ ID NO: 1632654 - RNA, 12 nt, Pseudomonas putida KT2440
ugauuuccagcg

SEQ ID NO: 1632655 - RNA, 12 nt, Pseudomonas putida KT2440
ugauuuccugca

SEQ ID NO: 1632656 - RNA, 13 nt, Pseudomonas putida KT2440
ugauugccuggcu

SEQ ID NO: 1632657 - RNA, 21 nt, Pseudomonas putida KT2440
ugaugaagccacgcucgugca

SEQ ID NO: 1632658 - RNA, 15 nt, Pseudomonas putida KT2440
ugaugcagcagugcc

SEQ ID NO: 1632659 - RNA, 22 nt, Pseudomonas putida KT2440
ugaucuugguggucagccaggc

SEQ ID NO: 1632660 - RNA, 15 nt, Pseudomonas putida KT2440
ugaucuuuacuuucu

SEQ ID NO: 1632661 - RNA, 15 nt, Pseudomonas putida KT2440
ugaugcggacccagc

SEQ ID NO: 1632662 - RNA, 16 nt, Pseudomonas putida KT2440
ugaugcggacccagcg

SEQ ID NO: 1632663 - RNA, 15 nt, Pseudomonas putida KT2440
ugaugcgcacccgac

SEQ ID NO: 1632664 - RNA, 14 nt, Pseudomonas putida KT2440
ugaugcgcccuucg

SEQ ID NO: 1632665 - RNA, 18 nt, Pseudomonas putida KT2440
ugaugcgcguccagcccg

SEQ ID NO: 1632666 - RNA, 23 nt, Pseudomonas putida KT2440
ugaugcgcguccagcccggucca

SEQ ID NO: 1632667 - RNA, 22 nt, Pseudomonas putida KT2440
ugaugcguacggccuuggcgcc

SEQ ID NO: 1632668 - RNA, 18 nt, Pseudomonas putida KT2440
ugaugcgggaccagcacc

SEQ ID NO: 1632669 - RNA, 20 nt, Pseudomonas putida KT2440
ugaucaagguuucagcagcg

SEQ ID NO: 1632670 - RNA, 22 nt, Pseudomonas putida KT2440
ugaucagcaaugccaguugauc

SEQ ID NO: 1632671 - RNA, 14 nt, Pseudomonas putida KT2440
ugaucauucaggca

SEQ ID NO: 1632672 - RNA, 13 nt, Pseudomonas putida KT2440
ugauccaccucuc

SEQ ID NO: 1632673 - RNA, 15 nt, Pseudomonas putida KT2440
ugagucagcuugugc

SEQ ID NO: 1632674 - RNA, 15 nt, Pseudomonas putida KT2440
ugagucaggcgcccu

SEQ ID NO: 1632675 - RNA, 14 nt, Pseudomonas putida KT2440
ugauaauugggcau

SEQ ID NO: 1632676 - RNA, 13 nt, Pseudomonas putida KT2440
ugagguucugcuc

SEQ ID NO: 1632677 - RNA, 16 nt, Pseudomonas putida KT2440
ugaggcacaaaaaagc

SEQ ID NO: 1632678 - RNA, 19 nt, Pseudomonas putida KT2440
ugaggcaacggcuaccagc

SEQ ID NO: 1632679 - RNA, 22 nt, Pseudomonas putida KT2440
ugaggcaugugcugucccggca

SEQ ID NO: 1632680 - RNA, 17 nt, Pseudomonas putida KT2440
ugagcuggccguccagc

SEQ ID NO: 1632681 - RNA, 22 nt, Pseudomonas putida KT2440
ugagcgcagcgacgaccugcac

SEQ ID NO: 1632682 - RNA, 23 nt, Pseudomonas putida KT2440
ugagcgagcucaaccagcugcgu

SEQ ID NO: 1632683 - RNA, 16 nt, Pseudomonas putida KT2440
ugagcgaugcgcuggc

SEQ ID NO: 1632684 - RNA, 18 nt, Pseudomonas putida KT2440
ugagcuguuucaugcugc

SEQ ID NO: 1632685 - RNA, 16 nt, Pseudomonas putida KT2440
ugagcuugacuuccag

SEQ ID NO: 1632686 - RNA, 15 nt, Pseudomonas putida KT2440
ugaccuugcugcuca

SEQ ID NO: 1632687 - RNA, 23 nt, Pseudomonas putida KT2440
ugaccuuuucuaaguccuugguu

SEQ ID NO: 1632688 - RNA, 12 nt, Pseudomonas putida KT2440
ugaccuuggcug

SEQ ID NO: 1632689 - RNA, 21 nt, Pseudomonas putida KT2440
ugacuuuccauuacuccagaa

SEQ ID NO: 1632690 - RNA, 20 nt, Pseudomonas putida KT2440
ugagcacgaaacugcgcugg

SEQ ID NO: 1632691 - RNA, 21 nt, Pseudomonas putida KT2440
ugagcacgaaguaacggccac

SEQ ID NO: 1632692 - RNA, 20 nt, Pseudomonas putida KT2440
ugagcagaccagccgggcug

SEQ ID NO: 1632693 - RNA, 16 nt, Pseudomonas putida KT2440
ugagaucgagcgccgc

SEQ ID NO: 1632694 - RNA, 17 nt, Pseudomonas putida KT2440
ugagaucgagcgccgcc

SEQ ID NO: 1632695 - RNA, 23 nt, Pseudomonas putida KT2440
ugagcacacgguaguccugccau

SEQ ID NO: 1632696 - RNA, 17 nt, Pseudomonas putida KT2440
ugagcagguuguccacc

SEQ ID NO: 1632697 - RNA, 21 nt, Pseudomonas putida KT2440
ugagcagcgguggcaaaucga

SEQ ID NO: 1632698 - RNA, 14 nt, Pseudomonas putida KT2440
ugagcauggcaaac

SEQ ID NO: 1632699 - RNA, 16 nt, Pseudomonas putida KT2440
ugagcauggcaaacag

SEQ ID NO: 1632700 - RNA, 18 nt, Pseudomonas putida KT2440
ugagccaaggccgcccag

SEQ ID NO: 1632701 - RNA, 17 nt, Pseudomonas putida KT2440
ugagccaggcuacccac

SEQ ID NO: 1632702 - RNA, 17 nt, Pseudomonas putida KT2440
ugagccagggcgcuguc

SEQ ID NO: 1632703 - RNA, 22 nt, Pseudomonas putida KT2440
ugagccguccggcaaucugccc

SEQ ID NO: 1632704 - RNA, 13 nt, Pseudomonas putida KT2440
ugagccugcaggg

SEQ ID NO: 1632705 - RNA, 17 nt, Pseudomonas putida KT2440
ugagccugcagggccuc

SEQ ID NO: 1632706 - RNA, 23 nt, Pseudomonas putida KT2440
ugagccuugucaguucugcucag

SEQ ID NO: 1632707 - RNA, 18 nt, Pseudomonas putida KT2440
ugcgcggguucugguugc

SEQ ID NO: 1632708 - RNA, 20 nt, Pseudomonas putida KT2440
ugcgcgguaaacgggaaguc

SEQ ID NO: 1632709 - RNA, 19 nt, Pseudomonas putida KT2440
ugcgcgguaaugaccugga

SEQ ID NO: 1632710 - RNA, 21 nt, Pseudomonas putida KT2440
ugcgcggggugaucgccucgu

SEQ ID NO: 1632711 - RNA, 19 nt, Pseudomonas putida KT2440
ugcgcgggucauccaggaa

SEQ ID NO: 1632712 - RNA, 21 nt, Pseudomonas putida KT2440
ugcgcgucucuuucaggcaca

SEQ ID NO: 1632713 - RNA, 15 nt, Pseudomonas putida KT2440
ugcgcggaacagguu

SEQ ID NO: 1632714 - RNA, 13 nt, Pseudomonas putida KT2440
ugcgcggccacua

SEQ ID NO: 1632715 - RNA, 17 nt, Pseudomonas putida KT2440
ugcgcgcauccagcagg

SEQ ID NO: 1632716 - RNA, 20 nt, Pseudomonas putida KT2440
ugcgcgccguugcacgucau

SEQ ID NO: 1632717 - RNA, 12 nt, Pseudomonas putida KT2440
ugcgcucaacca

SEQ ID NO: 1632718 - RNA, 15 nt, Pseudomonas putida KT2440
ugcgcucaaccagcc

SEQ ID NO: 1632719 - RNA, 23 nt, Pseudomonas putida KT2440
ugcgcucaaccagccgccuuugc

SEQ ID NO: 1632720 - RNA, 21 nt, Pseudomonas putida KT2440
ugcgcucaaccgaccugcaac

SEQ ID NO: 1632721 - RNA, 15 nt, Pseudomonas putida KT2440
ugcgcuccagcagcu

SEQ ID NO: 1632722 - RNA, 17 nt, Pseudomonas putida KT2440
ugcgcucgagcccgcca

SEQ ID NO: 1632723 - RNA, 17 nt, Pseudomonas putida KT2440
ugcgcucgauccugugg

SEQ ID NO: 1632724 - RNA, 22 nt, Pseudomonas putida KT2440
ugcgcugaucgaaagcugcgca

SEQ ID NO: 1632725 - RNA, 20 nt, Pseudomonas putida KT2440
ugcgcugaucgugcaccguc

SEQ ID NO: 1632726 - RNA, 14 nt, Pseudomonas putida KT2440
ugcgcugccugcug

SEQ ID NO: 1632727 - RNA, 18 nt, Pseudomonas putida KT2440
ugcggacucauagcucag

SEQ ID NO: 1632728 - RNA, 16 nt, Pseudomonas putida KT2440
ugcggaucaucggcac

SEQ ID NO: 1632729 - RNA, 20 nt, Pseudomonas putida KT2440
ugcggaucaucggcacgccc

SEQ ID NO: 1632730 - RNA, 22 nt, Pseudomonas putida KT2440
ugcggaucuuguauuggccaag

SEQ ID NO: 1632731 - RNA, 16 nt, Pseudomonas putida KT2440
ugcgggcgucuuccag

SEQ ID NO: 1632732 - RNA, 13 nt, Pseudomonas putida KT2440
ugcgggcccccuc

SEQ ID NO: 1632733 - RNA, 13 nt, Pseudomonas putida KT2440
ugcgggcuugucc

SEQ ID NO: 1632734 - RNA, 14 nt, Pseudomonas putida KT2440
ugcgggcuuucuca

SEQ ID NO: 1632735 - RNA, 21 nt, Pseudomonas putida KT2440
ugcgggucagcagcaccgcca

SEQ ID NO: 1632736 - RNA, 21 nt, Pseudomonas putida KT2440
ugcggguaaagcccgcaguga

SEQ ID NO: 1632737 - RNA, 17 nt, Pseudomonas putida KT2440
ugcggguaaugccaccu

SEQ ID NO: 1632738 - RNA, 22 nt, Pseudomonas putida KT2440
ugcggcccccugguuuuccacc

SEQ ID NO: 1632739 - RNA, 21 nt, Pseudomonas putida KT2440
ugcggcccuucgcgggcacgc

SEQ ID NO: 1632740 - RNA, 16 nt, Pseudomonas putida KT2440
ugcggcccuuggcagc

SEQ ID NO: 1632741 - RNA, 19 nt, Pseudomonas putida KT2440
ugcgggauuguucccacag

SEQ ID NO: 1632742 - RNA, 21 nt, Pseudomonas putida KT2440
ugcgguaaccggaauagaaca

SEQ ID NO: 1632743 - RNA, 19 nt, Pseudomonas putida KT2440
ugcgguaccggccagcugc

SEQ ID NO: 1632744 - RNA, 12 nt, Pseudomonas putida KT2440
ugcgggucagcu

SEQ ID NO: 1632745 - RNA, 17 nt, Pseudomonas putida KT2440
ugcgggucauccucaag

SEQ ID NO: 1632746 - RNA, 15 nt, Pseudomonas putida KT2440
ugcguaauuccugug

SEQ ID NO: 1632747 - RNA, 22 nt, Pseudomonas putida KT2440
ugcgguauaggccgcaagcccg

SEQ ID NO: 1632748 - RNA, 21 nt, Pseudomonas putida KT2440
ugcggucaucaccacccccag

SEQ ID NO: 1632749 - RNA, 22 nt, Pseudomonas putida KT2440
ugcguagguuauuggccagguc

SEQ ID NO: 1632750 - RNA, 21 nt, Pseudomonas putida KT2440
ugcgccuuuuccaccagcccu

SEQ ID NO: 1632751 - RNA, 22 nt, Pseudomonas putida KT2440
ugcgccuggcccgcagcgcuuc

SEQ ID NO: 1632752 - RNA, 12 nt, Pseudomonas putida KT2440
ugcgccugugca

SEQ ID NO: 1632753 - RNA, 19 nt, Pseudomonas putida KT2440
ugcgcgacagcaucaucag

SEQ ID NO: 1632754 - RNA, 16 nt, Pseudomonas putida KT2440
ugcgccgucgccuccc

SEQ ID NO: 1632755 - RNA, 13 nt, Pseudomonas putida KT2440
ugcgccucgcagg

SEQ ID NO: 1632756 - RNA, 18 nt, Pseudomonas putida KT2440
ugcgccuaucaggccuuc

SEQ ID NO: 1632757 - RNA, 16 nt, Pseudomonas putida KT2440
ugcgccuccagcagcg

SEQ ID NO: 1632758 - RNA, 16 nt, Pseudomonas putida KT2440
ugcgccugccgggcca

SEQ ID NO: 1632759 - RNA, 19 nt, Pseudomonas putida KT2440
ugcgccugcgggugccgug

SEQ ID NO: 1632760 - RNA, 13 nt, Pseudomonas putida KT2440
ugcgccguggccg

SEQ ID NO: 1632761 - RNA, 21 nt, Pseudomonas putida KT2440
ugcgcccaguagcgccaccau

SEQ ID NO: 1632762 - RNA, 19 nt, Pseudomonas putida KT2440
ugcgccccucaucaaacca

SEQ ID NO: 1632763 - RNA, 18 nt, Pseudomonas putida KT2440
ugcgcagguuggugcaau

SEQ ID NO: 1632764 - RNA, 19 nt, Pseudomonas putida KT2440
ugcgcagguuggugcaauu

SEQ ID NO: 1632765 - RNA, 18 nt, Pseudomonas putida KT2440
ugcgcaguaacaggcgca

SEQ ID NO: 1632766 - RNA, 20 nt, Pseudomonas putida KT2440
ugcgcaguaccuguggcagc

SEQ ID NO: 1632767 - RNA, 20 nt, Pseudomonas putida KT2440
ugcgcaucaacguucccaau

SEQ ID NO: 1632768 - RNA, 22 nt, Pseudomonas putida KT2440
ugcgaccaguaccgcgccucca

SEQ ID NO: 1632769 - RNA, 14 nt, Pseudomonas putida KT2440
ugccuggggcucga

SEQ ID NO: 1632770 - RNA, 15 nt, Pseudomonas putida KT2440
ugccugggucagcuc

SEQ ID NO: 1632771 - RNA, 20 nt, Pseudomonas putida KT2440
ugccuggcucaggcgcuggc

SEQ ID NO: 1632772 - RNA, 16 nt, Pseudomonas putida KT2440
ugccugcugcaacagc

SEQ ID NO: 1632773 - RNA, 17 nt, Pseudomonas putida KT2440
ugccugcugcaacagcu

SEQ ID NO: 1632774 - RNA, 23 nt, Pseudomonas putida KT2440
ugccugcugcaacagcucaucca

SEQ ID NO: 1632775 - RNA, 20 nt, Pseudomonas putida KT2440
ugcgcaacgacaagguacuc

SEQ ID NO: 1632776 - RNA, 13 nt, Pseudomonas putida KT2440
ugcgcagcccugu

SEQ ID NO: 1632777 - RNA, 15 nt, Pseudomonas putida KT2440
ugcgcagcccuguca

SEQ ID NO: 1632778 - RNA, 16 nt, Pseudomonas putida KT2440
ugcgcaagccucaggc

SEQ ID NO: 1632779 - RNA, 13 nt, Pseudomonas putida KT2440
ugcgcagagccac

SEQ ID NO: 1632780 - RNA, 12 nt, Pseudomonas putida KT2440
ugcgcacggcuu

SEQ ID NO: 1632781 - RNA, 22 nt, Pseudomonas putida KT2440
ugccgaacagucauccagaaag

SEQ ID NO: 1632782 - RNA, 14 nt, Pseudomonas putida KT2440
ugccgaauugaacu

SEQ ID NO: 1632783 - RNA, 15 nt, Pseudomonas putida KT2440
ugccgacagccaccg

SEQ ID NO: 1632784 - RNA, 14 nt, Pseudomonas putida KT2440
ugccgagaacagcu

SEQ ID NO: 1632785 - RNA, 21 nt, Pseudomonas putida KT2440
ugccgacuccguguccguccg

SEQ ID NO: 1632786 - RNA, 15 nt, Pseudomonas putida KT2440
ugccgagcagcgcgu

SEQ ID NO: 1632787 - RNA, 21 nt, Pseudomonas putida KT2440
ugccgacgccgcuucucaaga

SEQ ID NO: 1632788 - RNA, 12 nt, Pseudomonas putida KT2440
ugcccuucacug

SEQ ID NO: 1632789 - RNA, 20 nt, Pseudomonas putida KT2440
ugcccuucaugcgcccuggc

SEQ ID NO: 1632790 - RNA, 20 nt, Pseudomonas putida KT2440
ugcccuucugcgccaaagcg

SEQ ID NO: 1632791 - RNA, 21 nt, Pseudomonas putida KT2440
ugcccucauucgcccgcaccg

SEQ ID NO: 1632792 - RNA, 20 nt, Pseudomonas putida KT2440
ugcccugcagcuucccggcc

SEQ ID NO: 1632793 - RNA, 21 nt, Pseudomonas putida KT2440
ugcccugcagcuucccggccu

SEQ ID NO: 1632794 - RNA, 17 nt, Pseudomonas putida KT2440
ugcccucggccaccugg

SEQ ID NO: 1632795 - RNA, 16 nt, Pseudomonas putida KT2440
ugccgcagucccgcca

SEQ ID NO: 1632796 - RNA, 13 nt, Pseudomonas putida KT2440
ugccgaucagcac

SEQ ID NO: 1632797 - RNA, 14 nt, Pseudomonas putida KT2440
ugccgaucagcacg

SEQ ID NO: 1632798 - RNA, 19 nt, Pseudomonas putida KT2440
ugccgaucuucgcccuggg

SEQ ID NO: 1632799 - RNA, 14 nt, Pseudomonas putida KT2440
ugccgccagccccg

SEQ ID NO: 1632800 - RNA, 17 nt, Pseudomonas putida KT2440
ugccgccagccccgcca

SEQ ID NO: 1632801 - RNA, 14 nt, Pseudomonas putida KT2440
ugccggcagcgagc

SEQ ID NO: 1632802 - RNA, 21 nt, Pseudomonas putida KT2440
ugccggcaauaccggccacgc

SEQ ID NO: 1632803 - RNA, 13 nt, Pseudomonas putida KT2440
ugccggcacagcc

SEQ ID NO: 1632804 - RNA, 17 nt, Pseudomonas putida KT2440
ugccggcacagcccagc

SEQ ID NO: 1632805 - RNA, 14 nt, Pseudomonas putida KT2440
ugccgggccagggu

SEQ ID NO: 1632806 - RNA, 18 nt, Pseudomonas putida KT2440
ugccguaguaagccagcc

SEQ ID NO: 1632807 - RNA, 17 nt, Pseudomonas putida KT2440
ugccgugaguggccucg

SEQ ID NO: 1632808 - RNA, 18 nt, Pseudomonas putida KT2440
ugccgugaucgccgggcg

SEQ ID NO: 1632809 - RNA, 22 nt, Pseudomonas putida KT2440
ugccguccgcugccuuccaacc

SEQ ID NO: 1632810 - RNA, 16 nt, Pseudomonas putida KT2440
ugccguccaacgggcg

SEQ ID NO: 1632811 - RNA, 14 nt, Pseudomonas putida KT2440
ugccucagccaggc

SEQ ID NO: 1632812 - RNA, 12 nt, Pseudomonas putida KT2440
ugccucagggau

SEQ ID NO: 1632813 - RNA, 20 nt, Pseudomonas putida KT2440
ugccucaucaggccgaaggc

SEQ ID NO: 1632814 - RNA, 14 nt, Pseudomonas putida KT2440
ugccuaucucuucc

SEQ ID NO: 1632815 - RNA, 15 nt, Pseudomonas putida KT2440
ugccuaucucuucca

SEQ ID NO: 1632816 - RNA, 17 nt, Pseudomonas putida KT2440
ugccgugcucguccuug

SEQ ID NO: 1632817 - RNA, 20 nt, Pseudomonas putida KT2440
ugccguggcaggcaguucga

SEQ ID NO: 1632818 - RNA, 21 nt, Pseudomonas putida KT2440
ugccggaguggaagauggucu

SEQ ID NO: 1632819 - RNA, 15 nt, Pseudomonas putida KT2440
ugccgcuucguccag

SEQ ID NO: 1632820 - RNA, 19 nt, Pseudomonas putida KT2440
ugccgcuucguccagguag

SEQ ID NO: 1632821 - RNA, 16 nt, Pseudomonas putida KT2440
ugccggaacaaccccu

SEQ ID NO: 1632822 - RNA, 13 nt, Pseudomonas putida KT2440
ugccgcuuuggca

SEQ ID NO: 1632823 - RNA, 19 nt, Pseudomonas putida KT2440
ugccgcuuuggcagcagcc

SEQ ID NO: 1632824 - RNA, 20 nt, Pseudomonas putida KT2440
ugccgcuuuggcagcagccu

SEQ ID NO: 1632825 - RNA, 13 nt, Pseudomonas putida KT2440
ugccgcgccgccg

SEQ ID NO: 1632826 - RNA, 15 nt, Pseudomonas putida KT2440
ugccgcgcacuucgu

SEQ ID NO: 1632827 - RNA, 13 nt, Pseudomonas putida KT2440
ugccgccuucucc

SEQ ID NO: 1632828 - RNA, 19 nt, Pseudomonas putida KT2440
ugccgccuucuccagcucg

SEQ ID NO: 1632829 - RNA, 15 nt, Pseudomonas putida KT2440
ugccgccuuggcagc

SEQ ID NO: 1632830 - RNA, 17 nt, Pseudomonas putida KT2440
ugccgccuuggcagccu

SEQ ID NO: 1632831 - RNA, 14 nt, Pseudomonas putida KT2440
ugccgccgggccug

SEQ ID NO: 1632832 - RNA, 21 nt, Pseudomonas putida KT2440
ugcccagcgaauagcaacaca

SEQ ID NO: 1632833 - RNA, 19 nt, Pseudomonas putida KT2440
ugcccagcgcgccggcguc

SEQ ID NO: 1632834 - RNA, 12 nt, Pseudomonas putida KT2440
ugcccagcucca

SEQ ID NO: 1632835 - RNA, 18 nt, Pseudomonas putida KT2440
ugcccagcuccagcaccu

SEQ ID NO: 1632836 - RNA, 14 nt, Pseudomonas putida KT2440
ugcccagcucgcug

SEQ ID NO: 1632837 - RNA, 18 nt, Pseudomonas putida KT2440
ugcccaggugccaggcuc

SEQ ID NO: 1632838 - RNA, 17 nt, Pseudomonas putida KT2440
ugcccagggcugcuuca

SEQ ID NO: 1632839 - RNA, 18 nt, Pseudomonas putida KT2440
ugcccaggaucacuggcc

SEQ ID NO: 1632840 - RNA, 19 nt, Pseudomonas putida KT2440
ugcccaggaucacuggccu

SEQ ID NO: 1632841 - RNA, 23 nt, Pseudomonas putida KT2440
ugcccaccaagggugucaacagg

SEQ ID NO: 1632842 - RNA, 14 nt, Pseudomonas putida KT2440
ugcccaccagcgcu

SEQ ID NO: 1632843 - RNA, 14 nt, Pseudomonas putida KT2440
ugcccaccgcagau

SEQ ID NO: 1632844 - RNA, 20 nt, Pseudomonas putida KT2440
ugcccaccgcauugcaggcc

SEQ ID NO: 1632845 - RNA, 13 nt, Pseudomonas putida KT2440
ugcccacugcguu

SEQ ID NO: 1632846 - RNA, 13 nt, Pseudomonas putida KT2440
ugcccagaucacu

SEQ ID NO: 1632847 - RNA, 18 nt, Pseudomonas putida KT2440
ugcccagaucacuuccac

SEQ ID NO: 1632848 - RNA, 19 nt, Pseudomonas putida KT2440
ugcccagaucacuuccacc

SEQ ID NO: 1632849 - RNA, 19 nt, Pseudomonas putida KT2440
ugccccgguccagcacacu

SEQ ID NO: 1632850 - RNA, 21 nt, Pseudomonas putida KT2440
ugccccgaauugguaguuccu

SEQ ID NO: 1632851 - RNA, 14 nt, Pseudomonas putida KT2440
ugccccgcaggccg

SEQ ID NO: 1632852 - RNA, 19 nt, Pseudomonas putida KT2440
ugccccgaguaacccuggc

SEQ ID NO: 1632853 - RNA, 17 nt, Pseudomonas putida KT2440
ugcccccccaacaacag

SEQ ID NO: 1632854 - RNA, 22 nt, Pseudomonas putida KT2440
ugcccccccaacaacagucaac

SEQ ID NO: 1632855 - RNA, 20 nt, Pseudomonas putida KT2440
ugcccaugaagcggccggcc

SEQ ID NO: 1632856 - RNA, 15 nt, Pseudomonas putida KT2440
ugcccaugccaagcc

SEQ ID NO: 1632857 - RNA, 19 nt, Pseudomonas putida KT2440
ugcccaugccaagcccaca

SEQ ID NO: 1632858 - RNA, 21 nt, Pseudomonas putida KT2440
ugcccauggccagcguggccg

SEQ ID NO: 1632859 - RNA, 14 nt, Pseudomonas putida KT2440
ugcccauggccagg

SEQ ID NO: 1632860 - RNA, 16 nt, Pseudomonas putida KT2440
ugcccauggcgcagcu

SEQ ID NO: 1632861 - RNA, 21 nt, Pseudomonas putida KT2440
ugcccauggcgcagcuccacu

SEQ ID NO: 1632862 - RNA, 21 nt, Pseudomonas putida KT2440
ugcccgcccccacagagccgc

SEQ ID NO: 1632863 - RNA, 18 nt, Pseudomonas putida KT2440
ugcccgccccccaccugg

SEQ ID NO: 1632864 - RNA, 12 nt, Pseudomonas putida KT2440
ugcccgccaggc

SEQ ID NO: 1632865 - RNA, 14 nt, Pseudomonas putida KT2440
ugcccgccccugcc

SEQ ID NO: 1632866 - RNA, 22 nt, Pseudomonas putida KT2440
ugcccgccccugccagcaccag

SEQ ID NO: 1632867 - RNA, 15 nt, Pseudomonas putida KT2440
ugcccgccaaaaggc

SEQ ID NO: 1632868 - RNA, 22 nt, Pseudomonas putida KT2440
ugcccgccacaccugccaggcc

SEQ ID NO: 1632869 - RNA, 14 nt, Pseudomonas putida KT2440
ugcccgcagcaacu

SEQ ID NO: 1632870 - RNA, 16 nt, Pseudomonas putida KT2440
ugcccgaagccacgau

SEQ ID NO: 1632871 - RNA, 16 nt, Pseudomonas putida KT2440
ugccccugcgccgcca

SEQ ID NO: 1632872 - RNA, 22 nt, Pseudomonas putida KT2440
ugccccugauaggacugcuuca

SEQ ID NO: 1632873 - RNA, 17 nt, Pseudomonas putida KT2440
ugccccugaucauccac

SEQ ID NO: 1632874 - RNA, 23 nt, Pseudomonas putida KT2440
ugccccugaucauccacaaucag

SEQ ID NO: 1632875 - RNA, 12 nt, Pseudomonas putida KT2440
ugccccuggcug

SEQ ID NO: 1632876 - RNA, 13 nt, Pseudomonas putida KT2440
ugccccuguucca

SEQ ID NO: 1632877 - RNA, 19 nt, Pseudomonas putida KT2440
ugccccuaccgccaacgaa

SEQ ID NO: 1632878 - RNA, 18 nt, Pseudomonas putida KT2440
ugcccgaucgccucgcug

SEQ ID NO: 1632879 - RNA, 17 nt, Pseudomonas putida KT2440
ugcccgaucggguacuc

SEQ ID NO: 1632880 - RNA, 21 nt, Pseudomonas putida KT2440
ugcccgugacuaguggccacu

SEQ ID NO: 1632881 - RNA, 22 nt, Pseudomonas putida KT2440
ugcccgucggcguauggcuuca

SEQ ID NO: 1632882 - RNA, 17 nt, Pseudomonas putida KT2440
ugcccggugccgcgcca

SEQ ID NO: 1632883 - RNA, 23 nt, Pseudomonas putida KT2440
ugcccgggaacggcugccguccc

SEQ ID NO: 1632884 - RNA, 20 nt, Pseudomonas putida KT2440
ugcccggcguucaggcgcgu

SEQ ID NO: 1632885 - RNA, 19 nt, Pseudomonas putida KT2440
ugcccggcucaccgcagcc

SEQ ID NO: 1632886 - RNA, 20 nt, Pseudomonas putida KT2440
ugcccggcucaccgcagccc

SEQ ID NO: 1632887 - RNA, 19 nt, Pseudomonas putida KT2440
ugcccggcgcgcgcgaccg

SEQ ID NO: 1632888 - RNA, 20 nt, Pseudomonas putida KT2440
ugcccggguacagccccugc

SEQ ID NO: 1632889 - RNA, 19 nt, Pseudomonas putida KT2440
ugcccgggccgcuugcuca

SEQ ID NO: 1632890 - RNA, 20 nt, Pseudomonas putida KT2440
ugcccgggccgcuugcucag

SEQ ID NO: 1632891 - RNA, 21 nt, Pseudomonas putida KT2440
ugcccggcagguugcuggccu

SEQ ID NO: 1632892 - RNA, 15 nt, Pseudomonas putida KT2440
ugcccggccagcgau

SEQ ID NO: 1632893 - RNA, 15 nt, Pseudomonas putida KT2440
ugcccgcugcauagg

SEQ ID NO: 1632894 - RNA, 23 nt, Pseudomonas putida KT2440
ugcccgcgguaaugcgcacggcu

SEQ ID NO: 1632895 - RNA, 16 nt, Pseudomonas putida KT2440
ugcccgcguacucggc

SEQ ID NO: 1632896 - RNA, 18 nt, Pseudomonas putida KT2440
ugcccgcguacucggcca

SEQ ID NO: 1632897 - RNA, 20 nt, Pseudomonas putida KT2440
ugcccgcgcaaaucgccgca

SEQ ID NO: 1632898 - RNA, 15 nt, Pseudomonas putida KT2440
ugcccgcgaagaauu

SEQ ID NO: 1632899 - RNA, 14 nt, Pseudomonas putida KT2440
ugcccgcgaagggc

SEQ ID NO: 1632900 - RNA, 21 nt, Pseudomonas putida KT2440
ugcccgcgaagggcucaacac

SEQ ID NO: 1632901 - RNA, 17 nt, Pseudomonas putida KT2440
ugcccgcgaauggccuu

SEQ ID NO: 1632902 - RNA, 17 nt, Pseudomonas putida KT2440
ugcccgcgaguccucca

SEQ ID NO: 1632903 - RNA, 15 nt, Pseudomonas putida KT2440
ugccagcagggcagg

SEQ ID NO: 1632904 - RNA, 17 nt, Pseudomonas putida KT2440
ugccagcauggugcagg

SEQ ID NO: 1632905 - RNA, 23 nt, Pseudomonas putida KT2440
ugccaggcaccacaagaacugcg

SEQ ID NO: 1632906 - RNA, 16 nt, Pseudomonas putida KT2440
ugccaggcucaggccu

SEQ ID NO: 1632907 - RNA, 15 nt, Pseudomonas putida KT2440
ugccagcuccuggcu

SEQ ID NO: 1632908 - RNA, 18 nt, Pseudomonas putida KT2440
ugccagcuaucucccagc

SEQ ID NO: 1632909 - RNA, 19 nt, Pseudomonas putida KT2440
ugccagcuaucucccagcc

SEQ ID NO: 1632910 - RNA, 19 nt, Pseudomonas putida KT2440
ugccagcugcgcugccugc

SEQ ID NO: 1632911 - RNA, 24 nt, Pseudomonas putida KT2440
ugccaggucaccgcccagcuucuc

SEQ ID NO: 1632912 - RNA, 20 nt, Pseudomonas putida KT2440
ugccaguccuuggccaaugc

SEQ ID NO: 1632913 - RNA, 21 nt, Pseudomonas putida KT2440
ugccaguccuuggccaaugcc

SEQ ID NO: 1632914 - RNA, 19 nt, Pseudomonas putida KT2440
ugccagucgcacaggucca

SEQ ID NO: 1632915 - RNA, 23 nt, Pseudomonas putida KT2440
ugccaguugcuucugcagauccu

SEQ ID NO: 1632916 - RNA, 18 nt, Pseudomonas putida KT2440
ugccauagcgcugcaccg

SEQ ID NO: 1632917 - RNA, 15 nt, Pseudomonas putida KT2440
ugccauacagccaga

SEQ ID NO: 1632918 - RNA, 13 nt, Pseudomonas putida KT2440
ugccaucagggcg

SEQ ID NO: 1632919 - RNA, 18 nt, Pseudomonas putida KT2440
ugccaucgaguaucgccu

SEQ ID NO: 1632920 - RNA, 22 nt, Pseudomonas putida KT2440
ugccaucgccucggcacugcac

SEQ ID NO: 1632921 - RNA, 18 nt, Pseudomonas putida KT2440
ugccauccucggccaggc

SEQ ID NO: 1632922 - RNA, 14 nt, Pseudomonas putida KT2440
ugccauccuugaag

SEQ ID NO: 1632923 - RNA, 23 nt, Pseudomonas putida KT2440
ugccauccaccgcgccagccugg

SEQ ID NO: 1632924 - RNA, 15 nt, Pseudomonas putida KT2440
ugccaucuccaaugc

SEQ ID NO: 1632925 - RNA, 13 nt, Pseudomonas putida KT2440
ugccaucucgcca

SEQ ID NO: 1632926 - RNA, 17 nt, Pseudomonas putida KT2440
ugccaugcgcugcagcg

SEQ ID NO: 1632927 - RNA, 17 nt, Pseudomonas putida KT2440
ugccauucucgccgccg

SEQ ID NO: 1632928 - RNA, 14 nt, Pseudomonas putida KT2440
ugccauucaucgua

SEQ ID NO: 1632929 - RNA, 20 nt, Pseudomonas putida KT2440
ugcccaaugccgugauggua

SEQ ID NO: 1632930 - RNA, 18 nt, Pseudomonas putida KT2440
ugcccaagcgcuccgcca

SEQ ID NO: 1632931 - RNA, 20 nt, Pseudomonas putida KT2440
ugcccaagcgcuccgccaau

SEQ ID NO: 1632932 - RNA, 14 nt, Pseudomonas putida KT2440
ugcccaaacgccaa

SEQ ID NO: 1632933 - RNA, 16 nt, Pseudomonas putida KT2440
ugcccaaacgccaaca

SEQ ID NO: 1632934 - RNA, 23 nt, Pseudomonas putida KT2440
ugccauuuuggauuuuuuguaga

SEQ ID NO: 1632935 - RNA, 17 nt, Pseudomonas putida KT2440
ugccauuucuucagcag

SEQ ID NO: 1632936 - RNA, 18 nt, Pseudomonas putida KT2440
ugccauuucuucagcagg

SEQ ID NO: 1632937 - RNA, 16 nt, Pseudomonas putida KT2440
ugccauugcaccaccc

SEQ ID NO: 1632938 - RNA, 20 nt, Pseudomonas putida KT2440
ugccauuggugccaccgaug

SEQ ID NO: 1632939 - RNA, 13 nt, Pseudomonas putida KT2440
ugccacgcaccac

SEQ ID NO: 1632940 - RNA, 18 nt, Pseudomonas putida KT2440
ugccacggccuucuucac

SEQ ID NO: 1632941 - RNA, 19 nt, Pseudomonas putida KT2440
ugccacucuucaccauggg

SEQ ID NO: 1632942 - RNA, 20 nt, Pseudomonas putida KT2440
ugccacucuucaccaugggc

SEQ ID NO: 1632943 - RNA, 13 nt, Pseudomonas putida KT2440
ugccacucagcgg

SEQ ID NO: 1632944 - RNA, 14 nt, Pseudomonas putida KT2440
ugccagcaccagcg

SEQ ID NO: 1632945 - RNA, 13 nt, Pseudomonas putida KT2440
ugccagcaccagc

SEQ ID NO: 1632946 - RNA, 16 nt, Pseudomonas putida KT2440
ugccagcaacaagcug

SEQ ID NO: 1632947 - RNA, 13 nt, Pseudomonas putida KT2440
ugccaaggcuuuu

SEQ ID NO: 1632948 - RNA, 18 nt, Pseudomonas putida KT2440
ugccacacacccgggccc

SEQ ID NO: 1632949 - RNA, 15 nt, Pseudomonas putida KT2440
ugccaagcccacaca

SEQ ID NO: 1632950 - RNA, 18 nt, Pseudomonas putida KT2440
ugccaagccacuggccag

SEQ ID NO: 1632951 - RNA, 17 nt, Pseudomonas putida KT2440
ugcaggcgcuccaucau

SEQ ID NO: 1632952 - RNA, 15 nt, Pseudomonas putida KT2440
ugcaggcgcacaucc

SEQ ID NO: 1632953 - RNA, 14 nt, Pseudomonas putida KT2440
ugcaggcucggcca

SEQ ID NO: 1632954 - RNA, 19 nt, Pseudomonas putida KT2440
ugcaggcguaacucagcaa

SEQ ID NO: 1632955 - RNA, 20 nt, Pseudomonas putida KT2440
ugcagggccuggacgcgugc

SEQ ID NO: 1632956 - RNA, 23 nt, Pseudomonas putida KT2440
ugcagggggguaaggcuggcuua

SEQ ID NO: 1632957 - RNA, 21 nt, Pseudomonas putida KT2440
ugcagggcgccgaugaguugu

SEQ ID NO: 1632958 - RNA, 22 nt, Pseudomonas putida KT2440
ugcaggggugggaugcccaugg

SEQ ID NO: 1632959 - RNA, 22 nt, Pseudomonas putida KT2440
ugcauaugcagggccuuuucau

SEQ ID NO: 1632960 - RNA, 15 nt, Pseudomonas putida KT2440
ugcagguacagcagc

SEQ ID NO: 1632961 - RNA, 18 nt, Pseudomonas putida KT2440
ugcagguacagcagcugc

SEQ ID NO: 1632962 - RNA, 19 nt, Pseudomonas putida KT2440
ugcagguacagcagcugca

SEQ ID NO: 1632963 - RNA, 15 nt, Pseudomonas putida KT2440
ugcaugugccgcucg

SEQ ID NO: 1632964 - RNA, 16 nt, Pseudomonas putida KT2440
ugcauggcucgcagcc

SEQ ID NO: 1632965 - RNA, 18 nt, Pseudomonas putida KT2440
ugcauggguuguggcuug

SEQ ID NO: 1632966 - RNA, 15 nt, Pseudomonas putida KT2440
ugcaugcuguuucuu

SEQ ID NO: 1632967 - RNA, 15 nt, Pseudomonas putida KT2440
ugcaugccuuccugc

SEQ ID NO: 1632968 - RNA, 18 nt, Pseudomonas putida KT2440
ugcaucgcgcacuugcca

SEQ ID NO: 1632969 - RNA, 14 nt, Pseudomonas putida KT2440
ugcaucaaauuuag

SEQ ID NO: 1632970 - RNA, 22 nt, Pseudomonas putida KT2440
ugcauccugcacugcaacaccg

SEQ ID NO: 1632971 - RNA, 13 nt, Pseudomonas putida KT2440
ugcauccgcccca

SEQ ID NO: 1632972 - RNA, 16 nt, Pseudomonas putida KT2440
ugcagcgaccaucacc

SEQ ID NO: 1632973 - RNA, 23 nt, Pseudomonas putida KT2440
ugcagcaggcuggcgggguggcc

SEQ ID NO: 1632974 - RNA, 18 nt, Pseudomonas putida KT2440
ugcagcagguaguucaug

SEQ ID NO: 1632975 - RNA, 17 nt, Pseudomonas putida KT2440
ugcagcaggccgcugag

SEQ ID NO: 1632976 - RNA, 19 nt, Pseudomonas putida KT2440
ugcagcaggccgcugagga

SEQ ID NO: 1632977 - RNA, 20 nt, Pseudomonas putida KT2440
ugcagcuugaggucgccagg

SEQ ID NO: 1632978 - RNA, 19 nt, Pseudomonas putida KT2440
ugcagcuucccggccuggc

SEQ ID NO: 1632979 - RNA, 22 nt, Pseudomonas putida KT2440
ugcagcgccgcauccagcacug

SEQ ID NO: 1632980 - RNA, 14 nt, Pseudomonas putida KT2440
ugcaggagcggcuu

SEQ ID NO: 1632981 - RNA, 17 nt, Pseudomonas putida KT2440
ugcaggauuugcccgca

SEQ ID NO: 1632982 - RNA, 19 nt, Pseudomonas putida KT2440
ugcacgcgcagagaagccg

SEQ ID NO: 1632983 - RNA, 15 nt, Pseudomonas putida KT2440
ugcacgcgugccugg

SEQ ID NO: 1632984 - RNA, 14 nt, Pseudomonas putida KT2440
ugcacgccagccag

SEQ ID NO: 1632985 - RNA, 17 nt, Pseudomonas putida KT2440
ugcagaacguacuggcc

SEQ ID NO: 1632986 - RNA, 23 nt, Pseudomonas putida KT2440
ugcagaacguacuggccgcugaa

SEQ ID NO: 1632987 - RNA, 14 nt, Pseudomonas putida KT2440
ugcagaaccgccag

SEQ ID NO: 1632988 - RNA, 16 nt, Pseudomonas putida KT2440
ugcagaaccgccagca

SEQ ID NO: 1632989 - RNA, 19 nt, Pseudomonas putida KT2440
ugauuugcgcuacagcuuu

SEQ ID NO: 1632990 - RNA, 15 nt, Pseudomonas putida KT2440
ugcacccgugcaggg

SEQ ID NO: 1632991 - RNA, 18 nt, Pseudomonas putida KT2440
ugcacccgugccugccug

SEQ ID NO: 1632992 - RNA, 16 nt, Pseudomonas putida KT2440
ugcacccgcgcgcccg

SEQ ID NO: 1632993 - RNA, 17 nt, Pseudomonas putida KT2440
ugcaccccauaacgccc

SEQ ID NO: 1632994 - RNA, 14 nt, Pseudomonas putida KT2440
ugcacccgccagcc

SEQ ID NO: 1632995 - RNA, 14 nt, Pseudomonas putida KT2440
ugcacccacuggcc

SEQ ID NO: 1632996 - RNA, 15 nt, Pseudomonas putida KT2440
ugcacccacuggccg

SEQ ID NO: 1632997 - RNA, 16 nt, Pseudomonas putida KT2440
ugcaccgagaagcaca

SEQ ID NO: 1632998 - RNA, 22 nt, Pseudomonas putida KT2440
uccagcaacggacgucccagca

SEQ ID NO: 1632999 - RNA, 20 nt, Pseudomonas putida KT2440
uccagcaagggccugugccg

SEQ ID NO: 1633000 - RNA, 16 nt, Pseudomonas putida KT2440
uccagcaacagcugcc

SEQ ID NO: 1633001 - RNA, 22 nt, Pseudomonas putida KT2440
uccagcaacagcugccgggccg

SEQ ID NO: 1633002 - RNA, 17 nt, Pseudomonas putida KT2440
uccagcaacaacgccuu

SEQ ID NO: 1633003 - RNA, 13 nt, Pseudomonas putida KT2440
uccagcaccaacc

SEQ ID NO: 1633004 - RNA, 17 nt, Pseudomonas putida KT2440
uccagcaccggcgugcc

SEQ ID NO: 1633005 - RNA, 20 nt, Pseudomonas putida KT2440
uccagcagcgcauccaccuc

SEQ ID NO: 1633006 - RNA, 21 nt, Pseudomonas putida KT2440
uccagccagauugcaggaaca

SEQ ID NO: 1633007 - RNA, 19 nt, Pseudomonas putida KT2440
uccagcuccuucuucaccc

SEQ ID NO: 1633008 - RNA, 15 nt, Pseudomonas putida KT2440
uccagcucgccgccc

SEQ ID NO: 1633009 - RNA, 17 nt, Pseudomonas putida KT2440
uccagcguucggccagc

SEQ ID NO: 1633010 - RNA, 14 nt, Pseudomonas putida KT2440
uccagccccgcacc

SEQ ID NO: 1633011 - RNA, 22 nt, Pseudomonas putida KT2440
uccagcccucaagggauuggca

SEQ ID NO: 1633012 - RNA, 17 nt, Pseudomonas putida KT2440
uccagcccgauggccuu

SEQ ID NO: 1633013 - RNA, 18 nt, Pseudomonas putida KT2440
uccagcccugcucgccaa

SEQ ID NO: 1633014 - RNA, 15 nt, Pseudomonas putida KT2440
uccagcccuggcgac

SEQ ID NO: 1633015 - RNA, 15 nt, Pseudomonas putida KT2440
uccagcccuuccacc

SEQ ID NO: 1633016 - RNA, 16 nt, Pseudomonas putida KT2440
uccagccgcugcugca

SEQ ID NO: 1633017 - RNA, 19 nt, Pseudomonas putida KT2440
uccagccgcgccacuccca

SEQ ID NO: 1633018 - RNA, 17 nt, Pseudomonas putida KT2440
uccagccugcagcaccc

SEQ ID NO: 1633019 - RNA, 16 nt, Pseudomonas putida KT2440
uccagcuugccaccau

SEQ ID NO: 1633020 - RNA, 19 nt, Pseudomonas putida KT2440
uccagcuucugcaacuccu

SEQ ID NO: 1633021 - RNA, 14 nt, Pseudomonas putida KT2440
uccagcuucugcug

SEQ ID NO: 1633022 - RNA, 15 nt, Pseudomonas putida KT2440
uccagcuucugcugg

SEQ ID NO: 1633023 - RNA, 15 nt, Pseudomonas putida KT2440
uccaggaacgcugcc

SEQ ID NO: 1633024 - RNA, 16 nt, Pseudomonas putida KT2440
uccaggaagcaggcgu

SEQ ID NO: 1633025 - RNA, 15 nt, Pseudomonas putida KT2440
uccagcuguacgcug

SEQ ID NO: 1633026 - RNA, 15 nt, Pseudomonas putida KT2440
uccagcucggcaagg

SEQ ID NO: 1633027 - RNA, 16 nt, Pseudomonas putida KT2440
uccagcucggcaaggc

SEQ ID NO: 1633028 - RNA, 18 nt, Pseudomonas putida KT2440
uccagcucuggucaccuu

SEQ ID NO: 1633029 - RNA, 20 nt, Pseudomonas putida KT2440
uccagcucuggucaccuucg

SEQ ID NO: 1633030 - RNA, 21 nt, Pseudomonas putida KT2440
uccagcucuggucaccuucgu

SEQ ID NO: 1633031 - RNA, 19 nt, Pseudomonas putida KT2440
uccagcugcaacagcggcg

SEQ ID NO: 1633032 - RNA, 14 nt, Pseudomonas putida KT2440
uccagcugcgccug

SEQ ID NO: 1633033 - RNA, 14 nt, Pseudomonas putida KT2440
uccaggguggcguu

SEQ ID NO: 1633034 - RNA, 15 nt, Pseudomonas putida KT2440
uccaggcugcacugg

SEQ ID NO: 1633035 - RNA, 22 nt, Pseudomonas putida KT2440
uccaggacaaaccagcggucug

SEQ ID NO: 1633036 - RNA, 16 nt, Pseudomonas putida KT2440
uccaggcucagcucgu

SEQ ID NO: 1633037 - RNA, 15 nt, Pseudomonas putida KT2440
uccagggcaggcuga

SEQ ID NO: 1633038 - RNA, 16 nt, Pseudomonas putida KT2440
uccaggcugcgcauca

SEQ ID NO: 1633039 - RNA, 15 nt, Pseudomonas putida KT2440
uccaaauaaagaucu

SEQ ID NO: 1633040 - RNA, 14 nt, Pseudomonas putida KT2440
uccacaaaccccga

SEQ ID NO: 1633041 - RNA, 23 nt, Pseudomonas putida KT2440
uccacaaaccccgacgccggccu

SEQ ID NO: 1633042 - RNA, 21 nt, Pseudomonas putida KT2440
uccaccacacgcccgcgugag

SEQ ID NO: 1633043 - RNA, 12 nt, Pseudomonas putida KT2440
uccaccacagcu

SEQ ID NO: 1633044 - RNA, 18 nt, Pseudomonas putida KT2440
uccacagguaccaggcug

SEQ ID NO: 1633045 - RNA, 13 nt, Pseudomonas putida KT2440
uccacauacugcu

SEQ ID NO: 1633046 - RNA, 15 nt, Pseudomonas putida KT2440
uccacauaggccagc

SEQ ID NO: 1633047 - RNA, 16 nt, Pseudomonas putida KT2440
uccacauaggccagcu

SEQ ID NO: 1633048 - RNA, 14 nt, Pseudomonas putida KT2440
uccaccgccccaag

SEQ ID NO: 1633049 - RNA, 15 nt, Pseudomonas putida KT2440
uccaccgccccaagc

SEQ ID NO: 1633050 - RNA, 19 nt, Pseudomonas putida KT2440
uccaccgccucgaccuggc

SEQ ID NO: 1633051 - RNA, 12 nt, Pseudomonas putida KT2440
uccaccgcgcca

SEQ ID NO: 1633052 - RNA, 21 nt, Pseudomonas putida KT2440
uccacccggucccgcccggcc

SEQ ID NO: 1633053 - RNA, 16 nt, Pseudomonas putida KT2440
uccaccaccugcaggg

SEQ ID NO: 1633054 - RNA, 18 nt, Pseudomonas putida KT2440
uccagaccagacagcgcu

SEQ ID NO: 1633055 - RNA, 16 nt, Pseudomonas putida KT2440
uccacugugcccgcca

SEQ ID NO: 1633056 - RNA, 22 nt, Pseudomonas putida KT2440
uccacuggaacucgaucggcac

SEQ ID NO: 1633057 - RNA, 21 nt, Pseudomonas putida KT2440
uccacucgucgaucuggauga

SEQ ID NO: 1633058 - RNA, 16 nt, Pseudomonas putida KT2440
uccaccuaucaggagc

SEQ ID NO: 1633059 - RNA, 22 nt, Pseudomonas putida KT2440
uccaccucgggcuuggcacgcu

SEQ ID NO: 1633060 - RNA, 20 nt, Pseudomonas putida KT2440
uccaccuuccacucuuccac

SEQ ID NO: 1633061 - RNA, 16 nt, Pseudomonas putida KT2440
uccaccugacgcgcca

SEQ ID NO: 1633062 - RNA, 20 nt, Pseudomonas putida KT2440
uccaccugacgcgccagguc

SEQ ID NO: 1633063 - RNA, 12 nt, Pseudomonas putida KT2440
uccaccugccac

SEQ ID NO: 1633064 - RNA, 16 nt, Pseudomonas putida KT2440
uccacgaaccugugca

SEQ ID NO: 1633065 - RNA, 20 nt, Pseudomonas putida KT2440
uccacgaaccugugcacagc

SEQ ID NO: 1633066 - RNA, 15 nt, Pseudomonas putida KT2440
ucaucuugccggccu

SEQ ID NO: 1633067 - RNA, 11 nt, Pseudomonas putida KT2440
ucaucuucuug

SEQ ID NO: 1633068 - RNA, 22 nt, Pseudomonas putida KT2440
ucaucuucaucgcgaggcccga

SEQ ID NO: 1633069 - RNA, 15 nt, Pseudomonas putida KT2440
ucaucugcccgcgcc

SEQ ID NO: 1633070 - RNA, 17 nt, Pseudomonas putida KT2440
ucaucgggaucagcacg

SEQ ID NO: 1633071 - RNA, 20 nt, Pseudomonas putida KT2440
ucaucgggaucagcacgccc

SEQ ID NO: 1633072 - RNA, 17 nt, Pseudomonas putida KT2440
ucaucgguuuuuccaug

SEQ ID NO: 1633073 - RNA, 15 nt, Pseudomonas putida KT2440
ucaucguaauggccu

SEQ ID NO: 1633074 - RNA, 13 nt, Pseudomonas putida KT2440
ucaucuaccagcu

SEQ ID NO: 1633075 - RNA, 18 nt, Pseudomonas putida KT2440
ucaugaacagcgcccaga

SEQ ID NO: 1633076 - RNA, 15 nt, Pseudomonas putida KT2440
ucaugaagcuucaaa

SEQ ID NO: 1633077 - RNA, 16 nt, Pseudomonas putida KT2440
ucaugaagcuucaaac

SEQ ID NO: 1633078 - RNA, 18 nt, Pseudomonas putida KT2440
ucaugcaacaacccgccc

SEQ ID NO: 1633079 - RNA, 16 nt, Pseudomonas putida KT2440
ucaugcaggucaucga

SEQ ID NO: 1633080 - RNA, 20 nt, Pseudomonas putida KT2440
ucaugcaguucuaccagcag

SEQ ID NO: 1633081 - RNA, 13 nt, Pseudomonas putida KT2440
ucaugcagcaccu

SEQ ID NO: 1633082 - RNA, 14 nt, Pseudomonas putida KT2440
ucaugcagcaccuc

SEQ ID NO: 1633083 - RNA, 21 nt, Pseudomonas putida KT2440
ucaugccauccucggccaggc

SEQ ID NO: 1633084 - RNA, 13 nt, Pseudomonas putida KT2440
ucaugccuucggu

SEQ ID NO: 1633085 - RNA, 16 nt, Pseudomonas putida KT2440
ucaugccggccccaga

SEQ ID NO: 1633086 - RNA, 17 nt, Pseudomonas putida KT2440
ucaugcgcuggccacga

SEQ ID NO: 1633087 - RNA, 14 nt, Pseudomonas putida KT2440
ucaugcuggccagg

SEQ ID NO: 1633088 - RNA, 15 nt, Pseudomonas putida KT2440
ucaugcuggccagga

SEQ ID NO: 1633089 - RNA, 15 nt, Pseudomonas putida KT2440
ucauggucaacagcc

SEQ ID NO: 1633090 - RNA, 20 nt, Pseudomonas putida KT2440
ucauggcgccgaugccgucg

SEQ ID NO: 1633091 - RNA, 17 nt, Pseudomonas putida KT2440
ucauggcuauucuccuu

SEQ ID NO: 1633092 - RNA, 20 nt, Pseudomonas putida KT2440
ucauggcucacacccaggcu

SEQ ID NO: 1633093 - RNA, 19 nt, Pseudomonas putida KT2440
ucauuuccugaaccaugcg

SEQ ID NO: 1633094 - RNA, 18 nt, Pseudomonas putida KT2440
ucauugggucccugguuc

SEQ ID NO: 1633095 - RNA, 22 nt, Pseudomonas putida KT2440
ucagcgaggggacgaucugcag

SEQ ID NO: 1633096 - RNA, 16 nt, Pseudomonas putida KT2440
ucagcgaguugaacuu

SEQ ID NO: 1633097 - RNA, 15 nt, Pseudomonas putida KT2440
ucagcgacaccgcca

SEQ ID NO: 1633098 - RNA, 14 nt, Pseudomonas putida KT2440
ucagcgacugccaa

SEQ ID NO: 1633099 - RNA, 19 nt, Pseudomonas putida KT2440
ucagcgaauaguagaagca

SEQ ID NO: 1633100 - RNA, 13 nt, Pseudomonas putida KT2440
ucagccuuuucca

SEQ ID NO: 1633101 - RNA, 17 nt, Pseudomonas putida KT2440
ucagccuucagugcuuc

SEQ ID NO: 1633102 - RNA, 18 nt, Pseudomonas putida KT2440
ucagccuguaccgcccuc

SEQ ID NO: 1633103 - RNA, 12 nt, Pseudomonas putida KT2440
ucagccugccau

SEQ ID NO: 1633104 - RNA, 23 nt, Pseudomonas putida KT2440
ucagccucggucagguacucgcc

SEQ ID NO: 1633105 - RNA, 16 nt, Pseudomonas putida KT2440
ucagccgcugcgccug

SEQ ID NO: 1633106 - RNA, 13 nt, Pseudomonas putida KT2440
ucagccgcgcccu

SEQ ID NO: 1633107 - RNA, 14 nt, Pseudomonas putida KT2440
ucagccgcgcugac

SEQ ID NO: 1633108 - RNA, 14 nt, Pseudomonas putida KT2440
ucagccacgggcuu

SEQ ID NO: 1633109 - RNA, 12 nt, Pseudomonas putida KT2440
ucagccagcaag

SEQ ID NO: 1633110 - RNA, 23 nt, Pseudomonas putida KT2440
ucagccagggcgagagcggcuuc

SEQ ID NO: 1633111 - RNA, 18 nt, Pseudomonas putida KT2440
ucagccaggcugagcccg

SEQ ID NO: 1633112 - RNA, 19 nt, Pseudomonas putida KT2440
ucagccagcgguccggccc

SEQ ID NO: 1633113 - RNA, 14 nt, Pseudomonas putida KT2440
ucacugagccaggc

SEQ ID NO: 1633114 - RNA, 16 nt, Pseudomonas putida KT2440
ucacugacagcaugcc

SEQ ID NO: 1633115 - RNA, 20 nt, Pseudomonas putida KT2440
ucacuguggucauccaggcu

SEQ ID NO: 1633116 - RNA, 20 nt, Pseudomonas putida KT2440
ucaggaacaaucuucuucau

SEQ ID NO: 1633117 - RNA, 14 nt, Pseudomonas putida KT2440
ucaggaaggcacca

SEQ ID NO: 1633118 - RNA, 20 nt, Pseudomonas putida KT2440
ucagcuucuggguaucguuc

SEQ ID NO: 1633119 - RNA, 14 nt, Pseudomonas putida KT2440
ucagcuugaacacg

SEQ ID NO: 1633120 - RNA, 19 nt, Pseudomonas putida KT2440
ucagcuugccuuccgggaa

SEQ ID NO: 1633121 - RNA, 17 nt, Pseudomonas putida KT2440
ucagcgcggugaccagc

SEQ ID NO: 1633122 - RNA, 15 nt, Pseudomonas putida KT2440
ucagcgcguccagca

SEQ ID NO: 1633123 - RNA, 19 nt, Pseudomonas putida KT2440
ucagcgcggcaaagguggc

SEQ ID NO: 1633124 - RNA, 14 nt, Pseudomonas putida KT2440
ucagcgccugcuca

SEQ ID NO: 1633125 - RNA, 22 nt, Pseudomonas putida KT2440
ucagcgccugcucauccaccac

SEQ ID NO: 1633126 - RNA, 21 nt, Pseudomonas putida KT2440
ucagcgccgguagcggcuggg

SEQ ID NO: 1633127 - RNA, 19 nt, Pseudomonas putida KT2440
ucagcgccuccagggcggc

SEQ ID NO: 1633128 - RNA, 20 nt, Pseudomonas putida KT2440
ucagcuggaacgcuuggcca

SEQ ID NO: 1633129 - RNA, 21 nt, Pseudomonas putida KT2440
ucagcuggaacgcuuggccag

SEQ ID NO: 1633130 - RNA, 18 nt, Pseudomonas putida KT2440
ucagcugggagagcgccu

SEQ ID NO: 1633131 - RNA, 21 nt, Pseudomonas putida KT2440
ucagcuuaacgcuuggccaga

SEQ ID NO: 1633132 - RNA, 13 nt, Pseudomonas putida KT2440
ucagcuguucuuc

SEQ ID NO: 1633133 - RNA, 14 nt, Pseudomonas putida KT2440
ucagcugccacucu

SEQ ID NO: 1633134 - RNA, 19 nt, Pseudomonas putida KT2440
ucagcuggccggcuuggca

SEQ ID NO: 1633135 - RNA, 16 nt, Pseudomonas putida KT2440
ucagcugcugcucuuu

SEQ ID NO: 1633136 - RNA, 22 nt, Pseudomonas putida KT2440
ucagcugauguuacggacgggc

SEQ ID NO: 1633137 - RNA, 20 nt, Pseudomonas putida KT2440
ucagcucaggccuugcucga

SEQ ID NO: 1633138 - RNA, 16 nt, Pseudomonas putida KT2440
ucagcucaagcgcucc

SEQ ID NO: 1633139 - RNA, 14 nt, Pseudomonas putida KT2440
ucagcucacaggcu

SEQ ID NO: 1633140 - RNA, 14 nt, Pseudomonas putida KT2440
ucagcuacgcugga

SEQ ID NO: 1633141 - RNA, 21 nt, Pseudomonas putida KT2440
ucagcuacgcuggacuugccu

SEQ ID NO: 1633142 - RNA, 24 nt, Pseudomonas putida KT2440
ucaggguauugaacggcgcaucca

SEQ ID NO: 1633143 - RNA, 18 nt, Pseudomonas putida KT2440
ucagggucgggcacaggc

SEQ ID NO: 1633144 - RNA, 18 nt, Pseudomonas putida KT2440
ucagguaauccaccagcc

SEQ ID NO: 1633145 - RNA, 15 nt, Pseudomonas putida KT2440
ucagguugcccagca

SEQ ID NO: 1633146 - RNA, 18 nt, Pseudomonas putida KT2440
ucagguugcccgcaugca

SEQ ID NO: 1633147 - RNA, 18 nt, Pseudomonas putida KT2440
ucagguugagcaccgggc

SEQ ID NO: 1633148 - RNA, 16 nt, Pseudomonas putida KT2440
ucagguucacuuccac

SEQ ID NO: 1633149 - RNA, 13 nt, Pseudomonas putida KT2440
ucagguucagggc

SEQ ID NO: 1633150 - RNA, 15 nt, Pseudomonas putida KT2440
ucagguucagggcaa

SEQ ID NO: 1633151 - RNA, 14 nt, Pseudomonas putida KT2440
ucagguuacuggcc

SEQ ID NO: 1633152 - RNA, 21 nt, Pseudomonas putida KT2440
ucagguuacgcaccagcucca

SEQ ID NO: 1633153 - RNA, 17 nt, Pseudomonas putida KT2440
ucagguguuccagcacg

SEQ ID NO: 1633154 - RNA, 23 nt, Pseudomonas putida KT2440
ucaguaccggucauggcgcgcca

SEQ ID NO: 1633155 - RNA, 17 nt, Pseudomonas putida KT2440
ucagggucucgcggcug

SEQ ID NO: 1633156 - RNA, 18 nt, Pseudomonas putida KT2440
ucagggcuuuuuccagcg

SEQ ID NO: 1633157 - RNA, 15 nt, Pseudomonas putida KT2440
ucagggcccgggcac

SEQ ID NO: 1633158 - RNA, 18 nt, Pseudomonas putida KT2440
ucagggcccgggcacggg

SEQ ID NO: 1633159 - RNA, 23 nt, Pseudomonas putida KT2440
ucagggcacggcugcccugcaug

SEQ ID NO: 1633160 - RNA, 21 nt, Pseudomonas putida KT2440
ucaggaugccgugcgcggcau

SEQ ID NO: 1633161 - RNA, 23 nt, Pseudomonas putida KT2440
ucaggcaaaacaaaaagcgcagc

SEQ ID NO: 1633162 - RNA, 13 nt, Pseudomonas putida KT2440
ucagucagccagu

SEQ ID NO: 1633163 - RNA, 14 nt, Pseudomonas putida KT2440
ucaguucagccagg

SEQ ID NO: 1633164 - RNA, 19 nt, Pseudomonas putida KT2440
ucaguuugggcgggcugcg

SEQ ID NO: 1633165 - RNA, 17 nt, Pseudomonas putida KT2440
ucagucgguagagcaaa

SEQ ID NO: 1633166 - RNA, 16 nt, Pseudomonas putida KT2440
ucauaaggaucaugaa

SEQ ID NO: 1633167 - RNA, 20 nt, Pseudomonas putida KT2440
ucaucaggcgauucaggcuu

SEQ ID NO: 1633168 - RNA, 23 nt, Pseudomonas putida KT2440
ucaucaggccgaugccaagcacc

SEQ ID NO: 1633169 - RNA, 23 nt, Pseudomonas putida KT2440
ucaucagguacggguuggcgucg

SEQ ID NO: 1633170 - RNA, 21 nt, Pseudomonas putida KT2440
ucaucaucgagauguggcccg

SEQ ID NO: 1633171 - RNA, 23 nt, Pseudomonas putida KT2440
ucaucaggacggucaugcucagc

SEQ ID NO: 1633172 - RNA, 21 nt, Pseudomonas putida KT2440
ucaucagcaacccggccaggc

SEQ ID NO: 1633173 - RNA, 14 nt, Pseudomonas putida KT2440
ucaucagcaggcag

SEQ ID NO: 1633174 - RNA, 13 nt, Pseudomonas putida KT2440
ucaucaucgguaa

SEQ ID NO: 1633175 - RNA, 14 nt, Pseudomonas putida KT2440
ucaucaucagcagg

SEQ ID NO: 1633176 - RNA, 19 nt, Pseudomonas putida KT2440
ucaucaucggcaugcagcg

SEQ ID NO: 1633177 - RNA, 14 nt, Pseudomonas putida KT2440
ucauccaggcugca

SEQ ID NO: 1633178 - RNA, 17 nt, Pseudomonas putida KT2440
ucauccaggcugcacug

SEQ ID NO: 1633179 - RNA, 13 nt, Pseudomonas putida KT2440
ucauccagcagcu

SEQ ID NO: 1633180 - RNA, 14 nt, Pseudomonas putida KT2440
ucauccagcagcuc

SEQ ID NO: 1633181 - RNA, 22 nt, Pseudomonas putida KT2440
ucauccagcgggaugcagucga

SEQ ID NO: 1633182 - RNA, 15 nt, Pseudomonas putida KT2440
ucauccgccaggcuc

SEQ ID NO: 1633183 - RNA, 16 nt, Pseudomonas putida KT2440
ucauccgccaggcucu

SEQ ID NO: 1633184 - RNA, 18 nt, Pseudomonas putida KT2440
ucauccggcgcggccugc

SEQ ID NO: 1633185 - RNA, 22 nt, Pseudomonas putida KT2440
ucauccggcgcggccugcucca

SEQ ID NO: 1633186 - RNA, 17 nt, Pseudomonas putida KT2440
ucauccucgcccaccag

SEQ ID NO: 1633187 - RNA, 18 nt, Pseudomonas putida KT2440
ucaucgaagccaagcgcc

SEQ ID NO: 1633188 - RNA, 14 nt, Pseudomonas putida KT2440
ucaucgaacaccuc

SEQ ID NO: 1633189 - RNA, 21 nt, Pseudomonas putida KT2440
ucaucccucauuucaggcuuc

SEQ ID NO: 1633190 - RNA, 16 nt, Pseudomonas putida KT2440
ucaucccuguacagau

SEQ ID NO: 1633191 - RNA, 16 nt, Pseudomonas putida KT2440
ucauccauggcaaaac

SEQ ID NO: 1633192 - RNA, 16 nt, Pseudomonas putida KT2440
ucauccaucaccugcc

SEQ ID NO: 1633193 - RNA, 22 nt, Pseudomonas putida KT2440
ucaucgaugcccgucccuucau

SEQ ID NO: 1633194 - RNA, 20 nt, Pseudomonas putida KT2440
ucaucgccggguccaccagc

SEQ ID NO: 1633195 - RNA, 21 nt, Pseudomonas putida KT2440
ucaucggcaguagagccccca

SEQ ID NO: 1633196 - RNA, 13 nt, Pseudomonas putida KT2440
ucaucaccagccc

SEQ ID NO: 1633197 - RNA, 13 nt, Pseudomonas putida KT2440
ucaucaccacccc

SEQ ID NO: 1633198 - RNA, 22 nt, Pseudomonas putida KT2440
ucaucacccgggaacagcagca

SEQ ID NO: 1633199 - RNA, 23 nt, Pseudomonas putida KT2440
ucaucacccgggaacagcagcac

SEQ ID NO: 1633200 - RNA, 22 nt, Pseudomonas putida KT2440
ucauagaaauggcuuccggcgc

SEQ ID NO: 1633201 - RNA, 18 nt, Pseudomonas putida KT2440
ucauagcuuucaggcgca

SEQ ID NO: 1633202 - RNA, 14 nt, Pseudomonas putida KT2440
ucauacgcaaucuc

SEQ ID NO: 1633203 - RNA, 16 nt, Pseudomonas putida KT2440
ucauaaugaaaacccu

SEQ ID NO: 1633204 - RNA, 17 nt, Pseudomonas putida KT2440
ucacuacaugcggcccu

SEQ ID NO: 1633205 - RNA, 17 nt, Pseudomonas putida KT2440
ucacguagaacaggccu

SEQ ID NO: 1633206 - RNA, 21 nt, Pseudomonas putida KT2440
ucacguagaacaggccugcgg

SEQ ID NO: 1633207 - RNA, 15 nt, Pseudomonas putida KT2440
ucacuacccaggcca

SEQ ID NO: 1633208 - RNA, 12 nt, Pseudomonas putida KT2440
ucacgcaccaug

SEQ ID NO: 1633209 - RNA, 21 nt, Pseudomonas putida KT2440
ucacgcaagcggcccugaucc

SEQ ID NO: 1633210 - RNA, 17 nt, Pseudomonas putida KT2440
ucacgcgaccucagccg

SEQ ID NO: 1633211 - RNA, 15 nt, Pseudomonas putida KT2440
ucacgcaggcccagc

SEQ ID NO: 1633212 - RNA, 18 nt, Pseudomonas putida KT2440
ucacgcagcccuuucagg

SEQ ID NO: 1633213 - RNA, 19 nt, Pseudomonas putida KT2440
ucacgcagcccuuucaggg

SEQ ID NO: 1633214 - RNA, 18 nt, Pseudomonas putida KT2440
ucacggguaagccggcgg

SEQ ID NO: 1633215 - RNA, 19 nt, Pseudomonas putida KT2440
ucacgcucguuguccagca

SEQ ID NO: 1633216 - RNA, 12 nt, Pseudomonas putida KT2440
ucaccugggcga

SEQ ID NO: 1633217 - RNA, 17 nt, Pseudomonas putida KT2440
ucaccuggcccacgccu

SEQ ID NO: 1633218 - RNA, 16 nt, Pseudomonas putida KT2440
ucaccuguucccccac

SEQ ID NO: 1633219 - RNA, 16 nt, Pseudomonas putida KT2440
ucaccugcucuggccc

SEQ ID NO: 1633220 - RNA, 14 nt, Pseudomonas putida KT2440
ucaccugcggccug

SEQ ID NO: 1633221 - RNA, 15 nt, Pseudomonas putida KT2440
ucaccuccaguugcc

SEQ ID NO: 1633222 - RNA, 17 nt, Pseudomonas putida KT2440
ucaccuuugagugcuuc

SEQ ID NO: 1633223 - RNA, 17 nt, Pseudomonas putida KT2440
ucaccuuguccagcagg

SEQ ID NO: 1633224 - RNA, 21 nt, Pseudomonas putida KT2440
ucaccuugcugaaauccagcc

SEQ ID NO: 1633225 - RNA, 19 nt, Pseudomonas putida KT2440
ucacgagacauccgcaaca

SEQ ID NO: 1633226 - RNA, 15 nt, Pseudomonas putida KT2440
ucacgaacagccaga

SEQ ID NO: 1633227 - RNA, 16 nt, Pseudomonas putida KT2440
ucacgaucgccaaccc

SEQ ID NO: 1633228 - RNA, 15 nt, Pseudomonas putida KT2440
ucacgaucaugcugg

SEQ ID NO: 1633229 - RNA, 21 nt, Pseudomonas putida KT2440
ucacgaucaugcuggccagga

SEQ ID NO: 1633230 - RNA, 18 nt, Pseudomonas putida KT2440
ucacgauccccaccagca

SEQ ID NO: 1633231 - RNA, 23 nt, Pseudomonas putida KT2440
ucaccgcugccgaucagcacgcc

SEQ ID NO: 1633232 - RNA, 16 nt, Pseudomonas putida KT2440
ucaccggccagcacuu

SEQ ID NO: 1633233 - RNA, 12 nt, Pseudomonas putida KT2440
ucaccgccgccu

SEQ ID NO: 1633234 - RNA, 15 nt, Pseudomonas putida KT2440
ucaccgcgcaccucc

SEQ ID NO: 1633235 - RNA, 17 nt, Pseudomonas putida KT2440
ucaccgccccagcgcgc

SEQ ID NO: 1633236 - RNA, 12 nt, Pseudomonas putida KT2440
ucaccgccgcca

SEQ ID NO: 1633237 - RNA, 22 nt, Pseudomonas putida KT2440
ucaccgguaucgaugcacagcu

SEQ ID NO: 1633238 - RNA, 20 nt, Pseudomonas putida KT2440
ucaccguucuugauccagcu

SEQ ID NO: 1633239 - RNA, 15 nt, Pseudomonas putida KT2440
ucaccguugccgcca

SEQ ID NO: 1633240 - RNA, 14 nt, Pseudomonas putida KT2440
ucaccgucggcgcu

SEQ ID NO: 1633241 - RNA, 19 nt, Pseudomonas putida KT2440
ucaccgcagcccagcgccg

SEQ ID NO: 1633242 - RNA, 15 nt, Pseudomonas putida KT2440
ucaccgcaagcugca

SEQ ID NO: 1633243 - RNA, 17 nt, Pseudomonas putida KT2440
ucaccgccagcauggcc

SEQ ID NO: 1633244 - RNA, 15 nt, Pseudomonas putida KT2440
ucaccgaugcgcccg

SEQ ID NO: 1633245 - RNA, 17 nt, Pseudomonas putida KT2440
ucaccgacgugugccca

SEQ ID NO: 1633246 - RNA, 20 nt, Pseudomonas putida KT2440
ucaccgacgugugcccacug

SEQ ID NO: 1633247 - RNA, 15 nt, Pseudomonas putida KT2440
ucacccccaucagcg

SEQ ID NO: 1633248 - RNA, 12 nt, Pseudomonas putida KT2440
ucacccagguga

SEQ ID NO: 1633249 - RNA, 17 nt, Pseudomonas putida KT2440
ucaccccguacacccgc

SEQ ID NO: 1633250 - RNA, 17 nt, Pseudomonas putida KT2440
ucacccgccccacgccc

SEQ ID NO: 1633251 - RNA, 21 nt, Pseudomonas putida KT2440
ucacccgaccagaucaggccg

SEQ ID NO: 1633252 - RNA, 16 nt, Pseudomonas putida KT2440
ucaccacaaaaccuuc

SEQ ID NO: 1633253 - RNA, 15 nt, Pseudomonas putida KT2440
ucaccagcagcuucu

SEQ ID NO: 1633254 - RNA, 19 nt, Pseudomonas putida KT2440
ucaccagcagcuucuucac

SEQ ID NO: 1633255 - RNA, 13 nt, Pseudomonas putida KT2440
ucacccaccagcc

SEQ ID NO: 1633256 - RNA, 14 nt, Pseudomonas putida KT2440
ucaccagccccuca

SEQ ID NO: 1633257 - RNA, 17 nt, Pseudomonas putida KT2440
ucaccauugaugaacga

SEQ ID NO: 1633258 - RNA, 15 nt, Pseudomonas putida KT2440
ucacacucagccgcu

SEQ ID NO: 1633259 - RNA, 15 nt, Pseudomonas putida KT2440
ucacacgccacuaag

SEQ ID NO: 1633260 - RNA, 16 nt, Pseudomonas putida KT2440
ucacagaaaagcugca

SEQ ID NO: 1633261 - RNA, 20 nt, Pseudomonas putida KT2440
ucaaucaacucggcagugaa

SEQ ID NO: 1633262 - RNA, 21 nt, Pseudomonas putida KT2440
ucaaggucagcuucuggguau

SEQ ID NO: 1633263 - RNA, 15 nt, Pseudomonas putida KT2440
ucaagggcaggguga

SEQ ID NO: 1633264 - RNA, 15 nt, Pseudomonas putida KT2440
ucaagggcaaacugg

SEQ ID NO: 1633265 - RNA, 11 nt, Pseudomonas putida KT2440
ucaaggcugcu

SEQ ID NO: 1633266 - RNA, 15 nt, Pseudomonas putida KT2440
ucaaggcgccgauga

SEQ ID NO: 1633267 - RNA, 16 nt, Pseudomonas putida KT2440
ucaagguuucagcagc

SEQ ID NO: 1633268 - RNA, 21 nt, Pseudomonas putida KT2440
ucaagcuggcgcaaucuugcc

SEQ ID NO: 1633269 - RNA, 13 nt, Pseudomonas putida KT2440
ucaagcuccccag

SEQ ID NO: 1633270 - RNA, 15 nt, Pseudomonas putida KT2440
ucaagcuccccagca

SEQ ID NO: 1633271 - RNA, 16 nt, Pseudomonas putida KT2440
ucaagcucgacccgcg

SEQ ID NO: 1633272 - RNA, 16 nt, Pseudomonas putida KT2440
ucaaggccagcgccug

SEQ ID NO: 1633273 - RNA, 14 nt, Pseudomonas putida KT2440
ucaagcgccagggc

SEQ ID NO: 1633274 - RNA, 16 nt, Pseudomonas putida KT2440
ucaagcgccagggcau

SEQ ID NO: 1633275 - RNA, 16 nt, Pseudomonas putida KT2440
ucaagccuugcugauc

SEQ ID NO: 1633276 - RNA, 24 nt, Pseudomonas putida KT2440
ucaagccucgcgcaacaccgccag

SEQ ID NO: 1633277 - RNA, 17 nt, Pseudomonas putida KT2440
ucaagcccugccgccuu

SEQ ID NO: 1633278 - RNA, 20 nt, Pseudomonas putida KT2440
ucaagcagguaaccgcugcc

SEQ ID NO: 1633279 - RNA, 13 nt, Pseudomonas putida KT2440
ucaagcacguugu

SEQ ID NO: 1633280 - RNA, 16 nt, Pseudomonas putida KT2440
ucaagcacuacaucua

SEQ ID NO: 1633281 - RNA, 18 nt, Pseudomonas putida KT2440
ucaacggcgcccgggcca

SEQ ID NO: 1633282 - RNA, 14 nt, Pseudomonas putida KT2440
ucaacugccaggcu

SEQ ID NO: 1633283 - RNA, 12 nt, Pseudomonas putida KT2440
ucaacuggcagg

SEQ ID NO: 1633284 - RNA, 17 nt, Pseudomonas putida KT2440
ucaagaauuucuaccaa

SEQ ID NO: 1633285 - RNA, 12 nt, Pseudomonas putida KT2440
uauccgcuggcu

SEQ ID NO: 1633286 - RNA, 18 nt, Pseudomonas putida KT2440
uauugccccggccaguga

SEQ ID NO: 1633287 - RNA, 13 nt, Pseudomonas putida KT2440
uauugccugccag

SEQ ID NO: 1633288 - RNA, 21 nt, Pseudomonas putida KT2440
uauuuaugccgcguuccuuuc

SEQ ID NO: 1633289 - RNA, 20 nt, Pseudomonas putida KT2440
ucaaaguuuugcaucaagag

SEQ ID NO: 1633290 - RNA, 21 nt, Pseudomonas putida KT2440
ucaaacccggcagccaccgcc

SEQ ID NO: 1633291 - RNA, 16 nt, Pseudomonas putida KT2440
ucaaagaaccugggac

SEQ ID NO: 1633292 - RNA, 23 nt, Pseudomonas putida KT2440
uauuuguacgggugcuccaccaa

SEQ ID NO: 1633293 - RNA, 19 nt, Pseudomonas putida KT2440
uauuugugaaacaccacac

SEQ ID NO: 1633294 - RNA, 11 nt, Pseudomonas putida KT2440
uauuugaccag

SEQ ID NO: 1633295 - RNA, 16 nt, Pseudomonas putida KT2440
uauuucucuuccuggc

SEQ ID NO: 1633296 - RNA, 18 nt, Pseudomonas putida KT2440
uacaccccgaccaaggcc

SEQ ID NO: 1633297 - RNA, 22 nt, Pseudomonas putida KT2440
uacacgccuuaguucacccaca

SEQ ID NO: 1633298 - RNA, 17 nt, Pseudomonas putida KT2440
uacacgguaugcaggua

SEQ ID NO: 1633299 - RNA, 14 nt, Pseudomonas putida KT2440
uacacgggacaggc

SEQ ID NO: 1633300 - RNA, 22 nt, Pseudomonas putida KT2440
uacacuggcuuucccccagcca

SEQ ID NO: 1633301 - RNA, 19 nt, Pseudomonas putida KT2440
uacacaucggucggccccu

SEQ ID NO: 1633302 - RNA, 13 nt, Pseudomonas putida KT2440
uacacagcccaag

SEQ ID NO: 1633303 - RNA, 21 nt, Pseudomonas putida KT2440
uacacagcccaaggcuggcca

SEQ ID NO: 1633304 - RNA, 23 nt, Pseudomonas putida KT2440
uacacagcccaaggcuggccaga

SEQ ID NO: 1633305 - RNA, 23 nt, Pseudomonas putida KT2440
uacaggcgcgugugcagguggau

SEQ ID NO: 1633306 - RNA, 14 nt, Pseudomonas putida KT2440
uacaggaccaggcc

SEQ ID NO: 1633307 - RNA, 17 nt, Pseudomonas putida KT2440
uacagcucacuggccaa

SEQ ID NO: 1633308 - RNA, 22 nt, Pseudomonas putida KT2440
uacagcucccgcgcaugcugcc

SEQ ID NO: 1633309 - RNA, 23 nt, Pseudomonas putida KT2440
uacagcucccgcgcaugcugcca

SEQ ID NO: 1633310 - RNA, 16 nt, Pseudomonas putida KT2440
uacagcuugccagcgu

SEQ ID NO: 1633311 - RNA, 17 nt, Pseudomonas putida KT2440
uacagcuugcccaucac

SEQ ID NO: 1633312 - RNA, 21 nt, Pseudomonas putida KT2440
uacagaugucuggcaucaaug

SEQ ID NO: 1633313 - RNA, 13 nt, Pseudomonas putida KT2440
uacagcgccucca

SEQ ID NO: 1633314 - RNA, 22 nt, Pseudomonas putida KT2440
uacagcgccuccagcaggggca

SEQ ID NO: 1633315 - RNA, 16 nt, Pseudomonas putida KT2440
uacagccagaaagcca

SEQ ID NO: 1633316 - RNA, 20 nt, Pseudomonas putida KT2440
uacagccccuuccccaggcc

SEQ ID NO: 1633317 - RNA, 22 nt, Pseudomonas putida KT2440
uacagccccuuccccaggccgc

SEQ ID NO: 1633318 - RNA, 23 nt, Pseudomonas putida KT2440
uacaugaucggguucuuccaagu

SEQ ID NO: 1633319 - RNA, 15 nt, Pseudomonas putida KT2440
uacauggaucgcauu

SEQ ID NO: 1633320 - RNA, 16 nt, Pseudomonas putida KT2440
uacaugcgaacgcagg

SEQ ID NO: 1633321 - RNA, 17 nt, Pseudomonas putida KT2440
uaccaaggcgguggagu

SEQ ID NO: 1633322 - RNA, 18 nt, Pseudomonas putida KT2440
uaauccucguccagcucg

SEQ ID NO: 1633323 - RNA, 19 nt, Pseudomonas putida KT2440
uaaucguucugcuugucca

SEQ ID NO: 1633324 - RNA, 16 nt, Pseudomonas putida KT2440
uaaucugccggcgccu

SEQ ID NO: 1633325 - RNA, 22 nt, Pseudomonas putida KT2440
uaaucugccggcgccuccagca

SEQ ID NO: 1633326 - RNA, 20 nt, Pseudomonas putida KT2440
uaaugaccuggaucgccagg

SEQ ID NO: 1633327 - RNA, 17 nt, Pseudomonas putida KT2440
uaauuggccggcaggcc

SEQ ID NO: 1633328 - RNA, 19 nt, Pseudomonas putida KT2440
uacuggucgcgugccgcca

SEQ ID NO: 1633329 - RNA, 16 nt, Pseudomonas putida KT2440
uacuuggccaucagcu

SEQ ID NO: 1633330 - RNA, 18 nt, Pseudomonas putida KT2440
uacuuggccaucagcugu

SEQ ID NO: 1633331 - RNA, 14 nt, Pseudomonas putida KT2440
uacuuauaagcagc

SEQ ID NO: 1633332 - RNA, 17 nt, Pseudomonas putida KT2440
uacuuggcaguaccugc

SEQ ID NO: 1633333 - RNA, 15 nt, Pseudomonas putida KT2440
uagaaaguccaucug

SEQ ID NO: 1633334 - RNA, 17 nt, Pseudomonas putida KT2440
uagaaaguccaucugcu

SEQ ID NO: 1633335 - RNA, 16 nt, Pseudomonas putida KT2440
uagaccuucuggcagc

SEQ ID NO: 1633336 - RNA, 22 nt, Pseudomonas putida KT2440
uagaccugcguugcccccagcc

SEQ ID NO: 1633337 - RNA, 20 nt, Pseudomonas putida KT2440
uagaccauuucgcgcagggu

SEQ ID NO: 1633338 - RNA, 19 nt, Pseudomonas putida KT2440
uagacaugaggcccucccc

SEQ ID NO: 1633339 - RNA, 15 nt, Pseudomonas putida KT2440
uagaacuggcgcagc

SEQ ID NO: 1633340 - RNA, 15 nt, Pseudomonas putida KT2440
uagaacuccaccagc

SEQ ID NO: 1633341 - RNA, 17 nt, Pseudomonas putida KT2440
uagaagcagaucaucau

SEQ ID NO: 1633342 - RNA, 20 nt, Pseudomonas putida KT2440
uagaacaagccccuccuaag

SEQ ID NO: 1633343 - RNA, 19 nt, Pseudomonas putida KT2440
uagaacaagucgcgcacca

SEQ ID NO: 1633344 - RNA, 12 nt, Pseudomonas putida KT2440
uagaacacccgc

SEQ ID NO: 1633345 - RNA, 18 nt, Pseudomonas putida KT2440
uagaacggcagcaggcca

SEQ ID NO: 1633346 - RNA, 21 nt, Pseudomonas putida KT2440
uagaauagccggccucagcag

SEQ ID NO: 1633347 - RNA, 20 nt, Pseudomonas putida KT2440
uacgcuuucggcgguuaaga

SEQ ID NO: 1633348 - RNA, 22 nt, Pseudomonas putida KT2440
uacgaagccaugucuucacgag

SEQ ID NO: 1633349 - RNA, 16 nt, Pseudomonas putida KT2440
uacgcuggccaaggcc

SEQ ID NO: 1633350 - RNA, 16 nt, Pseudomonas putida KT2440
uacgcugggcgugcca

SEQ ID NO: 1633351 - RNA, 21 nt, Pseudomonas putida KT2440
uacgcugggcgugccaggcuu

SEQ ID NO: 1633352 - RNA, 18 nt, Pseudomonas putida KT2440
uacgcuucgaacacccgc

SEQ ID NO: 1633353 - RNA, 13 nt, Pseudomonas putida KT2440
uacucccacagcg

SEQ ID NO: 1633354 - RNA, 21 nt, Pseudomonas putida KT2440
uacucccacagcggccccauc

SEQ ID NO: 1633355 - RNA, 24 nt, Pseudomonas putida KT2440
uacucagcggcuggcccuguacau

SEQ ID NO: 1633356 - RNA, 21 nt, Pseudomonas putida KT2440
uaccuucuggcuggagccguc

SEQ ID NO: 1633357 - RNA, 16 nt, Pseudomonas putida KT2440
uaccucccgcacauuu

SEQ ID NO: 1633358 - RNA, 22 nt, Pseudomonas putida KT2440
uaccucaagguaggggcagcca

SEQ ID NO: 1633359 - RNA, 15 nt, Pseudomonas putida KT2440
uaccucgcucaggcc

SEQ ID NO: 1633360 - RNA, 20 nt, Pseudomonas putida KT2440
uaccugacuugccugucaug

SEQ ID NO: 1633361 - RNA, 16 nt, Pseudomonas putida KT2440
uaccugcacacugccc

SEQ ID NO: 1633362 - RNA, 19 nt, Pseudomonas putida KT2440
uaccugagccugcagggcc

SEQ ID NO: 1633363 - RNA, 16 nt, Pseudomonas putida KT2440
uaccugcuccugauag

SEQ ID NO: 1633364 - RNA, 22 nt, Pseudomonas putida KT2440
uaccugcuuaucggcugaccug

SEQ ID NO: 1633365 - RNA, 18 nt, Pseudomonas putida KT2440
uaccuggaauaccaccuc

SEQ ID NO: 1633366 - RNA, 19 nt, Pseudomonas putida KT2440
uaccuguggggcaacugcg

SEQ ID NO: 1633367 - RNA, 21 nt, Pseudomonas putida KT2440
uaccggccgcucaccggccag

SEQ ID NO: 1633368 - RNA, 22 nt, Pseudomonas putida KT2440
uaccggcucccccuccacccgg

SEQ ID NO: 1633369 - RNA, 15 nt, Pseudomonas putida KT2440
uaccacguuauccag

SEQ ID NO: 1633370 - RNA, 18 nt, Pseudomonas putida KT2440
uaccgcgccuccagcugg

SEQ ID NO: 1633371 - RNA, 21 nt, Pseudomonas putida KT2440
uaccgcgccuccagcuggcca

SEQ ID NO: 1633372 - RNA, 17 nt, Pseudomonas putida KT2440
uaccgccguccaccauc

SEQ ID NO: 1633373 - RNA, 20 nt, Pseudomonas putida KT2440
uaccgccguccaccaucucc

SEQ ID NO: 1633374 - RNA, 20 nt, Pseudomonas putida KT2440
uaccaccugggcgcuuugca

SEQ ID NO: 1633375 - RNA, 13 nt, Pseudomonas putida KT2440
uagaucacaccgg

SEQ ID NO: 1633376 - RNA, 23 nt, Pseudomonas putida KT2440
uagaucacaccggccgccaggau

SEQ ID NO: 1633377 - RNA, 15 nt, Pseudomonas putida KT2440
uagauaucggccgug

SEQ ID NO: 1633378 - RNA, 12 nt, Pseudomonas putida KT2440
uagaucaucagc

SEQ ID NO: 1633379 - RNA, 15 nt, Pseudomonas putida KT2440
uagaucagcgaugcc

SEQ ID NO: 1633380 - RNA, 13 nt, Pseudomonas putida KT2440
uagaucugcucuu

SEQ ID NO: 1633381 - RNA, 23 nt, Pseudomonas putida KT2440
uagcaccagcgggcccagcaggu

SEQ ID NO: 1633382 - RNA, 16 nt, Pseudomonas putida KT2440
uagcaauggcccugga

SEQ ID NO: 1633383 - RNA, 16 nt, Pseudomonas putida KT2440
uagauuucgaagggau

SEQ ID NO: 1633384 - RNA, 17 nt, Pseudomonas putida KT2440
uagcagcgcuaugccuu

SEQ ID NO: 1633385 - RNA, 14 nt, Pseudomonas putida KT2440
uagcaggaacacca

SEQ ID NO: 1633386 - RNA, 17 nt, Pseudomonas putida KT2440
uagcagcaucaccgcgu

SEQ ID NO: 1633387 - RNA, 17 nt, Pseudomonas putida KT2440
uagccaaucaucuugcc

SEQ ID NO: 1633388 - RNA, 21 nt, Pseudomonas putida KT2440
uaggagcggguucacccgcga

SEQ ID NO: 1633389 - RNA, 16 nt, Pseudomonas putida KT2440
uaggagcggguuuacc

SEQ ID NO: 1633390 - RNA, 21 nt, Pseudomonas putida KT2440
uaggagcggguuuacccgcga

SEQ ID NO: 1633391 - RNA, 13 nt, Pseudomonas putida KT2440
uaggacaccgccc

SEQ ID NO: 1633392 - RNA, 20 nt, Pseudomonas putida KT2440
uagcuuucaggcgcagcaca

SEQ ID NO: 1633393 - RNA, 14 nt, Pseudomonas putida KT2440
uagcugggcccgcc

SEQ ID NO: 1633394 - RNA, 21 nt, Pseudomonas putida KT2440
uagcucgcuuuccaaaccugc

SEQ ID NO: 1633395 - RNA, 21 nt, Pseudomonas putida KT2440
uagcucagucgguagagcaaa

SEQ ID NO: 1633396 - RNA, 17 nt, Pseudomonas putida KT2440
uagcuccaccagcggcu

SEQ ID NO: 1633397 - RNA, 15 nt, Pseudomonas putida KT2440
uagcucagcuggaua

SEQ ID NO: 1633398 - RNA, 17 nt, Pseudomonas putida KT2440
uagcgugcuuccaccuc

SEQ ID NO: 1633399 - RNA, 19 nt, Pseudomonas putida KT2440
uagcgucgaugcggccaca

SEQ ID NO: 1633400 - RNA, 22 nt, Pseudomonas putida KT2440
uagcgugaagcggccaccugcc

SEQ ID NO: 1633401 - RNA, 22 nt, Pseudomonas putida KT2440
uagccggugccgaagucaucca

SEQ ID NO: 1633402 - RNA, 18 nt, Pseudomonas putida KT2440
uagccacgcugccaggac

SEQ ID NO: 1633403 - RNA, 11 nt, Pseudomonas putida KT2440
uagccagcccg

SEQ ID NO: 1633404 - RNA, 12 nt, Pseudomonas putida KT2440
uagcccaccacc

SEQ ID NO: 1633405 - RNA, 16 nt, Pseudomonas putida KT2440
uagcccaccaggucau

SEQ ID NO: 1633406 - RNA, 15 nt, Pseudomonas putida KT2440
uagccauugcggcug

SEQ ID NO: 1633407 - RNA, 20 nt, Pseudomonas putida KT2440
uagccauugcggcugaaucc

SEQ ID NO: 1633408 - RNA, 17 nt, Pseudomonas putida KT2440
uagccccgcccagcagc

SEQ ID NO: 1633409 - RNA, 17 nt, Pseudomonas putida KT2440
uagccugcugacgcagg

SEQ ID NO: 1633410 - RNA, 22 nt, Pseudomonas putida KT2440
uagccugcugcuccccaaccac

SEQ ID NO: 1633411 - RNA, 13 nt, Pseudomonas putida KT2440
uagccuguggggc

SEQ ID NO: 1633412 - RNA, 16 nt, Pseudomonas putida KT2440
uagccugcacuggccu

SEQ ID NO: 1633413 - RNA, 19 nt, Pseudomonas putida KT2440
uagccugcacuggccucuu

SEQ ID NO: 1633414 - RNA, 21 nt, Pseudomonas putida KT2440
uagccugcaaacgccgcucga

SEQ ID NO: 1633415 - RNA, 20 nt, Pseudomonas putida KT2440
uagccuuccagcuccuucuu

SEQ ID NO: 1633416 - RNA, 16 nt, Pseudomonas putida KT2440
uagcgauugcggccua

SEQ ID NO: 1633417 - RNA, 19 nt, Pseudomonas putida KT2440
uagcgagcaccggcaguac

SEQ ID NO: 1633418 - RNA, 15 nt, Pseudomonas putida KT2440
uagcgcuuucuggua

SEQ ID NO: 1633419 - RNA, 15 nt, Pseudomonas putida KT2440
uagcgcuuuuccagu

SEQ ID NO: 1633420 - RNA, 22 nt, Pseudomonas putida KT2440
uagcgcuggcuuuggagccugc

SEQ ID NO: 1633421 - RNA, 19 nt, Pseudomonas putida KT2440
uagcgcucuuugccacuca

SEQ ID NO: 1633422 - RNA, 23 nt, Pseudomonas putida KT2440
uagcgcucgcgcaggguuuucag

SEQ ID NO: 1633423 - RNA, 16 nt, Pseudomonas putida KT2440
uagcggccaacgcugc

SEQ ID NO: 1633424 - RNA, 20 nt, Pseudomonas putida KT2440
uauagugguaugauuucagg

SEQ ID NO: 1633425 - RNA, 18 nt, Pseudomonas putida KT2440
uaucacgcuccugcaugc

SEQ ID NO: 1633426 - RNA, 19 nt, Pseudomonas putida KT2440
uauccagugcuucacugcc

SEQ ID NO: 1633427 - RNA, 15 nt, Pseudomonas putida KT2440
uauccacacccucgu

SEQ ID NO: 1633428 - RNA, 11 nt, Pseudomonas putida KT2440
uagucaagcug

SEQ ID NO: 1633429 - RNA, 15 nt, Pseudomonas putida KT2440
uaguucacuggccag

SEQ ID NO: 1633430 - RNA, 15 nt, Pseudomonas putida KT2440
uaguucaucuucuug

SEQ ID NO: 1633431 - RNA, 16 nt, Pseudomonas putida KT2440
uagggggccgcuuugc

SEQ ID NO: 1633432 - RNA, 17 nt, Pseudomonas putida KT2440
uagggggccgcuuugcg

SEQ ID NO: 1633433 - RNA, 17 nt, Pseudomonas putida KT2440
uagguccagcucugguc

SEQ ID NO: 1633434 - RNA, 16 nt, Pseudomonas putida KT2440
uaggucacuucagugc

SEQ ID NO: 1633435 - RNA, 14 nt, Pseudomonas putida KT2440
uaguacuccagcag

SEQ ID NO: 1633436 - RNA, 16 nt, Pseudomonas putida KT2440
uagguuuucggcugga

SEQ ID NO: 1633437 - RNA, 18 nt, Pseudomonas putida KT2440
uagguuuucggcuggagc

SEQ ID NO: 1633438 - RNA, 12 nt, Pseudomonas putida KT2440
uaguagcuccag

SEQ ID NO: 1633439 - RNA, 18 nt, Pseudomonas putida KT2440
uaguagcuccagcccagc

SEQ ID NO: 1633440 - RNA, 17 nt, Pseudomonas putida KT2440
uagggaacagggcagac

SEQ ID NO: 1633441 - RNA, 18 nt, Pseudomonas putida KT2440
uagggaucaccgccagca

SEQ ID NO: 1633442 - RNA, 23 nt, Pseudomonas putida KT2440
uagggaucaccgccagcagcugg

SEQ ID NO: 1633443 - RNA, 12 nt, Pseudomonas putida KT2440
uaggcugcagcc

SEQ ID NO: 1633444 - RNA, 14 nt, Pseudomonas putida KT2440
uaggcgucuuccac

SEQ ID NO: 1633445 - RNA, 20 nt, Pseudomonas putida KT2440
uaggcgucuuccacgcccag

SEQ ID NO: 1633446 - RNA, 22 nt, Pseudomonas putida KT2440
uaggcgucuuccacgcccaggc

SEQ ID NO: 1633447 - RNA, 18 nt, Pseudomonas putida KT2440
uaggcagcugccuuggca

SEQ ID NO: 1633448 - RNA, 19 nt, Pseudomonas putida KT2440
uaggccggucccaauaaua

SEQ ID NO: 1633449 - RNA, 12 nt, Pseudomonas putida KT2440
uaaccauguuga

SEQ ID NO: 1633450 - RNA, 12 nt, Pseudomonas putida KT2440
uaaccgcugcca

SEQ ID NO: 1633451 - RNA, 13 nt, Pseudomonas putida KT2440
uaaccucugcaug

SEQ ID NO: 1633452 - RNA, 21 nt, Pseudomonas putida KT2440
uaacgacccaaaaauggucgg

SEQ ID NO: 1633453 - RNA, 22 nt, Pseudomonas putida KT2440
uaaagaaaagccgcuggcccua

SEQ ID NO: 1633454 - RNA, 17 nt, Pseudomonas putida KT2440
uaaacccgcucccacaa

SEQ ID NO: 1633455 - RNA, 22 nt, Pseudomonas putida KT2440
uaaacccgcuccuacaagguac

SEQ ID NO: 1633456 - RNA, 19 nt, Pseudomonas putida KT2440
uaaacccgcuccuacaugg

SEQ ID NO: 1633457 - RNA, 14 nt, Pseudomonas putida KT2440
uaaaccugccaccc

SEQ ID NO: 1633458 - RNA, 13 nt, Pseudomonas putida KT2440
uaaaccuucaaca

SEQ ID NO: 1633459 - RNA, 19 nt, Pseudomonas putida KT2440
uaaacaauucccagccuuu

SEQ ID NO: 1633460 - RNA, 15 nt, Pseudomonas putida KT2440
uaaacacgaacauca

SEQ ID NO: 1633461 - RNA, 15 nt, Pseudomonas putida KT2440
uaaagagaagcugca

SEQ ID NO: 1633462 - RNA, 14 nt, Pseudomonas putida KT2440
uaaaggguuuucaa

SEQ ID NO: 1633463 - RNA, 22 nt, Pseudomonas putida KT2440
uaaagguaaucccggucaccuc

SEQ ID NO: 1633464 - RNA, 17 nt, Pseudomonas putida KT2440
uaaaggcgugccgucca

SEQ ID NO: 1633465 - RNA, 22 nt, Pseudomonas putida KT2440
uaaaagccaacugcucuaccaa

SEQ ID NO: 1633466 - RNA, 23 nt, Pseudomonas putida KT2440
uaaaagauguguugucugugccc

SEQ ID NO: 1633467 - RNA, 22 nt, Pseudomonas putida KT2440
uaaaaauauugcgaaaaucgua

SEQ ID NO: 1633468 - RNA, 18 nt, Pseudomonas putida KT2440
guuuuccuaaagcauuuc

SEQ ID NO: 1633469 - RNA, 22 nt, Pseudomonas putida KT2440
guuuuggucacccgugcugcuc

SEQ ID NO: 1633470 - RNA, 20 nt, Pseudomonas putida KT2440
guuuucauaccgagaaugaa

SEQ ID NO: 1633471 - RNA, 16 nt, Pseudomonas putida KT2440
guuuucaucugcccgc

SEQ ID NO: 1633472 - RNA, 18 nt, Pseudomonas putida KT2440
aaauccaggacaaaccag

SEQ ID NO: 1633473 - RNA, 14 nt, Pseudomonas putida KT2440
guuugcaagcggcg

SEQ ID NO: 1633474 - RNA, 14 nt, Pseudomonas putida KT2440
guuugcagcucacc

SEQ ID NO: 1633475 - RNA, 19 nt, Pseudomonas putida KT2440
guuugccgagguucuucca

SEQ ID NO: 1633476 - RNA, 17 nt, Pseudomonas putida KT2440
guuugaagcccggccgc

SEQ ID NO: 1633477 - RNA, 20 nt, Pseudomonas putida KT2440
guuugaagcuaaacgaguuu

SEQ ID NO: 1633478 - RNA, 22 nt, Pseudomonas putida KT2440
guuugggcggcgugaccagccc

SEQ ID NO: 1633479 - RNA, 14 nt, Pseudomonas putida KT2440
guuuggcagugcca

SEQ ID NO: 1633480 - RNA, 15 nt, Pseudomonas putida KT2440
guuuggcagugccau

SEQ ID NO: 1633481 - RNA, 21 nt, Pseudomonas putida KT2440
uaaaaacuggccagcagcccc

SEQ ID NO: 1633482 - RNA, 19 nt, Pseudomonas putida KT2440
guuguaguccaugaucucc

SEQ ID NO: 1633483 - RNA, 23 nt, Pseudomonas putida KT2440
guuguaguucuuggucagcauca

SEQ ID NO: 1633484 - RNA, 15 nt, Pseudomonas putida KT2440
guuggcucuguggau

SEQ ID NO: 1633485 - RNA, 21 nt, Pseudomonas putida KT2440
guuggccaaaccguccaggua

SEQ ID NO: 1633486 - RNA, 17 nt, Pseudomonas putida KT2440
guuggccagcaugacag

SEQ ID NO: 1633487 - RNA, 21 nt, Pseudomonas putida KT2440
guuggcauggaaggcguccuc

SEQ ID NO: 1633488 - RNA, 17 nt, Pseudomonas putida KT2440
guugggcgggccgccga

SEQ ID NO: 1633489 - RNA, 14 nt, Pseudomonas putida KT2440
guugggcagggugu

SEQ ID NO: 1633490 - RNA, 21 nt, Pseudomonas putida KT2440
guugccgccagccccgccaac

SEQ ID NO: 1633491 - RNA, 19 nt, Pseudomonas putida KT2440
guuggcacguugcugccug

SEQ ID NO: 1633492 - RNA, 14 nt, Pseudomonas putida KT2440
guuggcaaucugcu

SEQ ID NO: 1633493 - RNA, 22 nt, Pseudomonas putida KT2440
guuggcaaacucgucgcugguc

SEQ ID NO: 1633494 - RNA, 21 nt, Pseudomonas putida KT2440
guugccauugaggcuguggcc

SEQ ID NO: 1633495 - RNA, 18 nt, Pseudomonas putida KT2440
guuuagaucgcuaucuga

SEQ ID NO: 1633496 - RNA, 22 nt, Pseudomonas putida KT2440
guuguucggcaggcucugcucc

SEQ ID NO: 1633497 - RNA, 20 nt, Pseudomonas putida KT2440
guuguucgucgagcaccacg

SEQ ID NO: 1633498 - RNA, 16 nt, Pseudomonas putida KT2440
guugugcuggcccuuu

SEQ ID NO: 1633499 - RNA, 23 nt, Pseudomonas putida KT2440
guuguggcuggcgucgaugauca

SEQ ID NO: 1633500 - RNA, 12 nt, Pseudomonas putida KT2440
guuuaaaccuuc

SEQ ID NO: 1633501 - RNA, 17 nt, Pseudomonas putida KT2440
guuguuguuccaucaug

SEQ ID NO: 1633502 - RNA, 22 nt, Pseudomonas putida KT2440
guugaccacgaugcccauggcg

SEQ ID NO: 1633503 - RNA, 22 nt, Pseudomonas putida KT2440
guugaccccgggcacaugcagg

SEQ ID NO: 1633504 - RNA, 23 nt, Pseudomonas putida KT2440
guugaccgccgccaccaucgacu

SEQ ID NO: 1633505 - RNA, 15 nt, Pseudomonas putida KT2440
guugaccugcugggu

SEQ ID NO: 1633506 - RNA, 12 nt, Pseudomonas putida KT2440
guugaacagcag

SEQ ID NO: 1633507 - RNA, 14 nt, Pseudomonas putida KT2440
guugaacagcagcg

SEQ ID NO: 1633508 - RNA, 12 nt, Pseudomonas putida KT2440
guugacagcgcu

SEQ ID NO: 1633509 - RNA, 19 nt, Pseudomonas putida KT2440
guugaugcgcuugaaguga

SEQ ID NO: 1633510 - RNA, 22 nt, Pseudomonas putida KT2440
guugagcacacgguaguccugc

SEQ ID NO: 1633511 - RNA, 23 nt, Pseudomonas putida KT2440
guugauccggcacuccagcgagu

SEQ ID NO: 1633512 - RNA, 14 nt, Pseudomonas putida KT2440
guugaucagcgaca

SEQ ID NO: 1633513 - RNA, 14 nt, Pseudomonas putida KT2440
guugagcagcagcc

SEQ ID NO: 1633514 - RNA, 21 nt, Pseudomonas putida KT2440
guucuuccaaguuggcucugu

SEQ ID NO: 1633515 - RNA, 16 nt, Pseudomonas putida KT2440
guucuucaacuccugc

SEQ ID NO: 1633516 - RNA, 19 nt, Pseudomonas putida KT2440
guucuucuuuaagccccug

SEQ ID NO: 1633517 - RNA, 15 nt, Pseudomonas putida KT2440
guucuugccuguccc

SEQ ID NO: 1633518 - RNA, 16 nt, Pseudomonas putida KT2440
guugaaaaccucccag

SEQ ID NO: 1633519 - RNA, 12 nt, Pseudomonas putida KT2440
guucugcccggc

SEQ ID NO: 1633520 - RNA, 23 nt, Pseudomonas putida KT2440
guucugcagucagguugcacagc

SEQ ID NO: 1633521 - RNA, 16 nt, Pseudomonas putida KT2440
guucgucgagcaucug

SEQ ID NO: 1633522 - RNA, 14 nt, Pseudomonas putida KT2440
guucugccggggca

SEQ ID NO: 1633523 - RNA, 15 nt, Pseudomonas putida KT2440
guucuguuucaccag

SEQ ID NO: 1633524 - RNA, 15 nt, Pseudomonas putida KT2440
guucugguacaucac

SEQ ID NO: 1633525 - RNA, 22 nt, Pseudomonas putida KT2440
guucuggcugccuucgcucagg

SEQ ID NO: 1633526 - RNA, 19 nt, Pseudomonas putida KT2440
guucacagccggcaaauca

SEQ ID NO: 1633527 - RNA, 16 nt, Pseudomonas putida KT2440
guucaaugccagcagu

SEQ ID NO: 1633528 - RNA, 12 nt, Pseudomonas putida KT2440
guucacuguugc

SEQ ID NO: 1633529 - RNA, 15 nt, Pseudomonas putida KT2440
guucaacacuguccc

SEQ ID NO: 1633530 - RNA, 17 nt, Pseudomonas putida KT2440
guucaagggcaggguga

SEQ ID NO: 1633531 - RNA, 20 nt, Pseudomonas putida KT2440
guucagguaggccgcagcca

SEQ ID NO: 1633532 - RNA, 11 nt, Pseudomonas putida KT2440
guucagcagcg

SEQ ID NO: 1633533 - RNA, 23 nt, Pseudomonas putida KT2440
guucauuaccauccaucaccaug

SEQ ID NO: 1633534 - RNA, 15 nt, Pseudomonas putida KT2440
guuccagcagcgaca

SEQ ID NO: 1633535 - RNA, 17 nt, Pseudomonas putida KT2440
guuccagccaggcgucg

SEQ ID NO: 1633536 - RNA, 19 nt, Pseudomonas putida KT2440
guuccagccgcgccacucc

SEQ ID NO: 1633537 - RNA, 21 nt, Pseudomonas putida KT2440
guuccagccgcgccacuccca

SEQ ID NO: 1633538 - RNA, 23 nt, Pseudomonas putida KT2440
guuccagccguccucgacccagu

SEQ ID NO: 1633539 - RNA, 12 nt, Pseudomonas putida KT2440
guuccaggccac

SEQ ID NO: 1633540 - RNA, 21 nt, Pseudomonas putida KT2440
guucccccaccggccgccgcc

SEQ ID NO: 1633541 - RNA, 14 nt, Pseudomonas putida KT2440
guucccaggcagcc

SEQ ID NO: 1633542 - RNA, 21 nt, Pseudomonas putida KT2440
guuccccgaccaaaugaguga

SEQ ID NO: 1633543 - RNA, 17 nt, Pseudomonas putida KT2440
guuccucaagcggccuc

SEQ ID NO: 1633544 - RNA, 14 nt, Pseudomonas putida KT2440
guucgguguccuug

SEQ ID NO: 1633545 - RNA, 15 nt, Pseudomonas putida KT2440
guucgguguccuugc

SEQ ID NO: 1633546 - RNA, 17 nt, Pseudomonas putida KT2440
guucggugcucaggcuc

SEQ ID NO: 1633547 - RNA, 17 nt, Pseudomonas putida KT2440
guucggcaucugccggg

SEQ ID NO: 1633548 - RNA, 15 nt, Pseudomonas putida KT2440
guucggccagcacua

SEQ ID NO: 1633549 - RNA, 16 nt, Pseudomonas putida KT2440
guuccucgccauggcc

SEQ ID NO: 1633550 - RNA, 17 nt, Pseudomonas putida KT2440
guucgaccgacaugcca

SEQ ID NO: 1633551 - RNA, 14 nt, Pseudomonas putida KT2440
guucgacagugccc

SEQ ID NO: 1633552 - RNA, 17 nt, Pseudomonas putida KT2440
guucgaccaauggcugc

SEQ ID NO: 1633553 - RNA, 17 nt, Pseudomonas putida KT2440
guucgaccaccgcaggu

SEQ ID NO: 1633554 - RNA, 18 nt, Pseudomonas putida KT2440
guucgaaucgcucaugcc

SEQ ID NO: 1633555 - RNA, 12 nt, Pseudomonas putida KT2440
guucgaguccag

SEQ ID NO: 1633556 - RNA, 15 nt, Pseudomonas putida KT2440
guucgaguccagguc

SEQ ID NO: 1633557 - RNA, 18 nt, Pseudomonas putida KT2440
guucgagcaucggcucgc

SEQ ID NO: 1633558 - RNA, 12 nt, Pseudomonas putida KT2440
guucgcgggcau

SEQ ID NO: 1633559 - RNA, 18 nt, Pseudomonas putida KT2440
gugucggcauacagcucc

SEQ ID NO: 1633560 - RNA, 23 nt, Pseudomonas putida KT2440
gugucggccagcugcgcacgcag

SEQ ID NO: 1633561 - RNA, 18 nt, Pseudomonas putida KT2440
guguuucgcccccggcgg

SEQ ID NO: 1633562 - RNA, 13 nt, Pseudomonas putida KT2440
guguuugaagcua

SEQ ID NO: 1633563 - RNA, 13 nt, Pseudomonas putida KT2440
guuacgccaggcg

SEQ ID NO: 1633564 - RNA, 16 nt, Pseudomonas putida KT2440
guuacgcaacuccacg

SEQ ID NO: 1633565 - RNA, 15 nt, Pseudomonas putida KT2440
guuacgcaccagcuc

SEQ ID NO: 1633566 - RNA, 17 nt, Pseudomonas putida KT2440
guuacgcaccagcucca

SEQ ID NO: 1633567 - RNA, 17 nt, Pseudomonas putida KT2440
guuacguaagucaggcc

SEQ ID NO: 1633568 - RNA, 18 nt, Pseudomonas putida KT2440
guuacggacccuaucggc

SEQ ID NO: 1633569 - RNA, 16 nt, Pseudomonas putida KT2440
guuagcucaguuggua

SEQ ID NO: 1633570 - RNA, 18 nt, Pseudomonas putida KT2440
guuaguucgugcacccca

SEQ ID NO: 1633571 - RNA, 17 nt, Pseudomonas putida KT2440
guuauccagcugcaaca

SEQ ID NO: 1633572 - RNA, 18 nt, Pseudomonas putida KT2440
guggcccugaccgcggug

SEQ ID NO: 1633573 - RNA, 13 nt, Pseudomonas putida KT2440
guggcccuggagc

SEQ ID NO: 1633574 - RNA, 19 nt, Pseudomonas putida KT2440
guggccgccaugaucugcc

SEQ ID NO: 1633575 - RNA, 15 nt, Pseudomonas putida KT2440
guggacaccauggcc

SEQ ID NO: 1633576 - RNA, 13 nt, Pseudomonas putida KT2440
guggacagcagcu

SEQ ID NO: 1633577 - RNA, 22 nt, Pseudomonas putida KT2440
guggcgccggauuucuuccaug

SEQ ID NO: 1633578 - RNA, 19 nt, Pseudomonas putida KT2440
guggcugaugccaucgaua

SEQ ID NO: 1633579 - RNA, 18 nt, Pseudomonas putida KT2440
guggcggccgcagcccca

SEQ ID NO: 1633580 - RNA, 17 nt, Pseudomonas putida KT2440
guggcuucguggugcug

SEQ ID NO: 1633581 - RNA, 23 nt, Pseudomonas putida KT2440
guggcuuucauaccccuccggcc

SEQ ID NO: 1633582 - RNA, 23 nt, Pseudomonas putida KT2440
guggugaucacggguaagccggc

SEQ ID NO: 1633583 - RNA, 17 nt, Pseudomonas putida KT2440
guggugcugguggccac

SEQ ID NO: 1633584 - RNA, 14 nt, Pseudomonas putida KT2440
guggugaccucgau

SEQ ID NO: 1633585 - RNA, 22 nt, Pseudomonas putida KT2440
guggucgaggcaaagaacagcg

SEQ ID NO: 1633586 - RNA, 17 nt, Pseudomonas putida KT2440
guggucauccaggcugg

SEQ ID NO: 1633587 - RNA, 23 nt, Pseudomonas putida KT2440
guggucauccaggcuggccagca

SEQ ID NO: 1633588 - RNA, 18 nt, Pseudomonas putida KT2440
gugguaucgcuuacagau

SEQ ID NO: 1633589 - RNA, 14 nt, Pseudomonas putida KT2440
gugucaacaggcug

SEQ ID NO: 1633590 - RNA, 16 nt, Pseudomonas putida KT2440
guguagguucacagaa

SEQ ID NO: 1633591 - RNA, 15 nt, Pseudomonas putida KT2440
gugcucaucggcggc

SEQ ID NO: 1633592 - RNA, 23 nt, Pseudomonas putida KT2440
gugcucacgccccuuggcacggc

SEQ ID NO: 1633593 - RNA, 15 nt, Pseudomonas putida KT2440
gugcuccagcuccag

SEQ ID NO: 1633594 - RNA, 14 nt, Pseudomonas putida KT2440
gugcucgaggaagc

SEQ ID NO: 1633595 - RNA, 21 nt, Pseudomonas putida KT2440
gugcucgaacucuuccagcuc

SEQ ID NO: 1633596 - RNA, 12 nt, Pseudomonas putida KT2440
gugcucugccgc

SEQ ID NO: 1633597 - RNA, 22 nt, Pseudomonas putida KT2440
gugcucugccgcaccaggucca

SEQ ID NO: 1633598 - RNA, 13 nt, Pseudomonas putida KT2440
gugcucguccagu

SEQ ID NO: 1633599 - RNA, 13 nt, Pseudomonas putida KT2440
gugcucggccugg

SEQ ID NO: 1633600 - RNA, 13 nt, Pseudomonas putida KT2440
gugcugcagaccc

SEQ ID NO: 1633601 - RNA, 15 nt, Pseudomonas putida KT2440
gugcugcaggcuggc

SEQ ID NO: 1633602 - RNA, 16 nt, Pseudomonas putida KT2440
gugcuucacugccggc

SEQ ID NO: 1633603 - RNA, 14 nt, Pseudomonas putida KT2440
gugcuugugguagu

SEQ ID NO: 1633604 - RNA, 18 nt, Pseudomonas putida KT2440
gugcgagaggcgcuuuuc

SEQ ID NO: 1633605 - RNA, 22 nt, Pseudomonas putida KT2440
gugcgcauuucacgcacggccu

SEQ ID NO: 1633606 - RNA, 22 nt, Pseudomonas putida KT2440
gugcgccucaugcagcaccucc

SEQ ID NO: 1633607 - RNA, 17 nt, Pseudomonas putida KT2440
gugcgccuccagcagcg

SEQ ID NO: 1633608 - RNA, 17 nt, Pseudomonas putida KT2440
gugcgccugcaaacgca

SEQ ID NO: 1633609 - RNA, 19 nt, Pseudomonas putida KT2440
gugcgccggcuugccuuca

SEQ ID NO: 1633610 - RNA, 19 nt, Pseudomonas putida KT2440
gugcgcccggcaaacacau

SEQ ID NO: 1633611 - RNA, 13 nt, Pseudomonas putida KT2440
gugcgcgcaacag

SEQ ID NO: 1633612 - RNA, 18 nt, Pseudomonas putida KT2440
gugcgcucguaggcugca

SEQ ID NO: 1633613 - RNA, 21 nt, Pseudomonas putida KT2440
gugcguagccuucagcggccg

SEQ ID NO: 1633614 - RNA, 13 nt, Pseudomonas putida KT2440
gugcggcaucaug

SEQ ID NO: 1633615 - RNA, 17 nt, Pseudomonas putida KT2440
gugcggcagcucgccgu

SEQ ID NO: 1633616 - RNA, 20 nt, Pseudomonas putida KT2440
gugcggaucgccgccgaugc

SEQ ID NO: 1633617 - RNA, 22 nt, Pseudomonas putida KT2440
gugcggcccucgguggcucucc

SEQ ID NO: 1633618 - RNA, 14 nt, Pseudomonas putida KT2440
gugcggcggcacug

SEQ ID NO: 1633619 - RNA, 16 nt, Pseudomonas putida KT2440
gucuagccgccugccg

SEQ ID NO: 1633620 - RNA, 14 nt, Pseudomonas putida KT2440
gucuagagaucugc

SEQ ID NO: 1633621 - RNA, 16 nt, Pseudomonas putida KT2440
gugauggucaccuugu

SEQ ID NO: 1633622 - RNA, 17 nt, Pseudomonas putida KT2440
gugauggcgcauggccu

SEQ ID NO: 1633623 - RNA, 16 nt, Pseudomonas putida KT2440
gugauguugcccggca

SEQ ID NO: 1633624 - RNA, 16 nt, Pseudomonas putida KT2440
gugaugaucagggaca

SEQ ID NO: 1633625 - RNA, 16 nt, Pseudomonas putida KT2440
gugcacccgugccugc

SEQ ID NO: 1633626 - RNA, 13 nt, Pseudomonas putida KT2440
gugcagcaccucc

SEQ ID NO: 1633627 - RNA, 16 nt, Pseudomonas putida KT2440
gugcagcaccuccacc

SEQ ID NO: 1633628 - RNA, 20 nt, Pseudomonas putida KT2440
gugcacgaacacguccagcc

SEQ ID NO: 1633629 - RNA, 21 nt, Pseudomonas putida KT2440
gugcaacugguucuccagguu

SEQ ID NO: 1633630 - RNA, 23 nt, Pseudomonas putida KT2440
gugcaccaacgccgauagccagc

SEQ ID NO: 1633631 - RNA, 21 nt, Pseudomonas putida KT2440
gugcacccaaccugccgaucu

SEQ ID NO: 1633632 - RNA, 18 nt, Pseudomonas putida KT2440
gugcacagccgugccuuc

SEQ ID NO: 1633633 - RNA, 24 nt, Pseudomonas putida KT2440
gugcaaaaccugccggugcgcggg

SEQ ID NO: 1633634 - RNA, 20 nt, Pseudomonas putida KT2440
gugcagguugauccagcccu

SEQ ID NO: 1633635 - RNA, 13 nt, Pseudomonas putida KT2440
gugcaggucagcg

SEQ ID NO: 1633636 - RNA, 15 nt, Pseudomonas putida KT2440
gugcaggucagcguu

SEQ ID NO: 1633637 - RNA, 16 nt, Pseudomonas putida KT2440
gugcauccaacgcugc

SEQ ID NO: 1633638 - RNA, 20 nt, Pseudomonas putida KT2440
gugcauguccugaagcaggg

SEQ ID NO: 1633639 - RNA, 23 nt, Pseudomonas putida KT2440
gugcauguccugaagcaggggcu

SEQ ID NO: 1633640 - RNA, 16 nt, Pseudomonas putida KT2440
gugcaugggccaggga

SEQ ID NO: 1633641 - RNA, 17 nt, Pseudomonas putida KT2440
gugcaucugcuccccca

SEQ ID NO: 1633642 - RNA, 14 nt, Pseudomonas putida KT2440
gugcaugcgccccc

SEQ ID NO: 1633643 - RNA, 13 nt, Pseudomonas putida KT2440
gugcccgccaggc

SEQ ID NO: 1633644 - RNA, 20 nt, Pseudomonas putida KT2440
gugcccgcgaagggcugccg

SEQ ID NO: 1633645 - RNA, 21 nt, Pseudomonas putida KT2440
gugcccgcgaagggcugccgc

SEQ ID NO: 1633646 - RNA, 18 nt, Pseudomonas putida KT2440
gugcccgcgaaggggccg

SEQ ID NO: 1633647 - RNA, 18 nt, Pseudomonas putida KT2440
gugcccgcgaguccucca

SEQ ID NO: 1633648 - RNA, 18 nt, Pseudomonas putida KT2440
gugcccggcaaucgccag

SEQ ID NO: 1633649 - RNA, 21 nt, Pseudomonas putida KT2440
gugcccggcaaucgccaggcg

SEQ ID NO: 1633650 - RNA, 20 nt, Pseudomonas putida KT2440
gugcccaugaucuugcugcc

SEQ ID NO: 1633651 - RNA, 12 nt, Pseudomonas putida KT2440
gugccccaaacg

SEQ ID NO: 1633652 - RNA, 14 nt, Pseudomonas putida KT2440
gugcccagaucacu

SEQ ID NO: 1633653 - RNA, 15 nt, Pseudomonas putida KT2440
gugcccacugcagcc

SEQ ID NO: 1633654 - RNA, 22 nt, Pseudomonas putida KT2440
gugccgaauugacccagucagc

SEQ ID NO: 1633655 - RNA, 20 nt, Pseudomonas putida KT2440
gugccgagugccaacaaucu

SEQ ID NO: 1633656 - RNA, 17 nt, Pseudomonas putida KT2440
gugcccugaucgccucc

SEQ ID NO: 1633657 - RNA, 16 nt, Pseudomonas putida KT2440
gugccgaagucaucca

SEQ ID NO: 1633658 - RNA, 20 nt, Pseudomonas putida KT2440
gugccgaagucauccauggc

SEQ ID NO: 1633659 - RNA, 21 nt, Pseudomonas putida KT2440
gugccgaagucauccauggca

SEQ ID NO: 1633660 - RNA, 13 nt, Pseudomonas putida KT2440
gugccauagcacc

SEQ ID NO: 1633661 - RNA, 16 nt, Pseudomonas putida KT2440
gugcccaccagugagg

SEQ ID NO: 1633662 - RNA, 12 nt, Pseudomonas putida KT2440
gugcccaccgca

SEQ ID NO: 1633663 - RNA, 17 nt, Pseudomonas putida KT2440
gugccaggcucaggccu

SEQ ID NO: 1633664 - RNA, 17 nt, Pseudomonas putida KT2440
gugccagcaacaagcug

SEQ ID NO: 1633665 - RNA, 14 nt, Pseudomonas putida KT2440
gugccagaaccagg

SEQ ID NO: 1633666 - RNA, 15 nt, Pseudomonas putida KT2440
gugccagaaccagga

SEQ ID NO: 1633667 - RNA, 13 nt, Pseudomonas putida KT2440
gugccagagaauu

SEQ ID NO: 1633668 - RNA, 18 nt, Pseudomonas putida KT2440
gugccagagaauuucucc

SEQ ID NO: 1633669 - RNA, 22 nt, Pseudomonas putida KT2440
gugccagagaauuucuccccag

SEQ ID NO: 1633670 - RNA, 18 nt, Pseudomonas putida KT2440
gugccggccagcggcaug

SEQ ID NO: 1633671 - RNA, 18 nt, Pseudomonas putida KT2440
gugccggguccaguuccu

SEQ ID NO: 1633672 - RNA, 21 nt, Pseudomonas putida KT2440
gugccguacauagcaggaucu

SEQ ID NO: 1633673 - RNA, 20 nt, Pseudomonas putida KT2440
gugccguccgcugccuucca

SEQ ID NO: 1633674 - RNA, 15 nt, Pseudomonas putida KT2440
gugccgucgagcagg

SEQ ID NO: 1633675 - RNA, 14 nt, Pseudomonas putida KT2440
gugccgccaguucg

SEQ ID NO: 1633676 - RNA, 15 nt, Pseudomonas putida KT2440
gugccgcaucagccg

SEQ ID NO: 1633677 - RNA, 18 nt, Pseudomonas putida KT2440
gugccgccugggucaggc

SEQ ID NO: 1633678 - RNA, 19 nt, Pseudomonas putida KT2440
gugccgccugggucaggcg

SEQ ID NO: 1633679 - RNA, 19 nt, Pseudomonas putida KT2440
gugccgcggauguggugga

SEQ ID NO: 1633680 - RNA, 16 nt, Pseudomonas putida KT2440
gugccucagccaggcu

SEQ ID NO: 1633681 - RNA, 13 nt, Pseudomonas putida KT2440
gugccucugcugc

SEQ ID NO: 1633682 - RNA, 15 nt, Pseudomonas putida KT2440
gugccucgcccaggu

SEQ ID NO: 1633683 - RNA, 13 nt, Pseudomonas putida KT2440
gugccugcagccc

SEQ ID NO: 1633684 - RNA, 16 nt, Pseudomonas putida KT2440
gugccugcagcccggc

SEQ ID NO: 1633685 - RNA, 17 nt, Pseudomonas putida KT2440
gugccugcagcccggca

SEQ ID NO: 1633686 - RNA, 19 nt, Pseudomonas putida KT2440
gugccuugccugggccggu

SEQ ID NO: 1633687 - RNA, 15 nt, Pseudomonas putida KT2440
gugcgaaguuggucc

SEQ ID NO: 1633688 - RNA, 17 nt, Pseudomonas putida KT2440
gugccuggcgugcuguu

SEQ ID NO: 1633689 - RNA, 13 nt, Pseudomonas putida KT2440
gugccuggguggu

SEQ ID NO: 1633690 - RNA, 16 nt, Pseudomonas putida KT2440
guccacgguucuggca

SEQ ID NO: 1633691 - RNA, 18 nt, Pseudomonas putida KT2440
guccacugcacccgugca

SEQ ID NO: 1633692 - RNA, 17 nt, Pseudomonas putida KT2440
guccacgcgcaggccac

SEQ ID NO: 1633693 - RNA, 15 nt, Pseudomonas putida KT2440
guccagcaacagcug

SEQ ID NO: 1633694 - RNA, 17 nt, Pseudomonas putida KT2440
guccagcaagggccugu

SEQ ID NO: 1633695 - RNA, 20 nt, Pseudomonas putida KT2440
guccagcacacugagcacca

SEQ ID NO: 1633696 - RNA, 13 nt, Pseudomonas putida KT2440
guccagacgccgc

SEQ ID NO: 1633697 - RNA, 16 nt, Pseudomonas putida KT2440
guccagacgccgcagu

SEQ ID NO: 1633698 - RNA, 18 nt, Pseudomonas putida KT2440
guccagacgccgcaguga

SEQ ID NO: 1633699 - RNA, 19 nt, Pseudomonas putida KT2440
guccagaaaauaugcuguu

SEQ ID NO: 1633700 - RNA, 14 nt, Pseudomonas putida KT2440
guccacgaaccugu

SEQ ID NO: 1633701 - RNA, 20 nt, Pseudomonas putida KT2440
gucauaguuguggcaacgau

SEQ ID NO: 1633702 - RNA, 22 nt, Pseudomonas putida KT2440
gucauaagccuuucaucgcuuu

SEQ ID NO: 1633703 - RNA, 20 nt, Pseudomonas putida KT2440
gucaugccauccucggccag

SEQ ID NO: 1633704 - RNA, 13 nt, Pseudomonas putida KT2440
gucaugcgguaca

SEQ ID NO: 1633705 - RNA, 16 nt, Pseudomonas putida KT2440
guccauugagcacuca

SEQ ID NO: 1633706 - RNA, 17 nt, Pseudomonas putida KT2440
guccagguccaggccag

SEQ ID NO: 1633707 - RNA, 16 nt, Pseudomonas putida KT2440
guccagguugagcaca

SEQ ID NO: 1633708 - RNA, 15 nt, Pseudomonas putida KT2440
guccagggcagguca

SEQ ID NO: 1633709 - RNA, 12 nt, Pseudomonas putida KT2440
guccaggcugcg

SEQ ID NO: 1633710 - RNA, 21 nt, Pseudomonas putida KT2440
guccagcagguuggacagcgc

SEQ ID NO: 1633711 - RNA, 13 nt, Pseudomonas putida KT2440
guccagccacaau

SEQ ID NO: 1633712 - RNA, 13 nt, Pseudomonas putida KT2440
guccccaccggca

SEQ ID NO: 1633713 - RNA, 17 nt, Pseudomonas putida KT2440
gucccuguaggcgcaac

SEQ ID NO: 1633714 - RNA, 21 nt, Pseudomonas putida KT2440
gucagcggcaguugccugccu

SEQ ID NO: 1633715 - RNA, 21 nt, Pseudomonas putida KT2440
gucagcgcugacucagcggcc

SEQ ID NO: 1633716 - RNA, 15 nt, Pseudomonas putida KT2440
gucagcggaccaggu

SEQ ID NO: 1633717 - RNA, 12 nt, Pseudomonas putida KT2440
gucagcaaccac

SEQ ID NO: 1633718 - RNA, 14 nt, Pseudomonas putida KT2440
gucagaaagaaugg

SEQ ID NO: 1633719 - RNA, 21 nt, Pseudomonas putida KT2440
gucagacgcggaacuggcuga

SEQ ID NO: 1633720 - RNA, 19 nt, Pseudomonas putida KT2440
gucagacuuucccacaugu

SEQ ID NO: 1633721 - RNA, 15 nt, Pseudomonas putida KT2440
gucagacuuuccuga

SEQ ID NO: 1633722 - RNA, 23 nt, Pseudomonas putida KT2440
gucagcugguucugcugcagcca

SEQ ID NO: 1633723 - RNA, 15 nt, Pseudomonas putida KT2440
gucaguucagccagg

SEQ ID NO: 1633724 - RNA, 16 nt, Pseudomonas putida KT2440
gucaguuccugaacca

SEQ ID NO: 1633725 - RNA, 18 nt, Pseudomonas putida KT2440
gucaguggucuucaaggc

SEQ ID NO: 1633726 - RNA, 16 nt, Pseudomonas putida KT2440
gucagugaugcuugcg

SEQ ID NO: 1633727 - RNA, 18 nt, Pseudomonas putida KT2440
gucaccauugcuccauau

SEQ ID NO: 1633728 - RNA, 13 nt, Pseudomonas putida KT2440
gucacccaccggc

SEQ ID NO: 1633729 - RNA, 17 nt, Pseudomonas putida KT2440
gucacccaccggcucca

SEQ ID NO: 1633730 - RNA, 19 nt, Pseudomonas putida KT2440
gucaccagcgucaccccuc

SEQ ID NO: 1633731 - RNA, 21 nt, Pseudomonas putida KT2440
gucaccaccggcuuccagcuu

SEQ ID NO: 1633732 - RNA, 12 nt, Pseudomonas putida KT2440
gucacuggcugc

SEQ ID NO: 1633733 - RNA, 14 nt, Pseudomonas putida KT2440
gucacuggcugcug

SEQ ID NO: 1633734 - RNA, 18 nt, Pseudomonas putida KT2440
gucacuggcugcugcggu

SEQ ID NO: 1633735 - RNA, 16 nt, Pseudomonas putida KT2440
gucaccugacacauag

SEQ ID NO: 1633736 - RNA, 20 nt, Pseudomonas putida KT2440
gucaccuuguccagcaggcc

SEQ ID NO: 1633737 - RNA, 17 nt, Pseudomonas putida KT2440
gucaccuugcuccacca

SEQ ID NO: 1633738 - RNA, 20 nt, Pseudomonas putida KT2440
gucacgacaggggcgcagag

SEQ ID NO: 1633739 - RNA, 22 nt, Pseudomonas putida KT2440
gucaagguugcucagggcggca

SEQ ID NO: 1633740 - RNA, 19 nt, Pseudomonas putida KT2440
gucaaccgaacccgcuggc

SEQ ID NO: 1633741 - RNA, 21 nt, Pseudomonas putida KT2440
gucaacggcaacgccagcaau

SEQ ID NO: 1633742 - RNA, 19 nt, Pseudomonas putida KT2440
gucacaccaucggccggcu

SEQ ID NO: 1633743 - RNA, 14 nt, Pseudomonas putida KT2440
gucgucagcuuccg

SEQ ID NO: 1633744 - RNA, 20 nt, Pseudomonas putida KT2440
gucgucagcuuccgcugccg

SEQ ID NO: 1633745 - RNA, 16 nt, Pseudomonas putida KT2440
gucguccugcccccaa

SEQ ID NO: 1633746 - RNA, 16 nt, Pseudomonas putida KT2440
gucuaaaagcuggcgc

SEQ ID NO: 1633747 - RNA, 13 nt, Pseudomonas putida KT2440
gucuacaaaacuu

SEQ ID NO: 1633748 - RNA, 15 nt, Pseudomonas putida KT2440
gucggcgcgcggcuc

SEQ ID NO: 1633749 - RNA, 17 nt, Pseudomonas putida KT2440
gucggggugcugcgcac

SEQ ID NO: 1633750 - RNA, 12 nt, Pseudomonas putida KT2440
gucggcgcugga

SEQ ID NO: 1633751 - RNA, 14 nt, Pseudomonas putida KT2440
gucgguagggauca

SEQ ID NO: 1633752 - RNA, 14 nt, Pseudomonas putida KT2440
gucguaggcgcggg

SEQ ID NO: 1633753 - RNA, 19 nt, Pseudomonas putida KT2440
gucgccacgccggucgggc

SEQ ID NO: 1633754 - RNA, 14 nt, Pseudomonas putida KT2440
gucgccacgcgggc

SEQ ID NO: 1633755 - RNA, 18 nt, Pseudomonas putida KT2440
gucgcgguucgacugccg

SEQ ID NO: 1633756 - RNA, 19 nt, Pseudomonas putida KT2440
gucgcgccccaagcgggcc

SEQ ID NO: 1633757 - RNA, 17 nt, Pseudomonas putida KT2440
gucggccgcauccaugc

SEQ ID NO: 1633758 - RNA, 11 nt, Pseudomonas putida KT2440
gucggccuggg

SEQ ID NO: 1633759 - RNA, 13 nt, Pseudomonas putida KT2440
gucggcccacugc

SEQ ID NO: 1633760 - RNA, 18 nt, Pseudomonas putida KT2440
gucggcaaccauggcuuc

SEQ ID NO: 1633761 - RNA, 21 nt, Pseudomonas putida KT2440
gucggaucgaaacauugacag

SEQ ID NO: 1633762 - RNA, 15 nt, Pseudomonas putida KT2440
gucgcgucgcccaga

SEQ ID NO: 1633763 - RNA, 22 nt, Pseudomonas putida KT2440
gucgcucaacuccauggccagg

SEQ ID NO: 1633764 - RNA, 19 nt, Pseudomonas putida KT2440
guccucgaaacgcaggcuc

SEQ ID NO: 1633765 - RNA, 18 nt, Pseudomonas putida KT2440
guccucgacgggcaggcg

SEQ ID NO: 1633766 - RNA, 19 nt, Pseudomonas putida KT2440
guccucgacgggcaggcgg

SEQ ID NO: 1633767 - RNA, 16 nt, Pseudomonas putida KT2440
guccgcgccagcggcc

SEQ ID NO: 1633768 - RNA, 18 nt, Pseudomonas putida KT2440
guccgccuugagguugcc

SEQ ID NO: 1633769 - RNA, 18 nt, Pseudomonas putida KT2440
guccuggucacggccacc

SEQ ID NO: 1633770 - RNA, 16 nt, Pseudomonas putida KT2440
gucgaacaggcugccg

SEQ ID NO: 1633771 - RNA, 14 nt, Pseudomonas putida KT2440
gucgaaccugcccg

SEQ ID NO: 1633772 - RNA, 22 nt, Pseudomonas putida KT2440
gucgaaccacaucggcgcgccc

SEQ ID NO: 1633773 - RNA, 23 nt, Pseudomonas putida KT2440
gucgaaguauuccagaaucugca

SEQ ID NO: 1633774 - RNA, 14 nt, Pseudomonas putida KT2440
gucgaggaugucgu

SEQ ID NO: 1633775 - RNA, 13 nt, Pseudomonas putida KT2440
gucgccaacccca

SEQ ID NO: 1633776 - RNA, 16 nt, Pseudomonas putida KT2440
gucgccaaccgccagc

SEQ ID NO: 1633777 - RNA, 17 nt, Pseudomonas putida KT2440
gucgauguccagcgagg

SEQ ID NO: 1633778 - RNA, 16 nt, Pseudomonas putida KT2440
gucgaugucgauccac

SEQ ID NO: 1633779 - RNA, 20 nt, Pseudomonas putida KT2440
gucgaugucguggucgccgu

SEQ ID NO: 1633780 - RNA, 16 nt, Pseudomonas putida KT2440
gucgaugaucgccgcc

SEQ ID NO: 1633781 - RNA, 13 nt, Pseudomonas putida KT2440
gucgaugcugcug

SEQ ID NO: 1633782 - RNA, 16 nt, Pseudomonas putida KT2440
gucgaucugcaggugg

SEQ ID NO: 1633783 - RNA, 17 nt, Pseudomonas putida KT2440
gucgaucuggaugaagu

SEQ ID NO: 1633784 - RNA, 18 nt, Pseudomonas putida KT2440
gucaaagaaccugggacu

SEQ ID NO: 1633785 - RNA, 22 nt, Pseudomonas putida KT2440
guauuugaccagcccgcugcag

SEQ ID NO: 1633786 - RNA, 16 nt, Pseudomonas putida KT2440
guauugccccggccag

SEQ ID NO: 1633787 - RNA, 15 nt, Pseudomonas putida KT2440
guauucacaccugcc

SEQ ID NO: 1633788 - RNA, 14 nt, Pseudomonas putida KT2440
guauucgagcuuga

SEQ ID NO: 1633789 - RNA, 14 nt, Pseudomonas putida KT2440
guauggcuucacgg

SEQ ID NO: 1633790 - RNA, 19 nt, Pseudomonas putida KT2440
guaugugcacauucuccag

SEQ ID NO: 1633791 - RNA, 15 nt, Pseudomonas putida KT2440
guauggcguugcuca

SEQ ID NO: 1633792 - RNA, 20 nt, Pseudomonas putida KT2440
guauccuccagcccugcucg

SEQ ID NO: 1633793 - RNA, 16 nt, Pseudomonas putida KT2440
guaucgccccggucag

SEQ ID NO: 1633794 - RNA, 18 nt, Pseudomonas putida KT2440
guaucgaucaggaaggca

SEQ ID NO: 1633795 - RNA, 14 nt, Pseudomonas putida KT2440
guaucguucuccag

SEQ ID NO: 1633796 - RNA, 14 nt, Pseudomonas putida KT2440
guaucugccagcac

SEQ ID NO: 1633797 - RNA, 21 nt, Pseudomonas putida KT2440
guauagugguaugauuucagg

SEQ ID NO: 1633798 - RNA, 20 nt, Pseudomonas putida KT2440
guauauaucucgggcuucca

SEQ ID NO: 1633799 - RNA, 14 nt, Pseudomonas putida KT2440
guauacccaucggu

SEQ ID NO: 1633800 - RNA, 14 nt, Pseudomonas putida KT2440
guauaaaggucuuu

SEQ ID NO: 1633801 - RNA, 15 nt, Pseudomonas putida KT2440
guauaacgcacgugg

SEQ ID NO: 1633802 - RNA, 22 nt, Pseudomonas putida KT2440
guagcugaccuuggacagggug

SEQ ID NO: 1633803 - RNA, 15 nt, Pseudomonas putida KT2440
guagcugggcccgcc

SEQ ID NO: 1633804 - RNA, 22 nt, Pseudomonas putida KT2440
guagcugggcccgcccagcugg

SEQ ID NO: 1633805 - RNA, 21 nt, Pseudomonas putida KT2440
guaggcacucggucggcuggc

SEQ ID NO: 1633806 - RNA, 15 nt, Pseudomonas putida KT2440
guagcggggccgcuu

SEQ ID NO: 1633807 - RNA, 15 nt, Pseudomonas putida KT2440
guagcgguggcguug

SEQ ID NO: 1633808 - RNA, 21 nt, Pseudomonas putida KT2440
guagcgguggcguugccuucg

SEQ ID NO: 1633809 - RNA, 21 nt, Pseudomonas putida KT2440
guagcgcccacaaguccgaac

SEQ ID NO: 1633810 - RNA, 16 nt, Pseudomonas putida KT2440
guagcccgggcagccg

SEQ ID NO: 1633811 - RNA, 23 nt, Pseudomonas putida KT2440
guagccgucuuugagggucagcu

SEQ ID NO: 1633812 - RNA, 19 nt, Pseudomonas putida KT2440
guagccgugcggccaaagc

SEQ ID NO: 1633813 - RNA, 13 nt, Pseudomonas putida KT2440
guagccguggcug

SEQ ID NO: 1633814 - RNA, 20 nt, Pseudomonas putida KT2440
guagccuucuucggucagcu

SEQ ID NO: 1633815 - RNA, 17 nt, Pseudomonas putida KT2440
guagccguuugaagcca

SEQ ID NO: 1633816 - RNA, 17 nt, Pseudomonas putida KT2440
guaggccuugaccagcu

SEQ ID NO: 1633817 - RNA, 16 nt, Pseudomonas putida KT2440
guaggcccagcccagc

SEQ ID NO: 1633818 - RNA, 13 nt, Pseudomonas putida KT2440
guaggccgcagcc

SEQ ID NO: 1633819 - RNA, 14 nt, Pseudomonas putida KT2440
guaggccgcagcca

SEQ ID NO: 1633820 - RNA, 20 nt, Pseudomonas putida KT2440
guaggcgggagagcagggcu

SEQ ID NO: 1633821 - RNA, 13 nt, Pseudomonas putida KT2440
guaggcuucacgc

SEQ ID NO: 1633822 - RNA, 20 nt, Pseudomonas putida KT2440
guaggucaccaucagccgcg

SEQ ID NO: 1633823 - RNA, 20 nt, Pseudomonas putida KT2440
guagguuuucggcuggagcu

SEQ ID NO: 1633824 - RNA, 18 nt, Pseudomonas putida KT2440
guagguuauuggccaggu

SEQ ID NO: 1633825 - RNA, 20 nt, Pseudomonas putida KT2440
guaguccccaucacgcagcg

SEQ ID NO: 1633826 - RNA, 16 nt, Pseudomonas putida KT2440
guagucgauccaggug

SEQ ID NO: 1633827 - RNA, 15 nt, Pseudomonas putida KT2440
guagucgcucaggcg

SEQ ID NO: 1633828 - RNA, 20 nt, Pseudomonas putida KT2440
guacuugcugcagggcacgc

SEQ ID NO: 1633829 - RNA, 16 nt, Pseudomonas putida KT2440
guacuugugugccugc

SEQ ID NO: 1633830 - RNA, 15 nt, Pseudomonas putida KT2440
guacuucggaucgau

SEQ ID NO: 1633831 - RNA, 17 nt, Pseudomonas putida KT2440
guacuuauaagcagcaa

SEQ ID NO: 1633832 - RNA, 14 nt, Pseudomonas putida KT2440
guagaacaggccug

SEQ ID NO: 1633833 - RNA, 17 nt, Pseudomonas putida KT2440
guacuuuuucagguuua

SEQ ID NO: 1633834 - RNA, 15 nt, Pseudomonas putida KT2440
guacggguggcucug

SEQ ID NO: 1633835 - RNA, 16 nt, Pseudomonas putida KT2440
guacuccagcagcgca

SEQ ID NO: 1633836 - RNA, 17 nt, Pseudomonas putida KT2440
guacucaggggcauugc

SEQ ID NO: 1633837 - RNA, 14 nt, Pseudomonas putida KT2440
guacuccaccacca

SEQ ID NO: 1633838 - RNA, 13 nt, Pseudomonas putida KT2440
guacuccacuucc

SEQ ID NO: 1633839 - RNA, 14 nt, Pseudomonas putida KT2440
guacuccacuucca

SEQ ID NO: 1633840 - RNA, 22 nt, Pseudomonas putida KT2440
guacucucgucgaggcugucga

SEQ ID NO: 1633841 - RNA, 14 nt, Pseudomonas putida KT2440
guacucggccgggc

SEQ ID NO: 1633842 - RNA, 14 nt, Pseudomonas putida KT2440
guacucgaccacug

SEQ ID NO: 1633843 - RNA, 23 nt, Pseudomonas putida KT2440
guacucgaggucggagaucgagu

SEQ ID NO: 1633844 - RNA, 16 nt, Pseudomonas putida KT2440
guacugaucccuaccc

SEQ ID NO: 1633845 - RNA, 22 nt, Pseudomonas putida KT2440
guacuggucgcgugccgccagu

SEQ ID NO: 1633846 - RNA, 11 nt, Pseudomonas putida KT2440
guacuggcuga

SEQ ID NO: 1633847 - RNA, 11 nt, Pseudomonas putida KT2440
guacuggcugc

SEQ ID NO: 1633848 - RNA, 19 nt, Pseudomonas putida KT2440
guacuggcuucgaugaagg

SEQ ID NO: 1633849 - RNA, 13 nt, Pseudomonas putida KT2440
guacugcggcuga

SEQ ID NO: 1633850 - RNA, 19 nt, Pseudomonas putida KT2440
guacugcgucuuguaguuc

SEQ ID NO: 1633851 - RNA, 16 nt, Pseudomonas putida KT2440
guaaacguggucagcc

SEQ ID NO: 1633852 - RNA, 17 nt, Pseudomonas putida KT2440
guaaagaaaagccgcug

SEQ ID NO: 1633853 - RNA, 14 nt, Pseudomonas putida KT2440
guaaagccagcagc

SEQ ID NO: 1633854 - RNA, 15 nt, Pseudomonas putida KT2440
guaaagccagcagcc

SEQ ID NO: 1633855 - RNA, 18 nt, Pseudomonas putida KT2440
guaacagggaaacaaauc

SEQ ID NO: 1633856 - RNA, 13 nt, Pseudomonas putida KT2440
guaauacgcugug

SEQ ID NO: 1633857 - RNA, 18 nt, Pseudomonas putida KT2440
guaagccaugcgcaggca

SEQ ID NO: 1633858 - RNA, 13 nt, Pseudomonas putida KT2440
guaagguaguaaa

SEQ ID NO: 1633859 - RNA, 19 nt, Pseudomonas putida KT2440
guaagucggcucuucuuuc

SEQ ID NO: 1633860 - RNA, 16 nt, Pseudomonas putida KT2440
guaaguugaaugaaaa

SEQ ID NO: 1633861 - RNA, 18 nt, Pseudomonas putida KT2440
guaacguggacagcagcu

SEQ ID NO: 1633862 - RNA, 23 nt, Pseudomonas putida KT2440
guaacggcucugacauaacaaga

SEQ ID NO: 1633863 - RNA, 23 nt, Pseudomonas putida KT2440
guaacgggcaaaguccaucgguu

SEQ ID NO: 1633864 - RNA, 15 nt, Pseudomonas putida KT2440
guaacgggcaaggcu

SEQ ID NO: 1633865 - RNA, 17 nt, Pseudomonas putida KT2440
guaacgggccagccgcg

SEQ ID NO: 1633866 - RNA, 11 nt, Pseudomonas putida KT2440
guaacccugcu

SEQ ID NO: 1633867 - RNA, 17 nt, Pseudomonas putida KT2440
guacacagcccaaggcu

SEQ ID NO: 1633868 - RNA, 20 nt, Pseudomonas putida KT2440
guacaccccgaccaaggcca

SEQ ID NO: 1633869 - RNA, 15 nt, Pseudomonas putida KT2440
guacaagcuggcacg

SEQ ID NO: 1633870 - RNA, 22 nt, Pseudomonas putida KT2440
guaaugaccuggaucgccaggc

SEQ ID NO: 1633871 - RNA, 23 nt, Pseudomonas putida KT2440
guaaucugccggcgccuccagca

SEQ ID NO: 1633872 - RNA, 15 nt, Pseudomonas putida KT2440
guaaugcagccggcc

SEQ ID NO: 1633873 - RNA, 20 nt, Pseudomonas putida KT2440
guaauggccuacgcacuggg

SEQ ID NO: 1633874 - RNA, 20 nt, Pseudomonas putida KT2440
guaauggcgcuggaucuugc

SEQ ID NO: 1633875 - RNA, 17 nt, Pseudomonas putida KT2440
guaaucagcuugaacac

SEQ ID NO: 1633876 - RNA, 22 nt, Pseudomonas putida KT2440
guaaucgaugaaauucaccugc

SEQ ID NO: 1633877 - RNA, 17 nt, Pseudomonas putida KT2440
guaauccaucaccacaa

SEQ ID NO: 1633878 - RNA, 17 nt, Pseudomonas putida KT2440
guaauccggcaacuggc

SEQ ID NO: 1633879 - RNA, 15 nt, Pseudomonas putida KT2440
guacaggcugccgcc

SEQ ID NO: 1633880 - RNA, 19 nt, Pseudomonas putida KT2440
guacaguggcacuggcgcg

SEQ ID NO: 1633881 - RNA, 14 nt, Pseudomonas putida KT2440
guacauagcaggau

SEQ ID NO: 1633882 - RNA, 19 nt, Pseudomonas putida KT2440
guacauagcaggaucuagc

SEQ ID NO: 1633883 - RNA, 19 nt, Pseudomonas putida KT2440
guacauagaacagcaucaa

SEQ ID NO: 1633884 - RNA, 18 nt, Pseudomonas putida KT2440
guacagcgugcgcucagg

SEQ ID NO: 1633885 - RNA, 18 nt, Pseudomonas putida KT2440
guacagcucacuggccaa

SEQ ID NO: 1633886 - RNA, 13 nt, Pseudomonas putida KT2440
guacagcugcuca

SEQ ID NO: 1633887 - RNA, 11 nt, Pseudomonas putida KT2440
guacagcagcu

SEQ ID NO: 1633888 - RNA, 13 nt, Pseudomonas putida KT2440
guacagcagcuca

SEQ ID NO: 1633889 - RNA, 20 nt, Pseudomonas putida KT2440
guaccaggccuuucugcucg

SEQ ID NO: 1633890 - RNA, 16 nt, Pseudomonas putida KT2440
guaccaggcugccacg

SEQ ID NO: 1633891 - RNA, 19 nt, Pseudomonas putida KT2440
guaccaggcugccacggcg

SEQ ID NO: 1633892 - RNA, 16 nt, Pseudomonas putida KT2440
guaccaggucgccagc

SEQ ID NO: 1633893 - RNA, 11 nt, Pseudomonas putida KT2440
guaccagcagg

SEQ ID NO: 1633894 - RNA, 21 nt, Pseudomonas putida KT2440
guaccacgcuagucaagcugc

SEQ ID NO: 1633895 - RNA, 14 nt, Pseudomonas putida KT2440
guaccagcagcaca

SEQ ID NO: 1633896 - RNA, 14 nt, Pseudomonas putida KT2440
guaccagaaccccg

SEQ ID NO: 1633897 - RNA, 19 nt, Pseudomonas putida KT2440
guaccacuuccaacacccg

SEQ ID NO: 1633898 - RNA, 19 nt, Pseudomonas putida KT2440
guaccugcacacugcccag

SEQ ID NO: 1633899 - RNA, 15 nt, Pseudomonas putida KT2440
guaccgggcggccac

SEQ ID NO: 1633900 - RNA, 22 nt, Pseudomonas putida KT2440
guaccgccucgggggcaucauu

SEQ ID NO: 1633901 - RNA, 18 nt, Pseudomonas putida KT2440
guaccggucauggcgcgc

SEQ ID NO: 1633902 - RNA, 12 nt, Pseudomonas putida KT2440
guacccgcuggc

SEQ ID NO: 1633903 - RNA, 20 nt, Pseudomonas putida KT2440
guacccgcguuggcagcacc

SEQ ID NO: 1633904 - RNA, 13 nt, Pseudomonas putida KT2440
guacccagccccc

SEQ ID NO: 1633905 - RNA, 13 nt, Pseudomonas putida KT2440
guaccuguggggc

SEQ ID NO: 1633906 - RNA, 19 nt, Pseudomonas putida KT2440
guaccuucaagguuggggc

SEQ ID NO: 1633907 - RNA, 22 nt, Pseudomonas putida KT2440
guaccuuccauuucgaagcugu

SEQ ID NO: 1633908 - RNA, 14 nt, Pseudomonas putida KT2440
guaccuuucaugcc

SEQ ID NO: 1633909 - RNA, 21 nt, Pseudomonas putida KT2440
guacgaagccaugucuucacg

SEQ ID NO: 1633910 - RNA, 14 nt, Pseudomonas putida KT2440
guacgccagcagcg

SEQ ID NO: 1633911 - RNA, 22 nt, Pseudomonas putida KT2440
guacgccagcagcgcauggcuc

SEQ ID NO: 1633912 - RNA, 16 nt, Pseudomonas putida KT2440
guacgcaaucgcucag

SEQ ID NO: 1633913 - RNA, 14 nt, Pseudomonas putida KT2440
guacgcucuggucg

SEQ ID NO: 1633914 - RNA, 13 nt, Pseudomonas putida KT2440
guacggccuuggc

SEQ ID NO: 1633915 - RNA, 15 nt, Pseudomonas putida KT2440
guacggcgaauaauu

SEQ ID NO: 1633916 - RNA, 16 nt, Pseudomonas putida KT2440
guacggcagaacggcu

SEQ ID NO: 1633917 - RNA, 15 nt, Pseudomonas putida KT2440
guacggccagcaggu

SEQ ID NO: 1633918 - RNA, 20 nt, Pseudomonas putida KT2440
ggugccguacauagcaggau

SEQ ID NO: 1633919 - RNA, 19 nt, Pseudomonas putida KT2440
ggugccuaucgcucuggca

SEQ ID NO: 1633920 - RNA, 16 nt, Pseudomonas putida KT2440
ggugcucaggcucagc

SEQ ID NO: 1633921 - RNA, 12 nt, Pseudomonas putida KT2440
ggugcucagcca

SEQ ID NO: 1633922 - RNA, 15 nt, Pseudomonas putida KT2440
ggugcucagcggcac

SEQ ID NO: 1633923 - RNA, 14 nt, Pseudomonas putida KT2440
ggugcucugccgca

SEQ ID NO: 1633924 - RNA, 19 nt, Pseudomonas putida KT2440
ggugcugccgaggcgccga

SEQ ID NO: 1633925 - RNA, 17 nt, Pseudomonas putida KT2440
ggugcgccuccagcagc

SEQ ID NO: 1633926 - RNA, 20 nt, Pseudomonas putida KT2440
ggugcggcuuuagccgugaa

SEQ ID NO: 1633927 - RNA, 20 nt, Pseudomonas putida KT2440
ggugcggauaccgcuggccg

SEQ ID NO: 1633928 - RNA, 22 nt, Pseudomonas putida KT2440
gguggcucugcuugagcgcagc

SEQ ID NO: 1633929 - RNA, 19 nt, Pseudomonas putida KT2440
gguggcuucguggugcugg

SEQ ID NO: 1633930 - RNA, 12 nt, Pseudomonas putida KT2440
gguggggugcca

SEQ ID NO: 1633931 - RNA, 14 nt, Pseudomonas putida KT2440
gguggggugucugg

SEQ ID NO: 1633932 - RNA, 14 nt, Pseudomonas putida KT2440
gguggcggccagcg

SEQ ID NO: 1633933 - RNA, 13 nt, Pseudomonas putida KT2440
gguggcggcagca

SEQ ID NO: 1633934 - RNA, 21 nt, Pseudomonas putida KT2440
gguggcgauccacagcggguc

SEQ ID NO: 1633935 - RNA, 22 nt, Pseudomonas putida KT2440
gguggcgccuugauuaccagcg

SEQ ID NO: 1633936 - RNA, 23 nt, Pseudomonas putida KT2440
gguggcgcugaccaacaggcugg

SEQ ID NO: 1633937 - RNA, 23 nt, Pseudomonas putida KT2440
gguggauguugaugccacgggca

SEQ ID NO: 1633938 - RNA, 14 nt, Pseudomonas putida KT2440
gguggcaaugccau

SEQ ID NO: 1633939 - RNA, 16 nt, Pseudomonas putida KT2440
gguggcaaugcucgcc

SEQ ID NO: 1633940 - RNA, 19 nt, Pseudomonas putida KT2440
gguggcaauggccugcaug

SEQ ID NO: 1633941 - RNA, 15 nt, Pseudomonas putida KT2440
gguggaacaggaugg

SEQ ID NO: 1633942 - RNA, 15 nt, Pseudomonas putida KT2440
gguggaaauuggcca

SEQ ID NO: 1633943 - RNA, 18 nt, Pseudomonas putida KT2440
gguggaaauuggccagca

SEQ ID NO: 1633944 - RNA, 21 nt, Pseudomonas putida KT2440
gguggaaauuggccagcaggc

SEQ ID NO: 1633945 - RNA, 14 nt, Pseudomonas putida KT2440
ggcucagucccagu

SEQ ID NO: 1633946 - RNA, 17 nt, Pseudomonas putida KT2440
ggugaauggcgagcccg

SEQ ID NO: 1633947 - RNA, 18 nt, Pseudomonas putida KT2440
ggugaauggcgagcccgg

SEQ ID NO: 1633948 - RNA, 16 nt, Pseudomonas putida KT2440
ggugaccagcggcagc

SEQ ID NO: 1633949 - RNA, 16 nt, Pseudomonas putida KT2440
ggugaccaggcccagc

SEQ ID NO: 1633950 - RNA, 18 nt, Pseudomonas putida KT2440
ggugacgaccucggccag

SEQ ID NO: 1633951 - RNA, 15 nt, Pseudomonas putida KT2440
ggugagcaugccgau

SEQ ID NO: 1633952 - RNA, 20 nt, Pseudomonas putida KT2440
ggugacgggcccaaggugca

SEQ ID NO: 1633953 - RNA, 12 nt, Pseudomonas putida KT2440
ggugagcggcuu

SEQ ID NO: 1633954 - RNA, 17 nt, Pseudomonas putida KT2440
ggugcauccaacgcugc

SEQ ID NO: 1633955 - RNA, 23 nt, Pseudomonas putida KT2440
ggugcacggccguuggccagcau

SEQ ID NO: 1633956 - RNA, 16 nt, Pseudomonas putida KT2440
ggugcacgccagccag

SEQ ID NO: 1633957 - RNA, 22 nt, Pseudomonas putida KT2440
ggugcaugcaagcagccacccu

SEQ ID NO: 1633958 - RNA, 16 nt, Pseudomonas putida KT2440
ggugcauggcucgcag

SEQ ID NO: 1633959 - RNA, 21 nt, Pseudomonas putida KT2440
ggugcauucugccaugauccg

SEQ ID NO: 1633960 - RNA, 14 nt, Pseudomonas putida KT2440
ggugccaccgaugg

SEQ ID NO: 1633961 - RNA, 15 nt, Pseudomonas putida KT2440
ggugccaccgauggu

SEQ ID NO: 1633962 - RNA, 13 nt, Pseudomonas putida KT2440
ggugcccacugca

SEQ ID NO: 1633963 - RNA, 15 nt, Pseudomonas putida KT2440
ggugauaccgaggag

SEQ ID NO: 1633964 - RNA, 14 nt, Pseudomonas putida KT2440
ggugaucagcaaug

SEQ ID NO: 1633965 - RNA, 14 nt, Pseudomonas putida KT2440
ggugauuuccugca

SEQ ID NO: 1633966 - RNA, 16 nt, Pseudomonas putida KT2440
ggugcaaagcgcccgu

SEQ ID NO: 1633967 - RNA, 12 nt, Pseudomonas putida KT2440
ggugcaacugcc

SEQ ID NO: 1633968 - RNA, 22 nt, Pseudomonas putida KT2440
ggugcaacugccacgcccgcug

SEQ ID NO: 1633969 - RNA, 19 nt, Pseudomonas putida KT2440
ggugcaaggucaaacuccc

SEQ ID NO: 1633970 - RNA, 19 nt, Pseudomonas putida KT2440
ggugcacagggcggccaag

SEQ ID NO: 1633971 - RNA, 22 nt, Pseudomonas putida KT2440
ggugauugaaggcauugcggcc

SEQ ID NO: 1633972 - RNA, 17 nt, Pseudomonas putida KT2440
ggugauguugcccggca

SEQ ID NO: 1633973 - RNA, 21 nt, Pseudomonas putida KT2440
ggugaugcgcuugccagcgug

SEQ ID NO: 1633974 - RNA, 19 nt, Pseudomonas putida KT2440
gguuuauccggcacagaau

SEQ ID NO: 1633975 - RNA, 14 nt, Pseudomonas putida KT2440
gguuucacccuugg

SEQ ID NO: 1633976 - RNA, 16 nt, Pseudomonas putida KT2440
gguuuucagcgccgca

SEQ ID NO: 1633977 - RNA, 16 nt, Pseudomonas putida KT2440
gguuugcguugccugu

SEQ ID NO: 1633978 - RNA, 17 nt, Pseudomonas putida KT2440
gguuuggggugagcgaa

SEQ ID NO: 1633979 - RNA, 12 nt, Pseudomonas putida KT2440
gguuuggugguu

SEQ ID NO: 1633980 - RNA, 23 nt, Pseudomonas putida KT2440
guaaaaacuggccagcagccccc

SEQ ID NO: 1633981 - RNA, 14 nt, Pseudomonas putida KT2440
guaaaacagccuug

SEQ ID NO: 1633982 - RNA, 19 nt, Pseudomonas putida KT2440
gguuuuuucuauugcucag

SEQ ID NO: 1633983 - RNA, 18 nt, Pseudomonas putida KT2440
gguuuuuugccugaucag

SEQ ID NO: 1633984 - RNA, 18 nt, Pseudomonas putida KT2440
gguucuucgccugcagca

SEQ ID NO: 1633985 - RNA, 19 nt, Pseudomonas putida KT2440
gguucucuucacucaacca

SEQ ID NO: 1633986 - RNA, 21 nt, Pseudomonas putida KT2440
gguucugaaucuggcucugca

SEQ ID NO: 1633987 - RNA, 16 nt, Pseudomonas putida KT2440
gguugaagaugcgcgc

SEQ ID NO: 1633988 - RNA, 15 nt, Pseudomonas putida KT2440
gguugacaagcaaaa

SEQ ID NO: 1633989 - RNA, 21 nt, Pseudomonas putida KT2440
gguugccucaucaccucggca

SEQ ID NO: 1633990 - RNA, 13 nt, Pseudomonas putida KT2440
gguugccugugcu

SEQ ID NO: 1633991 - RNA, 14 nt, Pseudomonas putida KT2440
gguugcccagcaug

SEQ ID NO: 1633992 - RNA, 17 nt, Pseudomonas putida KT2440
gguugccccugauagga

SEQ ID NO: 1633993 - RNA, 20 nt, Pseudomonas putida KT2440
gguugcccggcgagcgcagg

SEQ ID NO: 1633994 - RNA, 15 nt, Pseudomonas putida KT2440
gguugaugugcaggu

SEQ ID NO: 1633995 - RNA, 19 nt, Pseudomonas putida KT2440
gguugcaccguggcagcaa

SEQ ID NO: 1633996 - RNA, 16 nt, Pseudomonas putida KT2440
gguugaucaacugugc

SEQ ID NO: 1633997 - RNA, 21 nt, Pseudomonas putida KT2440
gguuggugccaucaccgcccg

SEQ ID NO: 1633998 - RNA, 20 nt, Pseudomonas putida KT2440
gguuggugcgccuccagcag

SEQ ID NO: 1633999 - RNA, 23 nt, Pseudomonas putida KT2440
gguuuaaaccgcgaagcaggcug

SEQ ID NO: 1634000 - RNA, 22 nt, Pseudomonas putida KT2440
gguuuaccggccgcucaccggc

SEQ ID NO: 1634001 - RNA, 21 nt, Pseudomonas putida KT2440
gguuuacccgcgaacaccggc

SEQ ID NO: 1634002 - RNA, 21 nt, Pseudomonas putida KT2440
gguuuacccgcgaagaagccg

SEQ ID NO: 1634003 - RNA, 15 nt, Pseudomonas putida KT2440
gguugcuccagcgug

SEQ ID NO: 1634004 - RNA, 16 nt, Pseudomonas putida KT2440
gguggucaccagcacg

SEQ ID NO: 1634005 - RNA, 16 nt, Pseudomonas putida KT2440
gguggucagccaggcg

SEQ ID NO: 1634006 - RNA, 15 nt, Pseudomonas putida KT2440
gguggguguccugca

SEQ ID NO: 1634007 - RNA, 18 nt, Pseudomonas putida KT2440
gguggucgcugcggcaca

SEQ ID NO: 1634008 - RNA, 12 nt, Pseudomonas putida KT2440
ggugguccccuu

SEQ ID NO: 1634009 - RNA, 20 nt, Pseudomonas putida KT2440
ggugguuggacacaggccgu

SEQ ID NO: 1634010 - RNA, 18 nt, Pseudomonas putida KT2440
ggugguuuauccggcaca

SEQ ID NO: 1634011 - RNA, 15 nt, Pseudomonas putida KT2440
ggugucggccagcug

SEQ ID NO: 1634012 - RNA, 18 nt, Pseudomonas putida KT2440
ggugucgauacucacccg

SEQ ID NO: 1634013 - RNA, 20 nt, Pseudomonas putida KT2440
ggugucgauacucacccgcu

SEQ ID NO: 1634014 - RNA, 19 nt, Pseudomonas putida KT2440
ggugucgguggcggccagc

SEQ ID NO: 1634015 - RNA, 13 nt, Pseudomonas putida KT2440
gguguccggcaug

SEQ ID NO: 1634016 - RNA, 23 nt, Pseudomonas putida KT2440
gguguccacuuuuagguggacac

SEQ ID NO: 1634017 - RNA, 20 nt, Pseudomonas putida KT2440
ggugucaacaggcuggccga

SEQ ID NO: 1634018 - RNA, 15 nt, Pseudomonas putida KT2440
gguguaucggccagu

SEQ ID NO: 1634019 - RNA, 13 nt, Pseudomonas putida KT2440
gguguucuucagg

SEQ ID NO: 1634020 - RNA, 22 nt, Pseudomonas putida KT2440
gguguucaugcccaccgcugca

SEQ ID NO: 1634021 - RNA, 14 nt, Pseudomonas putida KT2440
gguguuccagcacg

SEQ ID NO: 1634022 - RNA, 15 nt, Pseudomonas putida KT2440
gguguuggucagggc

SEQ ID NO: 1634023 - RNA, 16 nt, Pseudomonas putida KT2440
ggugucuuccggcaug

SEQ ID NO: 1634024 - RNA, 21 nt, Pseudomonas putida KT2440
ggugugcaccugguaggucac

SEQ ID NO: 1634025 - RNA, 19 nt, Pseudomonas putida KT2440
gguguguagguucacagaa

SEQ ID NO: 1634026 - RNA, 16 nt, Pseudomonas putida KT2440
gguguuacgccaggcg

SEQ ID NO: 1634027 - RNA, 15 nt, Pseudomonas putida KT2440
ggugugcuccagcuc

SEQ ID NO: 1634028 - RNA, 12 nt, Pseudomonas putida KT2440
ggugugcugcug

SEQ ID NO: 1634029 - RNA, 14 nt, Pseudomonas putida KT2440
gguuacuggccaau

SEQ ID NO: 1634030 - RNA, 14 nt, Pseudomonas putida KT2440
gguuccccagcaag

SEQ ID NO: 1634031 - RNA, 13 nt, Pseudomonas putida KT2440
gguuccaggccac

SEQ ID NO: 1634032 - RNA, 18 nt, Pseudomonas putida KT2440
gguucaucaccagccccc

SEQ ID NO: 1634033 - RNA, 21 nt, Pseudomonas putida KT2440
gguucgaccaccgcaggugca

SEQ ID NO: 1634034 - RNA, 13 nt, Pseudomonas putida KT2440
gguucgaccacug

SEQ ID NO: 1634035 - RNA, 21 nt, Pseudomonas putida KT2440
gguucgaccacugcaggugca

SEQ ID NO: 1634036 - RNA, 18 nt, Pseudomonas putida KT2440
gguucgacucccgcugcc

SEQ ID NO: 1634037 - RNA, 16 nt, Pseudomonas putida KT2440
gguucgcccccacggg

SEQ ID NO: 1634038 - RNA, 22 nt, Pseudomonas putida KT2440
gccgggcgguugucgaccuggc

SEQ ID NO: 1634039 - RNA, 18 nt, Pseudomonas putida KT2440
gccgggcacgacacuccg

SEQ ID NO: 1634040 - RNA, 21 nt, Pseudomonas putida KT2440
gccgggccugacgugcgcggg

SEQ ID NO: 1634041 - RNA, 17 nt, Pseudomonas putida KT2440
gccgggccgccguggug

SEQ ID NO: 1634042 - RNA, 18 nt, Pseudomonas putida KT2440
gccggguccaccagcccg

SEQ ID NO: 1634043 - RNA, 17 nt, Pseudomonas putida KT2440
gccggguccccggccgu

SEQ ID NO: 1634044 - RNA, 20 nt, Pseudomonas putida KT2440
gccgggucaaggccagcgcc

SEQ ID NO: 1634045 - RNA, 12 nt, Pseudomonas putida KT2440
gccgggucagcu

SEQ ID NO: 1634046 - RNA, 16 nt, Pseudomonas putida KT2440
gccgggucggccugcu

SEQ ID NO: 1634047 - RNA, 18 nt, Pseudomonas putida KT2440
gccgggguaauggcgcug

SEQ ID NO: 1634048 - RNA, 13 nt, Pseudomonas putida KT2440
gccggggcuguuu

SEQ ID NO: 1634049 - RNA, 18 nt, Pseudomonas putida KT2440
gccgggguuucagugacc

SEQ ID NO: 1634050 - RNA, 20 nt, Pseudomonas putida KT2440
gccgggcuuuuuugugccuc

SEQ ID NO: 1634051 - RNA, 15 nt, Pseudomonas putida KT2440
gccgggcuucaacca

SEQ ID NO: 1634052 - RNA, 13 nt, Pseudomonas putida KT2440
gccgguaccacug

SEQ ID NO: 1634053 - RNA, 17 nt, Pseudomonas putida KT2440
gccggguuguggcuggc

SEQ ID NO: 1634054 - RNA, 15 nt, Pseudomonas putida KT2440
gccggucaucacgcu

SEQ ID NO: 1634055 - RNA, 19 nt, Pseudomonas putida KT2440
gccggucacccccaucagc

SEQ ID NO: 1634056 - RNA, 17 nt, Pseudomonas putida KT2440
gccgguaggugcucaag

SEQ ID NO: 1634057 - RNA, 15 nt, Pseudomonas putida KT2440
gccgguggcggccgc

SEQ ID NO: 1634058 - RNA, 17 nt, Pseudomonas putida KT2440
gccggugggcaacagcu

SEQ ID NO: 1634059 - RNA, 18 nt, Pseudomonas putida KT2440
gccgguggggugucuggu

SEQ ID NO: 1634060 - RNA, 15 nt, Pseudomonas putida KT2440
gccggugccauccac

SEQ ID NO: 1634061 - RNA, 20 nt, Pseudomonas putida KT2440
gccggugccauccaccgcgc

SEQ ID NO: 1634062 - RNA, 20 nt, Pseudomonas putida KT2440
gccggucguuacccaccagc

SEQ ID NO: 1634063 - RNA, 23 nt, Pseudomonas putida KT2440
gccggucguuacccaccagcucc

SEQ ID NO: 1634064 - RNA, 15 nt, Pseudomonas putida KT2440
gccggucucccagcg

SEQ ID NO: 1634065 - RNA, 16 nt, Pseudomonas putida KT2440
gccguaggagcgggcu

SEQ ID NO: 1634066 - RNA, 19 nt, Pseudomonas putida KT2440
gccguaguaagccagcccu

SEQ ID NO: 1634067 - RNA, 21 nt, Pseudomonas putida KT2440
gccguaguaagccagcccugc

SEQ ID NO: 1634068 - RNA, 16 nt, Pseudomonas putida KT2440
gccgucagcagcaggc

SEQ ID NO: 1634069 - RNA, 23 nt, Pseudomonas putida KT2440
gccgucagcagcaggcgcgagcc

SEQ ID NO: 1634070 - RNA, 24 nt, Pseudomonas putida KT2440
gccgucagcagcaggcgcgagccu

SEQ ID NO: 1634071 - RNA, 19 nt, Pseudomonas putida KT2440
gccguccaccaucuccagc

SEQ ID NO: 1634072 - RNA, 22 nt, Pseudomonas putida KT2440
gccgguuucguaagcgcugcgc

SEQ ID NO: 1634073 - RNA, 17 nt, Pseudomonas putida KT2440
gccgguuucucgcagca

SEQ ID NO: 1634074 - RNA, 19 nt, Pseudomonas putida KT2440
gccgguuucucgcagcagc

SEQ ID NO: 1634075 - RNA, 21 nt, Pseudomonas putida KT2440
gccgguuucucgcagcagcac

SEQ ID NO: 1634076 - RNA, 16 nt, Pseudomonas putida KT2440
gccgguuugcgcucgc

SEQ ID NO: 1634077 - RNA, 14 nt, Pseudomonas putida KT2440
gccgguuuuuucau

SEQ ID NO: 1634078 - RNA, 17 nt, Pseudomonas putida KT2440
gccgguuaaaacccagg

SEQ ID NO: 1634079 - RNA, 21 nt, Pseudomonas putida KT2440
gccguaccuucggcgacaggu

SEQ ID NO: 1634080 - RNA, 15 nt, Pseudomonas putida KT2440
gccguacggcccaug

SEQ ID NO: 1634081 - RNA, 22 nt, Pseudomonas putida KT2440
gccguacaccaugcucaggaac

SEQ ID NO: 1634082 - RNA, 22 nt, Pseudomonas putida KT2440
gccguaggccagguacaggcaa

SEQ ID NO: 1634083 - RNA, 23 nt, Pseudomonas putida KT2440
gccguagccaaccgagucaacac

SEQ ID NO: 1634084 - RNA, 13 nt, Pseudomonas putida KT2440
gccguagaugccg

SEQ ID NO: 1634085 - RNA, 14 nt, Pseudomonas putida KT2440
gccuacccaggcaa

SEQ ID NO: 1634086 - RNA, 17 nt, Pseudomonas putida KT2440
gccuaccaacgcagcau

SEQ ID NO: 1634087 - RNA, 17 nt, Pseudomonas putida KT2440
gccguggguugaacagg

SEQ ID NO: 1634088 - RNA, 22 nt, Pseudomonas putida KT2440
gccgugguaucgcuuacagaug

SEQ ID NO: 1634089 - RNA, 19 nt, Pseudomonas putida KT2440
gccguggccgccaugaucu

SEQ ID NO: 1634090 - RNA, 15 nt, Pseudomonas putida KT2440
gccgucguuguucuu

SEQ ID NO: 1634091 - RNA, 22 nt, Pseudomonas putida KT2440
gccgugcauaagcgacacccug

SEQ ID NO: 1634092 - RNA, 16 nt, Pseudomonas putida KT2440
gccgugccagguguuu

SEQ ID NO: 1634093 - RNA, 18 nt, Pseudomonas putida KT2440
gccggccauucaucaucg

SEQ ID NO: 1634094 - RNA, 17 nt, Pseudomonas putida KT2440
gccggccauugccgcgc

SEQ ID NO: 1634095 - RNA, 22 nt, Pseudomonas putida KT2440
gccggccauugccgcgccgcaa

SEQ ID NO: 1634096 - RNA, 21 nt, Pseudomonas putida KT2440
gccggcccaaggcaccaacug

SEQ ID NO: 1634097 - RNA, 18 nt, Pseudomonas putida KT2440
gccggcauaacggcuggc

SEQ ID NO: 1634098 - RNA, 21 nt, Pseudomonas putida KT2440
gccggcauaacggcuggcgca

SEQ ID NO: 1634099 - RNA, 15 nt, Pseudomonas putida KT2440
gccggcaucgccucc

SEQ ID NO: 1634100 - RNA, 18 nt, Pseudomonas putida KT2440
gccggcaucgccuccagc

SEQ ID NO: 1634101 - RNA, 21 nt, Pseudomonas putida KT2440
gccggccaccacacuggucac

SEQ ID NO: 1634102 - RNA, 16 nt, Pseudomonas putida KT2440
gccggccaaggucagc

SEQ ID NO: 1634103 - RNA, 18 nt, Pseudomonas putida KT2440
gccggccaaguggccuug

SEQ ID NO: 1634104 - RNA, 15 nt, Pseudomonas putida KT2440
gccggccagaccuug

SEQ ID NO: 1634105 - RNA, 17 nt, Pseudomonas putida KT2440
gccggcagcucgcgcug

SEQ ID NO: 1634106 - RNA, 20 nt, Pseudomonas putida KT2440
gccggcagcucgcgcugcgc

SEQ ID NO: 1634107 - RNA, 15 nt, Pseudomonas putida KT2440
gccggcagcgcggcc

SEQ ID NO: 1634108 - RNA, 17 nt, Pseudomonas putida KT2440
gccggcacuuccucgug

SEQ ID NO: 1634109 - RNA, 21 nt, Pseudomonas putida KT2440
gccggcagcaaggcauccagc

SEQ ID NO: 1634110 - RNA, 15 nt, Pseudomonas putida KT2440
gccggcacgcccgcu

SEQ ID NO: 1634111 - RNA, 19 nt, Pseudomonas putida KT2440
gccggauuucuuccauggc

SEQ ID NO: 1634112 - RNA, 22 nt, Pseudomonas putida KT2440
gccggauuucuuccauggccug

SEQ ID NO: 1634113 - RNA, 12 nt, Pseudomonas putida KT2440
gccggcaacucc

SEQ ID NO: 1634114 - RNA, 18 nt, Pseudomonas putida KT2440
gccggcaacuccuccagc

SEQ ID NO: 1634115 - RNA, 20 nt, Pseudomonas putida KT2440
gccggcaacuccuccagccg

SEQ ID NO: 1634116 - RNA, 22 nt, Pseudomonas putida KT2440
gccggcaacuccuccagccgac

SEQ ID NO: 1634117 - RNA, 17 nt, Pseudomonas putida KT2440
gccggcaaccccugcag

SEQ ID NO: 1634118 - RNA, 15 nt, Pseudomonas putida KT2440
gccggcaacggccac

SEQ ID NO: 1634119 - RNA, 22 nt, Pseudomonas putida KT2440
gccggcaauuuccugcgcggcc

SEQ ID NO: 1634120 - RNA, 16 nt, Pseudomonas putida KT2440
gccggcacagaccgca

SEQ ID NO: 1634121 - RNA, 17 nt, Pseudomonas putida KT2440
gccggcacaggaaggca

SEQ ID NO: 1634122 - RNA, 19 nt, Pseudomonas putida KT2440
gccggagaacaugaaagug

SEQ ID NO: 1634123 - RNA, 20 nt, Pseudomonas putida KT2440
gccggauagagcccggcgca

SEQ ID NO: 1634124 - RNA, 15 nt, Pseudomonas putida KT2440
gccggaccugccgca

SEQ ID NO: 1634125 - RNA, 13 nt, Pseudomonas putida KT2440
gccggaccugcug

SEQ ID NO: 1634126 - RNA, 21 nt, Pseudomonas putida KT2440
gccgcggaaauaccagacgca

SEQ ID NO: 1634127 - RNA, 23 nt, Pseudomonas putida KT2440
gccgcggaaauaccagacgcagg

SEQ ID NO: 1634128 - RNA, 17 nt, Pseudomonas putida KT2440
gccgcggccaacauuca

SEQ ID NO: 1634129 - RNA, 16 nt, Pseudomonas putida KT2440
gccggaacguuuccag

SEQ ID NO: 1634130 - RNA, 17 nt, Pseudomonas putida KT2440
gccggcccugcuggcca

SEQ ID NO: 1634131 - RNA, 18 nt, Pseudomonas putida KT2440
gccggcccuucugcugcu

SEQ ID NO: 1634132 - RNA, 10 nt, Pseudomonas putida KT2440
gccggccucu

SEQ ID NO: 1634133 - RNA, 16 nt, Pseudomonas putida KT2440
gccggccucaauucca

SEQ ID NO: 1634134 - RNA, 16 nt, Pseudomonas putida KT2440
gccggcgaauccagcc

SEQ ID NO: 1634135 - RNA, 19 nt, Pseudomonas putida KT2440
gccggcgaauccagccggc

SEQ ID NO: 1634136 - RNA, 17 nt, Pseudomonas putida KT2440
gccggccuuggcgcggc

SEQ ID NO: 1634137 - RNA, 17 nt, Pseudomonas putida KT2440
gccggcuaucggccagc

SEQ ID NO: 1634138 - RNA, 16 nt, Pseudomonas putida KT2440
gccgggacagcaccau

SEQ ID NO: 1634139 - RNA, 18 nt, Pseudomonas putida KT2440
gccggcggauagccccgc

SEQ ID NO: 1634140 - RNA, 15 nt, Pseudomonas putida KT2440
gccggcgcugagcga

SEQ ID NO: 1634141 - RNA, 17 nt, Pseudomonas putida KT2440
gccggcgcucagcgggc

SEQ ID NO: 1634142 - RNA, 19 nt, Pseudomonas putida KT2440
gccuggaugcgggcuuucc

SEQ ID NO: 1634143 - RNA, 16 nt, Pseudomonas putida KT2440
gccuggcaaauaauca

SEQ ID NO: 1634144 - RNA, 15 nt, Pseudomonas putida KT2440
gccuggaauuccugc

SEQ ID NO: 1634145 - RNA, 23 nt, Pseudomonas putida KT2440
gccuggauaaucgccuguaccuc

SEQ ID NO: 1634146 - RNA, 22 nt, Pseudomonas putida KT2440
gccuggaaaauccgcuugaugg

SEQ ID NO: 1634147 - RNA, 20 nt, Pseudomonas putida KT2440
gccugguuuucgcucgccgg

SEQ ID NO: 1634148 - RNA, 14 nt, Pseudomonas putida KT2440
gccuguaccggccu

SEQ ID NO: 1634149 - RNA, 13 nt, Pseudomonas putida KT2440
gccuuacaugugu

SEQ ID NO: 1634150 - RNA, 15 nt, Pseudomonas putida KT2440
gccugugccggccgc

SEQ ID NO: 1634151 - RNA, 18 nt, Pseudomonas putida KT2440
gccugugccgguggggug

SEQ ID NO: 1634152 - RNA, 21 nt, Pseudomonas putida KT2440
gccugugagaucgagcgccgc

SEQ ID NO: 1634153 - RNA, 18 nt, Pseudomonas putida KT2440
gccuguguccaacacccg

SEQ ID NO: 1634154 - RNA, 17 nt, Pseudomonas putida KT2440
gccugugucgaaccacu

SEQ ID NO: 1634155 - RNA, 17 nt, Pseudomonas putida KT2440
gccugugucgaaccccu

SEQ ID NO: 1634156 - RNA, 18 nt, Pseudomonas putida KT2440
gccuguggguaacccugc

SEQ ID NO: 1634157 - RNA, 20 nt, Pseudomonas putida KT2440
gccuuccagcuccuucuuca

SEQ ID NO: 1634158 - RNA, 12 nt, Pseudomonas putida KT2440
gccuuccagcuu

SEQ ID NO: 1634159 - RNA, 18 nt, Pseudomonas putida KT2440
gccuuccaaccagccagc

SEQ ID NO: 1634160 - RNA, 19 nt, Pseudomonas putida KT2440
gccuuccaaccagccagcc

SEQ ID NO: 1634161 - RNA, 21 nt, Pseudomonas putida KT2440
gccuuccaaccagccagccac

SEQ ID NO: 1634162 - RNA, 22 nt, Pseudomonas putida KT2440
gccuucauaggcggccacggcc

SEQ ID NO: 1634163 - RNA, 19 nt, Pseudomonas putida KT2440
gccuucaucacgcaccagg

SEQ ID NO: 1634164 - RNA, 21 nt, Pseudomonas putida KT2440
gccuucaggguuguggugagc

SEQ ID NO: 1634165 - RNA, 21 nt, Pseudomonas putida KT2440
gcgaaaagccugcaccaguuc

SEQ ID NO: 1634166 - RNA, 19 nt, Pseudomonas putida KT2440
gcgaaaaccccggcucggu

SEQ ID NO: 1634167 - RNA, 22 nt, Pseudomonas putida KT2440
gccuugugggagcgggacugcc

SEQ ID NO: 1634168 - RNA, 16 nt, Pseudomonas putida KT2440
gccuuuacgcccggga

SEQ ID NO: 1634169 - RNA, 13 nt, Pseudomonas putida KT2440
gccuugcggcaag

SEQ ID NO: 1634170 - RNA, 16 nt, Pseudomonas putida KT2440
gccuugcggccccgga

SEQ ID NO: 1634171 - RNA, 16 nt, Pseudomonas putida KT2440
gccuugcgagccuggg

SEQ ID NO: 1634172 - RNA, 16 nt, Pseudomonas putida KT2440
gccuugcgcacgccgg

SEQ ID NO: 1634173 - RNA, 15 nt, Pseudomonas putida KT2440
gccuugcgcugggca

SEQ ID NO: 1634174 - RNA, 16 nt, Pseudomonas putida KT2440
gccuuguccgucagaa

SEQ ID NO: 1634175 - RNA, 14 nt, Pseudomonas putida KT2440
gccuuggucucgau

SEQ ID NO: 1634176 - RNA, 22 nt, Pseudomonas putida KT2440
gccuugucagcagcuucagcca

SEQ ID NO: 1634177 - RNA, 14 nt, Pseudomonas putida KT2440
gccuugcuuggcag

SEQ ID NO: 1634178 - RNA, 19 nt, Pseudomonas putida KT2440
gccuuggacaccaggcugg

SEQ ID NO: 1634179 - RNA, 22 nt, Pseudomonas putida KT2440
gccuucuucggucagcugguga

SEQ ID NO: 1634180 - RNA, 14 nt, Pseudomonas putida KT2440
gccuugcccugcag

SEQ ID NO: 1634181 - RNA, 14 nt, Pseudomonas putida KT2440
gccuugcccagcuc

SEQ ID NO: 1634182 - RNA, 15 nt, Pseudomonas putida KT2440
gccuugcccagcucc

SEQ ID NO: 1634183 - RNA, 17 nt, Pseudomonas putida KT2440
gccuugcccagcuccag

SEQ ID NO: 1634184 - RNA, 18 nt, Pseudomonas putida KT2440
gccuugcccagcuccagc

SEQ ID NO: 1634185 - RNA, 22 nt, Pseudomonas putida KT2440
gccuugcccagcuccagcaccu

SEQ ID NO: 1634186 - RNA, 20 nt, Pseudomonas putida KT2440
gccuucugugauuuccagcg

SEQ ID NO: 1634187 - RNA, 14 nt, Pseudomonas putida KT2440
gccuucuucgaugu

SEQ ID NO: 1634188 - RNA, 14 nt, Pseudomonas putida KT2440
gccuucuccagcuc

SEQ ID NO: 1634189 - RNA, 14 nt, Pseudomonas putida KT2440
gccuucucuuccgc

SEQ ID NO: 1634190 - RNA, 23 nt, Pseudomonas putida KT2440
gccuucucuuccgccagccaacg

SEQ ID NO: 1634191 - RNA, 20 nt, Pseudomonas putida KT2440
gccuucgaacaauucuucca

SEQ ID NO: 1634192 - RNA, 22 nt, Pseudomonas putida KT2440
gccuucgaacaauucuuccagc

SEQ ID NO: 1634193 - RNA, 18 nt, Pseudomonas putida KT2440
gccuucgaacagcgaagu

SEQ ID NO: 1634194 - RNA, 17 nt, Pseudomonas putida KT2440
gccuuccucggccaugc

SEQ ID NO: 1634195 - RNA, 19 nt, Pseudomonas putida KT2440
gccuucccgucgagccggg

SEQ ID NO: 1634196 - RNA, 13 nt, Pseudomonas putida KT2440
gccuuccgggaag

SEQ ID NO: 1634197 - RNA, 12 nt, Pseudomonas putida KT2440
gccuuccgggca

SEQ ID NO: 1634198 - RNA, 15 nt, Pseudomonas putida KT2440
gccuucccgccuggc

SEQ ID NO: 1634199 - RNA, 21 nt, Pseudomonas putida KT2440
gccugcuccggaauccgcaca

SEQ ID NO: 1634200 - RNA, 14 nt, Pseudomonas putida KT2440
gccugcuaauauua

SEQ ID NO: 1634201 - RNA, 14 nt, Pseudomonas putida KT2440
gccugcuccucacu

SEQ ID NO: 1634202 - RNA, 15 nt, Pseudomonas putida KT2440
gccugcuccagcacc

SEQ ID NO: 1634203 - RNA, 15 nt, Pseudomonas putida KT2440
gccugcuccaugggc

SEQ ID NO: 1634204 - RNA, 13 nt, Pseudomonas putida KT2440
gccugcucaucca

SEQ ID NO: 1634205 - RNA, 14 nt, Pseudomonas putida KT2440
gccugcucauccac

SEQ ID NO: 1634206 - RNA, 12 nt, Pseudomonas putida KT2440
gccugcccgccg

SEQ ID NO: 1634207 - RNA, 18 nt, Pseudomonas putida KT2440
gccugcccgccguccagc

SEQ ID NO: 1634208 - RNA, 15 nt, Pseudomonas putida KT2440
gccugcccgcccccc

SEQ ID NO: 1634209 - RNA, 20 nt, Pseudomonas putida KT2440
gccugcgaauggccgcaacc

SEQ ID NO: 1634210 - RNA, 22 nt, Pseudomonas putida KT2440
gccugcgcacggcgcugggaca

SEQ ID NO: 1634211 - RNA, 22 nt, Pseudomonas putida KT2440
gccugccaggucaccgcccagc

SEQ ID NO: 1634212 - RNA, 14 nt, Pseudomonas putida KT2440
gccugccagguccg

SEQ ID NO: 1634213 - RNA, 17 nt, Pseudomonas putida KT2440
gccugccauaccugcuu

SEQ ID NO: 1634214 - RNA, 11 nt, Pseudomonas putida KT2440
gccugcaugcg

SEQ ID NO: 1634215 - RNA, 14 nt, Pseudomonas putida KT2440
gccugccaaauccc

SEQ ID NO: 1634216 - RNA, 12 nt, Pseudomonas putida KT2440
gccugcauccac

SEQ ID NO: 1634217 - RNA, 19 nt, Pseudomonas putida KT2440
gccugcauccacaccagcg

SEQ ID NO: 1634218 - RNA, 21 nt, Pseudomonas putida KT2440
gccugcauccacaccagcggc

SEQ ID NO: 1634219 - RNA, 14 nt, Pseudomonas putida KT2440
gccugcagggccuc

SEQ ID NO: 1634220 - RNA, 16 nt, Pseudomonas putida KT2440
gccugcagggccugga

SEQ ID NO: 1634221 - RNA, 17 nt, Pseudomonas putida KT2440
gccugcaggcccaggug

SEQ ID NO: 1634222 - RNA, 15 nt, Pseudomonas putida KT2440
gccugcaccaguucc

SEQ ID NO: 1634223 - RNA, 13 nt, Pseudomonas putida KT2440
gccugcacccagc

SEQ ID NO: 1634224 - RNA, 14 nt, Pseudomonas putida KT2440
gccugcacccgcgc

SEQ ID NO: 1634225 - RNA, 14 nt, Pseudomonas putida KT2440
gccugcaccuggcu

SEQ ID NO: 1634226 - RNA, 15 nt, Pseudomonas putida KT2440
gccugcacugcaccc

SEQ ID NO: 1634227 - RNA, 22 nt, Pseudomonas putida KT2440
gccugcacugcacccucuuccu

SEQ ID NO: 1634228 - RNA, 24 nt, Pseudomonas putida KT2440
gccugcacuaccucgcucaggcca

SEQ ID NO: 1634229 - RNA, 20 nt, Pseudomonas putida KT2440
gccugcagcgcgucauccgc

SEQ ID NO: 1634230 - RNA, 18 nt, Pseudomonas putida KT2440
gccugcagccguugcugg

SEQ ID NO: 1634231 - RNA, 17 nt, Pseudomonas putida KT2440
gccugaugccucaucag

SEQ ID NO: 1634232 - RNA, 20 nt, Pseudomonas putida KT2440
gccugcaagccggcgaacag

SEQ ID NO: 1634233 - RNA, 17 nt, Pseudomonas putida KT2440
gccugcaaccagucauc

SEQ ID NO: 1634234 - RNA, 22 nt, Pseudomonas putida KT2440
gccugcaaccccuggaaacccu

SEQ ID NO: 1634235 - RNA, 22 nt, Pseudomonas putida KT2440
gccugagggguguucagugauu

SEQ ID NO: 1634236 - RNA, 13 nt, Pseudomonas putida KT2440
gccugaggcccuc

SEQ ID NO: 1634237 - RNA, 14 nt, Pseudomonas putida KT2440
gccugacgccgcca

SEQ ID NO: 1634238 - RNA, 18 nt, Pseudomonas putida KT2440
gccugacgccgccagcgc

SEQ ID NO: 1634239 - RNA, 19 nt, Pseudomonas putida KT2440
gccugacgccgccagcgcu

SEQ ID NO: 1634240 - RNA, 22 nt, Pseudomonas putida KT2440
gccugacgccgccagcgcucca

SEQ ID NO: 1634241 - RNA, 21 nt, Pseudomonas putida KT2440
gccugacgcgccgccaacccc

SEQ ID NO: 1634242 - RNA, 19 nt, Pseudomonas putida KT2440
gccugacgcagugcagccg

SEQ ID NO: 1634243 - RNA, 12 nt, Pseudomonas putida KT2440
gccucaaggccg

SEQ ID NO: 1634244 - RNA, 13 nt, Pseudomonas putida KT2440
gccucaaggccgg

SEQ ID NO: 1634245 - RNA, 14 nt, Pseudomonas putida KT2440
gccucaaggccggc

SEQ ID NO: 1634246 - RNA, 16 nt, Pseudomonas putida KT2440
gccucacaucgcgcag

SEQ ID NO: 1634247 - RNA, 13 nt, Pseudomonas putida KT2440
gccucacauucac

SEQ ID NO: 1634248 - RNA, 14 nt, Pseudomonas putida KT2440
gccucacauucacc

SEQ ID NO: 1634249 - RNA, 18 nt, Pseudomonas putida KT2440
gccucuugcaccuguccc

SEQ ID NO: 1634250 - RNA, 15 nt, Pseudomonas putida KT2440
gccuacccgggcgca

SEQ ID NO: 1634251 - RNA, 13 nt, Pseudomonas putida KT2440
gccuacgccccca

SEQ ID NO: 1634252 - RNA, 15 nt, Pseudomonas putida KT2440
gccuacgcccccagc

SEQ ID NO: 1634253 - RNA, 16 nt, Pseudomonas putida KT2440
gccuacgcccccagcc

SEQ ID NO: 1634254 - RNA, 20 nt, Pseudomonas putida KT2440
gccugaccggucagcccggc

SEQ ID NO: 1634255 - RNA, 18 nt, Pseudomonas putida KT2440
gccugaccugugcugaau

SEQ ID NO: 1634256 - RNA, 20 nt, Pseudomonas putida KT2440
gccucacagcgccgcggcca

SEQ ID NO: 1634257 - RNA, 12 nt, Pseudomonas putida KT2440
gccugaaaccca

SEQ ID NO: 1634258 - RNA, 18 nt, Pseudomonas putida KT2440
gcgauacccaauaaaaac

SEQ ID NO: 1634259 - RNA, 19 nt, Pseudomonas putida KT2440
gcgauagaacuccaccagc

SEQ ID NO: 1634260 - RNA, 22 nt, Pseudomonas putida KT2440
gcgauagaacuccaccagccca

SEQ ID NO: 1634261 - RNA, 18 nt, Pseudomonas putida KT2440
gcgaguaaagccagcagc

SEQ ID NO: 1634262 - RNA, 19 nt, Pseudomonas putida KT2440
gcgaguaaagccagcagcc

SEQ ID NO: 1634263 - RNA, 16 nt, Pseudomonas putida KT2440
gcgagguagcugucgg

SEQ ID NO: 1634264 - RNA, 16 nt, Pseudomonas putida KT2440
gcgaguccuccaacuc

SEQ ID NO: 1634265 - RNA, 12 nt, Pseudomonas putida KT2440
gcgagucaggcu

SEQ ID NO: 1634266 - RNA, 16 nt, Pseudomonas putida KT2440
gcgagucaggcugcac

SEQ ID NO: 1634267 - RNA, 22 nt, Pseudomonas putida KT2440
gcgagucaggcugcacaaggug

SEQ ID NO: 1634268 - RNA, 17 nt, Pseudomonas putida KT2440
gcgaguauccuccagcc

SEQ ID NO: 1634269 - RNA, 21 nt, Pseudomonas putida KT2440
gcgagcgucucgccaaacugc

SEQ ID NO: 1634270 - RNA, 15 nt, Pseudomonas putida KT2440
gcgaggaggccgggg

SEQ ID NO: 1634271 - RNA, 18 nt, Pseudomonas putida KT2440
gcgaggcaaucagggcau

SEQ ID NO: 1634272 - RNA, 21 nt, Pseudomonas putida KT2440
gcgaggcccgaacuggccggu

SEQ ID NO: 1634273 - RNA, 12 nt, Pseudomonas putida KT2440
gcgacgcggccc

SEQ ID NO: 1634274 - RNA, 14 nt, Pseudomonas putida KT2440
gcgacgcugccgca

SEQ ID NO: 1634275 - RNA, 22 nt, Pseudomonas putida KT2440
gcgacgaguuuaccuccaucac

SEQ ID NO: 1634276 - RNA, 23 nt, Pseudomonas putida KT2440
gcgacgaguuuaccuccaucacc

SEQ ID NO: 1634277 - RNA, 18 nt, Pseudomonas putida KT2440
gcgacgugcccagaucac

SEQ ID NO: 1634278 - RNA, 12 nt, Pseudomonas putida KT2440
gcgaccgccauu

SEQ ID NO: 1634279 - RNA, 21 nt, Pseudomonas putida KT2440
gcgacgaagcugcuggcguca

SEQ ID NO: 1634280 - RNA, 19 nt, Pseudomonas putida KT2440
gcgaccuggaucgcgccuu

SEQ ID NO: 1634281 - RNA, 17 nt, Pseudomonas putida KT2440
gcgaccuucacgccagc

SEQ ID NO: 1634282 - RNA, 19 nt, Pseudomonas putida KT2440
gcgacaugccggccaccac

SEQ ID NO: 1634283 - RNA, 17 nt, Pseudomonas putida KT2440
gcgaccaugcggcucug

SEQ ID NO: 1634284 - RNA, 18 nt, Pseudomonas putida KT2440
gcgacccgcuggccggac

SEQ ID NO: 1634285 - RNA, 17 nt, Pseudomonas putida KT2440
gcgacccguccaguucc

SEQ ID NO: 1634286 - RNA, 21 nt, Pseudomonas putida KT2440
gcgaaugcaaugguaaauuca

SEQ ID NO: 1634287 - RNA, 12 nt, Pseudomonas putida KT2440
gcgaaugggccg

SEQ ID NO: 1634288 - RNA, 20 nt, Pseudomonas putida KT2440
gcgaaugggcugcaaagcag

SEQ ID NO: 1634289 - RNA, 14 nt, Pseudomonas putida KT2440
gcgaauagcaacac

SEQ ID NO: 1634290 - RNA, 15 nt, Pseudomonas putida KT2440
gcgaauagcaacaca

SEQ ID NO: 1634291 - RNA, 21 nt, Pseudomonas putida KT2440
gcgaauaguagaagcagauca

SEQ ID NO: 1634292 - RNA, 24 nt, Pseudomonas putida KT2440
gcgaauccagcaggcuugccagcu

SEQ ID NO: 1634293 - RNA, 20 nt, Pseudomonas putida KT2440
gcgaauacgguagcggcgga

SEQ ID NO: 1634294 - RNA, 20 nt, Pseudomonas putida KT2440
gcgaauacggucgcggcggc

SEQ ID NO: 1634295 - RNA, 14 nt, Pseudomonas putida KT2440
gcgaaacaccagca

SEQ ID NO: 1634296 - RNA, 19 nt, Pseudomonas putida KT2440
gcgacacgcgaaucgccag

SEQ ID NO: 1634297 - RNA, 21 nt, Pseudomonas putida KT2440
gcgacacccuggucaugcagc

SEQ ID NO: 1634298 - RNA, 20 nt, Pseudomonas putida KT2440
gcgacaaccgaaaaggccaa

SEQ ID NO: 1634299 - RNA, 16 nt, Pseudomonas putida KT2440
gcgacaguucgccacc

SEQ ID NO: 1634300 - RNA, 14 nt, Pseudomonas putida KT2440
gcgacagggcgccc

SEQ ID NO: 1634301 - RNA, 22 nt, Pseudomonas putida KT2440
gcgacagguaguuggccgggcc

SEQ ID NO: 1634302 - RNA, 14 nt, Pseudomonas putida KT2440
gcgacagcugcggc

SEQ ID NO: 1634303 - RNA, 20 nt, Pseudomonas putida KT2440
gcgacagcaucaucaggccg

SEQ ID NO: 1634304 - RNA, 16 nt, Pseudomonas putida KT2440
gccgccuccugcugcu

SEQ ID NO: 1634305 - RNA, 17 nt, Pseudomonas putida KT2440
gccgccuccaccgggau

SEQ ID NO: 1634306 - RNA, 20 nt, Pseudomonas putida KT2440
gccgcgcaugcugugcccug

SEQ ID NO: 1634307 - RNA, 16 nt, Pseudomonas putida KT2440
gccgcgccaccgggcg

SEQ ID NO: 1634308 - RNA, 18 nt, Pseudomonas putida KT2440
gccgcgccucgcggugca

SEQ ID NO: 1634309 - RNA, 22 nt, Pseudomonas putida KT2440
gccgccauugaugccgaaggcc

SEQ ID NO: 1634310 - RNA, 17 nt, Pseudomonas putida KT2440
gccgccauugcccagcc

SEQ ID NO: 1634311 - RNA, 13 nt, Pseudomonas putida KT2440
gccgcccagcucu

SEQ ID NO: 1634312 - RNA, 14 nt, Pseudomonas putida KT2440
gccgccccacccuu

SEQ ID NO: 1634313 - RNA, 22 nt, Pseudomonas putida KT2440
gccgcccuagcuaucucaagcc

SEQ ID NO: 1634314 - RNA, 14 nt, Pseudomonas putida KT2440
gccgccccccagua

SEQ ID NO: 1634315 - RNA, 23 nt, Pseudomonas putida KT2440
gccgcccggucauacagcccuac

SEQ ID NO: 1634316 - RNA, 21 nt, Pseudomonas putida KT2440
gccgccccgcaccagaccagc

SEQ ID NO: 1634317 - RNA, 12 nt, Pseudomonas putida KT2440
gccgcccccuuc

SEQ ID NO: 1634318 - RNA, 14 nt, Pseudomonas putida KT2440
gccgccgaccaggu

SEQ ID NO: 1634319 - RNA, 18 nt, Pseudomonas putida KT2440
gccgccgaacaggccggc

SEQ ID NO: 1634320 - RNA, 23 nt, Pseudomonas putida KT2440
gccgcccuugagcuucagcgcgc

SEQ ID NO: 1634321 - RNA, 23 nt, Pseudomonas putida KT2440
gccgccgauguagucguccugcc

SEQ ID NO: 1634322 - RNA, 15 nt, Pseudomonas putida KT2440
gccgccgcugccagc

SEQ ID NO: 1634323 - RNA, 21 nt, Pseudomonas putida KT2440
gccgcagcugcggucgagcug

SEQ ID NO: 1634324 - RNA, 16 nt, Pseudomonas putida KT2440
gccgcacccagcaggc

SEQ ID NO: 1634325 - RNA, 14 nt, Pseudomonas putida KT2440
gccgcaaggccgcu

SEQ ID NO: 1634326 - RNA, 15 nt, Pseudomonas putida KT2440
gccgcaaggccgcuc

SEQ ID NO: 1634327 - RNA, 15 nt, Pseudomonas putida KT2440
gccgcaaggcggccc

SEQ ID NO: 1634328 - RNA, 16 nt, Pseudomonas putida KT2440
gccgcaaggcggccca

SEQ ID NO: 1634329 - RNA, 16 nt, Pseudomonas putida KT2440
gccgcacaaggccgcu

SEQ ID NO: 1634330 - RNA, 18 nt, Pseudomonas putida KT2440
gccgcaauggucuuacca

SEQ ID NO: 1634331 - RNA, 15 nt, Pseudomonas putida KT2440
gccgcagugacacgg

SEQ ID NO: 1634332 - RNA, 17 nt, Pseudomonas putida KT2440
gccgccaacagcgcagg

SEQ ID NO: 1634333 - RNA, 13 nt, Pseudomonas putida KT2440
gccgccaggcagc

SEQ ID NO: 1634334 - RNA, 13 nt, Pseudomonas putida KT2440
gccgccagcgugc

SEQ ID NO: 1634335 - RNA, 18 nt, Pseudomonas putida KT2440
gccgccagcgcuccagca

SEQ ID NO: 1634336 - RNA, 12 nt, Pseudomonas putida KT2440
gccgccagcggc

SEQ ID NO: 1634337 - RNA, 13 nt, Pseudomonas putida KT2440
gccgccagcggca

SEQ ID NO: 1634338 - RNA, 21 nt, Pseudomonas putida KT2440
gccgccagcggcaguugcagg

SEQ ID NO: 1634339 - RNA, 19 nt, Pseudomonas putida KT2440
gccgccacccaccacggcc

SEQ ID NO: 1634340 - RNA, 12 nt, Pseudomonas putida KT2440
gccgccagcccc

SEQ ID NO: 1634341 - RNA, 15 nt, Pseudomonas putida KT2440
gccgccaccagcgcc

SEQ ID NO: 1634342 - RNA, 21 nt, Pseudomonas putida KT2440
gccgccaguucgcccuucagc

SEQ ID NO: 1634343 - RNA, 17 nt, Pseudomonas putida KT2440
gccgaguaaccggcggc

SEQ ID NO: 1634344 - RNA, 15 nt, Pseudomonas putida KT2440
gccgagguucuucca

SEQ ID NO: 1634345 - RNA, 15 nt, Pseudomonas putida KT2440
gccgaucacuuccug

SEQ ID NO: 1634346 - RNA, 23 nt, Pseudomonas putida KT2440
gccgaguccuugcgugccucagc

SEQ ID NO: 1634347 - RNA, 14 nt, Pseudomonas putida KT2440
gccgaucaaugucg

SEQ ID NO: 1634348 - RNA, 19 nt, Pseudomonas putida KT2440
gccgaugggcuguuccagc

SEQ ID NO: 1634349 - RNA, 16 nt, Pseudomonas putida KT2440
gccgaugggcaggcca

SEQ ID NO: 1634350 - RNA, 17 nt, Pseudomonas putida KT2440
gccgaugggcaggccau

SEQ ID NO: 1634351 - RNA, 19 nt, Pseudomonas putida KT2440
gccgaugcucgucagcccc

SEQ ID NO: 1634352 - RNA, 20 nt, Pseudomonas putida KT2440
gccgaugcucgucagccccu

SEQ ID NO: 1634353 - RNA, 14 nt, Pseudomonas putida KT2440
gccgaugccaagca

SEQ ID NO: 1634354 - RNA, 22 nt, Pseudomonas putida KT2440
gccgaugaugcgggcaaagaac

SEQ ID NO: 1634355 - RNA, 18 nt, Pseudomonas putida KT2440
gccgaucagcacgccgcc

SEQ ID NO: 1634356 - RNA, 20 nt, Pseudomonas putida KT2440
gccgaucagcacgccgccga

SEQ ID NO: 1634357 - RNA, 19 nt, Pseudomonas putida KT2440
gccgaucaggaagccccgc

SEQ ID NO: 1634358 - RNA, 18 nt, Pseudomonas putida KT2440
gccgaucaggaaggccuu

SEQ ID NO: 1634359 - RNA, 16 nt, Pseudomonas putida KT2440
gccgaagaacgcgagc

SEQ ID NO: 1634360 - RNA, 15 nt, Pseudomonas putida KT2440
gcccuuuuucaccag

SEQ ID NO: 1634361 - RNA, 16 nt, Pseudomonas putida KT2440
gccgaaggccguggca

SEQ ID NO: 1634362 - RNA, 18 nt, Pseudomonas putida KT2440
gccgaagccaugagcgag

SEQ ID NO: 1634363 - RNA, 21 nt, Pseudomonas putida KT2440
gccgaagccaugagcgagcuc

SEQ ID NO: 1634364 - RNA, 18 nt, Pseudomonas putida KT2440
gccgaagcccagcgaggc

SEQ ID NO: 1634365 - RNA, 18 nt, Pseudomonas putida KT2440
aaagcgggcaacugcgcc

SEQ ID NO: 1634366 - RNA, 15 nt, Pseudomonas putida KT2440
gccgaaguggcggcu

SEQ ID NO: 1634367 - RNA, 20 nt, Pseudomonas putida KT2440
gccgaaguggcggcucgcug

SEQ ID NO: 1634368 - RNA, 18 nt, Pseudomonas putida KT2440
gccgaagucauccauggc

SEQ ID NO: 1634369 - RNA, 19 nt, Pseudomonas putida KT2440
gccgaagucauccauggca

SEQ ID NO: 1634370 - RNA, 18 nt, Pseudomonas putida KT2440
aaagcgugaaugcauggu

SEQ ID NO: 1634371 - RNA, 13 nt, Pseudomonas putida KT2440
gccgaccuugggc

SEQ ID NO: 1634372 - RNA, 13 nt, Pseudomonas putida KT2440
gccgacgaugccc

SEQ ID NO: 1634373 - RNA, 23 nt, Pseudomonas putida KT2440
gccgaccaagcgccccacaagcc

SEQ ID NO: 1634374 - RNA, 20 nt, Pseudomonas putida KT2440
gcccucguucgcgggcacgc

SEQ ID NO: 1634375 - RNA, 20 nt, Pseudomonas putida KT2440
gcccucggcaaucugcagca

SEQ ID NO: 1634376 - RNA, 23 nt, Pseudomonas putida KT2440
gcccucggcaaucugcagcagca

SEQ ID NO: 1634377 - RNA, 16 nt, Pseudomonas putida KT2440
gcccugacgccagcgc

SEQ ID NO: 1634378 - RNA, 17 nt, Pseudomonas putida KT2440
gcccugacgccagcgcu

SEQ ID NO: 1634379 - RNA, 22 nt, Pseudomonas putida KT2440
gcccugaacuuggccuccagca

SEQ ID NO: 1634380 - RNA, 12 nt, Pseudomonas putida KT2440
gcccucuuccgc

SEQ ID NO: 1634381 - RNA, 15 nt, Pseudomonas putida KT2440
gcccucuuccgcacg

SEQ ID NO: 1634382 - RNA, 13 nt, Pseudomonas putida KT2440
gcccucuugcugc

SEQ ID NO: 1634383 - RNA, 17 nt, Pseudomonas putida KT2440
gcccugaucgccuccag

SEQ ID NO: 1634384 - RNA, 18 nt, Pseudomonas putida KT2440
gcccugagccaaggccgc

SEQ ID NO: 1634385 - RNA, 15 nt, Pseudomonas putida KT2440
gcccuggcccgccgc

SEQ ID NO: 1634386 - RNA, 13 nt, Pseudomonas putida KT2440
gcccugcagcuuc

SEQ ID NO: 1634387 - RNA, 18 nt, Pseudomonas putida KT2440
gcccugcagcuucccggc

SEQ ID NO: 1634388 - RNA, 19 nt, Pseudomonas putida KT2440
gcccugcagcuucccggcc

SEQ ID NO: 1634389 - RNA, 17 nt, Pseudomonas putida KT2440
gcccuuucgcgggugaa

SEQ ID NO: 1634390 - RNA, 19 nt, Pseudomonas putida KT2440
gcccuuuucuacauggugg

SEQ ID NO: 1634391 - RNA, 12 nt, Pseudomonas putida KT2440
gcccuuguccau

SEQ ID NO: 1634392 - RNA, 13 nt, Pseudomonas putida KT2440
gcccuuucagggu

SEQ ID NO: 1634393 - RNA, 19 nt, Pseudomonas putida KT2440
gcccuucgcggaagcucuc

SEQ ID NO: 1634394 - RNA, 21 nt, Pseudomonas putida KT2440
gcccuucgcgggugaacccgc

SEQ ID NO: 1634395 - RNA, 13 nt, Pseudomonas putida KT2440
gcccuucgcaggc

SEQ ID NO: 1634396 - RNA, 16 nt, Pseudomonas putida KT2440
gcccuucgcaggcacg

SEQ ID NO: 1634397 - RNA, 23 nt, Pseudomonas putida KT2440
gcccuucaggccccagucauccg

SEQ ID NO: 1634398 - RNA, 17 nt, Pseudomonas putida KT2440
gcccuucaugcgcccug

SEQ ID NO: 1634399 - RNA, 23 nt, Pseudomonas putida KT2440
gcccuggcgacgaguuuaccucc

SEQ ID NO: 1634400 - RNA, 15 nt, Pseudomonas putida KT2440
gcccuggcggccacg

SEQ ID NO: 1634401 - RNA, 21 nt, Pseudomonas putida KT2440
gcccuguuucuucaaggccgc

SEQ ID NO: 1634402 - RNA, 23 nt, Pseudomonas putida KT2440
gcccuuaaggucaaucagggaua

SEQ ID NO: 1634403 - RNA, 17 nt, Pseudomonas putida KT2440
gcccguggcccucagcc

SEQ ID NO: 1634404 - RNA, 23 nt, Pseudomonas putida KT2440
gcccguuacguaagucaggccga

SEQ ID NO: 1634405 - RNA, 18 nt, Pseudomonas putida KT2440
gcccgugcucacgcacga

SEQ ID NO: 1634406 - RNA, 21 nt, Pseudomonas putida KT2440
gcccgugccgcaucagccggc

SEQ ID NO: 1634407 - RNA, 14 nt, Pseudomonas putida KT2440
gcccgucuggcugc

SEQ ID NO: 1634408 - RNA, 16 nt, Pseudomonas putida KT2440
gcccgucuggcugcaa

SEQ ID NO: 1634409 - RNA, 22 nt, Pseudomonas putida KT2440
gcccgucugcgugcacccaacc

SEQ ID NO: 1634410 - RNA, 17 nt, Pseudomonas putida KT2440
gcccuccugcagcaggc

SEQ ID NO: 1634411 - RNA, 20 nt, Pseudomonas putida KT2440
gcccucggccggggccaggc

SEQ ID NO: 1634412 - RNA, 21 nt, Pseudomonas putida KT2440
gcccucggccggggccaggcg

SEQ ID NO: 1634413 - RNA, 17 nt, Pseudomonas putida KT2440
gcccucgaugucuucca

SEQ ID NO: 1634414 - RNA, 21 nt, Pseudomonas putida KT2440
gcccucgaugucuuccagacc

SEQ ID NO: 1634415 - RNA, 17 nt, Pseudomonas putida KT2440
gcccuagaacaggcggc

SEQ ID NO: 1634416 - RNA, 13 nt, Pseudomonas putida KT2440
gcccuccagccgc

SEQ ID NO: 1634417 - RNA, 20 nt, Pseudomonas putida KT2440
gcccuccccguuuggcagcu

SEQ ID NO: 1634418 - RNA, 14 nt, Pseudomonas putida KT2440
gcccucagcccagu

SEQ ID NO: 1634419 - RNA, 16 nt, Pseudomonas putida KT2440
gcccucaacccucgcc

SEQ ID NO: 1634420 - RNA, 23 nt, Pseudomonas putida KT2440
gcccggggaucuugcuggccggu

SEQ ID NO: 1634421 - RNA, 23 nt, Pseudomonas putida KT2440
gcccgccucgccauaagcuguca

SEQ ID NO: 1634422 - RNA, 14 nt, Pseudomonas putida KT2440
gcccgccguccagc

SEQ ID NO: 1634423 - RNA, 18 nt, Pseudomonas putida KT2440
gcccgccguguucccagc

SEQ ID NO: 1634424 - RNA, 13 nt, Pseudomonas putida KT2440
gcccgggucccgu

SEQ ID NO: 1634425 - RNA, 20 nt, Pseudomonas putida KT2440
gcccgccggcaacuccucca

SEQ ID NO: 1634426 - RNA, 22 nt, Pseudomonas putida KT2440
gcccgccggcaacuccuccagc

SEQ ID NO: 1634427 - RNA, 13 nt, Pseudomonas putida KT2440
gcccgcccaccac

SEQ ID NO: 1634428 - RNA, 18 nt, Pseudomonas putida KT2440
gcccgcccaccaccagcc

SEQ ID NO: 1634429 - RNA, 19 nt, Pseudomonas putida KT2440
gcccgcccaccaccagccc

SEQ ID NO: 1634430 - RNA, 16 nt, Pseudomonas putida KT2440
gcccgcccacgccgcu

SEQ ID NO: 1634431 - RNA, 20 nt, Pseudomonas putida KT2440
gcccgccaguaggcugcagc

SEQ ID NO: 1634432 - RNA, 22 nt, Pseudomonas putida KT2440
gcccgccaguaggcugcagccu

SEQ ID NO: 1634433 - RNA, 16 nt, Pseudomonas putida KT2440
gcccggugcaagccaa

SEQ ID NO: 1634434 - RNA, 21 nt, Pseudomonas putida KT2440
gcccggugcccuugccgcccc

SEQ ID NO: 1634435 - RNA, 17 nt, Pseudomonas putida KT2440
gcccggucccgcugccg

SEQ ID NO: 1634436 - RNA, 22 nt, Pseudomonas putida KT2440
gcccguagcggauaaucuguuu

SEQ ID NO: 1634437 - RNA, 16 nt, Pseudomonas putida KT2440
gcccgucagcuugccu

SEQ ID NO: 1634438 - RNA, 12 nt, Pseudomonas putida KT2440
gccaugccaccc

SEQ ID NO: 1634439 - RNA, 16 nt, Pseudomonas putida KT2440
gccaugcuuuccaggu

SEQ ID NO: 1634440 - RNA, 16 nt, Pseudomonas putida KT2440
gccaugguuuugggca

SEQ ID NO: 1634441 - RNA, 17 nt, Pseudomonas putida KT2440
gccauguacguugccag

SEQ ID NO: 1634442 - RNA, 22 nt, Pseudomonas putida KT2440
gccauggucgcguuguucagca

SEQ ID NO: 1634443 - RNA, 18 nt, Pseudomonas putida KT2440
gccauggcgacaauggcg

SEQ ID NO: 1634444 - RNA, 23 nt, Pseudomonas putida KT2440
gccauggccucgucgcgguccuu

SEQ ID NO: 1634445 - RNA, 19 nt, Pseudomonas putida KT2440
gccaucucaaucgcaugca

SEQ ID NO: 1634446 - RNA, 13 nt, Pseudomonas putida KT2440
gcccaaacagcau

SEQ ID NO: 1634447 - RNA, 18 nt, Pseudomonas putida KT2440
gccauuucuucagcagga

SEQ ID NO: 1634448 - RNA, 12 nt, Pseudomonas putida KT2440
gccauucucgau

SEQ ID NO: 1634449 - RNA, 17 nt, Pseudomonas putida KT2440
gccauugaggcuguggc

SEQ ID NO: 1634450 - RNA, 15 nt, Pseudomonas putida KT2440
gccauuccaggcuag

SEQ ID NO: 1634451 - RNA, 23 nt, Pseudomonas putida KT2440
gccaguuucaccugaccaucagc

SEQ ID NO: 1634452 - RNA, 20 nt, Pseudomonas putida KT2440
gccaguuuccgucuuucagg

SEQ ID NO: 1634453 - RNA, 23 nt, Pseudomonas putida KT2440
gccaguuugcacuggcggggcuu

SEQ ID NO: 1634454 - RNA, 17 nt, Pseudomonas putida KT2440
gccauagcgcugcaccg

SEQ ID NO: 1634455 - RNA, 16 nt, Pseudomonas putida KT2440
gccauaggcuugcgcu

SEQ ID NO: 1634456 - RNA, 21 nt, Pseudomonas putida KT2440
gccauaccgggucuugccgau

SEQ ID NO: 1634457 - RNA, 19 nt, Pseudomonas putida KT2440
gccauacaagaucaagccc

SEQ ID NO: 1634458 - RNA, 18 nt, Pseudomonas putida KT2440
gccaucagcaagccgccg

SEQ ID NO: 1634459 - RNA, 15 nt, Pseudomonas putida KT2440
gccaucaccgcccgc

SEQ ID NO: 1634460 - RNA, 20 nt, Pseudomonas putida KT2440
gccauaguuuugugccaccu

SEQ ID NO: 1634461 - RNA, 21 nt, Pseudomonas putida KT2440
gccaucaauaccggcaugccc

SEQ ID NO: 1634462 - RNA, 15 nt, Pseudomonas putida KT2440
gccaucgcccacggc

SEQ ID NO: 1634463 - RNA, 12 nt, Pseudomonas putida KT2440
gccaucccgcug

SEQ ID NO: 1634464 - RNA, 21 nt, Pseudomonas putida KT2440
gccauccagucgaucagcgac

SEQ ID NO: 1634465 - RNA, 15 nt, Pseudomonas putida KT2440
gccauccccccagcc

SEQ ID NO: 1634466 - RNA, 19 nt, Pseudomonas putida KT2440
gccauccccccagcccuug

SEQ ID NO: 1634467 - RNA, 15 nt, Pseudomonas putida KT2440
gccaggugcucagcc

SEQ ID NO: 1634468 - RNA, 16 nt, Pseudomonas putida KT2440
gccagguggccuuccc

SEQ ID NO: 1634469 - RNA, 16 nt, Pseudomonas putida KT2440
gccagguuggcaaacu

SEQ ID NO: 1634470 - RNA, 18 nt, Pseudomonas putida KT2440
gccagguuguucaguggc

SEQ ID NO: 1634471 - RNA, 19 nt, Pseudomonas putida KT2440
gccaggguuugcaagcggc

SEQ ID NO: 1634472 - RNA, 20 nt, Pseudomonas putida KT2440
gccaggucaccgcccagcuu

SEQ ID NO: 1634473 - RNA, 15 nt, Pseudomonas putida KT2440
gccagggugccagac

SEQ ID NO: 1634474 - RNA, 21 nt, Pseudomonas putida KT2440
gccagguccaggcugcgcgcc

SEQ ID NO: 1634475 - RNA, 21 nt, Pseudomonas putida KT2440
gccagguccgguaacuggccc

SEQ ID NO: 1634476 - RNA, 13 nt, Pseudomonas putida KT2440
gccagggccgggg

SEQ ID NO: 1634477 - RNA, 15 nt, Pseudomonas putida KT2440
gccagggccuguagg

SEQ ID NO: 1634478 - RNA, 15 nt, Pseudomonas putida KT2440
gccagggcccgccgc

SEQ ID NO: 1634479 - RNA, 18 nt, Pseudomonas putida KT2440
gccagggcccgccgcgcg

SEQ ID NO: 1634480 - RNA, 20 nt, Pseudomonas putida KT2440
gccacuucgccguacuggcu

SEQ ID NO: 1634481 - RNA, 23 nt, Pseudomonas putida KT2440
gccacuucgccguacuggcugca

SEQ ID NO: 1634482 - RNA, 23 nt, Pseudomonas putida KT2440
gccaggcuugguuuggccucugg

SEQ ID NO: 1634483 - RNA, 14 nt, Pseudomonas putida KT2440
gccacuucuuccac

SEQ ID NO: 1634484 - RNA, 19 nt, Pseudomonas putida KT2440
gccagugaccgcuggcgcc

SEQ ID NO: 1634485 - RNA, 17 nt, Pseudomonas putida KT2440
gccagucugcuccaccg

SEQ ID NO: 1634486 - RNA, 21 nt, Pseudomonas putida KT2440
gccaguggcacccacagcgcc

SEQ ID NO: 1634487 - RNA, 14 nt, Pseudomonas putida KT2440
gccaguggccuugg

SEQ ID NO: 1634488 - RNA, 21 nt, Pseudomonas putida KT2440
gccagugggugcuguggcgca

SEQ ID NO: 1634489 - RNA, 21 nt, Pseudomonas putida KT2440
gccagugucaguugcucgccc

SEQ ID NO: 1634490 - RNA, 13 nt, Pseudomonas putida KT2440
gccagugcgugca

SEQ ID NO: 1634491 - RNA, 16 nt, Pseudomonas putida KT2440
gccaguucgcggcgca

SEQ ID NO: 1634492 - RNA, 15 nt, Pseudomonas putida KT2440
gccaguucgacaggu

SEQ ID NO: 1634493 - RNA, 23 nt, Pseudomonas putida KT2440
gccaguucgacgcugcugucggu

SEQ ID NO: 1634494 - RNA, 20 nt, Pseudomonas putida KT2440
gccaguucacggaucgccag

SEQ ID NO: 1634495 - RNA, 22 nt, Pseudomonas putida KT2440
gccaguuacccuguacccgcug

SEQ ID NO: 1634496 - RNA, 23 nt, Pseudomonas putida KT2440
gccaguagcacagugcggcggca

SEQ ID NO: 1634497 - RNA, 20 nt, Pseudomonas putida KT2440
gccaguacgcgccugcaccu

SEQ ID NO: 1634498 - RNA, 20 nt, Pseudomonas putida KT2440
gccaguaccuucuggcugga

SEQ ID NO: 1634499 - RNA, 15 nt, Pseudomonas putida KT2440
gccaguaccagcagc

SEQ ID NO: 1634500 - RNA, 14 nt, Pseudomonas putida KT2440
gccaguaccagcag

SEQ ID NO: 1634501 - RNA, 15 nt, Pseudomonas putida KT2440
gccaguccaggccaa

SEQ ID NO: 1634502 - RNA, 17 nt, Pseudomonas putida KT2440
gccccacuuccagcgac

SEQ ID NO: 1634503 - RNA, 14 nt, Pseudomonas putida KT2440
gccccaccacaucc

SEQ ID NO: 1634504 - RNA, 15 nt, Pseudomonas putida KT2440
gccccaccaggcacc

SEQ ID NO: 1634505 - RNA, 16 nt, Pseudomonas putida KT2440
gccccaccaggcaccg

SEQ ID NO: 1634506 - RNA, 22 nt, Pseudomonas putida KT2440
gccccaagcgggccaaggucau

SEQ ID NO: 1634507 - RNA, 18 nt, Pseudomonas putida KT2440
gcccauuucugcaugucc

SEQ ID NO: 1634508 - RNA, 23 nt, Pseudomonas putida KT2440
gcccauuuccgggcaaugcaggc

SEQ ID NO: 1634509 - RNA, 15 nt, Pseudomonas putida KT2440
gccccaaaccaggcc

SEQ ID NO: 1634510 - RNA, 18 nt, Pseudomonas putida KT2440
gccccaaaaaaccggggu

SEQ ID NO: 1634511 - RNA, 23 nt, Pseudomonas putida KT2440
gcccauuucgcgggucaggggga

SEQ ID NO: 1634512 - RNA, 17 nt, Pseudomonas putida KT2440
gccccacaacggccgca

SEQ ID NO: 1634513 - RNA, 22 nt, Pseudomonas putida KT2440
gccccacaauaagaugcggcgc

SEQ ID NO: 1634514 - RNA, 18 nt, Pseudomonas putida KT2440
gccccaauggcgaacccc

SEQ ID NO: 1634515 - RNA, 19 nt, Pseudomonas putida KT2440
gccccaauggcgaacccca

SEQ ID NO: 1634516 - RNA, 20 nt, Pseudomonas putida KT2440
gccccaauggcgaaccccag

SEQ ID NO: 1634517 - RNA, 16 nt, Pseudomonas putida KT2440
gccccaacugcauccg

SEQ ID NO: 1634518 - RNA, 20 nt, Pseudomonas putida KT2440
gccccaacugcauccgcccc

SEQ ID NO: 1634519 - RNA, 15 nt, Pseudomonas putida KT2440
gcccagguugccuca

SEQ ID NO: 1634520 - RNA, 16 nt, Pseudomonas putida KT2440
gcccaguacgccaccc

SEQ ID NO: 1634521 - RNA, 18 nt, Pseudomonas putida KT2440
gcccaguacgccacccag

SEQ ID NO: 1634522 - RNA, 18 nt, Pseudomonas putida KT2440
gcccagugcgcgcaacag

SEQ ID NO: 1634523 - RNA, 23 nt, Pseudomonas putida KT2440
gcccagugcgcgcaacagugccc

SEQ ID NO: 1634524 - RNA, 16 nt, Pseudomonas putida KT2440
gcccaggcgcaucacg

SEQ ID NO: 1634525 - RNA, 16 nt, Pseudomonas putida KT2440
gcccaggcgccgcagc

SEQ ID NO: 1634526 - RNA, 14 nt, Pseudomonas putida KT2440
gcccaugccaagcc

SEQ ID NO: 1634527 - RNA, 20 nt, Pseudomonas putida KT2440
gcccaugccacccaugccac

SEQ ID NO: 1634528 - RNA, 22 nt, Pseudomonas putida KT2440
gcccaucugcacgucauagccc

SEQ ID NO: 1634529 - RNA, 15 nt, Pseudomonas putida KT2440
gcccaugaaguucau

SEQ ID NO: 1634530 - RNA, 18 nt, Pseudomonas putida KT2440
gcccaugauguggcuggu

SEQ ID NO: 1634531 - RNA, 16 nt, Pseudomonas putida KT2440
gcccaguucguccacc

SEQ ID NO: 1634532 - RNA, 22 nt, Pseudomonas putida KT2440
gcccaguucguccaccgacggc

SEQ ID NO: 1634533 - RNA, 15 nt, Pseudomonas putida KT2440
gcccaugaagcggcc

SEQ ID NO: 1634534 - RNA, 18 nt, Pseudomonas putida KT2440
gcccaugaagcggccggc

SEQ ID NO: 1634535 - RNA, 17 nt, Pseudomonas putida KT2440
gcccaucucaggcccac

SEQ ID NO: 1634536 - RNA, 14 nt, Pseudomonas putida KT2440
gcccaggccgccga

SEQ ID NO: 1634537 - RNA, 18 nt, Pseudomonas putida KT2440
gcccaggcccgacuccac

SEQ ID NO: 1634538 - RNA, 14 nt, Pseudomonas putida KT2440
gcccagcgccgccg

SEQ ID NO: 1634539 - RNA, 16 nt, Pseudomonas putida KT2440
gcccagcgccgccggc

SEQ ID NO: 1634540 - RNA, 16 nt, Pseudomonas putida KT2440
gcccagcgccaccggc

SEQ ID NO: 1634541 - RNA, 18 nt, Pseudomonas putida KT2440
gcccagcaacagccccau

SEQ ID NO: 1634542 - RNA, 14 nt, Pseudomonas putida KT2440
gcccagcaacugcg

SEQ ID NO: 1634543 - RNA, 22 nt, Pseudomonas putida KT2440
gcccagcaacugcgcccaaugc

SEQ ID NO: 1634544 - RNA, 16 nt, Pseudomonas putida KT2440
gcccagcagccaacgc

SEQ ID NO: 1634545 - RNA, 21 nt, Pseudomonas putida KT2440
gcccagcagccaacgccccag

SEQ ID NO: 1634546 - RNA, 10 nt, Pseudomonas putida KT2440
gcccagcagc

SEQ ID NO: 1634547 - RNA, 15 nt, Pseudomonas putida KT2440
gcccagaucagcagc

SEQ ID NO: 1634548 - RNA, 17 nt, Pseudomonas putida KT2440
gcccagaucagcagcac

SEQ ID NO: 1634549 - RNA, 12 nt, Pseudomonas putida KT2440
gcccagaucacu

SEQ ID NO: 1634550 - RNA, 15 nt, Pseudomonas putida KT2440
gcccagaucacuucc

SEQ ID NO: 1634551 - RNA, 12 nt, Pseudomonas putida KT2440
gcccaaggugca

SEQ ID NO: 1634552 - RNA, 18 nt, Pseudomonas putida KT2440
gcccaaguacaccggcag

SEQ ID NO: 1634553 - RNA, 19 nt, Pseudomonas putida KT2440
gcccaaguacaccggcagc

SEQ ID NO: 1634554 - RNA, 21 nt, Pseudomonas putida KT2440
gcccaaguacaccggcagcac

SEQ ID NO: 1634555 - RNA, 17 nt, Pseudomonas putida KT2440
gcccaagcgcuccgcca

SEQ ID NO: 1634556 - RNA, 13 nt, Pseudomonas putida KT2440
gcccaagcggcag

SEQ ID NO: 1634557 - RNA, 22 nt, Pseudomonas putida KT2440
gccccagucauccgggccguca

SEQ ID NO: 1634558 - RNA, 17 nt, Pseudomonas putida KT2440
gccccauagccugcugc

SEQ ID NO: 1634559 - RNA, 21 nt, Pseudomonas putida KT2440
gccccauagccugcugcuccc

SEQ ID NO: 1634560 - RNA, 23 nt, Pseudomonas putida KT2440
gccccauagccugcugcucccca

SEQ ID NO: 1634561 - RNA, 22 nt, Pseudomonas putida KT2440
gccccagugugcaaacacccag

SEQ ID NO: 1634562 - RNA, 14 nt, Pseudomonas putida KT2440
gccccagucuucgu

SEQ ID NO: 1634563 - RNA, 15 nt, Pseudomonas putida KT2440
gccccaggccgcggc

SEQ ID NO: 1634564 - RNA, 16 nt, Pseudomonas putida KT2440
gccccaggccgcggcc

SEQ ID NO: 1634565 - RNA, 17 nt, Pseudomonas putida KT2440
gccccaggccgcggccg

SEQ ID NO: 1634566 - RNA, 16 nt, Pseudomonas putida KT2440
gccccaggcggugcac

SEQ ID NO: 1634567 - RNA, 15 nt, Pseudomonas putida KT2440
gccccagggggcagc

SEQ ID NO: 1634568 - RNA, 14 nt, Pseudomonas putida KT2440
gccccagcccgccc

SEQ ID NO: 1634569 - RNA, 12 nt, Pseudomonas putida KT2440
gccccagccggu

SEQ ID NO: 1634570 - RNA, 14 nt, Pseudomonas putida KT2440
gccccagcgcgcca

SEQ ID NO: 1634571 - RNA, 19 nt, Pseudomonas putida KT2440
gccccagcgcgccagcagg

SEQ ID NO: 1634572 - RNA, 14 nt, Pseudomonas putida KT2440
gccccagccucagc

SEQ ID NO: 1634573 - RNA, 15 nt, Pseudomonas putida KT2440
gccccagccucagcu

SEQ ID NO: 1634574 - RNA, 23 nt, Pseudomonas putida KT2440
gccccagccucagcuggccggcu

SEQ ID NO: 1634575 - RNA, 17 nt, Pseudomonas putida KT2440
gccccagcggcaaccug

SEQ ID NO: 1634576 - RNA, 15 nt, Pseudomonas putida KT2440
gccccagcggcagca

SEQ ID NO: 1634577 - RNA, 19 nt, Pseudomonas putida KT2440
gccccagcggcagcagcag

SEQ ID NO: 1634578 - RNA, 18 nt, Pseudomonas putida KT2440
gccccgcucgccuggcca

SEQ ID NO: 1634579 - RNA, 12 nt, Pseudomonas putida KT2440
gccccgcaggcc

SEQ ID NO: 1634580 - RNA, 14 nt, Pseudomonas putida KT2440
gccccgcaggccgc

SEQ ID NO: 1634581 - RNA, 16 nt, Pseudomonas putida KT2440
gccccgcaggccgccg

SEQ ID NO: 1634582 - RNA, 19 nt, Pseudomonas putida KT2440
gccccgauacagcgcgccg

SEQ ID NO: 1634583 - RNA, 14 nt, Pseudomonas putida KT2440
gcccccaugaugac

SEQ ID NO: 1634584 - RNA, 13 nt, Pseudomonas putida KT2440
gcccccaucgcag

SEQ ID NO: 1634585 - RNA, 15 nt, Pseudomonas putida KT2440
gcccccccaaggcga

SEQ ID NO: 1634586 - RNA, 13 nt, Pseudomonas putida KT2440
gccccccaggcgg

SEQ ID NO: 1634587 - RNA, 13 nt, Pseudomonas putida KT2440
gccccccugccgc

SEQ ID NO: 1634588 - RNA, 19 nt, Pseudomonas putida KT2440
gccccccuuccgcgugccc

SEQ ID NO: 1634589 - RNA, 20 nt, Pseudomonas putida KT2440
gccccccuuccgcgugcccc

SEQ ID NO: 1634590 - RNA, 13 nt, Pseudomonas putida KT2440
gccccccgccagc

SEQ ID NO: 1634591 - RNA, 16 nt, Pseudomonas putida KT2440
gccccccggcuccaca

SEQ ID NO: 1634592 - RNA, 21 nt, Pseudomonas putida KT2440
gccccgaggaaguacgccggc

SEQ ID NO: 1634593 - RNA, 23 nt, Pseudomonas putida KT2440
gccccgaggaaguacgccggcgc

SEQ ID NO: 1634594 - RNA, 17 nt, Pseudomonas putida KT2440
gccccgaccaccgccuc

SEQ ID NO: 1634595 - RNA, 17 nt, Pseudomonas putida KT2440
gcccccgccacagguga

SEQ ID NO: 1634596 - RNA, 14 nt, Pseudomonas putida KT2440
gcccccgccacccc

SEQ ID NO: 1634597 - RNA, 18 nt, Pseudomonas putida KT2440
gcccgccaaaaggcccga

SEQ ID NO: 1634598 - RNA, 21 nt, Pseudomonas putida KT2440
gcccgcaucaaacgaugcggg

SEQ ID NO: 1634599 - RNA, 11 nt, Pseudomonas putida KT2440
gcccgcagcuu

SEQ ID NO: 1634600 - RNA, 21 nt, Pseudomonas putida KT2440
gcccgcaucguuugaugcggg

SEQ ID NO: 1634601 - RNA, 15 nt, Pseudomonas putida KT2440
gcccgcaugcaaccc

SEQ ID NO: 1634602 - RNA, 17 nt, Pseudomonas putida KT2440
gcccgcaugcaacccgc

SEQ ID NO: 1634603 - RNA, 19 nt, Pseudomonas putida KT2440
gcccgcaugcaacccgcau

SEQ ID NO: 1634604 - RNA, 15 nt, Pseudomonas putida KT2440
gcccgaccuuggcga

SEQ ID NO: 1634605 - RNA, 15 nt, Pseudomonas putida KT2440
gcccgcaacaaccug

SEQ ID NO: 1634606 - RNA, 22 nt, Pseudomonas putida KT2440
gcccgcaacagaucccgcuccu

SEQ ID NO: 1634607 - RNA, 18 nt, Pseudomonas putida KT2440
gcccgcaaccucggccgc

SEQ ID NO: 1634608 - RNA, 15 nt, Pseudomonas putida KT2440
gccccucaggcacau

SEQ ID NO: 1634609 - RNA, 22 nt, Pseudomonas putida KT2440
gccccucauucaaagccugcuc

SEQ ID NO: 1634610 - RNA, 23 nt, Pseudomonas putida KT2440
gccccucauucaaagccugcucc

SEQ ID NO: 1634611 - RNA, 22 nt, Pseudomonas putida KT2440
gccccuccacccaccuuggccc

SEQ ID NO: 1634612 - RNA, 21 nt, Pseudomonas putida KT2440
gccccucaaugcugccuccgc

SEQ ID NO: 1634613 - RNA, 23 nt, Pseudomonas putida KT2440
gccccucaaugcugccuccgcca

SEQ ID NO: 1634614 - RNA, 13 nt, Pseudomonas putida KT2440
gccccuaccgcca

SEQ ID NO: 1634615 - RNA, 15 nt, Pseudomonas putida KT2440
gccccuacgcugguu

SEQ ID NO: 1634616 - RNA, 20 nt, Pseudomonas putida KT2440
gccccucgaacagcgccggc

SEQ ID NO: 1634617 - RNA, 13 nt, Pseudomonas putida KT2440
gccccugcgccgc

SEQ ID NO: 1634618 - RNA, 18 nt, Pseudomonas putida KT2440
gccccugcgccgccaccu

SEQ ID NO: 1634619 - RNA, 15 nt, Pseudomonas putida KT2440
gccccugcaauuucu

SEQ ID NO: 1634620 - RNA, 17 nt, Pseudomonas putida KT2440
gccccugcuugaccaug

SEQ ID NO: 1634621 - RNA, 19 nt, Pseudomonas putida KT2440
gccccugauaggacugcuu

SEQ ID NO: 1634622 - RNA, 23 nt, Pseudomonas putida KT2440
gccccugcacaucacgcgaccuc

SEQ ID NO: 1634623 - RNA, 14 nt, Pseudomonas putida KT2440
gccccugccagcac

SEQ ID NO: 1634624 - RNA, 15 nt, Pseudomonas putida KT2440
gccccugccagcacc

SEQ ID NO: 1634625 - RNA, 21 nt, Pseudomonas putida KT2440
gccccugccagcaccagcgcg

SEQ ID NO: 1634626 - RNA, 18 nt, Pseudomonas putida KT2440
gcccgacaaagaagcgcc

SEQ ID NO: 1634627 - RNA, 22 nt, Pseudomonas putida KT2440
gccccuggcugucccaugcugc

SEQ ID NO: 1634628 - RNA, 16 nt, Pseudomonas putida KT2440
gccaccgacgaacagg

SEQ ID NO: 1634629 - RNA, 20 nt, Pseudomonas putida KT2440
gccacccuccgggucaggcc

SEQ ID NO: 1634630 - RNA, 15 nt, Pseudomonas putida KT2440
gccaccgacuccggc

SEQ ID NO: 1634631 - RNA, 23 nt, Pseudomonas putida KT2440
gccaccggcgcugcguuggccau

SEQ ID NO: 1634632 - RNA, 22 nt, Pseudomonas putida KT2440
gccaccggcagcaccugccagc

SEQ ID NO: 1634633 - RNA, 15 nt, Pseudomonas putida KT2440
gccaccuucgccagg

SEQ ID NO: 1634634 - RNA, 23 nt, Pseudomonas putida KT2440
gccaccuuacuugcacaucccag

SEQ ID NO: 1634635 - RNA, 16 nt, Pseudomonas putida KT2440
gccacccggaccagcg

SEQ ID NO: 1634636 - RNA, 14 nt, Pseudomonas putida KT2440
gccacccgcugggc

SEQ ID NO: 1634637 - RNA, 15 nt, Pseudomonas putida KT2440
gccaccccgcaaagc

SEQ ID NO: 1634638 - RNA, 16 nt, Pseudomonas putida KT2440
gccaccccgcaaagcc

SEQ ID NO: 1634639 - RNA, 13 nt, Pseudomonas putida KT2440
gccaccccaggcc

SEQ ID NO: 1634640 - RNA, 16 nt, Pseudomonas putida KT2440
gccacccccgccgcca

SEQ ID NO: 1634641 - RNA, 22 nt, Pseudomonas putida KT2440
gccacccagaugcgggcccugg

SEQ ID NO: 1634642 - RNA, 22 nt, Pseudomonas putida KT2440
gccacccaggcccugacgccag

SEQ ID NO: 1634643 - RNA, 21 nt, Pseudomonas putida KT2440
gccaccaugaacagcacgccc

SEQ ID NO: 1634644 - RNA, 19 nt, Pseudomonas putida KT2440
gccaccaugcucaccgcca

SEQ ID NO: 1634645 - RNA, 18 nt, Pseudomonas putida KT2440
gccacccaaggcauccag

SEQ ID NO: 1634646 - RNA, 19 nt, Pseudomonas putida KT2440
gccacccaaggcauccagc

SEQ ID NO: 1634647 - RNA, 17 nt, Pseudomonas putida KT2440
gccacagcgccaacgcc

SEQ ID NO: 1634648 - RNA, 15 nt, Pseudomonas putida KT2440
gccacacugcucagu

SEQ ID NO: 1634649 - RNA, 20 nt, Pseudomonas putida KT2440
gccacguugaucgucggccc

SEQ ID NO: 1634650 - RNA, 15 nt, Pseudomonas putida KT2440
gccacguacagagau

SEQ ID NO: 1634651 - RNA, 19 nt, Pseudomonas putida KT2440
gccacguacagagauacgc

SEQ ID NO: 1634652 - RNA, 21 nt, Pseudomonas putida KT2440
gccacucuucaccaugggccu

SEQ ID NO: 1634653 - RNA, 14 nt, Pseudomonas putida KT2440
gccacugaccagcc

SEQ ID NO: 1634654 - RNA, 19 nt, Pseudomonas putida KT2440
gccacugaccagcccggcu

SEQ ID NO: 1634655 - RNA, 20 nt, Pseudomonas putida KT2440
gccacugccacuggucgccu

SEQ ID NO: 1634656 - RNA, 16 nt, Pseudomonas putida KT2440
gccacugguaguucau

SEQ ID NO: 1634657 - RNA, 14 nt, Pseudomonas putida KT2440
gccacgaacaggcg

SEQ ID NO: 1634658 - RNA, 13 nt, Pseudomonas putida KT2440
gccacggccaccu

SEQ ID NO: 1634659 - RNA, 19 nt, Pseudomonas putida KT2440
gccacggcaauggcccgcu

SEQ ID NO: 1634660 - RNA, 20 nt, Pseudomonas putida KT2440
gccacgaucgacaaccccag

SEQ ID NO: 1634661 - RNA, 18 nt, Pseudomonas putida KT2440
gccacgacgugucagugg

SEQ ID NO: 1634662 - RNA, 18 nt, Pseudomonas putida KT2440
gccacgguguauccagcc

SEQ ID NO: 1634663 - RNA, 19 nt, Pseudomonas putida KT2440
gccacgguguauccagccc

SEQ ID NO: 1634664 - RNA, 16 nt, Pseudomonas putida KT2440
gccacggucuggcgca

SEQ ID NO: 1634665 - RNA, 23 nt, Pseudomonas putida KT2440
gccacgguaggccuugaccagcu

SEQ ID NO: 1634666 - RNA, 20 nt, Pseudomonas putida KT2440
gccaagggucgacaccagga

SEQ ID NO: 1634667 - RNA, 15 nt, Pseudomonas putida KT2440
gccaagguaaucugg

SEQ ID NO: 1634668 - RNA, 16 nt, Pseudomonas putida KT2440
gccaaggucagcaagc

SEQ ID NO: 1634669 - RNA, 20 nt, Pseudomonas putida KT2440
gccaaggccucgaacagcag

SEQ ID NO: 1634670 - RNA, 22 nt, Pseudomonas putida KT2440
gccaaggccucgaacagcaguu

SEQ ID NO: 1634671 - RNA, 16 nt, Pseudomonas putida KT2440
gccaaggcguggcuug

SEQ ID NO: 1634672 - RNA, 14 nt, Pseudomonas putida KT2440
gccaaggcuagcca

SEQ ID NO: 1634673 - RNA, 13 nt, Pseudomonas putida KT2440
gccaagccacugg

SEQ ID NO: 1634674 - RNA, 21 nt, Pseudomonas putida KT2440
gccaagccacuggccagcaga

SEQ ID NO: 1634675 - RNA, 20 nt, Pseudomonas putida KT2440
gccaagcauucgcauuacca

SEQ ID NO: 1634676 - RNA, 22 nt, Pseudomonas putida KT2440
gccaagccgccauugcccagcc

SEQ ID NO: 1634677 - RNA, 14 nt, Pseudomonas putida KT2440
gccaagcccacaca

SEQ ID NO: 1634678 - RNA, 19 nt, Pseudomonas putida KT2440
gccaagcggccccaaugaa

SEQ ID NO: 1634679 - RNA, 14 nt, Pseudomonas putida KT2440
gccaaguacggcca

SEQ ID NO: 1634680 - RNA, 18 nt, Pseudomonas putida KT2440
gccacaaaaucacaggcc

SEQ ID NO: 1634681 - RNA, 20 nt, Pseudomonas putida KT2440
gccacaaaaucacaggccau

SEQ ID NO: 1634682 - RNA, 14 nt, Pseudomonas putida KT2440
gccaauugcgccau

SEQ ID NO: 1634683 - RNA, 18 nt, Pseudomonas putida KT2440
gccaauugcggacucaua

SEQ ID NO: 1634684 - RNA, 18 nt, Pseudomonas putida KT2440
gccaaugcugaugaagcc

SEQ ID NO: 1634685 - RNA, 18 nt, Pseudomonas putida KT2440
gccaaucucguugcgcca

SEQ ID NO: 1634686 - RNA, 20 nt, Pseudomonas putida KT2440
gccaacuccccacccaggug

SEQ ID NO: 1634687 - RNA, 16 nt, Pseudomonas putida KT2440
gccaagauccgcggca

SEQ ID NO: 1634688 - RNA, 16 nt, Pseudomonas putida KT2440
gccaacgcccccgcca

SEQ ID NO: 1634689 - RNA, 15 nt, Pseudomonas putida KT2440
gccaaccggcuugua

SEQ ID NO: 1634690 - RNA, 20 nt, Pseudomonas putida KT2440
gccaaccgcuaugccaagcc

SEQ ID NO: 1634691 - RNA, 15 nt, Pseudomonas putida KT2440
gccaaccgcuucacc

SEQ ID NO: 1634692 - RNA, 13 nt, Pseudomonas putida KT2440
gccaaccgcccca

SEQ ID NO: 1634693 - RNA, 18 nt, Pseudomonas putida KT2440
gccaaccugaucauucac

SEQ ID NO: 1634694 - RNA, 14 nt, Pseudomonas putida KT2440
gccaaccuugacca

SEQ ID NO: 1634695 - RNA, 13 nt, Pseudomonas putida KT2440
gccaaccacccgg

SEQ ID NO: 1634696 - RNA, 22 nt, Pseudomonas putida KT2440
gccaaccacccgggcagcgggc

SEQ ID NO: 1634697 - RNA, 15 nt, Pseudomonas putida KT2440
gccaaccagcucacc

SEQ ID NO: 1634698 - RNA, 16 nt, Pseudomonas putida KT2440
gccaaccccuccuuca

SEQ ID NO: 1634699 - RNA, 23 nt, Pseudomonas putida KT2440
gccaaccccuccuucagguaauc

SEQ ID NO: 1634700 - RNA, 14 nt, Pseudomonas putida KT2440
gccaacaggcagca

SEQ ID NO: 1634701 - RNA, 20 nt, Pseudomonas putida KT2440
gccaacagcacccgcccauc

SEQ ID NO: 1634702 - RNA, 19 nt, Pseudomonas putida KT2440
gccaacagcaguugcugcu

SEQ ID NO: 1634703 - RNA, 23 nt, Pseudomonas putida KT2440
gccaaaccucaaaugcgcccugc

SEQ ID NO: 1634704 - RNA, 15 nt, Pseudomonas putida KT2440
gccaaaccccagcaa

SEQ ID NO: 1634705 - RNA, 20 nt, Pseudomonas putida KT2440
gccaaaccccagcaaggcaa

SEQ ID NO: 1634706 - RNA, 23 nt, Pseudomonas putida KT2440
gccaaacaggaucuccucggcca

SEQ ID NO: 1634707 - RNA, 18 nt, Pseudomonas putida KT2440
gccaacaccaccuccacc

SEQ ID NO: 1634708 - RNA, 21 nt, Pseudomonas putida KT2440
gccaacaccaccuccaccccg

SEQ ID NO: 1634709 - RNA, 17 nt, Pseudomonas putida KT2440
gccaacacccucaccca

SEQ ID NO: 1634710 - RNA, 16 nt, Pseudomonas putida KT2440
gcaucacccgccccuc

SEQ ID NO: 1634711 - RNA, 20 nt, Pseudomonas putida KT2440
gcaucaccacgcccuggccc

SEQ ID NO: 1634712 - RNA, 15 nt, Pseudomonas putida KT2440
gcaucaauggcuggg

SEQ ID NO: 1634713 - RNA, 14 nt, Pseudomonas putida KT2440
gcaucaaugcagga

SEQ ID NO: 1634714 - RNA, 18 nt, Pseudomonas putida KT2440
gcaucacgccgcgcuggc

SEQ ID NO: 1634715 - RNA, 12 nt, Pseudomonas putida KT2440
gcaucacgcugg

SEQ ID NO: 1634716 - RNA, 19 nt, Pseudomonas putida KT2440
gcauaguccaggaagcagg

SEQ ID NO: 1634717 - RNA, 22 nt, Pseudomonas putida KT2440
gcaguacuugcuggauuccgac

SEQ ID NO: 1634718 - RNA, 15 nt, Pseudomonas putida KT2440
gcaguagagccccca

SEQ ID NO: 1634719 - RNA, 20 nt, Pseudomonas putida KT2440
gcauacagcuugcccaucac

SEQ ID NO: 1634720 - RNA, 15 nt, Pseudomonas putida KT2440
gcauacaggaccagg

SEQ ID NO: 1634721 - RNA, 17 nt, Pseudomonas putida KT2440
gcauaccgcaacaccug

SEQ ID NO: 1634722 - RNA, 21 nt, Pseudomonas putida KT2440
gcauaccgcaacaccugccgc

SEQ ID NO: 1634723 - RNA, 14 nt, Pseudomonas putida KT2440
gcauccccgccagu

SEQ ID NO: 1634724 - RNA, 23 nt, Pseudomonas putida KT2440
gcaucccuggcacgcccggcacc

SEQ ID NO: 1634725 - RNA, 21 nt, Pseudomonas putida KT2440
gcauccgccaugggccugcac

SEQ ID NO: 1634726 - RNA, 14 nt, Pseudomonas putida KT2440
gcauccgccccagg

SEQ ID NO: 1634727 - RNA, 17 nt, Pseudomonas putida KT2440
gcaucagcacacccagc

SEQ ID NO: 1634728 - RNA, 18 nt, Pseudomonas putida KT2440
gcaucagcacacccagca

SEQ ID NO: 1634729 - RNA, 22 nt, Pseudomonas putida KT2440
gcaucgcgcacuugccagccgc

SEQ ID NO: 1634730 - RNA, 16 nt, Pseudomonas putida KT2440
gcaucgccuccagcgc

SEQ ID NO: 1634731 - RNA, 19 nt, Pseudomonas putida KT2440
gcaucggcguugcggugca

SEQ ID NO: 1634732 - RNA, 19 nt, Pseudomonas putida KT2440
gcaucgggccgauggcgca

SEQ ID NO: 1634733 - RNA, 19 nt, Pseudomonas putida KT2440
gcaucggccgagccggucg

SEQ ID NO: 1634734 - RNA, 22 nt, Pseudomonas putida KT2440
gcauguucaacgcaaugggcac

SEQ ID NO: 1634735 - RNA, 17 nt, Pseudomonas putida KT2440
gcauucugccaugaucc

SEQ ID NO: 1634736 - RNA, 19 nt, Pseudomonas putida KT2440
gcaugacccuaugcgugaa

SEQ ID NO: 1634737 - RNA, 21 nt, Pseudomonas putida KT2440
gcaugacaaacgccagcaugc

SEQ ID NO: 1634738 - RNA, 20 nt, Pseudomonas putida KT2440
gcaugaaggacaucaccagg

SEQ ID NO: 1634739 - RNA, 22 nt, Pseudomonas putida KT2440
gcauggucacguagaacaggcc

SEQ ID NO: 1634740 - RNA, 11 nt, Pseudomonas putida KT2440
gcaugggugag

SEQ ID NO: 1634741 - RNA, 22 nt, Pseudomonas putida KT2440
gcauggguuguggcuuggccca

SEQ ID NO: 1634742 - RNA, 13 nt, Pseudomonas putida KT2440
gcaugggccacuu

SEQ ID NO: 1634743 - RNA, 15 nt, Pseudomonas putida KT2440
gcaugggccagggau

SEQ ID NO: 1634744 - RNA, 22 nt, Pseudomonas putida KT2440
gcaugcguuguucgaucagccg

SEQ ID NO: 1634745 - RNA, 16 nt, Pseudomonas putida KT2440
gcaugcgucuggcggc

SEQ ID NO: 1634746 - RNA, 17 nt, Pseudomonas putida KT2440
gcaugcgucuggcggcc

SEQ ID NO: 1634747 - RNA, 17 nt, Pseudomonas putida KT2440
gcaugcucaucgcggcc

SEQ ID NO: 1634748 - RNA, 20 nt, Pseudomonas putida KT2440
gcauggcguuguccagcagg

SEQ ID NO: 1634749 - RNA, 21 nt, Pseudomonas putida KT2440
gcauggcguuguccagcaggu

SEQ ID NO: 1634750 - RNA, 23 nt, Pseudomonas putida KT2440
gcauggcgucggcgauggcgucc

SEQ ID NO: 1634751 - RNA, 18 nt, Pseudomonas putida KT2440
gcauggcgugcccggcaa

SEQ ID NO: 1634752 - RNA, 13 nt, Pseudomonas putida KT2440
gcaugcgcccccc

SEQ ID NO: 1634753 - RNA, 16 nt, Pseudomonas putida KT2440
gcaugcgcgacagcau

SEQ ID NO: 1634754 - RNA, 11 nt, Pseudomonas putida KT2440
gcaugccuucc

SEQ ID NO: 1634755 - RNA, 16 nt, Pseudomonas putida KT2440
gcaugcccgcucccac

SEQ ID NO: 1634756 - RNA, 17 nt, Pseudomonas putida KT2440
gcaugaucaccgccagc

SEQ ID NO: 1634757 - RNA, 15 nt, Pseudomonas putida KT2440
gcaugacuuccaggu

SEQ ID NO: 1634758 - RNA, 16 nt, Pseudomonas putida KT2440
gcaugagccuggccgg

SEQ ID NO: 1634759 - RNA, 13 nt, Pseudomonas putida KT2440
gcaggucgccauc

SEQ ID NO: 1634760 - RNA, 19 nt, Pseudomonas putida KT2440
gcaggucgauguccaggcc

SEQ ID NO: 1634761 - RNA, 20 nt, Pseudomonas putida KT2440
gcaggucggccagcucggca

SEQ ID NO: 1634762 - RNA, 21 nt, Pseudomonas putida KT2440
gcaggucgaacagcccccgga

SEQ ID NO: 1634763 - RNA, 13 nt, Pseudomonas putida KT2440
gcaggucgacccg

SEQ ID NO: 1634764 - RNA, 16 nt, Pseudomonas putida KT2440
gcaggucgacccgcgc

SEQ ID NO: 1634765 - RNA, 22 nt, Pseudomonas putida KT2440
gcaggucgacccgcgccagggu

SEQ ID NO: 1634766 - RNA, 23 nt, Pseudomonas putida KT2440
gcaggucgacgaucgccgccacg

SEQ ID NO: 1634767 - RNA, 13 nt, Pseudomonas putida KT2440
gcaggucagcgcu

SEQ ID NO: 1634768 - RNA, 21 nt, Pseudomonas putida KT2440
gcaggugcccaagcggcacua

SEQ ID NO: 1634769 - RNA, 14 nt, Pseudomonas putida KT2440
gcaggugcgcaggc

SEQ ID NO: 1634770 - RNA, 23 nt, Pseudomonas putida KT2440
gcaggucgugcuugacccccuuc

SEQ ID NO: 1634771 - RNA, 12 nt, Pseudomonas putida KT2440
gcaggugcaggc

SEQ ID NO: 1634772 - RNA, 12 nt, Pseudomonas putida KT2440
gcaggugcaggu

SEQ ID NO: 1634773 - RNA, 13 nt, Pseudomonas putida KT2440
gcaggugcagguu

SEQ ID NO: 1634774 - RNA, 18 nt, Pseudomonas putida KT2440
gcagguucgaccagaaca

SEQ ID NO: 1634775 - RNA, 19 nt, Pseudomonas putida KT2440
gcagguucgacucccgcug

SEQ ID NO: 1634776 - RNA, 14 nt, Pseudomonas putida KT2440
gcagguucaacggc

SEQ ID NO: 1634777 - RNA, 16 nt, Pseudomonas putida KT2440
gcagguugcuggccuu

SEQ ID NO: 1634778 - RNA, 23 nt, Pseudomonas putida KT2440
gcagguucuuaucuggggugggg

SEQ ID NO: 1634779 - RNA, 18 nt, Pseudomonas putida KT2440
gcagguugaacagcagcg

SEQ ID NO: 1634780 - RNA, 23 nt, Pseudomonas putida KT2440
gcagguugaacagguugcugccg

SEQ ID NO: 1634781 - RNA, 22 nt, Pseudomonas putida KT2440
gcaguacauagaacagcaucaa

SEQ ID NO: 1634782 - RNA, 18 nt, Pseudomonas putida KT2440
gcagguacucgccgggcg

SEQ ID NO: 1634783 - RNA, 21 nt, Pseudomonas putida KT2440
gcagguacucugucacccgcu

SEQ ID NO: 1634784 - RNA, 23 nt, Pseudomonas putida KT2440
gcagguacagcaccccguccagc

SEQ ID NO: 1634785 - RNA, 21 nt, Pseudomonas putida KT2440
gcagguaaaaaucaugcaguu

SEQ ID NO: 1634786 - RNA, 14 nt, Pseudomonas putida KT2440
gcagguaccaguug

SEQ ID NO: 1634787 - RNA, 18 nt, Pseudomonas putida KT2440
gcagggugugcugcugcc

SEQ ID NO: 1634788 - RNA, 16 nt, Pseudomonas putida KT2440
gcagguaaacccgcgc

SEQ ID NO: 1634789 - RNA, 21 nt, Pseudomonas putida KT2440
gcagguaucacgcgagcuguu

SEQ ID NO: 1634790 - RNA, 15 nt, Pseudomonas putida KT2440
gcagguccagcuccg

SEQ ID NO: 1634791 - RNA, 13 nt, Pseudomonas putida KT2440
gcagguagcgccc

SEQ ID NO: 1634792 - RNA, 20 nt, Pseudomonas putida KT2440
gcagggaacugcgcgagcca

SEQ ID NO: 1634793 - RNA, 17 nt, Pseudomonas putida KT2440
gcagggaagguggccgg

SEQ ID NO: 1634794 - RNA, 18 nt, Pseudomonas putida KT2440
gcagggugccuucagggg

SEQ ID NO: 1634795 - RNA, 18 nt, Pseudomonas putida KT2440
gcagggucgcgccccaag

SEQ ID NO: 1634796 - RNA, 23 nt, Pseudomonas putida KT2440
gcagggucgccugaacgcugcgc

SEQ ID NO: 1634797 - RNA, 22 nt, Pseudomonas putida KT2440
gcaggccccugcaacagggcgc

SEQ ID NO: 1634798 - RNA, 14 nt, Pseudomonas putida KT2440
gcaggccauggcgg

SEQ ID NO: 1634799 - RNA, 21 nt, Pseudomonas putida KT2440
gcagcucuugucgacagugaa

SEQ ID NO: 1634800 - RNA, 17 nt, Pseudomonas putida KT2440
gcaggccaccggcagca

SEQ ID NO: 1634801 - RNA, 21 nt, Pseudomonas putida KT2440
gcaggcauacaggaccaggcc

SEQ ID NO: 1634802 - RNA, 23 nt, Pseudomonas putida KT2440
gcaggcgcucgggggugcacagc

SEQ ID NO: 1634803 - RNA, 17 nt, Pseudomonas putida KT2440
gcaggcgguuggccaug

SEQ ID NO: 1634804 - RNA, 20 nt, Pseudomonas putida KT2440
gcaggcgguuguagaucgcc

SEQ ID NO: 1634805 - RNA, 18 nt, Pseudomonas putida KT2440
gcaggauggugacugcca

SEQ ID NO: 1634806 - RNA, 13 nt, Pseudomonas putida KT2440
gcaggaugucagg

SEQ ID NO: 1634807 - RNA, 16 nt, Pseudomonas putida KT2440
gcaggcagucuugaaa

SEQ ID NO: 1634808 - RNA, 13 nt, Pseudomonas putida KT2440
gcaggcacacccg

SEQ ID NO: 1634809 - RNA, 23 nt, Pseudomonas putida KT2440
gcaggaugacuuucaugcccgcg

SEQ ID NO: 1634810 - RNA, 17 nt, Pseudomonas putida KT2440
gcaggaucuucaugcca

SEQ ID NO: 1634811 - RNA, 19 nt, Pseudomonas putida KT2440
gcagcgggcucgcccacac

SEQ ID NO: 1634812 - RNA, 16 nt, Pseudomonas putida KT2440
gcagcgggcacaggcc

SEQ ID NO: 1634813 - RNA, 18 nt, Pseudomonas putida KT2440
gcagcggcagaucacgca

SEQ ID NO: 1634814 - RNA, 15 nt, Pseudomonas putida KT2440
gcagcggccccuuuc

SEQ ID NO: 1634815 - RNA, 20 nt, Pseudomonas putida KT2440
gcagcgcgucauccgccaac

SEQ ID NO: 1634816 - RNA, 11 nt, Pseudomonas putida KT2440
gcagcgcgugc

SEQ ID NO: 1634817 - RNA, 17 nt, Pseudomonas putida KT2440
gcagcgcgugcuggucc

SEQ ID NO: 1634818 - RNA, 14 nt, Pseudomonas putida KT2440
gcagcgccugcagc

SEQ ID NO: 1634819 - RNA, 22 nt, Pseudomonas putida KT2440
gcagcgcaugcucgcgggccug

SEQ ID NO: 1634820 - RNA, 23 nt, Pseudomonas putida KT2440
gcagcgcaugcucgcgggccugg

SEQ ID NO: 1634821 - RNA, 15 nt, Pseudomonas putida KT2440
gcagcgccgccaggc

SEQ ID NO: 1634822 - RNA, 17 nt, Pseudomonas putida KT2440
gcagcgccgccaggccc

SEQ ID NO: 1634823 - RNA, 22 nt, Pseudomonas putida KT2440
gcagcgccgccaggcccaccac

SEQ ID NO: 1634824 - RNA, 22 nt, Pseudomonas putida KT2440
gcagccuuuuuuuauuuuucug

SEQ ID NO: 1634825 - RNA, 17 nt, Pseudomonas putida KT2440
gcagccugcuccucacu

SEQ ID NO: 1634826 - RNA, 16 nt, Pseudomonas putida KT2440
gcagccguucccgggc

SEQ ID NO: 1634827 - RNA, 18 nt, Pseudomonas putida KT2440
gcagccucuucggccagc

SEQ ID NO: 1634828 - RNA, 21 nt, Pseudomonas putida KT2440
gcagccucuucggccagcaac

SEQ ID NO: 1634829 - RNA, 15 nt, Pseudomonas putida KT2440
gcagcgaugccgggg

SEQ ID NO: 1634830 - RNA, 14 nt, Pseudomonas putida KT2440
gcagccggccuugc

SEQ ID NO: 1634831 - RNA, 16 nt, Pseudomonas putida KT2440
gcagccgcccuugagc

SEQ ID NO: 1634832 - RNA, 21 nt, Pseudomonas putida KT2440
gcagccgcacccaggccacga

SEQ ID NO: 1634833 - RNA, 19 nt, Pseudomonas putida KT2440
gcagccgcaccugcccgcc

SEQ ID NO: 1634834 - RNA, 11 nt, Pseudomonas putida KT2440
gcagcccagcg

SEQ ID NO: 1634835 - RNA, 22 nt, Pseudomonas putida KT2440
gcagccccccuuccgcgugccc

SEQ ID NO: 1634836 - RNA, 12 nt, Pseudomonas putida KT2440
gcagccccgccg

SEQ ID NO: 1634837 - RNA, 22 nt, Pseudomonas putida KT2440
gcagcccuucgcgggcacgccc

SEQ ID NO: 1634838 - RNA, 19 nt, Pseudomonas putida KT2440
gcagccgacugacagguga

SEQ ID NO: 1634839 - RNA, 15 nt, Pseudomonas putida KT2440
gcagcaacugugucu

SEQ ID NO: 1634840 - RNA, 22 nt, Pseudomonas putida KT2440
gcagcaacagguacauguuggu

SEQ ID NO: 1634841 - RNA, 12 nt, Pseudomonas putida KT2440
gcagcacaucac

SEQ ID NO: 1634842 - RNA, 22 nt, Pseudomonas putida KT2440
gcagcacaucacacagcggcag

SEQ ID NO: 1634843 - RNA, 18 nt, Pseudomonas putida KT2440
gcagcaauacgcacaggc

SEQ ID NO: 1634844 - RNA, 15 nt, Pseudomonas putida KT2440
gcagcaagcuggcac

SEQ ID NO: 1634845 - RNA, 13 nt, Pseudomonas putida KT2440
gcagcaaggccau

SEQ ID NO: 1634846 - RNA, 17 nt, Pseudomonas putida KT2440
gcagcaaucgccgccug

SEQ ID NO: 1634847 - RNA, 19 nt, Pseudomonas putida KT2440
gcagcaaucggcagcgcgc

SEQ ID NO: 1634848 - RNA, 14 nt, Pseudomonas putida KT2440
gcagcacacuccac

SEQ ID NO: 1634849 - RNA, 16 nt, Pseudomonas putida KT2440
gcagcacacuccacga

SEQ ID NO: 1634850 - RNA, 16 nt, Pseudomonas putida KT2440
gcagcaccugccagcc

SEQ ID NO: 1634851 - RNA, 18 nt, Pseudomonas putida KT2440
gcagcaccuccaccuuca

SEQ ID NO: 1634852 - RNA, 22 nt, Pseudomonas putida KT2440
gcagcaccgccaccaugcucac

SEQ ID NO: 1634853 - RNA, 20 nt, Pseudomonas putida KT2440
gcagcacuucgaucaggcag

SEQ ID NO: 1634854 - RNA, 23 nt, Pseudomonas putida KT2440
gcagcagagagauugagaggacu

SEQ ID NO: 1634855 - RNA, 15 nt, Pseudomonas putida KT2440
gcagcagcagcccca

SEQ ID NO: 1634856 - RNA, 22 nt, Pseudomonas putida KT2440
gcagcagccucggccucccgcu

SEQ ID NO: 1634857 - RNA, 23 nt, Pseudomonas putida KT2440
gcagcagccucggccucccgcuu

SEQ ID NO: 1634858 - RNA, 21 nt, Pseudomonas putida KT2440
gcagccacgggugcgggcucc

SEQ ID NO: 1634859 - RNA, 20 nt, Pseudomonas putida KT2440
gcagccaaucggcgccagga

SEQ ID NO: 1634860 - RNA, 20 nt, Pseudomonas putida KT2440
gcagccaacgccccaggccg

SEQ ID NO: 1634861 - RNA, 21 nt, Pseudomonas putida KT2440
gcagccacccuccgcacaggc

SEQ ID NO: 1634862 - RNA, 15 nt, Pseudomonas putida KT2440
gcagccagccccaac

SEQ ID NO: 1634863 - RNA, 23 nt, Pseudomonas putida KT2440
gcagccagccccaacccaccagc

SEQ ID NO: 1634864 - RNA, 21 nt, Pseudomonas putida KT2440
gcagccagcaucucggccagu

SEQ ID NO: 1634865 - RNA, 13 nt, Pseudomonas putida KT2440
gcagcccacggcc

SEQ ID NO: 1634866 - RNA, 16 nt, Pseudomonas putida KT2440
gcagcccacggccgcc

SEQ ID NO: 1634867 - RNA, 16 nt, Pseudomonas putida KT2440
gcagcccaaacagcau

SEQ ID NO: 1634868 - RNA, 23 nt, Pseudomonas putida KT2440
gcagcccauucgcgggcaagccc

SEQ ID NO: 1634869 - RNA, 16 nt, Pseudomonas putida KT2440
gcagccccacgcccag

SEQ ID NO: 1634870 - RNA, 22 nt, Pseudomonas putida KT2440
gcagccccacgcccaggcggcg

SEQ ID NO: 1634871 - RNA, 20 nt, Pseudomonas putida KT2440
gcagcagcucccgagccagg

SEQ ID NO: 1634872 - RNA, 13 nt, Pseudomonas putida KT2440
gcagcagcuugca

SEQ ID NO: 1634873 - RNA, 22 nt, Pseudomonas putida KT2440
gcagcagcuuccugugccgcuu

SEQ ID NO: 1634874 - RNA, 12 nt, Pseudomonas putida KT2440
gcagcaggcugg

SEQ ID NO: 1634875 - RNA, 22 nt, Pseudomonas putida KT2440
gcagcaggcuggcgggguggcc

SEQ ID NO: 1634876 - RNA, 12 nt, Pseudomonas putida KT2440
gcagcagcgcga

SEQ ID NO: 1634877 - RNA, 19 nt, Pseudomonas putida KT2440
gcagcagcgcgauaccgac

SEQ ID NO: 1634878 - RNA, 12 nt, Pseudomonas putida KT2440
gcagcagcccuu

SEQ ID NO: 1634879 - RNA, 13 nt, Pseudomonas putida KT2440
gcagcagcgcgcc

SEQ ID NO: 1634880 - RNA, 16 nt, Pseudomonas putida KT2440
gcagcagguccagcuc

SEQ ID NO: 1634881 - RNA, 12 nt, Pseudomonas putida KT2440
gcagcaucacca

SEQ ID NO: 1634882 - RNA, 13 nt, Pseudomonas putida KT2440
gcagcaucaccac

SEQ ID NO: 1634883 - RNA, 21 nt, Pseudomonas putida KT2440
gcagcaucaccacgcccuggc

SEQ ID NO: 1634884 - RNA, 22 nt, Pseudomonas putida KT2440
gcagcaucuucuucacguccag

SEQ ID NO: 1634885 - RNA, 17 nt, Pseudomonas putida KT2440
gcagcaugaacagcgcu

SEQ ID NO: 1634886 - RNA, 16 nt, Pseudomonas putida KT2440
gcagcaucgaccugcc

SEQ ID NO: 1634887 - RNA, 11 nt, Pseudomonas putida KT2440
gcagaaacucg

SEQ ID NO: 1634888 - RNA, 15 nt, Pseudomonas putida KT2440
gcagaacaucgccca

SEQ ID NO: 1634889 - RNA, 18 nt, Pseudomonas putida KT2440
gcagaacauggccgagcu

SEQ ID NO: 1634890 - RNA, 16 nt, Pseudomonas putida KT2440
gcagacacaggcgcuc

SEQ ID NO: 1634891 - RNA, 17 nt, Pseudomonas putida KT2440
gcagacaacgcggcgga

SEQ ID NO: 1634892 - RNA, 21 nt, Pseudomonas putida KT2440
gcagaagguaggcaccccggc

SEQ ID NO: 1634893 - RNA, 19 nt, Pseudomonas putida KT2440
gcagacgucuuccaugccu

SEQ ID NO: 1634894 - RNA, 20 nt, Pseudomonas putida KT2440
gcagacuucgcugucuucca

SEQ ID NO: 1634895 - RNA, 21 nt, Pseudomonas putida KT2440
gcagacuucgcugucuuccag

SEQ ID NO: 1634896 - RNA, 22 nt, Pseudomonas putida KT2440
gcagacccagaaucccaaccuc

SEQ ID NO: 1634897 - RNA, 22 nt, Pseudomonas putida KT2440
gcagaucaucaugcccaaugcc

SEQ ID NO: 1634898 - RNA, 14 nt, Pseudomonas putida KT2440
gcagauuccgcgau

SEQ ID NO: 1634899 - RNA, 14 nt, Pseudomonas putida KT2440
gcagauggccgcuu

SEQ ID NO: 1634900 - RNA, 18 nt, Pseudomonas putida KT2440
gcagaggcguagcaagca

SEQ ID NO: 1634901 - RNA, 19 nt, Pseudomonas putida KT2440
gcagagcggcccugagccu

SEQ ID NO: 1634902 - RNA, 16 nt, Pseudomonas putida KT2440
gcagaguaaccgcggc

SEQ ID NO: 1634903 - RNA, 15 nt, Pseudomonas putida KT2440
gcagagcgccccggc

SEQ ID NO: 1634904 - RNA, 14 nt, Pseudomonas putida KT2440
gcagagcgccagca

SEQ ID NO: 1634905 - RNA, 18 nt, Pseudomonas putida KT2440
gcagagccugcacccagg

SEQ ID NO: 1634906 - RNA, 14 nt, Pseudomonas putida KT2440
gcagagcaugguca

SEQ ID NO: 1634907 - RNA, 20 nt, Pseudomonas putida KT2440
gcagauaaccuggcucggcu

SEQ ID NO: 1634908 - RNA, 23 nt, Pseudomonas putida KT2440
gcagauaaccuggcucggcuggg

SEQ ID NO: 1634909 - RNA, 15 nt, Pseudomonas putida KT2440
gcacugggugcacag

SEQ ID NO: 1634910 - RNA, 15 nt, Pseudomonas putida KT2440
gcacuguuguccaag

SEQ ID NO: 1634911 - RNA, 13 nt, Pseudomonas putida KT2440
gcacugcugcgca

SEQ ID NO: 1634912 - RNA, 17 nt, Pseudomonas putida KT2440
gcacuggccacccccac

SEQ ID NO: 1634913 - RNA, 21 nt, Pseudomonas putida KT2440
gcacuggccagcggcgcggcc

SEQ ID NO: 1634914 - RNA, 11 nt, Pseudomonas putida KT2440
gcacuggcuga

SEQ ID NO: 1634915 - RNA, 20 nt, Pseudomonas putida KT2440
gcacuggcugauagccgcca

SEQ ID NO: 1634916 - RNA, 13 nt, Pseudomonas putida KT2440
gcacugccuggcc

SEQ ID NO: 1634917 - RNA, 18 nt, Pseudomonas putida KT2440
gcacugccuggccacugu

SEQ ID NO: 1634918 - RNA, 18 nt, Pseudomonas putida KT2440
gcacugccuggcucaggc

SEQ ID NO: 1634919 - RNA, 13 nt, Pseudomonas putida KT2440
gcacugccuugcc

SEQ ID NO: 1634920 - RNA, 22 nt, Pseudomonas putida KT2440
gcacugccagcccggcggccag

SEQ ID NO: 1634921 - RNA, 18 nt, Pseudomonas putida KT2440
gcacugccagcgccucac

SEQ ID NO: 1634922 - RNA, 11 nt, Pseudomonas putida KT2440
gcacugcaccc

SEQ ID NO: 1634923 - RNA, 13 nt, Pseudomonas putida KT2440
gcacugcacccuc

SEQ ID NO: 1634924 - RNA, 15 nt, Pseudomonas putida KT2440
gcacuucuguggaaa

SEQ ID NO: 1634925 - RNA, 20 nt, Pseudomonas putida KT2440
gcacuucuguggaaaaccgc

SEQ ID NO: 1634926 - RNA, 21 nt, Pseudomonas putida KT2440
gcacuucgauacccagccagc

SEQ ID NO: 1634927 - RNA, 22 nt, Pseudomonas putida KT2440
gcacuucgauacccagccagcc

SEQ ID NO: 1634928 - RNA, 13 nt, Pseudomonas putida KT2440
gcacuuccacucc

SEQ ID NO: 1634929 - RNA, 12 nt, Pseudomonas putida KT2440
gcacuuccagga

SEQ ID NO: 1634930 - RNA, 21 nt, Pseudomonas putida KT2440
gcacuuccaggaaggccucgc

SEQ ID NO: 1634931 - RNA, 15 nt, Pseudomonas putida KT2440
gcacuuguggcgccu

SEQ ID NO: 1634932 - RNA, 16 nt, Pseudomonas putida KT2440
gcacuuguggcgccua

SEQ ID NO: 1634933 - RNA, 20 nt, Pseudomonas putida KT2440
gcacuuguugcgcagguaca

SEQ ID NO: 1634934 - RNA, 13 nt, Pseudomonas putida KT2440
gcacuuguuggug

SEQ ID NO: 1634935 - RNA, 16 nt, Pseudomonas putida KT2440
gcacuuuugccaccac

SEQ ID NO: 1634936 - RNA, 13 nt, Pseudomonas putida KT2440
gcacuuugccgcc

SEQ ID NO: 1634937 - RNA, 12 nt, Pseudomonas putida KT2440
gcacuaagcgaa

SEQ ID NO: 1634938 - RNA, 15 nt, Pseudomonas putida KT2440
gcacuaccucgcuca

SEQ ID NO: 1634939 - RNA, 16 nt, Pseudomonas putida KT2440
gcacgucgcgcagggc

SEQ ID NO: 1634940 - RNA, 17 nt, Pseudomonas putida KT2440
gcacgucgcgcagggcc

SEQ ID NO: 1634941 - RNA, 19 nt, Pseudomonas putida KT2440
gcacgucgcgcagggccuu

SEQ ID NO: 1634942 - RNA, 20 nt, Pseudomonas putida KT2440
gcacguuauccacagcguuu

SEQ ID NO: 1634943 - RNA, 23 nt, Pseudomonas putida KT2440
gcacgugggucgggaacagcucu

SEQ ID NO: 1634944 - RNA, 17 nt, Pseudomonas putida KT2440
gcacgucagacuuuccu

SEQ ID NO: 1634945 - RNA, 17 nt, Pseudomonas putida KT2440
gcacguaccuggcugca

SEQ ID NO: 1634946 - RNA, 20 nt, Pseudomonas putida KT2440
gcacguaccuggcugcagug

SEQ ID NO: 1634947 - RNA, 16 nt, Pseudomonas putida KT2440
gcacgucacccacuuc

SEQ ID NO: 1634948 - RNA, 21 nt, Pseudomonas putida KT2440
gcacuccgcccguaugcaucc

SEQ ID NO: 1634949 - RNA, 13 nt, Pseudomonas putida KT2440
gcacuccagcgag

SEQ ID NO: 1634950 - RNA, 18 nt, Pseudomonas putida KT2440
gcacuccccaucagcagc

SEQ ID NO: 1634951 - RNA, 13 nt, Pseudomonas putida KT2440
gcacucccccuug

SEQ ID NO: 1634952 - RNA, 17 nt, Pseudomonas putida KT2440
gcacucugcugcucugc

SEQ ID NO: 1634953 - RNA, 18 nt, Pseudomonas putida KT2440
gcacucugcugcucugcc

SEQ ID NO: 1634954 - RNA, 13 nt, Pseudomonas putida KT2440
gcacugaagauuu

SEQ ID NO: 1634955 - RNA, 20 nt, Pseudomonas putida KT2440
gcacugaagauuuucagcca

SEQ ID NO: 1634956 - RNA, 17 nt, Pseudomonas putida KT2440
gcacucggucggcuggc

SEQ ID NO: 1634957 - RNA, 18 nt, Pseudomonas putida KT2440
gcacucggucggcuggca

SEQ ID NO: 1634958 - RNA, 19 nt, Pseudomonas putida KT2440
gcacucguuggcaaagcug

SEQ ID NO: 1634959 - RNA, 16 nt, Pseudomonas putida KT2440
gcacucucccgcagcc

SEQ ID NO: 1634960 - RNA, 17 nt, Pseudomonas putida KT2440
gcacucucgcggugccu

SEQ ID NO: 1634961 - RNA, 13 nt, Pseudomonas putida KT2440
gcacgcuggcugu

SEQ ID NO: 1634962 - RNA, 20 nt, Pseudomonas putida KT2440
gcacgcuucgauccgcgccc

SEQ ID NO: 1634963 - RNA, 17 nt, Pseudomonas putida KT2440
gcacgcuugagcgcgcc

SEQ ID NO: 1634964 - RNA, 23 nt, Pseudomonas putida KT2440
gcacgcuuucgccgaucagcugg

SEQ ID NO: 1634965 - RNA, 19 nt, Pseudomonas putida KT2440
gcacgcgccucuugcaccu

SEQ ID NO: 1634966 - RNA, 16 nt, Pseudomonas putida KT2440
gcacgcgcuuuuccag

SEQ ID NO: 1634967 - RNA, 16 nt, Pseudomonas putida KT2440
gcacgcgccagcagcg

SEQ ID NO: 1634968 - RNA, 20 nt, Pseudomonas putida KT2440
gcacgcguaccccuggcgcu

SEQ ID NO: 1634969 - RNA, 17 nt, Pseudomonas putida KT2440
gcacgccuucagcagcc

SEQ ID NO: 1634970 - RNA, 18 nt, Pseudomonas putida KT2440
gcacgcgcagagaagccg

SEQ ID NO: 1634971 - RNA, 17 nt, Pseudomonas putida KT2440
gcacggcaaaguccagc

SEQ ID NO: 1634972 - RNA, 13 nt, Pseudomonas putida KT2440
gcacggcaccagc

SEQ ID NO: 1634973 - RNA, 16 nt, Pseudomonas putida KT2440
gcacggcaccagcacc

SEQ ID NO: 1634974 - RNA, 15 nt, Pseudomonas putida KT2440
gcacggccagcaccg

SEQ ID NO: 1634975 - RNA, 14 nt, Pseudomonas putida KT2440
gcacggccagcacc

SEQ ID NO: 1634976 - RNA, 19 nt, Pseudomonas putida KT2440
gcacgggcacacuggccac

SEQ ID NO: 1634977 - RNA, 17 nt, Pseudomonas putida KT2440
gcacgggccagcgcggu

SEQ ID NO: 1634978 - RNA, 18 nt, Pseudomonas putida KT2440
gcacguaguaauccggca

SEQ ID NO: 1634979 - RNA, 20 nt, Pseudomonas putida KT2440
gcacguaguaauccggcaac

SEQ ID NO: 1634980 - RNA, 18 nt, Pseudomonas putida KT2440
gcacggucgguagccugg

SEQ ID NO: 1634981 - RNA, 23 nt, Pseudomonas putida KT2440
gcacggguucacggaagaucacc

SEQ ID NO: 1634982 - RNA, 16 nt, Pseudomonas putida KT2440
gcacgaacacguccag

SEQ ID NO: 1634983 - RNA, 14 nt, Pseudomonas putida KT2440
gcacgaacagcggc

SEQ ID NO: 1634984 - RNA, 16 nt, Pseudomonas putida KT2440
gcacgaagcccaguug

SEQ ID NO: 1634985 - RNA, 15 nt, Pseudomonas putida KT2440
gcacgaaggccagca

SEQ ID NO: 1634986 - RNA, 17 nt, Pseudomonas putida KT2440
gcacgaaggccagcaaa

SEQ ID NO: 1634987 - RNA, 21 nt, Pseudomonas putida KT2440
gcaccugguaggucacuucag

SEQ ID NO: 1634988 - RNA, 14 nt, Pseudomonas putida KT2440
gcacgauggcgguc

SEQ ID NO: 1634989 - RNA, 22 nt, Pseudomonas putida KT2440
gcacgauggcggucgaacccag

SEQ ID NO: 1634990 - RNA, 13 nt, Pseudomonas putida KT2440
gcacgagcaugcc

SEQ ID NO: 1634991 - RNA, 17 nt, Pseudomonas putida KT2440
gcacgcaggccagcgca

SEQ ID NO: 1634992 - RNA, 13 nt, Pseudomonas putida KT2440
gcacgcagcaauu

SEQ ID NO: 1634993 - RNA, 16 nt, Pseudomonas putida KT2440
gcacgcaucugcaccg

SEQ ID NO: 1634994 - RNA, 19 nt, Pseudomonas putida KT2440
gcacgcaugucaggggugc

SEQ ID NO: 1634995 - RNA, 20 nt, Pseudomonas putida KT2440
gcacgcauguccuuggccca

SEQ ID NO: 1634996 - RNA, 14 nt, Pseudomonas putida KT2440
gcacgcccagcaac

SEQ ID NO: 1634997 - RNA, 18 nt, Pseudomonas putida KT2440
gcacgcccgaaacacccu

SEQ ID NO: 1634998 - RNA, 16 nt, Pseudomonas putida KT2440
gcacgcccgcucccac

SEQ ID NO: 1634999 - RNA, 17 nt, Pseudomonas putida KT2440
gcacgcccgcucccaca

SEQ ID NO: 1635000 - RNA, 21 nt, Pseudomonas putida KT2440
gcacgcccgcucccacaggug

SEQ ID NO: 1635001 - RNA, 18 nt, Pseudomonas putida KT2440
gcaccccuuucuccagca

SEQ ID NO: 1635002 - RNA, 19 nt, Pseudomonas putida KT2440
gcaccccuuucuccagcaa

SEQ ID NO: 1635003 - RNA, 16 nt, Pseudomonas putida KT2440
gcacccgaccacccuc

SEQ ID NO: 1635004 - RNA, 15 nt, Pseudomonas putida KT2440
gcacccgcaagcgcc

SEQ ID NO: 1635005 - RNA, 16 nt, Pseudomonas putida KT2440
gcacccgcaagcgccg

SEQ ID NO: 1635006 - RNA, 16 nt, Pseudomonas putida KT2440
gcaccccaaggcugcc

SEQ ID NO: 1635007 - RNA, 15 nt, Pseudomonas putida KT2440
gcacccgccuccggc

SEQ ID NO: 1635008 - RNA, 19 nt, Pseudomonas putida KT2440
gcacccgcccaucgcacac

SEQ ID NO: 1635009 - RNA, 14 nt, Pseudomonas putida KT2440
gcacccgcuuggcc

SEQ ID NO: 1635010 - RNA, 16 nt, Pseudomonas putida KT2440
gcaccaugaacucuuc

SEQ ID NO: 1635011 - RNA, 15 nt, Pseudomonas putida KT2440
gcaccaugcgcgggu

SEQ ID NO: 1635012 - RNA, 15 nt, Pseudomonas putida KT2440
gcacccaaccugccg

SEQ ID NO: 1635013 - RNA, 12 nt, Pseudomonas putida KT2440
gcacccagcagg

SEQ ID NO: 1635014 - RNA, 21 nt, Pseudomonas putida KT2440
gcacccagcguauagccaccg

SEQ ID NO: 1635015 - RNA, 17 nt, Pseudomonas putida KT2440
gcacccaauagcccacc

SEQ ID NO: 1635016 - RNA, 20 nt, Pseudomonas putida KT2440
gcacccaauagcccaccguc

SEQ ID NO: 1635017 - RNA, 20 nt, Pseudomonas putida KT2440
gcacccacagcgccugcugc

SEQ ID NO: 1635018 - RNA, 14 nt, Pseudomonas putida KT2440
gcaccaucggcucc

SEQ ID NO: 1635019 - RNA, 18 nt, Pseudomonas putida KT2440
gcaccaucggcuccagcg

SEQ ID NO: 1635020 - RNA, 14 nt, Pseudomonas putida KT2440
gcaccaucagagcg

SEQ ID NO: 1635021 - RNA, 17 nt, Pseudomonas putida KT2440
gcaccaucagagcgcca

SEQ ID NO: 1635022 - RNA, 18 nt, Pseudomonas putida KT2440
gcaccaucagagcgccag

SEQ ID NO: 1635023 - RNA, 19 nt, Pseudomonas putida KT2440
gcaccagguuggccgccgc

SEQ ID NO: 1635024 - RNA, 21 nt, Pseudomonas putida KT2440
gcaccagguuggccgccgcca

SEQ ID NO: 1635025 - RNA, 17 nt, Pseudomonas putida KT2440
gcaccagguccaccagc

SEQ ID NO: 1635026 - RNA, 22 nt, Pseudomonas putida KT2440
gcaccagguccaccagcaggcu

SEQ ID NO: 1635027 - RNA, 15 nt, Pseudomonas putida KT2440
gcaccacgccauagc

SEQ ID NO: 1635028 - RNA, 16 nt, Pseudomonas putida KT2440
gcaccacgccauagcu

SEQ ID NO: 1635029 - RNA, 15 nt, Pseudomonas putida KT2440
gcaccacggaaggcc

SEQ ID NO: 1635030 - RNA, 17 nt, Pseudomonas putida KT2440
gcaccacggaaggccac

SEQ ID NO: 1635031 - RNA, 22 nt, Pseudomonas putida KT2440
gcaccacgcgcaaaugcuugcc

SEQ ID NO: 1635032 - RNA, 20 nt, Pseudomonas putida KT2440
gcaccaccugugccggcagc

SEQ ID NO: 1635033 - RNA, 16 nt, Pseudomonas putida KT2440
gcaccacccaccagca

SEQ ID NO: 1635034 - RNA, 18 nt, Pseudomonas putida KT2440
gcaccacccaccagcagu

SEQ ID NO: 1635035 - RNA, 22 nt, Pseudomonas putida KT2440
gcaccacccaccagcagugccc

SEQ ID NO: 1635036 - RNA, 23 nt, Pseudomonas putida KT2440
gcaccaccccggggcgcuccagc

SEQ ID NO: 1635037 - RNA, 13 nt, Pseudomonas putida KT2440
gcaccacccccag

SEQ ID NO: 1635038 - RNA, 16 nt, Pseudomonas putida KT2440
gcaccacccccagcgc

SEQ ID NO: 1635039 - RNA, 20 nt, Pseudomonas putida KT2440
gcaccacccccagcgccucc

SEQ ID NO: 1635040 - RNA, 12 nt, Pseudomonas putida KT2440
gcaccaaugacu

SEQ ID NO: 1635041 - RNA, 16 nt, Pseudomonas putida KT2440
gcaccaacacuuccag

SEQ ID NO: 1635042 - RNA, 16 nt, Pseudomonas putida KT2440
gcaccagcggcuuggc

SEQ ID NO: 1635043 - RNA, 15 nt, Pseudomonas putida KT2440
gcaccagcaccagcu

SEQ ID NO: 1635044 - RNA, 16 nt, Pseudomonas putida KT2440
gcaccagaccagcagc

SEQ ID NO: 1635045 - RNA, 18 nt, Pseudomonas putida KT2440
gcaccagaccagcagcag

SEQ ID NO: 1635046 - RNA, 12 nt, Pseudomonas putida KT2440
gcaccacuguuc

SEQ ID NO: 1635047 - RNA, 15 nt, Pseudomonas putida KT2440
gcaccacguccggcc

SEQ ID NO: 1635048 - RNA, 21 nt, Pseudomonas putida KT2440
gcaccacguccggccagcaac

SEQ ID NO: 1635049 - RNA, 12 nt, Pseudomonas putida KT2440
gcaccucggcca

SEQ ID NO: 1635050 - RNA, 14 nt, Pseudomonas putida KT2440
gcaccuccugcaca

SEQ ID NO: 1635051 - RNA, 18 nt, Pseudomonas putida KT2440
gcaccuccugcggcagau

SEQ ID NO: 1635052 - RNA, 12 nt, Pseudomonas putida KT2440
gcaccuccagag

SEQ ID NO: 1635053 - RNA, 15 nt, Pseudomonas putida KT2440
gcaccuaucgcugcc

SEQ ID NO: 1635054 - RNA, 20 nt, Pseudomonas putida KT2440
gcaccuaucgcugccgccuu

SEQ ID NO: 1635055 - RNA, 20 nt, Pseudomonas putida KT2440
gcaccguggcguauugcugg

SEQ ID NO: 1635056 - RNA, 17 nt, Pseudomonas putida KT2440
gcaccgugcaccagcac

SEQ ID NO: 1635057 - RNA, 15 nt, Pseudomonas putida KT2440
gcaccuggcggcccg

SEQ ID NO: 1635058 - RNA, 18 nt, Pseudomonas putida KT2440
gcaccuggcggcccgccg

SEQ ID NO: 1635059 - RNA, 20 nt, Pseudomonas putida KT2440
gcaccugcuugccgcuggca

SEQ ID NO: 1635060 - RNA, 14 nt, Pseudomonas putida KT2440
gcaccugcccgccc

SEQ ID NO: 1635061 - RNA, 21 nt, Pseudomonas putida KT2440
gcaccugccgcugauaaccug

SEQ ID NO: 1635062 - RNA, 10 nt, Pseudomonas putida KT2440
gcaccucuug

SEQ ID NO: 1635063 - RNA, 15 nt, Pseudomonas putida KT2440
gcaccugccagccgc

SEQ ID NO: 1635064 - RNA, 15 nt, Pseudomonas putida KT2440
gcaccugcagguaca

SEQ ID NO: 1635065 - RNA, 22 nt, Pseudomonas putida KT2440
gcaccugcagguacagcagcug

SEQ ID NO: 1635066 - RNA, 14 nt, Pseudomonas putida KT2440
gcaccggccuugcc

SEQ ID NO: 1635067 - RNA, 14 nt, Pseudomonas putida KT2440
gcaccggccgaagu

SEQ ID NO: 1635068 - RNA, 16 nt, Pseudomonas putida KT2440
gcaccggcaccgggcg

SEQ ID NO: 1635069 - RNA, 14 nt, Pseudomonas putida KT2440
gcaccggcagcagc

SEQ ID NO: 1635070 - RNA, 16 nt, Pseudomonas putida KT2440
gcaccggcagcagcaa

SEQ ID NO: 1635071 - RNA, 18 nt, Pseudomonas putida KT2440
gcaccgguucgcccccac

SEQ ID NO: 1635072 - RNA, 15 nt, Pseudomonas putida KT2440
gcaccgucgccugca

SEQ ID NO: 1635073 - RNA, 15 nt, Pseudomonas putida KT2440
gcaccgggcggcggu

SEQ ID NO: 1635074 - RNA, 18 nt, Pseudomonas putida KT2440
gcaccgggcgggugcaug

SEQ ID NO: 1635075 - RNA, 18 nt, Pseudomonas putida KT2440
gcaccgggaugcucugca

SEQ ID NO: 1635076 - RNA, 15 nt, Pseudomonas putida KT2440
gcaccgagucgccuu

SEQ ID NO: 1635077 - RNA, 23 nt, Pseudomonas putida KT2440
gcaccgagucgccuucacacagg

SEQ ID NO: 1635078 - RNA, 16 nt, Pseudomonas putida KT2440
gcaccgcagccccagc

SEQ ID NO: 1635079 - RNA, 17 nt, Pseudomonas putida KT2440
gcaccgacuuccccggc

SEQ ID NO: 1635080 - RNA, 15 nt, Pseudomonas putida KT2440
gcaccgacuggcgua

SEQ ID NO: 1635081 - RNA, 22 nt, Pseudomonas putida KT2440
gcacccuuccccccuggccugg

SEQ ID NO: 1635082 - RNA, 14 nt, Pseudomonas putida KT2440
gcacccggucgccg

SEQ ID NO: 1635083 - RNA, 18 nt, Pseudomonas putida KT2440
gcaccgcguaucaggcau

SEQ ID NO: 1635084 - RNA, 16 nt, Pseudomonas putida KT2440
gcaccgcucagugccg

SEQ ID NO: 1635085 - RNA, 13 nt, Pseudomonas putida KT2440
gcaccgcugccag

SEQ ID NO: 1635086 - RNA, 15 nt, Pseudomonas putida KT2440
gcaccgcugccagcu

SEQ ID NO: 1635087 - RNA, 14 nt, Pseudomonas putida KT2440
gcaccgccauggcc

SEQ ID NO: 1635088 - RNA, 16 nt, Pseudomonas putida KT2440
gcaccgccaccccggc

SEQ ID NO: 1635089 - RNA, 21 nt, Pseudomonas putida KT2440
gcaccgccaccccggcuugcu

SEQ ID NO: 1635090 - RNA, 13 nt, Pseudomonas putida KT2440
gcaccgccccggc

SEQ ID NO: 1635091 - RNA, 15 nt, Pseudomonas putida KT2440
gcacaccgcucaacc

SEQ ID NO: 1635092 - RNA, 22 nt, Pseudomonas putida KT2440
gcacaccgcugguggcguggcu

SEQ ID NO: 1635093 - RNA, 21 nt, Pseudomonas putida KT2440
gcacacccugucgaucacggg

SEQ ID NO: 1635094 - RNA, 15 nt, Pseudomonas putida KT2440
gcacaccacgccaac

SEQ ID NO: 1635095 - RNA, 14 nt, Pseudomonas putida KT2440
gcacacgaccuugg

SEQ ID NO: 1635096 - RNA, 15 nt, Pseudomonas putida KT2440
gcacacugcccagca

SEQ ID NO: 1635097 - RNA, 18 nt, Pseudomonas putida KT2440
gcacacugcccagcagcc

SEQ ID NO: 1635098 - RNA, 21 nt, Pseudomonas putida KT2440
gcacacugcccagcagcccca

SEQ ID NO: 1635099 - RNA, 15 nt, Pseudomonas putida KT2440
gcacagaccgcaaca

SEQ ID NO: 1635100 - RNA, 16 nt, Pseudomonas putida KT2440
gcacagaccgcaacag

SEQ ID NO: 1635101 - RNA, 16 nt, Pseudomonas putida KT2440
gcacagaacaauaaaa

SEQ ID NO: 1635102 - RNA, 16 nt, Pseudomonas putida KT2440
gcacaacgcgcgggca

SEQ ID NO: 1635103 - RNA, 21 nt, Pseudomonas putida KT2440
gcacaaccgaacccgcugcca

SEQ ID NO: 1635104 - RNA, 11 nt, Pseudomonas putida KT2440
gcacaaagccc

SEQ ID NO: 1635105 - RNA, 21 nt, Pseudomonas putida KT2440
gcacacagcccaaagggcugg

SEQ ID NO: 1635106 - RNA, 13 nt, Pseudomonas putida KT2440
gcacaaucagcuc

SEQ ID NO: 1635107 - RNA, 12 nt, Pseudomonas putida KT2440
gcacaaggcugu

SEQ ID NO: 1635108 - RNA, 22 nt, Pseudomonas putida KT2440
gcacaaggcggcucuugcagcg

SEQ ID NO: 1635109 - RNA, 18 nt, Pseudomonas putida KT2440
gcacaucacggcgcaggc

SEQ ID NO: 1635110 - RNA, 19 nt, Pseudomonas putida KT2440
gcacaucacggcgcaggcc

SEQ ID NO: 1635111 - RNA, 20 nt, Pseudomonas putida KT2440
gcacaucacggcgcaggccg

SEQ ID NO: 1635112 - RNA, 22 nt, Pseudomonas putida KT2440
gcacauacaaaaugugccggcu

SEQ ID NO: 1635113 - RNA, 23 nt, Pseudomonas putida KT2440
gcacaucguccgccgcgcugacc

SEQ ID NO: 1635114 - RNA, 14 nt, Pseudomonas putida KT2440
gcacaucggccacc

SEQ ID NO: 1635115 - RNA, 11 nt, Pseudomonas putida KT2440
gcaccaaacac

SEQ ID NO: 1635116 - RNA, 18 nt, Pseudomonas putida KT2440
gcacagcacguucagcgg

SEQ ID NO: 1635117 - RNA, 18 nt, Pseudomonas putida KT2440
gcacagcucgaugccuuu

SEQ ID NO: 1635118 - RNA, 16 nt, Pseudomonas putida KT2440
gcacagugccaaggac

SEQ ID NO: 1635119 - RNA, 20 nt, Pseudomonas putida KT2440
gcacagugguguacagcaac

SEQ ID NO: 1635120 - RNA, 23 nt, Pseudomonas putida KT2440
gcacagggcgaugcccuucaggc

SEQ ID NO: 1635121 - RNA, 14 nt, Pseudomonas putida KT2440
gcacaggcuggcca

SEQ ID NO: 1635122 - RNA, 19 nt, Pseudomonas putida KT2440
gcacagguaucgccgcccu

SEQ ID NO: 1635123 - RNA, 16 nt, Pseudomonas putida KT2440
gcacaggcgcagcagc

SEQ ID NO: 1635124 - RNA, 18 nt, Pseudomonas putida KT2440
gcacaggcccagcaugaa

SEQ ID NO: 1635125 - RNA, 14 nt, Pseudomonas putida KT2440
gcacaggccgccug

SEQ ID NO: 1635126 - RNA, 22 nt, Pseudomonas putida KT2440
gcacaggccgccugaccugugc

SEQ ID NO: 1635127 - RNA, 17 nt, Pseudomonas putida KT2440
gcacaggccgcgcauga

SEQ ID NO: 1635128 - RNA, 13 nt, Pseudomonas putida KT2440
gcaauugccaccg

SEQ ID NO: 1635129 - RNA, 15 nt, Pseudomonas putida KT2440
gcaaugccgaacagu

SEQ ID NO: 1635130 - RNA, 21 nt, Pseudomonas putida KT2440
gcaaugcggugugcugcggcc

SEQ ID NO: 1635131 - RNA, 16 nt, Pseudomonas putida KT2440
gcaaucgcugugcgug

SEQ ID NO: 1635132 - RNA, 20 nt, Pseudomonas putida KT2440
gcaaugaugauguugccgau

SEQ ID NO: 1635133 - RNA, 16 nt, Pseudomonas putida KT2440
gcaaugauggcaauca

SEQ ID NO: 1635134 - RNA, 21 nt, Pseudomonas putida KT2440
gcaaugauggcaaucacgaac

SEQ ID NO: 1635135 - RNA, 20 nt, Pseudomonas putida KT2440
gcaaugcccauggccaggcu

SEQ ID NO: 1635136 - RNA, 13 nt, Pseudomonas putida KT2440
gcaaucugcagca

SEQ ID NO: 1635137 - RNA, 15 nt, Pseudomonas putida KT2440
gcaauccccuccgcc

SEQ ID NO: 1635138 - RNA, 20 nt, Pseudomonas putida KT2440
gcaaucaagguuucacgccg

SEQ ID NO: 1635139 - RNA, 21 nt, Pseudomonas putida KT2440
gcaagccacgccagaaccuga

SEQ ID NO: 1635140 - RNA, 18 nt, Pseudomonas putida KT2440
gcaagccgccgaccaggu

SEQ ID NO: 1635141 - RNA, 19 nt, Pseudomonas putida KT2440
gcaagcccgcgaagaggcc

SEQ ID NO: 1635142 - RNA, 23 nt, Pseudomonas putida KT2440
gcaagcccgcgaagaggccagga

SEQ ID NO: 1635143 - RNA, 23 nt, Pseudomonas putida KT2440
gcaagcccgcuccuacaggggac

SEQ ID NO: 1635144 - RNA, 20 nt, Pseudomonas putida KT2440
gcaagcgcauaggcaaugau

SEQ ID NO: 1635145 - RNA, 18 nt, Pseudomonas putida KT2440
gcaagcgggcagugcaau

SEQ ID NO: 1635146 - RNA, 14 nt, Pseudomonas putida KT2440
gcaagcgcgcgccc

SEQ ID NO: 1635147 - RNA, 16 nt, Pseudomonas putida KT2440
gcaagcgcgcgcccac

SEQ ID NO: 1635148 - RNA, 15 nt, Pseudomonas putida KT2440
gcaagccucaggcau

SEQ ID NO: 1635149 - RNA, 20 nt, Pseudomonas putida KT2440
gcaagccuucgucgcuggcc

SEQ ID NO: 1635150 - RNA, 19 nt, Pseudomonas putida KT2440
gcaagcaggugcgcaggcu

SEQ ID NO: 1635151 - RNA, 17 nt, Pseudomonas putida KT2440
gcaagcagucccagcac

SEQ ID NO: 1635152 - RNA, 17 nt, Pseudomonas putida KT2440
gcaagaugucaucaaua

SEQ ID NO: 1635153 - RNA, 23 nt, Pseudomonas putida KT2440
gcaaggccgcggcugaacacgcu

SEQ ID NO: 1635154 - RNA, 15 nt, Pseudomonas putida KT2440
gcaaggccagugccg

SEQ ID NO: 1635155 - RNA, 21 nt, Pseudomonas putida KT2440
gcaaggcauucagcucggcca

SEQ ID NO: 1635156 - RNA, 23 nt, Pseudomonas putida KT2440
gcaaggcaaugcccauggccagg

SEQ ID NO: 1635157 - RNA, 18 nt, Pseudomonas putida KT2440
gcaagcuugccagcgucu

SEQ ID NO: 1635158 - RNA, 14 nt, Pseudomonas putida KT2440
gcaaggaucaccaa

SEQ ID NO: 1635159 - RNA, 16 nt, Pseudomonas putida KT2440
gcaagcucaucaccag

SEQ ID NO: 1635160 - RNA, 17 nt, Pseudomonas putida KT2440
gcaagcucgcuccugca

SEQ ID NO: 1635161 - RNA, 19 nt, Pseudomonas putida KT2440
gcaagcgguugcccgcugc

SEQ ID NO: 1635162 - RNA, 19 nt, Pseudomonas putida KT2440
gcaagcuggucaggugcau

SEQ ID NO: 1635163 - RNA, 13 nt, Pseudomonas putida KT2440
gcaagcugcaccg

SEQ ID NO: 1635164 - RNA, 18 nt, Pseudomonas putida KT2440
gcaagggccugcaggcag

SEQ ID NO: 1635165 - RNA, 20 nt, Pseudomonas putida KT2440
gcaagggccugcaggcagca

SEQ ID NO: 1635166 - RNA, 16 nt, Pseudomonas putida KT2440
gcaagggccugugccg

SEQ ID NO: 1635167 - RNA, 22 nt, Pseudomonas putida KT2440
gcaaggucucuuccugcaccug

SEQ ID NO: 1635168 - RNA, 17 nt, Pseudomonas putida KT2440
gcaaggugccaacaggc

SEQ ID NO: 1635169 - RNA, 19 nt, Pseudomonas putida KT2440
gcaaggugccaacaggcag

SEQ ID NO: 1635170 - RNA, 21 nt, Pseudomonas putida KT2440
gcaaggugccaacaggcagca

SEQ ID NO: 1635171 - RNA, 13 nt, Pseudomonas putida KT2440
gcaaggcgcagcc

SEQ ID NO: 1635172 - RNA, 17 nt, Pseudomonas putida KT2440
gcaaggcgaccugccag

SEQ ID NO: 1635173 - RNA, 17 nt, Pseudomonas putida KT2440
gcaagucaugcucgccg

SEQ ID NO: 1635174 - RNA, 14 nt, Pseudomonas putida KT2440
gcaagucccccauc

SEQ ID NO: 1635175 - RNA, 20 nt, Pseudomonas putida KT2440
gcaaggugggguugaccagg

SEQ ID NO: 1635176 - RNA, 16 nt, Pseudomonas putida KT2440
gcaauaccgugcuugc

SEQ ID NO: 1635177 - RNA, 19 nt, Pseudomonas putida KT2440
gcaaccugggugugccgcu

SEQ ID NO: 1635178 - RNA, 16 nt, Pseudomonas putida KT2440
gcaacggccacgcugc

SEQ ID NO: 1635179 - RNA, 15 nt, Pseudomonas putida KT2440
gcaacgccagcaaug

SEQ ID NO: 1635180 - RNA, 20 nt, Pseudomonas putida KT2440
gcaacgccuuggccugcggg

SEQ ID NO: 1635181 - RNA, 20 nt, Pseudomonas putida KT2440
gcaacgccgguagcugcgca

SEQ ID NO: 1635182 - RNA, 19 nt, Pseudomonas putida KT2440
gcaacgcggcccuggguuu

SEQ ID NO: 1635183 - RNA, 15 nt, Pseudomonas putida KT2440
gcaacugcccaggau

SEQ ID NO: 1635184 - RNA, 23 nt, Pseudomonas putida KT2440
gcaacugcccaggaucacuggcc

SEQ ID NO: 1635185 - RNA, 17 nt, Pseudomonas putida KT2440
gcaacugcgccguggcc

SEQ ID NO: 1635186 - RNA, 22 nt, Pseudomonas putida KT2440
gcaacugcgcgauagccugugg

SEQ ID NO: 1635187 - RNA, 18 nt, Pseudomonas putida KT2440
aaagcgcaaucaaagcag

SEQ ID NO: 1635188 - RNA, 24 nt, Pseudomonas putida KT2440
aaagcgcaaucaaagcagacagcu

SEQ ID NO: 1635189 - RNA, 16 nt, Pseudomonas putida KT2440
gcaacuccuccagccg

SEQ ID NO: 1635190 - RNA, 15 nt, Pseudomonas putida KT2440
gcaacuggcgcaggc

SEQ ID NO: 1635191 - RNA, 23 nt, Pseudomonas putida KT2440
gcaacuggugaaucagccccagc

SEQ ID NO: 1635192 - RNA, 18 nt, Pseudomonas putida KT2440
gcaacugguucuccaggu

SEQ ID NO: 1635193 - RNA, 19 nt, Pseudomonas putida KT2440
gcaacugguucuccagguu

SEQ ID NO: 1635194 - RNA, 13 nt, Pseudomonas putida KT2440
gcaacuggcacaa

SEQ ID NO: 1635195 - RNA, 18 nt, Pseudomonas putida KT2440
gcaacuggcaucggucac

SEQ ID NO: 1635196 - RNA, 15 nt, Pseudomonas putida KT2440
gcaacuggcccgcgc

SEQ ID NO: 1635197 - RNA, 17 nt, Pseudomonas putida KT2440
aaagcgcgccuccagcu

SEQ ID NO: 1635198 - RNA, 13 nt, Pseudomonas putida KT2440
aaagcggccccca

SEQ ID NO: 1635199 - RNA, 11 nt, Pseudomonas putida KT2440
aaagcgcucga

SEQ ID NO: 1635200 - RNA, 14 nt, Pseudomonas putida KT2440
gcaagaaggcugcc

SEQ ID NO: 1635201 - RNA, 15 nt, Pseudomonas putida KT2440
gcaacugugucucga

SEQ ID NO: 1635202 - RNA, 19 nt, Pseudomonas putida KT2440
gcgcuagucgaaaaaccga

SEQ ID NO: 1635203 - RNA, 16 nt, Pseudomonas putida KT2440
gcgcucaaccagccgc

SEQ ID NO: 1635204 - RNA, 17 nt, Pseudomonas putida KT2440
gcgcucaaccagccgcc

SEQ ID NO: 1635205 - RNA, 21 nt, Pseudomonas putida KT2440
gcgcuaugccuuggaggcugg

SEQ ID NO: 1635206 - RNA, 14 nt, Pseudomonas putida KT2440
gcgcuccaacuggc

SEQ ID NO: 1635207 - RNA, 19 nt, Pseudomonas putida KT2440
gcgcuccagcagcuccaca

SEQ ID NO: 1635208 - RNA, 15 nt, Pseudomonas putida KT2440
gcgcucacugcaucg

SEQ ID NO: 1635209 - RNA, 14 nt, Pseudomonas putida KT2440
gcgcgugugcaggu

SEQ ID NO: 1635210 - RNA, 22 nt, Pseudomonas putida KT2440
gcgcuaccugugggagcgggcg

SEQ ID NO: 1635211 - RNA, 18 nt, Pseudomonas putida KT2440
gcgcuacaagccggcgcu

SEQ ID NO: 1635212 - RNA, 22 nt, Pseudomonas putida KT2440
gcgcgucucuuucaggcacagc

SEQ ID NO: 1635213 - RNA, 14 nt, Pseudomonas putida KT2440
gcgcguccagcaac

SEQ ID NO: 1635214 - RNA, 20 nt, Pseudomonas putida KT2440
gcgcgugcggggcaucgccg

SEQ ID NO: 1635215 - RNA, 18 nt, Pseudomonas putida KT2440
gcgcgggugcgagaggcg

SEQ ID NO: 1635216 - RNA, 14 nt, Pseudomonas putida KT2440
gcgcgggcggcgcu

SEQ ID NO: 1635217 - RNA, 13 nt, Pseudomonas putida KT2440
gcgcgggcgcagg

SEQ ID NO: 1635218 - RNA, 14 nt, Pseudomonas putida KT2440
gcgcggcuugcucg

SEQ ID NO: 1635219 - RNA, 19 nt, Pseudomonas putida KT2440
gcgcggcuugcucgcggcg

SEQ ID NO: 1635220 - RNA, 23 nt, Pseudomonas putida KT2440
gcgcggcuugcucgcggcgcagg

SEQ ID NO: 1635221 - RNA, 15 nt, Pseudomonas putida KT2440
gcgcggucaagcucg

SEQ ID NO: 1635222 - RNA, 16 nt, Pseudomonas putida KT2440
gcgcggugccggcagc

SEQ ID NO: 1635223 - RNA, 17 nt, Pseudomonas putida KT2440
gcgcggugccggcagcu

SEQ ID NO: 1635224 - RNA, 17 nt, Pseudomonas putida KT2440
gcgcggugaccagcggc

SEQ ID NO: 1635225 - RNA, 21 nt, Pseudomonas putida KT2440
gcgcggugaccagcggcagca

SEQ ID NO: 1635226 - RNA, 16 nt, Pseudomonas putida KT2440
gcgcggugauggcgca

SEQ ID NO: 1635227 - RNA, 16 nt, Pseudomonas putida KT2440
gcgcgucauccgccaa

SEQ ID NO: 1635228 - RNA, 22 nt, Pseudomonas putida KT2440
gcgcgucacugcaccucccgcc

SEQ ID NO: 1635229 - RNA, 18 nt, Pseudomonas putida KT2440
gcgcguaaaucccgcagg

SEQ ID NO: 1635230 - RNA, 19 nt, Pseudomonas putida KT2440
gcgcguaguacuccagcag

SEQ ID NO: 1635231 - RNA, 21 nt, Pseudomonas putida KT2440
gcgcguaguacuccagcagcg

SEQ ID NO: 1635232 - RNA, 22 nt, Pseudomonas putida KT2440
gcgcguaguacuccagcagcgc

SEQ ID NO: 1635233 - RNA, 23 nt, Pseudomonas putida KT2440
gcgcguauccuugcccaccagga

SEQ ID NO: 1635234 - RNA, 13 nt, Pseudomonas putida KT2440
gcgaucaguuccg

SEQ ID NO: 1635235 - RNA, 16 nt, Pseudomonas putida KT2440
gcgaucagcgcgguga

SEQ ID NO: 1635236 - RNA, 17 nt, Pseudomonas putida KT2440
gcgauccgccccauagc

SEQ ID NO: 1635237 - RNA, 17 nt, Pseudomonas putida KT2440
gcgauccaggaucacgu

SEQ ID NO: 1635238 - RNA, 20 nt, Pseudomonas putida KT2440
gcgcgaaguggauauccagc

SEQ ID NO: 1635239 - RNA, 21 nt, Pseudomonas putida KT2440
gcgaucgaaaggcgacuccug

SEQ ID NO: 1635240 - RNA, 17 nt, Pseudomonas putida KT2440
gcgaucgaacgcuugcc

SEQ ID NO: 1635241 - RNA, 16 nt, Pseudomonas putida KT2440
gcgcgccagggcaacg

SEQ ID NO: 1635242 - RNA, 17 nt, Pseudomonas putida KT2440
gcgcgaucccuguggga

SEQ ID NO: 1635243 - RNA, 13 nt, Pseudomonas putida KT2440
gcgcgaucaccag

SEQ ID NO: 1635244 - RNA, 18 nt, Pseudomonas putida KT2440
gcgcgaucaccagccccu

SEQ ID NO: 1635245 - RNA, 17 nt, Pseudomonas putida KT2440
gcgcgacagcacgggca

SEQ ID NO: 1635246 - RNA, 15 nt, Pseudomonas putida KT2440
gcgcgccuccagcug

SEQ ID NO: 1635247 - RNA, 17 nt, Pseudomonas putida KT2440
gcgcgccugcaccugac

SEQ ID NO: 1635248 - RNA, 23 nt, Pseudomonas putida KT2440
gcgcgccugcaccugacgagcga

SEQ ID NO: 1635249 - RNA, 12 nt, Pseudomonas putida KT2440
gcgcgcccgcgg

SEQ ID NO: 1635250 - RNA, 14 nt, Pseudomonas putida KT2440
gcgcgcccgcggcc

SEQ ID NO: 1635251 - RNA, 13 nt, Pseudomonas putida KT2440
gcgcgcccaccgg

SEQ ID NO: 1635252 - RNA, 18 nt, Pseudomonas putida KT2440
gcgcgcccugcucaucca

SEQ ID NO: 1635253 - RNA, 21 nt, Pseudomonas putida KT2440
gcgcggccgccuccugcugcu

SEQ ID NO: 1635254 - RNA, 23 nt, Pseudomonas putida KT2440
gcgcggaacacacgcuccgggug

SEQ ID NO: 1635255 - RNA, 22 nt, Pseudomonas putida KT2440
gcgcuccgccaauugcgccagc

SEQ ID NO: 1635256 - RNA, 11 nt, Pseudomonas putida KT2440
gcgcuccucca

SEQ ID NO: 1635257 - RNA, 21 nt, Pseudomonas putida KT2440
gcgcugacgaacaacgccacc

SEQ ID NO: 1635258 - RNA, 15 nt, Pseudomonas putida KT2440
gcgcugacgcagggc

SEQ ID NO: 1635259 - RNA, 20 nt, Pseudomonas putida KT2440
gcgcugacgcagggccucga

SEQ ID NO: 1635260 - RNA, 15 nt, Pseudomonas putida KT2440
gcgcugaccgggacg

SEQ ID NO: 1635261 - RNA, 17 nt, Pseudomonas putida KT2440
gcgcugaccgggacgca

SEQ ID NO: 1635262 - RNA, 17 nt, Pseudomonas putida KT2440
gcgcugaccaacaggcu

SEQ ID NO: 1635263 - RNA, 18 nt, Pseudomonas putida KT2440
gcgcugaccaaggcaaag

SEQ ID NO: 1635264 - RNA, 14 nt, Pseudomonas putida KT2440
gcgcuuccuuccug

SEQ ID NO: 1635265 - RNA, 20 nt, Pseudomonas putida KT2440
gcgcuucgaucagcgccugc

SEQ ID NO: 1635266 - RNA, 17 nt, Pseudomonas putida KT2440
gcgcuucgaucgccggc

SEQ ID NO: 1635267 - RNA, 17 nt, Pseudomonas putida KT2440
gcgcugacugccaggcc

SEQ ID NO: 1635268 - RNA, 15 nt, Pseudomonas putida KT2440
gcgcugagcgacagc

SEQ ID NO: 1635269 - RNA, 16 nt, Pseudomonas putida KT2440
gcgcuugagcucggca

SEQ ID NO: 1635270 - RNA, 19 nt, Pseudomonas putida KT2440
gcgcugaucaagcccgcuc

SEQ ID NO: 1635271 - RNA, 14 nt, Pseudomonas putida KT2440
gcgcuugcaccagg

SEQ ID NO: 1635272 - RNA, 16 nt, Pseudomonas putida KT2440
gcgcuuuuccaguucc

SEQ ID NO: 1635273 - RNA, 15 nt, Pseudomonas putida KT2440
gcgcuuugugcacaa

SEQ ID NO: 1635274 - RNA, 18 nt, Pseudomonas putida KT2440
gcgcuuugcgccccuuuc

SEQ ID NO: 1635275 - RNA, 18 nt, Pseudomonas putida KT2440
gcgcuuuucaccuccagu

SEQ ID NO: 1635276 - RNA, 23 nt, Pseudomonas putida KT2440
gcgcuuuucaccuccaguugcca

SEQ ID NO: 1635277 - RNA, 16 nt, Pseudomonas putida KT2440
gcgcuuucacuggcga

SEQ ID NO: 1635278 - RNA, 19 nt, Pseudomonas putida KT2440
gcggacucauagcucagcu

SEQ ID NO: 1635279 - RNA, 20 nt, Pseudomonas putida KT2440
gcggagauuggccagcaggc

SEQ ID NO: 1635280 - RNA, 22 nt, Pseudomonas putida KT2440
gcggauagccccgcccagcagc

SEQ ID NO: 1635281 - RNA, 16 nt, Pseudomonas putida KT2440
gcggaucagcgcgucc

SEQ ID NO: 1635282 - RNA, 19 nt, Pseudomonas putida KT2440
gcggcagauccugcagccg

SEQ ID NO: 1635283 - RNA, 22 nt, Pseudomonas putida KT2440
gcggccgggucgauagccagcc

SEQ ID NO: 1635284 - RNA, 13 nt, Pseudomonas putida KT2440
gcggccgcuggua

SEQ ID NO: 1635285 - RNA, 13 nt, Pseudomonas putida KT2440
gcggccaucgcag

SEQ ID NO: 1635286 - RNA, 22 nt, Pseudomonas putida KT2440
gcggccaguaaggaucgcgcag

SEQ ID NO: 1635287 - RNA, 15 nt, Pseudomonas putida KT2440
gcggccaggccggcg

SEQ ID NO: 1635288 - RNA, 18 nt, Pseudomonas putida KT2440
gcggcaguugccugccuu

SEQ ID NO: 1635289 - RNA, 14 nt, Pseudomonas putida KT2440
gcggcagcgacgau

SEQ ID NO: 1635290 - RNA, 17 nt, Pseudomonas putida KT2440
gcggcagcaugaacagc

SEQ ID NO: 1635291 - RNA, 17 nt, Pseudomonas putida KT2440
gcggccugugcccaacc

SEQ ID NO: 1635292 - RNA, 22 nt, Pseudomonas putida KT2440
gcggccugugcccaaccaccga

SEQ ID NO: 1635293 - RNA, 22 nt, Pseudomonas putida KT2440
gcggccuucaagcuccccagca

SEQ ID NO: 1635294 - RNA, 22 nt, Pseudomonas putida KT2440
gcggccucgguccaccccaugu

SEQ ID NO: 1635295 - RNA, 18 nt, Pseudomonas putida KT2440
gcggcgaucaacgcaggc

SEQ ID NO: 1635296 - RNA, 17 nt, Pseudomonas putida KT2440
gcggcgaucagcgcggu

SEQ ID NO: 1635297 - RNA, 22 nt, Pseudomonas putida KT2440
gcggcgaugcaucaauggcugg

SEQ ID NO: 1635298 - RNA, 20 nt, Pseudomonas putida KT2440
gcggcgaacacagcggccuu

SEQ ID NO: 1635299 - RNA, 19 nt, Pseudomonas putida KT2440
gcguacgccguugccgccc

SEQ ID NO: 1635300 - RNA, 15 nt, Pseudomonas putida KT2440
gcguacggccuuggc

SEQ ID NO: 1635301 - RNA, 22 nt, Pseudomonas putida KT2440
gcguacccgucgcucuucaacc

SEQ ID NO: 1635302 - RNA, 13 nt, Pseudomonas putida KT2440
gcguaagcuggcu

SEQ ID NO: 1635303 - RNA, 14 nt, Pseudomonas putida KT2440
gcgguuugcucuga

SEQ ID NO: 1635304 - RNA, 22 nt, Pseudomonas putida KT2440
gcgguuuuugggggagcgggcg

SEQ ID NO: 1635305 - RNA, 17 nt, Pseudomonas putida KT2440
gcgguuuuuucauggau

SEQ ID NO: 1635306 - RNA, 15 nt, Pseudomonas putida KT2440
gcgguucaccagcag

SEQ ID NO: 1635307 - RNA, 19 nt, Pseudomonas putida KT2440
gcgguugcaggacuacauc

SEQ ID NO: 1635308 - RNA, 13 nt, Pseudomonas putida KT2440
gcgguugcaccgu

SEQ ID NO: 1635309 - RNA, 19 nt, Pseudomonas putida KT2440
gcgguguagaacggcagca

SEQ ID NO: 1635310 - RNA, 16 nt, Pseudomonas putida KT2440
gcgguggcuggcaccg

SEQ ID NO: 1635311 - RNA, 23 nt, Pseudomonas putida KT2440
gcggugcagauugcccuguggcu

SEQ ID NO: 1635312 - RNA, 21 nt, Pseudomonas putida KT2440
gcggugaucguacgccggcgc

SEQ ID NO: 1635313 - RNA, 18 nt, Pseudomonas putida KT2440
gcggugauggcgcauggc

SEQ ID NO: 1635314 - RNA, 17 nt, Pseudomonas putida KT2440
gcggugaccagcggcag

SEQ ID NO: 1635315 - RNA, 14 nt, Pseudomonas putida KT2440
gcggugaggcaacg

SEQ ID NO: 1635316 - RNA, 14 nt, Pseudomonas putida KT2440
gcgguggauggcac

SEQ ID NO: 1635317 - RNA, 15 nt, Pseudomonas putida KT2440
gcgguggauggcacg

SEQ ID NO: 1635318 - RNA, 18 nt, Pseudomonas putida KT2440
gcggugccugcagcccgg

SEQ ID NO: 1635319 - RNA, 19 nt, Pseudomonas putida KT2440
gcggugcgcacgaagauca

SEQ ID NO: 1635320 - RNA, 13 nt, Pseudomonas putida KT2440
gcggucggccagc

SEQ ID NO: 1635321 - RNA, 16 nt, Pseudomonas putida KT2440
gcggucguagcccucg

SEQ ID NO: 1635322 - RNA, 16 nt, Pseudomonas putida KT2440
gcggucgguggucagc

SEQ ID NO: 1635323 - RNA, 16 nt, Pseudomonas putida KT2440
gcggucucggugcucc

SEQ ID NO: 1635324 - RNA, 22 nt, Pseudomonas putida KT2440
gcggucuuguaucccaggcgcu

SEQ ID NO: 1635325 - RNA, 13 nt, Pseudomonas putida KT2440
gcgguccaccgcc

SEQ ID NO: 1635326 - RNA, 17 nt, Pseudomonas putida KT2440
gcggucgaaaagccgcg

SEQ ID NO: 1635327 - RNA, 17 nt, Pseudomonas putida KT2440
gcggucgaacccagcuu

SEQ ID NO: 1635328 - RNA, 15 nt, Pseudomonas putida KT2440
gcggucgaugcagga

SEQ ID NO: 1635329 - RNA, 19 nt, Pseudomonas putida KT2440
gcgggggccccaccaggca

SEQ ID NO: 1635330 - RNA, 16 nt, Pseudomonas putida KT2440
gcggguaaacccgcgc

SEQ ID NO: 1635331 - RNA, 15 nt, Pseudomonas putida KT2440
gcgggguuuuuucua

SEQ ID NO: 1635332 - RNA, 15 nt, Pseudomonas putida KT2440
gcggggugcucugcc

SEQ ID NO: 1635333 - RNA, 22 nt, Pseudomonas putida KT2440
gcggucaucaccacccccagcg

SEQ ID NO: 1635334 - RNA, 14 nt, Pseudomonas putida KT2440
gcggucaggccaag

SEQ ID NO: 1635335 - RNA, 16 nt, Pseudomonas putida KT2440
gcggguuuacccgcga

SEQ ID NO: 1635336 - RNA, 17 nt, Pseudomonas putida KT2440
gcgguaccggccagcug

SEQ ID NO: 1635337 - RNA, 16 nt, Pseudomonas putida KT2440
gcggguucacccgcga

SEQ ID NO: 1635338 - RNA, 17 nt, Pseudomonas putida KT2440
gcgggugggugcagcug

SEQ ID NO: 1635339 - RNA, 19 nt, Pseudomonas putida KT2440
gcggguaaugucccgcacg

SEQ ID NO: 1635340 - RNA, 23 nt, Pseudomonas putida KT2440
gcggguaaugucccgcacgaucc

SEQ ID NO: 1635341 - RNA, 19 nt, Pseudomonas putida KT2440
gcggcugggucacccaggu

SEQ ID NO: 1635342 - RNA, 20 nt, Pseudomonas putida KT2440
gcggcugggucacccaggug

SEQ ID NO: 1635343 - RNA, 17 nt, Pseudomonas putida KT2440
gcggcugggcgcggcgg

SEQ ID NO: 1635344 - RNA, 20 nt, Pseudomonas putida KT2440
gcggcgcgaaucagcgccuc

SEQ ID NO: 1635345 - RNA, 16 nt, Pseudomonas putida KT2440
gcggcuguucgcagca

SEQ ID NO: 1635346 - RNA, 19 nt, Pseudomonas putida KT2440
gcggcuggugucggccagg

SEQ ID NO: 1635347 - RNA, 19 nt, Pseudomonas putida KT2440
gcggcuuccagggcugguu

SEQ ID NO: 1635348 - RNA, 12 nt, Pseudomonas putida KT2440
gcgggccgccga

SEQ ID NO: 1635349 - RNA, 20 nt, Pseudomonas putida KT2440
gcgggcaaagaacaucacga

SEQ ID NO: 1635350 - RNA, 22 nt, Pseudomonas putida KT2440
gcgggcaacugcgccugggaaa

SEQ ID NO: 1635351 - RNA, 20 nt, Pseudomonas putida KT2440
gcgggcaagcccgcacccac

SEQ ID NO: 1635352 - RNA, 15 nt, Pseudomonas putida KT2440
gcgggcaagcccgcu

SEQ ID NO: 1635353 - RNA, 15 nt, Pseudomonas putida KT2440
gcgggcacgcccgcu

SEQ ID NO: 1635354 - RNA, 17 nt, Pseudomonas putida KT2440
gcgggcacaggccgcgc

SEQ ID NO: 1635355 - RNA, 20 nt, Pseudomonas putida KT2440
gcgggcaaggucgaugcugc

SEQ ID NO: 1635356 - RNA, 22 nt, Pseudomonas putida KT2440
gcgggcagacuucggucuggcc

SEQ ID NO: 1635357 - RNA, 15 nt, Pseudomonas putida KT2440
gcgucggucgcuggu

SEQ ID NO: 1635358 - RNA, 17 nt, Pseudomonas putida KT2440
gcgucgcgcgcccaggc

SEQ ID NO: 1635359 - RNA, 21 nt, Pseudomonas putida KT2440
gcgucgcgcgcccaggcccaa

SEQ ID NO: 1635360 - RNA, 23 nt, Pseudomonas putida KT2440
gcgucgcgaaagggccgcaaggc

SEQ ID NO: 1635361 - RNA, 19 nt, Pseudomonas putida KT2440
gcgucgcgaucacgcaggc

SEQ ID NO: 1635362 - RNA, 19 nt, Pseudomonas putida KT2440
gcgucggccaugccacccc

SEQ ID NO: 1635363 - RNA, 18 nt, Pseudomonas putida KT2440
gcgucuggucgcuuucca

SEQ ID NO: 1635364 - RNA, 13 nt, Pseudomonas putida KT2440
gcgucuucgccag

SEQ ID NO: 1635365 - RNA, 15 nt, Pseudomonas putida KT2440
gcgucuucgccaggu

SEQ ID NO: 1635366 - RNA, 17 nt, Pseudomonas putida KT2440
gcgucugauagccaggg

SEQ ID NO: 1635367 - RNA, 17 nt, Pseudomonas putida KT2440
gcgucucauuguuugcg

SEQ ID NO: 1635368 - RNA, 17 nt, Pseudomonas putida KT2440
gcgucguguucgccugu

SEQ ID NO: 1635369 - RNA, 15 nt, Pseudomonas putida KT2440
gcgucucgccaaacu

SEQ ID NO: 1635370 - RNA, 14 nt, Pseudomonas putida KT2440
gcgucugacuggca

SEQ ID NO: 1635371 - RNA, 14 nt, Pseudomonas putida KT2440
gcgugauggugguc

SEQ ID NO: 1635372 - RNA, 16 nt, Pseudomonas putida KT2440
gcgugccaggcuuggc

SEQ ID NO: 1635373 - RNA, 15 nt, Pseudomonas putida KT2440
gcgugccaccucugg

SEQ ID NO: 1635374 - RNA, 16 nt, Pseudomonas putida KT2440
gcgucuuguuguccgg

SEQ ID NO: 1635375 - RNA, 11 nt, Pseudomonas putida KT2440
gcgugaaagca

SEQ ID NO: 1635376 - RNA, 16 nt, Pseudomonas putida KT2440
gcgugaccagcccggc

SEQ ID NO: 1635377 - RNA, 17 nt, Pseudomonas putida KT2440
gcgugaccagcccggcc

SEQ ID NO: 1635378 - RNA, 16 nt, Pseudomonas putida KT2440
gcgugaccgccccgcc

SEQ ID NO: 1635379 - RNA, 19 nt, Pseudomonas putida KT2440
gcgugagauguucaccagu

SEQ ID NO: 1635380 - RNA, 13 nt, Pseudomonas putida KT2440
gcgugcgcccggc

SEQ ID NO: 1635381 - RNA, 13 nt, Pseudomonas putida KT2440
gcgugccucgggc

SEQ ID NO: 1635382 - RNA, 13 nt, Pseudomonas putida KT2440
gcgugcugugcac

SEQ ID NO: 1635383 - RNA, 15 nt, Pseudomonas putida KT2440
gcgugcugguccucc

SEQ ID NO: 1635384 - RNA, 17 nt, Pseudomonas putida KT2440
gcguggccgccaacagc

SEQ ID NO: 1635385 - RNA, 14 nt, Pseudomonas putida KT2440
gcguggccagccca

SEQ ID NO: 1635386 - RNA, 18 nt, Pseudomonas putida KT2440
gcguggccuucucuuccg

SEQ ID NO: 1635387 - RNA, 23 nt, Pseudomonas putida KT2440
gcguggaacaacggcucacugcu

SEQ ID NO: 1635388 - RNA, 18 nt, Pseudomonas putida KT2440
gcgucagggucucgcggc

SEQ ID NO: 1635389 - RNA, 20 nt, Pseudomonas putida KT2440
gcgucaucaucagcaggcag

SEQ ID NO: 1635390 - RNA, 17 nt, Pseudomonas putida KT2440
gcgucauccugcgcggc

SEQ ID NO: 1635391 - RNA, 15 nt, Pseudomonas putida KT2440
gcgucaccuuccugg

SEQ ID NO: 1635392 - RNA, 13 nt, Pseudomonas putida KT2440
gcgucacccgcgc

SEQ ID NO: 1635393 - RNA, 17 nt, Pseudomonas putida KT2440
gcgucacccgcgccacc

SEQ ID NO: 1635394 - RNA, 11 nt, Pseudomonas putida KT2440
gcgucaaaguu

SEQ ID NO: 1635395 - RNA, 13 nt, Pseudomonas putida KT2440
gcgucaacucauc

SEQ ID NO: 1635396 - RNA, 13 nt, Pseudomonas putida KT2440
gcguagugcaggc

SEQ ID NO: 1635397 - RNA, 17 nt, Pseudomonas putida KT2440
gcguagugcaggcgcag

SEQ ID NO: 1635398 - RNA, 18 nt, Pseudomonas putida KT2440
gcguaguacuccagcagc

SEQ ID NO: 1635399 - RNA, 20 nt, Pseudomonas putida KT2440
gcguauugccagaaggcuca

SEQ ID NO: 1635400 - RNA, 20 nt, Pseudomonas putida KT2440
gcgucaaacagccgcccagu

SEQ ID NO: 1635401 - RNA, 22 nt, Pseudomonas putida KT2440
gcguaggccugcgaaaggcgcu

SEQ ID NO: 1635402 - RNA, 20 nt, Pseudomonas putida KT2440
gcguaggcgcaucgggccga

SEQ ID NO: 1635403 - RNA, 16 nt, Pseudomonas putida KT2440
gcguaggugcgcggcc

SEQ ID NO: 1635404 - RNA, 16 nt, Pseudomonas putida KT2440
gcguccuggacccgca

SEQ ID NO: 1635405 - RNA, 18 nt, Pseudomonas putida KT2440
gcguccuggacccgcagc

SEQ ID NO: 1635406 - RNA, 15 nt, Pseudomonas putida KT2440
gcguccgucgccggc

SEQ ID NO: 1635407 - RNA, 15 nt, Pseudomonas putida KT2440
gcgucgacucuuccc

SEQ ID NO: 1635408 - RNA, 16 nt, Pseudomonas putida KT2440
gcguccagcagugcca

SEQ ID NO: 1635409 - RNA, 18 nt, Pseudomonas putida KT2440
gcguccaguucaaugcca

SEQ ID NO: 1635410 - RNA, 19 nt, Pseudomonas putida KT2440
gcguccaguucaaugccag

SEQ ID NO: 1635411 - RNA, 20 nt, Pseudomonas putida KT2440
gcguccaguucaaugccagc

SEQ ID NO: 1635412 - RNA, 20 nt, Pseudomonas putida KT2440
gcguccaggcccgccagagc

SEQ ID NO: 1635413 - RNA, 19 nt, Pseudomonas putida KT2440
gcguccagcaacagcugcc

SEQ ID NO: 1635414 - RNA, 15 nt, Pseudomonas putida KT2440
gcguccauggcgccg

SEQ ID NO: 1635415 - RNA, 13 nt, Pseudomonas putida KT2440
gcuggcggcugcc

SEQ ID NO: 1635416 - RNA, 22 nt, Pseudomonas putida KT2440
gcuggcgcuuccuuccuggaag

SEQ ID NO: 1635417 - RNA, 18 nt, Pseudomonas putida KT2440
gcuggccugcagccguug

SEQ ID NO: 1635418 - RNA, 19 nt, Pseudomonas putida KT2440
gcuggccuugcggcaagcu

SEQ ID NO: 1635419 - RNA, 23 nt, Pseudomonas putida KT2440
gcuggccuugcaggaagcggcgc

SEQ ID NO: 1635420 - RNA, 22 nt, Pseudomonas putida KT2440
gcuggccgucacauaguugggc

SEQ ID NO: 1635421 - RNA, 22 nt, Pseudomonas putida KT2440
gcuggccguggugauguucuca

SEQ ID NO: 1635422 - RNA, 15 nt, Pseudomonas putida KT2440
gcuggccguccagcu

SEQ ID NO: 1635423 - RNA, 17 nt, Pseudomonas putida KT2440
gcuggccguccagcuga

SEQ ID NO: 1635424 - RNA, 20 nt, Pseudomonas putida KT2440
gcuggcgcaagccgugccug

SEQ ID NO: 1635425 - RNA, 17 nt, Pseudomonas putida KT2440
gcuggcgaucggcuggu

SEQ ID NO: 1635426 - RNA, 19 nt, Pseudomonas putida KT2440
gcuggcgaucggcuggucc

SEQ ID NO: 1635427 - RNA, 17 nt, Pseudomonas putida KT2440
gcuggcgacgccacccc

SEQ ID NO: 1635428 - RNA, 17 nt, Pseudomonas putida KT2440
gcuggcgaucaggcagg

SEQ ID NO: 1635429 - RNA, 16 nt, Pseudomonas putida KT2440
gcuggccgcacccagc

SEQ ID NO: 1635430 - RNA, 22 nt, Pseudomonas putida KT2440
gcuggccgccagacaacuggcc

SEQ ID NO: 1635431 - RNA, 20 nt, Pseudomonas putida KT2440
gcuggcccuguacauccagc

SEQ ID NO: 1635432 - RNA, 12 nt, Pseudomonas putida KT2440
gcuggcccgcga

SEQ ID NO: 1635433 - RNA, 18 nt, Pseudomonas putida KT2440
gcuggccaucgacccgcu

SEQ ID NO: 1635434 - RNA, 12 nt, Pseudomonas putida KT2440
gcuggcauccac

SEQ ID NO: 1635435 - RNA, 21 nt, Pseudomonas putida KT2440
gcuggccaccaugaacagcac

SEQ ID NO: 1635436 - RNA, 16 nt, Pseudomonas putida KT2440
gcuggccaaucuccac

SEQ ID NO: 1635437 - RNA, 17 nt, Pseudomonas putida KT2440
gcuggccaaucuccacc

SEQ ID NO: 1635438 - RNA, 14 nt, Pseudomonas putida KT2440
gcuggccagccgcu

SEQ ID NO: 1635439 - RNA, 14 nt, Pseudomonas putida KT2440
gcuggcagcugcag

SEQ ID NO: 1635440 - RNA, 16 nt, Pseudomonas putida KT2440
gcuggcagcugcagug

SEQ ID NO: 1635441 - RNA, 21 nt, Pseudomonas putida KT2440
gcuggcagcugcagugcuggg

SEQ ID NO: 1635442 - RNA, 17 nt, Pseudomonas putida KT2440
gcuggauacccagcgcc

SEQ ID NO: 1635443 - RNA, 14 nt, Pseudomonas putida KT2440
gcuggaucaccacc

SEQ ID NO: 1635444 - RNA, 12 nt, Pseudomonas putida KT2440
gcuggauagagu

SEQ ID NO: 1635445 - RNA, 17 nt, Pseudomonas putida KT2440
gcuggaccuggcuggcg

SEQ ID NO: 1635446 - RNA, 16 nt, Pseudomonas putida KT2440
gcuggacucgccgaga

SEQ ID NO: 1635447 - RNA, 22 nt, Pseudomonas putida KT2440
gcuggacccaaucgcugugcaa

SEQ ID NO: 1635448 - RNA, 14 nt, Pseudomonas putida KT2440
gcugcuuugcagcc

SEQ ID NO: 1635449 - RNA, 16 nt, Pseudomonas putida KT2440
gcugcuuugcagcccu

SEQ ID NO: 1635450 - RNA, 15 nt, Pseudomonas putida KT2440
gcugcugugcggcug

SEQ ID NO: 1635451 - RNA, 12 nt, Pseudomonas putida KT2440
gcugcugcaggg

SEQ ID NO: 1635452 - RNA, 14 nt, Pseudomonas putida KT2440
gcugcugccauccu

SEQ ID NO: 1635453 - RNA, 17 nt, Pseudomonas putida KT2440
gcugcugcagcacugcc

SEQ ID NO: 1635454 - RNA, 20 nt, Pseudomonas putida KT2440
gcugcugcagcacugccugc

SEQ ID NO: 1635455 - RNA, 21 nt, Pseudomonas putida KT2440
gcugcuucacgggucaugcca

SEQ ID NO: 1635456 - RNA, 22 nt, Pseudomonas putida KT2440
gcugcuuaccagcuuggcgccc

SEQ ID NO: 1635457 - RNA, 21 nt, Pseudomonas putida KT2440
gcugcggcaugaaggcccagc

SEQ ID NO: 1635458 - RNA, 15 nt, Pseudomonas putida KT2440
gcugcggcaggcugg

SEQ ID NO: 1635459 - RNA, 16 nt, Pseudomonas putida KT2440
gcugcggcaggcuggc

SEQ ID NO: 1635460 - RNA, 17 nt, Pseudomonas putida KT2440
gcugcggauacagcgcc

SEQ ID NO: 1635461 - RNA, 22 nt, Pseudomonas putida KT2440
gcugcggaucaucuccaugaag

SEQ ID NO: 1635462 - RNA, 17 nt, Pseudomonas putida KT2440
gcugcccucgggcagcc

SEQ ID NO: 1635463 - RNA, 19 nt, Pseudomonas putida KT2440
gcugcccucgggcagccuu

SEQ ID NO: 1635464 - RNA, 18 nt, Pseudomonas putida KT2440
gcugcggcgaaagccagc

SEQ ID NO: 1635465 - RNA, 19 nt, Pseudomonas putida KT2440
gcugcggcgaaagccagca

SEQ ID NO: 1635466 - RNA, 20 nt, Pseudomonas putida KT2440
gcugcggcgaaagccagcag

SEQ ID NO: 1635467 - RNA, 14 nt, Pseudomonas putida KT2440
gcugcucgccucac

SEQ ID NO: 1635468 - RNA, 14 nt, Pseudomonas putida KT2440
gcugcguccucgga

SEQ ID NO: 1635469 - RNA, 15 nt, Pseudomonas putida KT2440
gcugcgucagcaucc

SEQ ID NO: 1635470 - RNA, 16 nt, Pseudomonas putida KT2440
gcugcgucagcaucca

SEQ ID NO: 1635471 - RNA, 15 nt, Pseudomonas putida KT2440
gcugcgucaggccau

SEQ ID NO: 1635472 - RNA, 17 nt, Pseudomonas putida KT2440
gcugcgucaggccaugc

SEQ ID NO: 1635473 - RNA, 18 nt, Pseudomonas putida KT2440
gcugcgucaggccaugcc

SEQ ID NO: 1635474 - RNA, 18 nt, Pseudomonas putida KT2440
gcugcguacgcucugguc

SEQ ID NO: 1635475 - RNA, 17 nt, Pseudomonas putida KT2440
gcugcggucaucaccac

SEQ ID NO: 1635476 - RNA, 15 nt, Pseudomonas putida KT2440
gcugcggggcagccc

SEQ ID NO: 1635477 - RNA, 19 nt, Pseudomonas putida KT2440
gcugcggguaaugccaccu

SEQ ID NO: 1635478 - RNA, 15 nt, Pseudomonas putida KT2440
gcugcgguaccggcc

SEQ ID NO: 1635479 - RNA, 18 nt, Pseudomonas putida KT2440
gcugcgguaccggccagc

SEQ ID NO: 1635480 - RNA, 23 nt, Pseudomonas putida KT2440
gcuggggauggcaccggcucugc

SEQ ID NO: 1635481 - RNA, 16 nt, Pseudomonas putida KT2440
gcugggcuucuucgug

SEQ ID NO: 1635482 - RNA, 22 nt, Pseudomonas putida KT2440
gcugggcuucuucgugcgccuc

SEQ ID NO: 1635483 - RNA, 23 nt, Pseudomonas putida KT2440
gcugggcuucuucgugcgccuca

SEQ ID NO: 1635484 - RNA, 19 nt, Pseudomonas putida KT2440
gcugggcgugccaggcuug

SEQ ID NO: 1635485 - RNA, 15 nt, Pseudomonas putida KT2440
gcugggcguuuccag

SEQ ID NO: 1635486 - RNA, 12 nt, Pseudomonas putida KT2440
gcugguacucca

SEQ ID NO: 1635487 - RNA, 19 nt, Pseudomonas putida KT2440
gcugggugccaucagggcg

SEQ ID NO: 1635488 - RNA, 15 nt, Pseudomonas putida KT2440
gcuggcgucauccug

SEQ ID NO: 1635489 - RNA, 12 nt, Pseudomonas putida KT2440
gcuggcguggug

SEQ ID NO: 1635490 - RNA, 19 nt, Pseudomonas putida KT2440
gcuggcuacccgcucggcc

SEQ ID NO: 1635491 - RNA, 21 nt, Pseudomonas putida KT2440
gcuggcuguaccggccucuuc

SEQ ID NO: 1635492 - RNA, 18 nt, Pseudomonas putida KT2440
gcuggcuuuggagccugc

SEQ ID NO: 1635493 - RNA, 23 nt, Pseudomonas putida KT2440
gcugggcacccugaucgaugagc

SEQ ID NO: 1635494 - RNA, 19 nt, Pseudomonas putida KT2440
gcugguucgauuccagcag

SEQ ID NO: 1635495 - RNA, 17 nt, Pseudomonas putida KT2440
gcuggugguggcccuga

SEQ ID NO: 1635496 - RNA, 22 nt, Pseudomonas putida KT2440
gcuggugucggccagggcccgc

SEQ ID NO: 1635497 - RNA, 18 nt, Pseudomonas putida KT2440
gcugguguguugaagucc

SEQ ID NO: 1635498 - RNA, 16 nt, Pseudomonas putida KT2440
gcugguuuggcagcac

SEQ ID NO: 1635499 - RNA, 12 nt, Pseudomonas putida KT2440
gcugguggcggc

SEQ ID NO: 1635500 - RNA, 19 nt, Pseudomonas putida KT2440
gcugucgauuuccagugcc

SEQ ID NO: 1635501 - RNA, 22 nt, Pseudomonas putida KT2440
gcuguccuuggccaacugcagc

SEQ ID NO: 1635502 - RNA, 20 nt, Pseudomonas putida KT2440
gcugucgaagcgcucccagg

SEQ ID NO: 1635503 - RNA, 21 nt, Pseudomonas putida KT2440
gcuguccucaaucacauccac

SEQ ID NO: 1635504 - RNA, 14 nt, Pseudomonas putida KT2440
gcugucguccagcu

SEQ ID NO: 1635505 - RNA, 13 nt, Pseudomonas putida KT2440
gcugucgugcuca

SEQ ID NO: 1635506 - RNA, 17 nt, Pseudomonas putida KT2440
gcugucgguaccuggcc

SEQ ID NO: 1635507 - RNA, 14 nt, Pseudomonas putida KT2440
gcugucggucagca

SEQ ID NO: 1635508 - RNA, 21 nt, Pseudomonas putida KT2440
gcugucggucagcaucugggu

SEQ ID NO: 1635509 - RNA, 16 nt, Pseudomonas putida KT2440
gcugucggugaagccg

SEQ ID NO: 1635510 - RNA, 18 nt, Pseudomonas putida KT2440
gcugucggcauagggcac

SEQ ID NO: 1635511 - RNA, 19 nt, Pseudomonas putida KT2440
gcugucggcauagggcaca

SEQ ID NO: 1635512 - RNA, 19 nt, Pseudomonas putida KT2440
gcugucggcaugcacuucc

SEQ ID NO: 1635513 - RNA, 21 nt, Pseudomonas putida KT2440
gcugucgucaagcucuuccuu

SEQ ID NO: 1635514 - RNA, 15 nt, Pseudomonas putida KT2440
gcugcccaggugcca

SEQ ID NO: 1635515 - RNA, 15 nt, Pseudomonas putida KT2440
gcugccccaagugcc

SEQ ID NO: 1635516 - RNA, 21 nt, Pseudomonas putida KT2440
gcugcauacgcaccaacuggu

SEQ ID NO: 1635517 - RNA, 16 nt, Pseudomonas putida KT2440
gcugccaugcgcugca

SEQ ID NO: 1635518 - RNA, 13 nt, Pseudomonas putida KT2440
gcugccauacagc

SEQ ID NO: 1635519 - RNA, 16 nt, Pseudomonas putida KT2440
gcugccauacagccag

SEQ ID NO: 1635520 - RNA, 14 nt, Pseudomonas putida KT2440
gcugcaugcucggc

SEQ ID NO: 1635521 - RNA, 18 nt, Pseudomonas putida KT2440
gcugcauuggcggcaggc

SEQ ID NO: 1635522 - RNA, 23 nt, Pseudomonas putida KT2440
gcugcauuggcggcaggcgcagc

SEQ ID NO: 1635523 - RNA, 17 nt, Pseudomonas putida KT2440
gcugcacaggccagccc

SEQ ID NO: 1635524 - RNA, 18 nt, Pseudomonas putida KT2440
gcugcacaggccagcccc

SEQ ID NO: 1635525 - RNA, 17 nt, Pseudomonas putida KT2440
gcugcacaucuccacug

SEQ ID NO: 1635526 - RNA, 16 nt, Pseudomonas putida KT2440
gcugcaccaccugcuc

SEQ ID NO: 1635527 - RNA, 18 nt, Pseudomonas putida KT2440
gcugcaccaccugcuccu

SEQ ID NO: 1635528 - RNA, 16 nt, Pseudomonas putida KT2440
gcugcaccgcagcccc

SEQ ID NO: 1635529 - RNA, 21 nt, Pseudomonas putida KT2440
gcugcagggcccagccaccga

SEQ ID NO: 1635530 - RNA, 16 nt, Pseudomonas putida KT2440
gcugcaguucuuccag

SEQ ID NO: 1635531 - RNA, 15 nt, Pseudomonas putida KT2440
gcugaugcgccgcuc

SEQ ID NO: 1635532 - RNA, 15 nt, Pseudomonas putida KT2440
gcugaugcgcuggcc

SEQ ID NO: 1635533 - RNA, 17 nt, Pseudomonas putida KT2440
gcugaugcgcuggcccu

SEQ ID NO: 1635534 - RNA, 18 nt, Pseudomonas putida KT2440
gcugaugcgcuggcccuu

SEQ ID NO: 1635535 - RNA, 20 nt, Pseudomonas putida KT2440
gcugaugcgggaccagcacc

SEQ ID NO: 1635536 - RNA, 22 nt, Pseudomonas putida KT2440
gcugaugcgggaccagcaccac

SEQ ID NO: 1635537 - RNA, 15 nt, Pseudomonas putida KT2440
gcugacgcgccgugc

SEQ ID NO: 1635538 - RNA, 19 nt, Pseudomonas putida KT2440
gcugaccauaccucccgca

SEQ ID NO: 1635539 - RNA, 16 nt, Pseudomonas putida KT2440
gcugaccacaaagccu

SEQ ID NO: 1635540 - RNA, 22 nt, Pseudomonas putida KT2440
gcugaccacgccgaagcgcgcc

SEQ ID NO: 1635541 - RNA, 18 nt, Pseudomonas putida KT2440
gcucuuugggggugcuga

SEQ ID NO: 1635542 - RNA, 20 nt, Pseudomonas putida KT2440
gcugagguucagcgcaccgc

SEQ ID NO: 1635543 - RNA, 14 nt, Pseudomonas putida KT2440
gcugauaaccugca

SEQ ID NO: 1635544 - RNA, 14 nt, Pseudomonas putida KT2440
gcugagcgccaucc

SEQ ID NO: 1635545 - RNA, 22 nt, Pseudomonas putida KT2440
gcugagcgccauccaccuguga

SEQ ID NO: 1635546 - RNA, 18 nt, Pseudomonas putida KT2440
gcugacguugucauggcu

SEQ ID NO: 1635547 - RNA, 12 nt, Pseudomonas putida KT2440
gcugacugccag

SEQ ID NO: 1635548 - RNA, 19 nt, Pseudomonas putida KT2440
gcucuggcccgaacagcac

SEQ ID NO: 1635549 - RNA, 18 nt, Pseudomonas putida KT2440
gcucuguuucugccccug

SEQ ID NO: 1635550 - RNA, 19 nt, Pseudomonas putida KT2440
gcucuguuucugccccugg

SEQ ID NO: 1635551 - RNA, 19 nt, Pseudomonas putida KT2440
gcucuguaucgaacaggca

SEQ ID NO: 1635552 - RNA, 20 nt, Pseudomonas putida KT2440
gcucuguaucgaacaggcag

SEQ ID NO: 1635553 - RNA, 21 nt, Pseudomonas putida KT2440
gcucuucgaguuuggccagcc

SEQ ID NO: 1635554 - RNA, 14 nt, Pseudomonas putida KT2440
gcucuucgaucucu

SEQ ID NO: 1635555 - RNA, 13 nt, Pseudomonas putida KT2440
gcucuucaucgcg

SEQ ID NO: 1635556 - RNA, 23 nt, Pseudomonas putida KT2440
gcucuucaccugaccauuggcca

SEQ ID NO: 1635557 - RNA, 20 nt, Pseudomonas putida KT2440
gcucuucaacaccagcaugu

SEQ ID NO: 1635558 - RNA, 12 nt, Pseudomonas putida KT2440
gcucuucaaccg

SEQ ID NO: 1635559 - RNA, 18 nt, Pseudomonas putida KT2440
gcucuugucgacagugaa

SEQ ID NO: 1635560 - RNA, 14 nt, Pseudomonas putida KT2440
gcucuccagccgcu

SEQ ID NO: 1635561 - RNA, 18 nt, Pseudomonas putida KT2440
gcucugaaugucagcgcu

SEQ ID NO: 1635562 - RNA, 18 nt, Pseudomonas putida KT2440
gcucugcaggcacacccg

SEQ ID NO: 1635563 - RNA, 20 nt, Pseudomonas putida KT2440
gcucugcccgcgccacccgc

SEQ ID NO: 1635564 - RNA, 23 nt, Pseudomonas putida KT2440
gcucugcccgcgccacccgcugg

SEQ ID NO: 1635565 - RNA, 24 nt, Pseudomonas putida KT2440
gcucugccgccgcagcaaucugcu

SEQ ID NO: 1635566 - RNA, 15 nt, Pseudomonas putida KT2440
gcucugcuccagcug

SEQ ID NO: 1635567 - RNA, 21 nt, Pseudomonas putida KT2440
gcucguaauccucguccagcu

SEQ ID NO: 1635568 - RNA, 17 nt, Pseudomonas putida KT2440
gcucgucaaccacagcc

SEQ ID NO: 1635569 - RNA, 19 nt, Pseudomonas putida KT2440
gcucgucaaccacagcccg

SEQ ID NO: 1635570 - RNA, 21 nt, Pseudomonas putida KT2440
gcucggcggugccugcagccc

SEQ ID NO: 1635571 - RNA, 11 nt, Pseudomonas putida KT2440
gcucggcuggg

SEQ ID NO: 1635572 - RNA, 15 nt, Pseudomonas putida KT2440
gcucguugcugagca

SEQ ID NO: 1635573 - RNA, 16 nt, Pseudomonas putida KT2440
gcucuaaaucgaccug

SEQ ID NO: 1635574 - RNA, 13 nt, Pseudomonas putida KT2440
gcucguccaucac

SEQ ID NO: 1635575 - RNA, 13 nt, Pseudomonas putida KT2440
gcucgucagcccc

SEQ ID NO: 1635576 - RNA, 17 nt, Pseudomonas putida KT2440
gcucgcgcugccaggcc

SEQ ID NO: 1635577 - RNA, 19 nt, Pseudomonas putida KT2440
gcucgcgccgccgcugcug

SEQ ID NO: 1635578 - RNA, 21 nt, Pseudomonas putida KT2440
gcucgcgcaggaaccgcguca

SEQ ID NO: 1635579 - RNA, 17 nt, Pseudomonas putida KT2440
gcucgcgcaacaaggcc

SEQ ID NO: 1635580 - RNA, 12 nt, Pseudomonas putida KT2440
gcucggccuugc

SEQ ID NO: 1635581 - RNA, 15 nt, Pseudomonas putida KT2440
gcucggccugggcag

SEQ ID NO: 1635582 - RNA, 23 nt, Pseudomonas putida KT2440
gcucggccaccacuucuggcugg

SEQ ID NO: 1635583 - RNA, 16 nt, Pseudomonas putida KT2440
gcucggcaguggcggu

SEQ ID NO: 1635584 - RNA, 14 nt, Pseudomonas putida KT2440
gcuaucucaggcca

SEQ ID NO: 1635585 - RNA, 18 nt, Pseudomonas putida KT2440
gcuaucgccagcaggccg

SEQ ID NO: 1635586 - RNA, 15 nt, Pseudomonas putida KT2440
gcuauaucucuggua

SEQ ID NO: 1635587 - RNA, 21 nt, Pseudomonas putida KT2440
gcucaagcccugccgccuucu

SEQ ID NO: 1635588 - RNA, 22 nt, Pseudomonas putida KT2440
gcucaaccuuugcggcacaucu

SEQ ID NO: 1635589 - RNA, 15 nt, Pseudomonas putida KT2440
gcucaacccgccuga

SEQ ID NO: 1635590 - RNA, 13 nt, Pseudomonas putida KT2440
gcucaacagccac

SEQ ID NO: 1635591 - RNA, 12 nt, Pseudomonas putida KT2440
gcucaaaugcug

SEQ ID NO: 1635592 - RNA, 22 nt, Pseudomonas putida KT2440
gcucaaaugcuggcaauccagc

SEQ ID NO: 1635593 - RNA, 15 nt, Pseudomonas putida KT2440
gcucaacuacccuga

SEQ ID NO: 1635594 - RNA, 16 nt, Pseudomonas putida KT2440
gcucaacuccauggcc

SEQ ID NO: 1635595 - RNA, 20 nt, Pseudomonas putida KT2440
gcucaaaccccccaugcuca

SEQ ID NO: 1635596 - RNA, 15 nt, Pseudomonas putida KT2440
gcucaaagcgcaaaa

SEQ ID NO: 1635597 - RNA, 13 nt, Pseudomonas putida KT2440
gcucaaaaaaaua

SEQ ID NO: 1635598 - RNA, 16 nt, Pseudomonas putida KT2440
gcuaugccggccccgu

SEQ ID NO: 1635599 - RNA, 19 nt, Pseudomonas putida KT2440
gcucagguaggcagcaacg

SEQ ID NO: 1635600 - RNA, 22 nt, Pseudomonas putida KT2440
gcucaguaauaggugcguggcu

SEQ ID NO: 1635601 - RNA, 19 nt, Pseudomonas putida KT2440
gcucagugugggggcggcc

SEQ ID NO: 1635602 - RNA, 22 nt, Pseudomonas putida KT2440
gcucaggcguggaaaaggcgcu

SEQ ID NO: 1635603 - RNA, 14 nt, Pseudomonas putida KT2440
gcucaggcucagcu

SEQ ID NO: 1635604 - RNA, 17 nt, Pseudomonas putida KT2440
gcucaggcucagcucca

SEQ ID NO: 1635605 - RNA, 16 nt, Pseudomonas putida KT2440
gcucaggcgcuccagc

SEQ ID NO: 1635606 - RNA, 21 nt, Pseudomonas putida KT2440
gcucaggcucuugaacugggc

SEQ ID NO: 1635607 - RNA, 15 nt, Pseudomonas putida KT2440
gcucaggugcaccuc

SEQ ID NO: 1635608 - RNA, 22 nt, Pseudomonas putida KT2440
gcucagguuacgcaccagcucc

SEQ ID NO: 1635609 - RNA, 18 nt, Pseudomonas putida KT2440
gcucaugguucuggcgca

SEQ ID NO: 1635610 - RNA, 19 nt, Pseudomonas putida KT2440
gcucccccuccacccgguc

SEQ ID NO: 1635611 - RNA, 17 nt, Pseudomonas putida KT2440
gcucccccaggcugcca

SEQ ID NO: 1635612 - RNA, 18 nt, Pseudomonas putida KT2440
gcuccaggccugcggcag

SEQ ID NO: 1635613 - RNA, 20 nt, Pseudomonas putida KT2440
gcuccaggugaaucagcggc

SEQ ID NO: 1635614 - RNA, 22 nt, Pseudomonas putida KT2440
gcuccaggugaaucagcggcag

SEQ ID NO: 1635615 - RNA, 23 nt, Pseudomonas putida KT2440
gcuccaggugaaucagcggcagg

SEQ ID NO: 1635616 - RNA, 20 nt, Pseudomonas putida KT2440
gcuccagucguggcgcuggc

SEQ ID NO: 1635617 - RNA, 21 nt, Pseudomonas putida KT2440
gcuccagucguggcgcuggcg

SEQ ID NO: 1635618 - RNA, 12 nt, Pseudomonas putida KT2440
gcucccagaaag

SEQ ID NO: 1635619 - RNA, 17 nt, Pseudomonas putida KT2440
gcuccagcucacagcac

SEQ ID NO: 1635620 - RNA, 18 nt, Pseudomonas putida KT2440
gcuccaggcacaggcgca

SEQ ID NO: 1635621 - RNA, 14 nt, Pseudomonas putida KT2440
gcuccaggcggcca

SEQ ID NO: 1635622 - RNA, 15 nt, Pseudomonas putida KT2440
gcuccaggcggccag

SEQ ID NO: 1635623 - RNA, 16 nt, Pseudomonas putida KT2440
gcuccaggcggccagc

SEQ ID NO: 1635624 - RNA, 17 nt, Pseudomonas putida KT2440
gcuccaggcggccagcc

SEQ ID NO: 1635625 - RNA, 18 nt, Pseudomonas putida KT2440
gcuccaccugccaccccg

SEQ ID NO: 1635626 - RNA, 14 nt, Pseudomonas putida KT2440
gcuccaccugcucc

SEQ ID NO: 1635627 - RNA, 17 nt, Pseudomonas putida KT2440
gcuccaccugcuccagc

SEQ ID NO: 1635628 - RNA, 14 nt, Pseudomonas putida KT2440
gcucaccgcagccc

SEQ ID NO: 1635629 - RNA, 17 nt, Pseudomonas putida KT2440
gcucaccgcagcccagc

SEQ ID NO: 1635630 - RNA, 16 nt, Pseudomonas putida KT2440
gcucaccccgccccug

SEQ ID NO: 1635631 - RNA, 19 nt, Pseudomonas putida KT2440
gcucaccguggucuccaac

SEQ ID NO: 1635632 - RNA, 13 nt, Pseudomonas putida KT2440
gcucaccugguac

SEQ ID NO: 1635633 - RNA, 15 nt, Pseudomonas putida KT2440
gcucacgcagccagu

SEQ ID NO: 1635634 - RNA, 13 nt, Pseudomonas putida KT2440
gcucacgccccgu

SEQ ID NO: 1635635 - RNA, 20 nt, Pseudomonas putida KT2440
gcucacacccaggcucgccc

SEQ ID NO: 1635636 - RNA, 12 nt, Pseudomonas putida KT2440
gcucacagcacu

SEQ ID NO: 1635637 - RNA, 22 nt, Pseudomonas putida KT2440
gcucaaucaaccagcccgccgc

SEQ ID NO: 1635638 - RNA, 22 nt, Pseudomonas putida KT2440
gcucagcgagcgguucagcgca

SEQ ID NO: 1635639 - RNA, 13 nt, Pseudomonas putida KT2440
gcucaggccuugc

SEQ ID NO: 1635640 - RNA, 16 nt, Pseudomonas putida KT2440
gcucaggccaugcugc

SEQ ID NO: 1635641 - RNA, 22 nt, Pseudomonas putida KT2440
gcucaggccaugcugcgccagg

SEQ ID NO: 1635642 - RNA, 22 nt, Pseudomonas putida KT2440
gcucaggaucacgucacccagg

SEQ ID NO: 1635643 - RNA, 16 nt, Pseudomonas putida KT2440
gcucacuggcauccag

SEQ ID NO: 1635644 - RNA, 19 nt, Pseudomonas putida KT2440
gcucacugaccaccuggau

SEQ ID NO: 1635645 - RNA, 18 nt, Pseudomonas putida KT2440
gcucagccaaccgcccca

SEQ ID NO: 1635646 - RNA, 17 nt, Pseudomonas putida KT2440
gcucagccaccuguggg

SEQ ID NO: 1635647 - RNA, 18 nt, Pseudomonas putida KT2440
gcucagccacgcuggcac

SEQ ID NO: 1635648 - RNA, 15 nt, Pseudomonas putida KT2440
gcucagccagcaagc

SEQ ID NO: 1635649 - RNA, 18 nt, Pseudomonas putida KT2440
gcguucaucgaaggccuu

SEQ ID NO: 1635650 - RNA, 22 nt, Pseudomonas putida KT2440
gcguucggcaucugccgggucg

SEQ ID NO: 1635651 - RNA, 23 nt, Pseudomonas putida KT2440
gcguucagccgaucacuuccugg

SEQ ID NO: 1635652 - RNA, 16 nt, Pseudomonas putida KT2440
gcguucacaucgcccu

SEQ ID NO: 1635653 - RNA, 15 nt, Pseudomonas putida KT2440
gcguggucgccggcg

SEQ ID NO: 1635654 - RNA, 14 nt, Pseudomonas putida KT2440
gcguggggccugcc

SEQ ID NO: 1635655 - RNA, 16 nt, Pseudomonas putida KT2440
gcguggggccugccgg

SEQ ID NO: 1635656 - RNA, 18 nt, Pseudomonas putida KT2440
gcguggcugcguucaggc

SEQ ID NO: 1635657 - RNA, 18 nt, Pseudomonas putida KT2440
gcgugucaggagggccgu

SEQ ID NO: 1635658 - RNA, 13 nt, Pseudomonas putida KT2440
gcguguccagcag

SEQ ID NO: 1635659 - RNA, 15 nt, Pseudomonas putida KT2440
gcguguccagcaggu

SEQ ID NO: 1635660 - RNA, 21 nt, Pseudomonas putida KT2440
gcguguaguagcuccagccca

SEQ ID NO: 1635661 - RNA, 19 nt, Pseudomonas putida KT2440
gcguuguucagcagcgaag

SEQ ID NO: 1635662 - RNA, 19 nt, Pseudomonas putida KT2440
gcguuuaaaccuucaacac

SEQ ID NO: 1635663 - RNA, 20 nt, Pseudomonas putida KT2440
gcguuucggcggccugcagc

SEQ ID NO: 1635664 - RNA, 21 nt, Pseudomonas putida KT2440
gcguuucggcggccugcagcu

SEQ ID NO: 1635665 - RNA, 19 nt, Pseudomonas putida KT2440
gcguuuguaaguaggcgcu

SEQ ID NO: 1635666 - RNA, 21 nt, Pseudomonas putida KT2440
gcguuuuucucgaugaugcug

SEQ ID NO: 1635667 - RNA, 21 nt, Pseudomonas putida KT2440
gcguuuuuguuuggguugccu

SEQ ID NO: 1635668 - RNA, 16 nt, Pseudomonas putida KT2440
gcguucuuucucccag

SEQ ID NO: 1635669 - RNA, 23 nt, Pseudomonas putida KT2440
gcguucgucaagcucgacccgcg

SEQ ID NO: 1635670 - RNA, 13 nt, Pseudomonas putida KT2440
gcguugccccuuc

SEQ ID NO: 1635671 - RNA, 14 nt, Pseudomonas putida KT2440
gcguugaccugcug

SEQ ID NO: 1635672 - RNA, 15 nt, Pseudomonas putida KT2440
gcguuguccagcagg

SEQ ID NO: 1635673 - RNA, 18 nt, Pseudomonas putida KT2440
gcguugucagcaaccgga

SEQ ID NO: 1635674 - RNA, 15 nt, Pseudomonas putida KT2440
gcguugcuccagcuc

SEQ ID NO: 1635675 - RNA, 18 nt, Pseudomonas putida KT2440
gcguuggccgaaggccgu

SEQ ID NO: 1635676 - RNA, 23 nt, Pseudomonas putida KT2440
gcguugcggcccuucgcgggcac

SEQ ID NO: 1635677 - RNA, 21 nt, Pseudomonas putida KT2440
gcguugccgaugaccugcguc

SEQ ID NO: 1635678 - RNA, 16 nt, Pseudomonas putida KT2440
gcuaccacguuaucca

SEQ ID NO: 1635679 - RNA, 17 nt, Pseudomonas putida KT2440
gcuaccacguuauccag

SEQ ID NO: 1635680 - RNA, 20 nt, Pseudomonas putida KT2440
gcuaccacguuauccagcug

SEQ ID NO: 1635681 - RNA, 15 nt, Pseudomonas putida KT2440
gcuacccgcucggcc

SEQ ID NO: 1635682 - RNA, 15 nt, Pseudomonas putida KT2440
gcuaccaaucuguac

SEQ ID NO: 1635683 - RNA, 23 nt, Pseudomonas putida KT2440
gcuacccacuccccacuccugug

SEQ ID NO: 1635684 - RNA, 21 nt, Pseudomonas putida KT2440
gcuacccaaacucuugagcug

SEQ ID NO: 1635685 - RNA, 12 nt, Pseudomonas putida KT2440
gcuacagccccu

SEQ ID NO: 1635686 - RNA, 21 nt, Pseudomonas putida KT2440
gcuacagccccuuccccaggc

SEQ ID NO: 1635687 - RNA, 22 nt, Pseudomonas putida KT2440
gcuacagccccuuccccaggcc

SEQ ID NO: 1635688 - RNA, 16 nt, Pseudomonas putida KT2440
gcuacaccggccugga

SEQ ID NO: 1635689 - RNA, 18 nt, Pseudomonas putida KT2440
gcuacgcucguccaggcc

SEQ ID NO: 1635690 - RNA, 16 nt, Pseudomonas putida KT2440
gcuacggccgugcagg

SEQ ID NO: 1635691 - RNA, 17 nt, Pseudomonas putida KT2440
gcuacgugauugacccg

SEQ ID NO: 1635692 - RNA, 22 nt, Pseudomonas putida KT2440
gcuacgagacgguggcugccag

SEQ ID NO: 1635693 - RNA, 22 nt, Pseudomonas putida KT2440
gcuacgagagaucgcagcgagc

SEQ ID NO: 1635694 - RNA, 15 nt, Pseudomonas putida KT2440
gcuacgaaccgagcg

SEQ ID NO: 1635695 - RNA, 16 nt, Pseudomonas putida KT2440
gcuaccugacuugccu

SEQ ID NO: 1635696 - RNA, 18 nt, Pseudomonas putida KT2440
gcuaccugacuugccugu

SEQ ID NO: 1635697 - RNA, 13 nt, Pseudomonas putida KT2440
gcuacgccgcccc

SEQ ID NO: 1635698 - RNA, 17 nt, Pseudomonas putida KT2440
gcuacgccgccccacuc

SEQ ID NO: 1635699 - RNA, 18 nt, Pseudomonas putida KT2440
gcuacgcagcacccgguc

SEQ ID NO: 1635700 - RNA, 19 nt, Pseudomonas putida KT2440
gcuaacgacccaaaaaugg

SEQ ID NO: 1635701 - RNA, 18 nt, Pseudomonas putida KT2440
gcuaaacgaguuucucgc

SEQ ID NO: 1635702 - RNA, 22 nt, Pseudomonas putida KT2440
gcuuuucguuggccagcuuggc

SEQ ID NO: 1635703 - RNA, 17 nt, Pseudomonas putida KT2440
gcuuuucuucgcugcug

SEQ ID NO: 1635704 - RNA, 13 nt, Pseudomonas putida KT2440
gcuuuugaugguc

SEQ ID NO: 1635705 - RNA, 12 nt, Pseudomonas putida KT2440
ggaaaaccgcuc

SEQ ID NO: 1635706 - RNA, 22 nt, Pseudomonas putida KT2440
gcuuuuucguuauggaaggcaa

SEQ ID NO: 1635707 - RNA, 17 nt, Pseudomonas putida KT2440
gcuuuuuugugccuggu

SEQ ID NO: 1635708 - RNA, 21 nt, Pseudomonas putida KT2440
gcugugcggcguauacccggu

SEQ ID NO: 1635709 - RNA, 13 nt, Pseudomonas putida KT2440
gcugugcgugauu

SEQ ID NO: 1635710 - RNA, 24 nt, Pseudomonas putida KT2440
gcugugcacccgugccugccugca

SEQ ID NO: 1635711 - RNA, 22 nt, Pseudomonas putida KT2440
gcugugcacugcgaagcccagu

SEQ ID NO: 1635712 - RNA, 22 nt, Pseudomonas putida KT2440
gcugugcagcgcucgcugccgg

SEQ ID NO: 1635713 - RNA, 23 nt, Pseudomonas putida KT2440
gcuguggcaauuggcggaagccu

SEQ ID NO: 1635714 - RNA, 23 nt, Pseudomonas putida KT2440
gcuuucuggaggaguccagcugc

SEQ ID NO: 1635715 - RNA, 13 nt, Pseudomonas putida KT2440
gcuuucucauccc

SEQ ID NO: 1635716 - RNA, 19 nt, Pseudomonas putida KT2440
gcuuugcaccccuuuuucu

SEQ ID NO: 1635717 - RNA, 19 nt, Pseudomonas putida KT2440
gcuuugcacccgcgcgcug

SEQ ID NO: 1635718 - RNA, 12 nt, Pseudomonas putida KT2440
gcuuugcagccc

SEQ ID NO: 1635719 - RNA, 16 nt, Pseudomonas putida KT2440
gcuuugcagcccauuc

SEQ ID NO: 1635720 - RNA, 15 nt, Pseudomonas putida KT2440
gcuuugcagcccuuc

SEQ ID NO: 1635721 - RNA, 13 nt, Pseudomonas putida KT2440
gcuuugccggccu

SEQ ID NO: 1635722 - RNA, 16 nt, Pseudomonas putida KT2440
gcuuugcgucaucauc

SEQ ID NO: 1635723 - RNA, 18 nt, Pseudomonas putida KT2440
gcuuugcguggcaccggc

SEQ ID NO: 1635724 - RNA, 16 nt, Pseudomonas putida KT2440
gcuuugaagucacuuu

SEQ ID NO: 1635725 - RNA, 16 nt, Pseudomonas putida KT2440
gcuuuggucgcggcgc

SEQ ID NO: 1635726 - RNA, 13 nt, Pseudomonas putida KT2440
gcuuuggcagcag

SEQ ID NO: 1635727 - RNA, 15 nt, Pseudomonas putida KT2440
gcuuuggcagcagcc

SEQ ID NO: 1635728 - RNA, 21 nt, Pseudomonas putida KT2440
gcuuuguuugcuggcauggca

SEQ ID NO: 1635729 - RNA, 19 nt, Pseudomonas putida KT2440
ggaagcugggaauccagug

SEQ ID NO: 1635730 - RNA, 16 nt, Pseudomonas putida KT2440
ggaaggcaaagauuua

SEQ ID NO: 1635731 - RNA, 13 nt, Pseudomonas putida KT2440
ggaaggcagcggg

SEQ ID NO: 1635732 - RNA, 23 nt, Pseudomonas putida KT2440
ggaagcagaugaacccggcaaug

SEQ ID NO: 1635733 - RNA, 21 nt, Pseudomonas putida KT2440
ggaaggcgucacgcagggcca

SEQ ID NO: 1635734 - RNA, 19 nt, Pseudomonas putida KT2440
ggaauagaacacuggcagg

SEQ ID NO: 1635735 - RNA, 24 nt, Pseudomonas putida KT2440
ggaauagaacacuggcaggcucag

SEQ ID NO: 1635736 - RNA, 12 nt, Pseudomonas putida KT2440
ggaaucacgcgg

SEQ ID NO: 1635737 - RNA, 11 nt, Pseudomonas putida KT2440
ggaaauccucg

SEQ ID NO: 1635738 - RNA, 20 nt, Pseudomonas putida KT2440
ggaaauaccagacgcaggca

SEQ ID NO: 1635739 - RNA, 13 nt, Pseudomonas putida KT2440
ggaaagcccccgc

SEQ ID NO: 1635740 - RNA, 17 nt, Pseudomonas putida KT2440
ggaaacaguuucuucag

SEQ ID NO: 1635741 - RNA, 23 nt, Pseudomonas putida KT2440
ggaaaaugaugcagaugggggga

SEQ ID NO: 1635742 - RNA, 21 nt, Pseudomonas putida KT2440
ggagugcucgccucacagcgc

SEQ ID NO: 1635743 - RNA, 17 nt, Pseudomonas putida KT2440
ggagucgaaccugcccg

SEQ ID NO: 1635744 - RNA, 16 nt, Pseudomonas putida KT2440
ggaguaaauguaugcg

SEQ ID NO: 1635745 - RNA, 24 nt, Pseudomonas putida KT2440
ggaggucagcgguucgaucccgcu

SEQ ID NO: 1635746 - RNA, 19 nt, Pseudomonas putida KT2440
ggaucaccgacgugcagga

SEQ ID NO: 1635747 - RNA, 15 nt, Pseudomonas putida KT2440
ggaucacugccagca

SEQ ID NO: 1635748 - RNA, 21 nt, Pseudomonas putida KT2440
ggaucacugccagcaccuggc

SEQ ID NO: 1635749 - RNA, 12 nt, Pseudomonas putida KT2440
ggaucagccgcg

SEQ ID NO: 1635750 - RNA, 22 nt, Pseudomonas putida KT2440
ggaucagcacgcgaucggcagc

SEQ ID NO: 1635751 - RNA, 21 nt, Pseudomonas putida KT2440
ggagaucgucguaggagcggg

SEQ ID NO: 1635752 - RNA, 19 nt, Pseudomonas putida KT2440
ggagaucuugucgaccugg

SEQ ID NO: 1635753 - RNA, 12 nt, Pseudomonas putida KT2440
ggagaugcaguu

SEQ ID NO: 1635754 - RNA, 11 nt, Pseudomonas putida KT2440
ggagcggccuu

SEQ ID NO: 1635755 - RNA, 16 nt, Pseudomonas putida KT2440
ggagcggccuucaggg

SEQ ID NO: 1635756 - RNA, 18 nt, Pseudomonas putida KT2440
ggagcgcgcccccgacca

SEQ ID NO: 1635757 - RNA, 16 nt, Pseudomonas putida KT2440
ggagcgacuucgacca

SEQ ID NO: 1635758 - RNA, 14 nt, Pseudomonas putida KT2440
ggagcgggcgcgcc

SEQ ID NO: 1635759 - RNA, 15 nt, Pseudomonas putida KT2440
ggagcgggcuugccc

SEQ ID NO: 1635760 - RNA, 13 nt, Pseudomonas putida KT2440
ggagcgggcgacg

SEQ ID NO: 1635761 - RNA, 15 nt, Pseudomonas putida KT2440
ggagcggguucaccc

SEQ ID NO: 1635762 - RNA, 18 nt, Pseudomonas putida KT2440
ggagcguccgagcggagc

SEQ ID NO: 1635763 - RNA, 20 nt, Pseudomonas putida KT2440
ggagcguugcaggcgcucca

SEQ ID NO: 1635764 - RNA, 11 nt, Pseudomonas putida KT2440
ggaggccgggg

SEQ ID NO: 1635765 - RNA, 14 nt, Pseudomonas putida KT2440
ggagggggcuguuu

SEQ ID NO: 1635766 - RNA, 23 nt, Pseudomonas putida KT2440
ggagggggcuguuuugagagggu

SEQ ID NO: 1635767 - RNA, 14 nt, Pseudomonas putida KT2440
ggacucgaucugug

SEQ ID NO: 1635768 - RNA, 20 nt, Pseudomonas putida KT2440
ggacucauagcucagcugga

SEQ ID NO: 1635769 - RNA, 18 nt, Pseudomonas putida KT2440
ggacuauccggagcuccc

SEQ ID NO: 1635770 - RNA, 15 nt, Pseudomonas putida KT2440
ggaccugccgcagcg

SEQ ID NO: 1635771 - RNA, 13 nt, Pseudomonas putida KT2440
ggacgcauauccu

SEQ ID NO: 1635772 - RNA, 15 nt, Pseudomonas putida KT2440
ggacuaacaggugcu

SEQ ID NO: 1635773 - RNA, 16 nt, Pseudomonas putida KT2440
ggacgucccagcaggc

SEQ ID NO: 1635774 - RNA, 17 nt, Pseudomonas putida KT2440
ggacgucccagcaggca

SEQ ID NO: 1635775 - RNA, 22 nt, Pseudomonas putida KT2440
ggacgucgcgcuggccgcccgc

SEQ ID NO: 1635776 - RNA, 14 nt, Pseudomonas putida KT2440
ggacccaaucgcug

SEQ ID NO: 1635777 - RNA, 18 nt, Pseudomonas putida KT2440
ggaccaggugcagguacu

SEQ ID NO: 1635778 - RNA, 14 nt, Pseudomonas putida KT2440
ggaccagacccgcu

SEQ ID NO: 1635779 - RNA, 12 nt, Pseudomonas putida KT2440
ggacccaggccg

SEQ ID NO: 1635780 - RNA, 12 nt, Pseudomonas putida KT2440
ggaccuccgagu

SEQ ID NO: 1635781 - RNA, 16 nt, Pseudomonas putida KT2440
ggaccucacagccuuc

SEQ ID NO: 1635782 - RNA, 19 nt, Pseudomonas putida KT2440
aaagggcaucucuuugaga

SEQ ID NO: 1635783 - RNA, 22 nt, Pseudomonas putida KT2440
aaagggccgcgacgcggcccug

SEQ ID NO: 1635784 - RNA, 15 nt, Pseudomonas putida KT2440
aaagggcaccuccag

SEQ ID NO: 1635785 - RNA, 13 nt, Pseudomonas putida KT2440
ggcaacgccagca

SEQ ID NO: 1635786 - RNA, 15 nt, Pseudomonas putida KT2440
ggcaacgccagcaau

SEQ ID NO: 1635787 - RNA, 23 nt, Pseudomonas putida KT2440
ggcaacgccacacugucccggca

SEQ ID NO: 1635788 - RNA, 11 nt, Pseudomonas putida KT2440
ggcaaauaggc

SEQ ID NO: 1635789 - RNA, 16 nt, Pseudomonas putida KT2440
ggcaaaguccagcauc

SEQ ID NO: 1635790 - RNA, 14 nt, Pseudomonas putida KT2440
ggcaaagaacggug

SEQ ID NO: 1635791 - RNA, 12 nt, Pseudomonas putida KT2440
ggcaaagaaaca

SEQ ID NO: 1635792 - RNA, 17 nt, Pseudomonas putida KT2440
ggcaaagaacagcgcgg

SEQ ID NO: 1635793 - RNA, 15 nt, Pseudomonas putida KT2440
ggcaaagaacagcgu

SEQ ID NO: 1635794 - RNA, 19 nt, Pseudomonas putida KT2440
ggcaaacuggcgcccggca

SEQ ID NO: 1635795 - RNA, 13 nt, Pseudomonas putida KT2440
ggcaaagcguucg

SEQ ID NO: 1635796 - RNA, 19 nt, Pseudomonas putida KT2440
ggcaaagaaugccgcccau

SEQ ID NO: 1635797 - RNA, 13 nt, Pseudomonas putida KT2440
ggaucgccaggac

SEQ ID NO: 1635798 - RNA, 23 nt, Pseudomonas putida KT2440
ggaucgccaggcugauacgcgac

SEQ ID NO: 1635799 - RNA, 15 nt, Pseudomonas putida KT2440
ggcaaaaugcagcaa

SEQ ID NO: 1635800 - RNA, 17 nt, Pseudomonas putida KT2440
ggcaaacccggccagca

SEQ ID NO: 1635801 - RNA, 20 nt, Pseudomonas putida KT2440
ggcaaacgaaaucugccugc

SEQ ID NO: 1635802 - RNA, 21 nt, Pseudomonas putida KT2440
ggcaaacacauccaccaggcu

SEQ ID NO: 1635803 - RNA, 14 nt, Pseudomonas putida KT2440
ggcaaacagcacca

SEQ ID NO: 1635804 - RNA, 21 nt, Pseudomonas putida KT2440
ggcaaacaaaaagcaccucuu

SEQ ID NO: 1635805 - RNA, 16 nt, Pseudomonas putida KT2440
ggcaaucacgaucacu

SEQ ID NO: 1635806 - RNA, 14 nt, Pseudomonas putida KT2440
ggcaaucagcaggu

SEQ ID NO: 1635807 - RNA, 13 nt, Pseudomonas putida KT2440
ggcaaucaggcug

SEQ ID NO: 1635808 - RNA, 15 nt, Pseudomonas putida KT2440
ggcaaucagggcauc

SEQ ID NO: 1635809 - RNA, 16 nt, Pseudomonas putida KT2440
ggcaacuccuccagcc

SEQ ID NO: 1635810 - RNA, 16 nt, Pseudomonas putida KT2440
ggcaaugcgguccucc

SEQ ID NO: 1635811 - RNA, 14 nt, Pseudomonas putida KT2440
ggcaaugcucgccu

SEQ ID NO: 1635812 - RNA, 13 nt, Pseudomonas putida KT2440
ggcaaugcaggca

SEQ ID NO: 1635813 - RNA, 22 nt, Pseudomonas putida KT2440
ggcaaucucacuuucugcgcug

SEQ ID NO: 1635814 - RNA, 15 nt, Pseudomonas putida KT2440
ggcaaucgccaggcg

SEQ ID NO: 1635815 - RNA, 23 nt, Pseudomonas putida KT2440
ggcaaucggguacacgccacgga

SEQ ID NO: 1635816 - RNA, 20 nt, Pseudomonas putida KT2440
ggcaaucgugaucaucccca

SEQ ID NO: 1635817 - RNA, 15 nt, Pseudomonas putida KT2440
ggcaauccuggguga

SEQ ID NO: 1635818 - RNA, 18 nt, Pseudomonas putida KT2440
ggcaaucugcagcagcau

SEQ ID NO: 1635819 - RNA, 20 nt, Pseudomonas putida KT2440
ggcaccagauucaagcccgg

SEQ ID NO: 1635820 - RNA, 22 nt, Pseudomonas putida KT2440
ggcaccaccagggcgcgcuggc

SEQ ID NO: 1635821 - RNA, 20 nt, Pseudomonas putida KT2440
ggcacaggcuuacaacugcu

SEQ ID NO: 1635822 - RNA, 15 nt, Pseudomonas putida KT2440
ggcacaucaccagca

SEQ ID NO: 1635823 - RNA, 16 nt, Pseudomonas putida KT2440
ggcacaucaccagcag

SEQ ID NO: 1635824 - RNA, 18 nt, Pseudomonas putida KT2440
ggcacaucaccagcagcu

SEQ ID NO: 1635825 - RNA, 20 nt, Pseudomonas putida KT2440
ggcacaucaccagcagcuuc

SEQ ID NO: 1635826 - RNA, 13 nt, Pseudomonas putida KT2440
ggcacacuggcca

SEQ ID NO: 1635827 - RNA, 15 nt, Pseudomonas putida KT2440
ggcacaggcccagca

SEQ ID NO: 1635828 - RNA, 10 nt, Pseudomonas putida KT2440
ggcacaggcc

SEQ ID NO: 1635829 - RNA, 14 nt, Pseudomonas putida KT2440
ggcacaggccagcc

SEQ ID NO: 1635830 - RNA, 13 nt, Pseudomonas putida KT2440
ggcacagaacaau

SEQ ID NO: 1635831 - RNA, 13 nt, Pseudomonas putida KT2440
ggcacaacuccac

SEQ ID NO: 1635832 - RNA, 19 nt, Pseudomonas putida KT2440
ggcacaacgcgccaccgcc

SEQ ID NO: 1635833 - RNA, 15 nt, Pseudomonas putida KT2440
ggcaauuucauccac

SEQ ID NO: 1635834 - RNA, 21 nt, Pseudomonas putida KT2440
ggcagcagcucuuuugccggg

SEQ ID NO: 1635835 - RNA, 17 nt, Pseudomonas putida KT2440
ggcagcaucuucuucac

SEQ ID NO: 1635836 - RNA, 18 nt, Pseudomonas putida KT2440
ggcagcaugaacagcgcu

SEQ ID NO: 1635837 - RNA, 18 nt, Pseudomonas putida KT2440
ggcagcagccucggccuc

SEQ ID NO: 1635838 - RNA, 17 nt, Pseudomonas putida KT2440
ggcagcacgucggcgcc

SEQ ID NO: 1635839 - RNA, 22 nt, Pseudomonas putida KT2440
ggcagcacgucggcgccgaacg

SEQ ID NO: 1635840 - RNA, 16 nt, Pseudomonas putida KT2440
ggcagcagcagcccca

SEQ ID NO: 1635841 - RNA, 17 nt, Pseudomonas putida KT2440
ggcagcagcagccccag

SEQ ID NO: 1635842 - RNA, 14 nt, Pseudomonas putida KT2440
ggcagcacgaucag

SEQ ID NO: 1635843 - RNA, 12 nt, Pseudomonas putida KT2440
ggcagcgcggcc

SEQ ID NO: 1635844 - RNA, 16 nt, Pseudomonas putida KT2440
ggcagcgcggccgggu

SEQ ID NO: 1635845 - RNA, 14 nt, Pseudomonas putida KT2440
ggcacgugacugga

SEQ ID NO: 1635846 - RNA, 16 nt, Pseudomonas putida KT2440
ggcacguuggugccgg

SEQ ID NO: 1635847 - RNA, 23 nt, Pseudomonas putida KT2440
ggcacugaccacuucaagcacgc

SEQ ID NO: 1635848 - RNA, 17 nt, Pseudomonas putida KT2440
ggcacucggucggcugg

SEQ ID NO: 1635849 - RNA, 17 nt, Pseudomonas putida KT2440
ggcacuggccagcggcg

SEQ ID NO: 1635850 - RNA, 22 nt, Pseudomonas putida KT2440
ggcacuuguugguguggcagcu

SEQ ID NO: 1635851 - RNA, 24 nt, Pseudomonas putida KT2440
ggcagcaaguugaagaacagugug

SEQ ID NO: 1635852 - RNA, 14 nt, Pseudomonas putida KT2440
ggcagcacccgcuu

SEQ ID NO: 1635853 - RNA, 20 nt, Pseudomonas putida KT2440
ggcagcaccgcguaucaggc

SEQ ID NO: 1635854 - RNA, 19 nt, Pseudomonas putida KT2440
ggcagcaccgcugccagcu

SEQ ID NO: 1635855 - RNA, 22 nt, Pseudomonas putida KT2440
ggcagcaccgcugccagcugcg

SEQ ID NO: 1635856 - RNA, 23 nt, Pseudomonas putida KT2440
ggcagcaccgcugccagcugcgc

SEQ ID NO: 1635857 - RNA, 17 nt, Pseudomonas putida KT2440
ggcaccccuuucuccag

SEQ ID NO: 1635858 - RNA, 19 nt, Pseudomonas putida KT2440
ggcaccccuuucuccagca

SEQ ID NO: 1635859 - RNA, 16 nt, Pseudomonas putida KT2440
ggcaccagcgcugccg

SEQ ID NO: 1635860 - RNA, 19 nt, Pseudomonas putida KT2440
ggcaccagcgcugccgccu

SEQ ID NO: 1635861 - RNA, 12 nt, Pseudomonas putida KT2440
ggcaccagcuuc

SEQ ID NO: 1635862 - RNA, 23 nt, Pseudomonas putida KT2440
ggcacccuggcgguugaccaggg

SEQ ID NO: 1635863 - RNA, 14 nt, Pseudomonas putida KT2440
ggcaccgacccggc

SEQ ID NO: 1635864 - RNA, 14 nt, Pseudomonas putida KT2440
ggcaccgaucaccu

SEQ ID NO: 1635865 - RNA, 21 nt, Pseudomonas putida KT2440
ggcaccgacuuccccggcgcc

SEQ ID NO: 1635866 - RNA, 22 nt, Pseudomonas putida KT2440
ggcaccgacuuccccggcgccg

SEQ ID NO: 1635867 - RNA, 13 nt, Pseudomonas putida KT2440
ggcaccgccagcu

SEQ ID NO: 1635868 - RNA, 20 nt, Pseudomonas putida KT2440
ggcaccggcgaagacggcag

SEQ ID NO: 1635869 - RNA, 21 nt, Pseudomonas putida KT2440
ggcaccgggaugcucugcagc

SEQ ID NO: 1635870 - RNA, 15 nt, Pseudomonas putida KT2440
ggcaccgggcggcgg

SEQ ID NO: 1635871 - RNA, 20 nt, Pseudomonas putida KT2440
ggcaccggcaccgggcggcg

SEQ ID NO: 1635872 - RNA, 16 nt, Pseudomonas putida KT2440
ggcaccggcagcagca

SEQ ID NO: 1635873 - RNA, 23 nt, Pseudomonas putida KT2440
ggcacgaaacgccacgcccaacc

SEQ ID NO: 1635874 - RNA, 19 nt, Pseudomonas putida KT2440
ggcacgacgcucggacagc

SEQ ID NO: 1635875 - RNA, 15 nt, Pseudomonas putida KT2440
ggcacgaucagcagc

SEQ ID NO: 1635876 - RNA, 16 nt, Pseudomonas putida KT2440
ggcacgaucagcagca

SEQ ID NO: 1635877 - RNA, 18 nt, Pseudomonas putida KT2440
ggcacgagcaugccgagg

SEQ ID NO: 1635878 - RNA, 17 nt, Pseudomonas putida KT2440
ggcacgccuucagcagc

SEQ ID NO: 1635879 - RNA, 16 nt, Pseudomonas putida KT2440
ggcacgcgccagcagc

SEQ ID NO: 1635880 - RNA, 18 nt, Pseudomonas putida KT2440
ggcacgcccggcaccugc

SEQ ID NO: 1635881 - RNA, 19 nt, Pseudomonas putida KT2440
ggcacgcccagcaacugcg

SEQ ID NO: 1635882 - RNA, 23 nt, Pseudomonas putida KT2440
ggcacggugcuaccaaccuccag

SEQ ID NO: 1635883 - RNA, 21 nt, Pseudomonas putida KT2440
ggcacggcugcccugcauggc

SEQ ID NO: 1635884 - RNA, 21 nt, Pseudomonas putida KT2440
ggcacggauuuuguucuccag

SEQ ID NO: 1635885 - RNA, 12 nt, Pseudomonas putida KT2440
ggcacggccggu

SEQ ID NO: 1635886 - RNA, 19 nt, Pseudomonas putida KT2440
ggcacggccgguacggcca

SEQ ID NO: 1635887 - RNA, 19 nt, Pseudomonas putida KT2440
ggcauagcgcucgcgcagg

SEQ ID NO: 1635888 - RNA, 14 nt, Pseudomonas putida KT2440
ggcauagcaguccu

SEQ ID NO: 1635889 - RNA, 19 nt, Pseudomonas putida KT2440
ggcauacgaggccgucgua

SEQ ID NO: 1635890 - RNA, 12 nt, Pseudomonas putida KT2440
ggcaugaacaca

SEQ ID NO: 1635891 - RNA, 16 nt, Pseudomonas putida KT2440
ggcauccgccucaucc

SEQ ID NO: 1635892 - RNA, 14 nt, Pseudomonas putida KT2440
ggcauccggcagcu

SEQ ID NO: 1635893 - RNA, 22 nt, Pseudomonas putida KT2440
ggcagcuacgagacgguggcug

SEQ ID NO: 1635894 - RNA, 19 nt, Pseudomonas putida KT2440
ggcaguacauagaacagca

SEQ ID NO: 1635895 - RNA, 22 nt, Pseudomonas putida KT2440
ggcaguccugcaacucggccuu

SEQ ID NO: 1635896 - RNA, 21 nt, Pseudomonas putida KT2440
ggcaguguggcaagggcggag

SEQ ID NO: 1635897 - RNA, 16 nt, Pseudomonas putida KT2440
ggcaguguaaauagcu

SEQ ID NO: 1635898 - RNA, 21 nt, Pseudomonas putida KT2440
ggcagugcaauaccagccugg

SEQ ID NO: 1635899 - RNA, 18 nt, Pseudomonas putida KT2440
ggcagugaacuccaacgc

SEQ ID NO: 1635900 - RNA, 16 nt, Pseudomonas putida KT2440
ggcaguuugccgauga

SEQ ID NO: 1635901 - RNA, 22 nt, Pseudomonas putida KT2440
ggccaccaggguggcgauccac

SEQ ID NO: 1635902 - RNA, 20 nt, Pseudomonas putida KT2440
ggccaccaggcgcggcagca

SEQ ID NO: 1635903 - RNA, 16 nt, Pseudomonas putida KT2440
ggccaccaccagcaac

SEQ ID NO: 1635904 - RNA, 17 nt, Pseudomonas putida KT2440
ggccaccacacugguca

SEQ ID NO: 1635905 - RNA, 17 nt, Pseudomonas putida KT2440
ggccaaccacccgggca

SEQ ID NO: 1635906 - RNA, 13 nt, Pseudomonas putida KT2440
ggccaacucccca

SEQ ID NO: 1635907 - RNA, 19 nt, Pseudomonas putida KT2440
ggccaacuccccacccagg

SEQ ID NO: 1635908 - RNA, 20 nt, Pseudomonas putida KT2440
ggccaacggcaucacgcugg

SEQ ID NO: 1635909 - RNA, 22 nt, Pseudomonas putida KT2440
ggccacacugcucagugcuggc

SEQ ID NO: 1635910 - RNA, 15 nt, Pseudomonas putida KT2440
ggccaaaccguccag

SEQ ID NO: 1635911 - RNA, 16 nt, Pseudomonas putida KT2440
ggcaugugcacuggca

SEQ ID NO: 1635912 - RNA, 18 nt, Pseudomonas putida KT2440
ggcaugggugagcacggc

SEQ ID NO: 1635913 - RNA, 15 nt, Pseudomonas putida KT2440
ggcaugggccagggu

SEQ ID NO: 1635914 - RNA, 18 nt, Pseudomonas putida KT2440
ggcaugcaggaggucagc

SEQ ID NO: 1635915 - RNA, 14 nt, Pseudomonas putida KT2440
ggcaugcccgcccc

SEQ ID NO: 1635916 - RNA, 18 nt, Pseudomonas putida KT2440
ggcaugcccgccccugcc

SEQ ID NO: 1635917 - RNA, 15 nt, Pseudomonas putida KT2440
ggcaugcagcggcca

SEQ ID NO: 1635918 - RNA, 21 nt, Pseudomonas putida KT2440
ggcaugacaaacgccagcaug

SEQ ID NO: 1635919 - RNA, 17 nt, Pseudomonas putida KT2440
ggccagcgccugcaggc

SEQ ID NO: 1635920 - RNA, 13 nt, Pseudomonas putida KT2440
ggccagcgcgcug

SEQ ID NO: 1635921 - RNA, 21 nt, Pseudomonas putida KT2440
ggccagcgauaaaccagcagc

SEQ ID NO: 1635922 - RNA, 15 nt, Pseudomonas putida KT2440
ggccagcgcaucggc

SEQ ID NO: 1635923 - RNA, 19 nt, Pseudomonas putida KT2440
ggccagcgcacagcugccg

SEQ ID NO: 1635924 - RNA, 15 nt, Pseudomonas putida KT2440
ggccagcgacccuga

SEQ ID NO: 1635925 - RNA, 16 nt, Pseudomonas putida KT2440
ggccagccccagcggc

SEQ ID NO: 1635926 - RNA, 12 nt, Pseudomonas putida KT2440
ggccagccaggu

SEQ ID NO: 1635927 - RNA, 21 nt, Pseudomonas putida KT2440
ggccagccggcgcuggacagc

SEQ ID NO: 1635928 - RNA, 22 nt, Pseudomonas putida KT2440
ggccagccgcuguucugcaguc

SEQ ID NO: 1635929 - RNA, 12 nt, Pseudomonas putida KT2440
ggccagccgagc

SEQ ID NO: 1635930 - RNA, 17 nt, Pseudomonas putida KT2440
ggccagccgaggggugu

SEQ ID NO: 1635931 - RNA, 13 nt, Pseudomonas putida KT2440
ggccagccgccgc

SEQ ID NO: 1635932 - RNA, 18 nt, Pseudomonas putida KT2440
ggccagccgccgccgagu

SEQ ID NO: 1635933 - RNA, 19 nt, Pseudomonas putida KT2440
ggccagccgccgccgagug

SEQ ID NO: 1635934 - RNA, 21 nt, Pseudomonas putida KT2440
ggccacguugaucgucggccc

SEQ ID NO: 1635935 - RNA, 14 nt, Pseudomonas putida KT2440
ggccacgguccagu

SEQ ID NO: 1635936 - RNA, 19 nt, Pseudomonas putida KT2440
ggccacggugucggacagg

SEQ ID NO: 1635937 - RNA, 20 nt, Pseudomonas putida KT2440
ggccacggugucggacaggu

SEQ ID NO: 1635938 - RNA, 18 nt, Pseudomonas putida KT2440
ggccacggaucaccacgu

SEQ ID NO: 1635939 - RNA, 20 nt, Pseudomonas putida KT2440
ggccacggcaauggcccgcu

SEQ ID NO: 1635940 - RNA, 22 nt, Pseudomonas putida KT2440
ggccacccggaccagcgccgca

SEQ ID NO: 1635941 - RNA, 13 nt, Pseudomonas putida KT2440
ggccagcagguca

SEQ ID NO: 1635942 - RNA, 14 nt, Pseudomonas putida KT2440
ggccagcaggucag

SEQ ID NO: 1635943 - RNA, 16 nt, Pseudomonas putida KT2440
ggccagcaggucaggc

SEQ ID NO: 1635944 - RNA, 11 nt, Pseudomonas putida KT2440
ggccagcaggc

SEQ ID NO: 1635945 - RNA, 13 nt, Pseudomonas putida KT2440
ggccagcagcccc

SEQ ID NO: 1635946 - RNA, 14 nt, Pseudomonas putida KT2440
ggccagcagccccc

SEQ ID NO: 1635947 - RNA, 16 nt, Pseudomonas putida KT2440
ggccagcggcgcggcc

SEQ ID NO: 1635948 - RNA, 22 nt, Pseudomonas putida KT2440
ggccagcguggccgccaacagc

SEQ ID NO: 1635949 - RNA, 21 nt, Pseudomonas putida KT2440
ggccagcggcacgucacugca

SEQ ID NO: 1635950 - RNA, 20 nt, Pseudomonas putida KT2440
ggccaguaaggaucgcgcag

SEQ ID NO: 1635951 - RNA, 14 nt, Pseudomonas putida KT2440
ggccagguggccuu

SEQ ID NO: 1635952 - RNA, 15 nt, Pseudomonas putida KT2440
ggccaucaucugcug

SEQ ID NO: 1635953 - RNA, 20 nt, Pseudomonas putida KT2440
ggccagugccaugaacacca

SEQ ID NO: 1635954 - RNA, 14 nt, Pseudomonas putida KT2440
ggccaucgacccgc

SEQ ID NO: 1635955 - RNA, 22 nt, Pseudomonas putida KT2440
ggccauucgcgggcaugcccgc

SEQ ID NO: 1635956 - RNA, 13 nt, Pseudomonas putida KT2440
ggcguccagcagu

SEQ ID NO: 1635957 - RNA, 12 nt, Pseudomonas putida KT2440
ggcguccacagc

SEQ ID NO: 1635958 - RNA, 15 nt, Pseudomonas putida KT2440
ggcgucacgcagggc

SEQ ID NO: 1635959 - RNA, 17 nt, Pseudomonas putida KT2440
ggcgucacgcagggcca

SEQ ID NO: 1635960 - RNA, 18 nt, Pseudomonas putida KT2440
ggcgucacgcagggccag

SEQ ID NO: 1635961 - RNA, 15 nt, Pseudomonas putida KT2440
ggcguaccugccccc

SEQ ID NO: 1635962 - RNA, 15 nt, Pseudomonas putida KT2440
ggcguaauccagcug

SEQ ID NO: 1635963 - RNA, 21 nt, Pseudomonas putida KT2440
ggcgguuuuuugccugaucag

SEQ ID NO: 1635964 - RNA, 15 nt, Pseudomonas putida KT2440
ggcguaaacccaggu

SEQ ID NO: 1635965 - RNA, 16 nt, Pseudomonas putida KT2440
ggcggugcacggccug

SEQ ID NO: 1635966 - RNA, 16 nt, Pseudomonas putida KT2440
ggcggugacacugcca

SEQ ID NO: 1635967 - RNA, 21 nt, Pseudomonas putida KT2440
ggcggugaucguacgccggcg

SEQ ID NO: 1635968 - RNA, 21 nt, Pseudomonas putida KT2440
ggcgguccuucaugccgaacg

SEQ ID NO: 1635969 - RNA, 18 nt, Pseudomonas putida KT2440
ggcggcugagccggcugg

SEQ ID NO: 1635970 - RNA, 23 nt, Pseudomonas putida KT2440
ggcggcgaugcaucaauggcugg

SEQ ID NO: 1635971 - RNA, 13 nt, Pseudomonas putida KT2440
ggcggcgguaccc

SEQ ID NO: 1635972 - RNA, 15 nt, Pseudomonas putida KT2440
ggcggcgugaccagc

SEQ ID NO: 1635973 - RNA, 18 nt, Pseudomonas putida KT2440
ggcggcucgcugaacacg

SEQ ID NO: 1635974 - RNA, 20 nt, Pseudomonas putida KT2440
ggcgcuugaucugccaggca

SEQ ID NO: 1635975 - RNA, 19 nt, Pseudomonas putida KT2440
ggcgcuguaggggcgggcc

SEQ ID NO: 1635976 - RNA, 16 nt, Pseudomonas putida KT2440
ggcgcuguccagcgca

SEQ ID NO: 1635977 - RNA, 13 nt, Pseudomonas putida KT2440
ggcgcuggcgcca

SEQ ID NO: 1635978 - RNA, 17 nt, Pseudomonas putida KT2440
ggcggccgcagccccac

SEQ ID NO: 1635979 - RNA, 18 nt, Pseudomonas putida KT2440
ggcggcccgccggcaacu

SEQ ID NO: 1635980 - RNA, 19 nt, Pseudomonas putida KT2440
ggcgcuuuucuucgcugcu

SEQ ID NO: 1635981 - RNA, 16 nt, Pseudomonas putida KT2440
ggcucagccgccacau

SEQ ID NO: 1635982 - RNA, 17 nt, Pseudomonas putida KT2440
ggcucagccgccacaug

SEQ ID NO: 1635983 - RNA, 16 nt, Pseudomonas putida KT2440
ggcucacugaccaggu

SEQ ID NO: 1635984 - RNA, 14 nt, Pseudomonas putida KT2440
ggcucaccgcagcc

SEQ ID NO: 1635985 - RNA, 19 nt, Pseudomonas putida KT2440
ggcucaccgcagcccagcg

SEQ ID NO: 1635986 - RNA, 20 nt, Pseudomonas putida KT2440
ggcucaccgcagcccagcgc

SEQ ID NO: 1635987 - RNA, 13 nt, Pseudomonas putida KT2440
ggcucaacuggca

SEQ ID NO: 1635988 - RNA, 18 nt, Pseudomonas putida KT2440
ggcucaacagcaggugca

SEQ ID NO: 1635989 - RNA, 23 nt, Pseudomonas putida KT2440
ggcucaacaccagacucagcgcu

SEQ ID NO: 1635990 - RNA, 16 nt, Pseudomonas putida KT2440
ggcucacccaccagcc

SEQ ID NO: 1635991 - RNA, 19 nt, Pseudomonas putida KT2440
ggcucacaucaucgcccuc

SEQ ID NO: 1635992 - RNA, 17 nt, Pseudomonas putida KT2440
ggcuaucggccagcaaa

SEQ ID NO: 1635993 - RNA, 16 nt, Pseudomonas putida KT2440
ggcuaucucaggccag

SEQ ID NO: 1635994 - RNA, 17 nt, Pseudomonas putida KT2440
ggcuacauccaggcugu

SEQ ID NO: 1635995 - RNA, 23 nt, Pseudomonas putida KT2440
ggcguugaucuguugcugcaggu

SEQ ID NO: 1635996 - RNA, 18 nt, Pseudomonas putida KT2440
ggcguuguguugcugggc

SEQ ID NO: 1635997 - RNA, 15 nt, Pseudomonas putida KT2440
ggcguuguccagcag

SEQ ID NO: 1635998 - RNA, 13 nt, Pseudomonas putida KT2440
ggcguuggccaaa

SEQ ID NO: 1635999 - RNA, 16 nt, Pseudomonas putida KT2440
ggcguugggcacgaag

SEQ ID NO: 1636000 - RNA, 12 nt, Pseudomonas putida KT2440
ggcgucuuccac

SEQ ID NO: 1636001 - RNA, 23 nt, Pseudomonas putida KT2440
ggcgucuuccacgcccaggcgcu

SEQ ID NO: 1636002 - RNA, 16 nt, Pseudomonas putida KT2440
ggcgucggucgccccc

SEQ ID NO: 1636003 - RNA, 22 nt, Pseudomonas putida KT2440
ggcgucgcgaucacgcaggccc

SEQ ID NO: 1636004 - RNA, 15 nt, Pseudomonas putida KT2440
ggcguucgucaagcu

SEQ ID NO: 1636005 - RNA, 14 nt, Pseudomonas putida KT2440
ggcguggcgagcug

SEQ ID NO: 1636006 - RNA, 21 nt, Pseudomonas putida KT2440
ggcguggugaauggcgagccc

SEQ ID NO: 1636007 - RNA, 18 nt, Pseudomonas putida KT2440
ggcgugcccgcgaagggc

SEQ ID NO: 1636008 - RNA, 22 nt, Pseudomonas putida KT2440
ggcgugcacgcuugagcgcgcc

SEQ ID NO: 1636009 - RNA, 18 nt, Pseudomonas putida KT2440
ggcgugccgucgagcagg

SEQ ID NO: 1636010 - RNA, 20 nt, Pseudomonas putida KT2440
ggcgaucgccagguggaagc

SEQ ID NO: 1636011 - RNA, 16 nt, Pseudomonas putida KT2440
ggcgaucggcuggucc

SEQ ID NO: 1636012 - RNA, 21 nt, Pseudomonas putida KT2440
ggcgcaaguagaaccacacag

SEQ ID NO: 1636013 - RNA, 18 nt, Pseudomonas putida KT2440
ggcgcaaauugcccggcc

SEQ ID NO: 1636014 - RNA, 16 nt, Pseudomonas putida KT2440
ggcgcaacucagcgca

SEQ ID NO: 1636015 - RNA, 18 nt, Pseudomonas putida KT2440
ggcgcaacucagcgcagc

SEQ ID NO: 1636016 - RNA, 20 nt, Pseudomonas putida KT2440
ggcgcaacucagcgcagcuu

SEQ ID NO: 1636017 - RNA, 20 nt, Pseudomonas putida KT2440
ggcgcaaugaaaaagccccu

SEQ ID NO: 1636018 - RNA, 20 nt, Pseudomonas putida KT2440
ggcgcaacaucgaucuggug

SEQ ID NO: 1636019 - RNA, 11 nt, Pseudomonas putida KT2440
ggcgagucagg

SEQ ID NO: 1636020 - RNA, 15 nt, Pseudomonas putida KT2440
ggcgaucaggcaggc

SEQ ID NO: 1636021 - RNA, 19 nt, Pseudomonas putida KT2440
ggcgaaugcgcccggccag

SEQ ID NO: 1636022 - RNA, 22 nt, Pseudomonas putida KT2440
ggcgaaugagaggcgggucagg

SEQ ID NO: 1636023 - RNA, 13 nt, Pseudomonas putida KT2440
ggcgaggacagca

SEQ ID NO: 1636024 - RNA, 16 nt, Pseudomonas putida KT2440
ggcgccauuggugccc

SEQ ID NO: 1636025 - RNA, 17 nt, Pseudomonas putida KT2440
ggcgccauuggugcccu

SEQ ID NO: 1636026 - RNA, 14 nt, Pseudomonas putida KT2440
ggcgccaugccccc

SEQ ID NO: 1636027 - RNA, 19 nt, Pseudomonas putida KT2440
aaauacgguugcagcacac

SEQ ID NO: 1636028 - RNA, 16 nt, Pseudomonas putida KT2440
ggcgccaaacgccagg

SEQ ID NO: 1636029 - RNA, 22 nt, Pseudomonas putida KT2440
ggcgccacccagaacagccaca

SEQ ID NO: 1636030 - RNA, 23 nt, Pseudomonas putida KT2440
ggcgcauggccuggucgaagguc

SEQ ID NO: 1636031 - RNA, 20 nt, Pseudomonas putida KT2440
ggcgcauccucggugcgcgg

SEQ ID NO: 1636032 - RNA, 11 nt, Pseudomonas putida KT2440
ggcgcauggcc

SEQ ID NO: 1636033 - RNA, 16 nt, Pseudomonas putida KT2440
ggcgcaguucguccag

SEQ ID NO: 1636034 - RNA, 22 nt, Pseudomonas putida KT2440
ggcgcagugccgugaguggccu

SEQ ID NO: 1636035 - RNA, 13 nt, Pseudomonas putida KT2440
ggcgcaggguguc

SEQ ID NO: 1636036 - RNA, 20 nt, Pseudomonas putida KT2440
ggcgcagggugugcugcugc

SEQ ID NO: 1636037 - RNA, 23 nt, Pseudomonas putida KT2440
ggcgcagcauaugcuggucgccg

SEQ ID NO: 1636038 - RNA, 19 nt, Pseudomonas putida KT2440
ggcgcagcgcaugcucgcg

SEQ ID NO: 1636039 - RNA, 12 nt, Pseudomonas putida KT2440
ggcgcagcaagg

SEQ ID NO: 1636040 - RNA, 18 nt, Pseudomonas putida KT2440
ggcgcagcaaggucgccg

SEQ ID NO: 1636041 - RNA, 20 nt, Pseudomonas putida KT2440
ggcgcagcaaggucgccgcc

SEQ ID NO: 1636042 - RNA, 20 nt, Pseudomonas putida KT2440
ggcgcacagggcgaugcccu

SEQ ID NO: 1636043 - RNA, 16 nt, Pseudomonas putida KT2440
ggcgcagagcgccccg

SEQ ID NO: 1636044 - RNA, 18 nt, Pseudomonas putida KT2440
ggcgcagagcgccccggc

SEQ ID NO: 1636045 - RNA, 23 nt, Pseudomonas putida KT2440
ggcgccuaucagaucgagcgccc

SEQ ID NO: 1636046 - RNA, 20 nt, Pseudomonas putida KT2440
ggcgccuauccugugggagc

SEQ ID NO: 1636047 - RNA, 13 nt, Pseudomonas putida KT2440
ggcgccugccggg

SEQ ID NO: 1636048 - RNA, 21 nt, Pseudomonas putida KT2440
ggcgccuugauuaccagcgcc

SEQ ID NO: 1636049 - RNA, 20 nt, Pseudomonas putida KT2440
ggcgcgaucccugugggagc

SEQ ID NO: 1636050 - RNA, 16 nt, Pseudomonas putida KT2440
ggcgccgagcgcggcg

SEQ ID NO: 1636051 - RNA, 22 nt, Pseudomonas putida KT2440
ggcgccgagcgcggcgcccagc

SEQ ID NO: 1636052 - RNA, 20 nt, Pseudomonas putida KT2440
ggcgccgaugaagcaggccg

SEQ ID NO: 1636053 - RNA, 15 nt, Pseudomonas putida KT2440
ggcgccgacccugua

SEQ ID NO: 1636054 - RNA, 21 nt, Pseudomonas putida KT2440
ggcgccgaucauugcugcggu

SEQ ID NO: 1636055 - RNA, 14 nt, Pseudomonas putida KT2440
ggcgccgccaggca

SEQ ID NO: 1636056 - RNA, 17 nt, Pseudomonas putida KT2440
ggcgccgccaggcagca

SEQ ID NO: 1636057 - RNA, 20 nt, Pseudomonas putida KT2440
ggcgccgccaggcagcagac

SEQ ID NO: 1636058 - RNA, 12 nt, Pseudomonas putida KT2440
ggcgccgccagc

SEQ ID NO: 1636059 - RNA, 23 nt, Pseudomonas putida KT2440
ggcgcguguagcccgcugaaggu

SEQ ID NO: 1636060 - RNA, 17 nt, Pseudomonas putida KT2440
ggcgcgugugcaggugg

SEQ ID NO: 1636061 - RNA, 22 nt, Pseudomonas putida KT2440
ggcgcucaaggucacggcuguc

SEQ ID NO: 1636062 - RNA, 13 nt, Pseudomonas putida KT2440
ggcgcuaccccug

SEQ ID NO: 1636063 - RNA, 15 nt, Pseudomonas putida KT2440
ggcgcucgcgguuca

SEQ ID NO: 1636064 - RNA, 20 nt, Pseudomonas putida KT2440
ggcgcugaccaacaggcugg

SEQ ID NO: 1636065 - RNA, 14 nt, Pseudomonas putida KT2440
ggcgcugagcgaca

SEQ ID NO: 1636066 - RNA, 14 nt, Pseudomonas putida KT2440
ggcgcucgggggug

SEQ ID NO: 1636067 - RNA, 13 nt, Pseudomonas putida KT2440
ggcgcugaagcca

SEQ ID NO: 1636068 - RNA, 15 nt, Pseudomonas putida KT2440
ggcgcgggcacccug

SEQ ID NO: 1636069 - RNA, 19 nt, Pseudomonas putida KT2440
ggcgcgcgcauccacaggc

SEQ ID NO: 1636070 - RNA, 20 nt, Pseudomonas putida KT2440
ggcgcgcgcauccacaggcg

SEQ ID NO: 1636071 - RNA, 20 nt, Pseudomonas putida KT2440
aaauacucagaccaacaacu

SEQ ID NO: 1636072 - RNA, 19 nt, Pseudomonas putida KT2440
ggccuugaccagcaacggc

SEQ ID NO: 1636073 - RNA, 16 nt, Pseudomonas putida KT2440
ggccuuggccagcuca

SEQ ID NO: 1636074 - RNA, 17 nt, Pseudomonas putida KT2440
ggccuugcuccaguuca

SEQ ID NO: 1636075 - RNA, 17 nt, Pseudomonas putida KT2440
ggccuuggacaccaggc

SEQ ID NO: 1636076 - RNA, 13 nt, Pseudomonas putida KT2440
ggcgaagcguuca

SEQ ID NO: 1636077 - RNA, 12 nt, Pseudomonas putida KT2440
ggcgaagcccgu

SEQ ID NO: 1636078 - RNA, 14 nt, Pseudomonas putida KT2440
ggcgaagcccgugg

SEQ ID NO: 1636079 - RNA, 18 nt, Pseudomonas putida KT2440
ggcgaauacgcucagccg

SEQ ID NO: 1636080 - RNA, 23 nt, Pseudomonas putida KT2440
ggcgaauagcaucgcuagaaaac

SEQ ID NO: 1636081 - RNA, 21 nt, Pseudomonas putida KT2440
ggcgaaucagcaugcccagcg

SEQ ID NO: 1636082 - RNA, 15 nt, Pseudomonas putida KT2440
ggcgaauccagcagg

SEQ ID NO: 1636083 - RNA, 16 nt, Pseudomonas putida KT2440
ggccuggggcaggccc

SEQ ID NO: 1636084 - RNA, 17 nt, Pseudomonas putida KT2440
ggccuguugcgcacugc

SEQ ID NO: 1636085 - RNA, 20 nt, Pseudomonas putida KT2440
ggccuguggguaacccugcu

SEQ ID NO: 1636086 - RNA, 18 nt, Pseudomonas putida KT2440
ggccugugcauguccagu

SEQ ID NO: 1636087 - RNA, 16 nt, Pseudomonas putida KT2440
ggccuucagggccggu

SEQ ID NO: 1636088 - RNA, 14 nt, Pseudomonas putida KT2440
ggccuucaaccuca

SEQ ID NO: 1636089 - RNA, 17 nt, Pseudomonas putida KT2440
ggccuucaagcucccca

SEQ ID NO: 1636090 - RNA, 22 nt, Pseudomonas putida KT2440
ggccuucaagcuccccagcaac

SEQ ID NO: 1636091 - RNA, 17 nt, Pseudomonas putida KT2440
ggccuguuuggccgcau

SEQ ID NO: 1636092 - RNA, 16 nt, Pseudomonas putida KT2440
ggccugcaggcagcau

SEQ ID NO: 1636093 - RNA, 12 nt, Pseudomonas putida KT2440
ggccugagccgg

SEQ ID NO: 1636094 - RNA, 22 nt, Pseudomonas putida KT2440
ggccugagccggucggagagac

SEQ ID NO: 1636095 - RNA, 17 nt, Pseudomonas putida KT2440
ggccugaugccucauca

SEQ ID NO: 1636096 - RNA, 21 nt, Pseudomonas putida KT2440
ggccugcagagacaucuccau

SEQ ID NO: 1636097 - RNA, 23 nt, Pseudomonas putida KT2440
ggccugcaagccggcgaacagca

SEQ ID NO: 1636098 - RNA, 11 nt, Pseudomonas putida KT2440
ggccugcacaa

SEQ ID NO: 1636099 - RNA, 15 nt, Pseudomonas putida KT2440
ggccugcacaaacuu

SEQ ID NO: 1636100 - RNA, 12 nt, Pseudomonas putida KT2440
ggccugcggcca

SEQ ID NO: 1636101 - RNA, 13 nt, Pseudomonas putida KT2440
ggccugcuccaca

SEQ ID NO: 1636102 - RNA, 18 nt, Pseudomonas putida KT2440
ggccugcggccaggccgg

SEQ ID NO: 1636103 - RNA, 18 nt, Pseudomonas putida KT2440
ggccugcuugaucaggcc

SEQ ID NO: 1636104 - RNA, 20 nt, Pseudomonas putida KT2440
ggccuggcggguuuccucgg

SEQ ID NO: 1636105 - RNA, 23 nt, Pseudomonas putida KT2440
ggccuggcccggugcaaggucaa

SEQ ID NO: 1636106 - RNA, 15 nt, Pseudomonas putida KT2440
ggccuggccugcaug

SEQ ID NO: 1636107 - RNA, 16 nt, Pseudomonas putida KT2440
ggccucgguacccgcc

SEQ ID NO: 1636108 - RNA, 19 nt, Pseudomonas putida KT2440
ggccucgguacccgccagc

SEQ ID NO: 1636109 - RNA, 21 nt, Pseudomonas putida KT2440
ggccucgucgcgguccuugcc

SEQ ID NO: 1636110 - RNA, 14 nt, Pseudomonas putida KT2440
ggccucuucgcggg

SEQ ID NO: 1636111 - RNA, 23 nt, Pseudomonas putida KT2440
ggccucuucgcgggcaagcccgc

SEQ ID NO: 1636112 - RNA, 20 nt, Pseudomonas putida KT2440
ggccucuggcuuggcugcgu

SEQ ID NO: 1636113 - RNA, 15 nt, Pseudomonas putida KT2440
ggccucuucacggcu

SEQ ID NO: 1636114 - RNA, 16 nt, Pseudomonas putida KT2440
ggccucuucaggcaau

SEQ ID NO: 1636115 - RNA, 16 nt, Pseudomonas putida KT2440
ggccugaccgcccagc

SEQ ID NO: 1636116 - RNA, 21 nt, Pseudomonas putida KT2440
ggccucgaugcggucuuccag

SEQ ID NO: 1636117 - RNA, 15 nt, Pseudomonas putida KT2440
ggccucgaacauggc

SEQ ID NO: 1636118 - RNA, 18 nt, Pseudomonas putida KT2440
ggccucggcgaucgccag

SEQ ID NO: 1636119 - RNA, 12 nt, Pseudomonas putida KT2440
ggccuaggacac

SEQ ID NO: 1636120 - RNA, 21 nt, Pseudomonas putida KT2440
ggccuaguucggcaccuuucu

SEQ ID NO: 1636121 - RNA, 15 nt, Pseudomonas putida KT2440
ggccucaagccucgc

SEQ ID NO: 1636122 - RNA, 15 nt, Pseudomonas putida KT2440
ggccguucccacaaa

SEQ ID NO: 1636123 - RNA, 20 nt, Pseudomonas putida KT2440
ggccggucacccccaucagc

SEQ ID NO: 1636124 - RNA, 20 nt, Pseudomonas putida KT2440
ggccgguagcucgcuuucca

SEQ ID NO: 1636125 - RNA, 14 nt, Pseudomonas putida KT2440
ggccggguccugca

SEQ ID NO: 1636126 - RNA, 15 nt, Pseudomonas putida KT2440
ggccgguacugccca

SEQ ID NO: 1636127 - RNA, 15 nt, Pseudomonas putida KT2440
ggccguccagcugag

SEQ ID NO: 1636128 - RNA, 16 nt, Pseudomonas putida KT2440
ggccgucagcagcagg

SEQ ID NO: 1636129 - RNA, 13 nt, Pseudomonas putida KT2440
ggccgucagcagc

SEQ ID NO: 1636130 - RNA, 17 nt, Pseudomonas putida KT2440
ggccgucaccgcugccg

SEQ ID NO: 1636131 - RNA, 19 nt, Pseudomonas putida KT2440
ggccguaaaguccgugccc

SEQ ID NO: 1636132 - RNA, 14 nt, Pseudomonas putida KT2440
ggccgugcaggcgg

SEQ ID NO: 1636133 - RNA, 17 nt, Pseudomonas putida KT2440
ggccgccacggugccga

SEQ ID NO: 1636134 - RNA, 18 nt, Pseudomonas putida KT2440
ggccgcauauacgccggc

SEQ ID NO: 1636135 - RNA, 16 nt, Pseudomonas putida KT2440
ggccgccaagcggccc

SEQ ID NO: 1636136 - RNA, 18 nt, Pseudomonas putida KT2440
ggccgccaagcggcccca

SEQ ID NO: 1636137 - RNA, 21 nt, Pseudomonas putida KT2440
ggccgccgccagaccaccuca

SEQ ID NO: 1636138 - RNA, 16 nt, Pseudomonas putida KT2440
ggccgcccucgcgcgu

SEQ ID NO: 1636139 - RNA, 15 nt, Pseudomonas putida KT2440
ggccgcaacgcggcc

SEQ ID NO: 1636140 - RNA, 16 nt, Pseudomonas putida KT2440
ggccgcacaaggccgc

SEQ ID NO: 1636141 - RNA, 17 nt, Pseudomonas putida KT2440
ggccgcacaaggccgcu

SEQ ID NO: 1636142 - RNA, 18 nt, Pseudomonas putida KT2440
ggccgaugggcaggccau

SEQ ID NO: 1636143 - RNA, 15 nt, Pseudomonas putida KT2440
ggccgcaaagcggcc

SEQ ID NO: 1636144 - RNA, 16 nt, Pseudomonas putida KT2440
ggccgcaaagcggccc

SEQ ID NO: 1636145 - RNA, 19 nt, Pseudomonas putida KT2440
ggccgcaaagcggccccag

SEQ ID NO: 1636146 - RNA, 21 nt, Pseudomonas putida KT2440
ggccgcaaagcggcccccagc

SEQ ID NO: 1636147 - RNA, 13 nt, Pseudomonas putida KT2440
ggccgcagccaug

SEQ ID NO: 1636148 - RNA, 16 nt, Pseudomonas putida KT2440
ggccgcacccagcagg

SEQ ID NO: 1636149 - RNA, 23 nt, Pseudomonas putida KT2440
ggccgcacgcgccucuugcaccu

SEQ ID NO: 1636150 - RNA, 12 nt, Pseudomonas putida KT2440
ggccgcaggccc

SEQ ID NO: 1636151 - RNA, 22 nt, Pseudomonas putida KT2440
ggccgauggcgcaaacccucgg

SEQ ID NO: 1636152 - RNA, 23 nt, Pseudomonas putida KT2440
ggcccaaacaacaaagccccggc

SEQ ID NO: 1636153 - RNA, 15 nt, Pseudomonas putida KT2440
ggccgagcaggagcu

SEQ ID NO: 1636154 - RNA, 14 nt, Pseudomonas putida KT2440
ggccgaggccgggu

SEQ ID NO: 1636155 - RNA, 21 nt, Pseudomonas putida KT2440
ggccgagcuuuguagcucccu

SEQ ID NO: 1636156 - RNA, 16 nt, Pseudomonas putida KT2440
ggccgagcgcgagcgu

SEQ ID NO: 1636157 - RNA, 16 nt, Pseudomonas putida KT2440
ggccgaucaccagcac

SEQ ID NO: 1636158 - RNA, 17 nt, Pseudomonas putida KT2440
ggccgaucaccagcacc

SEQ ID NO: 1636159 - RNA, 21 nt, Pseudomonas putida KT2440
ggccgaucaccagcaccccga

SEQ ID NO: 1636160 - RNA, 20 nt, Pseudomonas putida KT2440
ggccgcugaaccucaccgcc

SEQ ID NO: 1636161 - RNA, 15 nt, Pseudomonas putida KT2440
ggccgcuaggcggcc

SEQ ID NO: 1636162 - RNA, 17 nt, Pseudomonas putida KT2440
ggccgcuaggcggcccc

SEQ ID NO: 1636163 - RNA, 20 nt, Pseudomonas putida KT2440
ggccgcucaccggccagcgc

SEQ ID NO: 1636164 - RNA, 14 nt, Pseudomonas putida KT2440
ggccgcuccagcuc

SEQ ID NO: 1636165 - RNA, 16 nt, Pseudomonas putida KT2440
ggccgcuccuucacca

SEQ ID NO: 1636166 - RNA, 18 nt, Pseudomonas putida KT2440
ggccgcguaccagcaggg

SEQ ID NO: 1636167 - RNA, 18 nt, Pseudomonas putida KT2440
ggccgcgcuuggcggccc

SEQ ID NO: 1636168 - RNA, 21 nt, Pseudomonas putida KT2440
ggccgcgcgcccaucugcacg

SEQ ID NO: 1636169 - RNA, 21 nt, Pseudomonas putida KT2440
ggccgcgcgggugcgagaggc

SEQ ID NO: 1636170 - RNA, 16 nt, Pseudomonas putida KT2440
ggccgcgcaggaagaa

SEQ ID NO: 1636171 - RNA, 14 nt, Pseudomonas putida KT2440
ggccgcgcaggcgg

SEQ ID NO: 1636172 - RNA, 14 nt, Pseudomonas putida KT2440
ggccgcgcagcggc

SEQ ID NO: 1636173 - RNA, 16 nt, Pseudomonas putida KT2440
ggccgcgcagcggccc

SEQ ID NO: 1636174 - RNA, 20 nt, Pseudomonas putida KT2440
ggccgccuugcggccccgga

SEQ ID NO: 1636175 - RNA, 15 nt, Pseudomonas putida KT2440
ggccgcgaagcggcc

SEQ ID NO: 1636176 - RNA, 17 nt, Pseudomonas putida KT2440
ggccgcgaagcggcccc

SEQ ID NO: 1636177 - RNA, 14 nt, Pseudomonas putida KT2440
ggccggcacaggcu

SEQ ID NO: 1636178 - RNA, 16 nt, Pseudomonas putida KT2440
ggccggcagccagggc

SEQ ID NO: 1636179 - RNA, 13 nt, Pseudomonas putida KT2440
ggccgcugugcca

SEQ ID NO: 1636180 - RNA, 15 nt, Pseudomonas putida KT2440
ggccgcuucgcggau

SEQ ID NO: 1636181 - RNA, 12 nt, Pseudomonas putida KT2440
ggccggggaugc

SEQ ID NO: 1636182 - RNA, 15 nt, Pseudomonas putida KT2440
ggccggggcaaccug

SEQ ID NO: 1636183 - RNA, 18 nt, Pseudomonas putida KT2440
ggccggauagagcccggc

SEQ ID NO: 1636184 - RNA, 19 nt, Pseudomonas putida KT2440
gagcgaaauagguaaagcc

SEQ ID NO: 1636185 - RNA, 18 nt, Pseudomonas putida KT2440
gagcuggccguccagcug

SEQ ID NO: 1636186 - RNA, 15 nt, Pseudomonas putida KT2440
gagcuggucaucguc

SEQ ID NO: 1636187 - RNA, 22 nt, Pseudomonas putida KT2440
gagcuggucaucguccacccac

SEQ ID NO: 1636188 - RNA, 11 nt, Pseudomonas putida KT2440
gagcuucaacg

SEQ ID NO: 1636189 - RNA, 18 nt, Pseudomonas putida KT2440
gagcuuggcguccacagc

SEQ ID NO: 1636190 - RNA, 15 nt, Pseudomonas putida KT2440
gagcuugacuuccag

SEQ ID NO: 1636191 - RNA, 16 nt, Pseudomonas putida KT2440
gaggacacaucgauca

SEQ ID NO: 1636192 - RNA, 18 nt, Pseudomonas putida KT2440
gaggacacaucgaucagg

SEQ ID NO: 1636193 - RNA, 20 nt, Pseudomonas putida KT2440
gaggaucagcgcagacuggg

SEQ ID NO: 1636194 - RNA, 17 nt, Pseudomonas putida KT2440
gaggcaaaagaaaaagg

SEQ ID NO: 1636195 - RNA, 18 nt, Pseudomonas putida KT2440
gaggcaaaagaaaaaggg

SEQ ID NO: 1636196 - RNA, 19 nt, Pseudomonas putida KT2440
gagggaaaacucggucagg

SEQ ID NO: 1636197 - RNA, 20 nt, Pseudomonas putida KT2440
gaggcucuugaggucggcgc

SEQ ID NO: 1636198 - RNA, 15 nt, Pseudomonas putida KT2440
gaggcagcgaaagca

SEQ ID NO: 1636199 - RNA, 14 nt, Pseudomonas putida KT2440
gaggcguuggccga

SEQ ID NO: 1636200 - RNA, 15 nt, Pseudomonas putida KT2440
gaggcguuggccgaa

SEQ ID NO: 1636201 - RNA, 23 nt, Pseudomonas putida KT2440
gaggugcgcuucaaauagaagaa

SEQ ID NO: 1636202 - RNA, 19 nt, Pseudomonas putida KT2440
gaggugccauagcaccagc

SEQ ID NO: 1636203 - RNA, 22 nt, Pseudomonas putida KT2440
gaggucuucgaucucggccagc

SEQ ID NO: 1636204 - RNA, 16 nt, Pseudomonas putida KT2440
gaggucgucggucucg

SEQ ID NO: 1636205 - RNA, 23 nt, Pseudomonas putida KT2440
gaggucgggaauugcagcccgca

SEQ ID NO: 1636206 - RNA, 23 nt, Pseudomonas putida KT2440
gaggucggagaucgagugcucga

SEQ ID NO: 1636207 - RNA, 20 nt, Pseudomonas putida KT2440
gagggaugagaaagcccgca

SEQ ID NO: 1636208 - RNA, 17 nt, Pseudomonas putida KT2440
gagggcaggaugacuuu

SEQ ID NO: 1636209 - RNA, 18 nt, Pseudomonas putida KT2440
gagggccgcgcaggcggc

SEQ ID NO: 1636210 - RNA, 16 nt, Pseudomonas putida KT2440
gagggcguuccagcca

SEQ ID NO: 1636211 - RNA, 15 nt, Pseudomonas putida KT2440
gaguucauggucacc

SEQ ID NO: 1636212 - RNA, 14 nt, Pseudomonas putida KT2440
gaguugaguggggu

SEQ ID NO: 1636213 - RNA, 18 nt, Pseudomonas putida KT2440
gaguugcguggggccugc

SEQ ID NO: 1636214 - RNA, 21 nt, Pseudomonas putida KT2440
gaguuacagguuguaaacaaa

SEQ ID NO: 1636215 - RNA, 19 nt, Pseudomonas putida KT2440
gaguuagacauuagaaaau

SEQ ID NO: 1636216 - RNA, 20 nt, Pseudomonas putida KT2440
gaguuagacauuagaaaaug

SEQ ID NO: 1636217 - RNA, 23 nt, Pseudomonas putida KT2440
gagguguacgcgaaggcggucgc

SEQ ID NO: 1636218 - RNA, 19 nt, Pseudomonas putida KT2440
gagguugccauugaggcug

SEQ ID NO: 1636219 - RNA, 18 nt, Pseudomonas putida KT2440
gagucagcgugccagaga

SEQ ID NO: 1636220 - RNA, 16 nt, Pseudomonas putida KT2440
gagucaggcugcacaa

SEQ ID NO: 1636221 - RNA, 21 nt, Pseudomonas putida KT2440
gagugccccaaacggaccgca

SEQ ID NO: 1636222 - RNA, 20 nt, Pseudomonas putida KT2440
gagugcgcugaucgaaagcu

SEQ ID NO: 1636223 - RNA, 13 nt, Pseudomonas putida KT2440
gagugcggcaggc

SEQ ID NO: 1636224 - RNA, 12 nt, Pseudomonas putida KT2440
gauauccagcac

SEQ ID NO: 1636225 - RNA, 18 nt, Pseudomonas putida KT2440
gauauccgcagccccgcc

SEQ ID NO: 1636226 - RNA, 15 nt, Pseudomonas putida KT2440
gauaucggcgcggcc

SEQ ID NO: 1636227 - RNA, 19 nt, Pseudomonas putida KT2440
gauauugaccagcgacggu

SEQ ID NO: 1636228 - RNA, 15 nt, Pseudomonas putida KT2440
gaucaaaacucugca

SEQ ID NO: 1636229 - RNA, 23 nt, Pseudomonas putida KT2440
gaucaacaaaccgacccugcugc

SEQ ID NO: 1636230 - RNA, 22 nt, Pseudomonas putida KT2440
gaucaauaucaucacugccacc

SEQ ID NO: 1636231 - RNA, 13 nt, Pseudomonas putida KT2440
gauagcggcggca

SEQ ID NO: 1636232 - RNA, 19 nt, Pseudomonas putida KT2440
gauagcgcuuuuccaguuc

SEQ ID NO: 1636233 - RNA, 16 nt, Pseudomonas putida KT2440
gauagcgugaagcggc

SEQ ID NO: 1636234 - RNA, 20 nt, Pseudomonas putida KT2440
gauaucaaagcgguacgccg

SEQ ID NO: 1636235 - RNA, 19 nt, Pseudomonas putida KT2440
gauagcagcgcuaugccuu

SEQ ID NO: 1636236 - RNA, 23 nt, Pseudomonas putida KT2440
gauacggggaggccgucaggccu

SEQ ID NO: 1636237 - RNA, 16 nt, Pseudomonas putida KT2440
gauacggucuuuuccc

SEQ ID NO: 1636238 - RNA, 14 nt, Pseudomonas putida KT2440
gauacccaggcgcg

SEQ ID NO: 1636239 - RNA, 19 nt, Pseudomonas putida KT2440
gauacccaauaaaaacaac

SEQ ID NO: 1636240 - RNA, 21 nt, Pseudomonas putida KT2440
gauacccaauaaaaacaacag

SEQ ID NO: 1636241 - RNA, 22 nt, Pseudomonas putida KT2440
gauaccgaggaggaggcugggg

SEQ ID NO: 1636242 - RNA, 15 nt, Pseudomonas putida KT2440
aaagccaacugcucu

SEQ ID NO: 1636243 - RNA, 23 nt, Pseudomonas putida KT2440
aaagcaggucagcgcucaaaaaa

SEQ ID NO: 1636244 - RNA, 14 nt, Pseudomonas putida KT2440
gagccccaccagga

SEQ ID NO: 1636245 - RNA, 17 nt, Pseudomonas putida KT2440
gagcccccgcugcucga

SEQ ID NO: 1636246 - RNA, 14 nt, Pseudomonas putida KT2440
gagcccgccagcag

SEQ ID NO: 1636247 - RNA, 19 nt, Pseudomonas putida KT2440
gagcccgccagcaggccac

SEQ ID NO: 1636248 - RNA, 16 nt, Pseudomonas putida KT2440
gagcccggcgccaaac

SEQ ID NO: 1636249 - RNA, 18 nt, Pseudomonas putida KT2440
gagccuuauagggucagu

SEQ ID NO: 1636250 - RNA, 18 nt, Pseudomonas putida KT2440
gagccggucggagagacc

SEQ ID NO: 1636251 - RNA, 16 nt, Pseudomonas putida KT2440
gagcaugaucaccgcc

SEQ ID NO: 1636252 - RNA, 20 nt, Pseudomonas putida KT2440
gagcaucugcugcggcaggc

SEQ ID NO: 1636253 - RNA, 23 nt, Pseudomonas putida KT2440
gagcaucugcugcggcaggcugg

SEQ ID NO: 1636254 - RNA, 16 nt, Pseudomonas putida KT2440
gagcaucccccuccua

SEQ ID NO: 1636255 - RNA, 16 nt, Pseudomonas putida KT2440
gagcaguuccuucagc

SEQ ID NO: 1636256 - RNA, 19 nt, Pseudomonas putida KT2440
gagcaguuccuucagcagu

SEQ ID NO: 1636257 - RNA, 23 nt, Pseudomonas putida KT2440
aaagcaggauggugacugccagc

SEQ ID NO: 1636258 - RNA, 22 nt, Pseudomonas putida KT2440
gagccaggagaacacccagcgc

SEQ ID NO: 1636259 - RNA, 24 nt, Pseudomonas putida KT2440
gagcagguucaggcgcagcacgcc

SEQ ID NO: 1636260 - RNA, 19 nt, Pseudomonas putida KT2440
gagcaggucgaacagcccc

SEQ ID NO: 1636261 - RNA, 20 nt, Pseudomonas putida KT2440
gagcaggucgaacagccccc

SEQ ID NO: 1636262 - RNA, 22 nt, Pseudomonas putida KT2440
gagcaggucgaacagcccccgg

SEQ ID NO: 1636263 - RNA, 12 nt, Pseudomonas putida KT2440
aaagcagcccca

SEQ ID NO: 1636264 - RNA, 14 nt, Pseudomonas putida KT2440
aaagcagccccaaa

SEQ ID NO: 1636265 - RNA, 18 nt, Pseudomonas putida KT2440
aaagcagccccaaaagcc

SEQ ID NO: 1636266 - RNA, 12 nt, Pseudomonas putida KT2440
aaagcagccccc

SEQ ID NO: 1636267 - RNA, 15 nt, Pseudomonas putida KT2440
aaagcagcccccaac

SEQ ID NO: 1636268 - RNA, 23 nt, Pseudomonas putida KT2440
gagcacggcuucgacgcuuuccu

SEQ ID NO: 1636269 - RNA, 17 nt, Pseudomonas putida KT2440
gagcaccacggcggcga

SEQ ID NO: 1636270 - RNA, 19 nt, Pseudomonas putida KT2440
gagcaccgggcacuuggca

SEQ ID NO: 1636271 - RNA, 19 nt, Pseudomonas putida KT2440
gagauaucgcauuucuagc

SEQ ID NO: 1636272 - RNA, 19 nt, Pseudomonas putida KT2440
gagagccucggcucuccuu

SEQ ID NO: 1636273 - RNA, 19 nt, Pseudomonas putida KT2440
gagagcaguuccuucagca

SEQ ID NO: 1636274 - RNA, 13 nt, Pseudomonas putida KT2440
gagaaggcguggu

SEQ ID NO: 1636275 - RNA, 17 nt, Pseudomonas putida KT2440
gagaagcugcagcuuca

SEQ ID NO: 1636276 - RNA, 15 nt, Pseudomonas putida KT2440
gagaagcacaagcca

SEQ ID NO: 1636277 - RNA, 19 nt, Pseudomonas putida KT2440
gagaccgauuucaacccua

SEQ ID NO: 1636278 - RNA, 12 nt, Pseudomonas putida KT2440
gagaccaguucu

SEQ ID NO: 1636279 - RNA, 18 nt, Pseudomonas putida KT2440
gagacgcauguugaaaca

SEQ ID NO: 1636280 - RNA, 13 nt, Pseudomonas putida KT2440
gagacaucuccau

SEQ ID NO: 1636281 - RNA, 17 nt, Pseudomonas putida KT2440
gagaaugcggauguagu

SEQ ID NO: 1636282 - RNA, 13 nt, Pseudomonas putida KT2440
gagaacaggcggc

SEQ ID NO: 1636283 - RNA, 14 nt, Pseudomonas putida KT2440
gagaacaugaaagu

SEQ ID NO: 1636284 - RNA, 21 nt, Pseudomonas putida KT2440
gagaaauggcaguguggcaag

SEQ ID NO: 1636285 - RNA, 18 nt, Pseudomonas putida KT2440
gagaaacucacgcauggc

SEQ ID NO: 1636286 - RNA, 23 nt, Pseudomonas putida KT2440
gacuucgaccacggccggggccu

SEQ ID NO: 1636287 - RNA, 15 nt, Pseudomonas putida KT2440
gacuuccagcagcac

SEQ ID NO: 1636288 - RNA, 18 nt, Pseudomonas putida KT2440
gacuucccgcaagccagc

SEQ ID NO: 1636289 - RNA, 12 nt, Pseudomonas putida KT2440
gacuucaucgcg

SEQ ID NO: 1636290 - RNA, 22 nt, Pseudomonas putida KT2440
gacuuaaucaaugcaaguaauc

SEQ ID NO: 1636291 - RNA, 17 nt, Pseudomonas putida KT2440
gacuuuaaaacuaauau

SEQ ID NO: 1636292 - RNA, 22 nt, Pseudomonas putida KT2440
gacuuuccauuacuccagaaaa

SEQ ID NO: 1636293 - RNA, 20 nt, Pseudomonas putida KT2440
gacuugccugucauggcagu

SEQ ID NO: 1636294 - RNA, 13 nt, Pseudomonas putida KT2440
gacucgaugccau

SEQ ID NO: 1636295 - RNA, 22 nt, Pseudomonas putida KT2440
gacucgaucugugggagcggcc

SEQ ID NO: 1636296 - RNA, 22 nt, Pseudomonas putida KT2440
gacucgaaaccaucaaucaacu

SEQ ID NO: 1636297 - RNA, 20 nt, Pseudomonas putida KT2440
gacuccugugggagcgggcg

SEQ ID NO: 1636298 - RNA, 18 nt, Pseudomonas putida KT2440
gacucgcggccggucacc

SEQ ID NO: 1636299 - RNA, 15 nt, Pseudomonas putida KT2440
gacucuucaccagcu

SEQ ID NO: 1636300 - RNA, 21 nt, Pseudomonas putida KT2440
gacucuuguguugccacccgg

SEQ ID NO: 1636301 - RNA, 16 nt, Pseudomonas putida KT2440
gacuccgcuucaucag

SEQ ID NO: 1636302 - RNA, 23 nt, Pseudomonas putida KT2440
gacuccgcuucaucaggucgccu

SEQ ID NO: 1636303 - RNA, 17 nt, Pseudomonas putida KT2440
gacugccgcucaucgag

SEQ ID NO: 1636304 - RNA, 15 nt, Pseudomonas putida KT2440
gacugcgcuacaccc

SEQ ID NO: 1636305 - RNA, 13 nt, Pseudomonas putida KT2440
gacugcaccaggu

SEQ ID NO: 1636306 - RNA, 18 nt, Pseudomonas putida KT2440
gacugcaccagguccagc

SEQ ID NO: 1636307 - RNA, 13 nt, Pseudomonas putida KT2440
gacugcacugcca

SEQ ID NO: 1636308 - RNA, 22 nt, Pseudomonas putida KT2440
gacugaacaccugccagccccg

SEQ ID NO: 1636309 - RNA, 19 nt, Pseudomonas putida KT2440
gacuggccggagcuggagc

SEQ ID NO: 1636310 - RNA, 20 nt, Pseudomonas putida KT2440
gacuggcgcaccagcggcuu

SEQ ID NO: 1636311 - RNA, 21 nt, Pseudomonas putida KT2440
gacugcuguggaacagccuug

SEQ ID NO: 1636312 - RNA, 16 nt, Pseudomonas putida KT2440
gacccuuccagcccgc

SEQ ID NO: 1636313 - RNA, 14 nt, Pseudomonas putida KT2440
gaccgcacucccca

SEQ ID NO: 1636314 - RNA, 20 nt, Pseudomonas putida KT2440
gaccgggacgcaggcgcaac

SEQ ID NO: 1636315 - RNA, 18 nt, Pseudomonas putida KT2440
gaccggcuugucuuccag

SEQ ID NO: 1636316 - RNA, 22 nt, Pseudomonas putida KT2440
gaccggggcugcuuugcagccc

SEQ ID NO: 1636317 - RNA, 18 nt, Pseudomonas putida KT2440
gaccgguggccugagccg

SEQ ID NO: 1636318 - RNA, 15 nt, Pseudomonas putida KT2440
gaccgguggcgccuu

SEQ ID NO: 1636319 - RNA, 18 nt, Pseudomonas putida KT2440
gaccucagccgugguuuc

SEQ ID NO: 1636320 - RNA, 15 nt, Pseudomonas putida KT2440
gaccguuugcagcgu

SEQ ID NO: 1636321 - RNA, 17 nt, Pseudomonas putida KT2440
gaccgugaucaucagcg

SEQ ID NO: 1636322 - RNA, 20 nt, Pseudomonas putida KT2440
gaccgugcauacacccgguc

SEQ ID NO: 1636323 - RNA, 14 nt, Pseudomonas putida KT2440
gaccguuccgcaaa

SEQ ID NO: 1636324 - RNA, 13 nt, Pseudomonas putida KT2440
gacgaccagcaug

SEQ ID NO: 1636325 - RNA, 17 nt, Pseudomonas putida KT2440
gaccucgacccgcccgc

SEQ ID NO: 1636326 - RNA, 18 nt, Pseudomonas putida KT2440
gacgauggacagcccaag

SEQ ID NO: 1636327 - RNA, 23 nt, Pseudomonas putida KT2440
gacgauggccaccaggguggcga

SEQ ID NO: 1636328 - RNA, 17 nt, Pseudomonas putida KT2440
gacgaccucggccaggu

SEQ ID NO: 1636329 - RNA, 22 nt, Pseudomonas putida KT2440
gacgaccaguucgacgcugcug

SEQ ID NO: 1636330 - RNA, 22 nt, Pseudomonas putida KT2440
gacgcugccgucucgucacugg

SEQ ID NO: 1636331 - RNA, 15 nt, Pseudomonas putida KT2440
gacgcugcacuucca

SEQ ID NO: 1636332 - RNA, 19 nt, Pseudomonas putida KT2440
gacggauacaccagaaagc

SEQ ID NO: 1636333 - RNA, 15 nt, Pseudomonas putida KT2440
gacggaucggcacac

SEQ ID NO: 1636334 - RNA, 20 nt, Pseudomonas putida KT2440
gacgcuggcagcuuggccau

SEQ ID NO: 1636335 - RNA, 15 nt, Pseudomonas putida KT2440
gacgcgugguccuga

SEQ ID NO: 1636336 - RNA, 16 nt, Pseudomonas putida KT2440
gacgcgugguccugau

SEQ ID NO: 1636337 - RNA, 21 nt, Pseudomonas putida KT2440
gacgcguacgccguugccgcc

SEQ ID NO: 1636338 - RNA, 12 nt, Pseudomonas putida KT2440
gacgcacacucc

SEQ ID NO: 1636339 - RNA, 15 nt, Pseudomonas putida KT2440
gacgcaagcgcgccg

SEQ ID NO: 1636340 - RNA, 15 nt, Pseudomonas putida KT2440
gacgcaaggccgcuc

SEQ ID NO: 1636341 - RNA, 22 nt, Pseudomonas putida KT2440
gacgcaaggccguucccacaaa

SEQ ID NO: 1636342 - RNA, 21 nt, Pseudomonas putida KT2440
gacgcaccagguuggccgccg

SEQ ID NO: 1636343 - RNA, 15 nt, Pseudomonas putida KT2440
gacgucccagcaggc

SEQ ID NO: 1636344 - RNA, 12 nt, Pseudomonas putida KT2440
gacgguggcugc

SEQ ID NO: 1636345 - RNA, 20 nt, Pseudomonas putida KT2440
gacgguuacgugcaggcgca

SEQ ID NO: 1636346 - RNA, 12 nt, Pseudomonas putida KT2440
gacggugguggc

SEQ ID NO: 1636347 - RNA, 17 nt, Pseudomonas putida KT2440
gacggugguggccgcgc

SEQ ID NO: 1636348 - RNA, 13 nt, Pseudomonas putida KT2440
gacaguucgccac

SEQ ID NO: 1636349 - RNA, 15 nt, Pseudomonas putida KT2440
gacaguucgccaccc

SEQ ID NO: 1636350 - RNA, 13 nt, Pseudomonas putida KT2440
gacagcggccagc

SEQ ID NO: 1636351 - RNA, 22 nt, Pseudomonas putida KT2440
gacagcucucaacguucauccc

SEQ ID NO: 1636352 - RNA, 20 nt, Pseudomonas putida KT2440
gacagcuuguugccagcggc

SEQ ID NO: 1636353 - RNA, 21 nt, Pseudomonas putida KT2440
gacacggcgaugcgcccccca

SEQ ID NO: 1636354 - RNA, 14 nt, Pseudomonas putida KT2440
gacacggacucaua

SEQ ID NO: 1636355 - RNA, 18 nt, Pseudomonas putida KT2440
gacacgcuuuucaggggu

SEQ ID NO: 1636356 - RNA, 21 nt, Pseudomonas putida KT2440
gacacgcgaaucgccagggcu

SEQ ID NO: 1636357 - RNA, 19 nt, Pseudomonas putida KT2440
gacacauaggcagccaccu

SEQ ID NO: 1636358 - RNA, 15 nt, Pseudomonas putida KT2440
gacacaggcgcucgu

SEQ ID NO: 1636359 - RNA, 19 nt, Pseudomonas putida KT2440
gacacaucacgcacauuca

SEQ ID NO: 1636360 - RNA, 16 nt, Pseudomonas putida KT2440
gacacaugcaaacccu

SEQ ID NO: 1636361 - RNA, 17 nt, Pseudomonas putida KT2440
gacacaugcaaacccug

SEQ ID NO: 1636362 - RNA, 12 nt, Pseudomonas putida KT2440
gacagcaccaug

SEQ ID NO: 1636363 - RNA, 22 nt, Pseudomonas putida KT2440
gacagcacgggcacacuggcca

SEQ ID NO: 1636364 - RNA, 18 nt, Pseudomonas putida KT2440
gacagcaggaacagcggc

SEQ ID NO: 1636365 - RNA, 20 nt, Pseudomonas putida KT2440
gacacuugguccagggccau

SEQ ID NO: 1636366 - RNA, 16 nt, Pseudomonas putida KT2440
gaccacggccggggcc

SEQ ID NO: 1636367 - RNA, 17 nt, Pseudomonas putida KT2440
gaccacggccggggccu

SEQ ID NO: 1636368 - RNA, 13 nt, Pseudomonas putida KT2440
gaccaaggccaac

SEQ ID NO: 1636369 - RNA, 14 nt, Pseudomonas putida KT2440
gaccagacagcgcu

SEQ ID NO: 1636370 - RNA, 19 nt, Pseudomonas putida KT2440
gaccagacccgcuucgccg

SEQ ID NO: 1636371 - RNA, 13 nt, Pseudomonas putida KT2440
gaccagaucagcc

SEQ ID NO: 1636372 - RNA, 22 nt, Pseudomonas putida KT2440
gaccagaagggcgcaaaagucc

SEQ ID NO: 1636373 - RNA, 20 nt, Pseudomonas putida KT2440
gaccacuucgacauggcugg

SEQ ID NO: 1636374 - RNA, 16 nt, Pseudomonas putida KT2440
gaccaacaggcuggca

SEQ ID NO: 1636375 - RNA, 18 nt, Pseudomonas putida KT2440
gaccaagcaacgcaacaa

SEQ ID NO: 1636376 - RNA, 15 nt, Pseudomonas putida KT2440
gacauugaagaagcc

SEQ ID NO: 1636377 - RNA, 16 nt, Pseudomonas putida KT2440
gaccaaaugagugagc

SEQ ID NO: 1636378 - RNA, 20 nt, Pseudomonas putida KT2440
gaccagcccggcuccgcgca

SEQ ID NO: 1636379 - RNA, 16 nt, Pseudomonas putida KT2440
gaccagcagcaguggc

SEQ ID NO: 1636380 - RNA, 22 nt, Pseudomonas putida KT2440
gaccaggcgcucgcuccagggc

SEQ ID NO: 1636381 - RNA, 18 nt, Pseudomonas putida KT2440
gaccaggcaguaggugca

SEQ ID NO: 1636382 - RNA, 19 nt, Pseudomonas putida KT2440
gaccagcgacgguggcgug

SEQ ID NO: 1636383 - RNA, 17 nt, Pseudomonas putida KT2440
gacccgucgcugccaaa

SEQ ID NO: 1636384 - RNA, 21 nt, Pseudomonas putida KT2440
gacccuggaaaaugcccccgc

SEQ ID NO: 1636385 - RNA, 19 nt, Pseudomonas putida KT2440
gacccuggcauagcagucc

SEQ ID NO: 1636386 - RNA, 24 nt, Pseudomonas putida KT2440
gacccggccuuucgcgccaguucg

SEQ ID NO: 1636387 - RNA, 14 nt, Pseudomonas putida KT2440
gacccgcuggaccu

SEQ ID NO: 1636388 - RNA, 12 nt, Pseudomonas putida KT2440
gacccgcugccc

SEQ ID NO: 1636389 - RNA, 14 nt, Pseudomonas putida KT2440
gacccgcgccaggg

SEQ ID NO: 1636390 - RNA, 12 nt, Pseudomonas putida KT2440
gacccacaggca

SEQ ID NO: 1636391 - RNA, 15 nt, Pseudomonas putida KT2440
gacccagaaucccaa

SEQ ID NO: 1636392 - RNA, 13 nt, Pseudomonas putida KT2440
gacccagccaccc

SEQ ID NO: 1636393 - RNA, 21 nt, Pseudomonas putida KT2440
gacccgcagcagguugcuggu

SEQ ID NO: 1636394 - RNA, 16 nt, Pseudomonas putida KT2440
gaccaggcccagcagg

SEQ ID NO: 1636395 - RNA, 15 nt, Pseudomonas putida KT2440
gaccagggccuuggc

SEQ ID NO: 1636396 - RNA, 20 nt, Pseudomonas putida KT2440
gaccagggccuuggccuggg

SEQ ID NO: 1636397 - RNA, 20 nt, Pseudomonas putida KT2440
gaccaggugguaacuggcca

SEQ ID NO: 1636398 - RNA, 21 nt, Pseudomonas putida KT2440
gaccaggugguaacuggccag

SEQ ID NO: 1636399 - RNA, 14 nt, Pseudomonas putida KT2440
gaccagugucugca

SEQ ID NO: 1636400 - RNA, 20 nt, Pseudomonas putida KT2440
gaccauuucgcgcagggugc

SEQ ID NO: 1636401 - RNA, 15 nt, Pseudomonas putida KT2440
gaauucguuuucggu

SEQ ID NO: 1636402 - RNA, 19 nt, Pseudomonas putida KT2440
gaauuucugcaccuugccc

SEQ ID NO: 1636403 - RNA, 23 nt, Pseudomonas putida KT2440
gaauuugccgggagcggguuuuc

SEQ ID NO: 1636404 - RNA, 17 nt, Pseudomonas putida KT2440
gaauuugguggaaguug

SEQ ID NO: 1636405 - RNA, 13 nt, Pseudomonas putida KT2440
gaauggguggcag

SEQ ID NO: 1636406 - RNA, 16 nt, Pseudomonas putida KT2440
gaauggguggcagcug

SEQ ID NO: 1636407 - RNA, 17 nt, Pseudomonas putida KT2440
gacaagccaaccaaagg

SEQ ID NO: 1636408 - RNA, 19 nt, Pseudomonas putida KT2440
gacaagccgacaaaaacaa

SEQ ID NO: 1636409 - RNA, 15 nt, Pseudomonas putida KT2440
gacaagccgcugggc

SEQ ID NO: 1636410 - RNA, 21 nt, Pseudomonas putida KT2440
gacaacgguguggccagugcc

SEQ ID NO: 1636411 - RNA, 18 nt, Pseudomonas putida KT2440
gacaagaagcggcugccu

SEQ ID NO: 1636412 - RNA, 19 nt, Pseudomonas putida KT2440
gacaaucggcucaacagcc

SEQ ID NO: 1636413 - RNA, 19 nt, Pseudomonas putida KT2440
gacacaaggccgcucccac

SEQ ID NO: 1636414 - RNA, 12 nt, Pseudomonas putida KT2440
gacaaauccagg

SEQ ID NO: 1636415 - RNA, 16 nt, Pseudomonas putida KT2440
gacaacagcaugcuca

SEQ ID NO: 1636416 - RNA, 13 nt, Pseudomonas putida KT2440
gacaaagccugca

SEQ ID NO: 1636417 - RNA, 14 nt, Pseudomonas putida KT2440
gacaaagcucaaau

SEQ ID NO: 1636418 - RNA, 17 nt, Pseudomonas putida KT2440
gacaaagcucaaaugcu

SEQ ID NO: 1636419 - RNA, 15 nt, Pseudomonas putida KT2440
gacaaaggccggcac

SEQ ID NO: 1636420 - RNA, 20 nt, Pseudomonas putida KT2440
gaauaggucacguuguagcc

SEQ ID NO: 1636421 - RNA, 18 nt, Pseudomonas putida KT2440
gaauaucgagcguuuuuc

SEQ ID NO: 1636422 - RNA, 20 nt, Pseudomonas putida KT2440
gaaucggcuccaggcacagg

SEQ ID NO: 1636423 - RNA, 21 nt, Pseudomonas putida KT2440
gaauccuagcuucuuggucuc

SEQ ID NO: 1636424 - RNA, 19 nt, Pseudomonas putida KT2440
gaaugcauggugaagcccg

SEQ ID NO: 1636425 - RNA, 14 nt, Pseudomonas putida KT2440
gaauaaagaaagug

SEQ ID NO: 1636426 - RNA, 17 nt, Pseudomonas putida KT2440
gaauaaagaaagugaug

SEQ ID NO: 1636427 - RNA, 20 nt, Pseudomonas putida KT2440
gaaguguuaccucccgcaca

SEQ ID NO: 1636428 - RNA, 15 nt, Pseudomonas putida KT2440
gaauacgcucagccg

SEQ ID NO: 1636429 - RNA, 13 nt, Pseudomonas putida KT2440
gaauacgguagcg

SEQ ID NO: 1636430 - RNA, 20 nt, Pseudomonas putida KT2440
gaauacgguagcggcagcaa

SEQ ID NO: 1636431 - RNA, 18 nt, Pseudomonas putida KT2440
gaauacgauagcggcggc

SEQ ID NO: 1636432 - RNA, 22 nt, Pseudomonas putida KT2440
gaauacgauauccgcagccccg

SEQ ID NO: 1636433 - RNA, 21 nt, Pseudomonas putida KT2440
gaauacgcucgaccagaucag

SEQ ID NO: 1636434 - RNA, 22 nt, Pseudomonas putida KT2440
gaauaauucuuauuaccagaau

SEQ ID NO: 1636435 - RNA, 18 nt, Pseudomonas putida KT2440
gaagguugcagguucuua

SEQ ID NO: 1636436 - RNA, 12 nt, Pseudomonas putida KT2440
gaagucaaccuc

SEQ ID NO: 1636437 - RNA, 16 nt, Pseudomonas putida KT2440
gaagguucguccccuu

SEQ ID NO: 1636438 - RNA, 14 nt, Pseudomonas putida KT2440
gaaggugguagccg

SEQ ID NO: 1636439 - RNA, 15 nt, Pseudomonas putida KT2440
gaaggucuucagcuc

SEQ ID NO: 1636440 - RNA, 18 nt, Pseudomonas putida KT2440
gaaggugcuguaagggcu

SEQ ID NO: 1636441 - RNA, 20 nt, Pseudomonas putida KT2440
gaagugcgcaauccuugccc

SEQ ID NO: 1636442 - RNA, 21 nt, Pseudomonas putida KT2440
gaagugccaaggcuuuuugau

SEQ ID NO: 1636443 - RNA, 20 nt, Pseudomonas putida KT2440
gaagugauuugauggggcgc

SEQ ID NO: 1636444 - RNA, 21 nt, Pseudomonas putida KT2440
gaagugauuugauggggcgcu

SEQ ID NO: 1636445 - RNA, 16 nt, Pseudomonas putida KT2440
gaaguggauauccagc

SEQ ID NO: 1636446 - RNA, 18 nt, Pseudomonas putida KT2440
gaagucacaccaucggcc

SEQ ID NO: 1636447 - RNA, 21 nt, Pseudomonas putida KT2440
gaagucagguaggugcugacc

SEQ ID NO: 1636448 - RNA, 21 nt, Pseudomonas putida KT2440
gaagucaugggucacucccgg

SEQ ID NO: 1636449 - RNA, 16 nt, Pseudomonas putida KT2440
gaaguccgggguuuuu

SEQ ID NO: 1636450 - RNA, 17 nt, Pseudomonas putida KT2440
gaagcucuccagcaggu

SEQ ID NO: 1636451 - RNA, 15 nt, Pseudomonas putida KT2440
gaagcugcagcagcu

SEQ ID NO: 1636452 - RNA, 14 nt, Pseudomonas putida KT2440
gaagcuguggggcu

SEQ ID NO: 1636453 - RNA, 18 nt, Pseudomonas putida KT2440
gaagcuguggggcugacu

SEQ ID NO: 1636454 - RNA, 14 nt, Pseudomonas putida KT2440
gaaggcuggccuca

SEQ ID NO: 1636455 - RNA, 15 nt, Pseudomonas putida KT2440
gaaggcugccuggcc

SEQ ID NO: 1636456 - RNA, 18 nt, Pseudomonas putida KT2440
gaagcuguuggcacggcu

SEQ ID NO: 1636457 - RNA, 15 nt, Pseudomonas putida KT2440
gaagauuuucagcca

SEQ ID NO: 1636458 - RNA, 21 nt, Pseudomonas putida KT2440
gaagccgacccgggccagcca

SEQ ID NO: 1636459 - RNA, 15 nt, Pseudomonas putida KT2440
gaagccgaccacuuc

SEQ ID NO: 1636460 - RNA, 19 nt, Pseudomonas putida KT2440
gaagccaaccccgcagaca

SEQ ID NO: 1636461 - RNA, 22 nt, Pseudomonas putida KT2440
gaagcaggccgguugcuccagc

SEQ ID NO: 1636462 - RNA, 14 nt, Pseudomonas putida KT2440
gaagccuucaucac

SEQ ID NO: 1636463 - RNA, 22 nt, Pseudomonas putida KT2440
gaagcgacagcggccagcucgg

SEQ ID NO: 1636464 - RNA, 16 nt, Pseudomonas putida KT2440
gaagcuaucgccagca

SEQ ID NO: 1636465 - RNA, 20 nt, Pseudomonas putida KT2440
gaagcuaucgccagcaggcc

SEQ ID NO: 1636466 - RNA, 17 nt, Pseudomonas putida KT2440
gaagcuccaggcgacca

SEQ ID NO: 1636467 - RNA, 18 nt, Pseudomonas putida KT2440
gaagcuaccccacaaccc

SEQ ID NO: 1636468 - RNA, 15 nt, Pseudomonas putida KT2440
gaagcuaacccgguc

SEQ ID NO: 1636469 - RNA, 17 nt, Pseudomonas putida KT2440
gaagccggcauggcggu

SEQ ID NO: 1636470 - RNA, 15 nt, Pseudomonas putida KT2440
gaacauggccgagcu

SEQ ID NO: 1636471 - RNA, 23 nt, Pseudomonas putida KT2440
gaacaugccacggccuucuucac

SEQ ID NO: 1636472 - RNA, 14 nt, Pseudomonas putida KT2440
gaagaagcucccgg

SEQ ID NO: 1636473 - RNA, 15 nt, Pseudomonas putida KT2440
gaagaugacuggccg

SEQ ID NO: 1636474 - RNA, 21 nt, Pseudomonas putida KT2440
gaagagccccuaaagggugaa

SEQ ID NO: 1636475 - RNA, 23 nt, Pseudomonas putida KT2440
gaagagauauguccauccaugca

SEQ ID NO: 1636476 - RNA, 23 nt, Pseudomonas putida KT2440
gaagaccacuuuuggcgugaggc

SEQ ID NO: 1636477 - RNA, 14 nt, Pseudomonas putida KT2440
gaagaccgccgccc

SEQ ID NO: 1636478 - RNA, 21 nt, Pseudomonas putida KT2440
gaagaccgccgcccaggucau

SEQ ID NO: 1636479 - RNA, 17 nt, Pseudomonas putida KT2440
gaaagggccgcaaagcg

SEQ ID NO: 1636480 - RNA, 16 nt, Pseudomonas putida KT2440
gaaagucgaccagcag

SEQ ID NO: 1636481 - RNA, 17 nt, Pseudomonas putida KT2440
gaaagucgaccagcagc

SEQ ID NO: 1636482 - RNA, 21 nt, Pseudomonas putida KT2440
gaaagcgcaaucaaagcagac

SEQ ID NO: 1636483 - RNA, 21 nt, Pseudomonas putida KT2440
gaaagugcguuggcugcugaa

SEQ ID NO: 1636484 - RNA, 22 nt, Pseudomonas putida KT2440
gaaaguggccaagccaccgcca

SEQ ID NO: 1636485 - RNA, 18 nt, Pseudomonas putida KT2440
gaaaucgggucauccccg

SEQ ID NO: 1636486 - RNA, 14 nt, Pseudomonas putida KT2440
gaaauccagccgcc

SEQ ID NO: 1636487 - RNA, 22 nt, Pseudomonas putida KT2440
gaaaucagccuucagugcuuca

SEQ ID NO: 1636488 - RNA, 19 nt, Pseudomonas putida KT2440
gaaauagguaaagccaccg

SEQ ID NO: 1636489 - RNA, 14 nt, Pseudomonas putida KT2440
gaaacggcaaugac

SEQ ID NO: 1636490 - RNA, 21 nt, Pseudomonas putida KT2440
gaaacggcaaugaccaagcaa

SEQ ID NO: 1636491 - RNA, 21 nt, Pseudomonas putida KT2440
gaaacgcguuucggcggccug

SEQ ID NO: 1636492 - RNA, 20 nt, Pseudomonas putida KT2440
gaaacgcggcaaccugcacu

SEQ ID NO: 1636493 - RNA, 14 nt, Pseudomonas putida KT2440
gaaacgccaggcac

SEQ ID NO: 1636494 - RNA, 17 nt, Pseudomonas putida KT2440
gaaacgauacuccggca

SEQ ID NO: 1636495 - RNA, 17 nt, Pseudomonas putida KT2440
gaaacgcaggcucugcg

SEQ ID NO: 1636496 - RNA, 16 nt, Pseudomonas putida KT2440
gaaagccuaccaggaa

SEQ ID NO: 1636497 - RNA, 13 nt, Pseudomonas putida KT2440
gaacagcaacaca

SEQ ID NO: 1636498 - RNA, 23 nt, Pseudomonas putida KT2440
gaacagcaacacauacuccaccg

SEQ ID NO: 1636499 - RNA, 15 nt, Pseudomonas putida KT2440
gaacagcgccacgcc

SEQ ID NO: 1636500 - RNA, 12 nt, Pseudomonas putida KT2440
gaacagccuugu

SEQ ID NO: 1636501 - RNA, 23 nt, Pseudomonas putida KT2440
gaacagcgcccagaucagcagca

SEQ ID NO: 1636502 - RNA, 16 nt, Pseudomonas putida KT2440
gaacagcgcagccacc

SEQ ID NO: 1636503 - RNA, 17 nt, Pseudomonas putida KT2440
gaacagcgaagccagca

SEQ ID NO: 1636504 - RNA, 13 nt, Pseudomonas putida KT2440
gaacagggcagac

SEQ ID NO: 1636505 - RNA, 19 nt, Pseudomonas putida KT2440
gaacagggccagguagacg

SEQ ID NO: 1636506 - RNA, 13 nt, Pseudomonas putida KT2440
gaacagcgccggc

SEQ ID NO: 1636507 - RNA, 14 nt, Pseudomonas putida KT2440
gaacagcgccggca

SEQ ID NO: 1636508 - RNA, 14 nt, Pseudomonas putida KT2440
gaacagcgccuuga

SEQ ID NO: 1636509 - RNA, 14 nt, Pseudomonas putida KT2440
gaacagcggcagca

SEQ ID NO: 1636510 - RNA, 17 nt, Pseudomonas putida KT2440
gaacagcggcagcaaca

SEQ ID NO: 1636511 - RNA, 22 nt, Pseudomonas putida KT2440
gaacaggcguacaucagccucg

SEQ ID NO: 1636512 - RNA, 18 nt, Pseudomonas putida KT2440
gaacaggugcgcgcgcga

SEQ ID NO: 1636513 - RNA, 21 nt, Pseudomonas putida KT2440
gaacaguguggugcggcuggg

SEQ ID NO: 1636514 - RNA, 14 nt, Pseudomonas putida KT2440
gaacacccagcgca

SEQ ID NO: 1636515 - RNA, 18 nt, Pseudomonas putida KT2440
gaacaccaguucgccauc

SEQ ID NO: 1636516 - RNA, 14 nt, Pseudomonas putida KT2440
gaacaccagcccca

SEQ ID NO: 1636517 - RNA, 16 nt, Pseudomonas putida KT2440
gaacaccagccccagc

SEQ ID NO: 1636518 - RNA, 18 nt, Pseudomonas putida KT2440
gaacagacccaugauuga

SEQ ID NO: 1636519 - RNA, 21 nt, Pseudomonas putida KT2440
gaacagaaggaagauugaagg

SEQ ID NO: 1636520 - RNA, 18 nt, Pseudomonas putida KT2440
gaacacuggcaggcucag

SEQ ID NO: 1636521 - RNA, 19 nt, Pseudomonas putida KT2440
gaacacuggcaggcucagg

SEQ ID NO: 1636522 - RNA, 20 nt, Pseudomonas putida KT2440
gaacaaccugaacaaggccu

SEQ ID NO: 1636523 - RNA, 15 nt, Pseudomonas putida KT2440
gaacacagcggccuu

SEQ ID NO: 1636524 - RNA, 15 nt, Pseudomonas putida KT2440
gaacacaucaccugc

SEQ ID NO: 1636525 - RNA, 22 nt, Pseudomonas putida KT2440
gaacaccacccggucggccagc

SEQ ID NO: 1636526 - RNA, 21 nt, Pseudomonas putida KT2440
gaaauuggccagcaggucagg

SEQ ID NO: 1636527 - RNA, 15 nt, Pseudomonas putida KT2440
gaaauuggcgagcag

SEQ ID NO: 1636528 - RNA, 18 nt, Pseudomonas putida KT2440
gaaauuggcgagcaggcc

SEQ ID NO: 1636529 - RNA, 13 nt, Pseudomonas putida KT2440
gaaauguucaaca

SEQ ID NO: 1636530 - RNA, 16 nt, Pseudomonas putida KT2440
gaaauguucaacagcc

SEQ ID NO: 1636531 - RNA, 18 nt, Pseudomonas putida KT2440
gaaauggcgaaucagcau

SEQ ID NO: 1636532 - RNA, 20 nt, Pseudomonas putida KT2440
gaaaucugccugcugcaaca

SEQ ID NO: 1636533 - RNA, 22 nt, Pseudomonas putida KT2440
gaaaucugccugcugcaacagc

SEQ ID NO: 1636534 - RNA, 23 nt, Pseudomonas putida KT2440
gaaaucugccugcugcaacagcu

SEQ ID NO: 1636535 - RNA, 14 nt, Pseudomonas putida KT2440
cuuuuggcugugca

SEQ ID NO: 1636536 - RNA, 18 nt, Pseudomonas putida KT2440
cuuuuggcugugcacccg

SEQ ID NO: 1636537 - RNA, 13 nt, Pseudomonas putida KT2440
gaaaaagaacaga

SEQ ID NO: 1636538 - RNA, 16 nt, Pseudomonas putida KT2440
gaaaaaauuuuugaau

SEQ ID NO: 1636539 - RNA, 22 nt, Pseudomonas putida KT2440
gaaaaaaucaugcgcuggccac

SEQ ID NO: 1636540 - RNA, 15 nt, Pseudomonas putida KT2440
cuuuuucaccaggcg

SEQ ID NO: 1636541 - RNA, 20 nt, Pseudomonas putida KT2440
gaaaccgcgaaucgcucacc

SEQ ID NO: 1636542 - RNA, 13 nt, Pseudomonas putida KT2440
gaaaccgccagcc

SEQ ID NO: 1636543 - RNA, 14 nt, Pseudomonas putida KT2440
gaaaccgccagcca

SEQ ID NO: 1636544 - RNA, 17 nt, Pseudomonas putida KT2440
gaaacccggcgcagcgg

SEQ ID NO: 1636545 - RNA, 20 nt, Pseudomonas putida KT2440
gaaacccucacgcgccaggu

SEQ ID NO: 1636546 - RNA, 23 nt, Pseudomonas putida KT2440
gaaaccuccggcaucauccugcu

SEQ ID NO: 1636547 - RNA, 21 nt, Pseudomonas putida KT2440
gaaaccuaaacugugggagca

SEQ ID NO: 1636548 - RNA, 13 nt, Pseudomonas putida KT2440
gaaaccacugcug

SEQ ID NO: 1636549 - RNA, 21 nt, Pseudomonas putida KT2440
gaaacacccugcaccacggca

SEQ ID NO: 1636550 - RNA, 10 nt, Pseudomonas putida KT2440
gaaacaccac

SEQ ID NO: 1636551 - RNA, 13 nt, Pseudomonas putida KT2440
gaaacacagcagg

SEQ ID NO: 1636552 - RNA, 14 nt, Pseudomonas putida KT2440
gaaacacagcaggc

SEQ ID NO: 1636553 - RNA, 18 nt, Pseudomonas putida KT2440
gaaacagauuccguacca

SEQ ID NO: 1636554 - RNA, 19 nt, Pseudomonas putida KT2440
gaaacagauagaucaugca

SEQ ID NO: 1636555 - RNA, 15 nt, Pseudomonas putida KT2440
gaaaagcgagguacg

SEQ ID NO: 1636556 - RNA, 15 nt, Pseudomonas putida KT2440
gaaaagccugcacca

SEQ ID NO: 1636557 - RNA, 17 nt, Pseudomonas putida KT2440
gaaaagccugccagguc

SEQ ID NO: 1636558 - RNA, 13 nt, Pseudomonas putida KT2440
gaaaaggcgcugu

SEQ ID NO: 1636559 - RNA, 17 nt, Pseudomonas putida KT2440
gaaaaggccaaccaccc

SEQ ID NO: 1636560 - RNA, 19 nt, Pseudomonas putida KT2440
gaaaauguuacccaagcac

SEQ ID NO: 1636561 - RNA, 18 nt, Pseudomonas putida KT2440
cuuucacuucauccagcc

SEQ ID NO: 1636562 - RNA, 20 nt, Pseudomonas putida KT2440
cuuuccagcuguacgcuggc

SEQ ID NO: 1636563 - RNA, 20 nt, Pseudomonas putida KT2440
cuuuaucuccaagccgcuuc

SEQ ID NO: 1636564 - RNA, 22 nt, Pseudomonas putida KT2440
aaagaagucgccacaccacagc

SEQ ID NO: 1636565 - RNA, 16 nt, Pseudomonas putida KT2440
cuuucggcagcacccg

SEQ ID NO: 1636566 - RNA, 21 nt, Pseudomonas putida KT2440
cuuucggcagcacccgcuugg

SEQ ID NO: 1636567 - RNA, 15 nt, Pseudomonas putida KT2440
cuuucggccacccgg

SEQ ID NO: 1636568 - RNA, 23 nt, Pseudomonas putida KT2440
cuuucuggaggaguccagcugca

SEQ ID NO: 1636569 - RNA, 17 nt, Pseudomonas putida KT2440
cuuugaaaguggccaag

SEQ ID NO: 1636570 - RNA, 21 nt, Pseudomonas putida KT2440
cuuugaaaguggccaagccac

SEQ ID NO: 1636571 - RNA, 23 nt, Pseudomonas putida KT2440
cuuugaacgagguuuugcagcgc

SEQ ID NO: 1636572 - RNA, 20 nt, Pseudomonas putida KT2440
cuuucgcgggcgcgcccgcu

SEQ ID NO: 1636573 - RNA, 20 nt, Pseudomonas putida KT2440
cuuucgcggguaaacccgcu

SEQ ID NO: 1636574 - RNA, 21 nt, Pseudomonas putida KT2440
cuuucgcggguaaacccgcuc

SEQ ID NO: 1636575 - RNA, 21 nt, Pseudomonas putida KT2440
cuuucgcgggugaacccgcuc

SEQ ID NO: 1636576 - RNA, 18 nt, Pseudomonas putida KT2440
cuuucgacaugcaguuga

SEQ ID NO: 1636577 - RNA, 16 nt, Pseudomonas putida KT2440
cuuuccagguccugcu

SEQ ID NO: 1636578 - RNA, 21 nt, Pseudomonas putida KT2440
cuuuccagguccugcuccacc

SEQ ID NO: 1636579 - RNA, 16 nt, Pseudomonas putida KT2440
cuuuccagguccuugc

SEQ ID NO: 1636580 - RNA, 21 nt, Pseudomonas putida KT2440
cuuuccugaaaccccgcccca

SEQ ID NO: 1636581 - RNA, 16 nt, Pseudomonas putida KT2440
cuuugaggggcuagcu

SEQ ID NO: 1636582 - RNA, 20 nt, Pseudomonas putida KT2440
cuuugggagcaguggugcuc

SEQ ID NO: 1636583 - RNA, 22 nt, Pseudomonas putida KT2440
cuuuggcuggacucgccgagaa

SEQ ID NO: 1636584 - RNA, 17 nt, Pseudomonas putida KT2440
cuuuggccgccagcggc

SEQ ID NO: 1636585 - RNA, 20 nt, Pseudomonas putida KT2440
cuuuggguuuggucuguaca

SEQ ID NO: 1636586 - RNA, 13 nt, Pseudomonas putida KT2440
cuuggccaucagc

SEQ ID NO: 1636587 - RNA, 18 nt, Pseudomonas putida KT2440
cuuggccauuuccggccc

SEQ ID NO: 1636588 - RNA, 23 nt, Pseudomonas putida KT2440
cuuggccagacucagcugcugcu

SEQ ID NO: 1636589 - RNA, 19 nt, Pseudomonas putida KT2440
cuuggcccaguucuccggc

SEQ ID NO: 1636590 - RNA, 13 nt, Pseudomonas putida KT2440
cuuggcccuuccu

SEQ ID NO: 1636591 - RNA, 15 nt, Pseudomonas putida KT2440
cuuggccaaugccag

SEQ ID NO: 1636592 - RNA, 17 nt, Pseudomonas putida KT2440
cuuggccaaugccagga

SEQ ID NO: 1636593 - RNA, 13 nt, Pseudomonas putida KT2440
cuuggcauuggcc

SEQ ID NO: 1636594 - RNA, 22 nt, Pseudomonas putida KT2440
cuuggcagcaccgcugccagcu

SEQ ID NO: 1636595 - RNA, 13 nt, Pseudomonas putida KT2440
cuuggcagccucg

SEQ ID NO: 1636596 - RNA, 15 nt, Pseudomonas putida KT2440
cuuggcauagcgcuc

SEQ ID NO: 1636597 - RNA, 23 nt, Pseudomonas putida KT2440
cuuggcauagcgcucgcgcaggg

SEQ ID NO: 1636598 - RNA, 22 nt, Pseudomonas putida KT2440
cuuggauggggcucagucccag

SEQ ID NO: 1636599 - RNA, 19 nt, Pseudomonas putida KT2440
cuuggcaccggcagcagca

SEQ ID NO: 1636600 - RNA, 16 nt, Pseudomonas putida KT2440
cuuggcaccuccggua

SEQ ID NO: 1636601 - RNA, 15 nt, Pseudomonas putida KT2440
cuuggcacgcuggcu

SEQ ID NO: 1636602 - RNA, 17 nt, Pseudomonas putida KT2440
cuuggacgcuggcagcu

SEQ ID NO: 1636603 - RNA, 16 nt, Pseudomonas putida KT2440
cuuggcguccacagcc

SEQ ID NO: 1636604 - RNA, 15 nt, Pseudomonas putida KT2440
cuuggcguccaggua

SEQ ID NO: 1636605 - RNA, 11 nt, Pseudomonas putida KT2440
cuuggcuucac

SEQ ID NO: 1636606 - RNA, 20 nt, Pseudomonas putida KT2440
cuuggcucgacgcgggccaa

SEQ ID NO: 1636607 - RNA, 13 nt, Pseudomonas putida KT2440
cuuggcgccgccc

SEQ ID NO: 1636608 - RNA, 20 nt, Pseudomonas putida KT2440
cuuggcgccgcccuggaugc

SEQ ID NO: 1636609 - RNA, 14 nt, Pseudomonas putida KT2440
cuuggcgcacuugu

SEQ ID NO: 1636610 - RNA, 23 nt, Pseudomonas putida KT2440
cuuggcgcacuuguuccagccgc

SEQ ID NO: 1636611 - RNA, 23 nt, Pseudomonas putida KT2440
cuuggcgaaugcgcucauccagc

SEQ ID NO: 1636612 - RNA, 16 nt, Pseudomonas putida KT2440
cuuggcggcugggugc

SEQ ID NO: 1636613 - RNA, 12 nt, Pseudomonas putida KT2440
cuuggcggcccu

SEQ ID NO: 1636614 - RNA, 17 nt, Pseudomonas putida KT2440
cuuguaagagcggccuu

SEQ ID NO: 1636615 - RNA, 12 nt, Pseudomonas putida KT2440
cuuguaguucau

SEQ ID NO: 1636616 - RNA, 19 nt, Pseudomonas putida KT2440
cuuguaguucaucuucuug

SEQ ID NO: 1636617 - RNA, 16 nt, Pseudomonas putida KT2440
cuugucaugccuuggc

SEQ ID NO: 1636618 - RNA, 14 nt, Pseudomonas putida KT2440
cuuguccagguuug

SEQ ID NO: 1636619 - RNA, 12 nt, Pseudomonas putida KT2440
cuugucccaggc

SEQ ID NO: 1636620 - RNA, 13 nt, Pseudomonas putida KT2440
cuugucccaggcc

SEQ ID NO: 1636621 - RNA, 14 nt, Pseudomonas putida KT2440
cuugucccaggcca

SEQ ID NO: 1636622 - RNA, 14 nt, Pseudomonas putida KT2440
cuuguauuggccaa

SEQ ID NO: 1636623 - RNA, 16 nt, Pseudomonas putida KT2440
cuuguaucccaggcgc

SEQ ID NO: 1636624 - RNA, 16 nt, Pseudomonas putida KT2440
cuugucagcagcuuca

SEQ ID NO: 1636625 - RNA, 14 nt, Pseudomonas putida KT2440
cuuggucugccggu

SEQ ID NO: 1636626 - RNA, 21 nt, Pseudomonas putida KT2440
cuuggugcgcgcauccagcag

SEQ ID NO: 1636627 - RNA, 16 nt, Pseudomonas putida KT2440
cuuggugcucaugauc

SEQ ID NO: 1636628 - RNA, 22 nt, Pseudomonas putida KT2440
cuugguuuggccucuggcuugg

SEQ ID NO: 1636629 - RNA, 18 nt, Pseudomonas putida KT2440
cuugguccagggccaugg

SEQ ID NO: 1636630 - RNA, 18 nt, Pseudomonas putida KT2440
cuuggucccccacuucug

SEQ ID NO: 1636631 - RNA, 16 nt, Pseudomonas putida KT2440
cuuggucagcaucacc

SEQ ID NO: 1636632 - RNA, 17 nt, Pseudomonas putida KT2440
cuuggucagcaucaccg

SEQ ID NO: 1636633 - RNA, 12 nt, Pseudomonas putida KT2440
cuuggguaacca

SEQ ID NO: 1636634 - RNA, 22 nt, Pseudomonas putida KT2440
cuuguucaucgcauucuucucc

SEQ ID NO: 1636635 - RNA, 17 nt, Pseudomonas putida KT2440
cuuguuccagccgcgcc

SEQ ID NO: 1636636 - RNA, 22 nt, Pseudomonas putida KT2440
cuuguuccagccgcgccacucc

SEQ ID NO: 1636637 - RNA, 16 nt, Pseudomonas putida KT2440
cuuguuccgcccagcu

SEQ ID NO: 1636638 - RNA, 15 nt, Pseudomonas putida KT2440
cuugugugccugcuc

SEQ ID NO: 1636639 - RNA, 23 nt, Pseudomonas putida KT2440
cuuguuacccgcauaaccaccac

SEQ ID NO: 1636640 - RNA, 20 nt, Pseudomonas putida KT2440
cuugugcacgaacagauggu

SEQ ID NO: 1636641 - RNA, 20 nt, Pseudomonas putida KT2440
cuugugcgccaccgacuccg

SEQ ID NO: 1636642 - RNA, 18 nt, Pseudomonas putida KT2440
cuugugcugcgaagaggc

SEQ ID NO: 1636643 - RNA, 19 nt, Pseudomonas putida KT2440
cuugucuuuacgcauugcc

SEQ ID NO: 1636644 - RNA, 20 nt, Pseudomonas putida KT2440
cuugugcauccugcacugca

SEQ ID NO: 1636645 - RNA, 15 nt, Pseudomonas putida KT2440
cuugucgacagugaa

SEQ ID NO: 1636646 - RNA, 21 nt, Pseudomonas putida KT2440
cuugucgaccugguccagcuu

SEQ ID NO: 1636647 - RNA, 13 nt, Pseudomonas putida KT2440
cuuguccuggauc

SEQ ID NO: 1636648 - RNA, 21 nt, Pseudomonas putida KT2440
cuuguccuggaucagccgcgc

SEQ ID NO: 1636649 - RNA, 20 nt, Pseudomonas putida KT2440
cuugucuccaugucgaauaa

SEQ ID NO: 1636650 - RNA, 16 nt, Pseudomonas putida KT2440
cuuguuggccaccauc

SEQ ID NO: 1636651 - RNA, 22 nt, Pseudomonas putida KT2440
aaagaacggugcugccgaggcg

SEQ ID NO: 1636652 - RNA, 14 nt, Pseudomonas putida KT2440
aaagaaccugggac

SEQ ID NO: 1636653 - RNA, 20 nt, Pseudomonas putida KT2440
cuuguucggguucagcuucu

SEQ ID NO: 1636654 - RNA, 13 nt, Pseudomonas putida KT2440
cuuguuggucagg

SEQ ID NO: 1636655 - RNA, 13 nt, Pseudomonas putida KT2440
cuucaaugcccag

SEQ ID NO: 1636656 - RNA, 12 nt, Pseudomonas putida KT2440
cuucaccaccag

SEQ ID NO: 1636657 - RNA, 14 nt, Pseudomonas putida KT2440
cuucacggcuuugu

SEQ ID NO: 1636658 - RNA, 23 nt, Pseudomonas putida KT2440
cuucacguccagccacuuguucg

SEQ ID NO: 1636659 - RNA, 24 nt, Pseudomonas putida KT2440
cuucacgucuggcaccaguuccag

SEQ ID NO: 1636660 - RNA, 18 nt, Pseudomonas putida KT2440
cuucacggauggcagcga

SEQ ID NO: 1636661 - RNA, 15 nt, Pseudomonas putida KT2440
cuucacggcaagccu

SEQ ID NO: 1636662 - RNA, 12 nt, Pseudomonas putida KT2440
cuucacggccaa

SEQ ID NO: 1636663 - RNA, 22 nt, Pseudomonas putida KT2440
cuucaagccauauucagcuuca

SEQ ID NO: 1636664 - RNA, 17 nt, Pseudomonas putida KT2440
cuucaaccucacuggca

SEQ ID NO: 1636665 - RNA, 14 nt, Pseudomonas putida KT2440
cuucaagcaccgcg

SEQ ID NO: 1636666 - RNA, 22 nt, Pseudomonas putida KT2440
cuucaagcaccgcgcacacuuc

SEQ ID NO: 1636667 - RNA, 14 nt, Pseudomonas putida KT2440
cuucaagcacgccg

SEQ ID NO: 1636668 - RNA, 13 nt, Pseudomonas putida KT2440
cuucaagcaggua

SEQ ID NO: 1636669 - RNA, 21 nt, Pseudomonas putida KT2440
cuucaaccgugguucuugccg

SEQ ID NO: 1636670 - RNA, 18 nt, Pseudomonas putida KT2440
cuucaaacacuucaucuc

SEQ ID NO: 1636671 - RNA, 14 nt, Pseudomonas putida KT2440
cuucagguaaucca

SEQ ID NO: 1636672 - RNA, 17 nt, Pseudomonas putida KT2440
cuucagguucacuucca

SEQ ID NO: 1636673 - RNA, 18 nt, Pseudomonas putida KT2440
cuucagguucacuuccac

SEQ ID NO: 1636674 - RNA, 20 nt, Pseudomonas putida KT2440
cuucagguucacuuccacac

SEQ ID NO: 1636675 - RNA, 17 nt, Pseudomonas putida KT2440
cuucaggcugcgccgcc

SEQ ID NO: 1636676 - RNA, 17 nt, Pseudomonas putida KT2440
cuucaggcgcucacccc

SEQ ID NO: 1636677 - RNA, 23 nt, Pseudomonas putida KT2440
cuucaggcaucacgucacagcca

SEQ ID NO: 1636678 - RNA, 20 nt, Pseudomonas putida KT2440
cuucaggccccagucauccg

SEQ ID NO: 1636679 - RNA, 21 nt, Pseudomonas putida KT2440
cuucagcuugagggucuugcc

SEQ ID NO: 1636680 - RNA, 22 nt, Pseudomonas putida KT2440
cuucagccaccgcacucugcug

SEQ ID NO: 1636681 - RNA, 13 nt, Pseudomonas putida KT2440
cuucagcaggaag

SEQ ID NO: 1636682 - RNA, 19 nt, Pseudomonas putida KT2440
cuucagaucacccuuggcc

SEQ ID NO: 1636683 - RNA, 21 nt, Pseudomonas putida KT2440
cuucagaucacccuuggccac

SEQ ID NO: 1636684 - RNA, 23 nt, Pseudomonas putida KT2440
cuucagaucacccuuggccaccu

SEQ ID NO: 1636685 - RNA, 16 nt, Pseudomonas putida KT2440
cuuccgggcacuggcu

SEQ ID NO: 1636686 - RNA, 16 nt, Pseudomonas putida KT2440
cuucgacauggcuggc

SEQ ID NO: 1636687 - RNA, 15 nt, Pseudomonas putida KT2440
cuuccuggcuggcag

SEQ ID NO: 1636688 - RNA, 14 nt, Pseudomonas putida KT2440
cuuccugugccgcu

SEQ ID NO: 1636689 - RNA, 15 nt, Pseudomonas putida KT2440
cuuccugcaccuugu

SEQ ID NO: 1636690 - RNA, 20 nt, Pseudomonas putida KT2440
cuuccuggccuuccuugccc

SEQ ID NO: 1636691 - RNA, 15 nt, Pseudomonas putida KT2440
cuucgccggcacgcc

SEQ ID NO: 1636692 - RNA, 20 nt, Pseudomonas putida KT2440
cuucgccggcaucgccucca

SEQ ID NO: 1636693 - RNA, 21 nt, Pseudomonas putida KT2440
cuucgaggauuuucaccuucg

SEQ ID NO: 1636694 - RNA, 22 nt, Pseudomonas putida KT2440
cuucgcgcuugagcaaggcauu

SEQ ID NO: 1636695 - RNA, 15 nt, Pseudomonas putida KT2440
cuucggcguugaucc

SEQ ID NO: 1636696 - RNA, 17 nt, Pseudomonas putida KT2440
cuucgcgggcacgcccg

SEQ ID NO: 1636697 - RNA, 18 nt, Pseudomonas putida KT2440
cuucgguggugaucauca

SEQ ID NO: 1636698 - RNA, 20 nt, Pseudomonas putida KT2440
cuucgguggugaucaucaga

SEQ ID NO: 1636699 - RNA, 17 nt, Pseudomonas putida KT2440
cuucgguagacuucugc

SEQ ID NO: 1636700 - RNA, 23 nt, Pseudomonas putida KT2440
cuuccaccgccucgaccuggccc

SEQ ID NO: 1636701 - RNA, 12 nt, Pseudomonas putida KT2440
cuuccacgccca

SEQ ID NO: 1636702 - RNA, 16 nt, Pseudomonas putida KT2440
cuuccacucuuccacc

SEQ ID NO: 1636703 - RNA, 20 nt, Pseudomonas putida KT2440
cuuccagcuccuucuucacc

SEQ ID NO: 1636704 - RNA, 15 nt, Pseudomonas putida KT2440
cuuccaacacccgga

SEQ ID NO: 1636705 - RNA, 24 nt, Pseudomonas putida KT2440
cuuccaaccagccagccaccacca

SEQ ID NO: 1636706 - RNA, 14 nt, Pseudomonas putida KT2440
cuuccggcugcagc

SEQ ID NO: 1636707 - RNA, 16 nt, Pseudomonas putida KT2440
cuuccgggaagaugca

SEQ ID NO: 1636708 - RNA, 22 nt, Pseudomonas putida KT2440
cuuccggcaacuugcgggucag

SEQ ID NO: 1636709 - RNA, 14 nt, Pseudomonas putida KT2440
cuuccggcaccccu

SEQ ID NO: 1636710 - RNA, 23 nt, Pseudomonas putida KT2440
cuuccggcaccccuuucuccagc

SEQ ID NO: 1636711 - RNA, 14 nt, Pseudomonas putida KT2440
cuucccggccuggc

SEQ ID NO: 1636712 - RNA, 14 nt, Pseudomonas putida KT2440
cuuccccgucuucc

SEQ ID NO: 1636713 - RNA, 13 nt, Pseudomonas putida KT2440
cuucccgccuggc

SEQ ID NO: 1636714 - RNA, 21 nt, Pseudomonas putida KT2440
cuuccaggucgaucgcaacgu

SEQ ID NO: 1636715 - RNA, 18 nt, Pseudomonas putida KT2440
cuuccagggcugguuccu

SEQ ID NO: 1636716 - RNA, 22 nt, Pseudomonas putida KT2440
cuuccagggcugguuccuggga

SEQ ID NO: 1636717 - RNA, 20 nt, Pseudomonas putida KT2440
cuuccagcugcgccugcaau

SEQ ID NO: 1636718 - RNA, 14 nt, Pseudomonas putida KT2440
cuuccagcuucugc

SEQ ID NO: 1636719 - RNA, 15 nt, Pseudomonas putida KT2440
cuuccagcuucugcu

SEQ ID NO: 1636720 - RNA, 14 nt, Pseudomonas putida KT2440
cuuccagucggccu

SEQ ID NO: 1636721 - RNA, 16 nt, Pseudomonas putida KT2440
cuuccagucggccuga

SEQ ID NO: 1636722 - RNA, 17 nt, Pseudomonas putida KT2440
cuuacgacgagggcagg

SEQ ID NO: 1636723 - RNA, 16 nt, Pseudomonas putida KT2440
cuuaccagcuuggcgc

SEQ ID NO: 1636724 - RNA, 19 nt, Pseudomonas putida KT2440
cuuaccaguaguucucgac

SEQ ID NO: 1636725 - RNA, 13 nt, Pseudomonas putida KT2440
cuguuucuucaag

SEQ ID NO: 1636726 - RNA, 15 nt, Pseudomonas putida KT2440
cuguuugagccggcg

SEQ ID NO: 1636727 - RNA, 23 nt, Pseudomonas putida KT2440
cuguuugagccggcgcugggcuu

SEQ ID NO: 1636728 - RNA, 20 nt, Pseudomonas putida KT2440
aaacugcuggaaaaagaaca

SEQ ID NO: 1636729 - RNA, 19 nt, Pseudomonas putida KT2440
aaacuggccagcagccccc

SEQ ID NO: 1636730 - RNA, 13 nt, Pseudomonas putida KT2440
cuuaaucccgcaa

SEQ ID NO: 1636731 - RNA, 12 nt, Pseudomonas putida KT2440
cuuaacgcuugg

SEQ ID NO: 1636732 - RNA, 13 nt, Pseudomonas putida KT2440
cuggccccaccca

SEQ ID NO: 1636733 - RNA, 16 nt, Pseudomonas putida KT2440
cuggccccacccaacu

SEQ ID NO: 1636734 - RNA, 12 nt, Pseudomonas putida KT2440
cuggcccgccgc

SEQ ID NO: 1636735 - RNA, 22 nt, Pseudomonas putida KT2440
cuggcccugcucacgcagcucg

SEQ ID NO: 1636736 - RNA, 13 nt, Pseudomonas putida KT2440
cuggcccuggcca

SEQ ID NO: 1636737 - RNA, 24 nt, Pseudomonas putida KT2440
cuggcccuuucgcgggagacccgu

SEQ ID NO: 1636738 - RNA, 13 nt, Pseudomonas putida KT2440
cuggcccugggag

SEQ ID NO: 1636739 - RNA, 13 nt, Pseudomonas putida KT2440
cuggcccugugcu

SEQ ID NO: 1636740 - RNA, 21 nt, Pseudomonas putida KT2440
cuggccgacaucaucaucuuc

SEQ ID NO: 1636741 - RNA, 20 nt, Pseudomonas putida KT2440
cuguuaccagagagcugaga

SEQ ID NO: 1636742 - RNA, 17 nt, Pseudomonas putida KT2440
cuguucccucaacaagc

SEQ ID NO: 1636743 - RNA, 19 nt, Pseudomonas putida KT2440
cuguuccauuucacuggcu

SEQ ID NO: 1636744 - RNA, 23 nt, Pseudomonas putida KT2440
cuguucccccaccggccgccgcc

SEQ ID NO: 1636745 - RNA, 17 nt, Pseudomonas putida KT2440
cuguuccggccucuucg

SEQ ID NO: 1636746 - RNA, 18 nt, Pseudomonas putida KT2440
cuguuccucgccauggcc

SEQ ID NO: 1636747 - RNA, 20 nt, Pseudomonas putida KT2440
cuguucgcugaugcgccgcu

SEQ ID NO: 1636748 - RNA, 17 nt, Pseudomonas putida KT2440
cuguucgucggccuugu

SEQ ID NO: 1636749 - RNA, 16 nt, Pseudomonas putida KT2440
cuguuucaugcugcga

SEQ ID NO: 1636750 - RNA, 22 nt, Pseudomonas putida KT2440
cuguuucggguaggucaccauc

SEQ ID NO: 1636751 - RNA, 15 nt, Pseudomonas putida KT2440
cuugcgggucagcag

SEQ ID NO: 1636752 - RNA, 17 nt, Pseudomonas putida KT2440
cuugcgguccugcacca

SEQ ID NO: 1636753 - RNA, 16 nt, Pseudomonas putida KT2440
cuugcgugccucagcc

SEQ ID NO: 1636754 - RNA, 22 nt, Pseudomonas putida KT2440
cuugcgugccucagccaggcug

SEQ ID NO: 1636755 - RNA, 17 nt, Pseudomonas putida KT2440
cuugcggaucacuucca

SEQ ID NO: 1636756 - RNA, 23 nt, Pseudomonas putida KT2440
cuugcggaccaccugggccagua

SEQ ID NO: 1636757 - RNA, 21 nt, Pseudomonas putida KT2440
cuugcggaacguuuccaggcu

SEQ ID NO: 1636758 - RNA, 15 nt, Pseudomonas putida KT2440
cuugcugcucugcaa

SEQ ID NO: 1636759 - RNA, 19 nt, Pseudomonas putida KT2440
cuugcugcucugcaaugcc

SEQ ID NO: 1636760 - RNA, 13 nt, Pseudomonas putida KT2440
cuugcuggccacc

SEQ ID NO: 1636761 - RNA, 17 nt, Pseudomonas putida KT2440
cuugcuggccgguggcu

SEQ ID NO: 1636762 - RNA, 18 nt, Pseudomonas putida KT2440
cuugcugcagcaggcugg

SEQ ID NO: 1636763 - RNA, 14 nt, Pseudomonas putida KT2440
cuugcugcagggca

SEQ ID NO: 1636764 - RNA, 17 nt, Pseudomonas putida KT2440
cuugcucgaaugccgcu

SEQ ID NO: 1636765 - RNA, 23 nt, Pseudomonas putida KT2440
cuugcucgaaugccgcugcuggc

SEQ ID NO: 1636766 - RNA, 16 nt, Pseudomonas putida KT2440
cuugcguuucuucauc

SEQ ID NO: 1636767 - RNA, 14 nt, Pseudomonas putida KT2440
cuugcucaggcuca

SEQ ID NO: 1636768 - RNA, 23 nt, Pseudomonas putida KT2440
cuugcugauggugucuuccaggu

SEQ ID NO: 1636769 - RNA, 14 nt, Pseudomonas putida KT2440
cuugcugaucaauc

SEQ ID NO: 1636770 - RNA, 21 nt, Pseudomonas putida KT2440
cuugcugaugauauuugccac

SEQ ID NO: 1636771 - RNA, 23 nt, Pseudomonas putida KT2440
cuugcugcaacagcuccagcaac

SEQ ID NO: 1636772 - RNA, 12 nt, Pseudomonas putida KT2440
cuugcccugcuu

SEQ ID NO: 1636773 - RNA, 24 nt, Pseudomonas putida KT2440
cuugcccagccaacccucgaccuc

SEQ ID NO: 1636774 - RNA, 14 nt, Pseudomonas putida KT2440
cuugcccagcucca

SEQ ID NO: 1636775 - RNA, 13 nt, Pseudomonas putida KT2440
cuugccccgcagg

SEQ ID NO: 1636776 - RNA, 17 nt, Pseudomonas putida KT2440
cuugcccgaagccacga

SEQ ID NO: 1636777 - RNA, 20 nt, Pseudomonas putida KT2440
cuugcccggggugcagaucc

SEQ ID NO: 1636778 - RNA, 20 nt, Pseudomonas putida KT2440
cuugcccucauucgcccgca

SEQ ID NO: 1636779 - RNA, 21 nt, Pseudomonas putida KT2440
cuugcccucauucgcccgcac

SEQ ID NO: 1636780 - RNA, 17 nt, Pseudomonas putida KT2440
cuugcccgcgaagaggc

SEQ ID NO: 1636781 - RNA, 21 nt, Pseudomonas putida KT2440
cuugcccgcgaagcagccacc

SEQ ID NO: 1636782 - RNA, 16 nt, Pseudomonas putida KT2440
cuugccgucgcuggag

SEQ ID NO: 1636783 - RNA, 17 nt, Pseudomonas putida KT2440
cuugccguaggugauca

SEQ ID NO: 1636784 - RNA, 18 nt, Pseudomonas putida KT2440
cuugccgugcucguccuu

SEQ ID NO: 1636785 - RNA, 15 nt, Pseudomonas putida KT2440
cuugccugucaguuc

SEQ ID NO: 1636786 - RNA, 12 nt, Pseudomonas putida KT2440
cuugccuuccac

SEQ ID NO: 1636787 - RNA, 16 nt, Pseudomonas putida KT2440
cuugccuguccccuug

SEQ ID NO: 1636788 - RNA, 14 nt, Pseudomonas putida KT2440
cuugccggccuuga

SEQ ID NO: 1636789 - RNA, 20 nt, Pseudomonas putida KT2440
cuugccgcucaccaccaucu

SEQ ID NO: 1636790 - RNA, 16 nt, Pseudomonas putida KT2440
cuugcaccgacaagcc

SEQ ID NO: 1636791 - RNA, 21 nt, Pseudomonas putida KT2440
cuugcacagguaucgccgccc

SEQ ID NO: 1636792 - RNA, 15 nt, Pseudomonas putida KT2440
cuugcagaaacgcca

SEQ ID NO: 1636793 - RNA, 13 nt, Pseudomonas putida KT2440
cuugcagccccug

SEQ ID NO: 1636794 - RNA, 22 nt, Pseudomonas putida KT2440
cuugcagcgccgcauccagcac

SEQ ID NO: 1636795 - RNA, 17 nt, Pseudomonas putida KT2440
cuugcagucaccuggcc

SEQ ID NO: 1636796 - RNA, 18 nt, Pseudomonas putida KT2440
cuugcagucaccuggccc

SEQ ID NO: 1636797 - RNA, 19 nt, Pseudomonas putida KT2440
cuugcagcucguugugcac

SEQ ID NO: 1636798 - RNA, 22 nt, Pseudomonas putida KT2440
cuugcagcucuugucgacagug

SEQ ID NO: 1636799 - RNA, 17 nt, Pseudomonas putida KT2440
cuugcaguuguccaggc

SEQ ID NO: 1636800 - RNA, 16 nt, Pseudomonas putida KT2440
cuugccaccagugccg

SEQ ID NO: 1636801 - RNA, 17 nt, Pseudomonas putida KT2440
cuugccaacggcacucg

SEQ ID NO: 1636802 - RNA, 21 nt, Pseudomonas putida KT2440
cuugccaaggcuagccacggc

SEQ ID NO: 1636803 - RNA, 16 nt, Pseudomonas putida KT2440
cuugccauucuugucc

SEQ ID NO: 1636804 - RNA, 11 nt, Pseudomonas putida KT2440
cuugcccacca

SEQ ID NO: 1636805 - RNA, 21 nt, Pseudomonas putida KT2440
cuugccauaacuccagcgcca

SEQ ID NO: 1636806 - RNA, 13 nt, Pseudomonas putida KT2440
cuugccagcaugg

SEQ ID NO: 1636807 - RNA, 22 nt, Pseudomonas putida KT2440
cuugccagcgucuuuggccugc

SEQ ID NO: 1636808 - RNA, 15 nt, Pseudomonas putida KT2440
cuugaugggccagaa

SEQ ID NO: 1636809 - RNA, 21 nt, Pseudomonas putida KT2440
cuugaugcgcgagcugggcac

SEQ ID NO: 1636810 - RNA, 21 nt, Pseudomonas putida KT2440
cuugaugcugucgucaagcuc

SEQ ID NO: 1636811 - RNA, 15 nt, Pseudomonas putida KT2440
cuugaugaucagguc

SEQ ID NO: 1636812 - RNA, 22 nt, Pseudomonas putida KT2440
cuugaugacuuuggcgucgguc

SEQ ID NO: 1636813 - RNA, 20 nt, Pseudomonas putida KT2440
cuugaucuguccuccugccg

SEQ ID NO: 1636814 - RNA, 18 nt, Pseudomonas putida KT2440
cuugaucugccaggcacc

SEQ ID NO: 1636815 - RNA, 15 nt, Pseudomonas putida KT2440
cuugaucugcgcgcu

SEQ ID NO: 1636816 - RNA, 15 nt, Pseudomonas putida KT2440
cuugaucaaugcccg

SEQ ID NO: 1636817 - RNA, 21 nt, Pseudomonas putida KT2440
cuugaccucgaccaggcgcuc

SEQ ID NO: 1636818 - RNA, 17 nt, Pseudomonas putida KT2440
cuugacgaucgccagcc

SEQ ID NO: 1636819 - RNA, 20 nt, Pseudomonas putida KT2440
cuugacgaucgccagcccca

SEQ ID NO: 1636820 - RNA, 21 nt, Pseudomonas putida KT2440
cuugacgggugaccaggccca

SEQ ID NO: 1636821 - RNA, 22 nt, Pseudomonas putida KT2440
cuugacguccagcucaacgcga

SEQ ID NO: 1636822 - RNA, 15 nt, Pseudomonas putida KT2440
cuugagcgccgcgcc

SEQ ID NO: 1636823 - RNA, 14 nt, Pseudomonas putida KT2440
cuugagaucagcaa

SEQ ID NO: 1636824 - RNA, 22 nt, Pseudomonas putida KT2440
cuugagaucagcaaccugcugg

SEQ ID NO: 1636825 - RNA, 17 nt, Pseudomonas putida KT2440
cuugacuauuucuagua

SEQ ID NO: 1636826 - RNA, 13 nt, Pseudomonas putida KT2440
cuugaggcuuuca

SEQ ID NO: 1636827 - RNA, 16 nt, Pseudomonas putida KT2440
cuugagggucuugccc

SEQ ID NO: 1636828 - RNA, 16 nt, Pseudomonas putida KT2440
cuugaggcacaaaaaa

SEQ ID NO: 1636829 - RNA, 13 nt, Pseudomonas putida KT2440
cuugaucagccug

SEQ ID NO: 1636830 - RNA, 18 nt, Pseudomonas putida KT2440
cuugauccgcgcuaccug

SEQ ID NO: 1636831 - RNA, 13 nt, Pseudomonas putida KT2440
cuugaagcuggcc

SEQ ID NO: 1636832 - RNA, 20 nt, Pseudomonas putida KT2440
cuugaagcgcggcaugcccg

SEQ ID NO: 1636833 - RNA, 23 nt, Pseudomonas putida KT2440
cuugaaguaguccccaucacgca

SEQ ID NO: 1636834 - RNA, 16 nt, Pseudomonas putida KT2440
cuugaacggccgucac

SEQ ID NO: 1636835 - RNA, 15 nt, Pseudomonas putida KT2440
cuugaacuugcucuu

SEQ ID NO: 1636836 - RNA, 17 nt, Pseudomonas putida KT2440
cuugaagaugaccuugu

SEQ ID NO: 1636837 - RNA, 16 nt, Pseudomonas putida KT2440
cuugaagaacaccugc

SEQ ID NO: 1636838 - RNA, 18 nt, Pseudomonas putida KT2440
cuugaagaagcucccggc

SEQ ID NO: 1636839 - RNA, 12 nt, Pseudomonas putida KT2440
cuugaccagcaa

SEQ ID NO: 1636840 - RNA, 16 nt, Pseudomonas putida KT2440
cuucuuuaagccccug

SEQ ID NO: 1636841 - RNA, 16 nt, Pseudomonas putida KT2440
cuucuuucagcucaau

SEQ ID NO: 1636842 - RNA, 12 nt, Pseudomonas putida KT2440
cuucuggugaaa

SEQ ID NO: 1636843 - RNA, 17 nt, Pseudomonas putida KT2440
cuucuucacguccagcc

SEQ ID NO: 1636844 - RNA, 15 nt, Pseudomonas putida KT2440
cuucuucggucagcu

SEQ ID NO: 1636845 - RNA, 14 nt, Pseudomonas putida KT2440
cuucuucgugcgcc

SEQ ID NO: 1636846 - RNA, 16 nt, Pseudomonas putida KT2440
cuucuugcaccgcucc

SEQ ID NO: 1636847 - RNA, 12 nt, Pseudomonas putida KT2440
cuucuugcaguu

SEQ ID NO: 1636848 - RNA, 13 nt, Pseudomonas putida KT2440
cuucuugcaguuc

SEQ ID NO: 1636849 - RNA, 14 nt, Pseudomonas putida KT2440
cuucuaccacuggg

SEQ ID NO: 1636850 - RNA, 22 nt, Pseudomonas putida KT2440
cuucuaccacuggggcuucugc

SEQ ID NO: 1636851 - RNA, 12 nt, Pseudomonas putida KT2440
cuucguccaggg

SEQ ID NO: 1636852 - RNA, 14 nt, Pseudomonas putida KT2440
cuucgucgcuggcc

SEQ ID NO: 1636853 - RNA, 15 nt, Pseudomonas putida KT2440
cuucgucgcuggcca

SEQ ID NO: 1636854 - RNA, 23 nt, Pseudomonas putida KT2440
cuucguagguaacaagcccuucg

SEQ ID NO: 1636855 - RNA, 14 nt, Pseudomonas putida KT2440
cuucgucaccgugc

SEQ ID NO: 1636856 - RNA, 18 nt, Pseudomonas putida KT2440
cuucucgccucagcgcca

SEQ ID NO: 1636857 - RNA, 19 nt, Pseudomonas putida KT2440
cuucucgccucagcgccaa

SEQ ID NO: 1636858 - RNA, 22 nt, Pseudomonas putida KT2440
cuucucgccucagcgccaauac

SEQ ID NO: 1636859 - RNA, 20 nt, Pseudomonas putida KT2440
cuucucggucgccaacccca

SEQ ID NO: 1636860 - RNA, 18 nt, Pseudomonas putida KT2440
cuucucgcgcuuggccag

SEQ ID NO: 1636861 - RNA, 16 nt, Pseudomonas putida KT2440
cuucucacugaugucg

SEQ ID NO: 1636862 - RNA, 17 nt, Pseudomonas putida KT2440
cuucugcugguccuugc

SEQ ID NO: 1636863 - RNA, 16 nt, Pseudomonas putida KT2440
cuucugcuucagcucg

SEQ ID NO: 1636864 - RNA, 14 nt, Pseudomonas putida KT2440
cuucugcuugcucu

SEQ ID NO: 1636865 - RNA, 22 nt, Pseudomonas putida KT2440
cuucugcuugcucugugcaugc

SEQ ID NO: 1636866 - RNA, 22 nt, Pseudomonas putida KT2440
cuucugccguuugcuggccugc

SEQ ID NO: 1636867 - RNA, 23 nt, Pseudomonas putida KT2440
cuucugcacgcccgaaacacccu

SEQ ID NO: 1636868 - RNA, 14 nt, Pseudomonas putida KT2440
cuucugcaacuccu

SEQ ID NO: 1636869 - RNA, 17 nt, Pseudomonas putida KT2440
cgggucaggccgaugcg

SEQ ID NO: 1636870 - RNA, 14 nt, Pseudomonas putida KT2440
cgggucauccccgg

SEQ ID NO: 1636871 - RNA, 14 nt, Pseudomonas putida KT2440
cggguccaccagcc

SEQ ID NO: 1636872 - RNA, 12 nt, Pseudomonas putida KT2440
cggguccaccca

SEQ ID NO: 1636873 - RNA, 17 nt, Pseudomonas putida KT2440
cggguccacccacccuc

SEQ ID NO: 1636874 - RNA, 15 nt, Pseudomonas putida KT2440
cgggucagcagcacc

SEQ ID NO: 1636875 - RNA, 16 nt, Pseudomonas putida KT2440
cgggucagcagcaccg

SEQ ID NO: 1636876 - RNA, 17 nt, Pseudomonas putida KT2440
cgggucagcagcaccgc

SEQ ID NO: 1636877 - RNA, 20 nt, Pseudomonas putida KT2440
cgggucgauagccagcccgg

SEQ ID NO: 1636878 - RNA, 17 nt, Pseudomonas putida KT2440
cgggucgacgcgcaagc

SEQ ID NO: 1636879 - RNA, 13 nt, Pseudomonas putida KT2440
cgggucgaaggca

SEQ ID NO: 1636880 - RNA, 15 nt, Pseudomonas putida KT2440
cgggucacgcuccuu

SEQ ID NO: 1636881 - RNA, 16 nt, Pseudomonas putida KT2440
cgggucacggcugaag

SEQ ID NO: 1636882 - RNA, 22 nt, Pseudomonas putida KT2440
cggguaguugcccggguacagc

SEQ ID NO: 1636883 - RNA, 14 nt, Pseudomonas putida KT2440
cggguacuccacca

SEQ ID NO: 1636884 - RNA, 22 nt, Pseudomonas putida KT2440
cggguaggucaccaucagccgc

SEQ ID NO: 1636885 - RNA, 17 nt, Pseudomonas putida KT2440
cgggugccgcagcaccg

SEQ ID NO: 1636886 - RNA, 16 nt, Pseudomonas putida KT2440
cgggugauuuccugca

SEQ ID NO: 1636887 - RNA, 22 nt, Pseudomonas putida KT2440
cgggugaacccgauuacaaggg

SEQ ID NO: 1636888 - RNA, 21 nt, Pseudomonas putida KT2440
cgggugaacccgcuccuacca

SEQ ID NO: 1636889 - RNA, 14 nt, Pseudomonas putida KT2440
cgggucuuccacca

SEQ ID NO: 1636890 - RNA, 16 nt, Pseudomonas putida KT2440
cgggucuuccaccacc

SEQ ID NO: 1636891 - RNA, 23 nt, Pseudomonas putida KT2440
cgggucugauugggcccgccauu

SEQ ID NO: 1636892 - RNA, 17 nt, Pseudomonas putida KT2440
cgggucgucgcccaggc

SEQ ID NO: 1636893 - RNA, 14 nt, Pseudomonas putida KT2440
cgggucuacccgcg

SEQ ID NO: 1636894 - RNA, 23 nt, Pseudomonas putida KT2440
cgggucuacccgcgaaagggcca

SEQ ID NO: 1636895 - RNA, 16 nt, Pseudomonas putida KT2440
cggguuugaagcccgg

SEQ ID NO: 1636896 - RNA, 23 nt, Pseudomonas putida KT2440
cggguuuacccgcgaaugggccg

SEQ ID NO: 1636897 - RNA, 17 nt, Pseudomonas putida KT2440
cggguugcccuguuucu

SEQ ID NO: 1636898 - RNA, 15 nt, Pseudomonas putida KT2440
cgguaaagcgcgccu

SEQ ID NO: 1636899 - RNA, 15 nt, Pseudomonas putida KT2440
cgguaaaacagccuu

SEQ ID NO: 1636900 - RNA, 21 nt, Pseudomonas putida KT2440
cggguuuuucaugaagcuuca

SEQ ID NO: 1636901 - RNA, 15 nt, Pseudomonas putida KT2440
cgguaaacaauuccc

SEQ ID NO: 1636902 - RNA, 14 nt, Pseudomonas putida KT2440
cggguucacccgcg

SEQ ID NO: 1636903 - RNA, 15 nt, Pseudomonas putida KT2440
cggguucacccgcga

SEQ ID NO: 1636904 - RNA, 14 nt, Pseudomonas putida KT2440
cggguguccacaaa

SEQ ID NO: 1636905 - RNA, 17 nt, Pseudomonas putida KT2440
cgggugguauccggggg

SEQ ID NO: 1636906 - RNA, 20 nt, Pseudomonas putida KT2440
cggguggaaauuggccagca

SEQ ID NO: 1636907 - RNA, 22 nt, Pseudomonas putida KT2440
cgggugcuggcucgcugcccca

SEQ ID NO: 1636908 - RNA, 20 nt, Pseudomonas putida KT2440
cggggaucuugcuggccggu

SEQ ID NO: 1636909 - RNA, 13 nt, Pseudomonas putida KT2440
cggggcaaccugg

SEQ ID NO: 1636910 - RNA, 17 nt, Pseudomonas putida KT2440
cggggcacaacccgggg

SEQ ID NO: 1636911 - RNA, 23 nt, Pseudomonas putida KT2440
cggggaggccgucaggccucccc

SEQ ID NO: 1636912 - RNA, 20 nt, Pseudomonas putida KT2440
cggggaauggcccagccagc

SEQ ID NO: 1636913 - RNA, 19 nt, Pseudomonas putida KT2440
cggggcagcaucaccacgc

SEQ ID NO: 1636914 - RNA, 22 nt, Pseudomonas putida KT2440
cggggcagcaucaccacgcccu

SEQ ID NO: 1636915 - RNA, 21 nt, Pseudomonas putida KT2440
cggggcaccuugaagugcgca

SEQ ID NO: 1636916 - RNA, 20 nt, Pseudomonas putida KT2440
cggggccgcaaggcggccca

SEQ ID NO: 1636917 - RNA, 14 nt, Pseudomonas putida KT2440
cgggcugucgagca

SEQ ID NO: 1636918 - RNA, 16 nt, Pseudomonas putida KT2440
cgggcuugcccaugaa

SEQ ID NO: 1636919 - RNA, 13 nt, Pseudomonas putida KT2440
cgggcuuggcacg

SEQ ID NO: 1636920 - RNA, 16 nt, Pseudomonas putida KT2440
cgggcuuuccacgccu

SEQ ID NO: 1636921 - RNA, 16 nt, Pseudomonas putida KT2440
cgggcuuucugguucu

SEQ ID NO: 1636922 - RNA, 20 nt, Pseudomonas putida KT2440
cgggcuuuggucgcggcgcu

SEQ ID NO: 1636923 - RNA, 22 nt, Pseudomonas putida KT2440
cgggcucgcccacacggcaagc

SEQ ID NO: 1636924 - RNA, 12 nt, Pseudomonas putida KT2440
cgggcugcugcc

SEQ ID NO: 1636925 - RNA, 17 nt, Pseudomonas putida KT2440
cgggcugcugccgcccc

SEQ ID NO: 1636926 - RNA, 16 nt, Pseudomonas putida KT2440
cgggcugcugcgcagc

SEQ ID NO: 1636927 - RNA, 20 nt, Pseudomonas putida KT2440
cgggcugcugcgcagcccug

SEQ ID NO: 1636928 - RNA, 23 nt, Pseudomonas putida KT2440
cggggcuccggcgaauccagcag

SEQ ID NO: 1636929 - RNA, 19 nt, Pseudomonas putida KT2440
cggggguggcgagcagguc

SEQ ID NO: 1636930 - RNA, 19 nt, Pseudomonas putida KT2440
cgggguaaaacgcauggcg

SEQ ID NO: 1636931 - RNA, 17 nt, Pseudomonas putida KT2440
cgggggcgcgucagccg

SEQ ID NO: 1636932 - RNA, 23 nt, Pseudomonas putida KT2440
cgggguuuuuuauugccugccag

SEQ ID NO: 1636933 - RNA, 23 nt, Pseudomonas putida KT2440
cgggguuuuuucuauugcucagu

SEQ ID NO: 1636934 - RNA, 22 nt, Pseudomonas putida KT2440
cggguaaacccgcuccuacaca

SEQ ID NO: 1636935 - RNA, 21 nt, Pseudomonas putida KT2440
cggguaaucgccaggcccagc

SEQ ID NO: 1636936 - RNA, 14 nt, Pseudomonas putida KT2440
cggguaagcccgcu

SEQ ID NO: 1636937 - RNA, 17 nt, Pseudomonas putida KT2440
cggguaagccggcggcc

SEQ ID NO: 1636938 - RNA, 17 nt, Pseudomonas putida KT2440
cgggguguggccaaugg

SEQ ID NO: 1636939 - RNA, 15 nt, Pseudomonas putida KT2440
cggggugcucugccg

SEQ ID NO: 1636940 - RNA, 18 nt, Pseudomonas putida KT2440
cgggguguccucgaucac

SEQ ID NO: 1636941 - RNA, 17 nt, Pseudomonas putida KT2440
cggggugauugcaguca

SEQ ID NO: 1636942 - RNA, 22 nt, Pseudomonas putida KT2440
cggucacugagccaggccgaca

SEQ ID NO: 1636943 - RNA, 17 nt, Pseudomonas putida KT2440
cggucacugcgcggccg

SEQ ID NO: 1636944 - RNA, 14 nt, Pseudomonas putida KT2440
cggucagcgcugcg

SEQ ID NO: 1636945 - RNA, 18 nt, Pseudomonas putida KT2440
cggucagcccggcuugca

SEQ ID NO: 1636946 - RNA, 22 nt, Pseudomonas putida KT2440
cggucagcaucuucuuccccgu

SEQ ID NO: 1636947 - RNA, 20 nt, Pseudomonas putida KT2440
cgguauucgagaaugugcuu

SEQ ID NO: 1636948 - RNA, 16 nt, Pseudomonas putida KT2440
cggucaauacccccga

SEQ ID NO: 1636949 - RNA, 21 nt, Pseudomonas putida KT2440
cgguauaggccgcaagcccgc

SEQ ID NO: 1636950 - RNA, 23 nt, Pseudomonas putida KT2440
cgguauagugguaugauuucagg

SEQ ID NO: 1636951 - RNA, 20 nt, Pseudomonas putida KT2440
cgguaccuggaauaccaccu

SEQ ID NO: 1636952 - RNA, 13 nt, Pseudomonas putida KT2440
cgguaccggcaau

SEQ ID NO: 1636953 - RNA, 19 nt, Pseudomonas putida KT2440
cgguagacuucugcgugcg

SEQ ID NO: 1636954 - RNA, 13 nt, Pseudomonas putida KT2440
cgguagccccagc

SEQ ID NO: 1636955 - RNA, 18 nt, Pseudomonas putida KT2440
cgguagugaugcaucagc

SEQ ID NO: 1636956 - RNA, 18 nt, Pseudomonas putida KT2440
cgguagugcggccggguc

SEQ ID NO: 1636957 - RNA, 20 nt, Pseudomonas putida KT2440
cgguagggaucaccgccagc

SEQ ID NO: 1636958 - RNA, 22 nt, Pseudomonas putida KT2440
cgguagggaucaccgccagcag

SEQ ID NO: 1636959 - RNA, 14 nt, Pseudomonas putida KT2440
cgguaccagcaggc

SEQ ID NO: 1636960 - RNA, 13 nt, Pseudomonas putida KT2440
cgguacagccagc

SEQ ID NO: 1636961 - RNA, 18 nt, Pseudomonas putida KT2440
cgguaacgggccagccgc

SEQ ID NO: 1636962 - RNA, 19 nt, Pseudomonas putida KT2440
cgguaaccggaauagaaca

SEQ ID NO: 1636963 - RNA, 18 nt, Pseudomonas putida KT2440
cgguaacguggacagcag

SEQ ID NO: 1636964 - RNA, 16 nt, Pseudomonas putida KT2440
cgguccauguaggagc

SEQ ID NO: 1636965 - RNA, 19 nt, Pseudomonas putida KT2440
cggucccaauaauaaaaaa

SEQ ID NO: 1636966 - RNA, 15 nt, Pseudomonas putida KT2440
cggucccgcccucca

SEQ ID NO: 1636967 - RNA, 17 nt, Pseudomonas putida KT2440
cggucccgcccuccagc

SEQ ID NO: 1636968 - RNA, 18 nt, Pseudomonas putida KT2440
cggucccgcccuccagcc

SEQ ID NO: 1636969 - RNA, 17 nt, Pseudomonas putida KT2440
cggucaugcagcgucgg

SEQ ID NO: 1636970 - RNA, 22 nt, Pseudomonas putida KT2440
cggucggcaguuugccgaugau

SEQ ID NO: 1636971 - RNA, 21 nt, Pseudomonas putida KT2440
cggucgccaaauucgaccagc

SEQ ID NO: 1636972 - RNA, 14 nt, Pseudomonas putida KT2440
cggucgccaacccc

SEQ ID NO: 1636973 - RNA, 19 nt, Pseudomonas putida KT2440
cggucgaugcaggagcggc

SEQ ID NO: 1636974 - RNA, 18 nt, Pseudomonas putida KT2440
cggucgagcugcccacca

SEQ ID NO: 1636975 - RNA, 15 nt, Pseudomonas putida KT2440
cggucgagcuuuucu

SEQ ID NO: 1636976 - RNA, 21 nt, Pseudomonas putida KT2440
cggugacgaccucggccaggu

SEQ ID NO: 1636977 - RNA, 11 nt, Pseudomonas putida KT2440
cggugagaugu

SEQ ID NO: 1636978 - RNA, 14 nt, Pseudomonas putida KT2440
cggugacacugcca

SEQ ID NO: 1636979 - RNA, 12 nt, Pseudomonas putida KT2440
cggugaccagcg

SEQ ID NO: 1636980 - RNA, 18 nt, Pseudomonas putida KT2440
cggugaccagcggcagca

SEQ ID NO: 1636981 - RNA, 20 nt, Pseudomonas putida KT2440
cggugaacagguugcgcgcc

SEQ ID NO: 1636982 - RNA, 19 nt, Pseudomonas putida KT2440
cggugaagaucgccgcgcu

SEQ ID NO: 1636983 - RNA, 14 nt, Pseudomonas putida KT2440
cggucuguucggca

SEQ ID NO: 1636984 - RNA, 17 nt, Pseudomonas putida KT2440
cggucucggugcuccuu

SEQ ID NO: 1636985 - RNA, 13 nt, Pseudomonas putida KT2440
cggucuccccuuc

SEQ ID NO: 1636986 - RNA, 14 nt, Pseudomonas putida KT2440
cggucugccggcac

SEQ ID NO: 1636987 - RNA, 19 nt, Pseudomonas putida KT2440
cggucggugaaaccacccc

SEQ ID NO: 1636988 - RNA, 23 nt, Pseudomonas putida KT2440
cggucggcguccacugcacccgu

SEQ ID NO: 1636989 - RNA, 19 nt, Pseudomonas putida KT2440
cggucguagucaucggccg

SEQ ID NO: 1636990 - RNA, 16 nt, Pseudomonas putida KT2440
cggucguuacccacca

SEQ ID NO: 1636991 - RNA, 21 nt, Pseudomonas putida KT2440
cggucguuacccaccagcucc

SEQ ID NO: 1636992 - RNA, 21 nt, Pseudomonas putida KT2440
cgggcagcgggcucgcccaca

SEQ ID NO: 1636993 - RNA, 14 nt, Pseudomonas putida KT2440
cgggcagugcaaua

SEQ ID NO: 1636994 - RNA, 23 nt, Pseudomonas putida KT2440
cgggcauacagggauagagccgc

SEQ ID NO: 1636995 - RNA, 22 nt, Pseudomonas putida KT2440
cgggcaugcccgcucccacagg

SEQ ID NO: 1636996 - RNA, 17 nt, Pseudomonas putida KT2440
cgggccaacuugcgcag

SEQ ID NO: 1636997 - RNA, 15 nt, Pseudomonas putida KT2440
cgggcacgcccgcuc

SEQ ID NO: 1636998 - RNA, 17 nt, Pseudomonas putida KT2440
cgggcacgcccgcuccc

SEQ ID NO: 1636999 - RNA, 21 nt, Pseudomonas putida KT2440
cgggcacucggguucgcagac

SEQ ID NO: 1637000 - RNA, 18 nt, Pseudomonas putida KT2440
cgggcacuggcugauagc

SEQ ID NO: 1637001 - RNA, 16 nt, Pseudomonas putida KT2440
cgggcacaccuggugc

SEQ ID NO: 1637002 - RNA, 17 nt, Pseudomonas putida KT2440
cgggcacaccuggugcg

SEQ ID NO: 1637003 - RNA, 16 nt, Pseudomonas putida KT2440
cgggcaauguccaggu

SEQ ID NO: 1637004 - RNA, 18 nt, Pseudomonas putida KT2440
cgggcacaggcccagcau

SEQ ID NO: 1637005 - RNA, 14 nt, Pseudomonas putida KT2440
cgggcacaucacca

SEQ ID NO: 1637006 - RNA, 18 nt, Pseudomonas putida KT2440
cgggcacaucaccagcag

SEQ ID NO: 1637007 - RNA, 21 nt, Pseudomonas putida KT2440
cgggauuguucccacagggag

SEQ ID NO: 1637008 - RNA, 16 nt, Pseudomonas putida KT2440
cgggauugccgucaaa

SEQ ID NO: 1637009 - RNA, 22 nt, Pseudomonas putida KT2440
cgggauucgacuaucaggggag

SEQ ID NO: 1637010 - RNA, 20 nt, Pseudomonas putida KT2440
cgggcaaacuggcgcccggc

SEQ ID NO: 1637011 - RNA, 12 nt, Pseudomonas putida KT2440
cgggcaaagcac

SEQ ID NO: 1637012 - RNA, 17 nt, Pseudomonas putida KT2440
cgggcaaggccagugcc

SEQ ID NO: 1637013 - RNA, 23 nt, Pseudomonas putida KT2440
cgggagagcagggcugcgcgccc

SEQ ID NO: 1637014 - RNA, 17 nt, Pseudomonas putida KT2440
cgggagcgggcgugccc

SEQ ID NO: 1637015 - RNA, 14 nt, Pseudomonas putida KT2440
cgggaaggucggcc

SEQ ID NO: 1637016 - RNA, 19 nt, Pseudomonas putida KT2440
cgggaaguccgccaggaag

SEQ ID NO: 1637017 - RNA, 22 nt, Pseudomonas putida KT2440
cgggaaguggugguagaagguc

SEQ ID NO: 1637018 - RNA, 19 nt, Pseudomonas putida KT2440
cgggauaccggugucuucc

SEQ ID NO: 1637019 - RNA, 17 nt, Pseudomonas putida KT2440
cgggaugcucugcagca

SEQ ID NO: 1637020 - RNA, 21 nt, Pseudomonas putida KT2440
cgggcgaagcccguggcccuc

SEQ ID NO: 1637021 - RNA, 13 nt, Pseudomonas putida KT2440
cgggcgcaggcag

SEQ ID NO: 1637022 - RNA, 18 nt, Pseudomonas putida KT2440
cgggcgaguggucggcgu

SEQ ID NO: 1637023 - RNA, 15 nt, Pseudomonas putida KT2440
cgggccuuugggcca

SEQ ID NO: 1637024 - RNA, 15 nt, Pseudomonas putida KT2440
cgggcgcgcccgcuc

SEQ ID NO: 1637025 - RNA, 22 nt, Pseudomonas putida KT2440
cgggcgcgcccgcucccacagg

SEQ ID NO: 1637026 - RNA, 18 nt, Pseudomonas putida KT2440
cgggcggagauuggccag

SEQ ID NO: 1637027 - RNA, 20 nt, Pseudomonas putida KT2440
cgggcggccaccggccacgc

SEQ ID NO: 1637028 - RNA, 23 nt, Pseudomonas putida KT2440
cgggcggcgguugucgucgaccg

SEQ ID NO: 1637029 - RNA, 24 nt, Pseudomonas putida KT2440
cgggcggcgcucgaucucacaggc

SEQ ID NO: 1637030 - RNA, 16 nt, Pseudomonas putida KT2440
cgggcguaccuggcug

SEQ ID NO: 1637031 - RNA, 18 nt, Pseudomonas putida KT2440
cgggcgguugggcaagug

SEQ ID NO: 1637032 - RNA, 18 nt, Pseudomonas putida KT2440
cgggcgguugucgaccug

SEQ ID NO: 1637033 - RNA, 18 nt, Pseudomonas putida KT2440
cgggcgucuuccaggugg

SEQ ID NO: 1637034 - RNA, 11 nt, Pseudomonas putida KT2440
cgggccugcug

SEQ ID NO: 1637035 - RNA, 18 nt, Pseudomonas putida KT2440
cgggccuggagcaaggcg

SEQ ID NO: 1637036 - RNA, 18 nt, Pseudomonas putida KT2440
cgggcccgcuugcgcggu

SEQ ID NO: 1637037 - RNA, 12 nt, Pseudomonas putida KT2440
cgggccaggugg

SEQ ID NO: 1637038 - RNA, 17 nt, Pseudomonas putida KT2440
cgggccagcgcgguagc

SEQ ID NO: 1637039 - RNA, 21 nt, Pseudomonas putida KT2440
cgggccaccaccgcguacagc

SEQ ID NO: 1637040 - RNA, 15 nt, Pseudomonas putida KT2440
cgggccaccaggccu

SEQ ID NO: 1637041 - RNA, 16 nt, Pseudomonas putida KT2440
cgggccaucggugccg

SEQ ID NO: 1637042 - RNA, 18 nt, Pseudomonas putida KT2440
cggcucaacagcaggugc

SEQ ID NO: 1637043 - RNA, 14 nt, Pseudomonas putida KT2440
cggcucacugacca

SEQ ID NO: 1637044 - RNA, 15 nt, Pseudomonas putida KT2440
cggcucacugcucau

SEQ ID NO: 1637045 - RNA, 14 nt, Pseudomonas putida KT2440
cggcucacccacca

SEQ ID NO: 1637046 - RNA, 15 nt, Pseudomonas putida KT2440
cggcucacccaccag

SEQ ID NO: 1637047 - RNA, 16 nt, Pseudomonas putida KT2440
cggcucacccaccagc

SEQ ID NO: 1637048 - RNA, 17 nt, Pseudomonas putida KT2440
cggcucacccaccagcc

SEQ ID NO: 1637049 - RNA, 22 nt, Pseudomonas putida KT2440
cggcucacccaccagccaaacc

SEQ ID NO: 1637050 - RNA, 19 nt, Pseudomonas putida KT2440
cggcucaccgcagcccagc

SEQ ID NO: 1637051 - RNA, 15 nt, Pseudomonas putida KT2440
cggcuccagcgcacg

SEQ ID NO: 1637052 - RNA, 15 nt, Pseudomonas putida KT2440
cggcucccccuccac

SEQ ID NO: 1637053 - RNA, 18 nt, Pseudomonas putida KT2440
cggcucccccuccacccg

SEQ ID NO: 1637054 - RNA, 12 nt, Pseudomonas putida KT2440
cggcuccgcgca

SEQ ID NO: 1637055 - RNA, 17 nt, Pseudomonas putida KT2440
cggcuaaagccgcaccu

SEQ ID NO: 1637056 - RNA, 21 nt, Pseudomonas putida KT2440
cggcuagccaucgcaccacgu

SEQ ID NO: 1637057 - RNA, 24 nt, Pseudomonas putida KT2440
cggcguguaguagcuccagcccag

SEQ ID NO: 1637058 - RNA, 16 nt, Pseudomonas putida KT2440
cggcguguccagcagg

SEQ ID NO: 1637059 - RNA, 16 nt, Pseudomonas putida KT2440
cggcgugguccagcgu

SEQ ID NO: 1637060 - RNA, 17 nt, Pseudomonas putida KT2440
cggcguccacugcaccc

SEQ ID NO: 1637061 - RNA, 19 nt, Pseudomonas putida KT2440
cggcguccacugcacccgu

SEQ ID NO: 1637062 - RNA, 20 nt, Pseudomonas putida KT2440
cggcgucccggccagcgacc

SEQ ID NO: 1637063 - RNA, 20 nt, Pseudomonas putida KT2440
cggcgucgaacaacggcagc

SEQ ID NO: 1637064 - RNA, 21 nt, Pseudomonas putida KT2440
cggcgucgaacaacggcagcg

SEQ ID NO: 1637065 - RNA, 16 nt, Pseudomonas putida KT2440
cggcguagaccagugc

SEQ ID NO: 1637066 - RNA, 16 nt, Pseudomonas putida KT2440
cggcgucaccuuccug

SEQ ID NO: 1637067 - RNA, 16 nt, Pseudomonas putida KT2440
cggcuuugcgucauca

SEQ ID NO: 1637068 - RNA, 17 nt, Pseudomonas putida KT2440
cggcuuucucaagccug

SEQ ID NO: 1637069 - RNA, 14 nt, Pseudomonas putida KT2440
cggcuuggcugccg

SEQ ID NO: 1637070 - RNA, 18 nt, Pseudomonas putida KT2440
cggcuuggcugccggccu

SEQ ID NO: 1637071 - RNA, 16 nt, Pseudomonas putida KT2440
cgggaacagcagcacc

SEQ ID NO: 1637072 - RNA, 13 nt, Pseudomonas putida KT2440
cgggaacacccag

SEQ ID NO: 1637073 - RNA, 23 nt, Pseudomonas putida KT2440
cgggaagcgcccgcccaccacca

SEQ ID NO: 1637074 - RNA, 17 nt, Pseudomonas putida KT2440
cggcuugcucgcggcgc

SEQ ID NO: 1637075 - RNA, 18 nt, Pseudomonas putida KT2440
cggcuugcucgcggcgca

SEQ ID NO: 1637076 - RNA, 13 nt, Pseudomonas putida KT2440
cggcuugcccggg

SEQ ID NO: 1637077 - RNA, 20 nt, Pseudomonas putida KT2440
cggcuucagguucacuucca

SEQ ID NO: 1637078 - RNA, 14 nt, Pseudomonas putida KT2440
cggcuucaagagga

SEQ ID NO: 1637079 - RNA, 22 nt, Pseudomonas putida KT2440
cggcuucacauccaccgcucgc

SEQ ID NO: 1637080 - RNA, 17 nt, Pseudomonas putida KT2440
cggcucgucaaccacag

SEQ ID NO: 1637081 - RNA, 14 nt, Pseudomonas putida KT2440
cggcucggccacca

SEQ ID NO: 1637082 - RNA, 19 nt, Pseudomonas putida KT2440
cggcucggccaccacccgc

SEQ ID NO: 1637083 - RNA, 17 nt, Pseudomonas putida KT2440
cggcucugacauaacaa

SEQ ID NO: 1637084 - RNA, 20 nt, Pseudomonas putida KT2440
cggcucugacauaacaagaa

SEQ ID NO: 1637085 - RNA, 22 nt, Pseudomonas putida KT2440
cggcucuguuucugccccuggc

SEQ ID NO: 1637086 - RNA, 15 nt, Pseudomonas putida KT2440
cggcucuucgccuuc

SEQ ID NO: 1637087 - RNA, 18 nt, Pseudomonas putida KT2440
cggcugaaauggcggccc

SEQ ID NO: 1637088 - RNA, 23 nt, Pseudomonas putida KT2440
cggcugaacacgcucaugaacag

SEQ ID NO: 1637089 - RNA, 16 nt, Pseudomonas putida KT2440
cggcugagccggcugg

SEQ ID NO: 1637090 - RNA, 21 nt, Pseudomonas putida KT2440
cggcugaucucuucagccacc

SEQ ID NO: 1637091 - RNA, 19 nt, Pseudomonas putida KT2440
cggcugcaguagucgccag

SEQ ID NO: 1637092 - RNA, 15 nt, Pseudomonas putida KT2440
cggcuggugucggcc

SEQ ID NO: 1637093 - RNA, 15 nt, Pseudomonas putida KT2440
cggcuggcgcaugca

SEQ ID NO: 1637094 - RNA, 12 nt, Pseudomonas putida KT2440
cggcuggcacuc

SEQ ID NO: 1637095 - RNA, 20 nt, Pseudomonas putida KT2440
cggcuggcagcgggcugccc

SEQ ID NO: 1637096 - RNA, 17 nt, Pseudomonas putida KT2440
cggcugcauccacccac

SEQ ID NO: 1637097 - RNA, 14 nt, Pseudomonas putida KT2440
cggcugccgucccc

SEQ ID NO: 1637098 - RNA, 21 nt, Pseudomonas putida KT2440
cuaaagugccuugaucaaugc

SEQ ID NO: 1637099 - RNA, 19 nt, Pseudomonas putida KT2440
cguuugcaacuggcgcagg

SEQ ID NO: 1637100 - RNA, 15 nt, Pseudomonas putida KT2440
cguuucaguacagcc

SEQ ID NO: 1637101 - RNA, 20 nt, Pseudomonas putida KT2440
cguuggcgaagucggccugg

SEQ ID NO: 1637102 - RNA, 23 nt, Pseudomonas putida KT2440
cguuggcccgccaguaggcugca

SEQ ID NO: 1637103 - RNA, 14 nt, Pseudomonas putida KT2440
cguuggccgccagc

SEQ ID NO: 1637104 - RNA, 18 nt, Pseudomonas putida KT2440
cguuggccgccagcggca

SEQ ID NO: 1637105 - RNA, 14 nt, Pseudomonas putida KT2440
cguuuaccugcagc

SEQ ID NO: 1637106 - RNA, 12 nt, Pseudomonas putida KT2440
cguuggccagcu

SEQ ID NO: 1637107 - RNA, 21 nt, Pseudomonas putida KT2440
cguuggccagcuuggcuuucg

SEQ ID NO: 1637108 - RNA, 13 nt, Pseudomonas putida KT2440
cguuggccgccag

SEQ ID NO: 1637109 - RNA, 15 nt, Pseudomonas putida KT2440
cguuggcagcaccac

SEQ ID NO: 1637110 - RNA, 23 nt, Pseudomonas putida KT2440
cguugcggucgguggucagcucg

SEQ ID NO: 1637111 - RNA, 17 nt, Pseudomonas putida KT2440
cguugcgggucagcucg

SEQ ID NO: 1637112 - RNA, 21 nt, Pseudomonas putida KT2440
cguugcuucuguaccgccguc

SEQ ID NO: 1637113 - RNA, 18 nt, Pseudomonas putida KT2440
cguugcuacugcuuuauc

SEQ ID NO: 1637114 - RNA, 20 nt, Pseudomonas putida KT2440
cguugcuccagcucacagca

SEQ ID NO: 1637115 - RNA, 22 nt, Pseudomonas putida KT2440
cguugcgccgcucgcccagcag

SEQ ID NO: 1637116 - RNA, 24 nt, Pseudomonas putida KT2440
cguugcgcucgagcccgccagcag

SEQ ID NO: 1637117 - RNA, 20 nt, Pseudomonas putida KT2440
cguugcgcugguucauugcc

SEQ ID NO: 1637118 - RNA, 15 nt, Pseudomonas putida KT2440
cguugcgcagcagca

SEQ ID NO: 1637119 - RNA, 16 nt, Pseudomonas putida KT2440
cguugcgcagcagcag

SEQ ID NO: 1637120 - RNA, 13 nt, Pseudomonas putida KT2440
cguucccaauguc

SEQ ID NO: 1637121 - RNA, 15 nt, Pseudomonas putida KT2440
cguuccagccaggcg

SEQ ID NO: 1637122 - RNA, 15 nt, Pseudomonas putida KT2440
cguugaccccgccgc

SEQ ID NO: 1637123 - RNA, 15 nt, Pseudomonas putida KT2440
cguucuugaagauga

SEQ ID NO: 1637124 - RNA, 22 nt, Pseudomonas putida KT2440
cguucggaucgucuggcacuga

SEQ ID NO: 1637125 - RNA, 18 nt, Pseudomonas putida KT2440
cguguuccccgaccaaau

SEQ ID NO: 1637126 - RNA, 23 nt, Pseudomonas putida KT2440
cguguucgacgaucgacuucauc

SEQ ID NO: 1637127 - RNA, 23 nt, Pseudomonas putida KT2440
cguguuguucgccaacuucgccg

SEQ ID NO: 1637128 - RNA, 21 nt, Pseudomonas putida KT2440
cguggucgccgucgcacaggc

SEQ ID NO: 1637129 - RNA, 22 nt, Pseudomonas putida KT2440
cguggugaauggcgagcccggc

SEQ ID NO: 1637130 - RNA, 16 nt, Pseudomonas putida KT2440
cguggugauguucuca

SEQ ID NO: 1637131 - RNA, 13 nt, Pseudomonas putida KT2440
cguggugcagacg

SEQ ID NO: 1637132 - RNA, 19 nt, Pseudomonas putida KT2440
cguggugcgauucgcgcau

SEQ ID NO: 1637133 - RNA, 15 nt, Pseudomonas putida KT2440
cguggugcgggccac

SEQ ID NO: 1637134 - RNA, 13 nt, Pseudomonas putida KT2440
cguguccagcagg

SEQ ID NO: 1637135 - RNA, 15 nt, Pseudomonas putida KT2440
cgugguugcugaugu

SEQ ID NO: 1637136 - RNA, 19 nt, Pseudomonas putida KT2440
cgugguucuugccgagcag

SEQ ID NO: 1637137 - RNA, 18 nt, Pseudomonas putida KT2440
cguggccuguaccgaccu

SEQ ID NO: 1637138 - RNA, 13 nt, Pseudomonas putida KT2440
cguggccuucucu

SEQ ID NO: 1637139 - RNA, 20 nt, Pseudomonas putida KT2440
cguggccccgggccauggca

SEQ ID NO: 1637140 - RNA, 16 nt, Pseudomonas putida KT2440
cguggccgccaacagc

SEQ ID NO: 1637141 - RNA, 13 nt, Pseudomonas putida KT2440
cguggccagccca

SEQ ID NO: 1637142 - RNA, 16 nt, Pseudomonas putida KT2440
cguggccagcccaagg

SEQ ID NO: 1637143 - RNA, 14 nt, Pseudomonas putida KT2440
cguggaccagagcg

SEQ ID NO: 1637144 - RNA, 12 nt, Pseudomonas putida KT2440
cguggacagcag

SEQ ID NO: 1637145 - RNA, 16 nt, Pseudomonas putida KT2440
cguggaacaacggcuc

SEQ ID NO: 1637146 - RNA, 21 nt, Pseudomonas putida KT2440
cguggggccugccgguacagc

SEQ ID NO: 1637147 - RNA, 22 nt, Pseudomonas putida KT2440
cguggggccugccgguacagcc

SEQ ID NO: 1637148 - RNA, 21 nt, Pseudomonas putida KT2440
cgugggucgggaacagcucug

SEQ ID NO: 1637149 - RNA, 18 nt, Pseudomonas putida KT2440
cguggcugcguucaggca

SEQ ID NO: 1637150 - RNA, 16 nt, Pseudomonas putida KT2440
cguggcuguugcgguu

SEQ ID NO: 1637151 - RNA, 16 nt, Pseudomonas putida KT2440
cguggcgcuggcgggc

SEQ ID NO: 1637152 - RNA, 22 nt, Pseudomonas putida KT2440
cgugaguggccucgaacauggc

SEQ ID NO: 1637153 - RNA, 13 nt, Pseudomonas putida KT2440
cgugcaccagcac

SEQ ID NO: 1637154 - RNA, 14 nt, Pseudomonas putida KT2440
cgugcacccaaccu

SEQ ID NO: 1637155 - RNA, 20 nt, Pseudomonas putida KT2440
cgugcacccaaccugccgau

SEQ ID NO: 1637156 - RNA, 20 nt, Pseudomonas putida KT2440
cgugcacgcuugagcgcgcc

SEQ ID NO: 1637157 - RNA, 19 nt, Pseudomonas putida KT2440
cgugcauguccugaagcag

SEQ ID NO: 1637158 - RNA, 21 nt, Pseudomonas putida KT2440
cgugcgcuacaagccggcgcu

SEQ ID NO: 1637159 - RNA, 20 nt, Pseudomonas putida KT2440
cgugcggccaaagcuguuga

SEQ ID NO: 1637160 - RNA, 20 nt, Pseudomonas putida KT2440
cgucgcgaaagggccgcaag

SEQ ID NO: 1637161 - RNA, 15 nt, Pseudomonas putida KT2440
cgucgccugcaaccc

SEQ ID NO: 1637162 - RNA, 13 nt, Pseudomonas putida KT2440
cgucgccugggca

SEQ ID NO: 1637163 - RNA, 15 nt, Pseudomonas putida KT2440
cgucgcgcgcccagg

SEQ ID NO: 1637164 - RNA, 21 nt, Pseudomonas putida KT2440
cgucucugaccggcacugcac

SEQ ID NO: 1637165 - RNA, 21 nt, Pseudomonas putida KT2440
cgucgcgauugaucagcgccu

SEQ ID NO: 1637166 - RNA, 19 nt, Pseudomonas putida KT2440
cgucugacuggcagcaagg

SEQ ID NO: 1637167 - RNA, 20 nt, Pseudomonas putida KT2440
cgucugcaucauucgcgcca

SEQ ID NO: 1637168 - RNA, 13 nt, Pseudomonas putida KT2440
cgugacggccagc

SEQ ID NO: 1637169 - RNA, 17 nt, Pseudomonas putida KT2440
cgugacgugcgcuccug

SEQ ID NO: 1637170 - RNA, 19 nt, Pseudomonas putida KT2440
cgugaaauccucaaccugg

SEQ ID NO: 1637171 - RNA, 12 nt, Pseudomonas putida KT2440
cgucuuccaggu

SEQ ID NO: 1637172 - RNA, 18 nt, Pseudomonas putida KT2440
cgucuuccaugccuucuu

SEQ ID NO: 1637173 - RNA, 21 nt, Pseudomonas putida KT2440
cgguugcagcacacuccacga

SEQ ID NO: 1637174 - RNA, 19 nt, Pseudomonas putida KT2440
cgguucuucgccugcagca

SEQ ID NO: 1637175 - RNA, 15 nt, Pseudomonas putida KT2440
cgguugacagcacgg

SEQ ID NO: 1637176 - RNA, 21 nt, Pseudomonas putida KT2440
cgguugaccgccgccaccauc

SEQ ID NO: 1637177 - RNA, 15 nt, Pseudomonas putida KT2440
cgguucaccagcagc

SEQ ID NO: 1637178 - RNA, 15 nt, Pseudomonas putida KT2440
cgguugcgcagccgg

SEQ ID NO: 1637179 - RNA, 17 nt, Pseudomonas putida KT2440
cgguugcgcagccggcc

SEQ ID NO: 1637180 - RNA, 14 nt, Pseudomonas putida KT2440
cgguugcgcccggc

SEQ ID NO: 1637181 - RNA, 16 nt, Pseudomonas putida KT2440
cgguugucgaccuggc

SEQ ID NO: 1637182 - RNA, 19 nt, Pseudomonas putida KT2440
cgguugucgaccuggcucu

SEQ ID NO: 1637183 - RNA, 16 nt, Pseudomonas putida KT2440
cgguuggugcgccucc

SEQ ID NO: 1637184 - RNA, 22 nt, Pseudomonas putida KT2440
cgguuggugcgccuccagcagc

SEQ ID NO: 1637185 - RNA, 23 nt, Pseudomonas putida KT2440
cgguuggugcgccuccagcagcg

SEQ ID NO: 1637186 - RNA, 17 nt, Pseudomonas putida KT2440
cgguuuccucgacgcca

SEQ ID NO: 1637187 - RNA, 15 nt, Pseudomonas putida KT2440
cgguuugaagccaua

SEQ ID NO: 1637188 - RNA, 16 nt, Pseudomonas putida KT2440
cgguuucucgcagcag

SEQ ID NO: 1637189 - RNA, 17 nt, Pseudomonas putida KT2440
cgguuucucgcagcagc

SEQ ID NO: 1637190 - RNA, 22 nt, Pseudomonas putida KT2440
cgguuucacccuugggcucagc

SEQ ID NO: 1637191 - RNA, 13 nt, Pseudomonas putida KT2440
cguaaccgcccgc

SEQ ID NO: 1637192 - RNA, 12 nt, Pseudomonas putida KT2440
cguaacggucac

SEQ ID NO: 1637193 - RNA, 19 nt, Pseudomonas putida KT2440
cguaacggucacugagcca

SEQ ID NO: 1637194 - RNA, 15 nt, Pseudomonas putida KT2440
cguaacgagccuugg

SEQ ID NO: 1637195 - RNA, 21 nt, Pseudomonas putida KT2440
cggugauaugcguacccggcu

SEQ ID NO: 1637196 - RNA, 12 nt, Pseudomonas putida KT2440
cggugaugcgcu

SEQ ID NO: 1637197 - RNA, 16 nt, Pseudomonas putida KT2440
cggugcacggccguug

SEQ ID NO: 1637198 - RNA, 20 nt, Pseudomonas putida KT2440
cggugcacggccugcaucca

SEQ ID NO: 1637199 - RNA, 15 nt, Pseudomonas putida KT2440
cggugccagucauuc

SEQ ID NO: 1637200 - RNA, 14 nt, Pseudomonas putida KT2440
cggugcccacugca

SEQ ID NO: 1637201 - RNA, 18 nt, Pseudomonas putida KT2440
cggugcccacugcagcca

SEQ ID NO: 1637202 - RNA, 18 nt, Pseudomonas putida KT2440
cggugcagauugcccugu

SEQ ID NO: 1637203 - RNA, 15 nt, Pseudomonas putida KT2440
cggugcagcaccucc

SEQ ID NO: 1637204 - RNA, 19 nt, Pseudomonas putida KT2440
cggugcagcaccuccaccu

SEQ ID NO: 1637205 - RNA, 15 nt, Pseudomonas putida KT2440
cggugcucaggcuca

SEQ ID NO: 1637206 - RNA, 17 nt, Pseudomonas putida KT2440
cggugcucaggcucagc

SEQ ID NO: 1637207 - RNA, 15 nt, Pseudomonas putida KT2440
cggugcugcugccau

SEQ ID NO: 1637208 - RNA, 15 nt, Pseudomonas putida KT2440
cgguggugaaauggu

SEQ ID NO: 1637209 - RNA, 13 nt, Pseudomonas putida KT2440
cgguguccuugca

SEQ ID NO: 1637210 - RNA, 17 nt, Pseudomonas putida KT2440
cggugugcauccagccc

SEQ ID NO: 1637211 - RNA, 17 nt, Pseudomonas putida KT2440
cggugucgucgcuguca

SEQ ID NO: 1637212 - RNA, 22 nt, Pseudomonas putida KT2440
cggugugcuccagcuccaggcg

SEQ ID NO: 1637213 - RNA, 19 nt, Pseudomonas putida KT2440
cgguggcaauggccugcau

SEQ ID NO: 1637214 - RNA, 15 nt, Pseudomonas putida KT2440
cgguggcaucaccgg

SEQ ID NO: 1637215 - RNA, 15 nt, Pseudomonas putida KT2440
cgguggcggcagcaa

SEQ ID NO: 1637216 - RNA, 17 nt, Pseudomonas putida KT2440
cgguggcucacaucauc

SEQ ID NO: 1637217 - RNA, 18 nt, Pseudomonas putida KT2440
cgguggcucuccucuccc

SEQ ID NO: 1637218 - RNA, 17 nt, Pseudomonas putida KT2440
cgucagcauccaacccu

SEQ ID NO: 1637219 - RNA, 15 nt, Pseudomonas putida KT2440
cgucacggcgcgggu

SEQ ID NO: 1637220 - RNA, 19 nt, Pseudomonas putida KT2440
cgucacguuuuuugggagc

SEQ ID NO: 1637221 - RNA, 16 nt, Pseudomonas putida KT2440
cgucagcagcaggcgc

SEQ ID NO: 1637222 - RNA, 17 nt, Pseudomonas putida KT2440
cgucaguucggcggccc

SEQ ID NO: 1637223 - RNA, 12 nt, Pseudomonas putida KT2440
cgucagccccua

SEQ ID NO: 1637224 - RNA, 21 nt, Pseudomonas putida KT2440
cgucagcggcaacaccagcag

SEQ ID NO: 1637225 - RNA, 17 nt, Pseudomonas putida KT2440
cgucaagcucgacccgc

SEQ ID NO: 1637226 - RNA, 15 nt, Pseudomonas putida KT2440
cgucaacgaggccgc

SEQ ID NO: 1637227 - RNA, 18 nt, Pseudomonas putida KT2440
cgucaacgaggccgccau

SEQ ID NO: 1637228 - RNA, 18 nt, Pseudomonas putida KT2440
cgucaaccgaacccgcug

SEQ ID NO: 1637229 - RNA, 13 nt, Pseudomonas putida KT2440
cgucaaccgugcc

SEQ ID NO: 1637230 - RNA, 14 nt, Pseudomonas putida KT2440
cgucaaccgugccc

SEQ ID NO: 1637231 - RNA, 18 nt, Pseudomonas putida KT2440
cgucaaccgugcccgccc

SEQ ID NO: 1637232 - RNA, 20 nt, Pseudomonas putida KT2440
cgucacccgcgccaccagcc

SEQ ID NO: 1637233 - RNA, 23 nt, Pseudomonas putida KT2440
cgucaccccucggcucacgcccc

SEQ ID NO: 1637234 - RNA, 16 nt, Pseudomonas putida KT2440
cgucaccauugaugaa

SEQ ID NO: 1637235 - RNA, 14 nt, Pseudomonas putida KT2440
cgucacccacuuca

SEQ ID NO: 1637236 - RNA, 14 nt, Pseudomonas putida KT2440
cgucacccaggugc

SEQ ID NO: 1637237 - RNA, 18 nt, Pseudomonas putida KT2440
cgucacaugcgccacacc

SEQ ID NO: 1637238 - RNA, 16 nt, Pseudomonas putida KT2440
cgucacagccaagccu

SEQ ID NO: 1637239 - RNA, 20 nt, Pseudomonas putida KT2440
cgucaauaccggugccccgg

SEQ ID NO: 1637240 - RNA, 19 nt, Pseudomonas putida KT2440
cguaauccucguccagcuc

SEQ ID NO: 1637241 - RNA, 23 nt, Pseudomonas putida KT2440
cguagccguuugaagccaacccc

SEQ ID NO: 1637242 - RNA, 16 nt, Pseudomonas putida KT2440
cguaaggccugaggcc

SEQ ID NO: 1637243 - RNA, 17 nt, Pseudomonas putida KT2440
cgucaaacagccgccca

SEQ ID NO: 1637244 - RNA, 24 nt, Pseudomonas putida KT2440
cgucaaacagccgcccaguuccag

SEQ ID NO: 1637245 - RNA, 17 nt, Pseudomonas putida KT2440
cguagucgucagggucu

SEQ ID NO: 1637246 - RNA, 14 nt, Pseudomonas putida KT2440
cgucccaguuauca

SEQ ID NO: 1637247 - RNA, 15 nt, Pseudomonas putida KT2440
cguccgggcgccagg

SEQ ID NO: 1637248 - RNA, 16 nt, Pseudomonas putida KT2440
cguccucgaacucaug

SEQ ID NO: 1637249 - RNA, 15 nt, Pseudomonas putida KT2440
cgucauacagcccga

SEQ ID NO: 1637250 - RNA, 14 nt, Pseudomonas putida KT2440
cgucaucacccggg

SEQ ID NO: 1637251 - RNA, 16 nt, Pseudomonas putida KT2440
cguccagcucgcgcag

SEQ ID NO: 1637252 - RNA, 16 nt, Pseudomonas putida KT2440
cguccagcugagcgcc

SEQ ID NO: 1637253 - RNA, 19 nt, Pseudomonas putida KT2440
cguccaguucaaugccagc

SEQ ID NO: 1637254 - RNA, 14 nt, Pseudomonas putida KT2440
cguccaguuccggc

SEQ ID NO: 1637255 - RNA, 22 nt, Pseudomonas putida KT2440
cguccagguaauggcgugacgg

SEQ ID NO: 1637256 - RNA, 15 nt, Pseudomonas putida KT2440
cguccagguccaggc

SEQ ID NO: 1637257 - RNA, 12 nt, Pseudomonas putida KT2440
cguccaggcuca

SEQ ID NO: 1637258 - RNA, 13 nt, Pseudomonas putida KT2440
cguccaggcucag

SEQ ID NO: 1637259 - RNA, 17 nt, Pseudomonas putida KT2440
cguccaucuugcugcuc

SEQ ID NO: 1637260 - RNA, 19 nt, Pseudomonas putida KT2440
cguccaucuugcugcucug

SEQ ID NO: 1637261 - RNA, 15 nt, Pseudomonas putida KT2440
cgucgaucagcuucu

SEQ ID NO: 1637262 - RNA, 19 nt, Pseudomonas putida KT2440
cgucgagcaacuugcgcag

SEQ ID NO: 1637263 - RNA, 20 nt, Pseudomonas putida KT2440
cgucgacucuucccaccacc

SEQ ID NO: 1637264 - RNA, 14 nt, Pseudomonas putida KT2440
cgucgaacagcaug

SEQ ID NO: 1637265 - RNA, 17 nt, Pseudomonas putida KT2440
cguccuugacgaugacc

SEQ ID NO: 1637266 - RNA, 18 nt, Pseudomonas putida KT2440
cgucgaccgccgccuggc

SEQ ID NO: 1637267 - RNA, 22 nt, Pseudomonas putida KT2440
cgucgacaacgcacccgccucc

SEQ ID NO: 1637268 - RNA, 19 nt, Pseudomonas putida KT2440
cucggucagggcggcagcg

SEQ ID NO: 1637269 - RNA, 16 nt, Pseudomonas putida KT2440
cucggccugggcaggu

SEQ ID NO: 1637270 - RNA, 19 nt, Pseudomonas putida KT2440
cucgggaugaacuucuucg

SEQ ID NO: 1637271 - RNA, 15 nt, Pseudomonas putida KT2440
cucggcucuccuuuu

SEQ ID NO: 1637272 - RNA, 20 nt, Pseudomonas putida KT2440
cucguaauccucguccagcu

SEQ ID NO: 1637273 - RNA, 23 nt, Pseudomonas putida KT2440
cucguaacgagccuuggccagcg

SEQ ID NO: 1637274 - RNA, 18 nt, Pseudomonas putida KT2440
cucgucaccgccccagcg

SEQ ID NO: 1637275 - RNA, 13 nt, Pseudomonas putida KT2440
cucgucacugccg

SEQ ID NO: 1637276 - RNA, 16 nt, Pseudomonas putida KT2440
cucgucacuggcugcu

SEQ ID NO: 1637277 - RNA, 19 nt, Pseudomonas putida KT2440
cucgucacuggcugcugcg

SEQ ID NO: 1637278 - RNA, 22 nt, Pseudomonas putida KT2440
cucgucaauaccggugccccgg

SEQ ID NO: 1637279 - RNA, 12 nt, Pseudomonas putida KT2440
cucgucaaaccg

SEQ ID NO: 1637280 - RNA, 18 nt, Pseudomonas putida KT2440
cucgucaaaccggcaccg

SEQ ID NO: 1637281 - RNA, 17 nt, Pseudomonas putida KT2440
cucgucgaacucgcgcc

SEQ ID NO: 1637282 - RNA, 15 nt, Pseudomonas putida KT2440
cucguccgggcgcca

SEQ ID NO: 1637283 - RNA, 20 nt, Pseudomonas putida KT2440
cucguccggugccgccuggg

SEQ ID NO: 1637284 - RNA, 19 nt, Pseudomonas putida KT2440
cucgucgcacucugggcuu

SEQ ID NO: 1637285 - RNA, 16 nt, Pseudomonas putida KT2440
cucguccgacaaugcc

SEQ ID NO: 1637286 - RNA, 20 nt, Pseudomonas putida KT2440
cucguccaucuugcugcucu

SEQ ID NO: 1637287 - RNA, 21 nt, Pseudomonas putida KT2440
cucguccaucuugcugcucug

SEQ ID NO: 1637288 - RNA, 19 nt, Pseudomonas putida KT2440
cucgucagccaccaccagc

SEQ ID NO: 1637289 - RNA, 13 nt, Pseudomonas putida KT2440
cucgucagccccu

SEQ ID NO: 1637290 - RNA, 14 nt, Pseudomonas putida KT2440
cucgucagccccua

SEQ ID NO: 1637291 - RNA, 13 nt, Pseudomonas putida KT2440
cucgcucaggcca

SEQ ID NO: 1637292 - RNA, 18 nt, Pseudomonas putida KT2440
cucggagaacgggcuguc

SEQ ID NO: 1637293 - RNA, 21 nt, Pseudomonas putida KT2440
cucgcuucauggccccaccca

SEQ ID NO: 1637294 - RNA, 20 nt, Pseudomonas putida KT2440
cucgaucggcacccccuuca

SEQ ID NO: 1637295 - RNA, 16 nt, Pseudomonas putida KT2440
cucgcggugccuucag

SEQ ID NO: 1637296 - RNA, 23 nt, Pseudomonas putida KT2440
cucgauacggucuuuuccccuua

SEQ ID NO: 1637297 - RNA, 23 nt, Pseudomonas putida KT2440
cucgaucgccauguguacgccgc

SEQ ID NO: 1637298 - RNA, 13 nt, Pseudomonas putida KT2440
cucgauccugugg

SEQ ID NO: 1637299 - RNA, 16 nt, Pseudomonas putida KT2440
cucgaucccgccgcca

SEQ ID NO: 1637300 - RNA, 20 nt, Pseudomonas putida KT2440
cucgaucccgccgccagacc

SEQ ID NO: 1637301 - RNA, 21 nt, Pseudomonas putida KT2440
cucggccagguacucgcgcug

SEQ ID NO: 1637302 - RNA, 13 nt, Pseudomonas putida KT2440
cucggccagugcg

SEQ ID NO: 1637303 - RNA, 17 nt, Pseudomonas putida KT2440
cucggccggggccaggc

SEQ ID NO: 1637304 - RNA, 18 nt, Pseudomonas putida KT2440
cucggccggggccaggcg

SEQ ID NO: 1637305 - RNA, 14 nt, Pseudomonas putida KT2440
cucggccucccgcu

SEQ ID NO: 1637306 - RNA, 16 nt, Pseudomonas putida KT2440
cucggccgaugccagg

SEQ ID NO: 1637307 - RNA, 16 nt, Pseudomonas putida KT2440
cucggccaccuggccu

SEQ ID NO: 1637308 - RNA, 23 nt, Pseudomonas putida KT2440
cucggccaccacuucuggcuggg

SEQ ID NO: 1637309 - RNA, 16 nt, Pseudomonas putida KT2440
cucggccaccacccgc

SEQ ID NO: 1637310 - RNA, 19 nt, Pseudomonas putida KT2440
cucggcaggaaacaccagg

SEQ ID NO: 1637311 - RNA, 22 nt, Pseudomonas putida KT2440
cucggcaaucagcaucagugca

SEQ ID NO: 1637312 - RNA, 18 nt, Pseudomonas putida KT2440
cucggcaaucugcagcag

SEQ ID NO: 1637313 - RNA, 15 nt, Pseudomonas putida KT2440
cucucgaaguagcgc

SEQ ID NO: 1637314 - RNA, 23 nt, Pseudomonas putida KT2440
cucucgaaguagcgcucuuugcc

SEQ ID NO: 1637315 - RNA, 15 nt, Pseudomonas putida KT2440
cucugcggccuucaa

SEQ ID NO: 1637316 - RNA, 18 nt, Pseudomonas putida KT2440
cucugcggccuucaagcu

SEQ ID NO: 1637317 - RNA, 16 nt, Pseudomonas putida KT2440
cucugccgccccucca

SEQ ID NO: 1637318 - RNA, 14 nt, Pseudomonas putida KT2440
cucugccgcaccag

SEQ ID NO: 1637319 - RNA, 18 nt, Pseudomonas putida KT2440
cucugccgcaccaggucc

SEQ ID NO: 1637320 - RNA, 11 nt, Pseudomonas putida KT2440
cucugcagcag

SEQ ID NO: 1637321 - RNA, 20 nt, Pseudomonas putida KT2440
cucugcaggcacacccggac

SEQ ID NO: 1637322 - RNA, 15 nt, Pseudomonas putida KT2440
cucuaucuucaggca

SEQ ID NO: 1637323 - RNA, 19 nt, Pseudomonas putida KT2440
cucgucgcgguccuugccg

SEQ ID NO: 1637324 - RNA, 11 nt, Pseudomonas putida KT2440
cucuccuugcg

SEQ ID NO: 1637325 - RNA, 18 nt, Pseudomonas putida KT2440
cucuccgaggccgggcag

SEQ ID NO: 1637326 - RNA, 19 nt, Pseudomonas putida KT2440
cucucccgcagccgauacg

SEQ ID NO: 1637327 - RNA, 19 nt, Pseudomonas putida KT2440
cucucaacguucauccccu

SEQ ID NO: 1637328 - RNA, 16 nt, Pseudomonas putida KT2440
cucuccaauccgcagc

SEQ ID NO: 1637329 - RNA, 15 nt, Pseudomonas putida KT2440
cucgagcccgccagc

SEQ ID NO: 1637330 - RNA, 13 nt, Pseudomonas putida KT2440
cucgauagcagcg

SEQ ID NO: 1637331 - RNA, 12 nt, Pseudomonas putida KT2440
cucgaccacugu

SEQ ID NO: 1637332 - RNA, 13 nt, Pseudomonas putida KT2440
cucgaccacuguc

SEQ ID NO: 1637333 - RNA, 16 nt, Pseudomonas putida KT2440
cucgaccacuucccac

SEQ ID NO: 1637334 - RNA, 14 nt, Pseudomonas putida KT2440
cucgaccagcgcca

SEQ ID NO: 1637335 - RNA, 15 nt, Pseudomonas putida KT2440
cucgacgccuuggcg

SEQ ID NO: 1637336 - RNA, 16 nt, Pseudomonas putida KT2440
cucgagaaacgccagc

SEQ ID NO: 1637337 - RNA, 20 nt, Pseudomonas putida KT2440
cucgacguuuaccugcagcu

SEQ ID NO: 1637338 - RNA, 23 nt, Pseudomonas putida KT2440
cuccuugcuguagcccaccaggu

SEQ ID NO: 1637339 - RNA, 16 nt, Pseudomonas putida KT2440
cuccuuggacagcaau

SEQ ID NO: 1637340 - RNA, 22 nt, Pseudomonas putida KT2440
cuccuucgccacgaacaggcgc

SEQ ID NO: 1637341 - RNA, 17 nt, Pseudomonas putida KT2440
cuccuucagguaaucca

SEQ ID NO: 1637342 - RNA, 20 nt, Pseudomonas putida KT2440
cuccuucagguaauccacca

SEQ ID NO: 1637343 - RNA, 21 nt, Pseudomonas putida KT2440
cuccuuguagauauugaccag

SEQ ID NO: 1637344 - RNA, 17 nt, Pseudomonas putida KT2440
cuccuugucgcaaugga

SEQ ID NO: 1637345 - RNA, 16 nt, Pseudomonas putida KT2440
cucgaaaccaucaauc

SEQ ID NO: 1637346 - RNA, 13 nt, Pseudomonas putida KT2440
cucgacaaauccc

SEQ ID NO: 1637347 - RNA, 13 nt, Pseudomonas putida KT2440
cucgacaaacugc

SEQ ID NO: 1637348 - RNA, 16 nt, Pseudomonas putida KT2440
cucgaaugccgcugcu

SEQ ID NO: 1637349 - RNA, 14 nt, Pseudomonas putida KT2440
cucgaauccccuua

SEQ ID NO: 1637350 - RNA, 23 nt, Pseudomonas putida KT2440
cuccggcgaaauacccaacucca

SEQ ID NO: 1637351 - RNA, 20 nt, Pseudomonas putida KT2440
cuccggcaucauccugcugg

SEQ ID NO: 1637352 - RNA, 16 nt, Pseudomonas putida KT2440
cuccggcaaggcaucc

SEQ ID NO: 1637353 - RNA, 14 nt, Pseudomonas putida KT2440
cuccggcgacagcu

SEQ ID NO: 1637354 - RNA, 15 nt, Pseudomonas putida KT2440
cuccggcgacagcuc

SEQ ID NO: 1637355 - RNA, 17 nt, Pseudomonas putida KT2440
cuccggcgacagcucaa

SEQ ID NO: 1637356 - RNA, 22 nt, Pseudomonas putida KT2440
cuccucggccguaaaguccgug

SEQ ID NO: 1637357 - RNA, 13 nt, Pseudomonas putida KT2440
cuccucggccagc

SEQ ID NO: 1637358 - RNA, 18 nt, Pseudomonas putida KT2440
cuccugcggucagccugc

SEQ ID NO: 1637359 - RNA, 22 nt, Pseudomonas putida KT2440
cuccugcggcagauccugcagc

SEQ ID NO: 1637360 - RNA, 17 nt, Pseudomonas putida KT2440
cuccugcugcagcuccg

SEQ ID NO: 1637361 - RNA, 13 nt, Pseudomonas putida KT2440
cuccuggcucagu

SEQ ID NO: 1637362 - RNA, 14 nt, Pseudomonas putida KT2440
cuccugugccggcc

SEQ ID NO: 1637363 - RNA, 19 nt, Pseudomonas putida KT2440
cuccugugccggccucuuc

SEQ ID NO: 1637364 - RNA, 15 nt, Pseudomonas putida KT2440
cuccugcgccaccuc

SEQ ID NO: 1637365 - RNA, 16 nt, Pseudomonas putida KT2440
cuccugcagcaggccg

SEQ ID NO: 1637366 - RNA, 22 nt, Pseudomonas putida KT2440
cuccugcaugccuuccugcacc

SEQ ID NO: 1637367 - RNA, 16 nt, Pseudomonas putida KT2440
cuccagggcaggcuga

SEQ ID NO: 1637368 - RNA, 17 nt, Pseudomonas putida KT2440
cuccaggccugcggcag

SEQ ID NO: 1637369 - RNA, 16 nt, Pseudomonas putida KT2440
cuccaguugccagugu

SEQ ID NO: 1637370 - RNA, 13 nt, Pseudomonas putida KT2440
cuccaucuccagc

SEQ ID NO: 1637371 - RNA, 17 nt, Pseudomonas putida KT2440
cucaugggugucggcau

SEQ ID NO: 1637372 - RNA, 19 nt, Pseudomonas putida KT2440
cucaugcgggucaagcugg

SEQ ID NO: 1637373 - RNA, 15 nt, Pseudomonas putida KT2440
cuccagcuccuggcc

SEQ ID NO: 1637374 - RNA, 16 nt, Pseudomonas putida KT2440
cuccagcuccuggccc

SEQ ID NO: 1637375 - RNA, 13 nt, Pseudomonas putida KT2440
cuccagcucgccg

SEQ ID NO: 1637376 - RNA, 18 nt, Pseudomonas putida KT2440
cuccaucuucucgcgcag

SEQ ID NO: 1637377 - RNA, 16 nt, Pseudomonas putida KT2440
cuccaugaaggccggc

SEQ ID NO: 1637378 - RNA, 13 nt, Pseudomonas putida KT2440
cucccacaggaau

SEQ ID NO: 1637379 - RNA, 21 nt, Pseudomonas putida KT2440
cucccacaggaauuacgcagg

SEQ ID NO: 1637380 - RNA, 12 nt, Pseudomonas putida KT2440
cucccacaggga

SEQ ID NO: 1637381 - RNA, 17 nt, Pseudomonas putida KT2440
cucccacagggaccgca

SEQ ID NO: 1637382 - RNA, 16 nt, Pseudomonas putida KT2440
cucccacagguccagc

SEQ ID NO: 1637383 - RNA, 20 nt, Pseudomonas putida KT2440
cucccacagguccagcgcag

SEQ ID NO: 1637384 - RNA, 22 nt, Pseudomonas putida KT2440
cucccagcgcugucccccagcc

SEQ ID NO: 1637385 - RNA, 12 nt, Pseudomonas putida KT2440
cucccaggccuc

SEQ ID NO: 1637386 - RNA, 15 nt, Pseudomonas putida KT2440
cucccaggccucgaa

SEQ ID NO: 1637387 - RNA, 16 nt, Pseudomonas putida KT2440
cucccgcacugcugcc

SEQ ID NO: 1637388 - RNA, 19 nt, Pseudomonas putida KT2440
cucccgcacugcugccgcc

SEQ ID NO: 1637389 - RNA, 17 nt, Pseudomonas putida KT2440
cucccgccacggccacc

SEQ ID NO: 1637390 - RNA, 20 nt, Pseudomonas putida KT2440
cucccgcgaacgcccgaccu

SEQ ID NO: 1637391 - RNA, 21 nt, Pseudomonas putida KT2440
cucccucgguuucucaccccg

SEQ ID NO: 1637392 - RNA, 12 nt, Pseudomonas putida KT2440
cuccgcccugcc

SEQ ID NO: 1637393 - RNA, 20 nt, Pseudomonas putida KT2440
cuccgccccaaaccaggccg

SEQ ID NO: 1637394 - RNA, 19 nt, Pseudomonas putida KT2440
cuccgccaaaccccagcaa

SEQ ID NO: 1637395 - RNA, 19 nt, Pseudomonas putida KT2440
cuccgccaagcacgcacag

SEQ ID NO: 1637396 - RNA, 14 nt, Pseudomonas putida KT2440
cuccgcacaggcug

SEQ ID NO: 1637397 - RNA, 21 nt, Pseudomonas putida KT2440
cuccgcacaggcuggccacca

SEQ ID NO: 1637398 - RNA, 22 nt, Pseudomonas putida KT2440
cuccgcacaggcuggccaccau

SEQ ID NO: 1637399 - RNA, 14 nt, Pseudomonas putida KT2440
cucacuggcauccg

SEQ ID NO: 1637400 - RNA, 23 nt, Pseudomonas putida KT2440
cucacuggcauccggcagcucac

SEQ ID NO: 1637401 - RNA, 17 nt, Pseudomonas putida KT2440
cucagaguaacugaaug

SEQ ID NO: 1637402 - RNA, 18 nt, Pseudomonas putida KT2440
cucaggcucagcuccaug

SEQ ID NO: 1637403 - RNA, 22 nt, Pseudomonas putida KT2440
cucaggcucaguugcaagucuc

SEQ ID NO: 1637404 - RNA, 14 nt, Pseudomonas putida KT2440
cucaggcugagcag

SEQ ID NO: 1637405 - RNA, 21 nt, Pseudomonas putida KT2440
cucaggcugagcagaccagcc

SEQ ID NO: 1637406 - RNA, 20 nt, Pseudomonas putida KT2440
cucagcacauucagcagcgc

SEQ ID NO: 1637407 - RNA, 15 nt, Pseudomonas putida KT2440
cucagggcagcaacg

SEQ ID NO: 1637408 - RNA, 16 nt, Pseudomonas putida KT2440
cucagguaggcagcaa

SEQ ID NO: 1637409 - RNA, 20 nt, Pseudomonas putida KT2440
cucaggugcacagggcggcc

SEQ ID NO: 1637410 - RNA, 20 nt, Pseudomonas putida KT2440
cucagguuacgcaccagcuc

SEQ ID NO: 1637411 - RNA, 22 nt, Pseudomonas putida KT2440
cucagguuacgcaccagcucca

SEQ ID NO: 1637412 - RNA, 15 nt, Pseudomonas putida KT2440
cucauagcucagcug

SEQ ID NO: 1637413 - RNA, 20 nt, Pseudomonas putida KT2440
cucauacccuuugccaucca

SEQ ID NO: 1637414 - RNA, 19 nt, Pseudomonas putida KT2440
cucagucgcaucgacaggu

SEQ ID NO: 1637415 - RNA, 18 nt, Pseudomonas putida KT2440
cucagugugggggcggcc

SEQ ID NO: 1637416 - RNA, 17 nt, Pseudomonas putida KT2440
cucaucggcgccggccg

SEQ ID NO: 1637417 - RNA, 16 nt, Pseudomonas putida KT2440
cucaucggcggcuucc

SEQ ID NO: 1637418 - RNA, 14 nt, Pseudomonas putida KT2440
cucaucccccggcc

SEQ ID NO: 1637419 - RNA, 18 nt, Pseudomonas putida KT2440
cucaucccccggcccagc

SEQ ID NO: 1637420 - RNA, 14 nt, Pseudomonas putida KT2440
cucauccucgccca

SEQ ID NO: 1637421 - RNA, 19 nt, Pseudomonas putida KT2440
cucaucuaccugagccugc

SEQ ID NO: 1637422 - RNA, 15 nt, Pseudomonas putida KT2440
cucaugaacagcgcc

SEQ ID NO: 1637423 - RNA, 16 nt, Pseudomonas putida KT2440
cucaugaacagcgccc

SEQ ID NO: 1637424 - RNA, 23 nt, Pseudomonas putida KT2440
cucaugaucugcaagcgcagccc

SEQ ID NO: 1637425 - RNA, 23 nt, Pseudomonas putida KT2440
cucaugccccgcaccuccuuggc

SEQ ID NO: 1637426 - RNA, 17 nt, Pseudomonas putida KT2440
cucauagcucagcugga

SEQ ID NO: 1637427 - RNA, 16 nt, Pseudomonas putida KT2440
cucauagcucagcugg

SEQ ID NO: 1637428 - RNA, 15 nt, Pseudomonas putida KT2440
cucaucaccaggccc

SEQ ID NO: 1637429 - RNA, 19 nt, Pseudomonas putida KT2440
cucaucaggcgauucaggc

SEQ ID NO: 1637430 - RNA, 23 nt, Pseudomonas putida KT2440
cucaucaggcgauucaggcuuug

SEQ ID NO: 1637431 - RNA, 13 nt, Pseudomonas putida KT2440
cucaucacucuug

SEQ ID NO: 1637432 - RNA, 12 nt, Pseudomonas putida KT2440
cucauccacccc

SEQ ID NO: 1637433 - RNA, 12 nt, Pseudomonas putida KT2440
cucauccaccac

SEQ ID NO: 1637434 - RNA, 13 nt, Pseudomonas putida KT2440
cucauccaccaca

SEQ ID NO: 1637435 - RNA, 14 nt, Pseudomonas putida KT2440
cucauccaggcugc

SEQ ID NO: 1637436 - RNA, 13 nt, Pseudomonas putida KT2440
cucauccagccgc

SEQ ID NO: 1637437 - RNA, 19 nt, Pseudomonas putida KT2440
cucaacuccauggccaggg

SEQ ID NO: 1637438 - RNA, 16 nt, Pseudomonas putida KT2440
cucaacgccuccccca

SEQ ID NO: 1637439 - RNA, 15 nt, Pseudomonas putida KT2440
cucaacgccaucagg

SEQ ID NO: 1637440 - RNA, 14 nt, Pseudomonas putida KT2440
cucaacuucccucu

SEQ ID NO: 1637441 - RNA, 20 nt, Pseudomonas putida KT2440
cucaacuucccucugccugc

SEQ ID NO: 1637442 - RNA, 22 nt, Pseudomonas putida KT2440
cucaacuucccucugccugccc

SEQ ID NO: 1637443 - RNA, 23 nt, Pseudomonas putida KT2440
cucaaggugucgauacucacccg

SEQ ID NO: 1637444 - RNA, 17 nt, Pseudomonas putida KT2440
cucaagggcgcugauca

SEQ ID NO: 1637445 - RNA, 14 nt, Pseudomonas putida KT2440
cucaaggcuuucca

SEQ ID NO: 1637446 - RNA, 14 nt, Pseudomonas putida KT2440
cucaaggccggcag

SEQ ID NO: 1637447 - RNA, 21 nt, Pseudomonas putida KT2440
cucaagccugccaaaucccuu

SEQ ID NO: 1637448 - RNA, 23 nt, Pseudomonas putida KT2440
cucaagcuucauguacagguucu

SEQ ID NO: 1637449 - RNA, 16 nt, Pseudomonas putida KT2440
cucaagcgcagccuug

SEQ ID NO: 1637450 - RNA, 20 nt, Pseudomonas putida KT2440
cucaagcgcagccuugugcu

SEQ ID NO: 1637451 - RNA, 23 nt, Pseudomonas putida KT2440
cucaaccuuugcggcacaucuca

SEQ ID NO: 1637452 - RNA, 18 nt, Pseudomonas putida KT2440
cucaaccggugcaacugc

SEQ ID NO: 1637453 - RNA, 19 nt, Pseudomonas putida KT2440
cucaacagguucgacagug

SEQ ID NO: 1637454 - RNA, 17 nt, Pseudomonas putida KT2440
cucaacaccagacucag

SEQ ID NO: 1637455 - RNA, 14 nt, Pseudomonas putida KT2440
cucaacagccacgc

SEQ ID NO: 1637456 - RNA, 20 nt, Pseudomonas putida KT2440
cucaccgcagcccagcgccg

SEQ ID NO: 1637457 - RNA, 18 nt, Pseudomonas putida KT2440
cucaccgccaacccgauc

SEQ ID NO: 1637458 - RNA, 14 nt, Pseudomonas putida KT2440
cucaccgcgcccaa

SEQ ID NO: 1637459 - RNA, 17 nt, Pseudomonas putida KT2440
cucaccggccagcgcgc

SEQ ID NO: 1637460 - RNA, 21 nt, Pseudomonas putida KT2440
cucaccuccaccgauccuugg

SEQ ID NO: 1637461 - RNA, 14 nt, Pseudomonas putida KT2440
cucacgcagccagu

SEQ ID NO: 1637462 - RNA, 13 nt, Pseudomonas putida KT2440
cucacgcagcucg

SEQ ID NO: 1637463 - RNA, 18 nt, Pseudomonas putida KT2440
cucacgaugacccuucca

SEQ ID NO: 1637464 - RNA, 23 nt, Pseudomonas putida KT2440
cucacguucgccauaggccgccu

SEQ ID NO: 1637465 - RNA, 16 nt, Pseudomonas putida KT2440
cucaaucaaccagccc

SEQ ID NO: 1637466 - RNA, 19 nt, Pseudomonas putida KT2440
cucaaucaaccagcccgcc

SEQ ID NO: 1637467 - RNA, 12 nt, Pseudomonas putida KT2440
cucacccgcuug

SEQ ID NO: 1637468 - RNA, 16 nt, Pseudomonas putida KT2440
cucacccgcuugccac

SEQ ID NO: 1637469 - RNA, 15 nt, Pseudomonas putida KT2440
cucaccaacugccug

SEQ ID NO: 1637470 - RNA, 14 nt, Pseudomonas putida KT2440
cucacaggcucagu

SEQ ID NO: 1637471 - RNA, 18 nt, Pseudomonas putida KT2440
cuauccggagcuccccuc

SEQ ID NO: 1637472 - RNA, 21 nt, Pseudomonas putida KT2440
cuauccggagcuccccucaga

SEQ ID NO: 1637473 - RNA, 12 nt, Pseudomonas putida KT2440
cuaucagggcug

SEQ ID NO: 1637474 - RNA, 20 nt, Pseudomonas putida KT2440
cuaucagccgugaugagguu

SEQ ID NO: 1637475 - RNA, 20 nt, Pseudomonas putida KT2440
cuaugccuuggaggcugggc

SEQ ID NO: 1637476 - RNA, 14 nt, Pseudomonas putida KT2440
cuaugccggggcug

SEQ ID NO: 1637477 - RNA, 17 nt, Pseudomonas putida KT2440
cuaugccggucagcagc

SEQ ID NO: 1637478 - RNA, 23 nt, Pseudomonas putida KT2440
cuaugcgugaaacgcagcuuugg

SEQ ID NO: 1637479 - RNA, 22 nt, Pseudomonas putida KT2440
cuauaucucugguacaacaaca

SEQ ID NO: 1637480 - RNA, 23 nt, Pseudomonas putida KT2440
cuauaucucugguacaacaacaa

SEQ ID NO: 1637481 - RNA, 19 nt, Pseudomonas putida KT2440
cuagguaguaaagccccca

SEQ ID NO: 1637482 - RNA, 19 nt, Pseudomonas putida KT2440
cuagcgccugacaugcaca

SEQ ID NO: 1637483 - RNA, 16 nt, Pseudomonas putida KT2440
cuagaggaucugaaug

SEQ ID NO: 1637484 - RNA, 18 nt, Pseudomonas putida KT2440
cuagauaaccaaccccug

SEQ ID NO: 1637485 - RNA, 15 nt, Pseudomonas putida KT2440
cuagaugcugguucg

SEQ ID NO: 1637486 - RNA, 19 nt, Pseudomonas putida KT2440
cuaacaggugcucaccaga

SEQ ID NO: 1637487 - RNA, 14 nt, Pseudomonas putida KT2440
cuacgacggccugc

SEQ ID NO: 1637488 - RNA, 15 nt, Pseudomonas putida KT2440
cuacgcaaggugcca

SEQ ID NO: 1637489 - RNA, 14 nt, Pseudomonas putida KT2440
cuacgaucgaauga

SEQ ID NO: 1637490 - RNA, 20 nt, Pseudomonas putida KT2440
cuacgacccugaagcccugg

SEQ ID NO: 1637491 - RNA, 13 nt, Pseudomonas putida KT2440
cugcgcccgcccc

SEQ ID NO: 1637492 - RNA, 17 nt, Pseudomonas putida KT2440
cugcgccccgcucgccu

SEQ ID NO: 1637493 - RNA, 22 nt, Pseudomonas putida KT2440
cugcgccccgcucgccuggcca

SEQ ID NO: 1637494 - RNA, 18 nt, Pseudomonas putida KT2440
cugcgcccgcacagcacg

SEQ ID NO: 1637495 - RNA, 22 nt, Pseudomonas putida KT2440
cugcgccgccaccugcggcagg

SEQ ID NO: 1637496 - RNA, 14 nt, Pseudomonas putida KT2440
cugcgcccgccuuc

SEQ ID NO: 1637497 - RNA, 17 nt, Pseudomonas putida KT2440
cugcgccggccaagugg

SEQ ID NO: 1637498 - RNA, 21 nt, Pseudomonas putida KT2440
cugcgccgguguucgcgggca

SEQ ID NO: 1637499 - RNA, 13 nt, Pseudomonas putida KT2440
cugcgccagugcc

SEQ ID NO: 1637500 - RNA, 14 nt, Pseudomonas putida KT2440
cugcgccaggcauu

SEQ ID NO: 1637501 - RNA, 15 nt, Pseudomonas putida KT2440
cugcgccagcgggug

SEQ ID NO: 1637502 - RNA, 21 nt, Pseudomonas putida KT2440
cugcgccagcaguuucagcgg

SEQ ID NO: 1637503 - RNA, 23 nt, Pseudomonas putida KT2440
cugcgccaaaaccuguuccagcc

SEQ ID NO: 1637504 - RNA, 21 nt, Pseudomonas putida KT2440
cugcgcaugaaacucgcgcgc

SEQ ID NO: 1637505 - RNA, 22 nt, Pseudomonas putida KT2440
cugcgcgcgagagcgacgcgcu

SEQ ID NO: 1637506 - RNA, 21 nt, Pseudomonas putida KT2440
cugcgcgggaagcccguacag

SEQ ID NO: 1637507 - RNA, 17 nt, Pseudomonas putida KT2440
cugcgcgccguugcacg

SEQ ID NO: 1637508 - RNA, 14 nt, Pseudomonas putida KT2440
cugcgcggccuugc

SEQ ID NO: 1637509 - RNA, 12 nt, Pseudomonas putida KT2440
cugcgcggcagc

SEQ ID NO: 1637510 - RNA, 18 nt, Pseudomonas putida KT2440
cugcgcggcagcccuucg

SEQ ID NO: 1637511 - RNA, 23 nt, Pseudomonas putida KT2440
cugcgcgguaaacgggaagucgc

SEQ ID NO: 1637512 - RNA, 12 nt, Pseudomonas putida KT2440
cugcgccugcug

SEQ ID NO: 1637513 - RNA, 22 nt, Pseudomonas putida KT2440
cugcgccugcugguacagccgg

SEQ ID NO: 1637514 - RNA, 16 nt, Pseudomonas putida KT2440
cugcgccugccgggcc

SEQ ID NO: 1637515 - RNA, 22 nt, Pseudomonas putida KT2440
cugcgcgagaaugcugcgcagc

SEQ ID NO: 1637516 - RNA, 23 nt, Pseudomonas putida KT2440
cugcgcgagaaugcugcgcagcu

SEQ ID NO: 1637517 - RNA, 14 nt, Pseudomonas putida KT2440
cugccggucggccu

SEQ ID NO: 1637518 - RNA, 18 nt, Pseudomonas putida KT2440
cugccggucggccugcac

SEQ ID NO: 1637519 - RNA, 20 nt, Pseudomonas putida KT2440
cugccggucggccugcacua

SEQ ID NO: 1637520 - RNA, 23 nt, Pseudomonas putida KT2440
cugccgguagugaugcaucagcu

SEQ ID NO: 1637521 - RNA, 16 nt, Pseudomonas putida KT2440
cugccgggucaaggcc

SEQ ID NO: 1637522 - RNA, 22 nt, Pseudomonas putida KT2440
cugccgggucaaggccagcgcc

SEQ ID NO: 1637523 - RNA, 23 nt, Pseudomonas putida KT2440
cugccgggucaaggccagcgccu

SEQ ID NO: 1637524 - RNA, 16 nt, Pseudomonas putida KT2440
cugccgguacagccua

SEQ ID NO: 1637525 - RNA, 19 nt, Pseudomonas putida KT2440
cugccgguguucgcgggug

SEQ ID NO: 1637526 - RNA, 15 nt, Pseudomonas putida KT2440
cugccuaccaccgca

SEQ ID NO: 1637527 - RNA, 18 nt, Pseudomonas putida KT2440
cugccguuugcuggccug

SEQ ID NO: 1637528 - RNA, 20 nt, Pseudomonas putida KT2440
cugccguuugcuggccugca

SEQ ID NO: 1637529 - RNA, 20 nt, Pseudomonas putida KT2440
cugccuccgccaagcacgca

SEQ ID NO: 1637530 - RNA, 23 nt, Pseudomonas putida KT2440
cugccgaugggcacuggccaccc

SEQ ID NO: 1637531 - RNA, 19 nt, Pseudomonas putida KT2440
cugccgccaaccagcucac

SEQ ID NO: 1637532 - RNA, 17 nt, Pseudomonas putida KT2440
cugccgggccgggcacg

SEQ ID NO: 1637533 - RNA, 15 nt, Pseudomonas putida KT2440
cugccggggcuuugu

SEQ ID NO: 1637534 - RNA, 18 nt, Pseudomonas putida KT2440
cugccggggcaugcgcag

SEQ ID NO: 1637535 - RNA, 19 nt, Pseudomonas putida KT2440
cugccuuccaaccagccag

SEQ ID NO: 1637536 - RNA, 21 nt, Pseudomonas putida KT2440
cugccuuccacccgccugcaa

SEQ ID NO: 1637537 - RNA, 12 nt, Pseudomonas putida KT2440
cugccugggcac

SEQ ID NO: 1637538 - RNA, 20 nt, Pseudomonas putida KT2440
cugccugggccgguccuuuc

SEQ ID NO: 1637539 - RNA, 16 nt, Pseudomonas putida KT2440
cugccugcaggcugcc

SEQ ID NO: 1637540 - RNA, 12 nt, Pseudomonas putida KT2440
cugccugugccg

SEQ ID NO: 1637541 - RNA, 20 nt, Pseudomonas putida KT2440
cugccugugccggccucuuc

SEQ ID NO: 1637542 - RNA, 14 nt, Pseudomonas putida KT2440
cugccuggcucagg

SEQ ID NO: 1637543 - RNA, 22 nt, Pseudomonas putida KT2440
cugccugcgcugugccgauaga

SEQ ID NO: 1637544 - RNA, 14 nt, Pseudomonas putida KT2440
cugccugcugcaac

SEQ ID NO: 1637545 - RNA, 15 nt, Pseudomonas putida KT2440
cugccugcugcagcu

SEQ ID NO: 1637546 - RNA, 18 nt, Pseudomonas putida KT2440
cugccugauugccuggcu

SEQ ID NO: 1637547 - RNA, 24 nt, Pseudomonas putida KT2440
cugcgcaaggcauucagcucggcc

SEQ ID NO: 1637548 - RNA, 22 nt, Pseudomonas putida KT2440
cugcgaugaacucgucacccuc

SEQ ID NO: 1637549 - RNA, 19 nt, Pseudomonas putida KT2440
cugcgcaucacccgccccu

SEQ ID NO: 1637550 - RNA, 20 nt, Pseudomonas putida KT2440
cugcgcaucacccgccccuc

SEQ ID NO: 1637551 - RNA, 16 nt, Pseudomonas putida KT2440
cugcgcaucaggcugc

SEQ ID NO: 1637552 - RNA, 16 nt, Pseudomonas putida KT2440
cugcgcagccccaaaa

SEQ ID NO: 1637553 - RNA, 21 nt, Pseudomonas putida KT2440
cugcgcagguauagggcuacg

SEQ ID NO: 1637554 - RNA, 18 nt, Pseudomonas putida KT2440
cugcgcaguacaggcugc

SEQ ID NO: 1637555 - RNA, 22 nt, Pseudomonas putida KT2440
cugcgcaguacaggcugccgcc

SEQ ID NO: 1637556 - RNA, 20 nt, Pseudomonas putida KT2440
cugccagaaucuggggccgc

SEQ ID NO: 1637557 - RNA, 16 nt, Pseudomonas putida KT2440
cugccacacacccggg

SEQ ID NO: 1637558 - RNA, 19 nt, Pseudomonas putida KT2440
cugccaacgggauaccggu

SEQ ID NO: 1637559 - RNA, 19 nt, Pseudomonas putida KT2440
cugccaacgcaccgaccac

SEQ ID NO: 1637560 - RNA, 19 nt, Pseudomonas putida KT2440
cugccaaccggcuuguagc

SEQ ID NO: 1637561 - RNA, 21 nt, Pseudomonas putida KT2440
cugccaaccggcuuguagccg

SEQ ID NO: 1637562 - RNA, 17 nt, Pseudomonas putida KT2440
cugccaguugcuucugc

SEQ ID NO: 1637563 - RNA, 19 nt, Pseudomonas putida KT2440
cugccaguugcuucugcag

SEQ ID NO: 1637564 - RNA, 21 nt, Pseudomonas putida KT2440
cugccauagcgcugcaccgaa

SEQ ID NO: 1637565 - RNA, 21 nt, Pseudomonas putida KT2440
cugccaguccuuggccaaugc

SEQ ID NO: 1637566 - RNA, 23 nt, Pseudomonas putida KT2440
cugccagugucaguugcucgccc

SEQ ID NO: 1637567 - RNA, 13 nt, Pseudomonas putida KT2440
cugccaucuccaa

SEQ ID NO: 1637568 - RNA, 19 nt, Pseudomonas putida KT2440
cugcccaggugccaggcuc

SEQ ID NO: 1637569 - RNA, 20 nt, Pseudomonas putida KT2440
cugcccauaaaagccucagc

SEQ ID NO: 1637570 - RNA, 21 nt, Pseudomonas putida KT2440
cugcccauaaaagccucagcg

SEQ ID NO: 1637571 - RNA, 20 nt, Pseudomonas putida KT2440
cugcccagcugaagugccaa

SEQ ID NO: 1637572 - RNA, 19 nt, Pseudomonas putida KT2440
cugccccaugcgaacugca

SEQ ID NO: 1637573 - RNA, 22 nt, Pseudomonas putida KT2440
cugcccgcgccacccgcugggc

SEQ ID NO: 1637574 - RNA, 15 nt, Pseudomonas putida KT2440
cugcccgagagcagu

SEQ ID NO: 1637575 - RNA, 23 nt, Pseudomonas putida KT2440
cugcccgaucgccucgcuggcgg

SEQ ID NO: 1637576 - RNA, 20 nt, Pseudomonas putida KT2440
cugcccgccccccaccuggc

SEQ ID NO: 1637577 - RNA, 17 nt, Pseudomonas putida KT2440
cugcccgcccucacuca

SEQ ID NO: 1637578 - RNA, 11 nt, Pseudomonas putida KT2440
cugcccgcagc

SEQ ID NO: 1637579 - RNA, 15 nt, Pseudomonas putida KT2440
cugcccgcagcuuca

SEQ ID NO: 1637580 - RNA, 21 nt, Pseudomonas putida KT2440
cugcagguaguuuuccagccc

SEQ ID NO: 1637581 - RNA, 15 nt, Pseudomonas putida KT2440
cugcaggggugggau

SEQ ID NO: 1637582 - RNA, 15 nt, Pseudomonas putida KT2440
cugcacacugcgcuu

SEQ ID NO: 1637583 - RNA, 21 nt, Pseudomonas putida KT2440
cugcaguagccgaacgcaaga

SEQ ID NO: 1637584 - RNA, 21 nt, Pseudomonas putida KT2440
cugcaguucagggcgugguga

SEQ ID NO: 1637585 - RNA, 18 nt, Pseudomonas putida KT2440
cugcaauccgaacuuaau

SEQ ID NO: 1637586 - RNA, 15 nt, Pseudomonas putida KT2440
cugcaaucagcucac

SEQ ID NO: 1637587 - RNA, 23 nt, Pseudomonas putida KT2440
cugcaaucagcucacaggcucag

SEQ ID NO: 1637588 - RNA, 11 nt, Pseudomonas putida KT2440
cugcaaucacc

SEQ ID NO: 1637589 - RNA, 17 nt, Pseudomonas putida KT2440
cugcaaucgagccgaac

SEQ ID NO: 1637590 - RNA, 13 nt, Pseudomonas putida KT2440
cugcacaaacuuc

SEQ ID NO: 1637591 - RNA, 14 nt, Pseudomonas putida KT2440
cugcaauucgugaa

SEQ ID NO: 1637592 - RNA, 16 nt, Pseudomonas putida KT2440
cugcauggcggcaccg

SEQ ID NO: 1637593 - RNA, 22 nt, Pseudomonas putida KT2440
cugcaugccuuccugcaccuug

SEQ ID NO: 1637594 - RNA, 21 nt, Pseudomonas putida KT2440
cugcauggcauaggcugucac

SEQ ID NO: 1637595 - RNA, 15 nt, Pseudomonas putida KT2440
cugcaucgguggaga

SEQ ID NO: 1637596 - RNA, 17 nt, Pseudomonas putida KT2440
cugcauccgccccaggu

SEQ ID NO: 1637597 - RNA, 21 nt, Pseudomonas putida KT2440
cugcaucauucgcgccauggc

SEQ ID NO: 1637598 - RNA, 20 nt, Pseudomonas putida KT2440
cugcaucagguagcugggcc

SEQ ID NO: 1637599 - RNA, 14 nt, Pseudomonas putida KT2440
cugcaugucggcag

SEQ ID NO: 1637600 - RNA, 15 nt, Pseudomonas putida KT2440
cugcaugugccgcuc

SEQ ID NO: 1637601 - RNA, 18 nt, Pseudomonas putida KT2440
cugcauugucauugccca

SEQ ID NO: 1637602 - RNA, 18 nt, Pseudomonas putida KT2440
cugcauugcagccccaau

SEQ ID NO: 1637603 - RNA, 16 nt, Pseudomonas putida KT2440
cugccaaaccgcccca

SEQ ID NO: 1637604 - RNA, 21 nt, Pseudomonas putida KT2440
cugcauugcgcgucacugcac

SEQ ID NO: 1637605 - RNA, 12 nt, Pseudomonas putida KT2440
cugcgguguguu

SEQ ID NO: 1637606 - RNA, 15 nt, Pseudomonas putida KT2440
cugcgucaggccaug

SEQ ID NO: 1637607 - RNA, 19 nt, Pseudomonas putida KT2440
cugcguaagguaguaaaaa

SEQ ID NO: 1637608 - RNA, 21 nt, Pseudomonas putida KT2440
cugcguuucgcuggccugccc

SEQ ID NO: 1637609 - RNA, 12 nt, Pseudomonas putida KT2440
cugcguugcggu

SEQ ID NO: 1637610 - RNA, 22 nt, Pseudomonas putida KT2440
cugcucaccauguuccaguucg

SEQ ID NO: 1637611 - RNA, 14 nt, Pseudomonas putida KT2440
cugcgcugccugcu

SEQ ID NO: 1637612 - RNA, 22 nt, Pseudomonas putida KT2440
cugcgcugguacagcaggaacg

SEQ ID NO: 1637613 - RNA, 14 nt, Pseudomonas putida KT2440
cugcgcuucaagca

SEQ ID NO: 1637614 - RNA, 18 nt, Pseudomonas putida KT2440
cugcgcuccagcagcucc

SEQ ID NO: 1637615 - RNA, 18 nt, Pseudomonas putida KT2440
cugcgcucaaccagccgc

SEQ ID NO: 1637616 - RNA, 14 nt, Pseudomonas putida KT2440
cugcggcgugcgcc

SEQ ID NO: 1637617 - RNA, 16 nt, Pseudomonas putida KT2440
cugcugcgcagcccca

SEQ ID NO: 1637618 - RNA, 17 nt, Pseudomonas putida KT2440
cugcugcgcagccccaa

SEQ ID NO: 1637619 - RNA, 17 nt, Pseudomonas putida KT2440
cugcugcgcagcccugu

SEQ ID NO: 1637620 - RNA, 20 nt, Pseudomonas putida KT2440
cugcugcgaaacgaaacccu

SEQ ID NO: 1637621 - RNA, 22 nt, Pseudomonas putida KT2440
cugcugcgaaacgaaacccugc

SEQ ID NO: 1637622 - RNA, 19 nt, Pseudomonas putida KT2440
cugcugcgguuugcucuga

SEQ ID NO: 1637623 - RNA, 19 nt, Pseudomonas putida KT2440
cugcugcggcaggcuggca

SEQ ID NO: 1637624 - RNA, 12 nt, Pseudomonas putida KT2440
cugcugcggccg

SEQ ID NO: 1637625 - RNA, 13 nt, Pseudomonas putida KT2440
cugcugcggccgc

SEQ ID NO: 1637626 - RNA, 13 nt, Pseudomonas putida KT2440
cugcugccaggcc

SEQ ID NO: 1637627 - RNA, 15 nt, Pseudomonas putida KT2440
cugcugccaggccgc

SEQ ID NO: 1637628 - RNA, 17 nt, Pseudomonas putida KT2440
cugcugccaaucgauca

SEQ ID NO: 1637629 - RNA, 23 nt, Pseudomonas putida KT2440
cugcugccaaucgaucacuucca

SEQ ID NO: 1637630 - RNA, 14 nt, Pseudomonas putida KT2440
cugcugcagggccc

SEQ ID NO: 1637631 - RNA, 20 nt, Pseudomonas putida KT2440
cugcugcagggcccagccac

SEQ ID NO: 1637632 - RNA, 14 nt, Pseudomonas putida KT2440
cugcugcaguucuu

SEQ ID NO: 1637633 - RNA, 15 nt, Pseudomonas putida KT2440
cugcugcagcacugc

SEQ ID NO: 1637634 - RNA, 17 nt, Pseudomonas putida KT2440
cugcugcagcacugccu

SEQ ID NO: 1637635 - RNA, 14 nt, Pseudomonas putida KT2440
cugcugcagcaugg

SEQ ID NO: 1637636 - RNA, 13 nt, Pseudomonas putida KT2440
cugcugcaggcuc

SEQ ID NO: 1637637 - RNA, 21 nt, Pseudomonas putida KT2440
cugcucgacaagccgcugggc

SEQ ID NO: 1637638 - RNA, 19 nt, Pseudomonas putida KT2440
cugcuccugguccugcgcg

SEQ ID NO: 1637639 - RNA, 22 nt, Pseudomonas putida KT2440
cugcuccugguccugcgcgucg

SEQ ID NO: 1637640 - RNA, 16 nt, Pseudomonas putida KT2440
cugcucagccaaccgc

SEQ ID NO: 1637641 - RNA, 17 nt, Pseudomonas putida KT2440
cugcucagugcuggcgu

SEQ ID NO: 1637642 - RNA, 20 nt, Pseudomonas putida KT2440
cugcuccggaauccgcacac

SEQ ID NO: 1637643 - RNA, 14 nt, Pseudomonas putida KT2440
cugcucucggcgcu

SEQ ID NO: 1637644 - RNA, 15 nt, Pseudomonas putida KT2440
cugcucgucguccuc

SEQ ID NO: 1637645 - RNA, 20 nt, Pseudomonas putida KT2440
cuggaucacugccagcaccu

SEQ ID NO: 1637646 - RNA, 22 nt, Pseudomonas putida KT2440
cuggaucgcucucgcuuuugcu

SEQ ID NO: 1637647 - RNA, 12 nt, Pseudomonas putida KT2440
cuggaucuugcu

SEQ ID NO: 1637648 - RNA, 15 nt, Pseudomonas putida KT2440
cuggaccuggcuggc

SEQ ID NO: 1637649 - RNA, 14 nt, Pseudomonas putida KT2440
cuggacccgcagca

SEQ ID NO: 1637650 - RNA, 13 nt, Pseudomonas putida KT2440
cuggaccccgccc

SEQ ID NO: 1637651 - RNA, 18 nt, Pseudomonas putida KT2440
cuggaccccgcccuagcg

SEQ ID NO: 1637652 - RNA, 16 nt, Pseudomonas putida KT2440
cuggaccaucacggaa

SEQ ID NO: 1637653 - RNA, 18 nt, Pseudomonas putida KT2440
cuggacgcgugcaaggga

SEQ ID NO: 1637654 - RNA, 20 nt, Pseudomonas putida KT2440
cuggacgugguugcugaugu

SEQ ID NO: 1637655 - RNA, 12 nt, Pseudomonas putida KT2440
cuggcccacccg

SEQ ID NO: 1637656 - RNA, 14 nt, Pseudomonas putida KT2440
cuggcccacccggc

SEQ ID NO: 1637657 - RNA, 18 nt, Pseudomonas putida KT2440
cuggcccacgccuuccac

SEQ ID NO: 1637658 - RNA, 22 nt, Pseudomonas putida KT2440
cuggcccacgccuuccaccggu

SEQ ID NO: 1637659 - RNA, 16 nt, Pseudomonas putida KT2440
cuggccagcagggccg

SEQ ID NO: 1637660 - RNA, 17 nt, Pseudomonas putida KT2440
cuggccagcagggccgc

SEQ ID NO: 1637661 - RNA, 11 nt, Pseudomonas putida KT2440
cuggccagcgg

SEQ ID NO: 1637662 - RNA, 22 nt, Pseudomonas putida KT2440
cuggccagcggcgcggccucgu

SEQ ID NO: 1637663 - RNA, 22 nt, Pseudomonas putida KT2440
cuggccaccgaaguucagcacg

SEQ ID NO: 1637664 - RNA, 16 nt, Pseudomonas putida KT2440
cuggccaaggccucua

SEQ ID NO: 1637665 - RNA, 16 nt, Pseudomonas putida KT2440
cuggccagcagccccc

SEQ ID NO: 1637666 - RNA, 21 nt, Pseudomonas putida KT2440
cuggccagcagccccccuucc

SEQ ID NO: 1637667 - RNA, 15 nt, Pseudomonas putida KT2440
cuggccaccagcaug

SEQ ID NO: 1637668 - RNA, 22 nt, Pseudomonas putida KT2440
cuggcaaauagcgcuuucuggu

SEQ ID NO: 1637669 - RNA, 20 nt, Pseudomonas putida KT2440
cuggcaacccgccuccugaa

SEQ ID NO: 1637670 - RNA, 13 nt, Pseudomonas putida KT2440
cuggcaugccccu

SEQ ID NO: 1637671 - RNA, 12 nt, Pseudomonas putida KT2440
cuggcauccagc

SEQ ID NO: 1637672 - RNA, 22 nt, Pseudomonas putida KT2440
cuggaauucgcugcgcaucacc

SEQ ID NO: 1637673 - RNA, 23 nt, Pseudomonas putida KT2440
cuggacaccucccgcgcauccuc

SEQ ID NO: 1637674 - RNA, 21 nt, Pseudomonas putida KT2440
cuggacccaaucgcugugcaa

SEQ ID NO: 1637675 - RNA, 14 nt, Pseudomonas putida KT2440
cugcuuugcagccc

SEQ ID NO: 1637676 - RNA, 22 nt, Pseudomonas putida KT2440
cugcugcuccccaaccaccucc

SEQ ID NO: 1637677 - RNA, 21 nt, Pseudomonas putida KT2440
cugcugcggauacagcgccca

SEQ ID NO: 1637678 - RNA, 17 nt, Pseudomonas putida KT2440
cugcugcuggcacgccu

SEQ ID NO: 1637679 - RNA, 19 nt, Pseudomonas putida KT2440
cugcugcuggcacgccuuc

SEQ ID NO: 1637680 - RNA, 14 nt, Pseudomonas putida KT2440
cugcugcuggccgc

SEQ ID NO: 1637681 - RNA, 16 nt, Pseudomonas putida KT2440
cugcugcuggccgcca

SEQ ID NO: 1637682 - RNA, 17 nt, Pseudomonas putida KT2440
cugcugcuggccgccag

SEQ ID NO: 1637683 - RNA, 15 nt, Pseudomonas putida KT2440
cugcuggccaauuuc

SEQ ID NO: 1637684 - RNA, 20 nt, Pseudomonas putida KT2440
cugcuggccgccagacaacu

SEQ ID NO: 1637685 - RNA, 21 nt, Pseudomonas putida KT2440
cugcuucagcucgaacccacu

SEQ ID NO: 1637686 - RNA, 21 nt, Pseudomonas putida KT2440
cugcuucaugaagucagccag

SEQ ID NO: 1637687 - RNA, 15 nt, Pseudomonas putida KT2440
cugcuuuaucuccaa

SEQ ID NO: 1637688 - RNA, 21 nt, Pseudomonas putida KT2440
cugcaauaacgccguuucagc

SEQ ID NO: 1637689 - RNA, 19 nt, Pseudomonas putida KT2440
cugcaacugcccacccaac

SEQ ID NO: 1637690 - RNA, 18 nt, Pseudomonas putida KT2440
cugcaagcgaugcacgcc

SEQ ID NO: 1637691 - RNA, 21 nt, Pseudomonas putida KT2440
cugcaagcgaugcacgccagc

SEQ ID NO: 1637692 - RNA, 16 nt, Pseudomonas putida KT2440
cugcaaacgcaggugc

SEQ ID NO: 1637693 - RNA, 13 nt, Pseudomonas putida KT2440
cugcaaagcagcc

SEQ ID NO: 1637694 - RNA, 14 nt, Pseudomonas putida KT2440
cugcaaagcagccc

SEQ ID NO: 1637695 - RNA, 15 nt, Pseudomonas putida KT2440
cugcaaagcagcccc

SEQ ID NO: 1637696 - RNA, 21 nt, Pseudomonas putida KT2440
cugcaaagcagccccagggcc

SEQ ID NO: 1637697 - RNA, 16 nt, Pseudomonas putida KT2440
cugcaaagcagccccc

SEQ ID NO: 1637698 - RNA, 17 nt, Pseudomonas putida KT2440
cugcaaagcagccccgg

SEQ ID NO: 1637699 - RNA, 22 nt, Pseudomonas putida KT2440
cugaucugaaaguucagcgccu

SEQ ID NO: 1637700 - RNA, 15 nt, Pseudomonas putida KT2440
cugaugcaccaggcc

SEQ ID NO: 1637701 - RNA, 18 nt, Pseudomonas putida KT2440
cugaugcaccaggcccag

SEQ ID NO: 1637702 - RNA, 20 nt, Pseudomonas putida KT2440
cugaugcagcagugccagca

SEQ ID NO: 1637703 - RNA, 16 nt, Pseudomonas putida KT2440
cugaugcgagcuaccu

SEQ ID NO: 1637704 - RNA, 15 nt, Pseudomonas putida KT2440
cugaugcgcuggccc

SEQ ID NO: 1637705 - RNA, 17 nt, Pseudomonas putida KT2440
cugaugcccaaacgcca

SEQ ID NO: 1637706 - RNA, 13 nt, Pseudomonas putida KT2440
cugauugagcagc

SEQ ID NO: 1637707 - RNA, 16 nt, Pseudomonas putida KT2440
cugaucgaaagcugcg

SEQ ID NO: 1637708 - RNA, 20 nt, Pseudomonas putida KT2440
cugaucgggauuacaugaug

SEQ ID NO: 1637709 - RNA, 14 nt, Pseudomonas putida KT2440
cugaucgccuccag

SEQ ID NO: 1637710 - RNA, 21 nt, Pseudomonas putida KT2440
cugaucaauccucugcccgca

SEQ ID NO: 1637711 - RNA, 17 nt, Pseudomonas putida KT2440
cugaucaauucagcaca

SEQ ID NO: 1637712 - RNA, 21 nt, Pseudomonas putida KT2440
cugaucaagcccgcucgccac

SEQ ID NO: 1637713 - RNA, 12 nt, Pseudomonas putida KT2440
cugaucagcuuc

SEQ ID NO: 1637714 - RNA, 16 nt, Pseudomonas putida KT2440
cugauccgccuggccc

SEQ ID NO: 1637715 - RNA, 13 nt, Pseudomonas putida KT2440
cugagccaguuca

SEQ ID NO: 1637716 - RNA, 21 nt, Pseudomonas putida KT2440
cugaguuacagguuguaaaca

SEQ ID NO: 1637717 - RNA, 11 nt, Pseudomonas putida KT2440
cugagucuggc

SEQ ID NO: 1637718 - RNA, 12 nt, Pseudomonas putida KT2440
cugaagcucucc

SEQ ID NO: 1637719 - RNA, 13 nt, Pseudomonas putida KT2440
cugaagcucucca

SEQ ID NO: 1637720 - RNA, 15 nt, Pseudomonas putida KT2440
cugaagcucuccagc

SEQ ID NO: 1637721 - RNA, 16 nt, Pseudomonas putida KT2440
cugaagcucuccagca

SEQ ID NO: 1637722 - RNA, 19 nt, Pseudomonas putida KT2440
cugaagcucuccagcaggu

SEQ ID NO: 1637723 - RNA, 22 nt, Pseudomonas putida KT2440
cugaagcccuggaugacacgga

SEQ ID NO: 1637724 - RNA, 23 nt, Pseudomonas putida KT2440
cugaagcgcgggucuuccaccac

SEQ ID NO: 1637725 - RNA, 15 nt, Pseudomonas putida KT2440
cugacaaagccugca

SEQ ID NO: 1637726 - RNA, 21 nt, Pseudomonas putida KT2440
cugacacauaggcagccaccu

SEQ ID NO: 1637727 - RNA, 13 nt, Pseudomonas putida KT2440
cugaccagguaaa

SEQ ID NO: 1637728 - RNA, 21 nt, Pseudomonas putida KT2440
cugaccagugucugcaacugc

SEQ ID NO: 1637729 - RNA, 23 nt, Pseudomonas putida KT2440
cugaccaguugcucgcagacuuc

SEQ ID NO: 1637730 - RNA, 20 nt, Pseudomonas putida KT2440
cugaccacgccgaagcgcgc

SEQ ID NO: 1637731 - RNA, 18 nt, Pseudomonas putida KT2440
cugaccaauccagcccuc

SEQ ID NO: 1637732 - RNA, 14 nt, Pseudomonas putida KT2440
cugacccgcgccuc

SEQ ID NO: 1637733 - RNA, 11 nt, Pseudomonas putida KT2440
cugaccccacc

SEQ ID NO: 1637734 - RNA, 20 nt, Pseudomonas putida KT2440
cugaccccacccuugaagac

SEQ ID NO: 1637735 - RNA, 17 nt, Pseudomonas putida KT2440
cugaccucgacccgccc

SEQ ID NO: 1637736 - RNA, 19 nt, Pseudomonas putida KT2440
cugaccucgacccgcccgc

SEQ ID NO: 1637737 - RNA, 15 nt, Pseudomonas putida KT2440
cugaccugugcugaa

SEQ ID NO: 1637738 - RNA, 22 nt, Pseudomonas putida KT2440
cugaccugugcugaauuuucuu

SEQ ID NO: 1637739 - RNA, 20 nt, Pseudomonas putida KT2440
cugacgcugcacuuccacac

SEQ ID NO: 1637740 - RNA, 23 nt, Pseudomonas putida KT2440
cugacgcggauagcgcgccaaag

SEQ ID NO: 1637741 - RNA, 20 nt, Pseudomonas putida KT2440
cugacgaagcgccuggagag

SEQ ID NO: 1637742 - RNA, 18 nt, Pseudomonas putida KT2440
cugacguugucauggcua

SEQ ID NO: 1637743 - RNA, 19 nt, Pseudomonas putida KT2440
cugacggcgcugcuggccu

SEQ ID NO: 1637744 - RNA, 16 nt, Pseudomonas putida KT2440
cugacucgaccgccgc

SEQ ID NO: 1637745 - RNA, 14 nt, Pseudomonas putida KT2440
cugacugccaggcc

SEQ ID NO: 1637746 - RNA, 13 nt, Pseudomonas putida KT2440
cugagcagaccag

SEQ ID NO: 1637747 - RNA, 17 nt, Pseudomonas putida KT2440
cugagcagaccagccgg

SEQ ID NO: 1637748 - RNA, 16 nt, Pseudomonas putida KT2440
cugagcaagaacgcua

SEQ ID NO: 1637749 - RNA, 21 nt, Pseudomonas putida KT2440
cugagcaagcgcgcgcccacc

SEQ ID NO: 1637750 - RNA, 18 nt, Pseudomonas putida KT2440
cugaaaacaacccgauuu

SEQ ID NO: 1637751 - RNA, 13 nt, Pseudomonas putida KT2440
cugaaacaucagc

SEQ ID NO: 1637752 - RNA, 15 nt, Pseudomonas putida KT2440
cugaaacgcccuugu

SEQ ID NO: 1637753 - RNA, 18 nt, Pseudomonas putida KT2440
cucuuucaggcacagcac

SEQ ID NO: 1637754 - RNA, 19 nt, Pseudomonas putida KT2440
cugaagaagcuaccccaca

SEQ ID NO: 1637755 - RNA, 16 nt, Pseudomonas putida KT2440
cugaacgaugcccggg

SEQ ID NO: 1637756 - RNA, 16 nt, Pseudomonas putida KT2440
cugaacgcugcgcggg

SEQ ID NO: 1637757 - RNA, 21 nt, Pseudomonas putida KT2440
cugaacggugaagucaaccaa

SEQ ID NO: 1637758 - RNA, 18 nt, Pseudomonas putida KT2440
cugaacuucaaccgcacc

SEQ ID NO: 1637759 - RNA, 14 nt, Pseudomonas putida KT2440
cugaacuuccaggu

SEQ ID NO: 1637760 - RNA, 19 nt, Pseudomonas putida KT2440
cugaacaaggccuggccca

SEQ ID NO: 1637761 - RNA, 21 nt, Pseudomonas putida KT2440
cugaacaaggccuggcccagu

SEQ ID NO: 1637762 - RNA, 16 nt, Pseudomonas putida KT2440
cugaacaccugccagc

SEQ ID NO: 1637763 - RNA, 17 nt, Pseudomonas putida KT2440
cugaacaccugccagcc

SEQ ID NO: 1637764 - RNA, 17 nt, Pseudomonas putida KT2440
cugaacagcuucaacaa

SEQ ID NO: 1637765 - RNA, 15 nt, Pseudomonas putida KT2440
cugaaccaccagugg

SEQ ID NO: 1637766 - RNA, 19 nt, Pseudomonas putida KT2440
cugaaccaugcgccgcugc

SEQ ID NO: 1637767 - RNA, 15 nt, Pseudomonas putida KT2440
cugaaaucuuugcuu

SEQ ID NO: 1637768 - RNA, 22 nt, Pseudomonas putida KT2440
cugaaauggcggcccagccagu

SEQ ID NO: 1637769 - RNA, 18 nt, Pseudomonas putida KT2440
cucuucacggcuaaagcc

SEQ ID NO: 1637770 - RNA, 19 nt, Pseudomonas putida KT2440
cucuucaccaugggccugg

SEQ ID NO: 1637771 - RNA, 22 nt, Pseudomonas putida KT2440
cucuucaccaugggccuggaug

SEQ ID NO: 1637772 - RNA, 15 nt, Pseudomonas putida KT2440
cucuggucaccuucg

SEQ ID NO: 1637773 - RNA, 16 nt, Pseudomonas putida KT2440
cucugguacaacaaca

SEQ ID NO: 1637774 - RNA, 19 nt, Pseudomonas putida KT2440
cucugcugcucugccgccg

SEQ ID NO: 1637775 - RNA, 17 nt, Pseudomonas putida KT2440
cucuucccaccaccagc

SEQ ID NO: 1637776 - RNA, 22 nt, Pseudomonas putida KT2440
cucuuccccgcccaagcggcag

SEQ ID NO: 1637777 - RNA, 14 nt, Pseudomonas putida KT2440
cucuuccagcucgc

SEQ ID NO: 1637778 - RNA, 18 nt, Pseudomonas putida KT2440
cucuucgcagcacaaggc

SEQ ID NO: 1637779 - RNA, 15 nt, Pseudomonas putida KT2440
cucuuccuggcuggc

SEQ ID NO: 1637780 - RNA, 16 nt, Pseudomonas putida KT2440
cucuuccuggcuggca

SEQ ID NO: 1637781 - RNA, 23 nt, Pseudomonas putida KT2440
cucuuccuugaucuucaugaagu

SEQ ID NO: 1637782 - RNA, 23 nt, Pseudomonas putida KT2440
cucuuccuccaucucgugguuga

SEQ ID NO: 1637783 - RNA, 20 nt, Pseudomonas putida KT2440
cucuucgcgggcacgcccgc

SEQ ID NO: 1637784 - RNA, 23 nt, Pseudomonas putida KT2440
cucuucgcgggcucgcccacucc

SEQ ID NO: 1637785 - RNA, 18 nt, Pseudomonas putida KT2440
cucuucgcggguaaaccc

SEQ ID NO: 1637786 - RNA, 14 nt, Pseudomonas putida KT2440
cucuucguucuuga

SEQ ID NO: 1637787 - RNA, 20 nt, Pseudomonas putida KT2440
cucuucugccaguugcuucu

SEQ ID NO: 1637788 - RNA, 22 nt, Pseudomonas putida KT2440
cucuucugccaguugcuucugc

SEQ ID NO: 1637789 - RNA, 12 nt, Pseudomonas putida KT2440
cucuugaggucg

SEQ ID NO: 1637790 - RNA, 14 nt, Pseudomonas putida KT2440
cucuucuuucaggu

SEQ ID NO: 1637791 - RNA, 17 nt, Pseudomonas putida KT2440
cucuugaacugggcauc

SEQ ID NO: 1637792 - RNA, 20 nt, Pseudomonas putida KT2440
cucuugcuuguuauggcacu

SEQ ID NO: 1637793 - RNA, 17 nt, Pseudomonas putida KT2440
cucuugucgacagugaa

SEQ ID NO: 1637794 - RNA, 11 nt, Pseudomonas putida KT2440
aaaaaaaaggg

SEQ ID NO: 1637795 - RNA, 14 nt, Pseudomonas putida KT2440
aaaaaagggcaccu

SEQ ID NO: 1637796 - RNA, 14 nt, Pseudomonas putida KT2440
aaaaaagggcaucu

SEQ ID NO: 1637797 - RNA, 22 nt, Pseudomonas putida KT2440
aaaaacagugccgucagaaaga

SEQ ID NO: 1637798 - RNA, 21 nt, Pseudomonas putida KT2440
aaaaacccggcgcaagccggg

SEQ ID NO: 1637799 - RNA, 24 nt, Pseudomonas putida KT2440
aaaaaucaugcaguucuaccagca

SEQ ID NO: 1637800 - RNA, 20 nt, Pseudomonas putida KT2440
aaaacauugcuaauuucagg

SEQ ID NO: 1637801 - RNA, 23 nt, Pseudomonas putida KT2440
aaaacgguuguuucagccuuggc

SEQ ID NO: 1637802 - RNA, 16 nt, Pseudomonas putida KT2440
aaaacuaauauuugaa

SEQ ID NO: 1637803 - RNA, 16 nt, Pseudomonas putida KT2440
aaaacuggccagcagc

SEQ ID NO: 1637804 - RNA, 13 nt, Pseudomonas putida KT2440
aaacaacaauagg

SEQ ID NO: 1637805 - RNA, 23 nt, Pseudomonas putida KT2440
aaaaugcccgcuguugagcagca

SEQ ID NO: 1637806 - RNA, 20 nt, Pseudomonas putida KT2440
aaaugcgcccugcugccgca

SEQ ID NO: 1637807 - RNA, 18 nt, Pseudomonas putida KT2440
aaaugaacggcuguuccu

SEQ ID NO: 1637808 - RNA, 15 nt, Pseudomonas putida KT2440
aaaucaugcgcuggc

SEQ ID NO: 1637809 - RNA, 14 nt, Pseudomonas putida KT2440
aaauucaaugaguu

SEQ ID NO: 1637810 - RNA, 22 nt, Pseudomonas putida KT2440
aaauucgaccagcagugucagc

SEQ ID NO: 1637811 - RNA, 15 nt, Pseudomonas putida KT2440
aaaguccugcaaagg

SEQ ID NO: 1637812 - RNA, 14 nt, Pseudomonas putida KT2440
aaauaaucagaauu

SEQ ID NO: 1637813 - RNA, 17 nt, Pseudomonas putida KT2440
aaaucaguaaagauuag

SEQ ID NO: 1637814 - RNA, 18 nt, Pseudomonas putida KT2440
aaaucagcuguuugaagc

SEQ ID NO: 1637815 - RNA, 14 nt, Pseudomonas putida KT2440
aaagggcaccucca

SEQ ID NO: 1637816 - RNA, 19 nt, Pseudomonas putida KT2440
aaagggccagcacaaccac

SEQ ID NO: 1637817 - RNA, 15 nt, Pseudomonas putida KT2440
aaagggccgggccug

SEQ ID NO: 1637818 - RNA, 13 nt, Pseudomonas putida KT2440
aaagcccaguuca

SEQ ID NO: 1637819 - RNA, 19 nt, Pseudomonas putida KT2440
aaagcccauaaaccccagc

SEQ ID NO: 1637820 - RNA, 14 nt, Pseudomonas putida KT2440
aaagccccggcagc

SEQ ID NO: 1637821 - RNA, 22 nt, Pseudomonas putida KT2440
aaagcccgugccgcaucagccg

SEQ ID NO: 1637822 - RNA, 21 nt, Pseudomonas putida KT2440
aaagcugcgcacauugacguc

SEQ ID NO: 1637823 - RNA, 19 nt, Pseudomonas putida KT2440
aaagcugucgcagucgaag

SEQ ID NO: 1637824 - RNA, 17 nt, Pseudomonas putida KT2440
aaagauaccccugcgcc

SEQ ID NO: 1637825 - RNA, 11 nt, Pseudomonas putida KT2440
aaagcauuucg

SEQ ID NO: 1637826 - RNA, 13 nt, Pseudomonas putida KT2440
aaagccaacugcu

SEQ ID NO: 1637827 - RNA, 16 nt, Pseudomonas putida KT2440
aaagccagcagccugu

SEQ ID NO: 1637828 - RNA, 12 nt, Pseudomonas putida KT2440
aaagccagcagu

SEQ ID NO: 1637829 - RNA, 22 nt, Pseudomonas putida KT2440
aaagccagcguaagcuggcuuu

SEQ ID NO: 1637830 - RNA, 12 nt, Pseudomonas putida KT2440
aaagccagcagc

SEQ ID NO: 1637831 - RNA, 22 nt, Pseudomonas putida KT2440
aaagccauaccgcaucccaaug

SEQ ID NO: 1637832 - RNA, 13 nt, Pseudomonas putida KT2440
aaagacugcuccg

SEQ ID NO: 1637833 - RNA, 16 nt, Pseudomonas putida KT2440
aaagagaagcugcagc

SEQ ID NO: 1637834 - RNA, 16 nt, Pseudomonas putida KT2440
aaacucccccccaauc

SEQ ID NO: 1637835 - RNA, 14 nt, Pseudomonas putida KT2440
aaacuccuugagau

SEQ ID NO: 1637836 - RNA, 13 nt, Pseudomonas putida KT2440
aaacucugcaggu

SEQ ID NO: 1637837 - RNA, 15 nt, Pseudomonas putida KT2440
aaacuaauauuugaa

SEQ ID NO: 1637838 - RNA, 16 nt, Pseudomonas putida KT2440
aaacuaauauuugaac

SEQ ID NO: 1637839 - RNA, 20 nt, Pseudomonas putida KT2440
aaacuaauauuugaacaccu

SEQ ID NO: 1637840 - RNA, 17 nt, Pseudomonas putida KT2440
aaacuaccucaagguag

SEQ ID NO: 1637841 - RNA, 22 nt, Pseudomonas putida KT2440
aaacgcggaucgugacggucug

SEQ ID NO: 1637842 - RNA, 22 nt, Pseudomonas putida KT2440
aaacggcggcccggccaacaac

SEQ ID NO: 1637843 - RNA, 19 nt, Pseudomonas putida KT2440
aaacgucggcagccaugcu

SEQ ID NO: 1637844 - RNA, 15 nt, Pseudomonas putida KT2440
aaacgaaacccugcu

SEQ ID NO: 1637845 - RNA, 23 nt, Pseudomonas putida KT2440
aaacgcaggugcgcacgcugccc

SEQ ID NO: 1637846 - RNA, 16 nt, Pseudomonas putida KT2440
auuuccgggcaaugca

SEQ ID NO: 1637847 - RNA, 16 nt, Pseudomonas putida KT2440
auuucaccggcuucua

SEQ ID NO: 1637848 - RNA, 16 nt, Pseudomonas putida KT2440
auuucagguuucgggc

SEQ ID NO: 1637849 - RNA, 13 nt, Pseudomonas putida KT2440
auuucguggguca

SEQ ID NO: 1637850 - RNA, 14 nt, Pseudomonas putida KT2440
auuucgucaccgau

SEQ ID NO: 1637851 - RNA, 14 nt, Pseudomonas putida KT2440
auuucguccaggcu

SEQ ID NO: 1637852 - RNA, 15 nt, Pseudomonas putida KT2440
auuucguccaggcuc

SEQ ID NO: 1637853 - RNA, 20 nt, Pseudomonas putida KT2440
auuucuugaggcacaaaaaa

SEQ ID NO: 1637854 - RNA, 13 nt, Pseudomonas putida KT2440
caaaaaaucgggu

SEQ ID NO: 1637855 - RNA, 16 nt, Pseudomonas putida KT2440
auuguucccacaggga

SEQ ID NO: 1637856 - RNA, 14 nt, Pseudomonas putida KT2440
auuguggccggcgc

SEQ ID NO: 1637857 - RNA, 22 nt, Pseudomonas putida KT2440
auugccaacagcaguugcugcu

SEQ ID NO: 1637858 - RNA, 20 nt, Pseudomonas putida KT2440
auugccagggugccagacca

SEQ ID NO: 1637859 - RNA, 19 nt, Pseudomonas putida KT2440
auugcccaacucugccgga

SEQ ID NO: 1637860 - RNA, 15 nt, Pseudomonas putida KT2440
auugcccgacaagcc

SEQ ID NO: 1637861 - RNA, 16 nt, Pseudomonas putida KT2440
auugcccagccugccc

SEQ ID NO: 1637862 - RNA, 17 nt, Pseudomonas putida KT2440
auugcguaccccaccgc

SEQ ID NO: 1637863 - RNA, 16 nt, Pseudomonas putida KT2440
auugcgggcuuucugg

SEQ ID NO: 1637864 - RNA, 18 nt, Pseudomonas putida KT2440
auugcgggcuuucugguu

SEQ ID NO: 1637865 - RNA, 20 nt, Pseudomonas putida KT2440
auugcugccgaccugcgccg

SEQ ID NO: 1637866 - RNA, 20 nt, Pseudomonas putida KT2440
auugccggucgggcaaggcc

SEQ ID NO: 1637867 - RNA, 14 nt, Pseudomonas putida KT2440
auugcggacucaua

SEQ ID NO: 1637868 - RNA, 22 nt, Pseudomonas putida KT2440
auugaucugcuggauacccagc

SEQ ID NO: 1637869 - RNA, 14 nt, Pseudomonas putida KT2440
auugcagccccaau

SEQ ID NO: 1637870 - RNA, 15 nt, Pseudomonas putida KT2440
auugcagggcggccu

SEQ ID NO: 1637871 - RNA, 18 nt, Pseudomonas putida KT2440
auugcaggaacaaccuga

SEQ ID NO: 1637872 - RNA, 18 nt, Pseudomonas putida KT2440
auugcaccacccccagcg

SEQ ID NO: 1637873 - RNA, 19 nt, Pseudomonas putida KT2440
auucuucuggcuuucuggc

SEQ ID NO: 1637874 - RNA, 15 nt, Pseudomonas putida KT2440
auucugccagcuccu

SEQ ID NO: 1637875 - RNA, 15 nt, Pseudomonas putida KT2440
auucucggcugccug

SEQ ID NO: 1637876 - RNA, 17 nt, Pseudomonas putida KT2440
auuccuugcagcgccgc

SEQ ID NO: 1637877 - RNA, 20 nt, Pseudomonas putida KT2440
auuccuugcagcucuugucg

SEQ ID NO: 1637878 - RNA, 21 nt, Pseudomonas putida KT2440
auuccauucggugcagcggca

SEQ ID NO: 1637879 - RNA, 22 nt, Pseudomonas putida KT2440
auuccauucggugcagcggcag

SEQ ID NO: 1637880 - RNA, 18 nt, Pseudomonas putida KT2440
auuccaaugagaauaauu

SEQ ID NO: 1637881 - RNA, 15 nt, Pseudomonas putida KT2440
auuagaaaauggcuu

SEQ ID NO: 1637882 - RNA, 18 nt, Pseudomonas putida KT2440
aaaagccccgccagugca

SEQ ID NO: 1637883 - RNA, 16 nt, Pseudomonas putida KT2440
auuacaugaugaagua

SEQ ID NO: 1637884 - RNA, 16 nt, Pseudomonas putida KT2440
auuacaggcagaucga

SEQ ID NO: 1637885 - RNA, 12 nt, Pseudomonas putida KT2440
auuacuccagaa

SEQ ID NO: 1637886 - RNA, 21 nt, Pseudomonas putida KT2440
auucaaagccugcuccagcac

SEQ ID NO: 1637887 - RNA, 18 nt, Pseudomonas putida KT2440
auuaucgagcuacagccc

SEQ ID NO: 1637888 - RNA, 12 nt, Pseudomonas putida KT2440
auguugaucagg

SEQ ID NO: 1637889 - RNA, 13 nt, Pseudomonas putida KT2440
auguucuugaccu

SEQ ID NO: 1637890 - RNA, 15 nt, Pseudomonas putida KT2440
augugcgugaacacu

SEQ ID NO: 1637891 - RNA, 16 nt, Pseudomonas putida KT2440
augugccuggcccggc

SEQ ID NO: 1637892 - RNA, 13 nt, Pseudomonas putida KT2440
augugcucggccu

SEQ ID NO: 1637893 - RNA, 15 nt, Pseudomonas putida KT2440
augucuggcaucaau

SEQ ID NO: 1637894 - RNA, 15 nt, Pseudomonas putida KT2440
augucuuccagacca

SEQ ID NO: 1637895 - RNA, 20 nt, Pseudomonas putida KT2440
augucuuucgcguacugcau

SEQ ID NO: 1637896 - RNA, 13 nt, Pseudomonas putida KT2440
augugcacacgca

SEQ ID NO: 1637897 - RNA, 22 nt, Pseudomonas putida KT2440
augucguaguaacggcggaugu

SEQ ID NO: 1637898 - RNA, 21 nt, Pseudomonas putida KT2440
augucguugaugaucugcucc

SEQ ID NO: 1637899 - RNA, 19 nt, Pseudomonas putida KT2440
augucgaauacaccgccgc

SEQ ID NO: 1637900 - RNA, 23 nt, Pseudomonas putida KT2440
augucgacguacagcagcucacu

SEQ ID NO: 1637901 - RNA, 12 nt, Pseudomonas putida KT2440
augguugaagau

SEQ ID NO: 1637902 - RNA, 15 nt, Pseudomonas putida KT2440
augguugacagcgcu

SEQ ID NO: 1637903 - RNA, 12 nt, Pseudomonas putida KT2440
augguggucagc

SEQ ID NO: 1637904 - RNA, 20 nt, Pseudomonas putida KT2440
augguguagucggugguguc

SEQ ID NO: 1637905 - RNA, 16 nt, Pseudomonas putida KT2440
auggugucuuccaggu

SEQ ID NO: 1637906 - RNA, 17 nt, Pseudomonas putida KT2440
augguguucaugcccac

SEQ ID NO: 1637907 - RNA, 17 nt, Pseudomonas putida KT2440
auggugcacgccagcca

SEQ ID NO: 1637908 - RNA, 16 nt, Pseudomonas putida KT2440
auggugaaggccagga

SEQ ID NO: 1637909 - RNA, 15 nt, Pseudomonas putida KT2440
auggugacugccagc

SEQ ID NO: 1637910 - RNA, 16 nt, Pseudomonas putida KT2440
auggugacugccagca

SEQ ID NO: 1637911 - RNA, 17 nt, Pseudomonas putida KT2440
auggcugcggcagguag

SEQ ID NO: 1637912 - RNA, 12 nt, Pseudomonas putida KT2440
auggcugaaauc

SEQ ID NO: 1637913 - RNA, 20 nt, Pseudomonas putida KT2440
augggcguaauacugcuucc

SEQ ID NO: 1637914 - RNA, 22 nt, Pseudomonas putida KT2440
augggcguaauacugcuuccag

SEQ ID NO: 1637915 - RNA, 15 nt, Pseudomonas putida KT2440
augggcugcaaagca

SEQ ID NO: 1637916 - RNA, 16 nt, Pseudomonas putida KT2440
augggcugcaaagcag

SEQ ID NO: 1637917 - RNA, 21 nt, Pseudomonas putida KT2440
augggcuuuucguuggccagc

SEQ ID NO: 1637918 - RNA, 17 nt, Pseudomonas putida KT2440
auggccgcccugcggcu

SEQ ID NO: 1637919 - RNA, 23 nt, Pseudomonas putida KT2440
auggccgagcugauccgccuggc

SEQ ID NO: 1637920 - RNA, 18 nt, Pseudomonas putida KT2440
auggccgaaaccagcccc

SEQ ID NO: 1637921 - RNA, 22 nt, Pseudomonas putida KT2440
auggcuagggucguccugggua

SEQ ID NO: 1637922 - RNA, 19 nt, Pseudomonas putida KT2440
auggcucacacccaggcuc

SEQ ID NO: 1637923 - RNA, 16 nt, Pseudomonas putida KT2440
auggcgugcccggcaa

SEQ ID NO: 1637924 - RNA, 17 nt, Pseudomonas putida KT2440
auggcguuguccagcag

SEQ ID NO: 1637925 - RNA, 19 nt, Pseudomonas putida KT2440
auggaagcuguggggcuga

SEQ ID NO: 1637926 - RNA, 17 nt, Pseudomonas putida KT2440
auggaaggcaaagauuu

SEQ ID NO: 1637927 - RNA, 13 nt, Pseudomonas putida KT2440
auggauagcaaag

SEQ ID NO: 1637928 - RNA, 15 nt, Pseudomonas putida KT2440
auggcagacaagucc

SEQ ID NO: 1637929 - RNA, 17 nt, Pseudomonas putida KT2440
auggacgccacguccuu

SEQ ID NO: 1637930 - RNA, 13 nt, Pseudomonas putida KT2440
augcuuuccaggu

SEQ ID NO: 1637931 - RNA, 14 nt, Pseudomonas putida KT2440
augcuuucaguuga

SEQ ID NO: 1637932 - RNA, 13 nt, Pseudomonas putida KT2440
augcugugcccug

SEQ ID NO: 1637933 - RNA, 20 nt, Pseudomonas putida KT2440
augcuguuggcggggggaga

SEQ ID NO: 1637934 - RNA, 22 nt, Pseudomonas putida KT2440
augcgcguauccuugcccacca

SEQ ID NO: 1637935 - RNA, 23 nt, Pseudomonas putida KT2440
augcgcguauccuugcccaccag

SEQ ID NO: 1637936 - RNA, 18 nt, Pseudomonas putida KT2440
augcgcgcugcaaucacc

SEQ ID NO: 1637937 - RNA, 13 nt, Pseudomonas putida KT2440
augcucggccagc

SEQ ID NO: 1637938 - RNA, 19 nt, Pseudomonas putida KT2440
augcugccuccgccaagca

SEQ ID NO: 1637939 - RNA, 18 nt, Pseudomonas putida KT2440
augcugcgccccagguug

SEQ ID NO: 1637940 - RNA, 16 nt, Pseudomonas putida KT2440
augcugcugcagcacu

SEQ ID NO: 1637941 - RNA, 18 nt, Pseudomonas putida KT2440
augcucugcgcaaaggcu

SEQ ID NO: 1637942 - RNA, 22 nt, Pseudomonas putida KT2440
augcucugcgcaaaggcuuugg

SEQ ID NO: 1637943 - RNA, 15 nt, Pseudomonas putida KT2440
augcugccaggcaaa

SEQ ID NO: 1637944 - RNA, 20 nt, Pseudomonas putida KT2440
augcugcagaaccgccagca

SEQ ID NO: 1637945 - RNA, 20 nt, Pseudomonas putida KT2440
augcugcagauugcaucacu

SEQ ID NO: 1637946 - RNA, 16 nt, Pseudomonas putida KT2440
augcagccagccucuu

SEQ ID NO: 1637947 - RNA, 14 nt, Pseudomonas putida KT2440
augccaagcccaca

SEQ ID NO: 1637948 - RNA, 18 nt, Pseudomonas putida KT2440
augccaacuuccaucgaa

SEQ ID NO: 1637949 - RNA, 15 nt, Pseudomonas putida KT2440
augcacagcgcucga

SEQ ID NO: 1637950 - RNA, 22 nt, Pseudomonas putida KT2440
augcacagcucgcgcugccagg

SEQ ID NO: 1637951 - RNA, 21 nt, Pseudomonas putida KT2440
augcacauuccgcacgucaga

SEQ ID NO: 1637952 - RNA, 21 nt, Pseudomonas putida KT2440
augcaccacgcgcaaaugcuu

SEQ ID NO: 1637953 - RNA, 17 nt, Pseudomonas putida KT2440
augcagcagugccagca

SEQ ID NO: 1637954 - RNA, 18 nt, Pseudomonas putida KT2440
augcagcagugccagcaa

SEQ ID NO: 1637955 - RNA, 20 nt, Pseudomonas putida KT2440
augcagcagugccagcaaca

SEQ ID NO: 1637956 - RNA, 22 nt, Pseudomonas putida KT2440
augcagauggggggauuugagg

SEQ ID NO: 1637957 - RNA, 23 nt, Pseudomonas putida KT2440
augccgagggugaggugcugcag

SEQ ID NO: 1637958 - RNA, 18 nt, Pseudomonas putida KT2440
augccgccauccucggcc

SEQ ID NO: 1637959 - RNA, 19 nt, Pseudomonas putida KT2440
augccgcccaucaccggca

SEQ ID NO: 1637960 - RNA, 20 nt, Pseudomonas putida KT2440
augccgcccaucaccggcac

SEQ ID NO: 1637961 - RNA, 19 nt, Pseudomonas putida KT2440
augccauugaucaccucca

SEQ ID NO: 1637962 - RNA, 16 nt, Pseudomonas putida KT2440
augccaccgccacuga

SEQ ID NO: 1637963 - RNA, 15 nt, Pseudomonas putida KT2440
augccaguugaucac

SEQ ID NO: 1637964 - RNA, 23 nt, Pseudomonas putida KT2440
augcgccagggcugauugagcag

SEQ ID NO: 1637965 - RNA, 16 nt, Pseudomonas putida KT2440
augcgccccacuucca

SEQ ID NO: 1637966 - RNA, 22 nt, Pseudomonas putida KT2440
augcgcccggccaggucacggu

SEQ ID NO: 1637967 - RNA, 21 nt, Pseudomonas putida KT2440
augcgcccuggcggccacggc

SEQ ID NO: 1637968 - RNA, 19 nt, Pseudomonas putida KT2440
augcgccaguacgccagca

SEQ ID NO: 1637969 - RNA, 15 nt, Pseudomonas putida KT2440
augcgcgcagcgaac

SEQ ID NO: 1637970 - RNA, 16 nt, Pseudomonas putida KT2440
augcgccuggcccgca

SEQ ID NO: 1637971 - RNA, 20 nt, Pseudomonas putida KT2440
augcgccgucgccucccccu

SEQ ID NO: 1637972 - RNA, 18 nt, Pseudomonas putida KT2440
augcgccgcaccaaagaa

SEQ ID NO: 1637973 - RNA, 16 nt, Pseudomonas putida KT2440
augcgagcuaccugac

SEQ ID NO: 1637974 - RNA, 13 nt, Pseudomonas putida KT2440
augccugcacugg

SEQ ID NO: 1637975 - RNA, 12 nt, Pseudomonas putida KT2440
augccuucggug

SEQ ID NO: 1637976 - RNA, 16 nt, Pseudomonas putida KT2440
augccgcguuccuuuc

SEQ ID NO: 1637977 - RNA, 19 nt, Pseudomonas putida KT2440
augccgcguuccuuucuca

SEQ ID NO: 1637978 - RNA, 16 nt, Pseudomonas putida KT2440
augccgccgcugccag

SEQ ID NO: 1637979 - RNA, 17 nt, Pseudomonas putida KT2440
augccgccgcugccagc

SEQ ID NO: 1637980 - RNA, 12 nt, Pseudomonas putida KT2440
augccgcgcacu

SEQ ID NO: 1637981 - RNA, 15 nt, Pseudomonas putida KT2440
augccucggcaaagc

SEQ ID NO: 1637982 - RNA, 17 nt, Pseudomonas putida KT2440
augaugaccaccaggaa

SEQ ID NO: 1637983 - RNA, 18 nt, Pseudomonas putida KT2440
augaugaucaauaucauc

SEQ ID NO: 1637984 - RNA, 19 nt, Pseudomonas putida KT2440
augaugaucaauaucauca

SEQ ID NO: 1637985 - RNA, 14 nt, Pseudomonas putida KT2440
augauguggcuggu

SEQ ID NO: 1637986 - RNA, 13 nt, Pseudomonas putida KT2440
augauuucagggu

SEQ ID NO: 1637987 - RNA, 17 nt, Pseudomonas putida KT2440
augcaaccgaugcccag

SEQ ID NO: 1637988 - RNA, 21 nt, Pseudomonas putida KT2440
augcaaguaaucuggggcgcu

SEQ ID NO: 1637989 - RNA, 12 nt, Pseudomonas putida KT2440
augcaagcagcc

SEQ ID NO: 1637990 - RNA, 12 nt, Pseudomonas putida KT2440
caauuccaauga

SEQ ID NO: 1637991 - RNA, 18 nt, Pseudomonas putida KT2440
caauugucgguacuggcu

SEQ ID NO: 1637992 - RNA, 15 nt, Pseudomonas putida KT2440
caauugguuaaaagc

SEQ ID NO: 1637993 - RNA, 16 nt, Pseudomonas putida KT2440
caauugcgccagccgc

SEQ ID NO: 1637994 - RNA, 22 nt, Pseudomonas putida KT2440
caauugcgccagccgcucagcc

SEQ ID NO: 1637995 - RNA, 17 nt, Pseudomonas putida KT2440
caauuuccugcgcggcc

SEQ ID NO: 1637996 - RNA, 21 nt, Pseudomonas putida KT2440
caauuucuugaggcacaaaaa

SEQ ID NO: 1637997 - RNA, 23 nt, Pseudomonas putida KT2440
caaucugguuacccaacagacca

SEQ ID NO: 1637998 - RNA, 13 nt, Pseudomonas putida KT2440
caaucuucuucau

SEQ ID NO: 1637999 - RNA, 23 nt, Pseudomonas putida KT2440
caaugcugccuuuuccugcugca

SEQ ID NO: 1638000 - RNA, 15 nt, Pseudomonas putida KT2440
caaugcugcucgccc

SEQ ID NO: 1638001 - RNA, 16 nt, Pseudomonas putida KT2440
caaugcuuucaguuga

SEQ ID NO: 1638002 - RNA, 20 nt, Pseudomonas putida KT2440
caaugucgacguacagcagc

SEQ ID NO: 1638003 - RNA, 13 nt, Pseudomonas putida KT2440
caaugggcuuccc

SEQ ID NO: 1638004 - RNA, 15 nt, Pseudomonas putida KT2440
caaugggcuucccca

SEQ ID NO: 1638005 - RNA, 16 nt, Pseudomonas putida KT2440
caauggcgucacagac

SEQ ID NO: 1638006 - RNA, 18 nt, Pseudomonas putida KT2440
caauggcgaugaacacgc

SEQ ID NO: 1638007 - RNA, 21 nt, Pseudomonas putida KT2440
caauggcgaugaacacgccgu

SEQ ID NO: 1638008 - RNA, 21 nt, Pseudomonas putida KT2440
caauggcgccauuggugcccu

SEQ ID NO: 1638009 - RNA, 15 nt, Pseudomonas putida KT2440
caauggccugcaugu

SEQ ID NO: 1638010 - RNA, 18 nt, Pseudomonas putida KT2440
cacaaccccugcaaggcc

SEQ ID NO: 1638011 - RNA, 17 nt, Pseudomonas putida KT2440
cacaaccgaacccgcug

SEQ ID NO: 1638012 - RNA, 23 nt, Pseudomonas putida KT2440
cacaaccgaacccgcugccaccc

SEQ ID NO: 1638013 - RNA, 12 nt, Pseudomonas putida KT2440
caauuuggccag

SEQ ID NO: 1638014 - RNA, 23 nt, Pseudomonas putida KT2440
cacaacggcgcgcccggcgcauu

SEQ ID NO: 1638015 - RNA, 20 nt, Pseudomonas putida KT2440
cacaaggcucaagcgcagcc

SEQ ID NO: 1638016 - RNA, 15 nt, Pseudomonas putida KT2440
cacaaggcuguucca

SEQ ID NO: 1638017 - RNA, 20 nt, Pseudomonas putida KT2440
cacaaggcuguuccacagca

SEQ ID NO: 1638018 - RNA, 14 nt, Pseudomonas putida KT2440
cacaagggccaggu

SEQ ID NO: 1638019 - RNA, 14 nt, Pseudomonas putida KT2440
cacaaggccgcucc

SEQ ID NO: 1638020 - RNA, 14 nt, Pseudomonas putida KT2440
cacaagcugcugau

SEQ ID NO: 1638021 - RNA, 16 nt, Pseudomonas putida KT2440
cacagaaggcugcgua

SEQ ID NO: 1638022 - RNA, 16 nt, Pseudomonas putida KT2440
cacagauauugcaccg

SEQ ID NO: 1638023 - RNA, 18 nt, Pseudomonas putida KT2440
cacagaucaacgccgcca

SEQ ID NO: 1638024 - RNA, 17 nt, Pseudomonas putida KT2440
cacagcaucacccgcga

SEQ ID NO: 1638025 - RNA, 15 nt, Pseudomonas putida KT2440
cacagcagaucacaa

SEQ ID NO: 1638026 - RNA, 16 nt, Pseudomonas putida KT2440
cacagcaggccaagga

SEQ ID NO: 1638027 - RNA, 16 nt, Pseudomonas putida KT2440
cacagauacuggcgcu

SEQ ID NO: 1638028 - RNA, 17 nt, Pseudomonas putida KT2440
cacagaugccgccgcug

SEQ ID NO: 1638029 - RNA, 22 nt, Pseudomonas putida KT2440
cacagaugccgccgcugccagc

SEQ ID NO: 1638030 - RNA, 15 nt, Pseudomonas putida KT2440
cacacauaucagcca

SEQ ID NO: 1638031 - RNA, 14 nt, Pseudomonas putida KT2440
cacaccaauggcca

SEQ ID NO: 1638032 - RNA, 22 nt, Pseudomonas putida KT2440
cacacgaccuuggacgcuggca

SEQ ID NO: 1638033 - RNA, 17 nt, Pseudomonas putida KT2440
cacacgucgccugggca

SEQ ID NO: 1638034 - RNA, 19 nt, Pseudomonas putida KT2440
caccagauucaagcccggc

SEQ ID NO: 1638035 - RNA, 14 nt, Pseudomonas putida KT2440
caccagcaccagcu

SEQ ID NO: 1638036 - RNA, 17 nt, Pseudomonas putida KT2440
caccagcaccugcaggu

SEQ ID NO: 1638037 - RNA, 15 nt, Pseudomonas putida KT2440
caccagcacgucacc

SEQ ID NO: 1638038 - RNA, 23 nt, Pseudomonas putida KT2440
caccagcacgucacccacuucaa

SEQ ID NO: 1638039 - RNA, 16 nt, Pseudomonas putida KT2440
caccagcacugccuug

SEQ ID NO: 1638040 - RNA, 17 nt, Pseudomonas putida KT2440
caccagcacugccuugc

SEQ ID NO: 1638041 - RNA, 19 nt, Pseudomonas putida KT2440
caccagcacugccuugccc

SEQ ID NO: 1638042 - RNA, 21 nt, Pseudomonas putida KT2440
caccagcacugccuugcccug

SEQ ID NO: 1638043 - RNA, 13 nt, Pseudomonas putida KT2440
caccagcacugcu

SEQ ID NO: 1638044 - RNA, 17 nt, Pseudomonas putida KT2440
caccacuggugccggca

SEQ ID NO: 1638045 - RNA, 15 nt, Pseudomonas putida KT2440
caccacuucuggcug

SEQ ID NO: 1638046 - RNA, 17 nt, Pseudomonas putida KT2440
caccacuucuggcuggg

SEQ ID NO: 1638047 - RNA, 22 nt, Pseudomonas putida KT2440
caccacgccaccaugcucggcc

SEQ ID NO: 1638048 - RNA, 17 nt, Pseudomonas putida KT2440
caccacguugcgcuuga

SEQ ID NO: 1638049 - RNA, 14 nt, Pseudomonas putida KT2440
caccacgaucacgc

SEQ ID NO: 1638050 - RNA, 17 nt, Pseudomonas putida KT2440
caccacgaucacgcccg

SEQ ID NO: 1638051 - RNA, 16 nt, Pseudomonas putida KT2440
caccacgaugccuggg

SEQ ID NO: 1638052 - RNA, 14 nt, Pseudomonas putida KT2440
caccacgccauagc

SEQ ID NO: 1638053 - RNA, 17 nt, Pseudomonas putida KT2440
caccacgcccgccggca

SEQ ID NO: 1638054 - RNA, 14 nt, Pseudomonas putida KT2440
caccacgcccugca

SEQ ID NO: 1638055 - RNA, 23 nt, Pseudomonas putida KT2440
caccacggcaguggccgaguugg

SEQ ID NO: 1638056 - RNA, 15 nt, Pseudomonas putida KT2440
caccacggaaggcca

SEQ ID NO: 1638057 - RNA, 19 nt, Pseudomonas putida KT2440
caccaccugugccggcagc

SEQ ID NO: 1638058 - RNA, 18 nt, Pseudomonas putida KT2440
caccacgaacgcccccag

SEQ ID NO: 1638059 - RNA, 20 nt, Pseudomonas putida KT2440
caccacgaacgcccccagcc

SEQ ID NO: 1638060 - RNA, 22 nt, Pseudomonas putida KT2440
caccacgaacgcccccagcccg

SEQ ID NO: 1638061 - RNA, 23 nt, Pseudomonas putida KT2440
caccacgaacuuguuggccacca

SEQ ID NO: 1638062 - RNA, 15 nt, Pseudomonas putida KT2440
caccacgaagcgcgg

SEQ ID NO: 1638063 - RNA, 21 nt, Pseudomonas putida KT2440
caccacgaagcgcggcaaggu

SEQ ID NO: 1638064 - RNA, 10 nt, Pseudomonas putida KT2440
caccaccagg

SEQ ID NO: 1638065 - RNA, 13 nt, Pseudomonas putida KT2440
caccagcggcgcg

SEQ ID NO: 1638066 - RNA, 14 nt, Pseudomonas putida KT2440
caccagcggcgcga

SEQ ID NO: 1638067 - RNA, 18 nt, Pseudomonas putida KT2440
caccagcgcgaucaccag

SEQ ID NO: 1638068 - RNA, 20 nt, Pseudomonas putida KT2440
caccagcgcgaucaccagcc

SEQ ID NO: 1638069 - RNA, 18 nt, Pseudomonas putida KT2440
caccagcgggcccagcag

SEQ ID NO: 1638070 - RNA, 15 nt, Pseudomonas putida KT2440
caccagcucauccau

SEQ ID NO: 1638071 - RNA, 13 nt, Pseudomonas putida KT2440
caccagcuccaac

SEQ ID NO: 1638072 - RNA, 14 nt, Pseudomonas putida KT2440
caccagcuccaaca

SEQ ID NO: 1638073 - RNA, 16 nt, Pseudomonas putida KT2440
caccagcuccaccuuc

SEQ ID NO: 1638074 - RNA, 16 nt, Pseudomonas putida KT2440
caccagcuccauggca

SEQ ID NO: 1638075 - RNA, 20 nt, Pseudomonas putida KT2440
caccagcguugucccgcccu

SEQ ID NO: 1638076 - RNA, 22 nt, Pseudomonas putida KT2440
caccaggcggucggccagcggc

SEQ ID NO: 1638077 - RNA, 22 nt, Pseudomonas putida KT2440
caccagguugcguugaccugcu

SEQ ID NO: 1638078 - RNA, 18 nt, Pseudomonas putida KT2440
aaaagugguugacaagca

SEQ ID NO: 1638079 - RNA, 14 nt, Pseudomonas putida KT2440
caccagcgcccuuc

SEQ ID NO: 1638080 - RNA, 17 nt, Pseudomonas putida KT2440
caccagcauguccugcu

SEQ ID NO: 1638081 - RNA, 20 nt, Pseudomonas putida KT2440
caccagcauguccugcugca

SEQ ID NO: 1638082 - RNA, 23 nt, Pseudomonas putida KT2440
caccagcauguccugcugcaggc

SEQ ID NO: 1638083 - RNA, 16 nt, Pseudomonas putida KT2440
caccagccaggcacag

SEQ ID NO: 1638084 - RNA, 19 nt, Pseudomonas putida KT2440
caccagcagcuucuucaca

SEQ ID NO: 1638085 - RNA, 15 nt, Pseudomonas putida KT2440
caccagcagugcccc

SEQ ID NO: 1638086 - RNA, 19 nt, Pseudomonas putida KT2440
caccagcagugcccccguc

SEQ ID NO: 1638087 - RNA, 21 nt, Pseudomonas putida KT2440
caccagcaggucggcacgcac

SEQ ID NO: 1638088 - RNA, 22 nt, Pseudomonas putida KT2440
caccagcaggucggcacgcacc

SEQ ID NO: 1638089 - RNA, 23 nt, Pseudomonas putida KT2440
caccagcaggucggcacgcaccu

SEQ ID NO: 1638090 - RNA, 14 nt, Pseudomonas putida KT2440
caccagcaggcugc

SEQ ID NO: 1638091 - RNA, 16 nt, Pseudomonas putida KT2440
cacauccgaccccagc

SEQ ID NO: 1638092 - RNA, 17 nt, Pseudomonas putida KT2440
cacauccgaccccagca

SEQ ID NO: 1638093 - RNA, 15 nt, Pseudomonas putida KT2440
cacauccccgccgcc

SEQ ID NO: 1638094 - RNA, 15 nt, Pseudomonas putida KT2440
cacauccucaaaggc

SEQ ID NO: 1638095 - RNA, 13 nt, Pseudomonas putida KT2440
cacauccucugcc

SEQ ID NO: 1638096 - RNA, 20 nt, Pseudomonas putida KT2440
cacauccaccaggcuggcca

SEQ ID NO: 1638097 - RNA, 13 nt, Pseudomonas putida KT2440
cacauccagcgcc

SEQ ID NO: 1638098 - RNA, 17 nt, Pseudomonas putida KT2440
cacauccagcgccgcgc

SEQ ID NO: 1638099 - RNA, 18 nt, Pseudomonas putida KT2440
cacauccagcgccucccc

SEQ ID NO: 1638100 - RNA, 14 nt, Pseudomonas putida KT2440
cacauccacagccu

SEQ ID NO: 1638101 - RNA, 15 nt, Pseudomonas putida KT2440
cacauccacagccuc

SEQ ID NO: 1638102 - RNA, 14 nt, Pseudomonas putida KT2440
cacaucacacagcg

SEQ ID NO: 1638103 - RNA, 11 nt, Pseudomonas putida KT2440
cacaucaccag

SEQ ID NO: 1638104 - RNA, 14 nt, Pseudomonas putida KT2440
cacaucacugcugu

SEQ ID NO: 1638105 - RNA, 19 nt, Pseudomonas putida KT2440
cacagcucgaugccuuugc

SEQ ID NO: 1638106 - RNA, 15 nt, Pseudomonas putida KT2440
cacagcccaaagggc

SEQ ID NO: 1638107 - RNA, 12 nt, Pseudomonas putida KT2440
cacagcccaagg

SEQ ID NO: 1638108 - RNA, 19 nt, Pseudomonas putida KT2440
cacagcccaaggcuggcca

SEQ ID NO: 1638109 - RNA, 19 nt, Pseudomonas putida KT2440
cacagcggccuugaccacu

SEQ ID NO: 1638110 - RNA, 16 nt, Pseudomonas putida KT2440
cacagccaugccggca

SEQ ID NO: 1638111 - RNA, 15 nt, Pseudomonas putida KT2440
cacagcggccacagc

SEQ ID NO: 1638112 - RNA, 18 nt, Pseudomonas putida KT2440
cacagcggccacagcgcc

SEQ ID NO: 1638113 - RNA, 17 nt, Pseudomonas putida KT2440
cacauagucgauaccca

SEQ ID NO: 1638114 - RNA, 20 nt, Pseudomonas putida KT2440
cacauagcgcacuugcacuu

SEQ ID NO: 1638115 - RNA, 16 nt, Pseudomonas putida KT2440
cacauacuccaccgcc

SEQ ID NO: 1638116 - RNA, 23 nt, Pseudomonas putida KT2440
cacauacugcuucugccguucac

SEQ ID NO: 1638117 - RNA, 18 nt, Pseudomonas putida KT2440
cacauaccucaucaguuc

SEQ ID NO: 1638118 - RNA, 14 nt, Pseudomonas putida KT2440
cacauagaacaggu

SEQ ID NO: 1638119 - RNA, 13 nt, Pseudomonas putida KT2440
cacauucagcagc

SEQ ID NO: 1638120 - RNA, 20 nt, Pseudomonas putida KT2440
cacaucgcuucugcacuccc

SEQ ID NO: 1638121 - RNA, 23 nt, Pseudomonas putida KT2440
cacaucgcuucugcacucccgcu

SEQ ID NO: 1638122 - RNA, 15 nt, Pseudomonas putida KT2440
cacaucggcgcgccc

SEQ ID NO: 1638123 - RNA, 17 nt, Pseudomonas putida KT2440
cacaucggcgcgcccuc

SEQ ID NO: 1638124 - RNA, 21 nt, Pseudomonas putida KT2440
cacaucgccaggugcucagcc

SEQ ID NO: 1638125 - RNA, 15 nt, Pseudomonas putida KT2440
cacauccugcucguc

SEQ ID NO: 1638126 - RNA, 14 nt, Pseudomonas putida KT2440
cacaucgaucaggu

SEQ ID NO: 1638127 - RNA, 14 nt, Pseudomonas putida KT2440
caccacaguucauu

SEQ ID NO: 1638128 - RNA, 19 nt, Pseudomonas putida KT2440
caccacauccgaccccagc

SEQ ID NO: 1638129 - RNA, 22 nt, Pseudomonas putida KT2440
caccacauccgaccccagcaug

SEQ ID NO: 1638130 - RNA, 16 nt, Pseudomonas putida KT2440
caccacagcugcgcca

SEQ ID NO: 1638131 - RNA, 13 nt, Pseudomonas putida KT2440
caccacacccggc

SEQ ID NO: 1638132 - RNA, 15 nt, Pseudomonas putida KT2440
caccaacggcuucac

SEQ ID NO: 1638133 - RNA, 21 nt, Pseudomonas putida KT2440
caccacaaaccacagcggcca

SEQ ID NO: 1638134 - RNA, 18 nt, Pseudomonas putida KT2440
caccacaaaaccucaguu

SEQ ID NO: 1638135 - RNA, 19 nt, Pseudomonas putida KT2440
caccaacgcauuuucauca

SEQ ID NO: 1638136 - RNA, 21 nt, Pseudomonas putida KT2440
caccaacgcauuuucaucaaa

SEQ ID NO: 1638137 - RNA, 15 nt, Pseudomonas putida KT2440
cacgaugaucugccg

SEQ ID NO: 1638138 - RNA, 14 nt, Pseudomonas putida KT2440
cacgaucgccaacc

SEQ ID NO: 1638139 - RNA, 17 nt, Pseudomonas putida KT2440
cacgaucucuucaccgu

SEQ ID NO: 1638140 - RNA, 13 nt, Pseudomonas putida KT2440
cacgauccccggc

SEQ ID NO: 1638141 - RNA, 17 nt, Pseudomonas putida KT2440
cacgagcggccuugucg

SEQ ID NO: 1638142 - RNA, 13 nt, Pseudomonas putida KT2440
cacgagcaugccg

SEQ ID NO: 1638143 - RNA, 17 nt, Pseudomonas putida KT2440
cacgaacaguggcccga

SEQ ID NO: 1638144 - RNA, 11 nt, Pseudomonas putida KT2440
cacgaacaggc

SEQ ID NO: 1638145 - RNA, 16 nt, Pseudomonas putida KT2440
cacgaacaccagcccc

SEQ ID NO: 1638146 - RNA, 17 nt, Pseudomonas putida KT2440
cacgaacaccagcccca

SEQ ID NO: 1638147 - RNA, 19 nt, Pseudomonas putida KT2440
cacgaacaccagccccagc

SEQ ID NO: 1638148 - RNA, 18 nt, Pseudomonas putida KT2440
cacgaacgcccccagccc

SEQ ID NO: 1638149 - RNA, 15 nt, Pseudomonas putida KT2440
cacgaaccugugcac

SEQ ID NO: 1638150 - RNA, 14 nt, Pseudomonas putida KT2440
cacgaaacugcgcu

SEQ ID NO: 1638151 - RNA, 23 nt, Pseudomonas putida KT2440
caccuucagcgggucgagccagg

SEQ ID NO: 1638152 - RNA, 14 nt, Pseudomonas putida KT2440
cacgaaaaagccag

SEQ ID NO: 1638153 - RNA, 23 nt, Pseudomonas putida KT2440
cacgaaucggguccacccacccu

SEQ ID NO: 1638154 - RNA, 17 nt, Pseudomonas putida KT2440
caccuggcugagguuca

SEQ ID NO: 1638155 - RNA, 19 nt, Pseudomonas putida KT2440
caccugguaggucacuuca

SEQ ID NO: 1638156 - RNA, 20 nt, Pseudomonas putida KT2440
caccuggcagccgaagcugu

SEQ ID NO: 1638157 - RNA, 22 nt, Pseudomonas putida KT2440
caccuggccuuccagcugcggc

SEQ ID NO: 1638158 - RNA, 17 nt, Pseudomonas putida KT2440
caccuggccacccggcu

SEQ ID NO: 1638159 - RNA, 15 nt, Pseudomonas putida KT2440
caccuggcccugcuc

SEQ ID NO: 1638160 - RNA, 14 nt, Pseudomonas putida KT2440
caccugcuccagca

SEQ ID NO: 1638161 - RNA, 17 nt, Pseudomonas putida KT2440
caccucauucagugccu

SEQ ID NO: 1638162 - RNA, 18 nt, Pseudomonas putida KT2440
caccuccaccccgcaggc

SEQ ID NO: 1638163 - RNA, 19 nt, Pseudomonas putida KT2440
caccucaucgacccuggca

SEQ ID NO: 1638164 - RNA, 14 nt, Pseudomonas putida KT2440
caccuccaccuuca

SEQ ID NO: 1638165 - RNA, 14 nt, Pseudomonas putida KT2440
caccucaucccccg

SEQ ID NO: 1638166 - RNA, 16 nt, Pseudomonas putida KT2440
caccucaucccccggc

SEQ ID NO: 1638167 - RNA, 18 nt, Pseudomonas putida KT2440
caccucccgcgcauccuc

SEQ ID NO: 1638168 - RNA, 19 nt, Pseudomonas putida KT2440
caccucccgcgcauccucc

SEQ ID NO: 1638169 - RNA, 11 nt, Pseudomonas putida KT2440
caccuccagag

SEQ ID NO: 1638170 - RNA, 17 nt, Pseudomonas putida KT2440
caccugcuccugguccu

SEQ ID NO: 1638171 - RNA, 18 nt, Pseudomonas putida KT2440
caccugcuccugguccug

SEQ ID NO: 1638172 - RNA, 21 nt, Pseudomonas putida KT2440
caccugcuccugguccugcgc

SEQ ID NO: 1638173 - RNA, 14 nt, Pseudomonas putida KT2440
caccuguggguugc

SEQ ID NO: 1638174 - RNA, 23 nt, Pseudomonas putida KT2440
caccugucccagcuggcaaugca

SEQ ID NO: 1638175 - RNA, 22 nt, Pseudomonas putida KT2440
caccuguucccccaccggccgc

SEQ ID NO: 1638176 - RNA, 20 nt, Pseudomonas putida KT2440
cacgauggucacccgcgacc

SEQ ID NO: 1638177 - RNA, 16 nt, Pseudomonas putida KT2440
cacgccgaagcgcgcc

SEQ ID NO: 1638178 - RNA, 20 nt, Pseudomonas putida KT2440
cacgccgaagcgcgccuggu

SEQ ID NO: 1638179 - RNA, 20 nt, Pseudomonas putida KT2440
cacgcccuggcccgccgcca

SEQ ID NO: 1638180 - RNA, 15 nt, Pseudomonas putida KT2440
cacgcaagcggcccu

SEQ ID NO: 1638181 - RNA, 14 nt, Pseudomonas putida KT2440
cacgcaagcccccc

SEQ ID NO: 1638182 - RNA, 13 nt, Pseudomonas putida KT2440
cacgcaagcgccu

SEQ ID NO: 1638183 - RNA, 17 nt, Pseudomonas putida KT2440
cacgccgaccgcgcgca

SEQ ID NO: 1638184 - RNA, 23 nt, Pseudomonas putida KT2440
cacgcgacgaagaugucgaugua

SEQ ID NO: 1638185 - RNA, 15 nt, Pseudomonas putida KT2440
cacgcgcaaaugcuu

SEQ ID NO: 1638186 - RNA, 13 nt, Pseudomonas putida KT2440
cacgcgaucggca

SEQ ID NO: 1638187 - RNA, 15 nt, Pseudomonas putida KT2440
cacgccuuaguucac

SEQ ID NO: 1638188 - RNA, 22 nt, Pseudomonas putida KT2440
cacgccuuaguucacccacacc

SEQ ID NO: 1638189 - RNA, 16 nt, Pseudomonas putida KT2440
cacgccugcgccgcuc

SEQ ID NO: 1638190 - RNA, 15 nt, Pseudomonas putida KT2440
cacgcgccagcagcg

SEQ ID NO: 1638191 - RNA, 14 nt, Pseudomonas putida KT2440
cacgcgcuuuucca

SEQ ID NO: 1638192 - RNA, 15 nt, Pseudomonas putida KT2440
cacgcggguccagcg

SEQ ID NO: 1638193 - RNA, 16 nt, Pseudomonas putida KT2440
cacgcguaccccuggc

SEQ ID NO: 1638194 - RNA, 19 nt, Pseudomonas putida KT2440
cacgcguaccccuggcgcu

SEQ ID NO: 1638195 - RNA, 14 nt, Pseudomonas putida KT2440
cacgcguugggggu

SEQ ID NO: 1638196 - RNA, 20 nt, Pseudomonas putida KT2440
cacgcucaaccccaucaccu

SEQ ID NO: 1638197 - RNA, 18 nt, Pseudomonas putida KT2440
cacgcuaccaccuggcuc

SEQ ID NO: 1638198 - RNA, 23 nt, Pseudomonas putida KT2440
cacgcuaccaccuggcucggugu

SEQ ID NO: 1638199 - RNA, 17 nt, Pseudomonas putida KT2440
cacggaucaccuggccg

SEQ ID NO: 1638200 - RNA, 20 nt, Pseudomonas putida KT2440
cacggaucagccgcgggcgu

SEQ ID NO: 1638201 - RNA, 15 nt, Pseudomonas putida KT2440
cacggccuucuucac

SEQ ID NO: 1638202 - RNA, 14 nt, Pseudomonas putida KT2440
cacggccuggccug

SEQ ID NO: 1638203 - RNA, 15 nt, Pseudomonas putida KT2440
cacggccguuggcca

SEQ ID NO: 1638204 - RNA, 13 nt, Pseudomonas putida KT2440
cacggcaccagca

SEQ ID NO: 1638205 - RNA, 18 nt, Pseudomonas putida KT2440
cacggcaagccacgccag

SEQ ID NO: 1638206 - RNA, 15 nt, Pseudomonas putida KT2440
cacggcaaucggcag

SEQ ID NO: 1638207 - RNA, 18 nt, Pseudomonas putida KT2440
cacgggucaugccaccgc

SEQ ID NO: 1638208 - RNA, 21 nt, Pseudomonas putida KT2440
cacggcgcaggccgacaacag

SEQ ID NO: 1638209 - RNA, 23 nt, Pseudomonas putida KT2440
cacggcgaugcgccccccaggcg

SEQ ID NO: 1638210 - RNA, 20 nt, Pseudomonas putida KT2440
cacggcgauggucugcucca

SEQ ID NO: 1638211 - RNA, 13 nt, Pseudomonas putida KT2440
cacggcgcugacc

SEQ ID NO: 1638212 - RNA, 16 nt, Pseudomonas putida KT2440
caccgcuucacccucg

SEQ ID NO: 1638213 - RNA, 21 nt, Pseudomonas putida KT2440
caccgcuucacccucgcgcag

SEQ ID NO: 1638214 - RNA, 19 nt, Pseudomonas putida KT2440
caccgcgguggauggcacg

SEQ ID NO: 1638215 - RNA, 18 nt, Pseudomonas putida KT2440
caccgcguacagcugcuc

SEQ ID NO: 1638216 - RNA, 22 nt, Pseudomonas putida KT2440
caccgcgaaacacagcaggcca

SEQ ID NO: 1638217 - RNA, 14 nt, Pseudomonas putida KT2440
caccgcgcgcuuga

SEQ ID NO: 1638218 - RNA, 21 nt, Pseudomonas putida KT2440
caccgccucuaccacgccgcu

SEQ ID NO: 1638219 - RNA, 13 nt, Pseudomonas putida KT2440
caccgccaaggca

SEQ ID NO: 1638220 - RNA, 13 nt, Pseudomonas putida KT2440
caccgcagcccag

SEQ ID NO: 1638221 - RNA, 14 nt, Pseudomonas putida KT2440
caccgcacccggcg

SEQ ID NO: 1638222 - RNA, 16 nt, Pseudomonas putida KT2440
caccgcacucugcugc

SEQ ID NO: 1638223 - RNA, 17 nt, Pseudomonas putida KT2440
caccgcacucugcugcu

SEQ ID NO: 1638224 - RNA, 15 nt, Pseudomonas putida KT2440
caccgagucaugaag

SEQ ID NO: 1638225 - RNA, 17 nt, Pseudomonas putida KT2440
caccgagugcccgcgca

SEQ ID NO: 1638226 - RNA, 16 nt, Pseudomonas putida KT2440
caccggcaucgaaggu

SEQ ID NO: 1638227 - RNA, 14 nt, Pseudomonas putida KT2440
caccggcagcagca

SEQ ID NO: 1638228 - RNA, 17 nt, Pseudomonas putida KT2440
caccgucaccuugcuga

SEQ ID NO: 1638229 - RNA, 17 nt, Pseudomonas putida KT2440
caccgggauacugcgca

SEQ ID NO: 1638230 - RNA, 16 nt, Pseudomonas putida KT2440
caccgggaugcucugc

SEQ ID NO: 1638231 - RNA, 21 nt, Pseudomonas putida KT2440
caccggcuucgucggcgcgga

SEQ ID NO: 1638232 - RNA, 16 nt, Pseudomonas putida KT2440
caccggcuucuaccac

SEQ ID NO: 1638233 - RNA, 22 nt, Pseudomonas putida KT2440
caccggcuccaccugcuccagc

SEQ ID NO: 1638234 - RNA, 16 nt, Pseudomonas putida KT2440
caccggcugcgccggu

SEQ ID NO: 1638235 - RNA, 23 nt, Pseudomonas putida KT2440
caccguugcgcucgagcccgcca

SEQ ID NO: 1638236 - RNA, 18 nt, Pseudomonas putida KT2440
caccguucuucuccaaca

SEQ ID NO: 1638237 - RNA, 14 nt, Pseudomonas putida KT2440
caccgucgccugca

SEQ ID NO: 1638238 - RNA, 17 nt, Pseudomonas putida KT2440
caccuaucgcugccgcc

SEQ ID NO: 1638239 - RNA, 21 nt, Pseudomonas putida KT2440
cacccaucggcgcgaagguca

SEQ ID NO: 1638240 - RNA, 14 nt, Pseudomonas putida KT2440
cacccagucgcccc

SEQ ID NO: 1638241 - RNA, 19 nt, Pseudomonas putida KT2440
cacccaggugcaacccggc

SEQ ID NO: 1638242 - RNA, 18 nt, Pseudomonas putida KT2440
caccccagaacggcacgc

SEQ ID NO: 1638243 - RNA, 19 nt, Pseudomonas putida KT2440
cacccccagcgccuccacc

SEQ ID NO: 1638244 - RNA, 13 nt, Pseudomonas putida KT2440
caccccccagcag

SEQ ID NO: 1638245 - RNA, 16 nt, Pseudomonas putida KT2440
caccccccagcagcgg

SEQ ID NO: 1638246 - RNA, 20 nt, Pseudomonas putida KT2440
caccccccagcagcgggcac

SEQ ID NO: 1638247 - RNA, 19 nt, Pseudomonas putida KT2440
cacccccagcgaccagcug

SEQ ID NO: 1638248 - RNA, 21 nt, Pseudomonas putida KT2440
caccccgaguguuucaaaaaa

SEQ ID NO: 1638249 - RNA, 20 nt, Pseudomonas putida KT2440
caccccgaccaaggccaacu

SEQ ID NO: 1638250 - RNA, 12 nt, Pseudomonas putida KT2440
cacccacccucg

SEQ ID NO: 1638251 - RNA, 19 nt, Pseudomonas putida KT2440
cacccaccuuggcccuucc

SEQ ID NO: 1638252 - RNA, 20 nt, Pseudomonas putida KT2440
cacccaccuuggcccuuccu

SEQ ID NO: 1638253 - RNA, 21 nt, Pseudomonas putida KT2440
caccagugcuuccagggcgcc

SEQ ID NO: 1638254 - RNA, 13 nt, Pseudomonas putida KT2440
cacccacgcgcuu

SEQ ID NO: 1638255 - RNA, 18 nt, Pseudomonas putida KT2440
cacccagaacagccacag

SEQ ID NO: 1638256 - RNA, 23 nt, Pseudomonas putida KT2440
caccagguuugcugccuucucug

SEQ ID NO: 1638257 - RNA, 14 nt, Pseudomonas putida KT2440
cacccagcaggccg

SEQ ID NO: 1638258 - RNA, 17 nt, Pseudomonas putida KT2440
cacccagaucaucaucg

SEQ ID NO: 1638259 - RNA, 15 nt, Pseudomonas putida KT2440
cacccaggcucgccc

SEQ ID NO: 1638260 - RNA, 14 nt, Pseudomonas putida KT2440
cacccagcucgcca

SEQ ID NO: 1638261 - RNA, 17 nt, Pseudomonas putida KT2440
cacccagcucgccaaca

SEQ ID NO: 1638262 - RNA, 19 nt, Pseudomonas putida KT2440
cacccagcucgccaacacc

SEQ ID NO: 1638263 - RNA, 20 nt, Pseudomonas putida KT2440
cacccagcguauagccaccg

SEQ ID NO: 1638264 - RNA, 14 nt, Pseudomonas putida KT2440
cacccagcgcggca

SEQ ID NO: 1638265 - RNA, 23 nt, Pseudomonas putida KT2440
cacccagcgcuugagaccaggcc

SEQ ID NO: 1638266 - RNA, 13 nt, Pseudomonas putida KT2440
cacccgccguuca

SEQ ID NO: 1638267 - RNA, 13 nt, Pseudomonas putida KT2440
cacccgcgccacc

SEQ ID NO: 1638268 - RNA, 14 nt, Pseudomonas putida KT2440
cacccgcgccacca

SEQ ID NO: 1638269 - RNA, 22 nt, Pseudomonas putida KT2440
cacccggcugaaauggcggccc

SEQ ID NO: 1638270 - RNA, 14 nt, Pseudomonas putida KT2440
cacccgggcccgcu

SEQ ID NO: 1638271 - RNA, 13 nt, Pseudomonas putida KT2440
cacccgugccugc

SEQ ID NO: 1638272 - RNA, 18 nt, Pseudomonas putida KT2440
cacccgugccugccugca

SEQ ID NO: 1638273 - RNA, 23 nt, Pseudomonas putida KT2440
cacccguggcagcccccccagca

SEQ ID NO: 1638274 - RNA, 18 nt, Pseudomonas putida KT2440
caccccgcaggccgcagc

SEQ ID NO: 1638275 - RNA, 22 nt, Pseudomonas putida KT2440
caccccggcagugccuggaugc

SEQ ID NO: 1638276 - RNA, 17 nt, Pseudomonas putida KT2440
caccgacgugcaggauc

SEQ ID NO: 1638277 - RNA, 18 nt, Pseudomonas putida KT2440
caccgacgugugcccacu

SEQ ID NO: 1638278 - RNA, 20 nt, Pseudomonas putida KT2440
caccgacuccggcaaggcau

SEQ ID NO: 1638279 - RNA, 19 nt, Pseudomonas putida KT2440
caccgacgccgaucaaugu

SEQ ID NO: 1638280 - RNA, 19 nt, Pseudomonas putida KT2440
caccgacccggccgcucca

SEQ ID NO: 1638281 - RNA, 23 nt, Pseudomonas putida KT2440
caccgacgcauucgcgggugaac

SEQ ID NO: 1638282 - RNA, 15 nt, Pseudomonas putida KT2440
caccgaccugugucc

SEQ ID NO: 1638283 - RNA, 23 nt, Pseudomonas putida KT2440
caccgaccuguguccacccccgc

SEQ ID NO: 1638284 - RNA, 21 nt, Pseudomonas putida KT2440
caccgaccacgguaccggcaa

SEQ ID NO: 1638285 - RNA, 23 nt, Pseudomonas putida KT2440
caccgacccacaggcacaggccc

SEQ ID NO: 1638286 - RNA, 20 nt, Pseudomonas putida KT2440
cacccuuccccccuggccug

SEQ ID NO: 1638287 - RNA, 22 nt, Pseudomonas putida KT2440
cacccuuaucguauugcccuuc

SEQ ID NO: 1638288 - RNA, 19 nt, Pseudomonas putida KT2440
cacccuugggcaccagcuu

SEQ ID NO: 1638289 - RNA, 21 nt, Pseudomonas putida KT2440
cacccuugggcaccagcuucc

SEQ ID NO: 1638290 - RNA, 20 nt, Pseudomonas putida KT2440
cacccugcgaagucagguag

SEQ ID NO: 1638291 - RNA, 17 nt, Pseudomonas putida KT2440
cacccugcaccacggca

SEQ ID NO: 1638292 - RNA, 20 nt, Pseudomonas putida KT2440
cacccugacgcugcacuucc

SEQ ID NO: 1638293 - RNA, 22 nt, Pseudomonas putida KT2440
cacccugacgcugcacuuccac

SEQ ID NO: 1638294 - RNA, 17 nt, Pseudomonas putida KT2440
cacccuggucaugcagc

SEQ ID NO: 1638295 - RNA, 22 nt, Pseudomonas putida KT2440
cacccuggucaugcagcggguc

SEQ ID NO: 1638296 - RNA, 17 nt, Pseudomonas putida KT2440
caaagcggcccccagca

SEQ ID NO: 1638297 - RNA, 17 nt, Pseudomonas putida KT2440
caaagcggccccuucga

SEQ ID NO: 1638298 - RNA, 17 nt, Pseudomonas putida KT2440
caaagcggcgcggcccu

SEQ ID NO: 1638299 - RNA, 16 nt, Pseudomonas putida KT2440
caaagcgagcauggcg

SEQ ID NO: 1638300 - RNA, 20 nt, Pseudomonas putida KT2440
caaagccugcuccagcaccc

SEQ ID NO: 1638301 - RNA, 14 nt, Pseudomonas putida KT2440
caaagccgccaugu

SEQ ID NO: 1638302 - RNA, 19 nt, Pseudomonas putida KT2440
caaagcccugccucagcuc

SEQ ID NO: 1638303 - RNA, 14 nt, Pseudomonas putida KT2440
caaagaaacaccag

SEQ ID NO: 1638304 - RNA, 20 nt, Pseudomonas putida KT2440
caaagaaacaccaggccuuc

SEQ ID NO: 1638305 - RNA, 19 nt, Pseudomonas putida KT2440
caaagaagcgccgcagguc

SEQ ID NO: 1638306 - RNA, 20 nt, Pseudomonas putida KT2440
caaacuucgggcuguccuca

SEQ ID NO: 1638307 - RNA, 22 nt, Pseudomonas putida KT2440
caaaccucaaaugcgcccugcu

SEQ ID NO: 1638308 - RNA, 14 nt, Pseudomonas putida KT2440
caaaccguccaggu

SEQ ID NO: 1638309 - RNA, 17 nt, Pseudomonas putida KT2440
caaaccagcggucugcu

SEQ ID NO: 1638310 - RNA, 14 nt, Pseudomonas putida KT2440
caaaccgccccacc

SEQ ID NO: 1638311 - RNA, 15 nt, Pseudomonas putida KT2440
caaaccacagcggcc

SEQ ID NO: 1638312 - RNA, 14 nt, Pseudomonas putida KT2440
caaaccaauuacuu

SEQ ID NO: 1638313 - RNA, 15 nt, Pseudomonas putida KT2440
caaaagaaaaagggc

SEQ ID NO: 1638314 - RNA, 16 nt, Pseudomonas putida KT2440
caaaacugagcaagaa

SEQ ID NO: 1638315 - RNA, 18 nt, Pseudomonas putida KT2440
caaaaacggugcagaccu

SEQ ID NO: 1638316 - RNA, 14 nt, Pseudomonas putida KT2440
caaaaccuguucca

SEQ ID NO: 1638317 - RNA, 16 nt, Pseudomonas putida KT2440
caaaagggugaugccc

SEQ ID NO: 1638318 - RNA, 13 nt, Pseudomonas putida KT2440
caaaagcugaaag

SEQ ID NO: 1638319 - RNA, 15 nt, Pseudomonas putida KT2440
caaaaugugccggcu

SEQ ID NO: 1638320 - RNA, 16 nt, Pseudomonas putida KT2440
caaaauagucgaaggc

SEQ ID NO: 1638321 - RNA, 17 nt, Pseudomonas putida KT2440
caaaauagucgaaggcu

SEQ ID NO: 1638322 - RNA, 17 nt, Pseudomonas putida KT2440
caaaaucgaccagggcc

SEQ ID NO: 1638323 - RNA, 18 nt, Pseudomonas putida KT2440
caacagcaguugcugcug

SEQ ID NO: 1638324 - RNA, 18 nt, Pseudomonas putida KT2440
caacagcacccgcccauc

SEQ ID NO: 1638325 - RNA, 12 nt, Pseudomonas putida KT2440
caacagccgcgg

SEQ ID NO: 1638326 - RNA, 13 nt, Pseudomonas putida KT2440
caacagccgcggc

SEQ ID NO: 1638327 - RNA, 23 nt, Pseudomonas putida KT2440
caacagccgcggcacccaauagc

SEQ ID NO: 1638328 - RNA, 15 nt, Pseudomonas putida KT2440
caacagcauccaaag

SEQ ID NO: 1638329 - RNA, 17 nt, Pseudomonas putida KT2440
caacagccacgcccguc

SEQ ID NO: 1638330 - RNA, 20 nt, Pseudomonas putida KT2440
caacagccccaucaccagcc

SEQ ID NO: 1638331 - RNA, 14 nt, Pseudomonas putida KT2440
caacagcccgguga

SEQ ID NO: 1638332 - RNA, 22 nt, Pseudomonas putida KT2440
caacagcccggugaagucaccg

SEQ ID NO: 1638333 - RNA, 11 nt, Pseudomonas putida KT2440
caacaccaucu

SEQ ID NO: 1638334 - RNA, 14 nt, Pseudomonas putida KT2440
caacaccagcagcc

SEQ ID NO: 1638335 - RNA, 13 nt, Pseudomonas putida KT2440
caacaccagcaug

SEQ ID NO: 1638336 - RNA, 15 nt, Pseudomonas putida KT2440
caacaccgccagaaa

SEQ ID NO: 1638337 - RNA, 21 nt, Pseudomonas putida KT2440
caacaaaccgacccugcugcu

SEQ ID NO: 1638338 - RNA, 13 nt, Pseudomonas putida KT2440
caacaacaaaaaa

SEQ ID NO: 1638339 - RNA, 14 nt, Pseudomonas putida KT2440
caacaacaaaaaaa

SEQ ID NO: 1638340 - RNA, 13 nt, Pseudomonas putida KT2440
caacaccaccucc

SEQ ID NO: 1638341 - RNA, 16 nt, Pseudomonas putida KT2440
caacaccaacuugcca

SEQ ID NO: 1638342 - RNA, 13 nt, Pseudomonas putida KT2440
caacaguuuucaa

SEQ ID NO: 1638343 - RNA, 16 nt, Pseudomonas putida KT2440
caacaguuuucaaugc

SEQ ID NO: 1638344 - RNA, 20 nt, Pseudomonas putida KT2440
caacaguuuucaaugcugcu

SEQ ID NO: 1638345 - RNA, 17 nt, Pseudomonas putida KT2440
caacccggucccgcccu

SEQ ID NO: 1638346 - RNA, 21 nt, Pseudomonas putida KT2440
caacccggucccgcccuccag

SEQ ID NO: 1638347 - RNA, 16 nt, Pseudomonas putida KT2440
caacccgucagugcuc

SEQ ID NO: 1638348 - RNA, 22 nt, Pseudomonas putida KT2440
caaccgaaaaggccaaccaccc

SEQ ID NO: 1638349 - RNA, 22 nt, Pseudomonas putida KT2440
caaccgaacccgcugccaccca

SEQ ID NO: 1638350 - RNA, 21 nt, Pseudomonas putida KT2440
caacccaccagcacugcugcg

SEQ ID NO: 1638351 - RNA, 19 nt, Pseudomonas putida KT2440
caaccaguucagcgcccgc

SEQ ID NO: 1638352 - RNA, 18 nt, Pseudomonas putida KT2440
caacaugccggcccaagg

SEQ ID NO: 1638353 - RNA, 23 nt, Pseudomonas putida KT2440
caacaugccggcccaaggcacca

SEQ ID NO: 1638354 - RNA, 21 nt, Pseudomonas putida KT2440
caacaugaagccaugggcaga

SEQ ID NO: 1638355 - RNA, 16 nt, Pseudomonas putida KT2440
caaccagccagccacc

SEQ ID NO: 1638356 - RNA, 18 nt, Pseudomonas putida KT2440
caaccaggugugccacuu

SEQ ID NO: 1638357 - RNA, 14 nt, Pseudomonas putida KT2440
caaccaggcgccga

SEQ ID NO: 1638358 - RNA, 17 nt, Pseudomonas putida KT2440
caaccagcccgccgcca

SEQ ID NO: 1638359 - RNA, 17 nt, Pseudomonas putida KT2440
caaccagccgccuuugc

SEQ ID NO: 1638360 - RNA, 17 nt, Pseudomonas putida KT2440
caaaucaguaaguugaa

SEQ ID NO: 1638361 - RNA, 12 nt, Pseudomonas putida KT2440
caaaucggcaga

SEQ ID NO: 1638362 - RNA, 14 nt, Pseudomonas putida KT2440
caaaucggccuugc

SEQ ID NO: 1638363 - RNA, 21 nt, Pseudomonas putida KT2440
caaaggcuugucaugccuugg

SEQ ID NO: 1638364 - RNA, 19 nt, Pseudomonas putida KT2440
caaaguccggcgaagcacu

SEQ ID NO: 1638365 - RNA, 22 nt, Pseudomonas putida KT2440
caaaguccagcaucagcacacc

SEQ ID NO: 1638366 - RNA, 17 nt, Pseudomonas putida KT2440
caaauucgaccagcagu

SEQ ID NO: 1638367 - RNA, 18 nt, Pseudomonas putida KT2440
caaauucgaccagcagug

SEQ ID NO: 1638368 - RNA, 19 nt, Pseudomonas putida KT2440
caaauucgaccagcagugu

SEQ ID NO: 1638369 - RNA, 21 nt, Pseudomonas putida KT2440
caaauucgaccagcaguguca

SEQ ID NO: 1638370 - RNA, 21 nt, Pseudomonas putida KT2440
caaauguccauugagcacuca

SEQ ID NO: 1638371 - RNA, 12 nt, Pseudomonas putida KT2440
caaaucuucccg

SEQ ID NO: 1638372 - RNA, 13 nt, Pseudomonas putida KT2440
caacggcugugcc

SEQ ID NO: 1638373 - RNA, 21 nt, Pseudomonas putida KT2440
caacggguucagguacagcag

SEQ ID NO: 1638374 - RNA, 23 nt, Pseudomonas putida KT2440
caacggguucagguacagcagcu

SEQ ID NO: 1638375 - RNA, 16 nt, Pseudomonas putida KT2440
caacggccacgcugcg

SEQ ID NO: 1638376 - RNA, 18 nt, Pseudomonas putida KT2440
caacggccgcgccgcgcc

SEQ ID NO: 1638377 - RNA, 19 nt, Pseudomonas putida KT2440
caacggcacucgaagcacu

SEQ ID NO: 1638378 - RNA, 15 nt, Pseudomonas putida KT2440
caacggcagcgacag

SEQ ID NO: 1638379 - RNA, 14 nt, Pseudomonas putida KT2440
caacgcuucggcca

SEQ ID NO: 1638380 - RNA, 17 nt, Pseudomonas putida KT2440
caacgccuugcgcucga

SEQ ID NO: 1638381 - RNA, 15 nt, Pseudomonas putida KT2440
caacgcgaacgacuu

SEQ ID NO: 1638382 - RNA, 15 nt, Pseudomonas putida KT2440
caacgcgccauggcc

SEQ ID NO: 1638383 - RNA, 15 nt, Pseudomonas putida KT2440
caacgcggcccuggg

SEQ ID NO: 1638384 - RNA, 18 nt, Pseudomonas putida KT2440
caacgcgguggcuggcac

SEQ ID NO: 1638385 - RNA, 22 nt, Pseudomonas putida KT2440
caacgcgacgguugacagcacg

SEQ ID NO: 1638386 - RNA, 17 nt, Pseudomonas putida KT2440
caaccgggucggcgcca

SEQ ID NO: 1638387 - RNA, 23 nt, Pseudomonas putida KT2440
caaccgugcccgcccacgccgcu

SEQ ID NO: 1638388 - RNA, 18 nt, Pseudomonas putida KT2440
caaccgugguucuugccg

SEQ ID NO: 1638389 - RNA, 16 nt, Pseudomonas putida KT2440
caacuccacgcggaac

SEQ ID NO: 1638390 - RNA, 19 nt, Pseudomonas putida KT2440
caacucuaccucacugaca

SEQ ID NO: 1638391 - RNA, 16 nt, Pseudomonas putida KT2440
caacugccgcgccgcc

SEQ ID NO: 1638392 - RNA, 21 nt, Pseudomonas putida KT2440
caacugcgccguggccgccau

SEQ ID NO: 1638393 - RNA, 24 nt, Pseudomonas putida KT2440
caacugcuccaggcagccugccag

SEQ ID NO: 1638394 - RNA, 17 nt, Pseudomonas putida KT2440
caacugcgcgauagccu

SEQ ID NO: 1638395 - RNA, 19 nt, Pseudomonas putida KT2440
caacugcgcgauagccugu

SEQ ID NO: 1638396 - RNA, 15 nt, Pseudomonas putida KT2440
caacuuacaaaucag

SEQ ID NO: 1638397 - RNA, 23 nt, Pseudomonas putida KT2440
caacuggaucuucucuuccaccg

SEQ ID NO: 1638398 - RNA, 21 nt, Pseudomonas putida KT2440
caacuggcaggguucgcuguc

SEQ ID NO: 1638399 - RNA, 19 nt, Pseudomonas putida KT2440
caacgguggccagcagcuc

SEQ ID NO: 1638400 - RNA, 17 nt, Pseudomonas putida KT2440
caacgguuuaccgccgu

SEQ ID NO: 1638401 - RNA, 13 nt, Pseudomonas putida KT2440
caacucacuuuca

SEQ ID NO: 1638402 - RNA, 21 nt, Pseudomonas putida KT2440
caacucacuuucagcgccugc

SEQ ID NO: 1638403 - RNA, 23 nt, Pseudomonas putida KT2440
caacucacuuucagcgccugccu

SEQ ID NO: 1638404 - RNA, 14 nt, Pseudomonas putida KT2440
caagccacgcaccu

SEQ ID NO: 1638405 - RNA, 15 nt, Pseudomonas putida KT2440
caagccacgcaccuc

SEQ ID NO: 1638406 - RNA, 17 nt, Pseudomonas putida KT2440
caagccggcgaacagca

SEQ ID NO: 1638407 - RNA, 16 nt, Pseudomonas putida KT2440
caagccgcugggcuuc

SEQ ID NO: 1638408 - RNA, 20 nt, Pseudomonas putida KT2440
caagccgcuucacuguccug

SEQ ID NO: 1638409 - RNA, 20 nt, Pseudomonas putida KT2440
caagccuacgcccccagccu

SEQ ID NO: 1638410 - RNA, 22 nt, Pseudomonas putida KT2440
caagccuacgcccccagccuug

SEQ ID NO: 1638411 - RNA, 14 nt, Pseudomonas putida KT2440
caagcaggugcgca

SEQ ID NO: 1638412 - RNA, 17 nt, Pseudomonas putida KT2440
caagcgcagcccccacc

SEQ ID NO: 1638413 - RNA, 23 nt, Pseudomonas putida KT2440
caagcgaugcacgccagcaucac

SEQ ID NO: 1638414 - RNA, 14 nt, Pseudomonas putida KT2440
caagcgcagccuug

SEQ ID NO: 1638415 - RNA, 16 nt, Pseudomonas putida KT2440
caagccugacucagcc

SEQ ID NO: 1638416 - RNA, 14 nt, Pseudomonas putida KT2440
caagccuugcugau

SEQ ID NO: 1638417 - RNA, 21 nt, Pseudomonas putida KT2440
caagcucuuccuugaucuuca

SEQ ID NO: 1638418 - RNA, 17 nt, Pseudomonas putida KT2440
caagcucguccugcagg

SEQ ID NO: 1638419 - RNA, 16 nt, Pseudomonas putida KT2440
caagcuccccagcaac

SEQ ID NO: 1638420 - RNA, 14 nt, Pseudomonas putida KT2440
caagcguuuuuugg

SEQ ID NO: 1638421 - RNA, 22 nt, Pseudomonas putida KT2440
caacuucccucugccugcccau

SEQ ID NO: 1638422 - RNA, 21 nt, Pseudomonas putida KT2440
caagaaucucccgggccaugu

SEQ ID NO: 1638423 - RNA, 13 nt, Pseudomonas putida KT2440
caagacugcugug

SEQ ID NO: 1638424 - RNA, 20 nt, Pseudomonas putida KT2440
caagacugcuguggaacagc

SEQ ID NO: 1638425 - RNA, 19 nt, Pseudomonas putida KT2440
caagauaacaccccccagc

SEQ ID NO: 1638426 - RNA, 21 nt, Pseudomonas putida KT2440
caaucccgccccaaaggaagu

SEQ ID NO: 1638427 - RNA, 13 nt, Pseudomonas putida KT2440
caauccuggguga

SEQ ID NO: 1638428 - RNA, 21 nt, Pseudomonas putida KT2440
caaucgccacacaagcccccc

SEQ ID NO: 1638429 - RNA, 18 nt, Pseudomonas putida KT2440
caaucagcgguucgacca

SEQ ID NO: 1638430 - RNA, 21 nt, Pseudomonas putida KT2440
caaucaggcugaucaccgccg

SEQ ID NO: 1638431 - RNA, 19 nt, Pseudomonas putida KT2440
caaucagcucacaggcuca

SEQ ID NO: 1638432 - RNA, 20 nt, Pseudomonas putida KT2440
caaucagcucacaggcucag

SEQ ID NO: 1638433 - RNA, 15 nt, Pseudomonas putida KT2440
caaucagcucuucga

SEQ ID NO: 1638434 - RNA, 14 nt, Pseudomonas putida KT2440
caaucaaagcagac

SEQ ID NO: 1638435 - RNA, 19 nt, Pseudomonas putida KT2440
caaucaaagcagacagcug

SEQ ID NO: 1638436 - RNA, 21 nt, Pseudomonas putida KT2440
caaucaccgccagguccaggc

SEQ ID NO: 1638437 - RNA, 23 nt, Pseudomonas putida KT2440
caauacgguaagccgccguggca

SEQ ID NO: 1638438 - RNA, 18 nt, Pseudomonas putida KT2440
caauacacccacaccucg

SEQ ID NO: 1638439 - RNA, 15 nt, Pseudomonas putida KT2440
caauaccggugcccc

SEQ ID NO: 1638440 - RNA, 17 nt, Pseudomonas putida KT2440
caauacauacaccaacg

SEQ ID NO: 1638441 - RNA, 14 nt, Pseudomonas putida KT2440
caauaauaaaaaaa

SEQ ID NO: 1638442 - RNA, 13 nt, Pseudomonas putida KT2440
caauaaaaacaac

SEQ ID NO: 1638443 - RNA, 15 nt, Pseudomonas putida KT2440
caauaaaaacaacag

SEQ ID NO: 1638444 - RNA, 13 nt, Pseudomonas putida KT2440
caaggaucagcuc

SEQ ID NO: 1638445 - RNA, 22 nt, Pseudomonas putida KT2440
caaggcaaagaagucgccacac

SEQ ID NO: 1638446 - RNA, 17 nt, Pseudomonas putida KT2440
caagcuggcaccggcgc

SEQ ID NO: 1638447 - RNA, 13 nt, Pseudomonas putida KT2440
caagcuucaccuc

SEQ ID NO: 1638448 - RNA, 15 nt, Pseudomonas putida KT2440
caagcuggucaggug

SEQ ID NO: 1638449 - RNA, 24 nt, Pseudomonas putida KT2440
caaggcagccccugcacaucacgc

SEQ ID NO: 1638450 - RNA, 18 nt, Pseudomonas putida KT2440
caaggcaaaggucugcug

SEQ ID NO: 1638451 - RNA, 23 nt, Pseudomonas putida KT2440
caaggcaaugcccauggccaggc

SEQ ID NO: 1638452 - RNA, 15 nt, Pseudomonas putida KT2440
caaggcaccaacugc

SEQ ID NO: 1638453 - RNA, 15 nt, Pseudomonas putida KT2440
caaggcauaaaaaag

SEQ ID NO: 1638454 - RNA, 20 nt, Pseudomonas putida KT2440
caaggcauuuucaaugcuuu

SEQ ID NO: 1638455 - RNA, 21 nt, Pseudomonas putida KT2440
caaggcauuuucaaugcuuug

SEQ ID NO: 1638456 - RNA, 13 nt, Pseudomonas putida KT2440
caaguaggcacga

SEQ ID NO: 1638457 - RNA, 16 nt, Pseudomonas putida KT2440
caaguaggcacgauga

SEQ ID NO: 1638458 - RNA, 23 nt, Pseudomonas putida KT2440
caaggccacuggcgucggucgcu

SEQ ID NO: 1638459 - RNA, 17 nt, Pseudomonas putida KT2440
caagucauccgccaggc

SEQ ID NO: 1638460 - RNA, 18 nt, Pseudomonas putida KT2440
caagucauccgccaggcu

SEQ ID NO: 1638461 - RNA, 16 nt, Pseudomonas putida KT2440
caaguguuugaagcua

SEQ ID NO: 1638462 - RNA, 14 nt, Pseudomonas putida KT2440
caagugcuguauga

SEQ ID NO: 1638463 - RNA, 21 nt, Pseudomonas putida KT2440
caagucgcccaguuccauguc

SEQ ID NO: 1638464 - RNA, 17 nt, Pseudomonas putida KT2440
caaguccgaacucccca

SEQ ID NO: 1638465 - RNA, 19 nt, Pseudomonas putida KT2440
caaguccgaacuccccacc

SEQ ID NO: 1638466 - RNA, 20 nt, Pseudomonas putida KT2440
aucaggcucuguuccauuuc

SEQ ID NO: 1638467 - RNA, 14 nt, Pseudomonas putida KT2440
aucaggcacaggcc

SEQ ID NO: 1638468 - RNA, 16 nt, Pseudomonas putida KT2440
aucaggcaggccagca

SEQ ID NO: 1638469 - RNA, 21 nt, Pseudomonas putida KT2440
aucaggcuggcgacgccaccc

SEQ ID NO: 1638470 - RNA, 14 nt, Pseudomonas putida KT2440
aucagggaugcugg

SEQ ID NO: 1638471 - RNA, 17 nt, Pseudomonas putida KT2440
aucagggaugcuggaca

SEQ ID NO: 1638472 - RNA, 20 nt, Pseudomonas putida KT2440
aucagggucagggccaggcc

SEQ ID NO: 1638473 - RNA, 18 nt, Pseudomonas putida KT2440
aucagguugcccagcaug

SEQ ID NO: 1638474 - RNA, 19 nt, Pseudomonas putida KT2440
aucagguugcccagcaugc

SEQ ID NO: 1638475 - RNA, 21 nt, Pseudomonas putida KT2440
aucaggucgccaggcuucaga

SEQ ID NO: 1638476 - RNA, 19 nt, Pseudomonas putida KT2440
aucaggucgacacccagca

SEQ ID NO: 1638477 - RNA, 18 nt, Pseudomonas putida KT2440
aucagguaauccggcaug

SEQ ID NO: 1638478 - RNA, 19 nt, Pseudomonas putida KT2440
aaaacggcggcccggccaa

SEQ ID NO: 1638479 - RNA, 21 nt, Pseudomonas putida KT2440
aucagccggucucccagcgcu

SEQ ID NO: 1638480 - RNA, 20 nt, Pseudomonas putida KT2440
aucagccgugacaguucgug

SEQ ID NO: 1638481 - RNA, 20 nt, Pseudomonas putida KT2440
aucagcggcgccacccagaa

SEQ ID NO: 1638482 - RNA, 23 nt, Pseudomonas putida KT2440
aucagcggcuuguucagcuggug

SEQ ID NO: 1638483 - RNA, 16 nt, Pseudomonas putida KT2440
aucagcggcaggcugg

SEQ ID NO: 1638484 - RNA, 12 nt, Pseudomonas putida KT2440
aucagcgacacc

SEQ ID NO: 1638485 - RNA, 17 nt, Pseudomonas putida KT2440
aucagcgacaccgccaa

SEQ ID NO: 1638486 - RNA, 21 nt, Pseudomonas putida KT2440
aucaggagcaacuaccaugaa

SEQ ID NO: 1638487 - RNA, 17 nt, Pseudomonas putida KT2440
aucaggauugccgcagc

SEQ ID NO: 1638488 - RNA, 21 nt, Pseudomonas putida KT2440
aucaggauugccgcagcugcg

SEQ ID NO: 1638489 - RNA, 17 nt, Pseudomonas putida KT2440
aucagcacacccagcac

SEQ ID NO: 1638490 - RNA, 20 nt, Pseudomonas putida KT2440
aucagcacacgcccgugcuc

SEQ ID NO: 1638491 - RNA, 13 nt, Pseudomonas putida KT2440
aucagcagcugcc

SEQ ID NO: 1638492 - RNA, 17 nt, Pseudomonas putida KT2440
aucagcagcuguugcug

SEQ ID NO: 1638493 - RNA, 16 nt, Pseudomonas putida KT2440
aucaccuguuccccca

SEQ ID NO: 1638494 - RNA, 22 nt, Pseudomonas putida KT2440
aucaccugcacaucggccaccg

SEQ ID NO: 1638495 - RNA, 19 nt, Pseudomonas putida KT2440
aucacgaacaccagcccca

SEQ ID NO: 1638496 - RNA, 13 nt, Pseudomonas putida KT2440
aucacguuuggca

SEQ ID NO: 1638497 - RNA, 18 nt, Pseudomonas putida KT2440
aucacguuuggcagugcc

SEQ ID NO: 1638498 - RNA, 17 nt, Pseudomonas putida KT2440
aucaccacaaaaccuuc

SEQ ID NO: 1638499 - RNA, 20 nt, Pseudomonas putida KT2440
aucaccaaggcuugaguggu

SEQ ID NO: 1638500 - RNA, 13 nt, Pseudomonas putida KT2440
aucaccagccccu

SEQ ID NO: 1638501 - RNA, 15 nt, Pseudomonas putida KT2440
aucaccacgcccugg

SEQ ID NO: 1638502 - RNA, 15 nt, Pseudomonas putida KT2440
aucaccagcagcuuc

SEQ ID NO: 1638503 - RNA, 21 nt, Pseudomonas putida KT2440
aucaccagcagcuucuucaca

SEQ ID NO: 1638504 - RNA, 15 nt, Pseudomonas putida KT2440
aucaccaggcccgca

SEQ ID NO: 1638505 - RNA, 21 nt, Pseudomonas putida KT2440
aucaccaggcccgcaaggguc

SEQ ID NO: 1638506 - RNA, 22 nt, Pseudomonas putida KT2440
aucaccagguuguggcccauga

SEQ ID NO: 1638507 - RNA, 17 nt, Pseudomonas putida KT2440
aucacccuuggccaccu

SEQ ID NO: 1638508 - RNA, 19 nt, Pseudomonas putida KT2440
aucacccgggaacagcagc

SEQ ID NO: 1638509 - RNA, 21 nt, Pseudomonas putida KT2440
aucacccgggaacagcagcac

SEQ ID NO: 1638510 - RNA, 13 nt, Pseudomonas putida KT2440
aucaccgacgugu

SEQ ID NO: 1638511 - RNA, 15 nt, Pseudomonas putida KT2440
aucacauaaggcagc

SEQ ID NO: 1638512 - RNA, 19 nt, Pseudomonas putida KT2440
aucacauaaggcagcagcu

SEQ ID NO: 1638513 - RNA, 16 nt, Pseudomonas putida KT2440
aucacauccacagccu

SEQ ID NO: 1638514 - RNA, 18 nt, Pseudomonas putida KT2440
auauggcgcuuucacugg

SEQ ID NO: 1638515 - RNA, 13 nt, Pseudomonas putida KT2440
auaugcuccaugu

SEQ ID NO: 1638516 - RNA, 18 nt, Pseudomonas putida KT2440
aucaacccgugcccggca

SEQ ID NO: 1638517 - RNA, 13 nt, Pseudomonas putida KT2440
aucaaauuuagag

SEQ ID NO: 1638518 - RNA, 13 nt, Pseudomonas putida KT2440
auauuugaacacc

SEQ ID NO: 1638519 - RNA, 21 nt, Pseudomonas putida KT2440
auauccacacccgccacgcuc

SEQ ID NO: 1638520 - RNA, 12 nt, Pseudomonas putida KT2440
auauccagcacc

SEQ ID NO: 1638521 - RNA, 15 nt, Pseudomonas putida KT2440
auauccgcagccccg

SEQ ID NO: 1638522 - RNA, 20 nt, Pseudomonas putida KT2440
auauccgcuuugcuugaguu

SEQ ID NO: 1638523 - RNA, 18 nt, Pseudomonas putida KT2440
auaggccuuggcuucacu

SEQ ID NO: 1638524 - RNA, 19 nt, Pseudomonas putida KT2440
auaggccccgaaugcacgg

SEQ ID NO: 1638525 - RNA, 11 nt, Pseudomonas putida KT2440
auaggccgcaa

SEQ ID NO: 1638526 - RNA, 13 nt, Pseudomonas putida KT2440
auaggugguguug

SEQ ID NO: 1638527 - RNA, 16 nt, Pseudomonas putida KT2440
auagcuuucaggcgca

SEQ ID NO: 1638528 - RNA, 22 nt, Pseudomonas putida KT2440
auagcuuuuuuggcguaguaau

SEQ ID NO: 1638529 - RNA, 19 nt, Pseudomonas putida KT2440
auaggacugcuucaggccu

SEQ ID NO: 1638530 - RNA, 13 nt, Pseudomonas putida KT2440
auagcccugcccu

SEQ ID NO: 1638531 - RNA, 18 nt, Pseudomonas putida KT2440
auagcccgcuggccgcac

SEQ ID NO: 1638532 - RNA, 22 nt, Pseudomonas putida KT2440
auagcccaccgucaggcucagc

SEQ ID NO: 1638533 - RNA, 13 nt, Pseudomonas putida KT2440
auacccagcgccg

SEQ ID NO: 1638534 - RNA, 17 nt, Pseudomonas putida KT2440
auacccaauaaaaacaa

SEQ ID NO: 1638535 - RNA, 19 nt, Pseudomonas putida KT2440
auaccaaacggagacucga

SEQ ID NO: 1638536 - RNA, 22 nt, Pseudomonas putida KT2440
auaccacgcgauuuuuuugaaa

SEQ ID NO: 1638537 - RNA, 18 nt, Pseudomonas putida KT2440
auaccacggucguaguca

SEQ ID NO: 1638538 - RNA, 19 nt, Pseudomonas putida KT2440
auaccaccucacacuggua

SEQ ID NO: 1638539 - RNA, 22 nt, Pseudomonas putida KT2440
auagaaccguuucaguacagcc

SEQ ID NO: 1638540 - RNA, 14 nt, Pseudomonas putida KT2440
auagaacuccacca

SEQ ID NO: 1638541 - RNA, 18 nt, Pseudomonas putida KT2440
auagaacacuggcaggcu

SEQ ID NO: 1638542 - RNA, 21 nt, Pseudomonas putida KT2440
auagacaaaaaaaucggccgc

SEQ ID NO: 1638543 - RNA, 19 nt, Pseudomonas putida KT2440
auagaccucgagaauccgu

SEQ ID NO: 1638544 - RNA, 19 nt, Pseudomonas putida KT2440
auacggcuugauauccagc

SEQ ID NO: 1638545 - RNA, 14 nt, Pseudomonas putida KT2440
auacguaaccgccc

SEQ ID NO: 1638546 - RNA, 21 nt, Pseudomonas putida KT2440
auaccguuguagcugcugaca

SEQ ID NO: 1638547 - RNA, 15 nt, Pseudomonas putida KT2440
auaccgguagccucg

SEQ ID NO: 1638548 - RNA, 18 nt, Pseudomonas putida KT2440
augaacuggaugauccag

SEQ ID NO: 1638549 - RNA, 22 nt, Pseudomonas putida KT2440
augaaacgcguuucggcggccu

SEQ ID NO: 1638550 - RNA, 19 nt, Pseudomonas putida KT2440
augacaaacgccagcaugc

SEQ ID NO: 1638551 - RNA, 22 nt, Pseudomonas putida KT2440
augacaaacgccagcaugcugg

SEQ ID NO: 1638552 - RNA, 12 nt, Pseudomonas putida KT2440
augaauaaugcu

SEQ ID NO: 1638553 - RNA, 17 nt, Pseudomonas putida KT2440
augaauaaugcuccagc

SEQ ID NO: 1638554 - RNA, 20 nt, Pseudomonas putida KT2440
augaauaaugcuccagcgaa

SEQ ID NO: 1638555 - RNA, 22 nt, Pseudomonas putida KT2440
augaccguccacguuggucucg

SEQ ID NO: 1638556 - RNA, 15 nt, Pseudomonas putida KT2440
aucuguugcugcagg

SEQ ID NO: 1638557 - RNA, 17 nt, Pseudomonas putida KT2440
aucuguugcugcagguu

SEQ ID NO: 1638558 - RNA, 20 nt, Pseudomonas putida KT2440
aucuguugcugcagguucug

SEQ ID NO: 1638559 - RNA, 13 nt, Pseudomonas putida KT2440
aucuggugcaggu

SEQ ID NO: 1638560 - RNA, 20 nt, Pseudomonas putida KT2440
aucugguugccgccagcccc

SEQ ID NO: 1638561 - RNA, 15 nt, Pseudomonas putida KT2440
aucuucuucaucacu

SEQ ID NO: 1638562 - RNA, 22 nt, Pseudomonas putida KT2440
aucuugcgugcaugggccaggg

SEQ ID NO: 1638563 - RNA, 14 nt, Pseudomonas putida KT2440
aucuugcugcucug

SEQ ID NO: 1638564 - RNA, 16 nt, Pseudomonas putida KT2440
aucuugcugcucugca

SEQ ID NO: 1638565 - RNA, 17 nt, Pseudomonas putida KT2440
aucuugcugcucugcaa

SEQ ID NO: 1638566 - RNA, 22 nt, Pseudomonas putida KT2440
aucuuguguuuugccuccagcu

SEQ ID NO: 1638567 - RNA, 22 nt, Pseudomonas putida KT2440
aucuugcugaacagccggcccu

SEQ ID NO: 1638568 - RNA, 13 nt, Pseudomonas putida KT2440
aucuuggccaggg

SEQ ID NO: 1638569 - RNA, 19 nt, Pseudomonas putida KT2440
aucuugggcaaggccguug

SEQ ID NO: 1638570 - RNA, 16 nt, Pseudomonas putida KT2440
aucugcagggguggga

SEQ ID NO: 1638571 - RNA, 18 nt, Pseudomonas putida KT2440
aucugcacacugcgcuug

SEQ ID NO: 1638572 - RNA, 13 nt, Pseudomonas putida KT2440
aucugcagcagca

SEQ ID NO: 1638573 - RNA, 15 nt, Pseudomonas putida KT2440
aucugcaccggcagc

SEQ ID NO: 1638574 - RNA, 15 nt, Pseudomonas putida KT2440
aucugcaccugguaa

SEQ ID NO: 1638575 - RNA, 17 nt, Pseudomonas putida KT2440
aucugaggcccgaaggu

SEQ ID NO: 1638576 - RNA, 18 nt, Pseudomonas putida KT2440
aucucuucgucaccgugc

SEQ ID NO: 1638577 - RNA, 14 nt, Pseudomonas putida KT2440
aucugcucuucgcc

SEQ ID NO: 1638578 - RNA, 17 nt, Pseudomonas putida KT2440
aucugccggcgccucca

SEQ ID NO: 1638579 - RNA, 13 nt, Pseudomonas putida KT2440
aucugccgaugcg

SEQ ID NO: 1638580 - RNA, 16 nt, Pseudomonas putida KT2440
aucugcugcagcaugg

SEQ ID NO: 1638581 - RNA, 16 nt, Pseudomonas putida KT2440
aucugcugcggcaggc

SEQ ID NO: 1638582 - RNA, 13 nt, Pseudomonas putida KT2440
aucugcugggugc

SEQ ID NO: 1638583 - RNA, 13 nt, Pseudomonas putida KT2440
aucugcauggcau

SEQ ID NO: 1638584 - RNA, 19 nt, Pseudomonas putida KT2440
aucugccaggcaccacaag

SEQ ID NO: 1638585 - RNA, 14 nt, Pseudomonas putida KT2440
aucuggaccccgcc

SEQ ID NO: 1638586 - RNA, 20 nt, Pseudomonas putida KT2440
aucuggucacccugacgcug

SEQ ID NO: 1638587 - RNA, 21 nt, Pseudomonas putida KT2440
aucuggucagucgagucgaca

SEQ ID NO: 1638588 - RNA, 15 nt, Pseudomonas putida KT2440
aucugguaggccggc

SEQ ID NO: 1638589 - RNA, 23 nt, Pseudomonas putida KT2440
aucugggucuugaucuugguggu

SEQ ID NO: 1638590 - RNA, 13 nt, Pseudomonas putida KT2440
aucucccagccug

SEQ ID NO: 1638591 - RNA, 18 nt, Pseudomonas putida KT2440
aucuccauagguuaucca

SEQ ID NO: 1638592 - RNA, 19 nt, Pseudomonas putida KT2440
aucuccaugaaggccggca

SEQ ID NO: 1638593 - RNA, 13 nt, Pseudomonas putida KT2440
aucucaagcuuca

SEQ ID NO: 1638594 - RNA, 16 nt, Pseudomonas putida KT2440
aucucaaggcuuucca

SEQ ID NO: 1638595 - RNA, 20 nt, Pseudomonas putida KT2440
aucucaaggcuuuccaccug

SEQ ID NO: 1638596 - RNA, 15 nt, Pseudomonas putida KT2440
aucucuucagccacc

SEQ ID NO: 1638597 - RNA, 19 nt, Pseudomonas putida KT2440
aucucggucgacaggggca

SEQ ID NO: 1638598 - RNA, 13 nt, Pseudomonas putida KT2440
aucgcuuacagau

SEQ ID NO: 1638599 - RNA, 18 nt, Pseudomonas putida KT2440
aucggcaaacacauccag

SEQ ID NO: 1638600 - RNA, 16 nt, Pseudomonas putida KT2440
aucgucggccccggcc

SEQ ID NO: 1638601 - RNA, 20 nt, Pseudomonas putida KT2440
aucgucgacaacgcacccgc

SEQ ID NO: 1638602 - RNA, 12 nt, Pseudomonas putida KT2440
aucguccaccca

SEQ ID NO: 1638603 - RNA, 13 nt, Pseudomonas putida KT2440
aucguccacccac

SEQ ID NO: 1638604 - RNA, 15 nt, Pseudomonas putida KT2440
aucuaccugagccug

SEQ ID NO: 1638605 - RNA, 18 nt, Pseudomonas putida KT2440
aucuaaaaucaucggcaa

SEQ ID NO: 1638606 - RNA, 17 nt, Pseudomonas putida KT2440
aucgccaggugcucagc

SEQ ID NO: 1638607 - RNA, 15 nt, Pseudomonas putida KT2440
aucgcaauccccucc

SEQ ID NO: 1638608 - RNA, 13 nt, Pseudomonas putida KT2440
aucgcaccgugcu

SEQ ID NO: 1638609 - RNA, 17 nt, Pseudomonas putida KT2440
aucgauccccaguucac

SEQ ID NO: 1638610 - RNA, 14 nt, Pseudomonas putida KT2440
aucgaggaaggcau

SEQ ID NO: 1638611 - RNA, 15 nt, Pseudomonas putida KT2440
aucgaggaaggcauc

SEQ ID NO: 1638612 - RNA, 13 nt, Pseudomonas putida KT2440
aucgauggucuuc

SEQ ID NO: 1638613 - RNA, 15 nt, Pseudomonas putida KT2440
aucgagcgccgcccg

SEQ ID NO: 1638614 - RNA, 17 nt, Pseudomonas putida KT2440
aucgagcuacagccccu

SEQ ID NO: 1638615 - RNA, 21 nt, Pseudomonas putida KT2440
aucgaaacauugacagcuuuu

SEQ ID NO: 1638616 - RNA, 22 nt, Pseudomonas putida KT2440
aucgaaacauugacagcuuuug

SEQ ID NO: 1638617 - RNA, 20 nt, Pseudomonas putida KT2440
aucgccggguccaccagccc

SEQ ID NO: 1638618 - RNA, 13 nt, Pseudomonas putida KT2440
aucgccucggcac

SEQ ID NO: 1638619 - RNA, 13 nt, Pseudomonas putida KT2440
aucgccuccaggc

SEQ ID NO: 1638620 - RNA, 13 nt, Pseudomonas putida KT2440
aucgccucgugca

SEQ ID NO: 1638621 - RNA, 12 nt, Pseudomonas putida KT2440
aucgccugcuug

SEQ ID NO: 1638622 - RNA, 20 nt, Pseudomonas putida KT2440
aucgccuggccggccgggcu

SEQ ID NO: 1638623 - RNA, 18 nt, Pseudomonas putida KT2440
aucgcgggccagguggcc

SEQ ID NO: 1638624 - RNA, 20 nt, Pseudomonas putida KT2440
aucgcgguauccaucaccau

SEQ ID NO: 1638625 - RNA, 16 nt, Pseudomonas putida KT2440
aucgcgcacuugccag

SEQ ID NO: 1638626 - RNA, 19 nt, Pseudomonas putida KT2440
aucgcgcacuugccagccg

SEQ ID NO: 1638627 - RNA, 15 nt, Pseudomonas putida KT2440
aucgcgcaggucgac

SEQ ID NO: 1638628 - RNA, 22 nt, Pseudomonas putida KT2440
aucgcgaaacgcggcaaccugc

SEQ ID NO: 1638629 - RNA, 19 nt, Pseudomonas putida KT2440
aucgccuucagcgccccau

SEQ ID NO: 1638630 - RNA, 13 nt, Pseudomonas putida KT2440
auccucgcccacc

SEQ ID NO: 1638631 - RNA, 15 nt, Pseudomonas putida KT2440
auccucggccaggcc

SEQ ID NO: 1638632 - RNA, 18 nt, Pseudomonas putida KT2440
auccucguccagcucguc

SEQ ID NO: 1638633 - RNA, 17 nt, Pseudomonas putida KT2440
auccuccgcccugcccu

SEQ ID NO: 1638634 - RNA, 18 nt, Pseudomonas putida KT2440
auccuccagcccugcucg

SEQ ID NO: 1638635 - RNA, 15 nt, Pseudomonas putida KT2440
auccuccugcgcaug

SEQ ID NO: 1638636 - RNA, 21 nt, Pseudomonas putida KT2440
auccucaaaucgcugcggccg

SEQ ID NO: 1638637 - RNA, 17 nt, Pseudomonas putida KT2440
auccucaagcugcaccg

SEQ ID NO: 1638638 - RNA, 19 nt, Pseudomonas putida KT2440
auccucaagcugcaccgcc

SEQ ID NO: 1638639 - RNA, 20 nt, Pseudomonas putida KT2440
auccuucaggcgcucacccc

SEQ ID NO: 1638640 - RNA, 20 nt, Pseudomonas putida KT2440
auccguggguugaucucuuc

SEQ ID NO: 1638641 - RNA, 15 nt, Pseudomonas putida KT2440
auccgugcaccgcuc

SEQ ID NO: 1638642 - RNA, 20 nt, Pseudomonas putida KT2440
auccgguggcaucaccggca

SEQ ID NO: 1638643 - RNA, 21 nt, Pseudomonas putida KT2440
auccguucggcgcgcugcugg

SEQ ID NO: 1638644 - RNA, 22 nt, Pseudomonas putida KT2440
auccgggugcuggcucgcugcc

SEQ ID NO: 1638645 - RNA, 16 nt, Pseudomonas putida KT2440
auccggggccgcaagg

SEQ ID NO: 1638646 - RNA, 19 nt, Pseudomonas putida KT2440
auccggcgcggccugcucc

SEQ ID NO: 1638647 - RNA, 17 nt, Pseudomonas putida KT2440
aucccgaggucagcagu

SEQ ID NO: 1638648 - RNA, 23 nt, Pseudomonas putida KT2440
aucccgcaggaauaacuggcccg

SEQ ID NO: 1638649 - RNA, 21 nt, Pseudomonas putida KT2440
auccccuuauaaugcgcccca

SEQ ID NO: 1638650 - RNA, 11 nt, Pseudomonas putida KT2440
auccagcuugc

SEQ ID NO: 1638651 - RNA, 20 nt, Pseudomonas putida KT2440
auccaggaaaagguagugca

SEQ ID NO: 1638652 - RNA, 12 nt, Pseudomonas putida KT2440
auccaucaccau

SEQ ID NO: 1638653 - RNA, 20 nt, Pseudomonas putida KT2440
auccagcggcgacaggugcc

SEQ ID NO: 1638654 - RNA, 22 nt, Pseudomonas putida KT2440
auccagcgguucguugcagaag

SEQ ID NO: 1638655 - RNA, 17 nt, Pseudomonas putida KT2440
auccagcuccagcacca

SEQ ID NO: 1638656 - RNA, 11 nt, Pseudomonas putida KT2440
auccagcugcu

SEQ ID NO: 1638657 - RNA, 17 nt, Pseudomonas putida KT2440
auccagaugaugucuac

SEQ ID NO: 1638658 - RNA, 23 nt, Pseudomonas putida KT2440
auccacucgucgaucuggaugaa

SEQ ID NO: 1638659 - RNA, 17 nt, Pseudomonas putida KT2440
auccacaaucagcacug

SEQ ID NO: 1638660 - RNA, 17 nt, Pseudomonas putida KT2440
auccacagggccuuccc

SEQ ID NO: 1638661 - RNA, 19 nt, Pseudomonas putida KT2440
auccacauccgguggcauc

SEQ ID NO: 1638662 - RNA, 17 nt, Pseudomonas putida KT2440
aucauugggucccuggu

SEQ ID NO: 1638663 - RNA, 20 nt, Pseudomonas putida KT2440
aaaacuggccagcagccccc

SEQ ID NO: 1638664 - RNA, 23 nt, Pseudomonas putida KT2440
aaaacuggccagcagccccccuu

SEQ ID NO: 1638665 - RNA, 16 nt, Pseudomonas putida KT2440
aaaacucggucaggca

SEQ ID NO: 1638666 - RNA, 22 nt, Pseudomonas putida KT2440
aucaucugcugaucuucccggg

SEQ ID NO: 1638667 - RNA, 21 nt, Pseudomonas putida KT2440
aucaucggcaugcagcggcca

SEQ ID NO: 1638668 - RNA, 23 nt, Pseudomonas putida KT2440
auaaacgccgcccccuucacuga

SEQ ID NO: 1638669 - RNA, 19 nt, Pseudomonas putida KT2440
aguuggccgggccuuucac

SEQ ID NO: 1638670 - RNA, 15 nt, Pseudomonas putida KT2440
aguuggcucugugga

SEQ ID NO: 1638671 - RNA, 23 nt, Pseudomonas putida KT2440
aguuggcucuguggauuucaauu

SEQ ID NO: 1638672 - RNA, 22 nt, Pseudomonas putida KT2440
aguuggucaaagaacguggaca

SEQ ID NO: 1638673 - RNA, 17 nt, Pseudomonas putida KT2440
aguuuuccuaaagcauu

SEQ ID NO: 1638674 - RNA, 16 nt, Pseudomonas putida KT2440
aguuuuuguaccugug

SEQ ID NO: 1638675 - RNA, 12 nt, Pseudomonas putida KT2440
auaaaaacaaca

SEQ ID NO: 1638676 - RNA, 14 nt, Pseudomonas putida KT2440
auaaaacuaccuca

SEQ ID NO: 1638677 - RNA, 15 nt, Pseudomonas putida KT2440
auaaggcuugcccuc

SEQ ID NO: 1638678 - RNA, 18 nt, Pseudomonas putida KT2440
auaagcgacaaaggcguc

SEQ ID NO: 1638679 - RNA, 16 nt, Pseudomonas putida KT2440
auaacgaaucugcagu

SEQ ID NO: 1638680 - RNA, 14 nt, Pseudomonas putida KT2440
auaacuccagcgcc

SEQ ID NO: 1638681 - RNA, 20 nt, Pseudomonas putida KT2440
aguucagcgccucuuugccc

SEQ ID NO: 1638682 - RNA, 18 nt, Pseudomonas putida KT2440
aguuccugcuugccgggu

SEQ ID NO: 1638683 - RNA, 23 nt, Pseudomonas putida KT2440
aguuccuucuugugcacaaagcc

SEQ ID NO: 1638684 - RNA, 19 nt, Pseudomonas putida KT2440
aguucccaggcagccucca

SEQ ID NO: 1638685 - RNA, 16 nt, Pseudomonas putida KT2440
aguucaaugccagcag

SEQ ID NO: 1638686 - RNA, 23 nt, Pseudomonas putida KT2440
aguucgaaaccacccugaugcag

SEQ ID NO: 1638687 - RNA, 14 nt, Pseudomonas putida KT2440
aguucgcccuucag

SEQ ID NO: 1638688 - RNA, 18 nt, Pseudomonas putida KT2440
aguucgcugcgcaaggca

SEQ ID NO: 1638689 - RNA, 17 nt, Pseudomonas putida KT2440
aguucuuggucagcauc

SEQ ID NO: 1638690 - RNA, 18 nt, Pseudomonas putida KT2440
aguucuuggucagcauca

SEQ ID NO: 1638691 - RNA, 22 nt, Pseudomonas putida KT2440
aguugacccugaaucagcaaac

SEQ ID NO: 1638692 - RNA, 20 nt, Pseudomonas putida KT2440
aguugaaugccgccauccuc

SEQ ID NO: 1638693 - RNA, 14 nt, Pseudomonas putida KT2440
aguugaccagcacc

SEQ ID NO: 1638694 - RNA, 15 nt, Pseudomonas putida KT2440
aguugaccagcacca

SEQ ID NO: 1638695 - RNA, 17 nt, Pseudomonas putida KT2440
aguugaccagcaccagc

SEQ ID NO: 1638696 - RNA, 15 nt, Pseudomonas putida KT2440
aguugcuccaccugc

SEQ ID NO: 1638697 - RNA, 16 nt, Pseudomonas putida KT2440
aguugcuccaccugcc

SEQ ID NO: 1638698 - RNA, 21 nt, Pseudomonas putida KT2440
aguguuggcagauaucuggac

SEQ ID NO: 1638699 - RNA, 16 nt, Pseudomonas putida KT2440
aguguucgaggaacau

SEQ ID NO: 1638700 - RNA, 16 nt, Pseudomonas putida KT2440
agugucugcgccugcu

SEQ ID NO: 1638701 - RNA, 21 nt, Pseudomonas putida KT2440
agugugaugcagccagccucu

SEQ ID NO: 1638702 - RNA, 17 nt, Pseudomonas putida KT2440
agugugcaaacacccag

SEQ ID NO: 1638703 - RNA, 17 nt, Pseudomonas putida KT2440
agugguugacaagcaaa

SEQ ID NO: 1638704 - RNA, 21 nt, Pseudomonas putida KT2440
aguggcggcucgcugaacacg

SEQ ID NO: 1638705 - RNA, 19 nt, Pseudomonas putida KT2440
agugcuuguggccauugca

SEQ ID NO: 1638706 - RNA, 14 nt, Pseudomonas putida KT2440
aguggcgcaggcug

SEQ ID NO: 1638707 - RNA, 18 nt, Pseudomonas putida KT2440
agugagccucacacagca

SEQ ID NO: 1638708 - RNA, 22 nt, Pseudomonas putida KT2440
agugagcuaaaccgcgaugcug

SEQ ID NO: 1638709 - RNA, 23 nt, Pseudomonas putida KT2440
agugagcuaaaccgcgaugcugc

SEQ ID NO: 1638710 - RNA, 15 nt, Pseudomonas putida KT2440
agugcgucggccacc

SEQ ID NO: 1638711 - RNA, 18 nt, Pseudomonas putida KT2440
agugcuaaugcucuugga

SEQ ID NO: 1638712 - RNA, 21 nt, Pseudomonas putida KT2440
agucgaaaccgaaaccacugc

SEQ ID NO: 1638713 - RNA, 16 nt, Pseudomonas putida KT2440
agucgcacaugaagcc

SEQ ID NO: 1638714 - RNA, 17 nt, Pseudomonas putida KT2440
aguccuuggccaaugcc

SEQ ID NO: 1638715 - RNA, 15 nt, Pseudomonas putida KT2440
agucccguuggcccg

SEQ ID NO: 1638716 - RNA, 19 nt, Pseudomonas putida KT2440
agucccugauacuucugac

SEQ ID NO: 1638717 - RNA, 21 nt, Pseudomonas putida KT2440
agucgccaaccgccagcaguu

SEQ ID NO: 1638718 - RNA, 22 nt, Pseudomonas putida KT2440
agucgccacaccacagcugcac

SEQ ID NO: 1638719 - RNA, 22 nt, Pseudomonas putida KT2440
agucgccgcggguaccaccugg

SEQ ID NO: 1638720 - RNA, 20 nt, Pseudomonas putida KT2440
agucgugccggaacaacccc

SEQ ID NO: 1638721 - RNA, 17 nt, Pseudomonas putida KT2440
agucgucggccgcaucc

SEQ ID NO: 1638722 - RNA, 23 nt, Pseudomonas putida KT2440
agucuacggaccuccgagucucc

SEQ ID NO: 1638723 - RNA, 13 nt, Pseudomonas putida KT2440
agugaacuccaac

SEQ ID NO: 1638724 - RNA, 13 nt, Pseudomonas putida KT2440
agugaauuccuug

SEQ ID NO: 1638725 - RNA, 22 nt, Pseudomonas putida KT2440
agugacacggcgaugcgccccc

SEQ ID NO: 1638726 - RNA, 16 nt, Pseudomonas putida KT2440
agucuugcugaucacc

SEQ ID NO: 1638727 - RNA, 18 nt, Pseudomonas putida KT2440
agucaggcugcacaaggu

SEQ ID NO: 1638728 - RNA, 20 nt, Pseudomonas putida KT2440
agucaggccgaugggcaggc

SEQ ID NO: 1638729 - RNA, 20 nt, Pseudomonas putida KT2440
agucagguugcacagcauca

SEQ ID NO: 1638730 - RNA, 22 nt, Pseudomonas putida KT2440
agucaugcucgccggccuuggc

SEQ ID NO: 1638731 - RNA, 15 nt, Pseudomonas putida KT2440
agucaugggccaugc

SEQ ID NO: 1638732 - RNA, 16 nt, Pseudomonas putida KT2440
agucaugggccaugcc

SEQ ID NO: 1638733 - RNA, 21 nt, Pseudomonas putida KT2440
agucaucacguuacgccagaa

SEQ ID NO: 1638734 - RNA, 13 nt, Pseudomonas putida KT2440
aguccagcugcau

SEQ ID NO: 1638735 - RNA, 14 nt, Pseudomonas putida KT2440
aguccagcugcauc

SEQ ID NO: 1638736 - RNA, 16 nt, Pseudomonas putida KT2440
aguccaggaagcaggc

SEQ ID NO: 1638737 - RNA, 23 nt, Pseudomonas putida KT2440
aguccaggucgcggagccagaca

SEQ ID NO: 1638738 - RNA, 12 nt, Pseudomonas putida KT2440
agucccagcacc

SEQ ID NO: 1638739 - RNA, 15 nt, Pseudomonas putida KT2440
aguagaagcagauca

SEQ ID NO: 1638740 - RNA, 17 nt, Pseudomonas putida KT2440
aguagaagcagaucauc

SEQ ID NO: 1638741 - RNA, 14 nt, Pseudomonas putida KT2440
aguacuccagcagc

SEQ ID NO: 1638742 - RNA, 20 nt, Pseudomonas putida KT2440
aguacugggcguccuucucc

SEQ ID NO: 1638743 - RNA, 17 nt, Pseudomonas putida KT2440
aguacuuauaagcagca

SEQ ID NO: 1638744 - RNA, 19 nt, Pseudomonas putida KT2440
aguacuuauaagcagcaag

SEQ ID NO: 1638745 - RNA, 14 nt, Pseudomonas putida KT2440
aguacuuuuucagg

SEQ ID NO: 1638746 - RNA, 18 nt, Pseudomonas putida KT2440
aguagagcccccagcaca

SEQ ID NO: 1638747 - RNA, 13 nt, Pseudomonas putida KT2440
agucagcgugcca

SEQ ID NO: 1638748 - RNA, 16 nt, Pseudomonas putida KT2440
agucagacuccuuuga

SEQ ID NO: 1638749 - RNA, 21 nt, Pseudomonas putida KT2440
agucagaaaguuugguuuuuu

SEQ ID NO: 1638750 - RNA, 14 nt, Pseudomonas putida KT2440
aggucugcugcggc

SEQ ID NO: 1638751 - RNA, 15 nt, Pseudomonas putida KT2440
aggucugcugcggcc

SEQ ID NO: 1638752 - RNA, 17 nt, Pseudomonas putida KT2440
aggucuucgaucucggc

SEQ ID NO: 1638753 - RNA, 21 nt, Pseudomonas putida KT2440
aggucuucucggcagacccuu

SEQ ID NO: 1638754 - RNA, 21 nt, Pseudomonas putida KT2440
aggucuucaaaucgcugcgca

SEQ ID NO: 1638755 - RNA, 16 nt, Pseudomonas putida KT2440
aggugacaagcugcgc

SEQ ID NO: 1638756 - RNA, 15 nt, Pseudomonas putida KT2440
agguccgguaacugg

SEQ ID NO: 1638757 - RNA, 22 nt, Pseudomonas putida KT2440
agguccgguaacuggcccaccc

SEQ ID NO: 1638758 - RNA, 16 nt, Pseudomonas putida KT2440
agguccugcuccaccc

SEQ ID NO: 1638759 - RNA, 16 nt, Pseudomonas putida KT2440
aggucucgaacgcugu

SEQ ID NO: 1638760 - RNA, 20 nt, Pseudomonas putida KT2440
aggucgacccgcgccagggu

SEQ ID NO: 1638761 - RNA, 17 nt, Pseudomonas putida KT2440
aggucacggucuuggcc

SEQ ID NO: 1638762 - RNA, 19 nt, Pseudomonas putida KT2440
aggucacguuguagcccac

SEQ ID NO: 1638763 - RNA, 21 nt, Pseudomonas putida KT2440
aggucaacggcaacgccagca

SEQ ID NO: 1638764 - RNA, 15 nt, Pseudomonas putida KT2440
aggucaaucuugugg

SEQ ID NO: 1638765 - RNA, 12 nt, Pseudomonas putida KT2440
aggucagcaagc

SEQ ID NO: 1638766 - RNA, 16 nt, Pseudomonas putida KT2440
aggucagcaagccgcc

SEQ ID NO: 1638767 - RNA, 18 nt, Pseudomonas putida KT2440
aggucagcgcucaaaaaa

SEQ ID NO: 1638768 - RNA, 21 nt, Pseudomonas putida KT2440
aggucaggucgcuaucggcag

SEQ ID NO: 1638769 - RNA, 15 nt, Pseudomonas putida KT2440
agguguuccagcacg

SEQ ID NO: 1638770 - RNA, 20 nt, Pseudomonas putida KT2440
aggugucgauacucacccgc

SEQ ID NO: 1638771 - RNA, 18 nt, Pseudomonas putida KT2440
aggugucgaacaccaccg

SEQ ID NO: 1638772 - RNA, 14 nt, Pseudomonas putida KT2440
agguguugaaaugg

SEQ ID NO: 1638773 - RNA, 20 nt, Pseudomonas putida KT2440
agguguugaaaugggaugag

SEQ ID NO: 1638774 - RNA, 22 nt, Pseudomonas putida KT2440
agguuacuggccaauugcgcca

SEQ ID NO: 1638775 - RNA, 22 nt, Pseudomonas putida KT2440
agguuacgcaccagcuccaaca

SEQ ID NO: 1638776 - RNA, 16 nt, Pseudomonas putida KT2440
agguuauccacacccu

SEQ ID NO: 1638777 - RNA, 23 nt, Pseudomonas putida KT2440
agguucagcgcaaauccccaacc

SEQ ID NO: 1638778 - RNA, 18 nt, Pseudomonas putida KT2440
aggugcgcggcaggucga

SEQ ID NO: 1638779 - RNA, 15 nt, Pseudomonas putida KT2440
aggugccaggcucag

SEQ ID NO: 1638780 - RNA, 22 nt, Pseudomonas putida KT2440
aggugcccaagcggcacuacca

SEQ ID NO: 1638781 - RNA, 16 nt, Pseudomonas putida KT2440
aggugccaacaggcag

SEQ ID NO: 1638782 - RNA, 21 nt, Pseudomonas putida KT2440
aggugcgguccggcuccuuga

SEQ ID NO: 1638783 - RNA, 18 nt, Pseudomonas putida KT2440
agguggcuguaauugcca

SEQ ID NO: 1638784 - RNA, 15 nt, Pseudomonas putida KT2440
aggugggucacgguc

SEQ ID NO: 1638785 - RNA, 19 nt, Pseudomonas putida KT2440
aggugucaccgcgagcagc

SEQ ID NO: 1638786 - RNA, 23 nt, Pseudomonas putida KT2440
aguaccuuggcguaggccugcga

SEQ ID NO: 1638787 - RNA, 21 nt, Pseudomonas putida KT2440
aguacgaacuacgcgccagca

SEQ ID NO: 1638788 - RNA, 17 nt, Pseudomonas putida KT2440
aguacggcuugccggca

SEQ ID NO: 1638789 - RNA, 13 nt, Pseudomonas putida KT2440
aguacggcagcca

SEQ ID NO: 1638790 - RNA, 12 nt, Pseudomonas putida KT2440
aguacggccagc

SEQ ID NO: 1638791 - RNA, 13 nt, Pseudomonas putida KT2440
aguacggccagca

SEQ ID NO: 1638792 - RNA, 18 nt, Pseudomonas putida KT2440
aguacggccaucagcaag

SEQ ID NO: 1638793 - RNA, 14 nt, Pseudomonas putida KT2440
aguacgcgccugca

SEQ ID NO: 1638794 - RNA, 15 nt, Pseudomonas putida KT2440
aguacgccacccaga

SEQ ID NO: 1638795 - RNA, 13 nt, Pseudomonas putida KT2440
aguacacgaggau

SEQ ID NO: 1638796 - RNA, 13 nt, Pseudomonas putida KT2440
aguacaacugcca

SEQ ID NO: 1638797 - RNA, 20 nt, Pseudomonas putida KT2440
aguacaugaucggguucuuc

SEQ ID NO: 1638798 - RNA, 20 nt, Pseudomonas putida KT2440
aguacagccguucgcucugc

SEQ ID NO: 1638799 - RNA, 16 nt, Pseudomonas putida KT2440
aguaaggaucgcgcag

SEQ ID NO: 1638800 - RNA, 16 nt, Pseudomonas putida KT2440
aguaacggcccuugcu

SEQ ID NO: 1638801 - RNA, 22 nt, Pseudomonas putida KT2440
aguaacggcggauguuggccac

SEQ ID NO: 1638802 - RNA, 20 nt, Pseudomonas putida KT2440
agguuccauagugugcucac

SEQ ID NO: 1638803 - RNA, 15 nt, Pseudomonas putida KT2440
agguucgaauccugc

SEQ ID NO: 1638804 - RNA, 16 nt, Pseudomonas putida KT2440
agguucgaauccugcu

SEQ ID NO: 1638805 - RNA, 17 nt, Pseudomonas putida KT2440
agguucgaauccugcug

SEQ ID NO: 1638806 - RNA, 14 nt, Pseudomonas putida KT2440
agguucguccccuu

SEQ ID NO: 1638807 - RNA, 22 nt, Pseudomonas putida KT2440
agguucgaaucgcucaugcccc

SEQ ID NO: 1638808 - RNA, 22 nt, Pseudomonas putida KT2440
agguucgaccaccgcaggugca

SEQ ID NO: 1638809 - RNA, 22 nt, Pseudomonas putida KT2440
agguucugaaucuggcucugca

SEQ ID NO: 1638810 - RNA, 20 nt, Pseudomonas putida KT2440
agggcagacuucgcugucuu

SEQ ID NO: 1638811 - RNA, 19 nt, Pseudomonas putida KT2440
agggcaucggcgccccgca

SEQ ID NO: 1638812 - RNA, 11 nt, Pseudomonas putida KT2440
agggcauggcc

SEQ ID NO: 1638813 - RNA, 20 nt, Pseudomonas putida KT2440
agggcauggccgcccugcgg

SEQ ID NO: 1638814 - RNA, 12 nt, Pseudomonas putida KT2440
agggccuggcgc

SEQ ID NO: 1638815 - RNA, 23 nt, Pseudomonas putida KT2440
agggccugcaggcagcauauggc

SEQ ID NO: 1638816 - RNA, 22 nt, Pseudomonas putida KT2440
agggccuuuucauauggcucga

SEQ ID NO: 1638817 - RNA, 17 nt, Pseudomonas putida KT2440
agggcgaaccaggugcg

SEQ ID NO: 1638818 - RNA, 20 nt, Pseudomonas putida KT2440
agggccuuccccgugauauc

SEQ ID NO: 1638819 - RNA, 17 nt, Pseudomonas putida KT2440
agggccugugccgggcc

SEQ ID NO: 1638820 - RNA, 14 nt, Pseudomonas putida KT2440
agggccugaccgcc

SEQ ID NO: 1638821 - RNA, 22 nt, Pseudomonas putida KT2440
agggccuccauacgcuggugca

SEQ ID NO: 1638822 - RNA, 16 nt, Pseudomonas putida KT2440
agggccgggccugcau

SEQ ID NO: 1638823 - RNA, 19 nt, Pseudomonas putida KT2440
agggccguuacucccacag

SEQ ID NO: 1638824 - RNA, 22 nt, Pseudomonas putida KT2440
aggcuugaaucagccuuugccc

SEQ ID NO: 1638825 - RNA, 23 nt, Pseudomonas putida KT2440
agggaucaagccugacucagccc

SEQ ID NO: 1638826 - RNA, 19 nt, Pseudomonas putida KT2440
aggcuguggcccaaggcga

SEQ ID NO: 1638827 - RNA, 16 nt, Pseudomonas putida KT2440
aggcugugcggcaacc

SEQ ID NO: 1638828 - RNA, 15 nt, Pseudomonas putida KT2440
aggcuucagaucacc

SEQ ID NO: 1638829 - RNA, 18 nt, Pseudomonas putida KT2440
aggcuucagaucacccuu

SEQ ID NO: 1638830 - RNA, 13 nt, Pseudomonas putida KT2440
aggcuucacgcgc

SEQ ID NO: 1638831 - RNA, 17 nt, Pseudomonas putida KT2440
aggcuucaaggccacgc

SEQ ID NO: 1638832 - RNA, 18 nt, Pseudomonas putida KT2440
aggcuucaaggccacgcg

SEQ ID NO: 1638833 - RNA, 19 nt, Pseudomonas putida KT2440
aggcuucaaggccacgcgg

SEQ ID NO: 1638834 - RNA, 19 nt, Pseudomonas putida KT2440
aggcuuacaucggcgacga

SEQ ID NO: 1638835 - RNA, 22 nt, Pseudomonas putida KT2440
aggcuuacaacugcuccaggca

SEQ ID NO: 1638836 - RNA, 17 nt, Pseudomonas putida KT2440
aggcuuacuuggucacc

SEQ ID NO: 1638837 - RNA, 15 nt, Pseudomonas putida KT2440
agggucuucucaggc

SEQ ID NO: 1638838 - RNA, 23 nt, Pseudomonas putida KT2440
agggucgcgccccaagcgggcca

SEQ ID NO: 1638839 - RNA, 14 nt, Pseudomonas putida KT2440
agggucgcuucuuu

SEQ ID NO: 1638840 - RNA, 14 nt, Pseudomonas putida KT2440
agggucggcgggcg

SEQ ID NO: 1638841 - RNA, 22 nt, Pseudomonas putida KT2440
agggucgggcacaggcccagca

SEQ ID NO: 1638842 - RNA, 20 nt, Pseudomonas putida KT2440
agggucgugagccugcaccc

SEQ ID NO: 1638843 - RNA, 16 nt, Pseudomonas putida KT2440
agggucucgcggcugg

SEQ ID NO: 1638844 - RNA, 11 nt, Pseudomonas putida KT2440
aggguuuucag

SEQ ID NO: 1638845 - RNA, 18 nt, Pseudomonas putida KT2440
aggguucgcuguccugau

SEQ ID NO: 1638846 - RNA, 21 nt, Pseudomonas putida KT2440
aggguguauugccgccgggcc

SEQ ID NO: 1638847 - RNA, 21 nt, Pseudomonas putida KT2440
agggugucgguggcggccagc

SEQ ID NO: 1638848 - RNA, 24 nt, Pseudomonas putida KT2440
agggugucgguggcggccagcgca

SEQ ID NO: 1638849 - RNA, 18 nt, Pseudomonas putida KT2440
agggugugcugcugccaa

SEQ ID NO: 1638850 - RNA, 12 nt, Pseudomonas putida KT2440
agggcgccguug

SEQ ID NO: 1638851 - RNA, 16 nt, Pseudomonas putida KT2440
agggcgcgcuggcgca

SEQ ID NO: 1638852 - RNA, 18 nt, Pseudomonas putida KT2440
aggggacgaucugcagca

SEQ ID NO: 1638853 - RNA, 16 nt, Pseudomonas putida KT2440
agggggcagcugcuga

SEQ ID NO: 1638854 - RNA, 18 nt, Pseudomonas putida KT2440
aggggcuuuuuguccauu

SEQ ID NO: 1638855 - RNA, 16 nt, Pseudomonas putida KT2440
aggggacagccacaug

SEQ ID NO: 1638856 - RNA, 14 nt, Pseudomonas putida KT2440
aggcguuggccaaa

SEQ ID NO: 1638857 - RNA, 13 nt, Pseudomonas putida KT2440
aggcgucacgcag

SEQ ID NO: 1638858 - RNA, 16 nt, Pseudomonas putida KT2440
aggcgucacgcagggc

SEQ ID NO: 1638859 - RNA, 13 nt, Pseudomonas putida KT2440
aggcguaccugcc

SEQ ID NO: 1638860 - RNA, 22 nt, Pseudomonas putida KT2440
aggcguagcacaagggccaggu

SEQ ID NO: 1638861 - RNA, 15 nt, Pseudomonas putida KT2440
aggcgggagagcagg

SEQ ID NO: 1638862 - RNA, 15 nt, Pseudomonas putida KT2440
aggcggucggccagc

SEQ ID NO: 1638863 - RNA, 20 nt, Pseudomonas putida KT2440
aggcgguccagcaagcucau

SEQ ID NO: 1638864 - RNA, 13 nt, Pseudomonas putida KT2440
aggccggccacca

SEQ ID NO: 1638865 - RNA, 23 nt, Pseudomonas putida KT2440
aggccggcacagaccgcaacagu

SEQ ID NO: 1638866 - RNA, 14 nt, Pseudomonas putida KT2440
aggcggcugaccug

SEQ ID NO: 1638867 - RNA, 13 nt, Pseudomonas putida KT2440
aggcucggccacc

SEQ ID NO: 1638868 - RNA, 17 nt, Pseudomonas putida KT2440
aggcucggccaccacuu

SEQ ID NO: 1638869 - RNA, 13 nt, Pseudomonas putida KT2440
aggcucuccagcc

SEQ ID NO: 1638870 - RNA, 17 nt, Pseudomonas putida KT2440
aggcucuccagccgcug

SEQ ID NO: 1638871 - RNA, 24 nt, Pseudomonas putida KT2440
aggcucuccagccgcugcugcagu

SEQ ID NO: 1638872 - RNA, 14 nt, Pseudomonas putida KT2440
aggcucuugaacug

SEQ ID NO: 1638873 - RNA, 18 nt, Pseudomonas putida KT2440
aggcucugcuccagcugc

SEQ ID NO: 1638874 - RNA, 20 nt, Pseudomonas putida KT2440
aggcuaucgaggggcaggcg

SEQ ID NO: 1638875 - RNA, 20 nt, Pseudomonas putida KT2440
aggcuaugccggucagcagc

SEQ ID NO: 1638876 - RNA, 17 nt, Pseudomonas putida KT2440
aggcuagcagcaucacc

SEQ ID NO: 1638877 - RNA, 14 nt, Pseudomonas putida KT2440
aggcuccaaagcca

SEQ ID NO: 1638878 - RNA, 14 nt, Pseudomonas putida KT2440
aggcuccagcaccg

SEQ ID NO: 1638879 - RNA, 13 nt, Pseudomonas putida KT2440
aggcucaggccuu

SEQ ID NO: 1638880 - RNA, 21 nt, Pseudomonas putida KT2440
aggcucagcagguugaacagc

SEQ ID NO: 1638881 - RNA, 12 nt, Pseudomonas putida KT2440
aggcuggccuca

SEQ ID NO: 1638882 - RNA, 23 nt, Pseudomonas putida KT2440
aggcuggcgcuaccccuguagga

SEQ ID NO: 1638883 - RNA, 13 nt, Pseudomonas putida KT2440
aggcuggcggggu

SEQ ID NO: 1638884 - RNA, 20 nt, Pseudomonas putida KT2440
aggcuggcgggguggccggc

SEQ ID NO: 1638885 - RNA, 15 nt, Pseudomonas putida KT2440
aggcuguccacacca

SEQ ID NO: 1638886 - RNA, 15 nt, Pseudomonas putida KT2440
aggcugcgcggcccc

SEQ ID NO: 1638887 - RNA, 22 nt, Pseudomonas putida KT2440
aggcugcgcccgcacagcacgu

SEQ ID NO: 1638888 - RNA, 18 nt, Pseudomonas putida KT2440
aggcugcgcgccauggcg

SEQ ID NO: 1638889 - RNA, 17 nt, Pseudomonas putida KT2440
aggcugcgugccugcug

SEQ ID NO: 1638890 - RNA, 19 nt, Pseudomonas putida KT2440
aggcugcgugccugcugcu

SEQ ID NO: 1638891 - RNA, 16 nt, Pseudomonas putida KT2440
aggcugaucaggaaca

SEQ ID NO: 1638892 - RNA, 19 nt, Pseudomonas putida KT2440
aggcugaugcgcuggcccu

SEQ ID NO: 1638893 - RNA, 14 nt, Pseudomonas putida KT2440
aggcugcccucggg

SEQ ID NO: 1638894 - RNA, 22 nt, Pseudomonas putida KT2440
aggcugcccucgggcagccuuu

SEQ ID NO: 1638895 - RNA, 16 nt, Pseudomonas putida KT2440
aggauggcauuggcca

SEQ ID NO: 1638896 - RNA, 13 nt, Pseudomonas putida KT2440
aggaugcggcuga

SEQ ID NO: 1638897 - RNA, 16 nt, Pseudomonas putida KT2440
aggaugcggcugaccc

SEQ ID NO: 1638898 - RNA, 21 nt, Pseudomonas putida KT2440
aggcaaaguugagcgccgcga

SEQ ID NO: 1638899 - RNA, 18 nt, Pseudomonas putida KT2440
aggcaaaggucugcugcg

SEQ ID NO: 1638900 - RNA, 17 nt, Pseudomonas putida KT2440
aggcaaagaaacaccag

SEQ ID NO: 1638901 - RNA, 21 nt, Pseudomonas putida KT2440
aggcaaacgcggucagcgaau

SEQ ID NO: 1638902 - RNA, 14 nt, Pseudomonas putida KT2440
aggcagcagcucuu

SEQ ID NO: 1638903 - RNA, 13 nt, Pseudomonas putida KT2440
aggcaaugcccau

SEQ ID NO: 1638904 - RNA, 18 nt, Pseudomonas putida KT2440
aggcaaugcccauggcca

SEQ ID NO: 1638905 - RNA, 12 nt, Pseudomonas putida KT2440
aggcaaucacug

SEQ ID NO: 1638906 - RNA, 17 nt, Pseudomonas putida KT2440
aggcaguaggugcaggc

SEQ ID NO: 1638907 - RNA, 22 nt, Pseudomonas putida KT2440
aggcaguucgagcgccugauua

SEQ ID NO: 1638908 - RNA, 16 nt, Pseudomonas putida KT2440
aggcagccccugcaca

SEQ ID NO: 1638909 - RNA, 19 nt, Pseudomonas putida KT2440
aggcauauccggccuuuuc

SEQ ID NO: 1638910 - RNA, 19 nt, Pseudomonas putida KT2440
aggcaguuucaggcgcuca

SEQ ID NO: 1638911 - RNA, 16 nt, Pseudomonas putida KT2440
aggcauaccgcaacac

SEQ ID NO: 1638912 - RNA, 22 nt, Pseudomonas putida KT2440
aggccagguacaggcaaagaaa

SEQ ID NO: 1638913 - RNA, 15 nt, Pseudomonas putida KT2440
aggccaguaccagca

SEQ ID NO: 1638914 - RNA, 14 nt, Pseudomonas putida KT2440
aggccagugagccu

SEQ ID NO: 1638915 - RNA, 20 nt, Pseudomonas putida KT2440
aggccaucuaagccuccaga

SEQ ID NO: 1638916 - RNA, 20 nt, Pseudomonas putida KT2440
aggccauauugcugagccag

SEQ ID NO: 1638917 - RNA, 21 nt, Pseudomonas putida KT2440
aggccauauugcugagccagu

SEQ ID NO: 1638918 - RNA, 13 nt, Pseudomonas putida KT2440
aggcccggcccuu

SEQ ID NO: 1638919 - RNA, 17 nt, Pseudomonas putida KT2440
aggccgccggcaacugg

SEQ ID NO: 1638920 - RNA, 16 nt, Pseudomonas putida KT2440
aggccgacacggggug

SEQ ID NO: 1638921 - RNA, 12 nt, Pseudomonas putida KT2440
aggcccugcagc

SEQ ID NO: 1638922 - RNA, 17 nt, Pseudomonas putida KT2440
aggccgaaaccgcccgg

SEQ ID NO: 1638923 - RNA, 13 nt, Pseudomonas putida KT2440
aggccgccuuggc

SEQ ID NO: 1638924 - RNA, 19 nt, Pseudomonas putida KT2440
aggccgcugaacaacuccg

SEQ ID NO: 1638925 - RNA, 17 nt, Pseudomonas putida KT2440
aggaucaccaaggcuug

SEQ ID NO: 1638926 - RNA, 15 nt, Pseudomonas putida KT2440
aggaucagcucggca

SEQ ID NO: 1638927 - RNA, 17 nt, Pseudomonas putida KT2440
aggauauaagccgcccc

SEQ ID NO: 1638928 - RNA, 17 nt, Pseudomonas putida KT2440
aggaucggguuuacccg

SEQ ID NO: 1638929 - RNA, 13 nt, Pseudomonas putida KT2440
aggaguccagcug

SEQ ID NO: 1638930 - RNA, 15 nt, Pseudomonas putida KT2440
aggaguccagcugca

SEQ ID NO: 1638931 - RNA, 18 nt, Pseudomonas putida KT2440
aggaguccagcugcauca

SEQ ID NO: 1638932 - RNA, 13 nt, Pseudomonas putida KT2440
aggaggcugggga

SEQ ID NO: 1638933 - RNA, 18 nt, Pseudomonas putida KT2440
aggacucggcguagcagg

SEQ ID NO: 1638934 - RNA, 22 nt, Pseudomonas putida KT2440
aggacuacaucuucgcgcucga

SEQ ID NO: 1638935 - RNA, 21 nt, Pseudomonas putida KT2440
aggaaaagcagcuccagcguu

SEQ ID NO: 1638936 - RNA, 19 nt, Pseudomonas putida KT2440
aggaaaaucagcuauugag

SEQ ID NO: 1638937 - RNA, 12 nt, Pseudomonas putida KT2440
aggaaucaccag

SEQ ID NO: 1638938 - RNA, 14 nt, Pseudomonas putida KT2440
aggaauuacgcagg

SEQ ID NO: 1638939 - RNA, 21 nt, Pseudomonas putida KT2440
aggacggucaugcucagcugg

SEQ ID NO: 1638940 - RNA, 20 nt, Pseudomonas putida KT2440
agcuucagaccugauccaaa

SEQ ID NO: 1638941 - RNA, 15 nt, Pseudomonas putida KT2440
agcuucaccucagaa

SEQ ID NO: 1638942 - RNA, 16 nt, Pseudomonas putida KT2440
agcuucaacuccacca

SEQ ID NO: 1638943 - RNA, 15 nt, Pseudomonas putida KT2440
agcuuaacgcuuggc

SEQ ID NO: 1638944 - RNA, 15 nt, Pseudomonas putida KT2440
agcuucuucacaccg

SEQ ID NO: 1638945 - RNA, 19 nt, Pseudomonas putida KT2440
agcuucuucacaccggccu

SEQ ID NO: 1638946 - RNA, 16 nt, Pseudomonas putida KT2440
agcuucuugcaccgcu

SEQ ID NO: 1638947 - RNA, 12 nt, Pseudomonas putida KT2440
agcuucuugugc

SEQ ID NO: 1638948 - RNA, 23 nt, Pseudomonas putida KT2440
agcuugcguuugggguccuguuu

SEQ ID NO: 1638949 - RNA, 18 nt, Pseudomonas putida KT2440
agcuuggacaggccccag

SEQ ID NO: 1638950 - RNA, 20 nt, Pseudomonas putida KT2440
agcuugcucgcgaugcgccg

SEQ ID NO: 1638951 - RNA, 15 nt, Pseudomonas putida KT2440
agcugcgcacgcagg

SEQ ID NO: 1638952 - RNA, 13 nt, Pseudomonas putida KT2440
agcugcgccugca

SEQ ID NO: 1638953 - RNA, 13 nt, Pseudomonas putida KT2440
agcugcgcugccu

SEQ ID NO: 1638954 - RNA, 24 nt, Pseudomonas putida KT2440
agcugaugcucaagcgccagggca

SEQ ID NO: 1638955 - RNA, 23 nt, Pseudomonas putida KT2440
agcugaucgccgucgaccaggca

SEQ ID NO: 1638956 - RNA, 13 nt, Pseudomonas putida KT2440
agcugcagcagcu

SEQ ID NO: 1638957 - RNA, 14 nt, Pseudomonas putida KT2440
agcugcagcagcuu

SEQ ID NO: 1638958 - RNA, 17 nt, Pseudomonas putida KT2440
agcugcaccgccacccc

SEQ ID NO: 1638959 - RNA, 19 nt, Pseudomonas putida KT2440
agcugcacaucuccacugc

SEQ ID NO: 1638960 - RNA, 15 nt, Pseudomonas putida KT2440
agcugcaccaccugc

SEQ ID NO: 1638961 - RNA, 21 nt, Pseudomonas putida KT2440
agcugcaccaccugcuccugg

SEQ ID NO: 1638962 - RNA, 12 nt, Pseudomonas putida KT2440
agcugcaacagc

SEQ ID NO: 1638963 - RNA, 17 nt, Pseudomonas putida KT2440
agcugcaacagcggcga

SEQ ID NO: 1638964 - RNA, 22 nt, Pseudomonas putida KT2440
agcuggcgcaaauugcccggcc

SEQ ID NO: 1638965 - RNA, 22 nt, Pseudomonas putida KT2440
agcuggcgcaagccgugccugg

SEQ ID NO: 1638966 - RNA, 19 nt, Pseudomonas putida KT2440
agcuggccguccagcugag

SEQ ID NO: 1638967 - RNA, 17 nt, Pseudomonas putida KT2440
agcuggcaaugcaacuc

SEQ ID NO: 1638968 - RNA, 15 nt, Pseudomonas putida KT2440
agcuggcaccggcgc

SEQ ID NO: 1638969 - RNA, 14 nt, Pseudomonas putida KT2440
agcuggccagccgc

SEQ ID NO: 1638970 - RNA, 20 nt, Pseudomonas putida KT2440
agcuggccagccgcuguucu

SEQ ID NO: 1638971 - RNA, 23 nt, Pseudomonas putida KT2440
agcuggcgcgaucccugugggag

SEQ ID NO: 1638972 - RNA, 22 nt, Pseudomonas putida KT2440
agcuggcgcaugacuuccaggu

SEQ ID NO: 1638973 - RNA, 22 nt, Pseudomonas putida KT2440
agcuggcuacccgcucggccuu

SEQ ID NO: 1638974 - RNA, 11 nt, Pseudomonas putida KT2440
agcuggcuggu

SEQ ID NO: 1638975 - RNA, 16 nt, Pseudomonas putida KT2440
agcugggcuugaaacc

SEQ ID NO: 1638976 - RNA, 14 nt, Pseudomonas putida KT2440
agcugggugaucag

SEQ ID NO: 1638977 - RNA, 17 nt, Pseudomonas putida KT2440
agcuguugcgcugggcg

SEQ ID NO: 1638978 - RNA, 13 nt, Pseudomonas putida KT2440
agcugaccuugga

SEQ ID NO: 1638979 - RNA, 20 nt, Pseudomonas putida KT2440
agcugaaugaaaaagccccg

SEQ ID NO: 1638980 - RNA, 13 nt, Pseudomonas putida KT2440
agcucuuccuuga

SEQ ID NO: 1638981 - RNA, 17 nt, Pseudomonas putida KT2440
agcucuucgaucucuuc

SEQ ID NO: 1638982 - RNA, 15 nt, Pseudomonas putida KT2440
agcugaagugccaag

SEQ ID NO: 1638983 - RNA, 15 nt, Pseudomonas putida KT2440
agcugaacugcucuc

SEQ ID NO: 1638984 - RNA, 23 nt, Pseudomonas putida KT2440
agcucguccugcagggcgagcac

SEQ ID NO: 1638985 - RNA, 13 nt, Pseudomonas putida KT2440
agcucuccagcag

SEQ ID NO: 1638986 - RNA, 19 nt, Pseudomonas putida KT2440
agcucugcgacugaauaca

SEQ ID NO: 1638987 - RNA, 13 nt, Pseudomonas putida KT2440
agcucuggucacc

SEQ ID NO: 1638988 - RNA, 14 nt, Pseudomonas putida KT2440
agcucuggucaccu

SEQ ID NO: 1638989 - RNA, 22 nt, Pseudomonas putida KT2440
agcucuggucgaucuucagcgc

SEQ ID NO: 1638990 - RNA, 14 nt, Pseudomonas putida KT2440
agcucgcccggcac

SEQ ID NO: 1638991 - RNA, 15 nt, Pseudomonas putida KT2440
agcucgccaacaccg

SEQ ID NO: 1638992 - RNA, 20 nt, Pseudomonas putida KT2440
agcucgcagguauccggguc

SEQ ID NO: 1638993 - RNA, 14 nt, Pseudomonas putida KT2440
agcucgcgcugcca

SEQ ID NO: 1638994 - RNA, 14 nt, Pseudomonas putida KT2440
agcucggcaaacag

SEQ ID NO: 1638995 - RNA, 21 nt, Pseudomonas putida KT2440
agcucgcuggccaccagcaug

SEQ ID NO: 1638996 - RNA, 13 nt, Pseudomonas putida KT2440
agcucggcagugg

SEQ ID NO: 1638997 - RNA, 16 nt, Pseudomonas putida KT2440
agcucggcaguggcgg

SEQ ID NO: 1638998 - RNA, 17 nt, Pseudomonas putida KT2440
agcucggcacuguaggc

SEQ ID NO: 1638999 - RNA, 15 nt, Pseudomonas putida KT2440
agcucgaucugccug

SEQ ID NO: 1639000 - RNA, 22 nt, Pseudomonas putida KT2440
agcucgaucuugccuucggcca

SEQ ID NO: 1639001 - RNA, 13 nt, Pseudomonas putida KT2440
agcucgagcaugc

SEQ ID NO: 1639002 - RNA, 20 nt, Pseudomonas putida KT2440
agcucgacaaaucccgcaca

SEQ ID NO: 1639003 - RNA, 14 nt, Pseudomonas putida KT2440
agcuccuggcccgc

SEQ ID NO: 1639004 - RNA, 22 nt, Pseudomonas putida KT2440
agcucgaaaccacagugggugg

SEQ ID NO: 1639005 - RNA, 16 nt, Pseudomonas putida KT2440
agcgucguguucgccu

SEQ ID NO: 1639006 - RNA, 19 nt, Pseudomonas putida KT2440
agcgucggcagagcgccag

SEQ ID NO: 1639007 - RNA, 13 nt, Pseudomonas putida KT2440
agcgucggccacc

SEQ ID NO: 1639008 - RNA, 14 nt, Pseudomonas putida KT2440
agcgucggccaccu

SEQ ID NO: 1639009 - RNA, 17 nt, Pseudomonas putida KT2440
agcgucucgccaaacug

SEQ ID NO: 1639010 - RNA, 15 nt, Pseudomonas putida KT2440
agcgucgcgcgccca

SEQ ID NO: 1639011 - RNA, 17 nt, Pseudomonas putida KT2440
agcgucgcccgcgaaau

SEQ ID NO: 1639012 - RNA, 22 nt, Pseudomonas putida KT2440
agcgucacccguggcagccccc

SEQ ID NO: 1639013 - RNA, 15 nt, Pseudomonas putida KT2440
agcgucagcagggcc

SEQ ID NO: 1639014 - RNA, 16 nt, Pseudomonas putida KT2440
agcgucuggacccacg

SEQ ID NO: 1639015 - RNA, 14 nt, Pseudomonas putida KT2440
agcucccgagccag

SEQ ID NO: 1639016 - RNA, 15 nt, Pseudomonas putida KT2440
agcucccucguagga

SEQ ID NO: 1639017 - RNA, 20 nt, Pseudomonas putida KT2440
agcucccucguaggagcggg

SEQ ID NO: 1639018 - RNA, 21 nt, Pseudomonas putida KT2440
agcuccgguguuuccacaggu

SEQ ID NO: 1639019 - RNA, 19 nt, Pseudomonas putida KT2440
accgacccacaggcacagg

SEQ ID NO: 1639020 - RNA, 12 nt, Pseudomonas putida KT2440
accgaccucuuc

SEQ ID NO: 1639021 - RNA, 15 nt, Pseudomonas putida KT2440
accgacccggccgcu

SEQ ID NO: 1639022 - RNA, 15 nt, Pseudomonas putida KT2440
accgaccugugucca

SEQ ID NO: 1639023 - RNA, 16 nt, Pseudomonas putida KT2440
accgacgaacagggcc

SEQ ID NO: 1639024 - RNA, 18 nt, Pseudomonas putida KT2440
accgauaaagagaagcug

SEQ ID NO: 1639025 - RNA, 20 nt, Pseudomonas putida KT2440
accgaugcggugcagcaccu

SEQ ID NO: 1639026 - RNA, 16 nt, Pseudomonas putida KT2440
accgaggaggaggcug

SEQ ID NO: 1639027 - RNA, 15 nt, Pseudomonas putida KT2440
accgaaaacggcggc

SEQ ID NO: 1639028 - RNA, 21 nt, Pseudomonas putida KT2440
accgaacagcaccgccauggc

SEQ ID NO: 1639029 - RNA, 22 nt, Pseudomonas putida KT2440
accgaaggcgucacccgcgcca

SEQ ID NO: 1639030 - RNA, 15 nt, Pseudomonas putida KT2440
acccucacgcgccag

SEQ ID NO: 1639031 - RNA, 16 nt, Pseudomonas putida KT2440
acccucacgcgccagg

SEQ ID NO: 1639032 - RNA, 20 nt, Pseudomonas putida KT2440
acccugaugcagcagugcca

SEQ ID NO: 1639033 - RNA, 17 nt, Pseudomonas putida KT2440
acccugagucuggcgcc

SEQ ID NO: 1639034 - RNA, 12 nt, Pseudomonas putida KT2440
acccucaccaac

SEQ ID NO: 1639035 - RNA, 13 nt, Pseudomonas putida KT2440
acccucaccaacu

SEQ ID NO: 1639036 - RNA, 22 nt, Pseudomonas putida KT2440
acccuggcccugugcuuugagc

SEQ ID NO: 1639037 - RNA, 18 nt, Pseudomonas putida KT2440
acccugcucgccaucgcc

SEQ ID NO: 1639038 - RNA, 15 nt, Pseudomonas putida KT2440
acccugcgccaggca

SEQ ID NO: 1639039 - RNA, 17 nt, Pseudomonas putida KT2440
acccuggucacgcaguu

SEQ ID NO: 1639040 - RNA, 15 nt, Pseudomonas putida KT2440
acccuggucaugcag

SEQ ID NO: 1639041 - RNA, 16 nt, Pseudomonas putida KT2440
acccuucaucgccggg

SEQ ID NO: 1639042 - RNA, 14 nt, Pseudomonas putida KT2440
acccuucggccagc

SEQ ID NO: 1639043 - RNA, 17 nt, Pseudomonas putida KT2440
acccuucggccagcagu

SEQ ID NO: 1639044 - RNA, 16 nt, Pseudomonas putida KT2440
acccuuccagcccgcc

SEQ ID NO: 1639045 - RNA, 18 nt, Pseudomonas putida KT2440
acccuugggcaccagcuu

SEQ ID NO: 1639046 - RNA, 13 nt, Pseudomonas putida KT2440
acccuugggcuca

SEQ ID NO: 1639047 - RNA, 17 nt, Pseudomonas putida KT2440
acccgcauuccuucugc

SEQ ID NO: 1639048 - RNA, 13 nt, Pseudomonas putida KT2440
acccgccacccca

SEQ ID NO: 1639049 - RNA, 22 nt, Pseudomonas putida KT2440
acccgcaggcgacgagccaguu

SEQ ID NO: 1639050 - RNA, 22 nt, Pseudomonas putida KT2440
acccgcauaaccaccaccgacc

SEQ ID NO: 1639051 - RNA, 20 nt, Pseudomonas putida KT2440
acccgcccaucgcacacccu

SEQ ID NO: 1639052 - RNA, 22 nt, Pseudomonas putida KT2440
acccggugugugcccaccgcag

SEQ ID NO: 1639053 - RNA, 14 nt, Pseudomonas putida KT2440
acccuaucggcacu

SEQ ID NO: 1639054 - RNA, 18 nt, Pseudomonas putida KT2440
accccguagcgcuucagc

SEQ ID NO: 1639055 - RNA, 21 nt, Pseudomonas putida KT2440
accccucgcugcccaacgccu

SEQ ID NO: 1639056 - RNA, 18 nt, Pseudomonas putida KT2440
accccguucgcccugcgc

SEQ ID NO: 1639057 - RNA, 22 nt, Pseudomonas putida KT2440
accccguugcgcagcagcaggc

SEQ ID NO: 1639058 - RNA, 17 nt, Pseudomonas putida KT2440
acccgacaacagcugca

SEQ ID NO: 1639059 - RNA, 16 nt, Pseudomonas putida KT2440
acccgaccagaucagg

SEQ ID NO: 1639060 - RNA, 18 nt, Pseudomonas putida KT2440
acccgcacaugccugcac

SEQ ID NO: 1639061 - RNA, 22 nt, Pseudomonas putida KT2440
acccgcaagcgggcagugcaau

SEQ ID NO: 1639062 - RNA, 18 nt, Pseudomonas putida KT2440
acccgauuucgcuggggc

SEQ ID NO: 1639063 - RNA, 19 nt, Pseudomonas putida KT2440
acccgauuccuugcagcgc

SEQ ID NO: 1639064 - RNA, 22 nt, Pseudomonas putida KT2440
accccgggcacaugcagguugc

SEQ ID NO: 1639065 - RNA, 16 nt, Pseudomonas putida KT2440
accccgaugcgcugau

SEQ ID NO: 1639066 - RNA, 16 nt, Pseudomonas putida KT2440
accccgaguguuucaa

SEQ ID NO: 1639067 - RNA, 16 nt, Pseudomonas putida KT2440
acccauuuacugcaga

SEQ ID NO: 1639068 - RNA, 13 nt, Pseudomonas putida KT2440
acccauuugcagc

SEQ ID NO: 1639069 - RNA, 15 nt, Pseudomonas putida KT2440
acccccgcuccuacg

SEQ ID NO: 1639070 - RNA, 14 nt, Pseudomonas putida KT2440
accccaacccgguc

SEQ ID NO: 1639071 - RNA, 21 nt, Pseudomonas putida KT2440
accccaacccggucccgcccu

SEQ ID NO: 1639072 - RNA, 21 nt, Pseudomonas putida KT2440
accccaaccucaacgccuccc

SEQ ID NO: 1639073 - RNA, 18 nt, Pseudomonas putida KT2440
acccagcucgccaacacc

SEQ ID NO: 1639074 - RNA, 21 nt, Pseudomonas putida KT2440
acccagcggucagcaucuucu

SEQ ID NO: 1639075 - RNA, 20 nt, Pseudomonas putida KT2440
acccagcguauagccaccgg

SEQ ID NO: 1639076 - RNA, 18 nt, Pseudomonas putida KT2440
acccagcgcggcaaaugc

SEQ ID NO: 1639077 - RNA, 22 nt, Pseudomonas putida KT2440
acccagcgcuugagaccaggcc

SEQ ID NO: 1639078 - RNA, 23 nt, Pseudomonas putida KT2440
acccagcgcuugagaccaggccu

SEQ ID NO: 1639079 - RNA, 22 nt, Pseudomonas putida KT2440
acccagcgcgaagcccagcuug

SEQ ID NO: 1639080 - RNA, 19 nt, Pseudomonas putida KT2440
acccagcacuucguccagg

SEQ ID NO: 1639081 - RNA, 21 nt, Pseudomonas putida KT2440
acccaggcucgcccgggucag

SEQ ID NO: 1639082 - RNA, 19 nt, Pseudomonas putida KT2440
acccaggcccugacgccag

SEQ ID NO: 1639083 - RNA, 17 nt, Pseudomonas putida KT2440
acccagguacgaagcca

SEQ ID NO: 1639084 - RNA, 16 nt, Pseudomonas putida KT2440
acccaguacggcgcca

SEQ ID NO: 1639085 - RNA, 13 nt, Pseudomonas putida KT2440
acccagucaccuu

SEQ ID NO: 1639086 - RNA, 22 nt, Pseudomonas putida KT2440
acccagucaccuugcuccacca

SEQ ID NO: 1639087 - RNA, 16 nt, Pseudomonas putida KT2440
acccagucgccccgcc

SEQ ID NO: 1639088 - RNA, 22 nt, Pseudomonas putida KT2440
acccagucgccccgccagcgcc

SEQ ID NO: 1639089 - RNA, 23 nt, Pseudomonas putida KT2440
acccacggcaauucgccggcagc

SEQ ID NO: 1639090 - RNA, 17 nt, Pseudomonas putida KT2440
acccacgcccaacccca

SEQ ID NO: 1639091 - RNA, 15 nt, Pseudomonas putida KT2440
acccacggagucagu

SEQ ID NO: 1639092 - RNA, 21 nt, Pseudomonas putida KT2440
acccagacucaaucaggcagc

SEQ ID NO: 1639093 - RNA, 20 nt, Pseudomonas putida KT2440
acccagaacagccacagcug

SEQ ID NO: 1639094 - RNA, 23 nt, Pseudomonas putida KT2440
acccagaacagccacagcugcug

SEQ ID NO: 1639095 - RNA, 16 nt, Pseudomonas putida KT2440
acccagaaucccaacc

SEQ ID NO: 1639096 - RNA, 17 nt, Pseudomonas putida KT2440
accaugaauggcgucuu

SEQ ID NO: 1639097 - RNA, 17 nt, Pseudomonas putida KT2440
accaugaaaaacaacaa

SEQ ID NO: 1639098 - RNA, 14 nt, Pseudomonas putida KT2440
acccaccuuggccc

SEQ ID NO: 1639099 - RNA, 14 nt, Pseudomonas putida KT2440
accagggcuggcag

SEQ ID NO: 1639100 - RNA, 17 nt, Pseudomonas putida KT2440
accaggucauaguucug

SEQ ID NO: 1639101 - RNA, 17 nt, Pseudomonas putida KT2440
accagguccaccagcag

SEQ ID NO: 1639102 - RNA, 22 nt, Pseudomonas putida KT2440
accagguccaccagcaggcugc

SEQ ID NO: 1639103 - RNA, 15 nt, Pseudomonas putida KT2440
accagguccagcgug

SEQ ID NO: 1639104 - RNA, 16 nt, Pseudomonas putida KT2440
accagggcaucggcgc

SEQ ID NO: 1639105 - RNA, 16 nt, Pseudomonas putida KT2440
accaggcggucggcca

SEQ ID NO: 1639106 - RNA, 14 nt, Pseudomonas putida KT2440
accaggcgcagcag

SEQ ID NO: 1639107 - RNA, 16 nt, Pseudomonas putida KT2440
accaguaaugcagccg

SEQ ID NO: 1639108 - RNA, 20 nt, Pseudomonas putida KT2440
accaguaaugcagccggccc

SEQ ID NO: 1639109 - RNA, 19 nt, Pseudomonas putida KT2440
accagguuggccgccgcca

SEQ ID NO: 1639110 - RNA, 16 nt, Pseudomonas putida KT2440
accagguuguggccca

SEQ ID NO: 1639111 - RNA, 16 nt, Pseudomonas putida KT2440
accaggugcagguacu

SEQ ID NO: 1639112 - RNA, 23 nt, Pseudomonas putida KT2440
accaggucgccagcaccaucagg

SEQ ID NO: 1639113 - RNA, 13 nt, Pseudomonas putida KT2440
accagcucaucca

SEQ ID NO: 1639114 - RNA, 19 nt, Pseudomonas putida KT2440
accagcucauccaucaccu

SEQ ID NO: 1639115 - RNA, 23 nt, Pseudomonas putida KT2440
accagcucauccaucaccugccc

SEQ ID NO: 1639116 - RNA, 17 nt, Pseudomonas putida KT2440
accagcguugucccgcc

SEQ ID NO: 1639117 - RNA, 19 nt, Pseudomonas putida KT2440
accagcguugucccgcccu

SEQ ID NO: 1639118 - RNA, 12 nt, Pseudomonas putida KT2440
accagcugccau

SEQ ID NO: 1639119 - RNA, 20 nt, Pseudomonas putida KT2440
accagcugccauacagccag

SEQ ID NO: 1639120 - RNA, 16 nt, Pseudomonas putida KT2440
accagcugcaccaccu

SEQ ID NO: 1639121 - RNA, 21 nt, Pseudomonas putida KT2440
accaggcaauugugccgcgcc

SEQ ID NO: 1639122 - RNA, 17 nt, Pseudomonas putida KT2440
accaggauuggccgcaa

SEQ ID NO: 1639123 - RNA, 18 nt, Pseudomonas putida KT2440
accaggauuggccgcaac

SEQ ID NO: 1639124 - RNA, 14 nt, Pseudomonas putida KT2440
accaggaucuucuc

SEQ ID NO: 1639125 - RNA, 15 nt, Pseudomonas putida KT2440
accagucugcucagc

SEQ ID NO: 1639126 - RNA, 21 nt, Pseudomonas putida KT2440
accaguccaaccgcaagcggc

SEQ ID NO: 1639127 - RNA, 15 nt, Pseudomonas putida KT2440
accaguuccuugagc

SEQ ID NO: 1639128 - RNA, 20 nt, Pseudomonas putida KT2440
accaguucaccauccgccag

SEQ ID NO: 1639129 - RNA, 12 nt, Pseudomonas putida KT2440
accagugucugc

SEQ ID NO: 1639130 - RNA, 21 nt, Pseudomonas putida KT2440
accaguucguccucgacccac

SEQ ID NO: 1639131 - RNA, 14 nt, Pseudomonas putida KT2440
accaguugguaaaa

SEQ ID NO: 1639132 - RNA, 15 nt, Pseudomonas putida KT2440
accaguugguaaaac

SEQ ID NO: 1639133 - RNA, 14 nt, Pseudomonas putida KT2440
accaguuccagggc

SEQ ID NO: 1639134 - RNA, 14 nt, Pseudomonas putida KT2440
accaucgccggcac

SEQ ID NO: 1639135 - RNA, 12 nt, Pseudomonas putida KT2440
accagagagcug

SEQ ID NO: 1639136 - RNA, 19 nt, Pseudomonas putida KT2440
accagcagcaccugccgcu

SEQ ID NO: 1639137 - RNA, 13 nt, Pseudomonas putida KT2440
accagcagcagug

SEQ ID NO: 1639138 - RNA, 19 nt, Pseudomonas putida KT2440
accagcacugccuugcccu

SEQ ID NO: 1639139 - RNA, 22 nt, Pseudomonas putida KT2440
accagcaccugcagguacagca

SEQ ID NO: 1639140 - RNA, 15 nt, Pseudomonas putida KT2440
accaaccccugcggc

SEQ ID NO: 1639141 - RNA, 18 nt, Pseudomonas putida KT2440
accaacugcacccgccag

SEQ ID NO: 1639142 - RNA, 21 nt, Pseudomonas putida KT2440
accagaccagcagcaguggca

SEQ ID NO: 1639143 - RNA, 23 nt, Pseudomonas putida KT2440
accagacggccuucgaagaacac

SEQ ID NO: 1639144 - RNA, 14 nt, Pseudomonas putida KT2440
accagacgcaggca

SEQ ID NO: 1639145 - RNA, 19 nt, Pseudomonas putida KT2440
accagacgggcauggugga

SEQ ID NO: 1639146 - RNA, 14 nt, Pseudomonas putida KT2440
accagccaggcaca

SEQ ID NO: 1639147 - RNA, 21 nt, Pseudomonas putida KT2440
accagcccgaacgacacggca

SEQ ID NO: 1639148 - RNA, 16 nt, Pseudomonas putida KT2440
accagccccagcgccu

SEQ ID NO: 1639149 - RNA, 13 nt, Pseudomonas putida KT2440
accagccccagcc

SEQ ID NO: 1639150 - RNA, 12 nt, Pseudomonas putida KT2440
accagcccggcc

SEQ ID NO: 1639151 - RNA, 15 nt, Pseudomonas putida KT2440
accagcccgccgcca

SEQ ID NO: 1639152 - RNA, 13 nt, Pseudomonas putida KT2440
accagcccggcuc

SEQ ID NO: 1639153 - RNA, 22 nt, Pseudomonas putida KT2440
accagcauguccugcugcaggc

SEQ ID NO: 1639154 - RNA, 16 nt, Pseudomonas putida KT2440
accagccaaacccggc

SEQ ID NO: 1639155 - RNA, 17 nt, Pseudomonas putida KT2440
accagccaaacccggcc

SEQ ID NO: 1639156 - RNA, 12 nt, Pseudomonas putida KT2440
accagccagcca

SEQ ID NO: 1639157 - RNA, 17 nt, Pseudomonas putida KT2440
accagcagcuucuucac

SEQ ID NO: 1639158 - RNA, 21 nt, Pseudomonas putida KT2440
accagcaggcugcgugccugc

SEQ ID NO: 1639159 - RNA, 23 nt, Pseudomonas putida KT2440
accagcagugucagcccauccag

SEQ ID NO: 1639160 - RNA, 17 nt, Pseudomonas putida KT2440
accagcgccgcaucgcc

SEQ ID NO: 1639161 - RNA, 17 nt, Pseudomonas putida KT2440
accagcgcgaucaccag

SEQ ID NO: 1639162 - RNA, 14 nt, Pseudomonas putida KT2440
accgcguacagcug

SEQ ID NO: 1639163 - RNA, 16 nt, Pseudomonas putida KT2440
accgcguacagcugcu

SEQ ID NO: 1639164 - RNA, 12 nt, Pseudomonas putida KT2440
accgcucaaccu

SEQ ID NO: 1639165 - RNA, 23 nt, Pseudomonas putida KT2440
accgcucgacguuuaccugcagc

SEQ ID NO: 1639166 - RNA, 14 nt, Pseudomonas putida KT2440
accggcacugcaca

SEQ ID NO: 1639167 - RNA, 15 nt, Pseudomonas putida KT2440
accgcucgcgccgcc

SEQ ID NO: 1639168 - RNA, 19 nt, Pseudomonas putida KT2440
accgcucugcgccacggcg

SEQ ID NO: 1639169 - RNA, 13 nt, Pseudomonas putida KT2440
accgcugaccaca

SEQ ID NO: 1639170 - RNA, 15 nt, Pseudomonas putida KT2440
accgcugaccacaaa

SEQ ID NO: 1639171 - RNA, 15 nt, Pseudomonas putida KT2440
accgcuucacccucg

SEQ ID NO: 1639172 - RNA, 19 nt, Pseudomonas putida KT2440
accgcuucacccucgcgca

SEQ ID NO: 1639173 - RNA, 14 nt, Pseudomonas putida KT2440
accgcuucuuuguu

SEQ ID NO: 1639174 - RNA, 20 nt, Pseudomonas putida KT2440
accgcuuggaguugcucgag

SEQ ID NO: 1639175 - RNA, 13 nt, Pseudomonas putida KT2440
accgguugcaggc

SEQ ID NO: 1639176 - RNA, 14 nt, Pseudomonas putida KT2440
accguacuugcugc

SEQ ID NO: 1639177 - RNA, 15 nt, Pseudomonas putida KT2440
accguacuugcugca

SEQ ID NO: 1639178 - RNA, 23 nt, Pseudomonas putida KT2440
accguacugcuucaucugcgccu

SEQ ID NO: 1639179 - RNA, 17 nt, Pseudomonas putida KT2440
accggcauucccggcgc

SEQ ID NO: 1639180 - RNA, 13 nt, Pseudomonas putida KT2440
accggcagcagca

SEQ ID NO: 1639181 - RNA, 18 nt, Pseudomonas putida KT2440
accggcagcgcaaucacc

SEQ ID NO: 1639182 - RNA, 18 nt, Pseudomonas putida KT2440
accggcaguucgacgccu

SEQ ID NO: 1639183 - RNA, 22 nt, Pseudomonas putida KT2440
accggcuugucuuccaguucca

SEQ ID NO: 1639184 - RNA, 19 nt, Pseudomonas putida KT2440
accggccacgcgcaguucg

SEQ ID NO: 1639185 - RNA, 17 nt, Pseudomonas putida KT2440
accggcuucuaccacug

SEQ ID NO: 1639186 - RNA, 20 nt, Pseudomonas putida KT2440
accgguaccgcucugcgcca

SEQ ID NO: 1639187 - RNA, 21 nt, Pseudomonas putida KT2440
accgguacauugcgcaccccu

SEQ ID NO: 1639188 - RNA, 15 nt, Pseudomonas putida KT2440
accgggugugagaac

SEQ ID NO: 1639189 - RNA, 13 nt, Pseudomonas putida KT2440
accgggcaaaaaa

SEQ ID NO: 1639190 - RNA, 16 nt, Pseudomonas putida KT2440
accgggaucuuggcgu

SEQ ID NO: 1639191 - RNA, 18 nt, Pseudomonas putida KT2440
accuacagggauugcgca

SEQ ID NO: 1639192 - RNA, 19 nt, Pseudomonas putida KT2440
accuacugccgucuuuucc

SEQ ID NO: 1639193 - RNA, 16 nt, Pseudomonas putida KT2440
accucaucccccggcc

SEQ ID NO: 1639194 - RNA, 21 nt, Pseudomonas putida KT2440
accucaucccccggcccagcc

SEQ ID NO: 1639195 - RNA, 16 nt, Pseudomonas putida KT2440
accucaucgacccugg

SEQ ID NO: 1639196 - RNA, 21 nt, Pseudomonas putida KT2440
accucaucuacgugcagcuug

SEQ ID NO: 1639197 - RNA, 18 nt, Pseudomonas putida KT2440
accgucgaucagcuucug

SEQ ID NO: 1639198 - RNA, 12 nt, Pseudomonas putida KT2440
accguccacacc

SEQ ID NO: 1639199 - RNA, 12 nt, Pseudomonas putida KT2440
accgugucgggc

SEQ ID NO: 1639200 - RNA, 18 nt, Pseudomonas putida KT2440
accgugguucuugccgag

SEQ ID NO: 1639201 - RNA, 18 nt, Pseudomonas putida KT2440
accguggcaaucuucuug

SEQ ID NO: 1639202 - RNA, 20 nt, Pseudomonas putida KT2440
accgugcuugcgggcaaggu

SEQ ID NO: 1639203 - RNA, 15 nt, Pseudomonas putida KT2440
acgaauggguggcag

SEQ ID NO: 1639204 - RNA, 19 nt, Pseudomonas putida KT2440
acgacaggggcgcagagcg

SEQ ID NO: 1639205 - RNA, 18 nt, Pseudomonas putida KT2440
acgacaagguacucagcg

SEQ ID NO: 1639206 - RNA, 20 nt, Pseudomonas putida KT2440
acgacaccgggauacugcgc

SEQ ID NO: 1639207 - RNA, 18 nt, Pseudomonas putida KT2440
acgaauacgcucgaccag

SEQ ID NO: 1639208 - RNA, 14 nt, Pseudomonas putida KT2440
acgaaucagccagc

SEQ ID NO: 1639209 - RNA, 19 nt, Pseudomonas putida KT2440
acgaaacgccacgcccaac

SEQ ID NO: 1639210 - RNA, 15 nt, Pseudomonas putida KT2440
acgaaaccgacuuga

SEQ ID NO: 1639211 - RNA, 19 nt, Pseudomonas putida KT2440
acgacgcgauaauggguca

SEQ ID NO: 1639212 - RNA, 15 nt, Pseudomonas putida KT2440
acgaccucggccagg

SEQ ID NO: 1639213 - RNA, 18 nt, Pseudomonas putida KT2440
acgacccugaagcccugg

SEQ ID NO: 1639214 - RNA, 22 nt, Pseudomonas putida KT2440
acgacugacguaguccuugugc

SEQ ID NO: 1639215 - RNA, 16 nt, Pseudomonas putida KT2440
acgagcaugccgagga

SEQ ID NO: 1639216 - RNA, 18 nt, Pseudomonas putida KT2440
acgagucagcgugccaga

SEQ ID NO: 1639217 - RNA, 16 nt, Pseudomonas putida KT2440
accuugcuugaccuug

SEQ ID NO: 1639218 - RNA, 18 nt, Pseudomonas putida KT2440
accuugcuugaccuuguc

SEQ ID NO: 1639219 - RNA, 13 nt, Pseudomonas putida KT2440
accuucucacuga

SEQ ID NO: 1639220 - RNA, 15 nt, Pseudomonas putida KT2440
accuucuggcagccg

SEQ ID NO: 1639221 - RNA, 18 nt, Pseudomonas putida KT2440
accuuguucgagcgccau

SEQ ID NO: 1639222 - RNA, 17 nt, Pseudomonas putida KT2440
accuuggcguccaggua

SEQ ID NO: 1639223 - RNA, 18 nt, Pseudomonas putida KT2440
accuugggccggcgcagg

SEQ ID NO: 1639224 - RNA, 18 nt, Pseudomonas putida KT2440
accuugggcgaggacagc

SEQ ID NO: 1639225 - RNA, 19 nt, Pseudomonas putida KT2440
accuugucagcaaccacgc

SEQ ID NO: 1639226 - RNA, 16 nt, Pseudomonas putida KT2440
accuugucgacaaagu

SEQ ID NO: 1639227 - RNA, 22 nt, Pseudomonas putida KT2440
accuugucgccagugagaaugc

SEQ ID NO: 1639228 - RNA, 22 nt, Pseudomonas putida KT2440
accuucacgccauuguucgccu

SEQ ID NO: 1639229 - RNA, 22 nt, Pseudomonas putida KT2440
accuguggcagcggcuuggccg

SEQ ID NO: 1639230 - RNA, 17 nt, Pseudomonas putida KT2440
accugugggagcgggcu

SEQ ID NO: 1639231 - RNA, 14 nt, Pseudomonas putida KT2440
accuguggggcaac

SEQ ID NO: 1639232 - RNA, 15 nt, Pseudomonas putida KT2440
accugugguggcugc

SEQ ID NO: 1639233 - RNA, 20 nt, Pseudomonas putida KT2440
accugugguggcugcuucuc

SEQ ID NO: 1639234 - RNA, 20 nt, Pseudomonas putida KT2440
accuggcucggugugcaccu

SEQ ID NO: 1639235 - RNA, 21 nt, Pseudomonas putida KT2440
accuggcucggugugcaccug

SEQ ID NO: 1639236 - RNA, 24 nt, Pseudomonas putida KT2440
accuggcucuucaacaccagcaug

SEQ ID NO: 1639237 - RNA, 23 nt, Pseudomonas putida KT2440
accuggcugcugugguuuggccc

SEQ ID NO: 1639238 - RNA, 17 nt, Pseudomonas putida KT2440
accuggccuuccagcug

SEQ ID NO: 1639239 - RNA, 23 nt, Pseudomonas putida KT2440
accuggccgugccgaggacaaca

SEQ ID NO: 1639240 - RNA, 16 nt, Pseudomonas putida KT2440
accuguaacucagcuu

SEQ ID NO: 1639241 - RNA, 14 nt, Pseudomonas putida KT2440
accugucccagcug

SEQ ID NO: 1639242 - RNA, 19 nt, Pseudomonas putida KT2440
accugcacuaucugcguuu

SEQ ID NO: 1639243 - RNA, 19 nt, Pseudomonas putida KT2440
accugcagguaaugcgccg

SEQ ID NO: 1639244 - RNA, 20 nt, Pseudomonas putida KT2440
accugcagguacagcagcug

SEQ ID NO: 1639245 - RNA, 21 nt, Pseudomonas putida KT2440
accugccgaucuucgcccugg

SEQ ID NO: 1639246 - RNA, 22 nt, Pseudomonas putida KT2440
accugccgcagcuggcgcaaau

SEQ ID NO: 1639247 - RNA, 13 nt, Pseudomonas putida KT2440
accugccccagcg

SEQ ID NO: 1639248 - RNA, 21 nt, Pseudomonas putida KT2440
accugccccagcgucacccgu

SEQ ID NO: 1639249 - RNA, 17 nt, Pseudomonas putida KT2440
accugcauugcgcguca

SEQ ID NO: 1639250 - RNA, 12 nt, Pseudomonas putida KT2440
accugcccggcg

SEQ ID NO: 1639251 - RNA, 18 nt, Pseudomonas putida KT2440
accugcccggcguucagg

SEQ ID NO: 1639252 - RNA, 22 nt, Pseudomonas putida KT2440
accugcccgggccgcuugcuca

SEQ ID NO: 1639253 - RNA, 12 nt, Pseudomonas putida KT2440
accuccagcccg

SEQ ID NO: 1639254 - RNA, 20 nt, Pseudomonas putida KT2440
accuccagcccggcuucaca

SEQ ID NO: 1639255 - RNA, 18 nt, Pseudomonas putida KT2440
accuccagaggugcccuu

SEQ ID NO: 1639256 - RNA, 15 nt, Pseudomonas putida KT2440
accuccacgccaccg

SEQ ID NO: 1639257 - RNA, 20 nt, Pseudomonas putida KT2440
accuccaggucauccgcacg

SEQ ID NO: 1639258 - RNA, 13 nt, Pseudomonas putida KT2440
accuccaucacca

SEQ ID NO: 1639259 - RNA, 15 nt, Pseudomonas putida KT2440
accugcaacaccucc

SEQ ID NO: 1639260 - RNA, 20 nt, Pseudomonas putida KT2440
accugaugcgagcuaccuga

SEQ ID NO: 1639261 - RNA, 15 nt, Pseudomonas putida KT2440
accugauguccaaau

SEQ ID NO: 1639262 - RNA, 17 nt, Pseudomonas putida KT2440
accugauguccaaauug

SEQ ID NO: 1639263 - RNA, 13 nt, Pseudomonas putida KT2440
accugcgucagga

SEQ ID NO: 1639264 - RNA, 17 nt, Pseudomonas putida KT2440
accugcgaccacacugc

SEQ ID NO: 1639265 - RNA, 24 nt, Pseudomonas putida KT2440
accugcggcuguccagcaagggcc

SEQ ID NO: 1639266 - RNA, 23 nt, Pseudomonas putida KT2440
accugcguugcccccagccgguc

SEQ ID NO: 1639267 - RNA, 20 nt, Pseudomonas putida KT2440
accugcuccugguccugcgc

SEQ ID NO: 1639268 - RNA, 22 nt, Pseudomonas putida KT2440
accugccgggcaucgaucacua

SEQ ID NO: 1639269 - RNA, 14 nt, Pseudomonas putida KT2440
accugcgccuugcu

SEQ ID NO: 1639270 - RNA, 16 nt, Pseudomonas putida KT2440
accugcgccuugcuug

SEQ ID NO: 1639271 - RNA, 15 nt, Pseudomonas putida KT2440
accuggcccacgccu

SEQ ID NO: 1639272 - RNA, 14 nt, Pseudomonas putida KT2440
accuggaauaccac

SEQ ID NO: 1639273 - RNA, 16 nt, Pseudomonas putida KT2440
accuggaucgccaggc

SEQ ID NO: 1639274 - RNA, 17 nt, Pseudomonas putida KT2440
accuggaucgccaggcu

SEQ ID NO: 1639275 - RNA, 23 nt, Pseudomonas putida KT2440
accugcugacaccgcugccgggc

SEQ ID NO: 1639276 - RNA, 16 nt, Pseudomonas putida KT2440
accugcuccagcaccu

SEQ ID NO: 1639277 - RNA, 12 nt, Pseudomonas putida KT2440
accugcugggca

SEQ ID NO: 1639278 - RNA, 15 nt, Pseudomonas putida KT2440
acggcccaggggcag

SEQ ID NO: 1639279 - RNA, 24 nt, Pseudomonas putida KT2440
acggccagcaccgaaccggcgauc

SEQ ID NO: 1639280 - RNA, 13 nt, Pseudomonas putida KT2440
acggccacgcugc

SEQ ID NO: 1639281 - RNA, 20 nt, Pseudomonas putida KT2440
acggccuucccgccuggcgc

SEQ ID NO: 1639282 - RNA, 21 nt, Pseudomonas putida KT2440
acggccuucccgccuggcgcc

SEQ ID NO: 1639283 - RNA, 12 nt, Pseudomonas putida KT2440
acggccugcgcc

SEQ ID NO: 1639284 - RNA, 18 nt, Pseudomonas putida KT2440
acggcagcaaucgccgcc

SEQ ID NO: 1639285 - RNA, 22 nt, Pseudomonas putida KT2440
acggcaucggccgagccggucg

SEQ ID NO: 1639286 - RNA, 15 nt, Pseudomonas putida KT2440
acggcacacgcacca

SEQ ID NO: 1639287 - RNA, 18 nt, Pseudomonas putida KT2440
acggcacacgcaccaccc

SEQ ID NO: 1639288 - RNA, 13 nt, Pseudomonas putida KT2440
acggcagccguuc

SEQ ID NO: 1639289 - RNA, 19 nt, Pseudomonas putida KT2440
acggcaccuuugcaggugc

SEQ ID NO: 1639290 - RNA, 14 nt, Pseudomonas putida KT2440
acggugaagagugg

SEQ ID NO: 1639291 - RNA, 23 nt, Pseudomonas putida KT2440
acggugaauuccuugcagcucuu

SEQ ID NO: 1639292 - RNA, 18 nt, Pseudomonas putida KT2440
acggucagcauccagcca

SEQ ID NO: 1639293 - RNA, 19 nt, Pseudomonas putida KT2440
acggucacugagccaggcc

SEQ ID NO: 1639294 - RNA, 15 nt, Pseudomonas putida KT2440
acgguagccagucug

SEQ ID NO: 1639295 - RNA, 16 nt, Pseudomonas putida KT2440
acgggucaccucaucg

SEQ ID NO: 1639296 - RNA, 14 nt, Pseudomonas putida KT2440
acgggguguugcuu

SEQ ID NO: 1639297 - RNA, 23 nt, Pseudomonas putida KT2440
acggcgcaauccgugagccagga

SEQ ID NO: 1639298 - RNA, 15 nt, Pseudomonas putida KT2440
acggcggcgaucagc

SEQ ID NO: 1639299 - RNA, 17 nt, Pseudomonas putida KT2440
acggcgggccaucugcu

SEQ ID NO: 1639300 - RNA, 14 nt, Pseudomonas putida KT2440
acggcgggcggaga

SEQ ID NO: 1639301 - RNA, 12 nt, Pseudomonas putida KT2440
acgggacaggcu

SEQ ID NO: 1639302 - RNA, 17 nt, Pseudomonas putida KT2440
acgggcaaacaggcuga

SEQ ID NO: 1639303 - RNA, 19 nt, Pseudomonas putida KT2440
acgggcacaccuggugcgc

SEQ ID NO: 1639304 - RNA, 15 nt, Pseudomonas putida KT2440
acgggcaaccgcauc

SEQ ID NO: 1639305 - RNA, 18 nt, Pseudomonas putida KT2440
acgggcaaccgcaucccc

SEQ ID NO: 1639306 - RNA, 17 nt, Pseudomonas putida KT2440
acgggcauuuuucgaac

SEQ ID NO: 1639307 - RNA, 18 nt, Pseudomonas putida KT2440
acgggccaccaaaggccu

SEQ ID NO: 1639308 - RNA, 16 nt, Pseudomonas putida KT2440
acggugucggacaggu

SEQ ID NO: 1639309 - RNA, 18 nt, Pseudomonas putida KT2440
acgguggucuuccaggua

SEQ ID NO: 1639310 - RNA, 18 nt, Pseudomonas putida KT2440
acgguguggccagugcca

SEQ ID NO: 1639311 - RNA, 15 nt, Pseudomonas putida KT2440
acgucagacuuuccu

SEQ ID NO: 1639312 - RNA, 23 nt, Pseudomonas putida KT2440
acguccaaucgggugaggaugag

SEQ ID NO: 1639313 - RNA, 15 nt, Pseudomonas putida KT2440
acguccagccacuug

SEQ ID NO: 1639314 - RNA, 23 nt, Pseudomonas putida KT2440
acgucgcgauugaucagcgccuc

SEQ ID NO: 1639315 - RNA, 14 nt, Pseudomonas putida KT2440
acgucggccugccc

SEQ ID NO: 1639316 - RNA, 11 nt, Pseudomonas putida KT2440
acgugucagug

SEQ ID NO: 1639317 - RNA, 16 nt, Pseudomonas putida KT2440
acgugauaccugggcu

SEQ ID NO: 1639318 - RNA, 16 nt, Pseudomonas putida KT2440
acgugcaaggaucacc

SEQ ID NO: 1639319 - RNA, 18 nt, Pseudomonas putida KT2440
acgugcaaggaucaccaa

SEQ ID NO: 1639320 - RNA, 14 nt, Pseudomonas putida KT2440
acgcgcaagcugag

SEQ ID NO: 1639321 - RNA, 19 nt, Pseudomonas putida KT2440
acgcgauauucagugcgca

SEQ ID NO: 1639322 - RNA, 19 nt, Pseudomonas putida KT2440
acgcgacgggaagugcacu

SEQ ID NO: 1639323 - RNA, 23 nt, Pseudomonas putida KT2440
acgcgauacccaauaaaaacaac

SEQ ID NO: 1639324 - RNA, 16 nt, Pseudomonas putida KT2440
acgcgacgaagauguc

SEQ ID NO: 1639325 - RNA, 22 nt, Pseudomonas putida KT2440
acgcgcagcacuuccucggcac

SEQ ID NO: 1639326 - RNA, 21 nt, Pseudomonas putida KT2440
acgcgcaggcgcugcagggcg

SEQ ID NO: 1639327 - RNA, 15 nt, Pseudomonas putida KT2440
acgcgccaaccgcgc

SEQ ID NO: 1639328 - RNA, 22 nt, Pseudomonas putida KT2440
acgcgcccugugggagcggccu

SEQ ID NO: 1639329 - RNA, 20 nt, Pseudomonas putida KT2440
acgcgccaggucggacaggg

SEQ ID NO: 1639330 - RNA, 18 nt, Pseudomonas putida KT2440
acgcgccucuugcaccug

SEQ ID NO: 1639331 - RNA, 14 nt, Pseudomonas putida KT2440
acgcgccugcaccu

SEQ ID NO: 1639332 - RNA, 14 nt, Pseudomonas putida KT2440
acgcgccgcugccu

SEQ ID NO: 1639333 - RNA, 22 nt, Pseudomonas putida KT2440
acgcgggcaauguccaggugcu

SEQ ID NO: 1639334 - RNA, 15 nt, Pseudomonas putida KT2440
acgcgggcagacuuc

SEQ ID NO: 1639335 - RNA, 14 nt, Pseudomonas putida KT2440
acgcgggccaaggu

SEQ ID NO: 1639336 - RNA, 17 nt, Pseudomonas putida KT2440
acgcggcaaccugcacu

SEQ ID NO: 1639337 - RNA, 18 nt, Pseudomonas putida KT2440
acgcggcaaccugcacua

SEQ ID NO: 1639338 - RNA, 17 nt, Pseudomonas putida KT2440
acgcggcauuggcgcgc

SEQ ID NO: 1639339 - RNA, 19 nt, Pseudomonas putida KT2440
acgcggcagcagcagcccc

SEQ ID NO: 1639340 - RNA, 13 nt, Pseudomonas putida KT2440
acgcgcgcagccu

SEQ ID NO: 1639341 - RNA, 15 nt, Pseudomonas putida KT2440
acgcggacccggcau

SEQ ID NO: 1639342 - RNA, 19 nt, Pseudomonas putida KT2440
acgcgcuuuuccagcaaag

SEQ ID NO: 1639343 - RNA, 18 nt, Pseudomonas putida KT2440
acgcugccugcaggcugc

SEQ ID NO: 1639344 - RNA, 23 nt, Pseudomonas putida KT2440
acgcugcggcgaaagccagcagu

SEQ ID NO: 1639345 - RNA, 16 nt, Pseudomonas putida KT2440
acgcugccaugcgcug

SEQ ID NO: 1639346 - RNA, 19 nt, Pseudomonas putida KT2440
acgcugccgcaccugccug

SEQ ID NO: 1639347 - RNA, 21 nt, Pseudomonas putida KT2440
acgcugcccaggugccaggcu

SEQ ID NO: 1639348 - RNA, 16 nt, Pseudomonas putida KT2440
acgcucgacagcaacu

SEQ ID NO: 1639349 - RNA, 14 nt, Pseudomonas putida KT2440
acgcuccuucgcca

SEQ ID NO: 1639350 - RNA, 19 nt, Pseudomonas putida KT2440
acgcugcucggccucgacc

SEQ ID NO: 1639351 - RNA, 16 nt, Pseudomonas putida KT2440
acgcuggccaaggccu

SEQ ID NO: 1639352 - RNA, 19 nt, Pseudomonas putida KT2440
acgcuggugcaguggcugu

SEQ ID NO: 1639353 - RNA, 22 nt, Pseudomonas putida KT2440
acgcggucaauuggagcggccu

SEQ ID NO: 1639354 - RNA, 15 nt, Pseudomonas putida KT2440
acgcggucagcgaau

SEQ ID NO: 1639355 - RNA, 15 nt, Pseudomonas putida KT2440
acgcguaccccuggc

SEQ ID NO: 1639356 - RNA, 21 nt, Pseudomonas putida KT2440
acgcguacgccguugccgccc

SEQ ID NO: 1639357 - RNA, 17 nt, Pseudomonas putida KT2440
acgcguggucgccggcg

SEQ ID NO: 1639358 - RNA, 17 nt, Pseudomonas putida KT2440
acgcguuucggcggccu

SEQ ID NO: 1639359 - RNA, 20 nt, Pseudomonas putida KT2440
acgcccuucauacagcgccu

SEQ ID NO: 1639360 - RNA, 22 nt, Pseudomonas putida KT2440
acgcccuucauacagcgccucc

SEQ ID NO: 1639361 - RNA, 19 nt, Pseudomonas putida KT2440
acgcccgggccaggccccu

SEQ ID NO: 1639362 - RNA, 19 nt, Pseudomonas putida KT2440
acgcccgcucccacaggga

SEQ ID NO: 1639363 - RNA, 21 nt, Pseudomonas putida KT2440
acgcccgcucccacagguuug

SEQ ID NO: 1639364 - RNA, 18 nt, Pseudomonas putida KT2440
acgcccgcugcaugcucg

SEQ ID NO: 1639365 - RNA, 18 nt, Pseudomonas putida KT2440
acgcccgcaacaaccugg

SEQ ID NO: 1639366 - RNA, 21 nt, Pseudomonas putida KT2440
acgcccgcaacaaccuggccg

SEQ ID NO: 1639367 - RNA, 19 nt, Pseudomonas putida KT2440
acgcccgccggcacuuccu

SEQ ID NO: 1639368 - RNA, 18 nt, Pseudomonas putida KT2440
acgcccaucagcgccgcc

SEQ ID NO: 1639369 - RNA, 13 nt, Pseudomonas putida KT2440
acgcccccagccc

SEQ ID NO: 1639370 - RNA, 15 nt, Pseudomonas putida KT2440
acgcccagcaacugc

SEQ ID NO: 1639371 - RNA, 17 nt, Pseudomonas putida KT2440
acgcccagcaacugcgc

SEQ ID NO: 1639372 - RNA, 13 nt, Pseudomonas putida KT2440
acgaucagcagca

SEQ ID NO: 1639373 - RNA, 14 nt, Pseudomonas putida KT2440
acgaucagcagcaa

SEQ ID NO: 1639374 - RNA, 17 nt, Pseudomonas putida KT2440
acgcccaacccagccag

SEQ ID NO: 1639375 - RNA, 13 nt, Pseudomonas putida KT2440
acgcccaacccca

SEQ ID NO: 1639376 - RNA, 14 nt, Pseudomonas putida KT2440
acgccuuggccucg

SEQ ID NO: 1639377 - RNA, 19 nt, Pseudomonas putida KT2440
acgccuuggcgcagcaagg

SEQ ID NO: 1639378 - RNA, 18 nt, Pseudomonas putida KT2440
acgcgaacgacuucggca

SEQ ID NO: 1639379 - RNA, 18 nt, Pseudomonas putida KT2440
acgccucaugaucugcaa

SEQ ID NO: 1639380 - RNA, 17 nt, Pseudomonas putida KT2440
acgccucgggcgcucgc

SEQ ID NO: 1639381 - RNA, 20 nt, Pseudomonas putida KT2440
acgccugaaccaccgggauc

SEQ ID NO: 1639382 - RNA, 14 nt, Pseudomonas putida KT2440
acgccgccagcgcu

SEQ ID NO: 1639383 - RNA, 16 nt, Pseudomonas putida KT2440
acgccguacugcuggg

SEQ ID NO: 1639384 - RNA, 19 nt, Pseudomonas putida KT2440
acgccgggcacugcccggc

SEQ ID NO: 1639385 - RNA, 15 nt, Pseudomonas putida KT2440
acgccggcgcacgca

SEQ ID NO: 1639386 - RNA, 18 nt, Pseudomonas putida KT2440
acgccggcgcacgcaugc

SEQ ID NO: 1639387 - RNA, 15 nt, Pseudomonas putida KT2440
acgccggucgggcac

SEQ ID NO: 1639388 - RNA, 16 nt, Pseudomonas putida KT2440
acuguaggcaaacagc

SEQ ID NO: 1639389 - RNA, 15 nt, Pseudomonas putida KT2440
acugugggaucacuu

SEQ ID NO: 1639390 - RNA, 11 nt, Pseudomonas putida KT2440
acuguuugagc

SEQ ID NO: 1639391 - RNA, 13 nt, Pseudomonas putida KT2440
acuguuuugagag

SEQ ID NO: 1639392 - RNA, 14 nt, Pseudomonas putida KT2440
acuggcuauccuuc

SEQ ID NO: 1639393 - RNA, 20 nt, Pseudomonas putida KT2440
acuggcuauccuucugccgu

SEQ ID NO: 1639394 - RNA, 13 nt, Pseudomonas putida KT2440
acuggcuacagau

SEQ ID NO: 1639395 - RNA, 17 nt, Pseudomonas putida KT2440
acuggcugauagccgcc

SEQ ID NO: 1639396 - RNA, 15 nt, Pseudomonas putida KT2440
acuggcugccgcuga

SEQ ID NO: 1639397 - RNA, 13 nt, Pseudomonas putida KT2440
acuggcugcugcg

SEQ ID NO: 1639398 - RNA, 15 nt, Pseudomonas putida KT2440
acuggcuuccucuuc

SEQ ID NO: 1639399 - RNA, 18 nt, Pseudomonas putida KT2440
acuggcuucgaugaaggc

SEQ ID NO: 1639400 - RNA, 15 nt, Pseudomonas putida KT2440
acuggccagcagccc

SEQ ID NO: 1639401 - RNA, 16 nt, Pseudomonas putida KT2440
acuggccagcagggcc

SEQ ID NO: 1639402 - RNA, 14 nt, Pseudomonas putida KT2440
acuggcauccggca

SEQ ID NO: 1639403 - RNA, 11 nt, Pseudomonas putida KT2440
acuggccaggg

SEQ ID NO: 1639404 - RNA, 13 nt, Pseudomonas putida KT2440
acuggcccuggcc

SEQ ID NO: 1639405 - RNA, 19 nt, Pseudomonas putida KT2440
acuggccucuucgcgggua

SEQ ID NO: 1639406 - RNA, 19 nt, Pseudomonas putida KT2440
acugcuucaucugcgccug

SEQ ID NO: 1639407 - RNA, 16 nt, Pseudomonas putida KT2440
acugcuucugccguuc

SEQ ID NO: 1639408 - RNA, 21 nt, Pseudomonas putida KT2440
acugcuugaacgagccagcca

SEQ ID NO: 1639409 - RNA, 18 nt, Pseudomonas putida KT2440
acuggugaaucagcccca

SEQ ID NO: 1639410 - RNA, 13 nt, Pseudomonas putida KT2440
acuggucgaggau

SEQ ID NO: 1639411 - RNA, 22 nt, Pseudomonas putida KT2440
acuggugcucugcaggcacacc

SEQ ID NO: 1639412 - RNA, 15 nt, Pseudomonas putida KT2440
acugguucuccaggu

SEQ ID NO: 1639413 - RNA, 18 nt, Pseudomonas putida KT2440
acuggucaaacaaugcac

SEQ ID NO: 1639414 - RNA, 20 nt, Pseudomonas putida KT2440
acuggucaaacaaugcacag

SEQ ID NO: 1639415 - RNA, 23 nt, Pseudomonas putida KT2440
acugguaaugcucuccagcgaug

SEQ ID NO: 1639416 - RNA, 14 nt, Pseudomonas putida KT2440
acugggugcacagg

SEQ ID NO: 1639417 - RNA, 15 nt, Pseudomonas putida KT2440
acucuacugcccgca

SEQ ID NO: 1639418 - RNA, 21 nt, Pseudomonas putida KT2440
acugaacaccugccagccccg

SEQ ID NO: 1639419 - RNA, 21 nt, Pseudomonas putida KT2440
acugaauucguauauguauuu

SEQ ID NO: 1639420 - RNA, 18 nt, Pseudomonas putida KT2440
acugacgcuacgccgccc

SEQ ID NO: 1639421 - RNA, 23 nt, Pseudomonas putida KT2440
acugcacgcuuucgccgaucagc

SEQ ID NO: 1639422 - RNA, 13 nt, Pseudomonas putida KT2440
acugcaccucccg

SEQ ID NO: 1639423 - RNA, 15 nt, Pseudomonas putida KT2440
acugcaccucccgcc

SEQ ID NO: 1639424 - RNA, 17 nt, Pseudomonas putida KT2440
acugcacccgugcaggg

SEQ ID NO: 1639425 - RNA, 18 nt, Pseudomonas putida KT2440
acugcacccgccagccgu

SEQ ID NO: 1639426 - RNA, 15 nt, Pseudomonas putida KT2440
acugcaagcaaacgc

SEQ ID NO: 1639427 - RNA, 18 nt, Pseudomonas putida KT2440
acugcaagcaaacgccag

SEQ ID NO: 1639428 - RNA, 16 nt, Pseudomonas putida KT2440
acugcaggagcgggca

SEQ ID NO: 1639429 - RNA, 22 nt, Pseudomonas putida KT2440
acugcagggacugucggcucaa

SEQ ID NO: 1639430 - RNA, 14 nt, Pseudomonas putida KT2440
acugcagagccugc

SEQ ID NO: 1639431 - RNA, 19 nt, Pseudomonas putida KT2440
acugcagaucaccagcucg

SEQ ID NO: 1639432 - RNA, 13 nt, Pseudomonas putida KT2440
acugcacugccag

SEQ ID NO: 1639433 - RNA, 18 nt, Pseudomonas putida KT2440
acugcacugccagcgccu

SEQ ID NO: 1639434 - RNA, 13 nt, Pseudomonas putida KT2440
acugccagcaccu

SEQ ID NO: 1639435 - RNA, 22 nt, Pseudomonas putida KT2440
acugcccaggaucacuggccug

SEQ ID NO: 1639436 - RNA, 20 nt, Pseudomonas putida KT2440
acugccccuguuccauugaa

SEQ ID NO: 1639437 - RNA, 22 nt, Pseudomonas putida KT2440
acugccccuguuccauugaagg

SEQ ID NO: 1639438 - RNA, 19 nt, Pseudomonas putida KT2440
acugcccacccaaccgcgc

SEQ ID NO: 1639439 - RNA, 14 nt, Pseudomonas putida KT2440
acugccgcgccgcc

SEQ ID NO: 1639440 - RNA, 21 nt, Pseudomonas putida KT2440
acugccgucguuguucuucag

SEQ ID NO: 1639441 - RNA, 20 nt, Pseudomonas putida KT2440
acugcuauuuucgugagacc

SEQ ID NO: 1639442 - RNA, 18 nt, Pseudomonas putida KT2440
acugcuccaggcagccug

SEQ ID NO: 1639443 - RNA, 17 nt, Pseudomonas putida KT2440
acuccagggucugcgcu

SEQ ID NO: 1639444 - RNA, 11 nt, Pseudomonas putida KT2440
acuccagcagc

SEQ ID NO: 1639445 - RNA, 14 nt, Pseudomonas putida KT2440
acuccagcagcgca

SEQ ID NO: 1639446 - RNA, 12 nt, Pseudomonas putida KT2440
acuccgccccaa

SEQ ID NO: 1639447 - RNA, 17 nt, Pseudomonas putida KT2440
acucccacagauauugc

SEQ ID NO: 1639448 - RNA, 12 nt, Pseudomonas putida KT2440
acucccacagcg

SEQ ID NO: 1639449 - RNA, 18 nt, Pseudomonas putida KT2440
acucccacagcggcccca

SEQ ID NO: 1639450 - RNA, 13 nt, Pseudomonas putida KT2440
acuccuugaaauu

SEQ ID NO: 1639451 - RNA, 13 nt, Pseudomonas putida KT2440
acucgcccgccag

SEQ ID NO: 1639452 - RNA, 19 nt, Pseudomonas putida KT2440
acucgccgagaaauggcag

SEQ ID NO: 1639453 - RNA, 13 nt, Pseudomonas putida KT2440
acucgcgcagcac

SEQ ID NO: 1639454 - RNA, 14 nt, Pseudomonas putida KT2440
acuccuugucgcaa

SEQ ID NO: 1639455 - RNA, 16 nt, Pseudomonas putida KT2440
acuccuugucgcaaug

SEQ ID NO: 1639456 - RNA, 17 nt, Pseudomonas putida KT2440
acuccuugucgcaaugg

SEQ ID NO: 1639457 - RNA, 21 nt, Pseudomonas putida KT2440
acuccuugcgcaucaagcggc

SEQ ID NO: 1639458 - RNA, 19 nt, Pseudomonas putida KT2440
acuccugacauccugcucc

SEQ ID NO: 1639459 - RNA, 15 nt, Pseudomonas putida KT2440
acuccggcaaccccg

SEQ ID NO: 1639460 - RNA, 17 nt, Pseudomonas putida KT2440
acuccggcaaccccgcc

SEQ ID NO: 1639461 - RNA, 15 nt, Pseudomonas putida KT2440
acuccugguuggcca

SEQ ID NO: 1639462 - RNA, 16 nt, Pseudomonas putida KT2440
acuccugguuggccag

SEQ ID NO: 1639463 - RNA, 18 nt, Pseudomonas putida KT2440
acucauuuuguaaaaccg

SEQ ID NO: 1639464 - RNA, 22 nt, Pseudomonas putida KT2440
acuccaccaucaagucauccgc

SEQ ID NO: 1639465 - RNA, 13 nt, Pseudomonas putida KT2440
acuccaccgccag

SEQ ID NO: 1639466 - RNA, 14 nt, Pseudomonas putida KT2440
acuccaccagccca

SEQ ID NO: 1639467 - RNA, 17 nt, Pseudomonas putida KT2440
acuccacuuccagcagc

SEQ ID NO: 1639468 - RNA, 15 nt, Pseudomonas putida KT2440
acuccagaaaaucag

SEQ ID NO: 1639469 - RNA, 13 nt, Pseudomonas putida KT2440
acucaugccuucg

SEQ ID NO: 1639470 - RNA, 13 nt, Pseudomonas putida KT2440
acucaugguuuug

SEQ ID NO: 1639471 - RNA, 15 nt, Pseudomonas putida KT2440
acucaugguuuuguu

SEQ ID NO: 1639472 - RNA, 12 nt, Pseudomonas putida KT2440
acucauagcuca

SEQ ID NO: 1639473 - RNA, 19 nt, Pseudomonas putida KT2440
acucaguuaaucagcaacg

SEQ ID NO: 1639474 - RNA, 20 nt, Pseudomonas putida KT2440
acucaguuaaucagcaacgc

SEQ ID NO: 1639475 - RNA, 23 nt, Pseudomonas putida KT2440
acucaggcugagcagaccagccg

SEQ ID NO: 1639476 - RNA, 20 nt, Pseudomonas putida KT2440
acucagcggccuuucugcuu

SEQ ID NO: 1639477 - RNA, 21 nt, Pseudomonas putida KT2440
acguucgccauaggccgccug

SEQ ID NO: 1639478 - RNA, 23 nt, Pseudomonas putida KT2440
acucaacgcaacugcggccccug

SEQ ID NO: 1639479 - RNA, 18 nt, Pseudomonas putida KT2440
acucacccgcaccucaca

SEQ ID NO: 1639480 - RNA, 12 nt, Pseudomonas putida KT2440
acucacccgccc

SEQ ID NO: 1639481 - RNA, 14 nt, Pseudomonas putida KT2440
acucacccgcccca

SEQ ID NO: 1639482 - RNA, 12 nt, Pseudomonas putida KT2440
acucacccgcuu

SEQ ID NO: 1639483 - RNA, 22 nt, Pseudomonas putida KT2440
acucacccgcuugccacggcgu

SEQ ID NO: 1639484 - RNA, 20 nt, Pseudomonas putida KT2440
acucaauuucccccaaaugc

SEQ ID NO: 1639485 - RNA, 23 nt, Pseudomonas putida KT2440
acucaauuucccccaaaugcccg

SEQ ID NO: 1639486 - RNA, 12 nt, Pseudomonas putida KT2440
acucaccgcaca

SEQ ID NO: 1639487 - RNA, 14 nt, Pseudomonas putida KT2440
acucaccgccgccc

SEQ ID NO: 1639488 - RNA, 19 nt, Pseudomonas putida KT2440
acucaccggcaucgaaggu

SEQ ID NO: 1639489 - RNA, 17 nt, Pseudomonas putida KT2440
acucacgcgccaggguu

SEQ ID NO: 1639490 - RNA, 20 nt, Pseudomonas putida KT2440
agcaagucccccaucggcac

SEQ ID NO: 1639491 - RNA, 14 nt, Pseudomonas putida KT2440
agcaagccgccgau

SEQ ID NO: 1639492 - RNA, 11 nt, Pseudomonas putida KT2440
agcaaggcauc

SEQ ID NO: 1639493 - RNA, 13 nt, Pseudomonas putida KT2440
agcaagccugccg

SEQ ID NO: 1639494 - RNA, 14 nt, Pseudomonas putida KT2440
agcaagcagauuuu

SEQ ID NO: 1639495 - RNA, 21 nt, Pseudomonas putida KT2440
agcaacggacgucccagcagg

SEQ ID NO: 1639496 - RNA, 13 nt, Pseudomonas putida KT2440
agcaacgccgagc

SEQ ID NO: 1639497 - RNA, 16 nt, Pseudomonas putida KT2440
agcaacgccuuggccu

SEQ ID NO: 1639498 - RNA, 17 nt, Pseudomonas putida KT2440
agcaacugggcaaugua

SEQ ID NO: 1639499 - RNA, 15 nt, Pseudomonas putida KT2440
agcaacuccccccgc

SEQ ID NO: 1639500 - RNA, 21 nt, Pseudomonas putida KT2440
agcaacuccccccgcgccaga

SEQ ID NO: 1639501 - RNA, 18 nt, Pseudomonas putida KT2440
agcaacgguuuaccgccg

SEQ ID NO: 1639502 - RNA, 22 nt, Pseudomonas putida KT2440
agcaaugcccgcucgcugcgau

SEQ ID NO: 1639503 - RNA, 18 nt, Pseudomonas putida KT2440
agcaaugccaguugauca

SEQ ID NO: 1639504 - RNA, 14 nt, Pseudomonas putida KT2440
agcaaugccagccg

SEQ ID NO: 1639505 - RNA, 15 nt, Pseudomonas putida KT2440
agcacaaccacugca

SEQ ID NO: 1639506 - RNA, 16 nt, Pseudomonas putida KT2440
agcacaaccacugcaa

SEQ ID NO: 1639507 - RNA, 12 nt, Pseudomonas putida KT2440
agcacaaggcug

SEQ ID NO: 1639508 - RNA, 16 nt, Pseudomonas putida KT2440
agcacuucguccaggg

SEQ ID NO: 1639509 - RNA, 16 nt, Pseudomonas putida KT2440
agcagacagcugugcu

SEQ ID NO: 1639510 - RNA, 19 nt, Pseudomonas putida KT2440
aaaaccggccacgaaggcc

SEQ ID NO: 1639511 - RNA, 20 nt, Pseudomonas putida KT2440
agcacgggcgcugaagccag

SEQ ID NO: 1639512 - RNA, 21 nt, Pseudomonas putida KT2440
agcacugccuggccacuguug

SEQ ID NO: 1639513 - RNA, 17 nt, Pseudomonas putida KT2440
agcacugccuugcccug

SEQ ID NO: 1639514 - RNA, 22 nt, Pseudomonas putida KT2440
agcacugccuugcccugcagcu

SEQ ID NO: 1639515 - RNA, 21 nt, Pseudomonas putida KT2440
agcacugccagcccggcggcc

SEQ ID NO: 1639516 - RNA, 16 nt, Pseudomonas putida KT2440
agcacugcauuggcca

SEQ ID NO: 1639517 - RNA, 19 nt, Pseudomonas putida KT2440
agcacggccuucuucggug

SEQ ID NO: 1639518 - RNA, 15 nt, Pseudomonas putida KT2440
agcacggccagcacc

SEQ ID NO: 1639519 - RNA, 13 nt, Pseudomonas putida KT2440
agcacgcuggcca

SEQ ID NO: 1639520 - RNA, 23 nt, Pseudomonas putida KT2440
agcacgcuggccagaguauugaa

SEQ ID NO: 1639521 - RNA, 14 nt, Pseudomonas putida KT2440
agcacgcccaucag

SEQ ID NO: 1639522 - RNA, 14 nt, Pseudomonas putida KT2440
agcacgcaggccag

SEQ ID NO: 1639523 - RNA, 15 nt, Pseudomonas putida KT2440
agcacgcaggccagc

SEQ ID NO: 1639524 - RNA, 20 nt, Pseudomonas putida KT2440
agcaccgccccggccagugc

SEQ ID NO: 1639525 - RNA, 14 nt, Pseudomonas putida KT2440
agcaccgccaccau

SEQ ID NO: 1639526 - RNA, 18 nt, Pseudomonas putida KT2440
agcaccgaggcgugauca

SEQ ID NO: 1639527 - RNA, 16 nt, Pseudomonas putida KT2440
agcaccgaucagcggc

SEQ ID NO: 1639528 - RNA, 19 nt, Pseudomonas putida KT2440
agcacgaucucgucacugc

SEQ ID NO: 1639529 - RNA, 18 nt, Pseudomonas putida KT2440
agcacgaucagcgcggca

SEQ ID NO: 1639530 - RNA, 16 nt, Pseudomonas putida KT2440
agcacauucagcagcg

SEQ ID NO: 1639531 - RNA, 19 nt, Pseudomonas putida KT2440
agcaccacccaccagcagu

SEQ ID NO: 1639532 - RNA, 21 nt, Pseudomonas putida KT2440
agcaccaccggacgcuugcca

SEQ ID NO: 1639533 - RNA, 14 nt, Pseudomonas putida KT2440
agcacagauaaacc

SEQ ID NO: 1639534 - RNA, 18 nt, Pseudomonas putida KT2440
agcacagauaaaccugcc

SEQ ID NO: 1639535 - RNA, 15 nt, Pseudomonas putida KT2440
agcacacugagcacc

SEQ ID NO: 1639536 - RNA, 19 nt, Pseudomonas putida KT2440
agcacacgcuugucuucca

SEQ ID NO: 1639537 - RNA, 23 nt, Pseudomonas putida KT2440
agcacacgguaggcgucuuccac

SEQ ID NO: 1639538 - RNA, 20 nt, Pseudomonas putida KT2440
agcacagugcggcggcacug

SEQ ID NO: 1639539 - RNA, 19 nt, Pseudomonas putida KT2440
agcacaucacacagcggca

SEQ ID NO: 1639540 - RNA, 17 nt, Pseudomonas putida KT2440
agcacccuuccccccug

SEQ ID NO: 1639541 - RNA, 21 nt, Pseudomonas putida KT2440
agcacccgcuuguagcucagg

SEQ ID NO: 1639542 - RNA, 19 nt, Pseudomonas putida KT2440
agcacccgcuuggccacca

SEQ ID NO: 1639543 - RNA, 14 nt, Pseudomonas putida KT2440
agcacccccgguuc

SEQ ID NO: 1639544 - RNA, 12 nt, Pseudomonas putida KT2440
agcacccacacc

SEQ ID NO: 1639545 - RNA, 23 nt, Pseudomonas putida KT2440
agcaccaugaacucuuccccgcc

SEQ ID NO: 1639546 - RNA, 22 nt, Pseudomonas putida KT2440
agcaccauuugucuugaagaua

SEQ ID NO: 1639547 - RNA, 14 nt, Pseudomonas putida KT2440
agcaccacuggaug

SEQ ID NO: 1639548 - RNA, 19 nt, Pseudomonas putida KT2440
agcaccagcgacugcaagc

SEQ ID NO: 1639549 - RNA, 22 nt, Pseudomonas putida KT2440
agcaccagcgcgaucaccagcc

SEQ ID NO: 1639550 - RNA, 23 nt, Pseudomonas putida KT2440
agcaccagcgcgaucaccagccc

SEQ ID NO: 1639551 - RNA, 19 nt, Pseudomonas putida KT2440
agcauuggauacugcccgu

SEQ ID NO: 1639552 - RNA, 15 nt, Pseudomonas putida KT2440
agcaucugcugcggc

SEQ ID NO: 1639553 - RNA, 22 nt, Pseudomonas putida KT2440
agcaucugcugcggcaggcugg

SEQ ID NO: 1639554 - RNA, 14 nt, Pseudomonas putida KT2440
agcaucuuccugcc

SEQ ID NO: 1639555 - RNA, 15 nt, Pseudomonas putida KT2440
agcaucuucuucacg

SEQ ID NO: 1639556 - RNA, 15 nt, Pseudomonas putida KT2440
agcaucuucuucccc

SEQ ID NO: 1639557 - RNA, 14 nt, Pseudomonas putida KT2440
agcaugucccgggu

SEQ ID NO: 1639558 - RNA, 16 nt, Pseudomonas putida KT2440
agcauguccugcugca

SEQ ID NO: 1639559 - RNA, 18 nt, Pseudomonas putida KT2440
agcauguccugcugcagg

SEQ ID NO: 1639560 - RNA, 19 nt, Pseudomonas putida KT2440
agcauguccugcugcaggc

SEQ ID NO: 1639561 - RNA, 23 nt, Pseudomonas putida KT2440
agccacauccucugcccgcaagg

SEQ ID NO: 1639562 - RNA, 20 nt, Pseudomonas putida KT2440
agccaccacgguggcugcca

SEQ ID NO: 1639563 - RNA, 20 nt, Pseudomonas putida KT2440
agccaccacgucacgcacca

SEQ ID NO: 1639564 - RNA, 17 nt, Pseudomonas putida KT2440
agccacuggccagcaga

SEQ ID NO: 1639565 - RNA, 18 nt, Pseudomonas putida KT2440
agccacuggccagcagau

SEQ ID NO: 1639566 - RNA, 19 nt, Pseudomonas putida KT2440
agccacuggccagcagaug

SEQ ID NO: 1639567 - RNA, 21 nt, Pseudomonas putida KT2440
agccacgggugcgggcuccac

SEQ ID NO: 1639568 - RNA, 13 nt, Pseudomonas putida KT2440
agccagcccggua

SEQ ID NO: 1639569 - RNA, 14 nt, Pseudomonas putida KT2440
agccagcccugccg

SEQ ID NO: 1639570 - RNA, 21 nt, Pseudomonas putida KT2440
agccagcagcguacccagcuc

SEQ ID NO: 1639571 - RNA, 18 nt, Pseudomonas putida KT2440
agccagccaccaccaugc

SEQ ID NO: 1639572 - RNA, 16 nt, Pseudomonas putida KT2440
agccacuucgucgagg

SEQ ID NO: 1639573 - RNA, 20 nt, Pseudomonas putida KT2440
agccaaaguccugcaaaggc

SEQ ID NO: 1639574 - RNA, 20 nt, Pseudomonas putida KT2440
agccaaaucagcuguuugaa

SEQ ID NO: 1639575 - RNA, 16 nt, Pseudomonas putida KT2440
agccaauggcaaacau

SEQ ID NO: 1639576 - RNA, 16 nt, Pseudomonas putida KT2440
agccaaugcagauggu

SEQ ID NO: 1639577 - RNA, 15 nt, Pseudomonas putida KT2440
agcagguucaggcgc

SEQ ID NO: 1639578 - RNA, 17 nt, Pseudomonas putida KT2440
agcagguugaacagcag

SEQ ID NO: 1639579 - RNA, 23 nt, Pseudomonas putida KT2440
agcaguucgcgcaccaucggcuc

SEQ ID NO: 1639580 - RNA, 19 nt, Pseudomonas putida KT2440
agcaguuucagcggccgcu

SEQ ID NO: 1639581 - RNA, 13 nt, Pseudomonas putida KT2440
agcaguugcugcu

SEQ ID NO: 1639582 - RNA, 14 nt, Pseudomonas putida KT2440
agcaguugcugcug

SEQ ID NO: 1639583 - RNA, 17 nt, Pseudomonas putida KT2440
agcaucccccuccuaag

SEQ ID NO: 1639584 - RNA, 19 nt, Pseudomonas putida KT2440
agcaucccccuccuaaggg

SEQ ID NO: 1639585 - RNA, 22 nt, Pseudomonas putida KT2440
agcaucaaucgcuccaggcggc

SEQ ID NO: 1639586 - RNA, 16 nt, Pseudomonas putida KT2440
agcagggccaucaucu

SEQ ID NO: 1639587 - RNA, 22 nt, Pseudomonas putida KT2440
agcaggaacgguguaucggcca

SEQ ID NO: 1639588 - RNA, 20 nt, Pseudomonas putida KT2440
agcagggugccuucaggggc

SEQ ID NO: 1639589 - RNA, 22 nt, Pseudomonas putida KT2440
agcagggugccuucaggggccc

SEQ ID NO: 1639590 - RNA, 18 nt, Pseudomonas putida KT2440
agcaggucaugcagguca

SEQ ID NO: 1639591 - RNA, 12 nt, Pseudomonas putida KT2440
agcagguccagc

SEQ ID NO: 1639592 - RNA, 13 nt, Pseudomonas putida KT2440
agcagguccagcu

SEQ ID NO: 1639593 - RNA, 21 nt, Pseudomonas putida KT2440
agcagguaguucauguaggca

SEQ ID NO: 1639594 - RNA, 15 nt, Pseudomonas putida KT2440
agcagguacaccgcc

SEQ ID NO: 1639595 - RNA, 14 nt, Pseudomonas putida KT2440
agcagcuugcagcg

SEQ ID NO: 1639596 - RNA, 20 nt, Pseudomonas putida KT2440
agcagcuugcagcgccgagc

SEQ ID NO: 1639597 - RNA, 17 nt, Pseudomonas putida KT2440
agcagcuucagccaggg

SEQ ID NO: 1639598 - RNA, 15 nt, Pseudomonas putida KT2440
agcaggaagcuguac

SEQ ID NO: 1639599 - RNA, 21 nt, Pseudomonas putida KT2440
agcaggaaauacgccgccacc

SEQ ID NO: 1639600 - RNA, 20 nt, Pseudomonas putida KT2440
agcagcuuauugcgcagggu

SEQ ID NO: 1639601 - RNA, 12 nt, Pseudomonas putida KT2440
agcagcuucagc

SEQ ID NO: 1639602 - RNA, 12 nt, Pseudomonas putida KT2440
agcagcugcauu

SEQ ID NO: 1639603 - RNA, 14 nt, Pseudomonas putida KT2440
agcagccucggccu

SEQ ID NO: 1639604 - RNA, 16 nt, Pseudomonas putida KT2440
agcagcgacaccagcg

SEQ ID NO: 1639605 - RNA, 18 nt, Pseudomonas putida KT2440
agcagcgacaccagcgca

SEQ ID NO: 1639606 - RNA, 19 nt, Pseudomonas putida KT2440
agcagcgacaccagcgcac

SEQ ID NO: 1639607 - RNA, 16 nt, Pseudomonas putida KT2440
agcagcgaagggcuca

SEQ ID NO: 1639608 - RNA, 23 nt, Pseudomonas putida KT2440
agcagcgaagggcucaacgccag

SEQ ID NO: 1639609 - RNA, 18 nt, Pseudomonas putida KT2440
agcagcgaaugcagcucg

SEQ ID NO: 1639610 - RNA, 21 nt, Pseudomonas putida KT2440
aaaaccugcugacaccgcugc

SEQ ID NO: 1639611 - RNA, 15 nt, Pseudomonas putida KT2440
aaaaccuguuccagc

SEQ ID NO: 1639612 - RNA, 16 nt, Pseudomonas putida KT2440
agcgcgggucuuccac

SEQ ID NO: 1639613 - RNA, 12 nt, Pseudomonas putida KT2440
agcgcguacagc

SEQ ID NO: 1639614 - RNA, 14 nt, Pseudomonas putida KT2440
agcgcuccgccaaa

SEQ ID NO: 1639615 - RNA, 20 nt, Pseudomonas putida KT2440
agcgcuccgccaaaccccag

SEQ ID NO: 1639616 - RNA, 17 nt, Pseudomonas putida KT2440
agcgcucguaggcuuca

SEQ ID NO: 1639617 - RNA, 16 nt, Pseudomonas putida KT2440
agcgcgccacgcacca

SEQ ID NO: 1639618 - RNA, 14 nt, Pseudomonas putida KT2440
agcgcgccagcagg

SEQ ID NO: 1639619 - RNA, 13 nt, Pseudomonas putida KT2440
agcgcggcaaccu

SEQ ID NO: 1639620 - RNA, 15 nt, Pseudomonas putida KT2440
agcgcggcaaccugc

SEQ ID NO: 1639621 - RNA, 20 nt, Pseudomonas putida KT2440
agcgcggcaaccugcucgcu

SEQ ID NO: 1639622 - RNA, 20 nt, Pseudomonas putida KT2440
agcgccgcgcgggcggcgcu

SEQ ID NO: 1639623 - RNA, 19 nt, Pseudomonas putida KT2440
agcgccggcaguugcuccu

SEQ ID NO: 1639624 - RNA, 13 nt, Pseudomonas putida KT2440
agcgcgacgcagc

SEQ ID NO: 1639625 - RNA, 17 nt, Pseudomonas putida KT2440
agcgcgacgcagcagcg

SEQ ID NO: 1639626 - RNA, 17 nt, Pseudomonas putida KT2440
agcgccgugcucggccu

SEQ ID NO: 1639627 - RNA, 16 nt, Pseudomonas putida KT2440
agcgcgaucaccagcc

SEQ ID NO: 1639628 - RNA, 18 nt, Pseudomonas putida KT2440
agcgcgaucaccagcccc

SEQ ID NO: 1639629 - RNA, 12 nt, Pseudomonas putida KT2440
agcgcgagcugg

SEQ ID NO: 1639630 - RNA, 14 nt, Pseudomonas putida KT2440
agcgccgccaggcc

SEQ ID NO: 1639631 - RNA, 21 nt, Pseudomonas putida KT2440
agcgcccgggcaucaucaaag

SEQ ID NO: 1639632 - RNA, 18 nt, Pseudomonas putida KT2440
agcgcccgguuccagguu

SEQ ID NO: 1639633 - RNA, 22 nt, Pseudomonas putida KT2440
agcgcccgcccaccaccagccc

SEQ ID NO: 1639634 - RNA, 18 nt, Pseudomonas putida KT2440
agcgccaugagugcaggc

SEQ ID NO: 1639635 - RNA, 19 nt, Pseudomonas putida KT2440
agcgcccagaucagcagca

SEQ ID NO: 1639636 - RNA, 12 nt, Pseudomonas putida KT2440
agcgccccagga

SEQ ID NO: 1639637 - RNA, 17 nt, Pseudomonas putida KT2440
agcgccaauaccgcgca

SEQ ID NO: 1639638 - RNA, 16 nt, Pseudomonas putida KT2440
agcgccaaaggcgcgu

SEQ ID NO: 1639639 - RNA, 18 nt, Pseudomonas putida KT2440
agcgcauugaucgccgcc

SEQ ID NO: 1639640 - RNA, 16 nt, Pseudomonas putida KT2440
agcgcagaucccgcuc

SEQ ID NO: 1639641 - RNA, 13 nt, Pseudomonas putida KT2440
agcgcagccacca

SEQ ID NO: 1639642 - RNA, 14 nt, Pseudomonas putida KT2440
agcgcagccaccag

SEQ ID NO: 1639643 - RNA, 15 nt, Pseudomonas putida KT2440
agcgcagccaccagc

SEQ ID NO: 1639644 - RNA, 17 nt, Pseudomonas putida KT2440
agcgcagccaccagcuu

SEQ ID NO: 1639645 - RNA, 23 nt, Pseudomonas putida KT2440
agcgcaggcgguuggccauguug

SEQ ID NO: 1639646 - RNA, 18 nt, Pseudomonas putida KT2440
agcgcagcgacgaccugc

SEQ ID NO: 1639647 - RNA, 21 nt, Pseudomonas putida KT2440
agcgcagccuugucucugaac

SEQ ID NO: 1639648 - RNA, 20 nt, Pseudomonas putida KT2440
agcgcacgucucgggaauug

SEQ ID NO: 1639649 - RNA, 11 nt, Pseudomonas putida KT2440
agcgcaccgcu

SEQ ID NO: 1639650 - RNA, 16 nt, Pseudomonas putida KT2440
agcgcaccgcugacca

SEQ ID NO: 1639651 - RNA, 18 nt, Pseudomonas putida KT2440
agcgcaccgcugaccaca

SEQ ID NO: 1639652 - RNA, 17 nt, Pseudomonas putida KT2440
agcgcaccgugcaccag

SEQ ID NO: 1639653 - RNA, 19 nt, Pseudomonas putida KT2440
agcgcaccgugcaccagca

SEQ ID NO: 1639654 - RNA, 21 nt, Pseudomonas putida KT2440
agcgcaccgugcaccagcacc

SEQ ID NO: 1639655 - RNA, 22 nt, Pseudomonas putida KT2440
agcgacaggcuugaagcugcgc

SEQ ID NO: 1639656 - RNA, 17 nt, Pseudomonas putida KT2440
agcgacaucggaacgaa

SEQ ID NO: 1639657 - RNA, 21 nt, Pseudomonas putida KT2440
agcgacaugccggccaccaca

SEQ ID NO: 1639658 - RNA, 14 nt, Pseudomonas putida KT2440
agcgaccuauaaug

SEQ ID NO: 1639659 - RNA, 21 nt, Pseudomonas putida KT2440
agcgaccgguuuucuguugcc

SEQ ID NO: 1639660 - RNA, 13 nt, Pseudomonas putida KT2440
agcggcgcggccu

SEQ ID NO: 1639661 - RNA, 19 nt, Pseudomonas putida KT2440
agcgggucgucgcccaggc

SEQ ID NO: 1639662 - RNA, 19 nt, Pseudomonas putida KT2440
agcggguuuacccgcgaag

SEQ ID NO: 1639663 - RNA, 19 nt, Pseudomonas putida KT2440
agcggguuuacccgcgaau

SEQ ID NO: 1639664 - RNA, 16 nt, Pseudomonas putida KT2440
agcggcaggcuggcgu

SEQ ID NO: 1639665 - RNA, 17 nt, Pseudomonas putida KT2440
agcggcaguugcaggcg

SEQ ID NO: 1639666 - RNA, 20 nt, Pseudomonas putida KT2440
agcggcaguugcaggcgcag

SEQ ID NO: 1639667 - RNA, 14 nt, Pseudomonas putida KT2440
agcggccacagcgc

SEQ ID NO: 1639668 - RNA, 13 nt, Pseudomonas putida KT2440
agcggccaccugc

SEQ ID NO: 1639669 - RNA, 21 nt, Pseudomonas putida KT2440
agcggcgagucgaucggcagu

SEQ ID NO: 1639670 - RNA, 21 nt, Pseudomonas putida KT2440
agcggcgauagggaacagggc

SEQ ID NO: 1639671 - RNA, 19 nt, Pseudomonas putida KT2440
agcggccugagaccaguuc

SEQ ID NO: 1639672 - RNA, 12 nt, Pseudomonas putida KT2440
agcggccuuuga

SEQ ID NO: 1639673 - RNA, 18 nt, Pseudomonas putida KT2440
agcggucugcugcgucag

SEQ ID NO: 1639674 - RNA, 17 nt, Pseudomonas putida KT2440
agcggugugggcgaagu

SEQ ID NO: 1639675 - RNA, 13 nt, Pseudomonas putida KT2440
agcguacacugca

SEQ ID NO: 1639676 - RNA, 16 nt, Pseudomonas putida KT2440
agcguacacugcagga

SEQ ID NO: 1639677 - RNA, 21 nt, Pseudomonas putida KT2440
agcguacacugcaggagcggg

SEQ ID NO: 1639678 - RNA, 14 nt, Pseudomonas putida KT2440
agcguagugcaggc

SEQ ID NO: 1639679 - RNA, 18 nt, Pseudomonas putida KT2440
agcgucaaccaggcgcag

SEQ ID NO: 1639680 - RNA, 15 nt, Pseudomonas putida KT2440
agcguauugccagaa

SEQ ID NO: 1639681 - RNA, 21 nt, Pseudomonas putida KT2440
agcgcugggcgguacccacca

SEQ ID NO: 1639682 - RNA, 19 nt, Pseudomonas putida KT2440
agcgcugacucagcggccu

SEQ ID NO: 1639683 - RNA, 18 nt, Pseudomonas putida KT2440
agcgcugacugccaggcc

SEQ ID NO: 1639684 - RNA, 12 nt, Pseudomonas putida KT2440
agcgcugcaccg

SEQ ID NO: 1639685 - RNA, 20 nt, Pseudomonas putida KT2440
agcgcugcaccgaaggccgc

SEQ ID NO: 1639686 - RNA, 19 nt, Pseudomonas putida KT2440
agcgcuucgugcagguugc

SEQ ID NO: 1639687 - RNA, 13 nt, Pseudomonas putida KT2440
agcgcuucagcuc

SEQ ID NO: 1639688 - RNA, 15 nt, Pseudomonas putida KT2440
agcgcuucagcucgc

SEQ ID NO: 1639689 - RNA, 19 nt, Pseudomonas putida KT2440
agcgcuuccaagugcugua

SEQ ID NO: 1639690 - RNA, 22 nt, Pseudomonas putida KT2440
agcgcuuaaaucaagagcccgg

SEQ ID NO: 1639691 - RNA, 20 nt, Pseudomonas putida KT2440
agcgcugucccccagcccug

SEQ ID NO: 1639692 - RNA, 17 nt, Pseudomonas putida KT2440
agcgcuuggucccccac

SEQ ID NO: 1639693 - RNA, 23 nt, Pseudomonas putida KT2440
agcggaugagccuucacugugca

SEQ ID NO: 1639694 - RNA, 22 nt, Pseudomonas putida KT2440
agcggaucaccgacgugcagga

SEQ ID NO: 1639695 - RNA, 15 nt, Pseudomonas putida KT2440
agcggagcugguggu

SEQ ID NO: 1639696 - RNA, 14 nt, Pseudomonas putida KT2440
agcggcaggcuggc

SEQ ID NO: 1639697 - RNA, 20 nt, Pseudomonas putida KT2440
agcggcagcaucgaccugcc

SEQ ID NO: 1639698 - RNA, 13 nt, Pseudomonas putida KT2440
agcggcagcaagu

SEQ ID NO: 1639699 - RNA, 15 nt, Pseudomonas putida KT2440
agccuaccaacgcag

SEQ ID NO: 1639700 - RNA, 18 nt, Pseudomonas putida KT2440
agccuacgcccccagccu

SEQ ID NO: 1639701 - RNA, 15 nt, Pseudomonas putida KT2440
agccggguccacccg

SEQ ID NO: 1639702 - RNA, 19 nt, Pseudomonas putida KT2440
agccggucauccagcagcu

SEQ ID NO: 1639703 - RNA, 20 nt, Pseudomonas putida KT2440
agccggucauccagcagcuc

SEQ ID NO: 1639704 - RNA, 13 nt, Pseudomonas putida KT2440
agccguccaggaa

SEQ ID NO: 1639705 - RNA, 19 nt, Pseudomonas putida KT2440
agccguccaggaacgcugc

SEQ ID NO: 1639706 - RNA, 21 nt, Pseudomonas putida KT2440
agccgguuggcguaaggacca

SEQ ID NO: 1639707 - RNA, 20 nt, Pseudomonas putida KT2440
agccgguuucguaagcgcug

SEQ ID NO: 1639708 - RNA, 15 nt, Pseudomonas putida KT2440
agccggcuaucggcc

SEQ ID NO: 1639709 - RNA, 14 nt, Pseudomonas putida KT2440
agccggcuuguucu

SEQ ID NO: 1639710 - RNA, 13 nt, Pseudomonas putida KT2440
agcgacacugaca

SEQ ID NO: 1639711 - RNA, 14 nt, Pseudomonas putida KT2440
agcgaagggcucaa

SEQ ID NO: 1639712 - RNA, 18 nt, Pseudomonas putida KT2440
agcgaaauagguaaagcc

SEQ ID NO: 1639713 - RNA, 17 nt, Pseudomonas putida KT2440
agccuuuagcgcaucuu

SEQ ID NO: 1639714 - RNA, 13 nt, Pseudomonas putida KT2440
agccuuggccagc

SEQ ID NO: 1639715 - RNA, 22 nt, Pseudomonas putida KT2440
agccuugucucugaacacaugc

SEQ ID NO: 1639716 - RNA, 14 nt, Pseudomonas putida KT2440
agccuugugcugca

SEQ ID NO: 1639717 - RNA, 18 nt, Pseudomonas putida KT2440
agccuucgucgcuggcca

SEQ ID NO: 1639718 - RNA, 18 nt, Pseudomonas putida KT2440
agccucuucggccagcaa

SEQ ID NO: 1639719 - RNA, 20 nt, Pseudomonas putida KT2440
agccucuucggccagcaacu

SEQ ID NO: 1639720 - RNA, 11 nt, Pseudomonas putida KT2440
agccucggcuc

SEQ ID NO: 1639721 - RNA, 14 nt, Pseudomonas putida KT2440
agccucggcucucc

SEQ ID NO: 1639722 - RNA, 18 nt, Pseudomonas putida KT2440
agccuucagcggccgcgc

SEQ ID NO: 1639723 - RNA, 20 nt, Pseudomonas putida KT2440
agccuccagagaaccgcaca

SEQ ID NO: 1639724 - RNA, 15 nt, Pseudomonas putida KT2440
agccucgcgcaacac

SEQ ID NO: 1639725 - RNA, 16 nt, Pseudomonas putida KT2440
agccuccggcccaucc

SEQ ID NO: 1639726 - RNA, 17 nt, Pseudomonas putida KT2440
agccuccggcccauccc

SEQ ID NO: 1639727 - RNA, 13 nt, Pseudomonas putida KT2440
agccucagcgccc

SEQ ID NO: 1639728 - RNA, 14 nt, Pseudomonas putida KT2440
agccgcguccuuga

SEQ ID NO: 1639729 - RNA, 14 nt, Pseudomonas putida KT2440
agccgcgcccucuu

SEQ ID NO: 1639730 - RNA, 19 nt, Pseudomonas putida KT2440
agccgcgcccucuuccgca

SEQ ID NO: 1639731 - RNA, 15 nt, Pseudomonas putida KT2440
agccgcgccaggucg

SEQ ID NO: 1639732 - RNA, 16 nt, Pseudomonas putida KT2440
agccgccguaccuucg

SEQ ID NO: 1639733 - RNA, 19 nt, Pseudomonas putida KT2440
agccgcuuucggucagggc

SEQ ID NO: 1639734 - RNA, 20 nt, Pseudomonas putida KT2440
agccgcugucgguaaaacag

SEQ ID NO: 1639735 - RNA, 22 nt, Pseudomonas putida KT2440
agccgcuguucugcagucaggu

SEQ ID NO: 1639736 - RNA, 16 nt, Pseudomonas putida KT2440
agccgcugcugcaguu

SEQ ID NO: 1639737 - RNA, 14 nt, Pseudomonas putida KT2440
agccgcugcgccug

SEQ ID NO: 1639738 - RNA, 16 nt, Pseudomonas putida KT2440
agccgcugcgccugcc

SEQ ID NO: 1639739 - RNA, 21 nt, Pseudomonas putida KT2440
agccgcugcgccugccgggcc

SEQ ID NO: 1639740 - RNA, 16 nt, Pseudomonas putida KT2440
agccgcucagccaccu

SEQ ID NO: 1639741 - RNA, 18 nt, Pseudomonas putida KT2440
agccgcucagccaccugu

SEQ ID NO: 1639742 - RNA, 19 nt, Pseudomonas putida KT2440
agccggcgaacagcacugc

SEQ ID NO: 1639743 - RNA, 14 nt, Pseudomonas putida KT2440
agccggccccugcu

SEQ ID NO: 1639744 - RNA, 13 nt, Pseudomonas putida KT2440
agcccggcaccug

SEQ ID NO: 1639745 - RNA, 15 nt, Pseudomonas putida KT2440
agcccggacugcacc

SEQ ID NO: 1639746 - RNA, 19 nt, Pseudomonas putida KT2440
agcccggacugcaccaggu

SEQ ID NO: 1639747 - RNA, 13 nt, Pseudomonas putida KT2440
agcccggccaggu

SEQ ID NO: 1639748 - RNA, 14 nt, Pseudomonas putida KT2440
agccagggcaagca

SEQ ID NO: 1639749 - RNA, 15 nt, Pseudomonas putida KT2440
agccagguauggcca

SEQ ID NO: 1639750 - RNA, 19 nt, Pseudomonas putida KT2440
agccagguauggccagagc

SEQ ID NO: 1639751 - RNA, 14 nt, Pseudomonas putida KT2440
agccagggccugua

SEQ ID NO: 1639752 - RNA, 17 nt, Pseudomonas putida KT2440
agccaggcugagcccgg

SEQ ID NO: 1639753 - RNA, 19 nt, Pseudomonas putida KT2440
agccaggcugagcccggca

SEQ ID NO: 1639754 - RNA, 17 nt, Pseudomonas putida KT2440
agcccgcucgccacaca

SEQ ID NO: 1639755 - RNA, 13 nt, Pseudomonas putida KT2440
agccagguuuuug

SEQ ID NO: 1639756 - RNA, 15 nt, Pseudomonas putida KT2440
agccaguacgcaggc

SEQ ID NO: 1639757 - RNA, 21 nt, Pseudomonas putida KT2440
agccaguacgcgccugcaccu

SEQ ID NO: 1639758 - RNA, 19 nt, Pseudomonas putida KT2440
agccgcacccaggccacga

SEQ ID NO: 1639759 - RNA, 21 nt, Pseudomonas putida KT2440
agccgacccgggccagccacu

SEQ ID NO: 1639760 - RNA, 14 nt, Pseudomonas putida KT2440
agccgaacagcagg

SEQ ID NO: 1639761 - RNA, 13 nt, Pseudomonas putida KT2440
agccgaacuuguc

SEQ ID NO: 1639762 - RNA, 17 nt, Pseudomonas putida KT2440
acuuggccugcugauua

SEQ ID NO: 1639763 - RNA, 13 nt, Pseudomonas putida KT2440
acuugucugccag

SEQ ID NO: 1639764 - RNA, 17 nt, Pseudomonas putida KT2440
acuugugugccugcucc

SEQ ID NO: 1639765 - RNA, 21 nt, Pseudomonas putida KT2440
acuugcgccccucaucaaacc

SEQ ID NO: 1639766 - RNA, 14 nt, Pseudomonas putida KT2440
acuugcgcagcuug

SEQ ID NO: 1639767 - RNA, 15 nt, Pseudomonas putida KT2440
acuugcgcagcuugu

SEQ ID NO: 1639768 - RNA, 22 nt, Pseudomonas putida KT2440
acuugcgcaguaacaggcgcac

SEQ ID NO: 1639769 - RNA, 15 nt, Pseudomonas putida KT2440
acuugcugcagggca

SEQ ID NO: 1639770 - RNA, 15 nt, Pseudomonas putida KT2440
acuugcaggugcagg

SEQ ID NO: 1639771 - RNA, 17 nt, Pseudomonas putida KT2440
acuuauaagcagcaagc

SEQ ID NO: 1639772 - RNA, 17 nt, Pseudomonas putida KT2440
acuuguuggccaccauc

SEQ ID NO: 1639773 - RNA, 13 nt, Pseudomonas putida KT2440
acuuuuucagguu

SEQ ID NO: 1639774 - RNA, 21 nt, Pseudomonas putida KT2440
acuuuucgccacaacccauca

SEQ ID NO: 1639775 - RNA, 15 nt, Pseudomonas putida KT2440
acuuugucgccuacc

SEQ ID NO: 1639776 - RNA, 14 nt, Pseudomonas putida KT2440
agaaugcugcgcag

SEQ ID NO: 1639777 - RNA, 19 nt, Pseudomonas putida KT2440
agaaugcggauguaguucu

SEQ ID NO: 1639778 - RNA, 14 nt, Pseudomonas putida KT2440
agaaucucccgggc

SEQ ID NO: 1639779 - RNA, 19 nt, Pseudomonas putida KT2440
agaaucucaaccaccucua

SEQ ID NO: 1639780 - RNA, 18 nt, Pseudomonas putida KT2440
agaauggaggagggcugc

SEQ ID NO: 1639781 - RNA, 16 nt, Pseudomonas putida KT2440
agaagccucaccgccg

SEQ ID NO: 1639782 - RNA, 14 nt, Pseudomonas putida KT2440
agaagcgccgcagg

SEQ ID NO: 1639783 - RNA, 14 nt, Pseudomonas putida KT2440
agaagccuuggccu

SEQ ID NO: 1639784 - RNA, 15 nt, Pseudomonas putida KT2440
agaagccuuuggccg

SEQ ID NO: 1639785 - RNA, 22 nt, Pseudomonas putida KT2440
agaagccaccgcgauggauggc

SEQ ID NO: 1639786 - RNA, 19 nt, Pseudomonas putida KT2440
agaauagccggccucagca

SEQ ID NO: 1639787 - RNA, 23 nt, Pseudomonas putida KT2440
agaauacccauuuacugcagaac

SEQ ID NO: 1639788 - RNA, 23 nt, Pseudomonas putida KT2440
agaauaauucuuauuaccagaau

SEQ ID NO: 1639789 - RNA, 14 nt, Pseudomonas putida KT2440
agaagaagcuguag

SEQ ID NO: 1639790 - RNA, 14 nt, Pseudomonas putida KT2440
agaacguggugcgg

SEQ ID NO: 1639791 - RNA, 16 nt, Pseudomonas putida KT2440
agaacuugguccagaa

SEQ ID NO: 1639792 - RNA, 19 nt, Pseudomonas putida KT2440
agaacuugguccagaaaau

SEQ ID NO: 1639793 - RNA, 14 nt, Pseudomonas putida KT2440
agaacggcagcagg

SEQ ID NO: 1639794 - RNA, 19 nt, Pseudomonas putida KT2440
agaacgggucauugcugau

SEQ ID NO: 1639795 - RNA, 19 nt, Pseudomonas putida KT2440
agaaccugacaagcgaggu

SEQ ID NO: 1639796 - RNA, 13 nt, Pseudomonas putida KT2440
agaacaacacggc

SEQ ID NO: 1639797 - RNA, 16 nt, Pseudomonas putida KT2440
agaacaugaaagugac

SEQ ID NO: 1639798 - RNA, 23 nt, Pseudomonas putida KT2440
agauacaggcuguuccauuuccc

SEQ ID NO: 1639799 - RNA, 24 nt, Pseudomonas putida KT2440
agaucaacgccgccagcggcucga

SEQ ID NO: 1639800 - RNA, 13 nt, Pseudomonas putida KT2440
agaucaagccccu

SEQ ID NO: 1639801 - RNA, 14 nt, Pseudomonas putida KT2440
agaucaagccccug

SEQ ID NO: 1639802 - RNA, 16 nt, Pseudomonas putida KT2440
agaucacccuuggcca

SEQ ID NO: 1639803 - RNA, 18 nt, Pseudomonas putida KT2440
agaucacccuuggccacc

SEQ ID NO: 1639804 - RNA, 15 nt, Pseudomonas putida KT2440
agaguccgaagcgaa

SEQ ID NO: 1639805 - RNA, 13 nt, Pseudomonas putida KT2440
aaaaccaccagcc

SEQ ID NO: 1639806 - RNA, 23 nt, Pseudomonas putida KT2440
agauaaccuggcucggcugggcu

SEQ ID NO: 1639807 - RNA, 15 nt, Pseudomonas putida KT2440
agaucgagcgccgcc

SEQ ID NO: 1639808 - RNA, 21 nt, Pseudomonas putida KT2440
agauccgcagggucuucucag

SEQ ID NO: 1639809 - RNA, 22 nt, Pseudomonas putida KT2440
agaugcacaccaguucaccauc

SEQ ID NO: 1639810 - RNA, 16 nt, Pseudomonas putida KT2440
agaugaaguagaacug

SEQ ID NO: 1639811 - RNA, 13 nt, Pseudomonas putida KT2440
agaugcugguucg

SEQ ID NO: 1639812 - RNA, 16 nt, Pseudomonas putida KT2440
agaugcugcugcagug

SEQ ID NO: 1639813 - RNA, 16 nt, Pseudomonas putida KT2440
agauggugaugccccu

SEQ ID NO: 1639814 - RNA, 16 nt, Pseudomonas putida KT2440
agagaccgauuucaac

SEQ ID NO: 1639815 - RNA, 13 nt, Pseudomonas putida KT2440
agagaagcugcag

SEQ ID NO: 1639816 - RNA, 16 nt, Pseudomonas putida KT2440
agacuuuccugaaacc

SEQ ID NO: 1639817 - RNA, 22 nt, Pseudomonas putida KT2440
agacuuuccugaaaccccgccc

SEQ ID NO: 1639818 - RNA, 23 nt, Pseudomonas putida KT2440
agagcauggccagccggcagcaa

SEQ ID NO: 1639819 - RNA, 14 nt, Pseudomonas putida KT2440
agagcaucccccuc

SEQ ID NO: 1639820 - RNA, 20 nt, Pseudomonas putida KT2440
agagcaucccccuccuaagg

SEQ ID NO: 1639821 - RNA, 20 nt, Pseudomonas putida KT2440
agacucucgauugaccccug

SEQ ID NO: 1639822 - RNA, 22 nt, Pseudomonas putida KT2440
agacuucgcugucuuccagggc

SEQ ID NO: 1639823 - RNA, 21 nt, Pseudomonas putida KT2440
agacgcuugcgcauggccgcc

SEQ ID NO: 1639824 - RNA, 17 nt, Pseudomonas putida KT2440
agacucaaucaggcagc

SEQ ID NO: 1639825 - RNA, 19 nt, Pseudomonas putida KT2440
agacccugacucaugccuu

SEQ ID NO: 1639826 - RNA, 20 nt, Pseudomonas putida KT2440
agacccugacucaugccuuc

SEQ ID NO: 1639827 - RNA, 16 nt, Pseudomonas putida KT2440
agacccgcuucgccgc

SEQ ID NO: 1639828 - RNA, 12 nt, Pseudomonas putida KT2440
agacccgcaagc

SEQ ID NO: 1639829 - RNA, 16 nt, Pseudomonas putida KT2440
agaccggguccagcaa

SEQ ID NO: 1639830 - RNA, 19 nt, Pseudomonas putida KT2440
agaccguuccgcaaauucu

SEQ ID NO: 1639831 - RNA, 18 nt, Pseudomonas putida KT2440
agacgcggaacuggcuga

SEQ ID NO: 1639832 - RNA, 19 nt, Pseudomonas putida KT2440
agacgcucgacagcaacuu

SEQ ID NO: 1639833 - RNA, 15 nt, Pseudomonas putida KT2440
agaccuccgucugcu

SEQ ID NO: 1639834 - RNA, 15 nt, Pseudomonas putida KT2440
agacgaacagcgccg

SEQ ID NO: 1639835 - RNA, 16 nt, Pseudomonas putida KT2440
acagcagcuugcgcgc

SEQ ID NO: 1639836 - RNA, 15 nt, Pseudomonas putida KT2440
acagcagcgccgcca

SEQ ID NO: 1639837 - RNA, 12 nt, Pseudomonas putida KT2440
acagcaauucca

SEQ ID NO: 1639838 - RNA, 20 nt, Pseudomonas putida KT2440
acagcaauuccaaugagaau

SEQ ID NO: 1639839 - RNA, 14 nt, Pseudomonas putida KT2440
acagcacaccuucc

SEQ ID NO: 1639840 - RNA, 17 nt, Pseudomonas putida KT2440
acacgucgccugggcau

SEQ ID NO: 1639841 - RNA, 13 nt, Pseudomonas putida KT2440
acacguccagccc

SEQ ID NO: 1639842 - RNA, 17 nt, Pseudomonas putida KT2440
acacguccagccccgca

SEQ ID NO: 1639843 - RNA, 20 nt, Pseudomonas putida KT2440
acacgucggcuggcagcuug

SEQ ID NO: 1639844 - RNA, 19 nt, Pseudomonas putida KT2440
acagcaggcaaagaaugcc

SEQ ID NO: 1639845 - RNA, 12 nt, Pseudomonas putida KT2440
acagcaggaaca

SEQ ID NO: 1639846 - RNA, 23 nt, Pseudomonas putida KT2440
acagccacgcccgucaccuugcc

SEQ ID NO: 1639847 - RNA, 16 nt, Pseudomonas putida KT2440
acagccagaaagccac

SEQ ID NO: 1639848 - RNA, 17 nt, Pseudomonas putida KT2440
acagccagaaagccacu

SEQ ID NO: 1639849 - RNA, 15 nt, Pseudomonas putida KT2440
acagccacaugccag

SEQ ID NO: 1639850 - RNA, 20 nt, Pseudomonas putida KT2440
acagccgcgcaugcugugcc

SEQ ID NO: 1639851 - RNA, 21 nt, Pseudomonas putida KT2440
acagccgcgcaugcugugccc

SEQ ID NO: 1639852 - RNA, 21 nt, Pseudomonas putida KT2440
acagccggcccuucugcugcu

SEQ ID NO: 1639853 - RNA, 17 nt, Pseudomonas putida KT2440
acagccuaccaacgcag

SEQ ID NO: 1639854 - RNA, 14 nt, Pseudomonas putida KT2440
acaggaaucaccag

SEQ ID NO: 1639855 - RNA, 14 nt, Pseudomonas putida KT2440
acaggccugcggcc

SEQ ID NO: 1639856 - RNA, 18 nt, Pseudomonas putida KT2440
acaggccugcggccaggc

SEQ ID NO: 1639857 - RNA, 13 nt, Pseudomonas putida KT2440
acaggcgcagcag

SEQ ID NO: 1639858 - RNA, 15 nt, Pseudomonas putida KT2440
acaggcgcagcagcu

SEQ ID NO: 1639859 - RNA, 15 nt, Pseudomonas putida KT2440
acaggcgaugaaagc

SEQ ID NO: 1639860 - RNA, 19 nt, Pseudomonas putida KT2440
acaggcgaugaaagccuaa

SEQ ID NO: 1639861 - RNA, 21 nt, Pseudomonas putida KT2440
acagggaccucacagccuuca

SEQ ID NO: 1639862 - RNA, 20 nt, Pseudomonas putida KT2440
acagggaucaagccugacuc

SEQ ID NO: 1639863 - RNA, 14 nt, Pseudomonas putida KT2440
acagggaaacaaau

SEQ ID NO: 1639864 - RNA, 21 nt, Pseudomonas putida KT2440
acaggcugucggcaugcacuu

SEQ ID NO: 1639865 - RNA, 18 nt, Pseudomonas putida KT2440
acaggcuggcaucgccuc

SEQ ID NO: 1639866 - RNA, 15 nt, Pseudomonas putida KT2440
acaggcuugaagcug

SEQ ID NO: 1639867 - RNA, 16 nt, Pseudomonas putida KT2440
acaggcgcuugaagaa

SEQ ID NO: 1639868 - RNA, 23 nt, Pseudomonas putida KT2440
acaggcggccgaucacucggcag

SEQ ID NO: 1639869 - RNA, 14 nt, Pseudomonas putida KT2440
acaggcguacauca

SEQ ID NO: 1639870 - RNA, 19 nt, Pseudomonas putida KT2440
acagcgcccggcgcagcau

SEQ ID NO: 1639871 - RNA, 18 nt, Pseudomonas putida KT2440
acagcuugcccagcugcg

SEQ ID NO: 1639872 - RNA, 23 nt, Pseudomonas putida KT2440
acagcuugcccaucaccucgucg

SEQ ID NO: 1639873 - RNA, 15 nt, Pseudomonas putida KT2440
acagcuucugguugu

SEQ ID NO: 1639874 - RNA, 18 nt, Pseudomonas putida KT2440
acagcuucuugcaccgcu

SEQ ID NO: 1639875 - RNA, 16 nt, Pseudomonas putida KT2440
acagcucacuggcauc

SEQ ID NO: 1639876 - RNA, 18 nt, Pseudomonas putida KT2440
acagcucauccaggcugc

SEQ ID NO: 1639877 - RNA, 22 nt, Pseudomonas putida KT2440
acagcucgauggccaggaacag

SEQ ID NO: 1639878 - RNA, 14 nt, Pseudomonas putida KT2440
acagcgagcagccu

SEQ ID NO: 1639879 - RNA, 20 nt, Pseudomonas putida KT2440
acagcgcacucucccgcagc

SEQ ID NO: 1639880 - RNA, 15 nt, Pseudomonas putida KT2440
acagcgcagccacca

SEQ ID NO: 1639881 - RNA, 13 nt, Pseudomonas putida KT2440
acagcgccuccag

SEQ ID NO: 1639882 - RNA, 15 nt, Pseudomonas putida KT2440
acagcgccugcugcu

SEQ ID NO: 1639883 - RNA, 14 nt, Pseudomonas putida KT2440
acagugcuuccagc

SEQ ID NO: 1639884 - RNA, 17 nt, Pseudomonas putida KT2440
acagugcuuccagcagg

SEQ ID NO: 1639885 - RNA, 16 nt, Pseudomonas putida KT2440
acagugguguacagca

SEQ ID NO: 1639886 - RNA, 19 nt, Pseudomonas putida KT2440
acagugguguacagcaaca

SEQ ID NO: 1639887 - RNA, 19 nt, Pseudomonas putida KT2440
acagugaauuccuugcugg

SEQ ID NO: 1639888 - RNA, 17 nt, Pseudomonas putida KT2440
acaguucgaaaaccugc

SEQ ID NO: 1639889 - RNA, 21 nt, Pseudomonas putida KT2440
acaguucgaaaaccugcugac

SEQ ID NO: 1639890 - RNA, 18 nt, Pseudomonas putida KT2440
acaguucgaaaccacccu

SEQ ID NO: 1639891 - RNA, 13 nt, Pseudomonas putida KT2440
acaguguggugcg

SEQ ID NO: 1639892 - RNA, 15 nt, Pseudomonas putida KT2440
acaguuggugggcaa

SEQ ID NO: 1639893 - RNA, 14 nt, Pseudomonas putida KT2440
acaguuucuugccu

SEQ ID NO: 1639894 - RNA, 19 nt, Pseudomonas putida KT2440
acauaaccccccacccagc

SEQ ID NO: 1639895 - RNA, 14 nt, Pseudomonas putida KT2440
acagguuugcugag

SEQ ID NO: 1639896 - RNA, 12 nt, Pseudomonas putida KT2440
acagggccuuga

SEQ ID NO: 1639897 - RNA, 20 nt, Pseudomonas putida KT2440
acagggccuugaucugcugc

SEQ ID NO: 1639898 - RNA, 21 nt, Pseudomonas putida KT2440
acagggccuugaucugcugcg

SEQ ID NO: 1639899 - RNA, 14 nt, Pseudomonas putida KT2440
acagggccggcccc

SEQ ID NO: 1639900 - RNA, 11 nt, Pseudomonas putida KT2440
acaggggaugc

SEQ ID NO: 1639901 - RNA, 12 nt, Pseudomonas putida KT2440
acaggggaugcg

SEQ ID NO: 1639902 - RNA, 20 nt, Pseudomonas putida KT2440
acagguacugagucggccuc

SEQ ID NO: 1639903 - RNA, 23 nt, Pseudomonas putida KT2440
acagguaauugguggugcugggc

SEQ ID NO: 1639904 - RNA, 18 nt, Pseudomonas putida KT2440
acagguaagucacaggcu

SEQ ID NO: 1639905 - RNA, 20 nt, Pseudomonas putida KT2440
acagguaagucacaggcuuc

SEQ ID NO: 1639906 - RNA, 23 nt, Pseudomonas putida KT2440
acaggguuaccacauaacugccg

SEQ ID NO: 1639907 - RNA, 14 nt, Pseudomonas putida KT2440
acagguaggcgcca

SEQ ID NO: 1639908 - RNA, 15 nt, Pseudomonas putida KT2440
acagguaccaggcug

SEQ ID NO: 1639909 - RNA, 21 nt, Pseudomonas putida KT2440
acaggucucgaacgcugugcc

SEQ ID NO: 1639910 - RNA, 15 nt, Pseudomonas putida KT2440
acagguccagccgcc

SEQ ID NO: 1639911 - RNA, 17 nt, Pseudomonas putida KT2440
acagguucggcucacug

SEQ ID NO: 1639912 - RNA, 15 nt, Pseudomonas putida KT2440
acagguugcgcgccg

SEQ ID NO: 1639913 - RNA, 17 nt, Pseudomonas putida KT2440
acauccugcaaggcaau

SEQ ID NO: 1639914 - RNA, 16 nt, Pseudomonas putida KT2440
acaucggccaccgccg

SEQ ID NO: 1639915 - RNA, 11 nt, Pseudomonas putida KT2440
acaucaucauc

SEQ ID NO: 1639916 - RNA, 21 nt, Pseudomonas putida KT2440
acaucaucaucuucgagguca

SEQ ID NO: 1639917 - RNA, 14 nt, Pseudomonas putida KT2440
acaucaccagcagc

SEQ ID NO: 1639918 - RNA, 16 nt, Pseudomonas putida KT2440
acaucacacagcggca

SEQ ID NO: 1639919 - RNA, 17 nt, Pseudomonas putida KT2440
acauaaggcagcagcuc

SEQ ID NO: 1639920 - RNA, 18 nt, Pseudomonas putida KT2440
acaugcccgcggcucacc

SEQ ID NO: 1639921 - RNA, 15 nt, Pseudomonas putida KT2440
acaugccggccacca

SEQ ID NO: 1639922 - RNA, 18 nt, Pseudomonas putida KT2440
acaugccggccaccacac

SEQ ID NO: 1639923 - RNA, 14 nt, Pseudomonas putida KT2440
acaugccggcccaa

SEQ ID NO: 1639924 - RNA, 17 nt, Pseudomonas putida KT2440
acaugcgagccgcugcc

SEQ ID NO: 1639925 - RNA, 19 nt, Pseudomonas putida KT2440
acaugcgagccgcugccaa

SEQ ID NO: 1639926 - RNA, 20 nt, Pseudomonas putida KT2440
acaucgugaagcaccgccac

SEQ ID NO: 1639927 - RNA, 17 nt, Pseudomonas putida KT2440
acaucuccacugcgcca

SEQ ID NO: 1639928 - RNA, 16 nt, Pseudomonas putida KT2440
acaugaaccacacacu

SEQ ID NO: 1639929 - RNA, 21 nt, Pseudomonas putida KT2440
acauugaagaagcccccggau

SEQ ID NO: 1639930 - RNA, 19 nt, Pseudomonas putida KT2440
accaaagucagccagccgg

SEQ ID NO: 1639931 - RNA, 22 nt, Pseudomonas putida KT2440
accaacaggcucuccauugcgc

SEQ ID NO: 1639932 - RNA, 18 nt, Pseudomonas putida KT2440
acaaccggggcaggcugu

SEQ ID NO: 1639933 - RNA, 19 nt, Pseudomonas putida KT2440
acaacccuaucagggcugc

SEQ ID NO: 1639934 - RNA, 18 nt, Pseudomonas putida KT2440
acaaccgaaaaggccaac

SEQ ID NO: 1639935 - RNA, 13 nt, Pseudomonas putida KT2440
acaaccgacgggu

SEQ ID NO: 1639936 - RNA, 12 nt, Pseudomonas putida KT2440
acaaccccaacc

SEQ ID NO: 1639937 - RNA, 14 nt, Pseudomonas putida KT2440
acaacccccacagg

SEQ ID NO: 1639938 - RNA, 18 nt, Pseudomonas putida KT2440
acaaccaauccccccucc

SEQ ID NO: 1639939 - RNA, 18 nt, Pseudomonas putida KT2440
acaacauggucacauguc

SEQ ID NO: 1639940 - RNA, 13 nt, Pseudomonas putida KT2440
acaacaacaaaaa

SEQ ID NO: 1639941 - RNA, 14 nt, Pseudomonas putida KT2440
acaacaacaaaaaa

SEQ ID NO: 1639942 - RNA, 15 nt, Pseudomonas putida KT2440
acaacaacaaaaaaa

SEQ ID NO: 1639943 - RNA, 16 nt, Pseudomonas putida KT2440
acaacaaggacugccu

SEQ ID NO: 1639944 - RNA, 13 nt, Pseudomonas putida KT2440
acaaauccaggac

SEQ ID NO: 1639945 - RNA, 18 nt, Pseudomonas putida KT2440
acaaaucggcagaauuuc

SEQ ID NO: 1639946 - RNA, 20 nt, Pseudomonas putida KT2440
acaaaucggcagaauuucag

SEQ ID NO: 1639947 - RNA, 20 nt, Pseudomonas putida KT2440
acaaaucggccuugcgcugg

SEQ ID NO: 1639948 - RNA, 18 nt, Pseudomonas putida KT2440
acaaaucuucccgcgucc

SEQ ID NO: 1639949 - RNA, 21 nt, Pseudomonas putida KT2440
acaaaggccggcaccgacagc

SEQ ID NO: 1639950 - RNA, 22 nt, Pseudomonas putida KT2440
acaaaggccggcaccgacagca

SEQ ID NO: 1639951 - RNA, 20 nt, Pseudomonas putida KT2440
acaaaggcgucgcuguucuu

SEQ ID NO: 1639952 - RNA, 15 nt, Pseudomonas putida KT2440
acaaagccccggcag

SEQ ID NO: 1639953 - RNA, 15 nt, Pseudomonas putida KT2440
acaaagcccuugucg

SEQ ID NO: 1639954 - RNA, 18 nt, Pseudomonas putida KT2440
acaaacugcugagucagc

SEQ ID NO: 1639955 - RNA, 12 nt, Pseudomonas putida KT2440
acaaaccacagc

SEQ ID NO: 1639956 - RNA, 15 nt, Pseudomonas putida KT2440
acaaacgccagcaug

SEQ ID NO: 1639957 - RNA, 17 nt, Pseudomonas putida KT2440
acaaacgccagcaugcu

SEQ ID NO: 1639958 - RNA, 17 nt, Pseudomonas putida KT2440
acaaacguaccagccgc

SEQ ID NO: 1639959 - RNA, 17 nt, Pseudomonas putida KT2440
acaaaacccuucucuuc

SEQ ID NO: 1639960 - RNA, 12 nt, Pseudomonas putida KT2440
acaccaccaguu

SEQ ID NO: 1639961 - RNA, 13 nt, Pseudomonas putida KT2440
acaccaccaguuc

SEQ ID NO: 1639962 - RNA, 14 nt, Pseudomonas putida KT2440
acaccacagcugca

SEQ ID NO: 1639963 - RNA, 15 nt, Pseudomonas putida KT2440
acaccacagcugcac

SEQ ID NO: 1639964 - RNA, 23 nt, Pseudomonas putida KT2440
acaccaccgcgaaacacagcagg

SEQ ID NO: 1639965 - RNA, 11 nt, Pseudomonas putida KT2440
acaccacgcca

SEQ ID NO: 1639966 - RNA, 13 nt, Pseudomonas putida KT2440
acacccagcaccc

SEQ ID NO: 1639967 - RNA, 22 nt, Pseudomonas putida KT2440
acaccgcccccaaaccgcugcc

SEQ ID NO: 1639968 - RNA, 21 nt, Pseudomonas putida KT2440
acaccgcguuaugacuggccu

SEQ ID NO: 1639969 - RNA, 18 nt, Pseudomonas putida KT2440
acacccccagguuaucca

SEQ ID NO: 1639970 - RNA, 16 nt, Pseudomonas putida KT2440
acacauuauccaccag

SEQ ID NO: 1639971 - RNA, 17 nt, Pseudomonas putida KT2440
acacauuauccaccagg

SEQ ID NO: 1639972 - RNA, 19 nt, Pseudomonas putida KT2440
acacauuauccaccaggcc

SEQ ID NO: 1639973 - RNA, 17 nt, Pseudomonas putida KT2440
acaccaaagucagccag

SEQ ID NO: 1639974 - RNA, 15 nt, Pseudomonas putida KT2440
acacaaggccgcucc

SEQ ID NO: 1639975 - RNA, 14 nt, Pseudomonas putida KT2440
acacaagccccccu

SEQ ID NO: 1639976 - RNA, 20 nt, Pseudomonas putida KT2440
acacgaauggguggcagcug

SEQ ID NO: 1639977 - RNA, 22 nt, Pseudomonas putida KT2440
acacgaaguugagcaccggcag

SEQ ID NO: 1639978 - RNA, 18 nt, Pseudomonas putida KT2440
acacgacgauggccacca

SEQ ID NO: 1639979 - RNA, 23 nt, Pseudomonas putida KT2440
acacgacgauggccaccagcacc

SEQ ID NO: 1639980 - RNA, 13 nt, Pseudomonas putida KT2440
acacgcuugcgaa

SEQ ID NO: 1639981 - RNA, 15 nt, Pseudomonas putida KT2440
acacgcuuuucaggg

SEQ ID NO: 1639982 - RNA, 21 nt, Pseudomonas putida KT2440
acacggcgaugcgccccccag

SEQ ID NO: 1639983 - RNA, 16 nt, Pseudomonas putida KT2440
acacgcuccagguagu

SEQ ID NO: 1639984 - RNA, 15 nt, Pseudomonas putida KT2440
acaccugccgcagcu

SEQ ID NO: 1639985 - RNA, 21 nt, Pseudomonas putida KT2440
acaccugcgccccgguacgac

SEQ ID NO: 1639986 - RNA, 15 nt, Pseudomonas putida KT2440
acaccugccagcccc

SEQ ID NO: 1639987 - RNA, 16 nt, Pseudomonas putida KT2440
acaccugccagccccg

SEQ ID NO: 1639988 - RNA, 14 nt, Pseudomonas putida KT2440
acacgaaaaagcca

SEQ ID NO: 1639989 - RNA, 16 nt, Pseudomonas putida KT2440
acacgaaaaagccagc

SEQ ID NO: 1639990 - RNA, 16 nt, Pseudomonas putida KT2440
acaccggccuuggcca

SEQ ID NO: 1639991 - RNA, 22 nt, Pseudomonas putida KT2440
acaccgcucaaccuuugcggca

SEQ ID NO: 1639992 - RNA, 22 nt, Pseudomonas putida KT2440
acaacgcagccggcaccgccau

SEQ ID NO: 1639993 - RNA, 13 nt, Pseudomonas putida KT2440
acaagcgcauuga

SEQ ID NO: 1639994 - RNA, 17 nt, Pseudomonas putida KT2440
acaaggucgccaggcgc

SEQ ID NO: 1639995 - RNA, 15 nt, Pseudomonas putida KT2440
acaaggcucagcuga

SEQ ID NO: 1639996 - RNA, 16 nt, Pseudomonas putida KT2440
acaaggcucagcugau

SEQ ID NO: 1639997 - RNA, 18 nt, Pseudomonas putida KT2440
acaaggccaaccacgccu

SEQ ID NO: 1639998 - RNA, 18 nt, Pseudomonas putida KT2440
acaaggccgcucccacag

SEQ ID NO: 1639999 - RNA, 23 nt, Pseudomonas putida KT2440
acaaggccgcucccacagguaau

SEQ ID NO: 1640000 - RNA, 18 nt, Pseudomonas putida KT2440
acaaggcaaaggucugcu

SEQ ID NO: 1640001 - RNA, 23 nt, Pseudomonas putida KT2440
acaagcuggcacgugcaggagag

SEQ ID NO: 1640002 - RNA, 15 nt, Pseudomonas putida KT2440
acaaguucauuacca

SEQ ID NO: 1640003 - RNA, 23 nt, Pseudomonas putida KT2440
acaaguuucaaaaacggugcaga

SEQ ID NO: 1640004 - RNA, 14 nt, Pseudomonas putida KT2440
acaaucgccaggua

SEQ ID NO: 1640005 - RNA, 21 nt, Pseudomonas putida KT2440
aaucgauaccuggguccaggc

SEQ ID NO: 1640006 - RNA, 15 nt, Pseudomonas putida KT2440
aaucgaucugcucgc

SEQ ID NO: 1640007 - RNA, 23 nt, Pseudomonas putida KT2440
aauccuugcccucgcccacucac

SEQ ID NO: 1640008 - RNA, 17 nt, Pseudomonas putida KT2440
aauccgugagccaggag

SEQ ID NO: 1640009 - RNA, 24 nt, Pseudomonas putida KT2440
aauccguuccuucgaccagaacag

SEQ ID NO: 1640010 - RNA, 22 nt, Pseudomonas putida KT2440
aaucgccacacaagccccccug

SEQ ID NO: 1640011 - RNA, 20 nt, Pseudomonas putida KT2440
aaucgucggugaugaucagg

SEQ ID NO: 1640012 - RNA, 13 nt, Pseudomonas putida KT2440
aaucugcagcagc

SEQ ID NO: 1640013 - RNA, 14 nt, Pseudomonas putida KT2440
aaucugcagcagca

SEQ ID NO: 1640014 - RNA, 22 nt, Pseudomonas putida KT2440
aaucugauuugcgcuacagcuu

SEQ ID NO: 1640015 - RNA, 16 nt, Pseudomonas putida KT2440
aaucuuccgcaugcuu

SEQ ID NO: 1640016 - RNA, 14 nt, Pseudomonas putida KT2440
aauaugcucuuucc

SEQ ID NO: 1640017 - RNA, 23 nt, Pseudomonas putida KT2440
aauagcccaccgucaggcucagc

SEQ ID NO: 1640018 - RNA, 18 nt, Pseudomonas putida KT2440
aauagcaucgcuagaaaa

SEQ ID NO: 1640019 - RNA, 17 nt, Pseudomonas putida KT2440
aaucacgaacaccagcc

SEQ ID NO: 1640020 - RNA, 20 nt, Pseudomonas putida KT2440
aaucacgaacaccagcccca

SEQ ID NO: 1640021 - RNA, 13 nt, Pseudomonas putida KT2440
aaucaaagcagac

SEQ ID NO: 1640022 - RNA, 22 nt, Pseudomonas putida KT2440
aauugcccuuaccggaugcgcu

SEQ ID NO: 1640023 - RNA, 14 nt, Pseudomonas putida KT2440
aauuggccagcagg

SEQ ID NO: 1640024 - RNA, 21 nt, Pseudomonas putida KT2440
aauuggccggcaggcccggcc

SEQ ID NO: 1640025 - RNA, 19 nt, Pseudomonas putida KT2440
aauuggccggcgcugagcg

SEQ ID NO: 1640026 - RNA, 20 nt, Pseudomonas putida KT2440
aauuggccggcgcugagcga

SEQ ID NO: 1640027 - RNA, 23 nt, Pseudomonas putida KT2440
aauuggcgagcaggcccgccccu

SEQ ID NO: 1640028 - RNA, 20 nt, Pseudomonas putida KT2440
aauugcccgagcgcuuaaau

SEQ ID NO: 1640029 - RNA, 15 nt, Pseudomonas putida KT2440
aauuggagcggccuu

SEQ ID NO: 1640030 - RNA, 13 nt, Pseudomonas putida KT2440
aauuggagcugaa

SEQ ID NO: 1640031 - RNA, 12 nt, Pseudomonas putida KT2440
aaaacaacaggu

SEQ ID NO: 1640032 - RNA, 11 nt, Pseudomonas putida KT2440
aaaacaacaau

SEQ ID NO: 1640033 - RNA, 16 nt, Pseudomonas putida KT2440
aauuguuguccgugug

SEQ ID NO: 1640034 - RNA, 17 nt, Pseudomonas putida KT2440
aauugucggggaaaugc

SEQ ID NO: 1640035 - RNA, 17 nt, Pseudomonas putida KT2440
aauugguuaaaagccaa

SEQ ID NO: 1640036 - RNA, 20 nt, Pseudomonas putida KT2440
aauucauaaggaucaugaac

SEQ ID NO: 1640037 - RNA, 16 nt, Pseudomonas putida KT2440
aauuccugccggggcg

SEQ ID NO: 1640038 - RNA, 14 nt, Pseudomonas putida KT2440
aauucgaccagcag

SEQ ID NO: 1640039 - RNA, 15 nt, Pseudomonas putida KT2440
aauucucgagcugau

SEQ ID NO: 1640040 - RNA, 17 nt, Pseudomonas putida KT2440
aauguccagauccucuu

SEQ ID NO: 1640041 - RNA, 17 nt, Pseudomonas putida KT2440
aauguggauagucccug

SEQ ID NO: 1640042 - RNA, 16 nt, Pseudomonas putida KT2440
aauguguauccacccc

SEQ ID NO: 1640043 - RNA, 21 nt, Pseudomonas putida KT2440
aauguucaacagccgcggcac

SEQ ID NO: 1640044 - RNA, 15 nt, Pseudomonas putida KT2440
aauguugaagaugac

SEQ ID NO: 1640045 - RNA, 21 nt, Pseudomonas putida KT2440
aaugcacuucugcuaaucgcu

SEQ ID NO: 1640046 - RNA, 12 nt, Pseudomonas putida KT2440
aaugcagaugcg

SEQ ID NO: 1640047 - RNA, 12 nt, Pseudomonas putida KT2440
aaugcacagcgc

SEQ ID NO: 1640048 - RNA, 15 nt, Pseudomonas putida KT2440
aaugcgacugaggca

SEQ ID NO: 1640049 - RNA, 17 nt, Pseudomonas putida KT2440
aaugccuugagcggcuc

SEQ ID NO: 1640050 - RNA, 18 nt, Pseudomonas putida KT2440
aaugcagcaagcuggcac

SEQ ID NO: 1640051 - RNA, 12 nt, Pseudomonas putida KT2440
aaugccagcagu

SEQ ID NO: 1640052 - RNA, 15 nt, Pseudomonas putida KT2440
aaugcgccccggcga

SEQ ID NO: 1640053 - RNA, 11 nt, Pseudomonas putida KT2440
aaugcgcccca

SEQ ID NO: 1640054 - RNA, 17 nt, Pseudomonas putida KT2440
aauggccgaugaacugg

SEQ ID NO: 1640055 - RNA, 16 nt, Pseudomonas putida KT2440
aauggcgagcccggcg

SEQ ID NO: 1640056 - RNA, 16 nt, Pseudomonas putida KT2440
aauggcgcgaacaggg

SEQ ID NO: 1640057 - RNA, 13 nt, Pseudomonas putida KT2440
aaugguugaagau

SEQ ID NO: 1640058 - RNA, 15 nt, Pseudomonas putida KT2440
aauguacaaugcacu

SEQ ID NO: 1640059 - RNA, 17 nt, Pseudomonas putida KT2440
aacagcaccggccaggc

SEQ ID NO: 1640060 - RNA, 17 nt, Pseudomonas putida KT2440
aacagcaguuugcugcg

SEQ ID NO: 1640061 - RNA, 20 nt, Pseudomonas putida KT2440
aacagcaguuugcugcgcug

SEQ ID NO: 1640062 - RNA, 13 nt, Pseudomonas putida KT2440
aacagcagcaccg

SEQ ID NO: 1640063 - RNA, 11 nt, Pseudomonas putida KT2440
aacagcaugau

SEQ ID NO: 1640064 - RNA, 18 nt, Pseudomonas putida KT2440
aacagcauccaaagccaa

SEQ ID NO: 1640065 - RNA, 16 nt, Pseudomonas putida KT2440
aacacuuccgggcuga

SEQ ID NO: 1640066 - RNA, 18 nt, Pseudomonas putida KT2440
aacacuuggcagccucga

SEQ ID NO: 1640067 - RNA, 15 nt, Pseudomonas putida KT2440
aacagaucccgcucc

SEQ ID NO: 1640068 - RNA, 16 nt, Pseudomonas putida KT2440
aacagaucccgcuccu

SEQ ID NO: 1640069 - RNA, 14 nt, Pseudomonas putida KT2440
aacagaggccucaa

SEQ ID NO: 1640070 - RNA, 16 nt, Pseudomonas putida KT2440
aacacuggcaggcuca

SEQ ID NO: 1640071 - RNA, 20 nt, Pseudomonas putida KT2440
aacacgucggcuggcagcuu

SEQ ID NO: 1640072 - RNA, 14 nt, Pseudomonas putida KT2440
aacacccugcacca

SEQ ID NO: 1640073 - RNA, 12 nt, Pseudomonas putida KT2440
aacacccagcgc

SEQ ID NO: 1640074 - RNA, 17 nt, Pseudomonas putida KT2440
aacaccgccagaaaauu

SEQ ID NO: 1640075 - RNA, 16 nt, Pseudomonas putida KT2440
aacacgaaaaagccag

SEQ ID NO: 1640076 - RNA, 16 nt, Pseudomonas putida KT2440
aacacgaacaucagca

SEQ ID NO: 1640077 - RNA, 18 nt, Pseudomonas putida KT2440
aacacgaacaucagcagg

SEQ ID NO: 1640078 - RNA, 21 nt, Pseudomonas putida KT2440
aacaccucuccaauccgcagc

SEQ ID NO: 1640079 - RNA, 17 nt, Pseudomonas putida KT2440
aacaccugccagccccg

SEQ ID NO: 1640080 - RNA, 13 nt, Pseudomonas putida KT2440
aacaccaguguca

SEQ ID NO: 1640081 - RNA, 12 nt, Pseudomonas putida KT2440
aacaccagcagc

SEQ ID NO: 1640082 - RNA, 13 nt, Pseudomonas putida KT2440
aacaccagacuca

SEQ ID NO: 1640083 - RNA, 14 nt, Pseudomonas putida KT2440
aacacauccacauc

SEQ ID NO: 1640084 - RNA, 20 nt, Pseudomonas putida KT2440
aaaaaggggugcaaagcgcc

SEQ ID NO: 1640085 - RNA, 19 nt, Pseudomonas putida KT2440
aacaaucgcgucagcaccg

SEQ ID NO: 1640086 - RNA, 21 nt, Pseudomonas putida KT2440
aacaauaggccggucccaaua

SEQ ID NO: 1640087 - RNA, 19 nt, Pseudomonas putida KT2440
aacaaguccacgaaccugu

SEQ ID NO: 1640088 - RNA, 22 nt, Pseudomonas putida KT2440
aacaaguccacgaaccugugca

SEQ ID NO: 1640089 - RNA, 16 nt, Pseudomonas putida KT2440
aaauucucgagcugau

SEQ ID NO: 1640090 - RNA, 18 nt, Pseudomonas putida KT2440
aaccacugcaaauacccc

SEQ ID NO: 1640091 - RNA, 18 nt, Pseudomonas putida KT2440
aaccacgaccggcucaac

SEQ ID NO: 1640092 - RNA, 21 nt, Pseudomonas putida KT2440
aaccauucaaugcgugggucg

SEQ ID NO: 1640093 - RNA, 14 nt, Pseudomonas putida KT2440
aaccauggaagcuc

SEQ ID NO: 1640094 - RNA, 15 nt, Pseudomonas putida KT2440
aaccauguugaaaau

SEQ ID NO: 1640095 - RNA, 18 nt, Pseudomonas putida KT2440
aacccggccagcagguca

SEQ ID NO: 1640096 - RNA, 22 nt, Pseudomonas putida KT2440
aacccgugcaucugcuccccca

SEQ ID NO: 1640097 - RNA, 19 nt, Pseudomonas putida KT2440
aacccgguucgccacggua

SEQ ID NO: 1640098 - RNA, 13 nt, Pseudomonas putida KT2440
aacccggccgagg

SEQ ID NO: 1640099 - RNA, 21 nt, Pseudomonas putida KT2440
aacccgcuccuacauaggggc

SEQ ID NO: 1640100 - RNA, 22 nt, Pseudomonas putida KT2440
aacccgcuccuacauggaucgc

SEQ ID NO: 1640101 - RNA, 19 nt, Pseudomonas putida KT2440
aacccgcugccacccacag

SEQ ID NO: 1640102 - RNA, 19 nt, Pseudomonas putida KT2440
aacccagguacgaagccau

SEQ ID NO: 1640103 - RNA, 17 nt, Pseudomonas putida KT2440
aacccaccagcacugcu

SEQ ID NO: 1640104 - RNA, 23 nt, Pseudomonas putida KT2440
aaccgccgcgccucgcggugcaa

SEQ ID NO: 1640105 - RNA, 11 nt, Pseudomonas putida KT2440
aaccgcucucg

SEQ ID NO: 1640106 - RNA, 18 nt, Pseudomonas putida KT2440
aacccuucggccagcagu

SEQ ID NO: 1640107 - RNA, 20 nt, Pseudomonas putida KT2440
aacccucggccacaucggca

SEQ ID NO: 1640108 - RNA, 20 nt, Pseudomonas putida KT2440
aacccucacgcgccaggucg

SEQ ID NO: 1640109 - RNA, 20 nt, Pseudomonas putida KT2440
aaccgaaaaggccaaccacc

SEQ ID NO: 1640110 - RNA, 16 nt, Pseudomonas putida KT2440
aaccgaauccagguug

SEQ ID NO: 1640111 - RNA, 15 nt, Pseudomonas putida KT2440
aaccgaacccgcugc

SEQ ID NO: 1640112 - RNA, 19 nt, Pseudomonas putida KT2440
aacagccggcuaucggcca

SEQ ID NO: 1640113 - RNA, 18 nt, Pseudomonas putida KT2440
aacagcgcagccaccagc

SEQ ID NO: 1640114 - RNA, 18 nt, Pseudomonas putida KT2440
aacagcgcccagaucagc

SEQ ID NO: 1640115 - RNA, 19 nt, Pseudomonas putida KT2440
aacagcgcccagaucagca

SEQ ID NO: 1640116 - RNA, 21 nt, Pseudomonas putida KT2440
aacagcgcccagaucagcagc

SEQ ID NO: 1640117 - RNA, 13 nt, Pseudomonas putida KT2440
aacagccgcgcau

SEQ ID NO: 1640118 - RNA, 14 nt, Pseudomonas putida KT2440
aacagccacagcug

SEQ ID NO: 1640119 - RNA, 13 nt, Pseudomonas putida KT2440
aacauacgcauca

SEQ ID NO: 1640120 - RNA, 18 nt, Pseudomonas putida KT2440
aacagcgccacgccugca

SEQ ID NO: 1640121 - RNA, 15 nt, Pseudomonas putida KT2440
aacauucaccagcca

SEQ ID NO: 1640122 - RNA, 19 nt, Pseudomonas putida KT2440
aacauugcuaauuucaggu

SEQ ID NO: 1640123 - RNA, 13 nt, Pseudomonas putida KT2440
aagaaggcaucca

SEQ ID NO: 1640124 - RNA, 17 nt, Pseudomonas putida KT2440
aagaagcuguagucacc

SEQ ID NO: 1640125 - RNA, 18 nt, Pseudomonas putida KT2440
aagaagcuaacccggucu

SEQ ID NO: 1640126 - RNA, 19 nt, Pseudomonas putida KT2440
aagaagucgccacaccaca

SEQ ID NO: 1640127 - RNA, 21 nt, Pseudomonas putida KT2440
aagaagucgccacaccacagc

SEQ ID NO: 1640128 - RNA, 18 nt, Pseudomonas putida KT2440
aagaagguucguccccuu

SEQ ID NO: 1640129 - RNA, 23 nt, Pseudomonas putida KT2440
aagaagcaaccgcugcauggccu

SEQ ID NO: 1640130 - RNA, 17 nt, Pseudomonas putida KT2440
aacuuggguaacacggu

SEQ ID NO: 1640131 - RNA, 15 nt, Pseudomonas putida KT2440
aacuugcgcaucaac

SEQ ID NO: 1640132 - RNA, 15 nt, Pseudomonas putida KT2440
aacuugcgcucaagc

SEQ ID NO: 1640133 - RNA, 12 nt, Pseudomonas putida KT2440
aagaacaucacg

SEQ ID NO: 1640134 - RNA, 13 nt, Pseudomonas putida KT2440
aagaacacggcuu

SEQ ID NO: 1640135 - RNA, 11 nt, Pseudomonas putida KT2440
aagaacaacac

SEQ ID NO: 1640136 - RNA, 17 nt, Pseudomonas putida KT2440
aacuggucaaacaaugc

SEQ ID NO: 1640137 - RNA, 16 nt, Pseudomonas putida KT2440
aacugggcauccagcu

SEQ ID NO: 1640138 - RNA, 21 nt, Pseudomonas putida KT2440
aacuggcugccgcugaccacc

SEQ ID NO: 1640139 - RNA, 17 nt, Pseudomonas putida KT2440
aacuggugaaucagccc

SEQ ID NO: 1640140 - RNA, 21 nt, Pseudomonas putida KT2440
aacuuaauaugcgccccgucc

SEQ ID NO: 1640141 - RNA, 19 nt, Pseudomonas putida KT2440
aacugaugggucuugccgg

SEQ ID NO: 1640142 - RNA, 19 nt, Pseudomonas putida KT2440
aacugaauggcuggugaag

SEQ ID NO: 1640143 - RNA, 19 nt, Pseudomonas putida KT2440
aacuggcccgcgccaggcu

SEQ ID NO: 1640144 - RNA, 20 nt, Pseudomonas putida KT2440
aacuggcgcccggcaucgcu

SEQ ID NO: 1640145 - RNA, 14 nt, Pseudomonas putida KT2440
aacuggaugaucca

SEQ ID NO: 1640146 - RNA, 21 nt, Pseudomonas putida KT2440
aacugcuccaggcagccugcc

SEQ ID NO: 1640147 - RNA, 19 nt, Pseudomonas putida KT2440
aacugcuggaaaaagaaca

SEQ ID NO: 1640148 - RNA, 20 nt, Pseudomonas putida KT2440
aacugcagagccugcaccca

SEQ ID NO: 1640149 - RNA, 20 nt, Pseudomonas putida KT2440
aacugcgcucaaccagccgc

SEQ ID NO: 1640150 - RNA, 16 nt, Pseudomonas putida KT2440
aacugcucuaccaacu

SEQ ID NO: 1640151 - RNA, 15 nt, Pseudomonas putida KT2440
aacguuuccagcaac

SEQ ID NO: 1640152 - RNA, 23 nt, Pseudomonas putida KT2440
aacgugcgggcuuguccgcgaag

SEQ ID NO: 1640153 - RNA, 16 nt, Pseudomonas putida KT2440
aacguggacagcagcu

SEQ ID NO: 1640154 - RNA, 23 nt, Pseudomonas putida KT2440
aacgugaucacuucgccuuccuc

SEQ ID NO: 1640155 - RNA, 16 nt, Pseudomonas putida KT2440
aacuaaaccggugaag

SEQ ID NO: 1640156 - RNA, 21 nt, Pseudomonas putida KT2440
aacgguaacguggacagcagc

SEQ ID NO: 1640157 - RNA, 18 nt, Pseudomonas putida KT2440
aacggugcugccgaggcg

SEQ ID NO: 1640158 - RNA, 16 nt, Pseudomonas putida KT2440
aacgguggccagcagc

SEQ ID NO: 1640159 - RNA, 15 nt, Pseudomonas putida KT2440
aacgccgccagcggc

SEQ ID NO: 1640160 - RNA, 13 nt, Pseudomonas putida KT2440
aacgccgccugcc

SEQ ID NO: 1640161 - RNA, 17 nt, Pseudomonas putida KT2440
aacgccgggcacaucac

SEQ ID NO: 1640162 - RNA, 16 nt, Pseudomonas putida KT2440
aacgccgggucagcuc

SEQ ID NO: 1640163 - RNA, 21 nt, Pseudomonas putida KT2440
aaccgcugcauggccuggcaa

SEQ ID NO: 1640164 - RNA, 17 nt, Pseudomonas putida KT2440
aacgcccgaccuuggcg

SEQ ID NO: 1640165 - RNA, 22 nt, Pseudomonas putida KT2440
aacgcccgcgcagcuuccacca

SEQ ID NO: 1640166 - RNA, 20 nt, Pseudomonas putida KT2440
aacgcccgcgcauagcagaa

SEQ ID NO: 1640167 - RNA, 18 nt, Pseudomonas putida KT2440
aacgccccgacugguucg

SEQ ID NO: 1640168 - RNA, 18 nt, Pseudomonas putida KT2440
aacgcccccagcccggcg

SEQ ID NO: 1640169 - RNA, 19 nt, Pseudomonas putida KT2440
aacgccccccggcuccaca

SEQ ID NO: 1640170 - RNA, 11 nt, Pseudomonas putida KT2440
aacgcccuuca

SEQ ID NO: 1640171 - RNA, 23 nt, Pseudomonas putida KT2440
aacgcccuugucgguggugauca

SEQ ID NO: 1640172 - RNA, 15 nt, Pseudomonas putida KT2440
aacgcaacaaccccg

SEQ ID NO: 1640173 - RNA, 23 nt, Pseudomonas putida KT2440
aacgccacggcggcauccaggcg

SEQ ID NO: 1640174 - RNA, 21 nt, Pseudomonas putida KT2440
aaggagaauccacuugaagac

SEQ ID NO: 1640175 - RNA, 14 nt, Pseudomonas putida KT2440
aagcugcagcagcu

SEQ ID NO: 1640176 - RNA, 20 nt, Pseudomonas putida KT2440
aagcugcgcacauugacguc

SEQ ID NO: 1640177 - RNA, 15 nt, Pseudomonas putida KT2440
aagcuguacagcgca

SEQ ID NO: 1640178 - RNA, 15 nt, Pseudomonas putida KT2440
aagcuaaacgaguuu

SEQ ID NO: 1640179 - RNA, 12 nt, Pseudomonas putida KT2440
aagccgcugcca

SEQ ID NO: 1640180 - RNA, 15 nt, Pseudomonas putida KT2440
aagcggaugagccuu

SEQ ID NO: 1640181 - RNA, 16 nt, Pseudomonas putida KT2440
aagcggauuucgccac

SEQ ID NO: 1640182 - RNA, 15 nt, Pseudomonas putida KT2440
aagcgcugguaaagu

SEQ ID NO: 1640183 - RNA, 22 nt, Pseudomonas putida KT2440
aagcggcacuaccaggcccaac

SEQ ID NO: 1640184 - RNA, 14 nt, Pseudomonas putida KT2440
aagcguaccgccag

SEQ ID NO: 1640185 - RNA, 15 nt, Pseudomonas putida KT2440
aagggugucaacagg

SEQ ID NO: 1640186 - RNA, 17 nt, Pseudomonas putida KT2440
aagggugucaacaggcu

SEQ ID NO: 1640187 - RNA, 18 nt, Pseudomonas putida KT2440
aagggugucaacaggcug

SEQ ID NO: 1640188 - RNA, 12 nt, Pseudomonas putida KT2440
aaggcgucacgc

SEQ ID NO: 1640189 - RNA, 17 nt, Pseudomonas putida KT2440
aaggcgucguacaggcc

SEQ ID NO: 1640190 - RNA, 18 nt, Pseudomonas putida KT2440
aaggcguaccugcccccc

SEQ ID NO: 1640191 - RNA, 20 nt, Pseudomonas putida KT2440
aagggauuggcaacaaugua

SEQ ID NO: 1640192 - RNA, 12 nt, Pseudomonas putida KT2440
aaggccuuggcc

SEQ ID NO: 1640193 - RNA, 13 nt, Pseudomonas putida KT2440
aaggcgaaugaga

SEQ ID NO: 1640194 - RNA, 13 nt, Pseudomonas putida KT2440
aaggccuggccca

SEQ ID NO: 1640195 - RNA, 14 nt, Pseudomonas putida KT2440
aaggcgacuccuga

SEQ ID NO: 1640196 - RNA, 13 nt, Pseudomonas putida KT2440
aaggcgauguuug

SEQ ID NO: 1640197 - RNA, 22 nt, Pseudomonas putida KT2440
aaggucacgcccaucaggaaca

SEQ ID NO: 1640198 - RNA, 18 nt, Pseudomonas putida KT2440
aaggucaaucagggauac

SEQ ID NO: 1640199 - RNA, 23 nt, Pseudomonas putida KT2440
aaggucccguuauggaugccaau

SEQ ID NO: 1640200 - RNA, 21 nt, Pseudomonas putida KT2440
aaggucucuuccugcaccugg

SEQ ID NO: 1640201 - RNA, 19 nt, Pseudomonas putida KT2440
aaggucucuacgcccaugg

SEQ ID NO: 1640202 - RNA, 19 nt, Pseudomonas putida KT2440
aaggugccaacaggcagca

SEQ ID NO: 1640203 - RNA, 22 nt, Pseudomonas putida KT2440
aagguggcaccgccgcccacgc

SEQ ID NO: 1640204 - RNA, 14 nt, Pseudomonas putida KT2440
aagguuuguuggca

SEQ ID NO: 1640205 - RNA, 17 nt, Pseudomonas putida KT2440
aagguuuguuggcaugg

SEQ ID NO: 1640206 - RNA, 19 nt, Pseudomonas putida KT2440
aagguugccaccagcauca

SEQ ID NO: 1640207 - RNA, 12 nt, Pseudomonas putida KT2440
aagccagccucc

SEQ ID NO: 1640208 - RNA, 21 nt, Pseudomonas putida KT2440
aagccacgcucgugcaggcug

SEQ ID NO: 1640209 - RNA, 17 nt, Pseudomonas putida KT2440
aagccaaugguauugcc

SEQ ID NO: 1640210 - RNA, 15 nt, Pseudomonas putida KT2440
aagccaacugcucua

SEQ ID NO: 1640211 - RNA, 17 nt, Pseudomonas putida KT2440
aagcccauaaaccccag

SEQ ID NO: 1640212 - RNA, 12 nt, Pseudomonas putida KT2440
aagcccgcgaag

SEQ ID NO: 1640213 - RNA, 21 nt, Pseudomonas putida KT2440
aagcccgcgaagaggccagca

SEQ ID NO: 1640214 - RNA, 12 nt, Pseudomonas putida KT2440
aagcccgcuccc

SEQ ID NO: 1640215 - RNA, 17 nt, Pseudomonas putida KT2440
aagcccgcuugcugugu

SEQ ID NO: 1640216 - RNA, 16 nt, Pseudomonas putida KT2440
aagccccgccagugca

SEQ ID NO: 1640217 - RNA, 16 nt, Pseudomonas putida KT2440
aagcccauggcuggca

SEQ ID NO: 1640218 - RNA, 16 nt, Pseudomonas putida KT2440
aagcaccgagaugauc

SEQ ID NO: 1640219 - RNA, 18 nt, Pseudomonas putida KT2440
aagcaccgccacaauccg

SEQ ID NO: 1640220 - RNA, 14 nt, Pseudomonas putida KT2440
aagcagaacaucag

SEQ ID NO: 1640221 - RNA, 17 nt, Pseudomonas putida KT2440
aagcagccccaaaagcc

SEQ ID NO: 1640222 - RNA, 20 nt, Pseudomonas putida KT2440
aagcagccccagggcccuca

SEQ ID NO: 1640223 - RNA, 12 nt, Pseudomonas putida KT2440
aagcagacagcu

SEQ ID NO: 1640224 - RNA, 14 nt, Pseudomonas putida KT2440
aagcagcagcuugc

SEQ ID NO: 1640225 - RNA, 14 nt, Pseudomonas putida KT2440
aagauuuucagcca

SEQ ID NO: 1640226 - RNA, 19 nt, Pseudomonas putida KT2440
aagauuuucagccaaauca

SEQ ID NO: 1640227 - RNA, 22 nt, Pseudomonas putida KT2440
aagcaagaccggguccagcaac

SEQ ID NO: 1640228 - RNA, 21 nt, Pseudomonas putida KT2440
aagcaauccacgguauagugg

SEQ ID NO: 1640229 - RNA, 23 nt, Pseudomonas putida KT2440
aagaugacuggccggagcuggag

SEQ ID NO: 1640230 - RNA, 18 nt, Pseudomonas putida KT2440
aagaugguuuccagcucc

SEQ ID NO: 1640231 - RNA, 16 nt, Pseudomonas putida KT2440
aagauguguugucugu

SEQ ID NO: 1640232 - RNA, 17 nt, Pseudomonas putida KT2440
aagaucugcguggcagu

SEQ ID NO: 1640233 - RNA, 22 nt, Pseudomonas putida KT2440
aagaugaccuugucgacaaagu

SEQ ID NO: 1640234 - RNA, 15 nt, Pseudomonas putida KT2440
aauaccgcugcaaca

SEQ ID NO: 1640235 - RNA, 23 nt, Pseudomonas putida KT2440
aauaccggugccccgguccagca

SEQ ID NO: 1640236 - RNA, 14 nt, Pseudomonas putida KT2440
aauacauacaccaa

SEQ ID NO: 1640237 - RNA, 16 nt, Pseudomonas putida KT2440
aauacauacaccaacg

SEQ ID NO: 1640238 - RNA, 18 nt, Pseudomonas putida KT2440
aauacgauauccgcagcc

SEQ ID NO: 1640239 - RNA, 16 nt, Pseudomonas putida KT2440
aauacgcucgaccaga

SEQ ID NO: 1640240 - RNA, 16 nt, Pseudomonas putida KT2440
aauacgguagcggcag

SEQ ID NO: 1640241 - RNA, 20 nt, Pseudomonas putida KT2440
aauaauuguucguaggucag

SEQ ID NO: 1640242 - RNA, 14 nt, Pseudomonas putida KT2440
aauaaucagaauuu

SEQ ID NO: 1640243 - RNA, 18 nt, Pseudomonas putida KT2440
aaguugcccgaaccuugc

SEQ ID NO: 1640244 - RNA, 21 nt, Pseudomonas putida KT2440
aaguuggaaagcuucuagcaa

SEQ ID NO: 1640245 - RNA, 23 nt, Pseudomonas putida KT2440
aagugauaacgcgccgcugccug

SEQ ID NO: 1640246 - RNA, 21 nt, Pseudomonas putida KT2440
aaguggcggcucgcugaacac

SEQ ID NO: 1640247 - RNA, 12 nt, Pseudomonas putida KT2440
aaguggaaggca

SEQ ID NO: 1640248 - RNA, 13 nt, Pseudomonas putida KT2440
aauaaaaacaaca

SEQ ID NO: 1640249 - RNA, 15 nt, Pseudomonas putida KT2440
cggagguagccaccu

SEQ ID NO: 1640250 - RNA, 21 nt, Pseudomonas putida KT2440
cggaggacacaucgaucaggu

SEQ ID NO: 1640251 - RNA, 19 nt, Pseudomonas putida KT2440
cggauagccccgcccagca

SEQ ID NO: 1640252 - RNA, 22 nt, Pseudomonas putida KT2440
cggaucaucggcacgcccagca

SEQ ID NO: 1640253 - RNA, 22 nt, Pseudomonas putida KT2440
cggaucagcgcguccagcaaca

SEQ ID NO: 1640254 - RNA, 21 nt, Pseudomonas putida KT2440
cggaucggugccacccaaggc

SEQ ID NO: 1640255 - RNA, 19 nt, Pseudomonas putida KT2440
cggaucgggcacaacucca

SEQ ID NO: 1640256 - RNA, 17 nt, Pseudomonas putida KT2440
cggaucuuguauuggcc

SEQ ID NO: 1640257 - RNA, 23 nt, Pseudomonas putida KT2440
cggaucuuguauuggccaagaau

SEQ ID NO: 1640258 - RNA, 21 nt, Pseudomonas putida KT2440
cggaugacguccggcugcggg

SEQ ID NO: 1640259 - RNA, 19 nt, Pseudomonas putida KT2440
cggaugccacgcugaacac

SEQ ID NO: 1640260 - RNA, 17 nt, Pseudomonas putida KT2440
cggauggugugcagcaa

SEQ ID NO: 1640261 - RNA, 20 nt, Pseudomonas putida KT2440
cggauggugugcagcaacac

SEQ ID NO: 1640262 - RNA, 17 nt, Pseudomonas putida KT2440
cggauguucuugaccuu

SEQ ID NO: 1640263 - RNA, 18 nt, Pseudomonas putida KT2440
cggauguucuugaccuug

SEQ ID NO: 1640264 - RNA, 18 nt, Pseudomonas putida KT2440
cggcaacccggcagucag

SEQ ID NO: 1640265 - RNA, 23 nt, Pseudomonas putida KT2440
cggcaacccggcagucagggucu

SEQ ID NO: 1640266 - RNA, 13 nt, Pseudomonas putida KT2440
cggcaacaccagc

SEQ ID NO: 1640267 - RNA, 17 nt, Pseudomonas putida KT2440
cggcaaaguccagcauc

SEQ ID NO: 1640268 - RNA, 20 nt, Pseudomonas putida KT2440
cggcaaaggccucuucaggc

SEQ ID NO: 1640269 - RNA, 19 nt, Pseudomonas putida KT2440
cggcaaacaaaaagcaccu

SEQ ID NO: 1640270 - RNA, 12 nt, Pseudomonas putida KT2440
cggcaaacacac

SEQ ID NO: 1640271 - RNA, 13 nt, Pseudomonas putida KT2440
cggcaaacacauc

SEQ ID NO: 1640272 - RNA, 17 nt, Pseudomonas putida KT2440
cggcaaacacauccagc

SEQ ID NO: 1640273 - RNA, 13 nt, Pseudomonas putida KT2440
cggcaagccacgc

SEQ ID NO: 1640274 - RNA, 17 nt, Pseudomonas putida KT2440
cggcaagcccauggcug

SEQ ID NO: 1640275 - RNA, 18 nt, Pseudomonas putida KT2440
cggcaaggcauccagaaa

SEQ ID NO: 1640276 - RNA, 14 nt, Pseudomonas putida KT2440
cggcaaccugaccc

SEQ ID NO: 1640277 - RNA, 23 nt, Pseudomonas putida KT2440
cggcaaccugacccgcgccucga

SEQ ID NO: 1640278 - RNA, 19 nt, Pseudomonas putida KT2440
cggcaaccugcucgcucag

SEQ ID NO: 1640279 - RNA, 18 nt, Pseudomonas putida KT2440
cggcaacuggcacaaccc

SEQ ID NO: 1640280 - RNA, 19 nt, Pseudomonas putida KT2440
cggcaacuggcaucgguca

SEQ ID NO: 1640281 - RNA, 21 nt, Pseudomonas putida KT2440
cggcaagggcgaaccaggugc

SEQ ID NO: 1640282 - RNA, 15 nt, Pseudomonas putida KT2440
cggcaagcuggucag

SEQ ID NO: 1640283 - RNA, 18 nt, Pseudomonas putida KT2440
cggcaagcuggucaggug

SEQ ID NO: 1640284 - RNA, 14 nt, Pseudomonas putida KT2440
cggcaaggcgaccu

SEQ ID NO: 1640285 - RNA, 20 nt, Pseudomonas putida KT2440
cggcaaggcgaccugccagc

SEQ ID NO: 1640286 - RNA, 21 nt, Pseudomonas putida KT2440
cggcaagguagccugcugacg

SEQ ID NO: 1640287 - RNA, 15 nt, Pseudomonas putida KT2440
cggcaaucgccgggc

SEQ ID NO: 1640288 - RNA, 22 nt, Pseudomonas putida KT2440
cggcaaucaccgccagguccag

SEQ ID NO: 1640289 - RNA, 21 nt, Pseudomonas putida KT2440
cggcaaucacgaacaccagcc

SEQ ID NO: 1640290 - RNA, 15 nt, Pseudomonas putida KT2440
cggcaauccugggug

SEQ ID NO: 1640291 - RNA, 16 nt, Pseudomonas putida KT2440
cggcaauccuggguga

SEQ ID NO: 1640292 - RNA, 22 nt, Pseudomonas putida KT2440
cggcaccaccgauucgcgcagg

SEQ ID NO: 1640293 - RNA, 20 nt, Pseudomonas putida KT2440
cggcaccccuuucuccagca

SEQ ID NO: 1640294 - RNA, 22 nt, Pseudomonas putida KT2440
cggcaccccuuucuccagcaac

SEQ ID NO: 1640295 - RNA, 23 nt, Pseudomonas putida KT2440
cggcaauugccaccggcgcugcg

SEQ ID NO: 1640296 - RNA, 23 nt, Pseudomonas putida KT2440
cggcaaugcgcgcgaaggcccgc

SEQ ID NO: 1640297 - RNA, 19 nt, Pseudomonas putida KT2440
cggcaauucgccggcagca

SEQ ID NO: 1640298 - RNA, 22 nt, Pseudomonas putida KT2440
cggcaauucgccggcagcaaac

SEQ ID NO: 1640299 - RNA, 18 nt, Pseudomonas putida KT2440
cggcacaggcuuacaacu

SEQ ID NO: 1640300 - RNA, 14 nt, Pseudomonas putida KT2440
cggcacagcccagc

SEQ ID NO: 1640301 - RNA, 12 nt, Pseudomonas putida KT2440
cggcacagaauc

SEQ ID NO: 1640302 - RNA, 13 nt, Pseudomonas putida KT2440
cggcaccgacagc

SEQ ID NO: 1640303 - RNA, 20 nt, Pseudomonas putida KT2440
cggcaccggcgaacagcaau

SEQ ID NO: 1640304 - RNA, 21 nt, Pseudomonas putida KT2440
cggcaccggcgaacagcaaug

SEQ ID NO: 1640305 - RNA, 14 nt, Pseudomonas putida KT2440
cggcaccugccggg

SEQ ID NO: 1640306 - RNA, 18 nt, Pseudomonas putida KT2440
cggcaccugccgggcauc

SEQ ID NO: 1640307 - RNA, 22 nt, Pseudomonas putida KT2440
cggcacguucacgcaagcgccu

SEQ ID NO: 1640308 - RNA, 15 nt, Pseudomonas putida KT2440
cggacagguuggcgc

SEQ ID NO: 1640309 - RNA, 17 nt, Pseudomonas putida KT2440
cggacagguuggcgccc

SEQ ID NO: 1640310 - RNA, 15 nt, Pseudomonas putida KT2440
cggaccaccugggcc

SEQ ID NO: 1640311 - RNA, 17 nt, Pseudomonas putida KT2440
cggacccugguucucca

SEQ ID NO: 1640312 - RNA, 20 nt, Pseudomonas putida KT2440
cggacccagcggucagcauc

SEQ ID NO: 1640313 - RNA, 16 nt, Pseudomonas putida KT2440
cggaccugccgcagcg

SEQ ID NO: 1640314 - RNA, 19 nt, Pseudomonas putida KT2440
cggaccugccgcagcgauc

SEQ ID NO: 1640315 - RNA, 14 nt, Pseudomonas putida KT2440
cggacgaugaggcc

SEQ ID NO: 1640316 - RNA, 19 nt, Pseudomonas putida KT2440
cggaaugcccgggcgcagg

SEQ ID NO: 1640317 - RNA, 20 nt, Pseudomonas putida KT2440
cggaaugcccgggcgcaggc

SEQ ID NO: 1640318 - RNA, 21 nt, Pseudomonas putida KT2440
cggacaacuuggcaccgaccc

SEQ ID NO: 1640319 - RNA, 18 nt, Pseudomonas putida KT2440
cggacugcaccaggucca

SEQ ID NO: 1640320 - RNA, 17 nt, Pseudomonas putida KT2440
cggagaacgggcugucg

SEQ ID NO: 1640321 - RNA, 14 nt, Pseudomonas putida KT2440
cggacucauagcuc

SEQ ID NO: 1640322 - RNA, 22 nt, Pseudomonas putida KT2440
cggacgcuugccacccaggccc

SEQ ID NO: 1640323 - RNA, 12 nt, Pseudomonas putida KT2440
cggagccagcca

SEQ ID NO: 1640324 - RNA, 16 nt, Pseudomonas putida KT2440
cggagauuggccagca

SEQ ID NO: 1640325 - RNA, 18 nt, Pseudomonas putida KT2440
cggagcgacuucgaccac

SEQ ID NO: 1640326 - RNA, 13 nt, Pseudomonas putida KT2440
cggaacaccccuu

SEQ ID NO: 1640327 - RNA, 14 nt, Pseudomonas putida KT2440
cggaacaggaucag

SEQ ID NO: 1640328 - RNA, 22 nt, Pseudomonas putida KT2440
cggaagaucaccuggucgaccg

SEQ ID NO: 1640329 - RNA, 16 nt, Pseudomonas putida KT2440
cggaacguuuccaggc

SEQ ID NO: 1640330 - RNA, 15 nt, Pseudomonas putida KT2440
cggaacuggcugacc

SEQ ID NO: 1640331 - RNA, 13 nt, Pseudomonas putida KT2440
cggaagcucucca

SEQ ID NO: 1640332 - RNA, 19 nt, Pseudomonas putida KT2440
cggaagcucuccaggguuc

SEQ ID NO: 1640333 - RNA, 19 nt, Pseudomonas putida KT2440
cggaaggucuucagcucac

SEQ ID NO: 1640334 - RNA, 21 nt, Pseudomonas putida KT2440
cggaauaccgauugccucagg

SEQ ID NO: 1640335 - RNA, 17 nt, Pseudomonas putida KT2440
cgcuacagcuuugaggc

SEQ ID NO: 1640336 - RNA, 13 nt, Pseudomonas putida KT2440
cgcuuuccugguu

SEQ ID NO: 1640337 - RNA, 20 nt, Pseudomonas putida KT2440
cgcuuuccugguuauccagg

SEQ ID NO: 1640338 - RNA, 20 nt, Pseudomonas putida KT2440
cgcuuucgccgaucagcugg

SEQ ID NO: 1640339 - RNA, 16 nt, Pseudomonas putida KT2440
cgcuuuggcagcagcc

SEQ ID NO: 1640340 - RNA, 19 nt, Pseudomonas putida KT2440
cgcuuugcacccgcgcgcu

SEQ ID NO: 1640341 - RNA, 16 nt, Pseudomonas putida KT2440
cggaaaaggccggcca

SEQ ID NO: 1640342 - RNA, 17 nt, Pseudomonas putida KT2440
cgcuuugcgccccuuuc

SEQ ID NO: 1640343 - RNA, 14 nt, Pseudomonas putida KT2440
cgcuuuugcuugca

SEQ ID NO: 1640344 - RNA, 17 nt, Pseudomonas putida KT2440
cgcuuuguuugcuggca

SEQ ID NO: 1640345 - RNA, 19 nt, Pseudomonas putida KT2440
cggcgccgccaggcagcag

SEQ ID NO: 1640346 - RNA, 14 nt, Pseudomonas putida KT2440
cggcgacgcggugc

SEQ ID NO: 1640347 - RNA, 19 nt, Pseudomonas putida KT2440
cggcgccaugccccccgcc

SEQ ID NO: 1640348 - RNA, 22 nt, Pseudomonas putida KT2440
cggcgccaugccccccgccagc

SEQ ID NO: 1640349 - RNA, 14 nt, Pseudomonas putida KT2440
cggcgccaggccuu

SEQ ID NO: 1640350 - RNA, 19 nt, Pseudomonas putida KT2440
cggcgccaggccuuucagc

SEQ ID NO: 1640351 - RNA, 15 nt, Pseudomonas putida KT2440
cggcgccagcagugc

SEQ ID NO: 1640352 - RNA, 14 nt, Pseudomonas putida KT2440
cggccgcucaccgg

SEQ ID NO: 1640353 - RNA, 14 nt, Pseudomonas putida KT2440
cggccgcuccagcu

SEQ ID NO: 1640354 - RNA, 15 nt, Pseudomonas putida KT2440
cggccggccagaccu

SEQ ID NO: 1640355 - RNA, 20 nt, Pseudomonas putida KT2440
cggccggcggauagccccgc

SEQ ID NO: 1640356 - RNA, 20 nt, Pseudomonas putida KT2440
cggcccugcuggccaaucuc

SEQ ID NO: 1640357 - RNA, 23 nt, Pseudomonas putida KT2440
cggcccugccggccucaauucca

SEQ ID NO: 1640358 - RNA, 15 nt, Pseudomonas putida KT2440
cggcccuucgcgggc

SEQ ID NO: 1640359 - RNA, 15 nt, Pseudomonas putida KT2440
cggcccugugccggg

SEQ ID NO: 1640360 - RNA, 18 nt, Pseudomonas putida KT2440
cggcccugaaggccgcuc

SEQ ID NO: 1640361 - RNA, 18 nt, Pseudomonas putida KT2440
cggcccugagccuuguca

SEQ ID NO: 1640362 - RNA, 14 nt, Pseudomonas putida KT2440
cggcccugaucccg

SEQ ID NO: 1640363 - RNA, 19 nt, Pseudomonas putida KT2440
cggccgaggccggguuuuu

SEQ ID NO: 1640364 - RNA, 20 nt, Pseudomonas putida KT2440
cggcccuuucgcgggugaac

SEQ ID NO: 1640365 - RNA, 20 nt, Pseudomonas putida KT2440
cggccuuuucauccggcgca

SEQ ID NO: 1640366 - RNA, 22 nt, Pseudomonas putida KT2440
cggccuugucgcgaaaggggcg

SEQ ID NO: 1640367 - RNA, 18 nt, Pseudomonas putida KT2440
cggccuuguucaacacug

SEQ ID NO: 1640368 - RNA, 17 nt, Pseudomonas putida KT2440
cggccuuugaagcuguu

SEQ ID NO: 1640369 - RNA, 19 nt, Pseudomonas putida KT2440
cggccuugucagcagcuuc

SEQ ID NO: 1640370 - RNA, 17 nt, Pseudomonas putida KT2440
cggccuuggcgcggcgg

SEQ ID NO: 1640371 - RNA, 18 nt, Pseudomonas putida KT2440
cggccuugaccacuucga

SEQ ID NO: 1640372 - RNA, 18 nt, Pseudomonas putida KT2440
cggccuugccgcuggcga

SEQ ID NO: 1640373 - RNA, 20 nt, Pseudomonas putida KT2440
cggccuguggguaacccugc

SEQ ID NO: 1640374 - RNA, 15 nt, Pseudomonas putida KT2440
cggccuucccgccug

SEQ ID NO: 1640375 - RNA, 21 nt, Pseudomonas putida KT2440
cggccuucguaguaauggccg

SEQ ID NO: 1640376 - RNA, 16 nt, Pseudomonas putida KT2440
cggccucagccggcuu

SEQ ID NO: 1640377 - RNA, 22 nt, Pseudomonas putida KT2440
cggccuaguucggcaccuuucu

SEQ ID NO: 1640378 - RNA, 21 nt, Pseudomonas putida KT2440
cggccggucguuacccaccag

SEQ ID NO: 1640379 - RNA, 21 nt, Pseudomonas putida KT2440
cggccggggccaggcgcggcu

SEQ ID NO: 1640380 - RNA, 21 nt, Pseudomonas putida KT2440
cggccugggucagcugguucu

SEQ ID NO: 1640381 - RNA, 17 nt, Pseudomonas putida KT2440
cggccuggggcaggccc

SEQ ID NO: 1640382 - RNA, 23 nt, Pseudomonas putida KT2440
cggccuggggcaggcccggcagg

SEQ ID NO: 1640383 - RNA, 16 nt, Pseudomonas putida KT2440
cggccuggccugcaug

SEQ ID NO: 1640384 - RNA, 16 nt, Pseudomonas putida KT2440
cggccagcgcgcugag

SEQ ID NO: 1640385 - RNA, 18 nt, Pseudomonas putida KT2440
cggccagcgccugcaggc

SEQ ID NO: 1640386 - RNA, 19 nt, Pseudomonas putida KT2440
cggccagcgccugcaggcc

SEQ ID NO: 1640387 - RNA, 18 nt, Pseudomonas putida KT2440
cggcccaaggcaccaacu

SEQ ID NO: 1640388 - RNA, 12 nt, Pseudomonas putida KT2440
cggccaggucac

SEQ ID NO: 1640389 - RNA, 23 nt, Pseudomonas putida KT2440
cggccaguaccaggucgccagca

SEQ ID NO: 1640390 - RNA, 17 nt, Pseudomonas putida KT2440
cggccaguaccuuggcg

SEQ ID NO: 1640391 - RNA, 17 nt, Pseudomonas putida KT2440
cggccccggccccaggg

SEQ ID NO: 1640392 - RNA, 21 nt, Pseudomonas putida KT2440
cggcccagccagucgcgcaac

SEQ ID NO: 1640393 - RNA, 12 nt, Pseudomonas putida KT2440
cggcccacugca

SEQ ID NO: 1640394 - RNA, 22 nt, Pseudomonas putida KT2440
cggccccuggaaccccauccac

SEQ ID NO: 1640395 - RNA, 15 nt, Pseudomonas putida KT2440
cggccacgaaggccg

SEQ ID NO: 1640396 - RNA, 16 nt, Pseudomonas putida KT2440
cggccaccuggccuuc

SEQ ID NO: 1640397 - RNA, 20 nt, Pseudomonas putida KT2440
cggccaccuggccuuccagc

SEQ ID NO: 1640398 - RNA, 19 nt, Pseudomonas putida KT2440
cggccaccacuucuggcug

SEQ ID NO: 1640399 - RNA, 14 nt, Pseudomonas putida KT2440
cggccaccgccucg

SEQ ID NO: 1640400 - RNA, 18 nt, Pseudomonas putida KT2440
cggccacagcgccaacgc

SEQ ID NO: 1640401 - RNA, 21 nt, Pseudomonas putida KT2440
cggccacgguguauccagccc

SEQ ID NO: 1640402 - RNA, 12 nt, Pseudomonas putida KT2440
cggccacgcccu

SEQ ID NO: 1640403 - RNA, 17 nt, Pseudomonas putida KT2440
cggcagauccugcagcc

SEQ ID NO: 1640404 - RNA, 23 nt, Pseudomonas putida KT2440
cggcagauccugcagccgcaccu

SEQ ID NO: 1640405 - RNA, 17 nt, Pseudomonas putida KT2440
cggcagcaaacccgaca

SEQ ID NO: 1640406 - RNA, 14 nt, Pseudomonas putida KT2440
cggcagcaaggcau

SEQ ID NO: 1640407 - RNA, 16 nt, Pseudomonas putida KT2440
cggcacuaccaggccc

SEQ ID NO: 1640408 - RNA, 19 nt, Pseudomonas putida KT2440
cggcagcagcagccccagc

SEQ ID NO: 1640409 - RNA, 19 nt, Pseudomonas putida KT2440
cggcagcaaucgccgccug

SEQ ID NO: 1640410 - RNA, 15 nt, Pseudomonas putida KT2440
cggcagcaccugcca

SEQ ID NO: 1640411 - RNA, 17 nt, Pseudomonas putida KT2440
cggcagcaccugccagc

SEQ ID NO: 1640412 - RNA, 18 nt, Pseudomonas putida KT2440
cggcagcaccugccagcc

SEQ ID NO: 1640413 - RNA, 20 nt, Pseudomonas putida KT2440
cggcagcaccugccagccgc

SEQ ID NO: 1640414 - RNA, 13 nt, Pseudomonas putida KT2440
cggcagcaucuuc

SEQ ID NO: 1640415 - RNA, 15 nt, Pseudomonas putida KT2440
cggcagcaugaacag

SEQ ID NO: 1640416 - RNA, 20 nt, Pseudomonas putida KT2440
cggcagcaugaacagcgcug

SEQ ID NO: 1640417 - RNA, 14 nt, Pseudomonas putida KT2440
cggcagcaggccaa

SEQ ID NO: 1640418 - RNA, 15 nt, Pseudomonas putida KT2440
cggccacacgggcgu

SEQ ID NO: 1640419 - RNA, 11 nt, Pseudomonas putida KT2440
cgagguuuugc

SEQ ID NO: 1640420 - RNA, 20 nt, Pseudomonas putida KT2440
cgagguggauagcagcucaa

SEQ ID NO: 1640421 - RNA, 19 nt, Pseudomonas putida KT2440
cgagguggucgaggcaaag

SEQ ID NO: 1640422 - RNA, 20 nt, Pseudomonas putida KT2440
cgagguggucgaggcaaaga

SEQ ID NO: 1640423 - RNA, 19 nt, Pseudomonas putida KT2440
cgaggguuccaggccacgg

SEQ ID NO: 1640424 - RNA, 20 nt, Pseudomonas putida KT2440
cgagguagcugucggucagc

SEQ ID NO: 1640425 - RNA, 23 nt, Pseudomonas putida KT2440
cgaggucaucgaagaucagcuca

SEQ ID NO: 1640426 - RNA, 15 nt, Pseudomonas putida KT2440
cgaggucagcaccag

SEQ ID NO: 1640427 - RNA, 23 nt, Pseudomonas putida KT2440
cgaggucagcaccagcucaucca

SEQ ID NO: 1640428 - RNA, 14 nt, Pseudomonas putida KT2440
cgaggucagcagug

SEQ ID NO: 1640429 - RNA, 18 nt, Pseudomonas putida KT2440
cgagucgacagugaccga

SEQ ID NO: 1640430 - RNA, 22 nt, Pseudomonas putida KT2440
cgaguguuucaaaaaaaagggc

SEQ ID NO: 1640431 - RNA, 11 nt, Pseudomonas putida KT2440
cgaguccccua

SEQ ID NO: 1640432 - RNA, 19 nt, Pseudomonas putida KT2440
cgaguagaucaucagcgcc

SEQ ID NO: 1640433 - RNA, 21 nt, Pseudomonas putida KT2440
cgaguagaucaucagcgccag

SEQ ID NO: 1640434 - RNA, 22 nt, Pseudomonas putida KT2440
cgagucaggcugcacaaggugc

SEQ ID NO: 1640435 - RNA, 17 nt, Pseudomonas putida KT2440
cgaguccugccuuccac

SEQ ID NO: 1640436 - RNA, 15 nt, Pseudomonas putida KT2440
cgaguauccuccagc

SEQ ID NO: 1640437 - RNA, 16 nt, Pseudomonas putida KT2440
cgaguauccuccagcc

SEQ ID NO: 1640438 - RNA, 20 nt, Pseudomonas putida KT2440
cgaguaccgucggcacgagc

SEQ ID NO: 1640439 - RNA, 14 nt, Pseudomonas putida KT2440
cgaguaaagccagc

SEQ ID NO: 1640440 - RNA, 13 nt, Pseudomonas putida KT2440
cgaguuuccggca

SEQ ID NO: 1640441 - RNA, 20 nt, Pseudomonas putida KT2440
cgaguuuaccuccaucacca

SEQ ID NO: 1640442 - RNA, 13 nt, Pseudomonas putida KT2440
cgaguuuggccag

SEQ ID NO: 1640443 - RNA, 15 nt, Pseudomonas putida KT2440
cgaguuuggccagcc

SEQ ID NO: 1640444 - RNA, 16 nt, Pseudomonas putida KT2440
cgauagcgucagcagg

SEQ ID NO: 1640445 - RNA, 20 nt, Pseudomonas putida KT2440
cgauaucggcgcggcccagu

SEQ ID NO: 1640446 - RNA, 19 nt, Pseudomonas putida KT2440
cgauaaccgaauccagguu

SEQ ID NO: 1640447 - RNA, 15 nt, Pseudomonas putida KT2440
cgagcugggcacggc

SEQ ID NO: 1640448 - RNA, 21 nt, Pseudomonas putida KT2440
cgagcuuggcguccacagcca

SEQ ID NO: 1640449 - RNA, 19 nt, Pseudomonas putida KT2440
cgagcuuuguagcucccuc

SEQ ID NO: 1640450 - RNA, 23 nt, Pseudomonas putida KT2440
cgagcgucucgccaaacugcugg

SEQ ID NO: 1640451 - RNA, 14 nt, Pseudomonas putida KT2440
cgagcgcuuaaauc

SEQ ID NO: 1640452 - RNA, 14 nt, Pseudomonas putida KT2440
cgagcgcggcgccc

SEQ ID NO: 1640453 - RNA, 16 nt, Pseudomonas putida KT2440
cgagcgguucagcgca

SEQ ID NO: 1640454 - RNA, 17 nt, Pseudomonas putida KT2440
cgagcgguugcacggcc

SEQ ID NO: 1640455 - RNA, 18 nt, Pseudomonas putida KT2440
cgagcgccgugcucggcc

SEQ ID NO: 1640456 - RNA, 16 nt, Pseudomonas putida KT2440
cgaggcauccacaccc

SEQ ID NO: 1640457 - RNA, 17 nt, Pseudomonas putida KT2440
cgaggcauccacacccu

SEQ ID NO: 1640458 - RNA, 18 nt, Pseudomonas putida KT2440
cgaggaaguacgccggcg

SEQ ID NO: 1640459 - RNA, 13 nt, Pseudomonas putida KT2440
cgaggaaagggca

SEQ ID NO: 1640460 - RNA, 15 nt, Pseudomonas putida KT2440
cgaggacagcaucuc

SEQ ID NO: 1640461 - RNA, 19 nt, Pseudomonas putida KT2440
cgaggacaacaaggacugc

SEQ ID NO: 1640462 - RNA, 15 nt, Pseudomonas putida KT2440
cgaggcgccgacgau

SEQ ID NO: 1640463 - RNA, 20 nt, Pseudomonas putida KT2440
cgaggcggcugucgcagaag

SEQ ID NO: 1640464 - RNA, 22 nt, Pseudomonas putida KT2440
cgaggcgacgaucaucgcgccg

SEQ ID NO: 1640465 - RNA, 12 nt, Pseudomonas putida KT2440
cgaggccgggca

SEQ ID NO: 1640466 - RNA, 16 nt, Pseudomonas putida KT2440
cgaggccgggcagagu

SEQ ID NO: 1640467 - RNA, 17 nt, Pseudomonas putida KT2440
cgaggccgggcagaguc

SEQ ID NO: 1640468 - RNA, 15 nt, Pseudomonas putida KT2440
cgaggccgcgacgau

SEQ ID NO: 1640469 - RNA, 15 nt, Pseudomonas putida KT2440
cgaggccccagacca

SEQ ID NO: 1640470 - RNA, 11 nt, Pseudomonas putida KT2440
cgagggcauca

SEQ ID NO: 1640471 - RNA, 17 nt, Pseudomonas putida KT2440
cgagggcaucagcgcac

SEQ ID NO: 1640472 - RNA, 16 nt, Pseudomonas putida KT2440
cgaauacgcucgacca

SEQ ID NO: 1640473 - RNA, 20 nt, Pseudomonas putida KT2440
cgaauacgagggugaaccca

SEQ ID NO: 1640474 - RNA, 22 nt, Pseudomonas putida KT2440
cgaauacgauauccgcagcccc

SEQ ID NO: 1640475 - RNA, 15 nt, Pseudomonas putida KT2440
cgacucccgcugccu

SEQ ID NO: 1640476 - RNA, 19 nt, Pseudomonas putida KT2440
cgacucccgcugccuuccg

SEQ ID NO: 1640477 - RNA, 16 nt, Pseudomonas putida KT2440
cgacucgucaauaccg

SEQ ID NO: 1640478 - RNA, 19 nt, Pseudomonas putida KT2440
cgacucgguacgcacugua

SEQ ID NO: 1640479 - RNA, 19 nt, Pseudomonas putida KT2440
cgacucuacugcccgcagc

SEQ ID NO: 1640480 - RNA, 18 nt, Pseudomonas putida KT2440
cgacugcacugccagcgc

SEQ ID NO: 1640481 - RNA, 22 nt, Pseudomonas putida KT2440
cgacugaacaccugccagcccc

SEQ ID NO: 1640482 - RNA, 17 nt, Pseudomonas putida KT2440
cgacuggcgcaccagcg

SEQ ID NO: 1640483 - RNA, 14 nt, Pseudomonas putida KT2440
cgacuggcuggccu

SEQ ID NO: 1640484 - RNA, 12 nt, Pseudomonas putida KT2440
cgagaacaggcg

SEQ ID NO: 1640485 - RNA, 20 nt, Pseudomonas putida KT2440
cgagaaauggcaguguggca

SEQ ID NO: 1640486 - RNA, 20 nt, Pseudomonas putida KT2440
cgacuuugaugccaacuucc

SEQ ID NO: 1640487 - RNA, 23 nt, Pseudomonas putida KT2440
cgacuugugcauccugcacugca

SEQ ID NO: 1640488 - RNA, 14 nt, Pseudomonas putida KT2440
cgacuucaucaccu

SEQ ID NO: 1640489 - RNA, 15 nt, Pseudomonas putida KT2440
cgacuucaucaccuc

SEQ ID NO: 1640490 - RNA, 23 nt, Pseudomonas putida KT2440
cgagagcggcuucuaccgcacuu

SEQ ID NO: 1640491 - RNA, 13 nt, Pseudomonas putida KT2440
cgagagccgggca

SEQ ID NO: 1640492 - RNA, 18 nt, Pseudomonas putida KT2440
cgagaaggcguggugcag

SEQ ID NO: 1640493 - RNA, 12 nt, Pseudomonas putida KT2440
cgagaaugaaac

SEQ ID NO: 1640494 - RNA, 14 nt, Pseudomonas putida KT2440
cgagcaagcucgcu

SEQ ID NO: 1640495 - RNA, 23 nt, Pseudomonas putida KT2440
cgagaucagguggaucaggguca

SEQ ID NO: 1640496 - RNA, 22 nt, Pseudomonas putida KT2440
cgagcaucugcugcggcaggcu

SEQ ID NO: 1640497 - RNA, 15 nt, Pseudomonas putida KT2440
cgagcaucuuccagc

SEQ ID NO: 1640498 - RNA, 22 nt, Pseudomonas putida KT2440
cgagcaucuuccagccugcagc

SEQ ID NO: 1640499 - RNA, 23 nt, Pseudomonas putida KT2440
cgagcaucuuccagccugcagca

SEQ ID NO: 1640500 - RNA, 15 nt, Pseudomonas putida KT2440
cgagccaaccgcuuc

SEQ ID NO: 1640501 - RNA, 17 nt, Pseudomonas putida KT2440
cgagcauccgcgccacu

SEQ ID NO: 1640502 - RNA, 17 nt, Pseudomonas putida KT2440
cgagccacucggcaauc

SEQ ID NO: 1640503 - RNA, 16 nt, Pseudomonas putida KT2440
cgagcccgccagcagg

SEQ ID NO: 1640504 - RNA, 18 nt, Pseudomonas putida KT2440
cgagcccgccagcaggcc

SEQ ID NO: 1640505 - RNA, 14 nt, Pseudomonas putida KT2440
cgagcccgcgcgcg

SEQ ID NO: 1640506 - RNA, 16 nt, Pseudomonas putida KT2440
cgagccgaucaggaag

SEQ ID NO: 1640507 - RNA, 18 nt, Pseudomonas putida KT2440
cgagccgaucaggaagcc

SEQ ID NO: 1640508 - RNA, 17 nt, Pseudomonas putida KT2440
cgagcccuuguccaggu

SEQ ID NO: 1640509 - RNA, 24 nt, Pseudomonas putida KT2440
cgagccgccagacuucauaggcug

SEQ ID NO: 1640510 - RNA, 15 nt, Pseudomonas putida KT2440
cgagcgccgcccggg

SEQ ID NO: 1640511 - RNA, 12 nt, Pseudomonas putida KT2440
cgagcgccgcgc

SEQ ID NO: 1640512 - RNA, 20 nt, Pseudomonas putida KT2440
cgagcgccgcgcgggcggcg

SEQ ID NO: 1640513 - RNA, 20 nt, Pseudomonas putida KT2440
aaacgcggaucgugacgguc

SEQ ID NO: 1640514 - RNA, 23 nt, Pseudomonas putida KT2440
aaacgcgauacccaauaaaaaca

SEQ ID NO: 1640515 - RNA, 12 nt, Pseudomonas putida KT2440
cgccaccgccgu

SEQ ID NO: 1640516 - RNA, 22 nt, Pseudomonas putida KT2440
cgccaccgacuccggcaaggca

SEQ ID NO: 1640517 - RNA, 19 nt, Pseudomonas putida KT2440
cgccaccgaucucgccagc

SEQ ID NO: 1640518 - RNA, 12 nt, Pseudomonas putida KT2440
cgccaccggcau

SEQ ID NO: 1640519 - RNA, 17 nt, Pseudomonas putida KT2440
cgccaccgcgcgccagu

SEQ ID NO: 1640520 - RNA, 14 nt, Pseudomonas putida KT2440
cgccaccaccgcug

SEQ ID NO: 1640521 - RNA, 14 nt, Pseudomonas putida KT2440
cgccaccacgaugc

SEQ ID NO: 1640522 - RNA, 21 nt, Pseudomonas putida KT2440
cgccaccacgaugccugggcg

SEQ ID NO: 1640523 - RNA, 12 nt, Pseudomonas putida KT2440
cgccaccaagcc

SEQ ID NO: 1640524 - RNA, 17 nt, Pseudomonas putida KT2440
cgccaccaagcccuucu

SEQ ID NO: 1640525 - RNA, 15 nt, Pseudomonas putida KT2440
cgccacaccacagcu

SEQ ID NO: 1640526 - RNA, 19 nt, Pseudomonas putida KT2440
cgccacauagcuggcacug

SEQ ID NO: 1640527 - RNA, 13 nt, Pseudomonas putida KT2440
cgccacauccagc

SEQ ID NO: 1640528 - RNA, 14 nt, Pseudomonas putida KT2440
cgccacauccagcg

SEQ ID NO: 1640529 - RNA, 17 nt, Pseudomonas putida KT2440
cgccacauccagcgccu

SEQ ID NO: 1640530 - RNA, 15 nt, Pseudomonas putida KT2440
cgccacacugucccg

SEQ ID NO: 1640531 - RNA, 17 nt, Pseudomonas putida KT2440
cgccacacugucccggc

SEQ ID NO: 1640532 - RNA, 21 nt, Pseudomonas putida KT2440
cgccacacugucccggcacaa

SEQ ID NO: 1640533 - RNA, 12 nt, Pseudomonas putida KT2440
cgccacaaacgc

SEQ ID NO: 1640534 - RNA, 18 nt, Pseudomonas putida KT2440
cgccacaacccuugcagc

SEQ ID NO: 1640535 - RNA, 19 nt, Pseudomonas putida KT2440
cgccaauugcgccagccgc

SEQ ID NO: 1640536 - RNA, 18 nt, Pseudomonas putida KT2440
cgccaagauccgcggcau

SEQ ID NO: 1640537 - RNA, 21 nt, Pseudomonas putida KT2440
cgccaagggucgacaccagga

SEQ ID NO: 1640538 - RNA, 16 nt, Pseudomonas putida KT2440
cgccaaccccaacccg

SEQ ID NO: 1640539 - RNA, 19 nt, Pseudomonas putida KT2440
cgccaacagcacccgccca

SEQ ID NO: 1640540 - RNA, 20 nt, Pseudomonas putida KT2440
cgccaacagcacccgcccau

SEQ ID NO: 1640541 - RNA, 19 nt, Pseudomonas putida KT2440
cgccaacuguuucugcucu

SEQ ID NO: 1640542 - RNA, 23 nt, Pseudomonas putida KT2440
cgccaacuguuucugcucuucug

SEQ ID NO: 1640543 - RNA, 17 nt, Pseudomonas putida KT2440
cgccaacgaaucagcca

SEQ ID NO: 1640544 - RNA, 18 nt, Pseudomonas putida KT2440
cgccaacgcccccgccac

SEQ ID NO: 1640545 - RNA, 23 nt, Pseudomonas putida KT2440
cgccaaaaccuguuccagccccu

SEQ ID NO: 1640546 - RNA, 21 nt, Pseudomonas putida KT2440
cgccaaaaggcccgaaacugc

SEQ ID NO: 1640547 - RNA, 14 nt, Pseudomonas putida KT2440
cgccaaaccccagc

SEQ ID NO: 1640548 - RNA, 22 nt, Pseudomonas putida KT2440
cgccaaaccccagcaaggcaau

SEQ ID NO: 1640549 - RNA, 18 nt, Pseudomonas putida KT2440
cgccaaacgccagggccg

SEQ ID NO: 1640550 - RNA, 15 nt, Pseudomonas putida KT2440
cgcauuuucaucaaa

SEQ ID NO: 1640551 - RNA, 20 nt, Pseudomonas putida KT2440
cgcauuucguccaggcucag

SEQ ID NO: 1640552 - RNA, 21 nt, Pseudomonas putida KT2440
cgcauuucguccaggcucagc

SEQ ID NO: 1640553 - RNA, 20 nt, Pseudomonas putida KT2440
cgcauugaucaugcccaugg

SEQ ID NO: 1640554 - RNA, 15 nt, Pseudomonas putida KT2440
cgcauugcaggccag

SEQ ID NO: 1640555 - RNA, 14 nt, Pseudomonas putida KT2440
cgcaugcuuggcga

SEQ ID NO: 1640556 - RNA, 19 nt, Pseudomonas putida KT2440
cgcauggcguuguccagca

SEQ ID NO: 1640557 - RNA, 23 nt, Pseudomonas putida KT2440
cgcauggcguuguccagcagguu

SEQ ID NO: 1640558 - RNA, 14 nt, Pseudomonas putida KT2440
cgcaugguccuggu

SEQ ID NO: 1640559 - RNA, 14 nt, Pseudomonas putida KT2440
cgcauguccuuggc

SEQ ID NO: 1640560 - RNA, 16 nt, Pseudomonas putida KT2440
cgcauguccuuggccc

SEQ ID NO: 1640561 - RNA, 21 nt, Pseudomonas putida KT2440
cgcaucaacgccucgcugccu

SEQ ID NO: 1640562 - RNA, 22 nt, Pseudomonas putida KT2440
cgcaggcuuucggccacccgga

SEQ ID NO: 1640563 - RNA, 16 nt, Pseudomonas putida KT2440
cgcagggccucguuga

SEQ ID NO: 1640564 - RNA, 22 nt, Pseudomonas putida KT2440
cgcagggcccccgauuccaagg

SEQ ID NO: 1640565 - RNA, 17 nt, Pseudomonas putida KT2440
cgcaucaggcugcgccc

SEQ ID NO: 1640566 - RNA, 14 nt, Pseudomonas putida KT2440
cgcaucauccacca

SEQ ID NO: 1640567 - RNA, 21 nt, Pseudomonas putida KT2440
cgcaucagcgcagcaucuucc

SEQ ID NO: 1640568 - RNA, 14 nt, Pseudomonas putida KT2440
cgcauccacaggcg

SEQ ID NO: 1640569 - RNA, 17 nt, Pseudomonas putida KT2440
cgcauccacaggcgccc

SEQ ID NO: 1640570 - RNA, 21 nt, Pseudomonas putida KT2440
cgcauccacaggcgccccggc

SEQ ID NO: 1640571 - RNA, 22 nt, Pseudomonas putida KT2440
cgcaugaugaaguggcgcaggc

SEQ ID NO: 1640572 - RNA, 19 nt, Pseudomonas putida KT2440
cgcaucuuuccggagaugu

SEQ ID NO: 1640573 - RNA, 15 nt, Pseudomonas putida KT2440
cgcaucggccacuuc

SEQ ID NO: 1640574 - RNA, 15 nt, Pseudomonas putida KT2440
cgcaucguccuugca

SEQ ID NO: 1640575 - RNA, 20 nt, Pseudomonas putida KT2440
cgcaucguuauccagcaccc

SEQ ID NO: 1640576 - RNA, 20 nt, Pseudomonas putida KT2440
cgcagcguaauagcugguga

SEQ ID NO: 1640577 - RNA, 13 nt, Pseudomonas putida KT2440
cgcagauggcaga

SEQ ID NO: 1640578 - RNA, 14 nt, Pseudomonas putida KT2440
cgcagcuccacugg

SEQ ID NO: 1640579 - RNA, 21 nt, Pseudomonas putida KT2440
cgcagaauauugaacaggcuc

SEQ ID NO: 1640580 - RNA, 16 nt, Pseudomonas putida KT2440
cgcagaucguuguagg

SEQ ID NO: 1640581 - RNA, 13 nt, Pseudomonas putida KT2440
cgcaggcagcucg

SEQ ID NO: 1640582 - RNA, 22 nt, Pseudomonas putida KT2440
cgcaggcagcucgauguacaac

SEQ ID NO: 1640583 - RNA, 13 nt, Pseudomonas putida KT2440
cgcaggcacgccc

SEQ ID NO: 1640584 - RNA, 15 nt, Pseudomonas putida KT2440
cgcaggcccagcagg

SEQ ID NO: 1640585 - RNA, 15 nt, Pseudomonas putida KT2440
cgcaggccgcuggcc

SEQ ID NO: 1640586 - RNA, 13 nt, Pseudomonas putida KT2440
cgcaggccgccgg

SEQ ID NO: 1640587 - RNA, 18 nt, Pseudomonas putida KT2440
cgcaggcgcugcagggcg

SEQ ID NO: 1640588 - RNA, 14 nt, Pseudomonas putida KT2440
cgcaggccgccggg

SEQ ID NO: 1640589 - RNA, 20 nt, Pseudomonas putida KT2440
cgcaggcgcaacucgcgccc

SEQ ID NO: 1640590 - RNA, 12 nt, Pseudomonas putida KT2440
cgcaggcgcccc

SEQ ID NO: 1640591 - RNA, 15 nt, Pseudomonas putida KT2440
cgcaggcggcugacc

SEQ ID NO: 1640592 - RNA, 16 nt, Pseudomonas putida KT2440
cgcaggcgguucaaau

SEQ ID NO: 1640593 - RNA, 21 nt, Pseudomonas putida KT2440
cgcaggcugucgaacaggcug

SEQ ID NO: 1640594 - RNA, 19 nt, Pseudomonas putida KT2440
cgcaggcucaucuaccagc

SEQ ID NO: 1640595 - RNA, 16 nt, Pseudomonas putida KT2440
cgcaggcuccaaagcc

SEQ ID NO: 1640596 - RNA, 13 nt, Pseudomonas putida KT2440
cgcaacgcggccc

SEQ ID NO: 1640597 - RNA, 16 nt, Pseudomonas putida KT2440
cgcaacgcccgcgcau

SEQ ID NO: 1640598 - RNA, 14 nt, Pseudomonas putida KT2440
cgcaacaccgccau

SEQ ID NO: 1640599 - RNA, 22 nt, Pseudomonas putida KT2440
cgcaacaugaagccaugggcag

SEQ ID NO: 1640600 - RNA, 14 nt, Pseudomonas putida KT2440
cgcaacacauuauc

SEQ ID NO: 1640601 - RNA, 22 nt, Pseudomonas putida KT2440
cgcaacacauuauccaccaggc

SEQ ID NO: 1640602 - RNA, 16 nt, Pseudomonas putida KT2440
cgcaacaccaggacaa

SEQ ID NO: 1640603 - RNA, 16 nt, Pseudomonas putida KT2440
cgcaaauccccaacca

SEQ ID NO: 1640604 - RNA, 15 nt, Pseudomonas putida KT2440
cgcaaagcccugccu

SEQ ID NO: 1640605 - RNA, 15 nt, Pseudomonas putida KT2440
cgcaaagcggcccca

SEQ ID NO: 1640606 - RNA, 17 nt, Pseudomonas putida KT2440
cgcaaagcggccccagc

SEQ ID NO: 1640607 - RNA, 20 nt, Pseudomonas putida KT2440
cgcaaagcggccccaguggc

SEQ ID NO: 1640608 - RNA, 17 nt, Pseudomonas putida KT2440
cgcaaagcggccccuuc

SEQ ID NO: 1640609 - RNA, 14 nt, Pseudomonas putida KT2440
cgcaacugcggccc

SEQ ID NO: 1640610 - RNA, 15 nt, Pseudomonas putida KT2440
cgcaacgugcgccga

SEQ ID NO: 1640611 - RNA, 23 nt, Pseudomonas putida KT2440
cgcaacucuaccucacugacagc

SEQ ID NO: 1640612 - RNA, 19 nt, Pseudomonas putida KT2440
cgcaacucagcgcagcuuc

SEQ ID NO: 1640613 - RNA, 19 nt, Pseudomonas putida KT2440
cgcacagcaucacccgcga

SEQ ID NO: 1640614 - RNA, 17 nt, Pseudomonas putida KT2440
cgcacagcugccggcca

SEQ ID NO: 1640615 - RNA, 20 nt, Pseudomonas putida KT2440
cgcacaggcgcagcagcuug

SEQ ID NO: 1640616 - RNA, 19 nt, Pseudomonas putida KT2440
cgcacaggcuggccaccau

SEQ ID NO: 1640617 - RNA, 22 nt, Pseudomonas putida KT2440
cgcacaucguccgccgcgcuga

SEQ ID NO: 1640618 - RNA, 16 nt, Pseudomonas putida KT2440
cgcacaugaagccgcg

SEQ ID NO: 1640619 - RNA, 17 nt, Pseudomonas putida KT2440
cgcacaugaagccgcgc

SEQ ID NO: 1640620 - RNA, 18 nt, Pseudomonas putida KT2440
cgcacaugaagccgcgca

SEQ ID NO: 1640621 - RNA, 13 nt, Pseudomonas putida KT2440
cgcacaccgcugg

SEQ ID NO: 1640622 - RNA, 13 nt, Pseudomonas putida KT2440
cgcaccagcucca

SEQ ID NO: 1640623 - RNA, 15 nt, Pseudomonas putida KT2440
cgcaccuccuuggcc

SEQ ID NO: 1640624 - RNA, 21 nt, Pseudomonas putida KT2440
cgcaccucgaccgcacccgcg

SEQ ID NO: 1640625 - RNA, 22 nt, Pseudomonas putida KT2440
cgcaccaacuggucggccuugc

SEQ ID NO: 1640626 - RNA, 21 nt, Pseudomonas putida KT2440
cgcacagugguguacagcaac

SEQ ID NO: 1640627 - RNA, 14 nt, Pseudomonas putida KT2440
cgcacaucacggcg

SEQ ID NO: 1640628 - RNA, 22 nt, Pseudomonas putida KT2440
cgcaccacguccggccagcaac

SEQ ID NO: 1640629 - RNA, 18 nt, Pseudomonas putida KT2440
cgcacgauccccggccgg

SEQ ID NO: 1640630 - RNA, 20 nt, Pseudomonas putida KT2440
cgcacucaguuaaucagcaa

SEQ ID NO: 1640631 - RNA, 20 nt, Pseudomonas putida KT2440
cgcacuccccaucagcagcu

SEQ ID NO: 1640632 - RNA, 14 nt, Pseudomonas putida KT2440
cgcacucggcaauc

SEQ ID NO: 1640633 - RNA, 15 nt, Pseudomonas putida KT2440
cgcacucucccgcag

SEQ ID NO: 1640634 - RNA, 19 nt, Pseudomonas putida KT2440
cgcacuugaucuugcgccc

SEQ ID NO: 1640635 - RNA, 15 nt, Pseudomonas putida KT2440
cgcacuugcacuuug

SEQ ID NO: 1640636 - RNA, 18 nt, Pseudomonas putida KT2440
cgcacuugccagccgccc

SEQ ID NO: 1640637 - RNA, 12 nt, Pseudomonas putida KT2440
cgcacuuggccu

SEQ ID NO: 1640638 - RNA, 18 nt, Pseudomonas putida KT2440
cgcacuuggccugcugau

SEQ ID NO: 1640639 - RNA, 22 nt, Pseudomonas putida KT2440
cgauguccucggcguucagcuc

SEQ ID NO: 1640640 - RNA, 22 nt, Pseudomonas putida KT2440
cgauggucacccgcgaccacag

SEQ ID NO: 1640641 - RNA, 23 nt, Pseudomonas putida KT2440
cgauggggcugcauugcagcccc

SEQ ID NO: 1640642 - RNA, 21 nt, Pseudomonas putida KT2440
cgaugggcuguuccagcagcg

SEQ ID NO: 1640643 - RNA, 13 nt, Pseudomonas putida KT2440
cgaugcugugccg

SEQ ID NO: 1640644 - RNA, 17 nt, Pseudomonas putida KT2440
cgaugcgccccccaggc

SEQ ID NO: 1640645 - RNA, 19 nt, Pseudomonas putida KT2440
cgaugaguugucugccgaa

SEQ ID NO: 1640646 - RNA, 21 nt, Pseudomonas putida KT2440
cgauaugcccgucaucgaucc

SEQ ID NO: 1640647 - RNA, 21 nt, Pseudomonas putida KT2440
cgauaugccgccguucaggcg

SEQ ID NO: 1640648 - RNA, 23 nt, Pseudomonas putida KT2440
cgauaugcggggucgcuaccacg

SEQ ID NO: 1640649 - RNA, 15 nt, Pseudomonas putida KT2440
cgaugaucgccgccg

SEQ ID NO: 1640650 - RNA, 14 nt, Pseudomonas putida KT2440
cgaugaugcgugcc

SEQ ID NO: 1640651 - RNA, 16 nt, Pseudomonas putida KT2440
cgcaaaaccaccagcc

SEQ ID NO: 1640652 - RNA, 18 nt, Pseudomonas putida KT2440
cgcaaaaaaugugcgcau

SEQ ID NO: 1640653 - RNA, 22 nt, Pseudomonas putida KT2440
cgcaaaccaaacgcccgcgcag

SEQ ID NO: 1640654 - RNA, 23 nt, Pseudomonas putida KT2440
cgaugucugccgcuucguccagg

SEQ ID NO: 1640655 - RNA, 17 nt, Pseudomonas putida KT2440
cgaugucuuccagacca

SEQ ID NO: 1640656 - RNA, 18 nt, Pseudomonas putida KT2440
cgaugucuuccagaccag

SEQ ID NO: 1640657 - RNA, 14 nt, Pseudomonas putida KT2440
cgaugugcgagccc

SEQ ID NO: 1640658 - RNA, 16 nt, Pseudomonas putida KT2440
cgaugugcgugaacac

SEQ ID NO: 1640659 - RNA, 18 nt, Pseudomonas putida KT2440
cgauucugccagcuccug

SEQ ID NO: 1640660 - RNA, 21 nt, Pseudomonas putida KT2440
cgauucugccagcuccuggcu

SEQ ID NO: 1640661 - RNA, 14 nt, Pseudomonas putida KT2440
cgauugcugccgac

SEQ ID NO: 1640662 - RNA, 17 nt, Pseudomonas putida KT2440
cgauugcgauccgcccc

SEQ ID NO: 1640663 - RNA, 21 nt, Pseudomonas putida KT2440
cgccgcgcggcuugcucgcgg

SEQ ID NO: 1640664 - RNA, 18 nt, Pseudomonas putida KT2440
cgccgcgcgggcggcgcu

SEQ ID NO: 1640665 - RNA, 17 nt, Pseudomonas putida KT2440
cgccgccuggcucaccu

SEQ ID NO: 1640666 - RNA, 13 nt, Pseudomonas putida KT2440
cgccgccuccacc

SEQ ID NO: 1640667 - RNA, 15 nt, Pseudomonas putida KT2440
cgccgcccgcgcggc

SEQ ID NO: 1640668 - RNA, 20 nt, Pseudomonas putida KT2440
cgccgccccacucgcgcagc

SEQ ID NO: 1640669 - RNA, 16 nt, Pseudomonas putida KT2440
cgccgcucugcccgcg

SEQ ID NO: 1640670 - RNA, 19 nt, Pseudomonas putida KT2440
cgccgcucugcccgcgcca

SEQ ID NO: 1640671 - RNA, 21 nt, Pseudomonas putida KT2440
cgccgcuucggcaugcacggc

SEQ ID NO: 1640672 - RNA, 17 nt, Pseudomonas putida KT2440
cgccgcuguucagcccu

SEQ ID NO: 1640673 - RNA, 18 nt, Pseudomonas putida KT2440
cgccgcgcuguggcgccc

SEQ ID NO: 1640674 - RNA, 14 nt, Pseudomonas putida KT2440
cgccgucaccagcg

SEQ ID NO: 1640675 - RNA, 19 nt, Pseudomonas putida KT2440
cgccgguuucucgcagcag

SEQ ID NO: 1640676 - RNA, 16 nt, Pseudomonas putida KT2440
cgccgguauucgcgag

SEQ ID NO: 1640677 - RNA, 17 nt, Pseudomonas putida KT2440
cgccgguagcggcuggg

SEQ ID NO: 1640678 - RNA, 14 nt, Pseudomonas putida KT2440
cgccgguagcugcg

SEQ ID NO: 1640679 - RNA, 22 nt, Pseudomonas putida KT2440
cgccgggcacaucaccagcagc

SEQ ID NO: 1640680 - RNA, 19 nt, Pseudomonas putida KT2440
cgccgggacagcaccaugc

SEQ ID NO: 1640681 - RNA, 21 nt, Pseudomonas putida KT2440
cgccggccauugccgcgccgc

SEQ ID NO: 1640682 - RNA, 22 nt, Pseudomonas putida KT2440
cgccggcgaaaugauccccggc

SEQ ID NO: 1640683 - RNA, 18 nt, Pseudomonas putida KT2440
cgccggccaaggucagca

SEQ ID NO: 1640684 - RNA, 16 nt, Pseudomonas putida KT2440
cgccggcacgcccgcu

SEQ ID NO: 1640685 - RNA, 17 nt, Pseudomonas putida KT2440
cgccggcaacuggcauc

SEQ ID NO: 1640686 - RNA, 19 nt, Pseudomonas putida KT2440
cgcccuggcaugcugaugc

SEQ ID NO: 1640687 - RNA, 16 nt, Pseudomonas putida KT2440
cgcccuggcccgccgc

SEQ ID NO: 1640688 - RNA, 15 nt, Pseudomonas putida KT2440
cgcccucgcggcggc

SEQ ID NO: 1640689 - RNA, 13 nt, Pseudomonas putida KT2440
cgcccucuugcug

SEQ ID NO: 1640690 - RNA, 21 nt, Pseudomonas putida KT2440
cgcccggcuugcccgggcgcg

SEQ ID NO: 1640691 - RNA, 17 nt, Pseudomonas putida KT2440
cgcccgggaucuggccg

SEQ ID NO: 1640692 - RNA, 18 nt, Pseudomonas putida KT2440
cgcccgggaucuggccga

SEQ ID NO: 1640693 - RNA, 23 nt, Pseudomonas putida KT2440
cgcccgguuccaauacauacacc

SEQ ID NO: 1640694 - RNA, 18 nt, Pseudomonas putida KT2440
cgcccgguggcgcggccg

SEQ ID NO: 1640695 - RNA, 23 nt, Pseudomonas putida KT2440
cgcccgguggcgcggccgggcuu

SEQ ID NO: 1640696 - RNA, 15 nt, Pseudomonas putida KT2440
cgcccuccgcguccu

SEQ ID NO: 1640697 - RNA, 16 nt, Pseudomonas putida KT2440
cgcccuccgcguccuc

SEQ ID NO: 1640698 - RNA, 17 nt, Pseudomonas putida KT2440
cgccgagugcgcggaac

SEQ ID NO: 1640699 - RNA, 15 nt, Pseudomonas putida KT2440
cgccgagcugaugcc

SEQ ID NO: 1640700 - RNA, 22 nt, Pseudomonas putida KT2440
cgccgagcgcggcgcccagcaa

SEQ ID NO: 1640701 - RNA, 16 nt, Pseudomonas putida KT2440
cgccgagcauccgcgc

SEQ ID NO: 1640702 - RNA, 20 nt, Pseudomonas putida KT2440
cgccgccaaaaaauccgccu

SEQ ID NO: 1640703 - RNA, 21 nt, Pseudomonas putida KT2440
cgccgcauccagcacugccug

SEQ ID NO: 1640704 - RNA, 19 nt, Pseudomonas putida KT2440
cgccgccaaccccuccagc

SEQ ID NO: 1640705 - RNA, 14 nt, Pseudomonas putida KT2440
cgccgccaccagcg

SEQ ID NO: 1640706 - RNA, 14 nt, Pseudomonas putida KT2440
cgccgccaccaucg

SEQ ID NO: 1640707 - RNA, 14 nt, Pseudomonas putida KT2440
cgccgccccccagu

SEQ ID NO: 1640708 - RNA, 12 nt, Pseudomonas putida KT2440
cgccgcccaggu

SEQ ID NO: 1640709 - RNA, 17 nt, Pseudomonas putida KT2440
cgcccagcagcaacgca

SEQ ID NO: 1640710 - RNA, 15 nt, Pseudomonas putida KT2440
cgcccacccaccaca

SEQ ID NO: 1640711 - RNA, 23 nt, Pseudomonas putida KT2440
cgccauguaccgggcggccaccg

SEQ ID NO: 1640712 - RNA, 15 nt, Pseudomonas putida KT2440
cgccaugcagcccgc

SEQ ID NO: 1640713 - RNA, 14 nt, Pseudomonas putida KT2440
cgccaugcaacugc

SEQ ID NO: 1640714 - RNA, 15 nt, Pseudomonas putida KT2440
cgccaugagcaauac

SEQ ID NO: 1640715 - RNA, 15 nt, Pseudomonas putida KT2440
cgccacgccgccaga

SEQ ID NO: 1640716 - RNA, 20 nt, Pseudomonas putida KT2440
cgccacggcggcauccaggc

SEQ ID NO: 1640717 - RNA, 22 nt, Pseudomonas putida KT2440
cgcccagucaccguucuugauc

SEQ ID NO: 1640718 - RNA, 13 nt, Pseudomonas putida KT2440
cgcccagugccug

SEQ ID NO: 1640719 - RNA, 14 nt, Pseudomonas putida KT2440
cgcccagugccuga

SEQ ID NO: 1640720 - RNA, 14 nt, Pseudomonas putida KT2440
cgcccaggcggcgu

SEQ ID NO: 1640721 - RNA, 21 nt, Pseudomonas putida KT2440
cgcccagggguuuccuuuggg

SEQ ID NO: 1640722 - RNA, 18 nt, Pseudomonas putida KT2440
cgcccaggucaugaucuu

SEQ ID NO: 1640723 - RNA, 12 nt, Pseudomonas putida KT2440
cgccccacgccc

SEQ ID NO: 1640724 - RNA, 14 nt, Pseudomonas putida KT2440
cgccccgccgcauc

SEQ ID NO: 1640725 - RNA, 15 nt, Pseudomonas putida KT2440
cgcccgaccgccagc

SEQ ID NO: 1640726 - RNA, 22 nt, Pseudomonas putida KT2440
cgcccgccaugcaacugcauga

SEQ ID NO: 1640727 - RNA, 20 nt, Pseudomonas putida KT2440
cgcccgcccaccaccagccc

SEQ ID NO: 1640728 - RNA, 17 nt, Pseudomonas putida KT2440
cgcccgccggcacuucc

SEQ ID NO: 1640729 - RNA, 13 nt, Pseudomonas putida KT2440
cgcccgcccgcuu

SEQ ID NO: 1640730 - RNA, 14 nt, Pseudomonas putida KT2440
cgcccgcaacagau

SEQ ID NO: 1640731 - RNA, 12 nt, Pseudomonas putida KT2440
cgcggcaaagau

SEQ ID NO: 1640732 - RNA, 20 nt, Pseudomonas putida KT2440
cgcggcaaagaucgcccagc

SEQ ID NO: 1640733 - RNA, 19 nt, Pseudomonas putida KT2440
cgcgcuuggcaccggcagc

SEQ ID NO: 1640734 - RNA, 20 nt, Pseudomonas putida KT2440
cgcgcuuggcaccggcagca

SEQ ID NO: 1640735 - RNA, 21 nt, Pseudomonas putida KT2440
cgcgcuugcgguccugcacca

SEQ ID NO: 1640736 - RNA, 15 nt, Pseudomonas putida KT2440
cgcgcuuggcggccc

SEQ ID NO: 1640737 - RNA, 17 nt, Pseudomonas putida KT2440
cgcggccaacauucacg

SEQ ID NO: 1640738 - RNA, 14 nt, Pseudomonas putida KT2440
cgcggcaccggcuu

SEQ ID NO: 1640739 - RNA, 18 nt, Pseudomonas putida KT2440
cgcggcagcaugaacagc

SEQ ID NO: 1640740 - RNA, 16 nt, Pseudomonas putida KT2440
cgcggcagcccuucgc

SEQ ID NO: 1640741 - RNA, 24 nt, Pseudomonas putida KT2440
cgcggcagcccuucgcgggcacgc

SEQ ID NO: 1640742 - RNA, 16 nt, Pseudomonas putida KT2440
cgcggcaauccgcugg

SEQ ID NO: 1640743 - RNA, 17 nt, Pseudomonas putida KT2440
cgcggcaugcccgcccc

SEQ ID NO: 1640744 - RNA, 21 nt, Pseudomonas putida KT2440
cgcggcaugcccgccccugcc

SEQ ID NO: 1640745 - RNA, 24 nt, Pseudomonas putida KT2440
cgcgggcggcgcucgaucucacag

SEQ ID NO: 1640746 - RNA, 17 nt, Pseudomonas putida KT2440
cgcgggcaaacccgcgc

SEQ ID NO: 1640747 - RNA, 16 nt, Pseudomonas putida KT2440
cgcgggcaagcccgca

SEQ ID NO: 1640748 - RNA, 13 nt, Pseudomonas putida KT2440
cgcgggcucgccc

SEQ ID NO: 1640749 - RNA, 14 nt, Pseudomonas putida KT2440
cgcgggcucgcccg

SEQ ID NO: 1640750 - RNA, 12 nt, Pseudomonas putida KT2440
cgcgggcgugcc

SEQ ID NO: 1640751 - RNA, 13 nt, Pseudomonas putida KT2440
cgcgggcgugccc

SEQ ID NO: 1640752 - RNA, 22 nt, Pseudomonas putida KT2440
cgcgggcgucgcgaucacgcag

SEQ ID NO: 1640753 - RNA, 20 nt, Pseudomonas putida KT2440
cgcggcuucgaugcccggca

SEQ ID NO: 1640754 - RNA, 22 nt, Pseudomonas putida KT2440
cgcggcuucgaugcccggcagg

SEQ ID NO: 1640755 - RNA, 23 nt, Pseudomonas putida KT2440
cgcggggugaucgccucgugcag

SEQ ID NO: 1640756 - RNA, 16 nt, Pseudomonas putida KT2440
cgcggguaaacccgcg

SEQ ID NO: 1640757 - RNA, 16 nt, Pseudomonas putida KT2440
cgcggguaagcccgcu

SEQ ID NO: 1640758 - RNA, 13 nt, Pseudomonas putida KT2440
cgcgggucagggg

SEQ ID NO: 1640759 - RNA, 18 nt, Pseudomonas putida KT2440
cgcggguccgauccggug

SEQ ID NO: 1640760 - RNA, 23 nt, Pseudomonas putida KT2440
cgcggguccagcgcggccacgcc

SEQ ID NO: 1640761 - RNA, 17 nt, Pseudomonas putida KT2440
cgcgggugaacccgcuc

SEQ ID NO: 1640762 - RNA, 16 nt, Pseudomonas putida KT2440
cgcgggugaaccgcgc

SEQ ID NO: 1640763 - RNA, 15 nt, Pseudomonas putida KT2440
cgcggcgaacacagc

SEQ ID NO: 1640764 - RNA, 17 nt, Pseudomonas putida KT2440
cgcggccugugcccaac

SEQ ID NO: 1640765 - RNA, 22 nt, Pseudomonas putida KT2440
cgcgucgacaaaccgcacccgg

SEQ ID NO: 1640766 - RNA, 20 nt, Pseudomonas putida KT2440
cgcguccuggacccgcagca

SEQ ID NO: 1640767 - RNA, 21 nt, Pseudomonas putida KT2440
cgcgucugcuucuucgcgggc

SEQ ID NO: 1640768 - RNA, 15 nt, Pseudomonas putida KT2440
cgcgucugccgcagc

SEQ ID NO: 1640769 - RNA, 16 nt, Pseudomonas putida KT2440
cgcgugguaaagcucg

SEQ ID NO: 1640770 - RNA, 16 nt, Pseudomonas putida KT2440
cgcguuacccaccaga

SEQ ID NO: 1640771 - RNA, 14 nt, Pseudomonas putida KT2440
cgcguacucggcca

SEQ ID NO: 1640772 - RNA, 17 nt, Pseudomonas putida KT2440
cgcguaccccuggcgcu

SEQ ID NO: 1640773 - RNA, 17 nt, Pseudomonas putida KT2440
cgcguacagcugcucac

SEQ ID NO: 1640774 - RNA, 21 nt, Pseudomonas putida KT2440
cgcguauccuugcccaccagg

SEQ ID NO: 1640775 - RNA, 15 nt, Pseudomonas putida KT2440
cgcguaucaggcauc

SEQ ID NO: 1640776 - RNA, 14 nt, Pseudomonas putida KT2440
cgcguauugcuccc

SEQ ID NO: 1640777 - RNA, 16 nt, Pseudomonas putida KT2440
cgcggucgaugcagga

SEQ ID NO: 1640778 - RNA, 18 nt, Pseudomonas putida KT2440
cgcgguauccaucaccau

SEQ ID NO: 1640779 - RNA, 17 nt, Pseudomonas putida KT2440
cgcggucaagcucgucc

SEQ ID NO: 1640780 - RNA, 21 nt, Pseudomonas putida KT2440
cgcggucaauuggagcggccu

SEQ ID NO: 1640781 - RNA, 22 nt, Pseudomonas putida KT2440
cgcgguaaugcgcacggcuucg

SEQ ID NO: 1640782 - RNA, 18 nt, Pseudomonas putida KT2440
cgcgguaagcaccacccc

SEQ ID NO: 1640783 - RNA, 18 nt, Pseudomonas putida KT2440
cgcgguaaugaccuggau

SEQ ID NO: 1640784 - RNA, 16 nt, Pseudomonas putida KT2440
cgcggguuugcccgcg

SEQ ID NO: 1640785 - RNA, 23 nt, Pseudomonas putida KT2440
cgcggguuugcccgcgaagaggu

SEQ ID NO: 1640786 - RNA, 17 nt, Pseudomonas putida KT2440
cgcggguuuacccgcga

SEQ ID NO: 1640787 - RNA, 17 nt, Pseudomonas putida KT2440
cgcggugaccagcggca

SEQ ID NO: 1640788 - RNA, 21 nt, Pseudomonas putida KT2440
cgcggugaccagcggcagcaa

SEQ ID NO: 1640789 - RNA, 14 nt, Pseudomonas putida KT2440
cgcggugaggcaac

SEQ ID NO: 1640790 - RNA, 16 nt, Pseudomonas putida KT2440
cgcggugaggcaacgg

SEQ ID NO: 1640791 - RNA, 13 nt, Pseudomonas putida KT2440
cgcggugcugacc

SEQ ID NO: 1640792 - RNA, 13 nt, Pseudomonas putida KT2440
cgcgguggcuggc

SEQ ID NO: 1640793 - RNA, 13 nt, Pseudomonas putida KT2440
cgcggugauggcg

SEQ ID NO: 1640794 - RNA, 21 nt, Pseudomonas putida KT2440
cgcgguucuucgccugcagca

SEQ ID NO: 1640795 - RNA, 23 nt, Pseudomonas putida KT2440
cgcgaucgcuuguaggagcgggu

SEQ ID NO: 1640796 - RNA, 13 nt, Pseudomonas putida KT2440
cgcgaugcgccgc

SEQ ID NO: 1640797 - RNA, 17 nt, Pseudomonas putida KT2440
cgcgaugccgacagcca

SEQ ID NO: 1640798 - RNA, 21 nt, Pseudomonas putida KT2440
cgcgaugccgacagccaccgc

SEQ ID NO: 1640799 - RNA, 18 nt, Pseudomonas putida KT2440
cgcgcaacacuucaggcu

SEQ ID NO: 1640800 - RNA, 21 nt, Pseudomonas putida KT2440
cgcgcaacacuucaggcugcg

SEQ ID NO: 1640801 - RNA, 20 nt, Pseudomonas putida KT2440
cgcgaugggcugcaaagcag

SEQ ID NO: 1640802 - RNA, 19 nt, Pseudomonas putida KT2440
cgcgauugaucagcgccuc

SEQ ID NO: 1640803 - RNA, 15 nt, Pseudomonas putida KT2440
cgcgcacgcaucugc

SEQ ID NO: 1640804 - RNA, 21 nt, Pseudomonas putida KT2440
cgcgcacuugccagccgccca

SEQ ID NO: 1640805 - RNA, 23 nt, Pseudomonas putida KT2440
cgcgcacugaauacaccagcuug

SEQ ID NO: 1640806 - RNA, 16 nt, Pseudomonas putida KT2440
cgcgcagacgggcgac

SEQ ID NO: 1640807 - RNA, 17 nt, Pseudomonas putida KT2440
cgcgcagacgggcgacg

SEQ ID NO: 1640808 - RNA, 23 nt, Pseudomonas putida KT2440
cgcgcaggguuuucagcgccgca

SEQ ID NO: 1640809 - RNA, 17 nt, Pseudomonas putida KT2440
cgcgcauuugcuccagg

SEQ ID NO: 1640810 - RNA, 17 nt, Pseudomonas putida KT2440
cgcgcaggcggcugacc

SEQ ID NO: 1640811 - RNA, 13 nt, Pseudomonas putida KT2440
cgcgcccaggccc

SEQ ID NO: 1640812 - RNA, 19 nt, Pseudomonas putida KT2440
cgcgcccagugcgcgcaac

SEQ ID NO: 1640813 - RNA, 19 nt, Pseudomonas putida KT2440
cgcgccauuggccgcgcgc

SEQ ID NO: 1640814 - RNA, 21 nt, Pseudomonas putida KT2440
cgcgccauuggccgcgcgccc

SEQ ID NO: 1640815 - RNA, 22 nt, Pseudomonas putida KT2440
cgcgcagggugccggccagcgg

SEQ ID NO: 1640816 - RNA, 18 nt, Pseudomonas putida KT2440
cgcgccaaccgcgccagc

SEQ ID NO: 1640817 - RNA, 13 nt, Pseudomonas putida KT2440
cgcgcccccgacc

SEQ ID NO: 1640818 - RNA, 14 nt, Pseudomonas putida KT2440
cgcgcccggcgcau

SEQ ID NO: 1640819 - RNA, 15 nt, Pseudomonas putida KT2440
cgcgccgccgacgau

SEQ ID NO: 1640820 - RNA, 15 nt, Pseudomonas putida KT2440
cgcgccgccaggcgg

SEQ ID NO: 1640821 - RNA, 13 nt, Pseudomonas putida KT2440
cgcgccgcccagc

SEQ ID NO: 1640822 - RNA, 14 nt, Pseudomonas putida KT2440
cgcgcccugcucau

SEQ ID NO: 1640823 - RNA, 15 nt, Pseudomonas putida KT2440
cgcgcgcccaggccc

SEQ ID NO: 1640824 - RNA, 16 nt, Pseudomonas putida KT2440
cgcgccuacagcggcc

SEQ ID NO: 1640825 - RNA, 19 nt, Pseudomonas putida KT2440
cgcgccuacagcggccugu

SEQ ID NO: 1640826 - RNA, 18 nt, Pseudomonas putida KT2440
cgcgccuacgacggccug

SEQ ID NO: 1640827 - RNA, 23 nt, Pseudomonas putida KT2440
cgcgccuacgacggccugcgccc

SEQ ID NO: 1640828 - RNA, 13 nt, Pseudomonas putida KT2440
cgcgccuccagcu

SEQ ID NO: 1640829 - RNA, 18 nt, Pseudomonas putida KT2440
cgccuugauuaccagcgc

SEQ ID NO: 1640830 - RNA, 22 nt, Pseudomonas putida KT2440
cgccuugggcaacaccgccaga

SEQ ID NO: 1640831 - RNA, 22 nt, Pseudomonas putida KT2440
cgccuugucggcacgcgccagc

SEQ ID NO: 1640832 - RNA, 14 nt, Pseudomonas putida KT2440
cgccugcugcugga

SEQ ID NO: 1640833 - RNA, 17 nt, Pseudomonas putida KT2440
cgccugcuuggccgacu

SEQ ID NO: 1640834 - RNA, 17 nt, Pseudomonas putida KT2440
cgccuggugccagcggc

SEQ ID NO: 1640835 - RNA, 19 nt, Pseudomonas putida KT2440
cgccugucuagccgccugc

SEQ ID NO: 1640836 - RNA, 21 nt, Pseudomonas putida KT2440
cgccugugagaucgagcgccg

SEQ ID NO: 1640837 - RNA, 13 nt, Pseudomonas putida KT2440
cgccugcgccgcu

SEQ ID NO: 1640838 - RNA, 18 nt, Pseudomonas putida KT2440
cgccugcgggugccgugg

SEQ ID NO: 1640839 - RNA, 17 nt, Pseudomonas putida KT2440
cgccugcucaaucaacc

SEQ ID NO: 1640840 - RNA, 23 nt, Pseudomonas putida KT2440
cgccugcggcaucagggcccggg

SEQ ID NO: 1640841 - RNA, 18 nt, Pseudomonas putida KT2440
cgcgaaggcuccagcacc

SEQ ID NO: 1640842 - RNA, 14 nt, Pseudomonas putida KT2440
cgcgaagggccgca

SEQ ID NO: 1640843 - RNA, 23 nt, Pseudomonas putida KT2440
cgcgaauacgauauccgcagccc

SEQ ID NO: 1640844 - RNA, 20 nt, Pseudomonas putida KT2440
cgcgaauacggucgcggcgg

SEQ ID NO: 1640845 - RNA, 14 nt, Pseudomonas putida KT2440
cgcgaccucagccg

SEQ ID NO: 1640846 - RNA, 15 nt, Pseudomonas putida KT2440
cgcgaagcaggcugc

SEQ ID NO: 1640847 - RNA, 18 nt, Pseudomonas putida KT2440
cgcgaagaggccggcccc

SEQ ID NO: 1640848 - RNA, 19 nt, Pseudomonas putida KT2440
cgcgaagaggccggccccg

SEQ ID NO: 1640849 - RNA, 20 nt, Pseudomonas putida KT2440
cgcgaagaggccgguacagg

SEQ ID NO: 1640850 - RNA, 17 nt, Pseudomonas putida KT2440
cgcgaagaagacaccgc

SEQ ID NO: 1640851 - RNA, 19 nt, Pseudomonas putida KT2440
cgcgaagcccagcuugccc

SEQ ID NO: 1640852 - RNA, 13 nt, Pseudomonas putida KT2440
cgcgaagcggccc

SEQ ID NO: 1640853 - RNA, 15 nt, Pseudomonas putida KT2440
cgccuuuuccaccag

SEQ ID NO: 1640854 - RNA, 16 nt, Pseudomonas putida KT2440
cgccuuuuccaccagc

SEQ ID NO: 1640855 - RNA, 13 nt, Pseudomonas putida KT2440
cgcgaucaccagc

SEQ ID NO: 1640856 - RNA, 13 nt, Pseudomonas putida KT2440
cgcgauaucccaa

SEQ ID NO: 1640857 - RNA, 21 nt, Pseudomonas putida KT2440
cgcgagaaugcugcgcagcug

SEQ ID NO: 1640858 - RNA, 20 nt, Pseudomonas putida KT2440
ccgucagcggcaacaccagc

SEQ ID NO: 1640859 - RNA, 17 nt, Pseudomonas putida KT2440
ccgucaggcucagcagg

SEQ ID NO: 1640860 - RNA, 17 nt, Pseudomonas putida KT2440
ccgucagguucaagccu

SEQ ID NO: 1640861 - RNA, 14 nt, Pseudomonas putida KT2440
ccgucagcuugccu

SEQ ID NO: 1640862 - RNA, 12 nt, Pseudomonas putida KT2440
ccgucagcagca

SEQ ID NO: 1640863 - RNA, 18 nt, Pseudomonas putida KT2440
ccgucagcagcaggcgcg

SEQ ID NO: 1640864 - RNA, 21 nt, Pseudomonas putida KT2440
ccgucagaaagaauggaaagc

SEQ ID NO: 1640865 - RNA, 11 nt, Pseudomonas putida KT2440
ccgucaccgcu

SEQ ID NO: 1640866 - RNA, 16 nt, Pseudomonas putida KT2440
ccgucaccgccgccug

SEQ ID NO: 1640867 - RNA, 12 nt, Pseudomonas putida KT2440
ccgucaccagcg

SEQ ID NO: 1640868 - RNA, 13 nt, Pseudomonas putida KT2440
ccgucaccagcgu

SEQ ID NO: 1640869 - RNA, 20 nt, Pseudomonas putida KT2440
ccgucauugcucaccguggu

SEQ ID NO: 1640870 - RNA, 12 nt, Pseudomonas putida KT2440
aaaccuucaaca

SEQ ID NO: 1640871 - RNA, 12 nt, Pseudomonas putida KT2440
ccguccagcuga

SEQ ID NO: 1640872 - RNA, 14 nt, Pseudomonas putida KT2440
ccguccagcugagc

SEQ ID NO: 1640873 - RNA, 22 nt, Pseudomonas putida KT2440
ccguccagcugagcgccaucca

SEQ ID NO: 1640874 - RNA, 14 nt, Pseudomonas putida KT2440
ccgucuggcugcaa

SEQ ID NO: 1640875 - RNA, 22 nt, Pseudomonas putida KT2440
ccgucuuucagguuccaagcgu

SEQ ID NO: 1640876 - RNA, 19 nt, Pseudomonas putida KT2440
ccgucuuccucgacccagc

SEQ ID NO: 1640877 - RNA, 15 nt, Pseudomonas putida KT2440
ccgucgaagcccgcg

SEQ ID NO: 1640878 - RNA, 13 nt, Pseudomonas putida KT2440
ccguacaccaugc

SEQ ID NO: 1640879 - RNA, 14 nt, Pseudomonas putida KT2440
ccguacagaccgcc

SEQ ID NO: 1640880 - RNA, 13 nt, Pseudomonas putida KT2440
ccguacccaggug

SEQ ID NO: 1640881 - RNA, 13 nt, Pseudomonas putida KT2440
ccgguuuuuucau

SEQ ID NO: 1640882 - RNA, 20 nt, Pseudomonas putida KT2440
ccgguuugcgcucgcugccg

SEQ ID NO: 1640883 - RNA, 22 nt, Pseudomonas putida KT2440
ccguaagccgcaggccaaugca

SEQ ID NO: 1640884 - RNA, 20 nt, Pseudomonas putida KT2440
ccguaggagcggguuuaccc

SEQ ID NO: 1640885 - RNA, 20 nt, Pseudomonas putida KT2440
ccguaggugaucagcuugcc

SEQ ID NO: 1640886 - RNA, 16 nt, Pseudomonas putida KT2440
ccgucaacucgccaaa

SEQ ID NO: 1640887 - RNA, 22 nt, Pseudomonas putida KT2440
ccggucccgcccuccagccgcg

SEQ ID NO: 1640888 - RNA, 22 nt, Pseudomonas putida KT2440
ccggguagaagggggcaaugcg

SEQ ID NO: 1640889 - RNA, 14 nt, Pseudomonas putida KT2440
ccggucccaauaau

SEQ ID NO: 1640890 - RNA, 13 nt, Pseudomonas putida KT2440
ccggucucccagc

SEQ ID NO: 1640891 - RNA, 16 nt, Pseudomonas putida KT2440
ccggucucccagcgcu

SEQ ID NO: 1640892 - RNA, 19 nt, Pseudomonas putida KT2440
ccggucguuacccaccagc

SEQ ID NO: 1640893 - RNA, 23 nt, Pseudomonas putida KT2440
ccgggguuuuuuauugccugcca

SEQ ID NO: 1640894 - RNA, 21 nt, Pseudomonas putida KT2440
ccggugguacagacaaucauc

SEQ ID NO: 1640895 - RNA, 15 nt, Pseudomonas putida KT2440
ccgguggcggccgca

SEQ ID NO: 1640896 - RNA, 15 nt, Pseudomonas putida KT2440
ccggugcgcgggcgu

SEQ ID NO: 1640897 - RNA, 16 nt, Pseudomonas putida KT2440
ccggugucuuccggca

SEQ ID NO: 1640898 - RNA, 13 nt, Pseudomonas putida KT2440
ccggugccgcgcc

SEQ ID NO: 1640899 - RNA, 20 nt, Pseudomonas putida KT2440
ccggugccgccugggucagg

SEQ ID NO: 1640900 - RNA, 22 nt, Pseudomonas putida KT2440
ccggucuugucugacagcagga

SEQ ID NO: 1640901 - RNA, 12 nt, Pseudomonas putida KT2440
ccggccaccaca

SEQ ID NO: 1640902 - RNA, 20 nt, Pseudomonas putida KT2440
ccggccaaggucagcaagcc

SEQ ID NO: 1640903 - RNA, 22 nt, Pseudomonas putida KT2440
ccggccaaucgaucugcucgcc

SEQ ID NO: 1640904 - RNA, 22 nt, Pseudomonas putida KT2440
ccggccaccagugcuuccaggg

SEQ ID NO: 1640905 - RNA, 12 nt, Pseudomonas putida KT2440
ccggccaccagg

SEQ ID NO: 1640906 - RNA, 21 nt, Pseudomonas putida KT2440
ccggccaccaggcgcggcagc

SEQ ID NO: 1640907 - RNA, 16 nt, Pseudomonas putida KT2440
ccggccagcaggucag

SEQ ID NO: 1640908 - RNA, 13 nt, Pseudomonas putida KT2440
ccggccagcaaca

SEQ ID NO: 1640909 - RNA, 13 nt, Pseudomonas putida KT2440
ccggccagcgacc

SEQ ID NO: 1640910 - RNA, 11 nt, Pseudomonas putida KT2440
ccggccagcgc

SEQ ID NO: 1640911 - RNA, 18 nt, Pseudomonas putida KT2440
ccggaguggaagaugguc

SEQ ID NO: 1640912 - RNA, 14 nt, Pseudomonas putida KT2440
ccggagcuggagcc

SEQ ID NO: 1640913 - RNA, 19 nt, Pseudomonas putida KT2440
ccggccucaauuccagucu

SEQ ID NO: 1640914 - RNA, 20 nt, Pseudomonas putida KT2440
ccggccucaauuccagucug

SEQ ID NO: 1640915 - RNA, 15 nt, Pseudomonas putida KT2440
ccggccgccgccaga

SEQ ID NO: 1640916 - RNA, 18 nt, Pseudomonas putida KT2440
ccggccuauucgcgggua

SEQ ID NO: 1640917 - RNA, 13 nt, Pseudomonas putida KT2440
ccggcccagcccc

SEQ ID NO: 1640918 - RNA, 22 nt, Pseudomonas putida KT2440
ccggccccaggguuaccuugau

SEQ ID NO: 1640919 - RNA, 15 nt, Pseudomonas putida KT2440
ccggccccccagcca

SEQ ID NO: 1640920 - RNA, 13 nt, Pseudomonas putida KT2440
ccggccgccagga

SEQ ID NO: 1640921 - RNA, 15 nt, Pseudomonas putida KT2440
ccggccgcacuucug

SEQ ID NO: 1640922 - RNA, 14 nt, Pseudomonas putida KT2440
ccggccgacccgcc

SEQ ID NO: 1640923 - RNA, 16 nt, Pseudomonas putida KT2440
ccggcgaguccugccu

SEQ ID NO: 1640924 - RNA, 14 nt, Pseudomonas putida KT2440
ccggcgaauccagc

SEQ ID NO: 1640925 - RNA, 21 nt, Pseudomonas putida KT2440
ccggcgcauugauagcggcag

SEQ ID NO: 1640926 - RNA, 18 nt, Pseudomonas putida KT2440
ccggcgccaaacgccagg

SEQ ID NO: 1640927 - RNA, 14 nt, Pseudomonas putida KT2440
ccggcgccaugccc

SEQ ID NO: 1640928 - RNA, 23 nt, Pseudomonas putida KT2440
ccggcgccaugccccccgccagc

SEQ ID NO: 1640929 - RNA, 13 nt, Pseudomonas putida KT2440
ccggcgccgccga

SEQ ID NO: 1640930 - RNA, 14 nt, Pseudomonas putida KT2440
ccggcgccgccagg

SEQ ID NO: 1640931 - RNA, 14 nt, Pseudomonas putida KT2440
ccggcgcugggcuu

SEQ ID NO: 1640932 - RNA, 18 nt, Pseudomonas putida KT2440
ccggcgcugaucagcugg

SEQ ID NO: 1640933 - RNA, 15 nt, Pseudomonas putida KT2440
ccggcgcggccugcu

SEQ ID NO: 1640934 - RNA, 12 nt, Pseudomonas putida KT2440
ccggcgccgccc

SEQ ID NO: 1640935 - RNA, 13 nt, Pseudomonas putida KT2440
ccggcgccggugg

SEQ ID NO: 1640936 - RNA, 22 nt, Pseudomonas putida KT2440
ccggcuugucuuccaguuccau

SEQ ID NO: 1640937 - RNA, 20 nt, Pseudomonas putida KT2440
ccgggagggcuuugcccucc

SEQ ID NO: 1640938 - RNA, 16 nt, Pseudomonas putida KT2440
ccgggagggugaacga

SEQ ID NO: 1640939 - RNA, 13 nt, Pseudomonas putida KT2440
ccggcucugccgg

SEQ ID NO: 1640940 - RNA, 15 nt, Pseudomonas putida KT2440
ccggcucugccggug

SEQ ID NO: 1640941 - RNA, 16 nt, Pseudomonas putida KT2440
ccggcucgucacugcc

SEQ ID NO: 1640942 - RNA, 15 nt, Pseudomonas putida KT2440
ccggcucgguccggg

SEQ ID NO: 1640943 - RNA, 17 nt, Pseudomonas putida KT2440
aaaccgcucgaagauau

SEQ ID NO: 1640944 - RNA, 18 nt, Pseudomonas putida KT2440
aaaccggccuugccgcug

SEQ ID NO: 1640945 - RNA, 19 nt, Pseudomonas putida KT2440
ccgggcugcugcgcagccc

SEQ ID NO: 1640946 - RNA, 22 nt, Pseudomonas putida KT2440
ccgggcugcugcgcagcccugu

SEQ ID NO: 1640947 - RNA, 21 nt, Pseudomonas putida KT2440
ccgggccugauuggcaucgcu

SEQ ID NO: 1640948 - RNA, 20 nt, Pseudomonas putida KT2440
ccgggcgcgggcccuguggg

SEQ ID NO: 1640949 - RNA, 16 nt, Pseudomonas putida KT2440
ccggggaucuugcugg

SEQ ID NO: 1640950 - RNA, 13 nt, Pseudomonas putida KT2440
ccggggcaccuug

SEQ ID NO: 1640951 - RNA, 20 nt, Pseudomonas putida KT2440
aaaccuccggcaucauccug

SEQ ID NO: 1640952 - RNA, 20 nt, Pseudomonas putida KT2440
aaaccucacggcgaacaccc

SEQ ID NO: 1640953 - RNA, 21 nt, Pseudomonas putida KT2440
ccgggccgcuugcucaggcuc

SEQ ID NO: 1640954 - RNA, 20 nt, Pseudomonas putida KT2440
aaaccugcgcuugcaccagg

SEQ ID NO: 1640955 - RNA, 17 nt, Pseudomonas putida KT2440
ccgcugccgaucagcac

SEQ ID NO: 1640956 - RNA, 14 nt, Pseudomonas putida KT2440
ccgcugccguagca

SEQ ID NO: 1640957 - RNA, 15 nt, Pseudomonas putida KT2440
ccgcugccugcgcuu

SEQ ID NO: 1640958 - RNA, 22 nt, Pseudomonas putida KT2440
ccgcugcgccugccgggccagg

SEQ ID NO: 1640959 - RNA, 21 nt, Pseudomonas putida KT2440
ccgcuggcuuccucacggcag

SEQ ID NO: 1640960 - RNA, 17 nt, Pseudomonas putida KT2440
ccgcuggccgcacccag

SEQ ID NO: 1640961 - RNA, 18 nt, Pseudomonas putida KT2440
ccgcuggcgaucaggcag

SEQ ID NO: 1640962 - RNA, 13 nt, Pseudomonas putida KT2440
ccgcuggaccugg

SEQ ID NO: 1640963 - RNA, 20 nt, Pseudomonas putida KT2440
ccgcugcggaucaucuccau

SEQ ID NO: 1640964 - RNA, 16 nt, Pseudomonas putida KT2440
ccgcugcuccaugauc

SEQ ID NO: 1640965 - RNA, 14 nt, Pseudomonas putida KT2440
ccgcugcuccgacc

SEQ ID NO: 1640966 - RNA, 16 nt, Pseudomonas putida KT2440
ccgcugccagcugcgc

SEQ ID NO: 1640967 - RNA, 22 nt, Pseudomonas putida KT2440
ccgcugccauagcgcugcaccg

SEQ ID NO: 1640968 - RNA, 16 nt, Pseudomonas putida KT2440
ccgcugccacccacag

SEQ ID NO: 1640969 - RNA, 22 nt, Pseudomonas putida KT2440
ccgcugccaccuuccaggucga

SEQ ID NO: 1640970 - RNA, 19 nt, Pseudomonas putida KT2440
ccgcugccagcagggcagg

SEQ ID NO: 1640971 - RNA, 21 nt, Pseudomonas putida KT2440
ccgcugcacgucgcgcagggc

SEQ ID NO: 1640972 - RNA, 19 nt, Pseudomonas putida KT2440
ccgcugcacaggccagccc

SEQ ID NO: 1640973 - RNA, 15 nt, Pseudomonas putida KT2440
ccgcucgcgccgccg

SEQ ID NO: 1640974 - RNA, 19 nt, Pseudomonas putida KT2440
ccgcucgguaucggccagc

SEQ ID NO: 1640975 - RNA, 20 nt, Pseudomonas putida KT2440
ccgcugaacaacuccgggug

SEQ ID NO: 1640976 - RNA, 20 nt, Pseudomonas putida KT2440
ccgcugaaccucaccgccgg

SEQ ID NO: 1640977 - RNA, 18 nt, Pseudomonas putida KT2440
ccggaaugcccgggcgca

SEQ ID NO: 1640978 - RNA, 19 nt, Pseudomonas putida KT2440
ccggaaugcccgggcgcag

SEQ ID NO: 1640979 - RNA, 15 nt, Pseudomonas putida KT2440
ccggacuuggacccc

SEQ ID NO: 1640980 - RNA, 15 nt, Pseudomonas putida KT2440
ccggacugcaccagg

SEQ ID NO: 1640981 - RNA, 18 nt, Pseudomonas putida KT2440
ccggagcgacuucgacca

SEQ ID NO: 1640982 - RNA, 23 nt, Pseudomonas putida KT2440
ccggagcgacuucgaccacggcc

SEQ ID NO: 1640983 - RNA, 15 nt, Pseudomonas putida KT2440
ccgcuugcucaggcu

SEQ ID NO: 1640984 - RNA, 23 nt, Pseudomonas putida KT2440
ccgcuugcuguguuaccagucca

SEQ ID NO: 1640985 - RNA, 13 nt, Pseudomonas putida KT2440
ccgcuuggccacc

SEQ ID NO: 1640986 - RNA, 14 nt, Pseudomonas putida KT2440
ccggaacaaccccu

SEQ ID NO: 1640987 - RNA, 18 nt, Pseudomonas putida KT2440
ccgcugggcacccugauc

SEQ ID NO: 1640988 - RNA, 19 nt, Pseudomonas putida KT2440
ccgcugguacagggucagg

SEQ ID NO: 1640989 - RNA, 17 nt, Pseudomonas putida KT2440
ccgcugguggcguggcu

SEQ ID NO: 1640990 - RNA, 20 nt, Pseudomonas putida KT2440
ccgcuugacgaucgccagcc

SEQ ID NO: 1640991 - RNA, 23 nt, Pseudomonas putida KT2440
ccgcuugacgaucgccagcccca

SEQ ID NO: 1640992 - RNA, 22 nt, Pseudomonas putida KT2440
ccgcuucggcgggguuuuuucu

SEQ ID NO: 1640993 - RNA, 23 nt, Pseudomonas putida KT2440
ccgcucgacguuuaccugcagcu

SEQ ID NO: 1640994 - RNA, 14 nt, Pseudomonas putida KT2440
ccgcucgcccagca

SEQ ID NO: 1640995 - RNA, 12 nt, Pseudomonas putida KT2440
ccgcucccaggu

SEQ ID NO: 1640996 - RNA, 13 nt, Pseudomonas putida KT2440
ccgcucccagguu

SEQ ID NO: 1640997 - RNA, 16 nt, Pseudomonas putida KT2440
ccgcucccauagccaa

SEQ ID NO: 1640998 - RNA, 21 nt, Pseudomonas putida KT2440
ccgcucccacagggaccgcau

SEQ ID NO: 1640999 - RNA, 21 nt, Pseudomonas putida KT2440
ccgcucccacaggugcagcac

SEQ ID NO: 1641000 - RNA, 20 nt, Pseudomonas putida KT2440
ccgcuccuacaaagcggcgc

SEQ ID NO: 1641001 - RNA, 23 nt, Pseudomonas putida KT2440
ccgcuccuacgcggggcagcgca

SEQ ID NO: 1641002 - RNA, 16 nt, Pseudomonas putida KT2440
ccgcuccuacgggcaa

SEQ ID NO: 1641003 - RNA, 14 nt, Pseudomonas putida KT2440
ccgcuccugcgguc

SEQ ID NO: 1641004 - RNA, 17 nt, Pseudomonas putida KT2440
ccgcuccugcggucagc

SEQ ID NO: 1641005 - RNA, 21 nt, Pseudomonas putida KT2440
ccgcuccugcggucagccugc

SEQ ID NO: 1641006 - RNA, 18 nt, Pseudomonas putida KT2440
ccgcucaaacccggcagc

SEQ ID NO: 1641007 - RNA, 19 nt, Pseudomonas putida KT2440
ccgcucaaacccggcagcc

SEQ ID NO: 1641008 - RNA, 21 nt, Pseudomonas putida KT2440
ccgcucaaacccggcagccac

SEQ ID NO: 1641009 - RNA, 20 nt, Pseudomonas putida KT2440
ccgcucaaccuuugcggcac

SEQ ID NO: 1641010 - RNA, 13 nt, Pseudomonas putida KT2440
ccgcucaccggcc

SEQ ID NO: 1641011 - RNA, 18 nt, Pseudomonas putida KT2440
ccgcguuggccaggucga

SEQ ID NO: 1641012 - RNA, 16 nt, Pseudomonas putida KT2440
ccgcuacaccggccug

SEQ ID NO: 1641013 - RNA, 15 nt, Pseudomonas putida KT2440
ccgcguucaugccgg

SEQ ID NO: 1641014 - RNA, 22 nt, Pseudomonas putida KT2440
ccgcgugcccccccaacaacag

SEQ ID NO: 1641015 - RNA, 18 nt, Pseudomonas putida KT2440
ccgcguuaugacuggccu

SEQ ID NO: 1641016 - RNA, 14 nt, Pseudomonas putida KT2440
ccgcgucagcucaa

SEQ ID NO: 1641017 - RNA, 22 nt, Pseudomonas putida KT2440
ccgcgucugcuucuucgcgggc

SEQ ID NO: 1641018 - RNA, 16 nt, Pseudomonas putida KT2440
ccgcgucucgccgcug

SEQ ID NO: 1641019 - RNA, 21 nt, Pseudomonas putida KT2440
ccgcguauguuuuguaggcgc

SEQ ID NO: 1641020 - RNA, 12 nt, Pseudomonas putida KT2440
ccgcggucuggc

SEQ ID NO: 1641021 - RNA, 14 nt, Pseudomonas putida KT2440
ccgcgguuucugca

SEQ ID NO: 1641022 - RNA, 19 nt, Pseudomonas putida KT2440
ccgcggaugcgccuggccc

SEQ ID NO: 1641023 - RNA, 22 nt, Pseudomonas putida KT2440
ccgcgcggcuugcucgcggcgc

SEQ ID NO: 1641024 - RNA, 14 nt, Pseudomonas putida KT2440
aaaccgccccacca

SEQ ID NO: 1641025 - RNA, 15 nt, Pseudomonas putida KT2440
aaaccgaccaggcag

SEQ ID NO: 1641026 - RNA, 19 nt, Pseudomonas putida KT2440
aaaccgcacccggcuacca

SEQ ID NO: 1641027 - RNA, 21 nt, Pseudomonas putida KT2440
ccgcgcgcgaugcgccgcgcg

SEQ ID NO: 1641028 - RNA, 15 nt, Pseudomonas putida KT2440
ccgcgccugcaaguc

SEQ ID NO: 1641029 - RNA, 13 nt, Pseudomonas putida KT2440
aaacccuucucuu

SEQ ID NO: 1641030 - RNA, 20 nt, Pseudomonas putida KT2440
aaacccucacgcgccagguc

SEQ ID NO: 1641031 - RNA, 20 nt, Pseudomonas putida KT2440
ccgcgcccgcaaccucggcc

SEQ ID NO: 1641032 - RNA, 21 nt, Pseudomonas putida KT2440
ccgcgccaucaaggccgacag

SEQ ID NO: 1641033 - RNA, 17 nt, Pseudomonas putida KT2440
ccgcgccaucagcugcg

SEQ ID NO: 1641034 - RNA, 12 nt, Pseudomonas putida KT2440
ccgcgcccggcu

SEQ ID NO: 1641035 - RNA, 22 nt, Pseudomonas putida KT2440
ccgcgcccagucaccguucuug

SEQ ID NO: 1641036 - RNA, 14 nt, Pseudomonas putida KT2440
ccgcgccuacagcg

SEQ ID NO: 1641037 - RNA, 18 nt, Pseudomonas putida KT2440
ccgcgccuacagcggccu

SEQ ID NO: 1641038 - RNA, 19 nt, Pseudomonas putida KT2440
ccgcgccuacagcggccug

SEQ ID NO: 1641039 - RNA, 16 nt, Pseudomonas putida KT2440
ccgcgccuacaggccc

SEQ ID NO: 1641040 - RNA, 15 nt, Pseudomonas putida KT2440
ccgcgccgcccagcu

SEQ ID NO: 1641041 - RNA, 16 nt, Pseudomonas putida KT2440
ccgccuggcucaccuu

SEQ ID NO: 1641042 - RNA, 21 nt, Pseudomonas putida KT2440
ccgccuggcccgucugcgugc

SEQ ID NO: 1641043 - RNA, 18 nt, Pseudomonas putida KT2440
ccgccuggccgcugcgcc

SEQ ID NO: 1641044 - RNA, 21 nt, Pseudomonas putida KT2440
ccgccugcggcaccgucgccu

SEQ ID NO: 1641045 - RNA, 12 nt, Pseudomonas putida KT2440
ccgcgaagaggc

SEQ ID NO: 1641046 - RNA, 17 nt, Pseudomonas putida KT2440
ccgcgaagaggccagca

SEQ ID NO: 1641047 - RNA, 20 nt, Pseudomonas putida KT2440
ccgcgaagaggccaggacag

SEQ ID NO: 1641048 - RNA, 21 nt, Pseudomonas putida KT2440
ccgcgaagaggccaggacagg

SEQ ID NO: 1641049 - RNA, 22 nt, Pseudomonas putida KT2440
ccgcgaauacgguggcggcagc

SEQ ID NO: 1641050 - RNA, 16 nt, Pseudomonas putida KT2440
ccgcgaagcagccacc

SEQ ID NO: 1641051 - RNA, 19 nt, Pseudomonas putida KT2440
ccgcgaagcagccaccacg

SEQ ID NO: 1641052 - RNA, 16 nt, Pseudomonas putida KT2440
ccgcgaaggcuccagc

SEQ ID NO: 1641053 - RNA, 23 nt, Pseudomonas putida KT2440
ccgcgaagggccgcaacgcggcc

SEQ ID NO: 1641054 - RNA, 15 nt, Pseudomonas putida KT2440
ccgcgaagggccgcc

SEQ ID NO: 1641055 - RNA, 21 nt, Pseudomonas putida KT2440
ccgcgaacaccggcagagccg

SEQ ID NO: 1641056 - RNA, 16 nt, Pseudomonas putida KT2440
ccgcgaaacacagcag

SEQ ID NO: 1641057 - RNA, 12 nt, Pseudomonas putida KT2440
ccgcgaaagggc

SEQ ID NO: 1641058 - RNA, 14 nt, Pseudomonas putida KT2440
ccgccugcgccagc

SEQ ID NO: 1641059 - RNA, 15 nt, Pseudomonas putida KT2440
ccgccugcgccagcg

SEQ ID NO: 1641060 - RNA, 14 nt, Pseudomonas putida KT2440
ccgccugcccgccc

SEQ ID NO: 1641061 - RNA, 20 nt, Pseudomonas putida KT2440
ccgcagcgcuucgaucagcg

SEQ ID NO: 1641062 - RNA, 18 nt, Pseudomonas putida KT2440
ccgccugacgccgccagc

SEQ ID NO: 1641063 - RNA, 17 nt, Pseudomonas putida KT2440
ccgcagccaugccgccg

SEQ ID NO: 1641064 - RNA, 13 nt, Pseudomonas putida KT2440
ccgcagccccgcc

SEQ ID NO: 1641065 - RNA, 15 nt, Pseudomonas putida KT2440
ccgcagccccgccgc

SEQ ID NO: 1641066 - RNA, 14 nt, Pseudomonas putida KT2440
ccgcagcgcauggu

SEQ ID NO: 1641067 - RNA, 22 nt, Pseudomonas putida KT2440
ccgcgaaugcuccggcgacagc

SEQ ID NO: 1641068 - RNA, 20 nt, Pseudomonas putida KT2440
ccgcgacgcggcccugggau

SEQ ID NO: 1641069 - RNA, 21 nt, Pseudomonas putida KT2440
ccgcgagcagcguucucggug

SEQ ID NO: 1641070 - RNA, 16 nt, Pseudomonas putida KT2440
ccgcgcaaaugcaccc

SEQ ID NO: 1641071 - RNA, 22 nt, Pseudomonas putida KT2440
ccgcgauggauggcaccggcuu

SEQ ID NO: 1641072 - RNA, 16 nt, Pseudomonas putida KT2440
ccgcgaugccgacagc

SEQ ID NO: 1641073 - RNA, 12 nt, Pseudomonas putida KT2440
ccgcgcaccucc

SEQ ID NO: 1641074 - RNA, 15 nt, Pseudomonas putida KT2440
ccgcgcaccuccugc

SEQ ID NO: 1641075 - RNA, 16 nt, Pseudomonas putida KT2440
ccgcgcagccuuugaa

SEQ ID NO: 1641076 - RNA, 15 nt, Pseudomonas putida KT2440
ccgcgcaggcggcug

SEQ ID NO: 1641077 - RNA, 18 nt, Pseudomonas putida KT2440
ccgcgcauccuccgcccu

SEQ ID NO: 1641078 - RNA, 17 nt, Pseudomonas putida KT2440
ccgcgccagcggccagc

SEQ ID NO: 1641079 - RNA, 17 nt, Pseudomonas putida KT2440
ccgcgccagccugggcu

SEQ ID NO: 1641080 - RNA, 22 nt, Pseudomonas putida KT2440
ccucgugaccgaccaccugcuc

SEQ ID NO: 1641081 - RNA, 15 nt, Pseudomonas putida KT2440
ccucgugcagcugca

SEQ ID NO: 1641082 - RNA, 18 nt, Pseudomonas putida KT2440
ccucgugcagcugcaccg

SEQ ID NO: 1641083 - RNA, 22 nt, Pseudomonas putida KT2440
ccucgucgcgguccuugccgua

SEQ ID NO: 1641084 - RNA, 15 nt, Pseudomonas putida KT2440
ccucguccccgcgcu

SEQ ID NO: 1641085 - RNA, 16 nt, Pseudomonas putida KT2440
ccucguccagcucguc

SEQ ID NO: 1641086 - RNA, 15 nt, Pseudomonas putida KT2440
ccucguccagguuga

SEQ ID NO: 1641087 - RNA, 18 nt, Pseudomonas putida KT2440
ccucguccaucuugcugc

SEQ ID NO: 1641088 - RNA, 16 nt, Pseudomonas putida KT2440
ccucgucaugcagcgc

SEQ ID NO: 1641089 - RNA, 17 nt, Pseudomonas putida KT2440
ccucgucaugcagcgcc

SEQ ID NO: 1641090 - RNA, 18 nt, Pseudomonas putida KT2440
ccucuccaauccgcagcu

SEQ ID NO: 1641091 - RNA, 22 nt, Pseudomonas putida KT2440
ccucucagcaccauuugucuug

SEQ ID NO: 1641092 - RNA, 16 nt, Pseudomonas putida KT2440
ccucuaucaccuguuc

SEQ ID NO: 1641093 - RNA, 18 nt, Pseudomonas putida KT2440
ccucuaucaccuguuccc

SEQ ID NO: 1641094 - RNA, 15 nt, Pseudomonas putida KT2440
ccucugccugcccau

SEQ ID NO: 1641095 - RNA, 19 nt, Pseudomonas putida KT2440
ccucggucgccgagccgau

SEQ ID NO: 1641096 - RNA, 16 nt, Pseudomonas putida KT2440
ccucggcgaucgccag

SEQ ID NO: 1641097 - RNA, 17 nt, Pseudomonas putida KT2440
ccucggccgcauccugc

SEQ ID NO: 1641098 - RNA, 15 nt, Pseudomonas putida KT2440
ccucggccggggcca

SEQ ID NO: 1641099 - RNA, 24 nt, Pseudomonas putida KT2440
ccucggccggggccaggcgcggcu

SEQ ID NO: 1641100 - RNA, 22 nt, Pseudomonas putida KT2440
ccucgcggcggcuaagcgccag

SEQ ID NO: 1641101 - RNA, 14 nt, Pseudomonas putida KT2440
ccuccgcccugccc

SEQ ID NO: 1641102 - RNA, 14 nt, Pseudomonas putida KT2440
ccuccgccugcggc

SEQ ID NO: 1641103 - RNA, 22 nt, Pseudomonas putida KT2440
ccucgccauaagcugucagcac

SEQ ID NO: 1641104 - RNA, 13 nt, Pseudomonas putida KT2440
ccucgcccagguc

SEQ ID NO: 1641105 - RNA, 14 nt, Pseudomonas putida KT2440
ccucgcccaccagc

SEQ ID NO: 1641106 - RNA, 19 nt, Pseudomonas putida KT2440
ccucgauuuccaccggcuu

SEQ ID NO: 1641107 - RNA, 22 nt, Pseudomonas putida KT2440
ccuccugaacgaugcccgggcc

SEQ ID NO: 1641108 - RNA, 12 nt, Pseudomonas putida KT2440
aaacgccagggc

SEQ ID NO: 1641109 - RNA, 13 nt, Pseudomonas putida KT2440
ccucaugcagcac

SEQ ID NO: 1641110 - RNA, 17 nt, Pseudomonas putida KT2440
ccucauucgcccgcacc

SEQ ID NO: 1641111 - RNA, 18 nt, Pseudomonas putida KT2440
ccucauuucaggcuucag

SEQ ID NO: 1641112 - RNA, 14 nt, Pseudomonas putida KT2440
ccuccagcuggcca

SEQ ID NO: 1641113 - RNA, 18 nt, Pseudomonas putida KT2440
ccuccagcugaaagucgu

SEQ ID NO: 1641114 - RNA, 11 nt, Pseudomonas putida KT2440
ccuccagcagc

SEQ ID NO: 1641115 - RNA, 23 nt, Pseudomonas putida KT2440
ccuccagcagcgacaccagcgca

SEQ ID NO: 1641116 - RNA, 21 nt, Pseudomonas putida KT2440
ccuccagcccugcucgccaaa

SEQ ID NO: 1641117 - RNA, 23 nt, Pseudomonas putida KT2440
ccuccagccgacggccaauggcc

SEQ ID NO: 1641118 - RNA, 22 nt, Pseudomonas putida KT2440
ccuccagcauggcgaucaacga

SEQ ID NO: 1641119 - RNA, 12 nt, Pseudomonas putida KT2440
ccucccgcgcau

SEQ ID NO: 1641120 - RNA, 20 nt, Pseudomonas putida KT2440
ccucccgcgcauccuccgcc

SEQ ID NO: 1641121 - RNA, 16 nt, Pseudomonas putida KT2440
ccuccccuucccgcca

SEQ ID NO: 1641122 - RNA, 13 nt, Pseudomonas putida KT2440
ccgugccugccug

SEQ ID NO: 1641123 - RNA, 14 nt, Pseudomonas putida KT2440
ccgugccugccugc

SEQ ID NO: 1641124 - RNA, 17 nt, Pseudomonas putida KT2440
ccuauggggugagcggc

SEQ ID NO: 1641125 - RNA, 16 nt, Pseudomonas putida KT2440
ccucagggguaaugcc

SEQ ID NO: 1641126 - RNA, 12 nt, Pseudomonas putida KT2440
ccucaggcacau

SEQ ID NO: 1641127 - RNA, 13 nt, Pseudomonas putida KT2440
ccucaggccccag

SEQ ID NO: 1641128 - RNA, 17 nt, Pseudomonas putida KT2440
ccucaggccccaggcca

SEQ ID NO: 1641129 - RNA, 16 nt, Pseudomonas putida KT2440
ccucagcuggccggcu

SEQ ID NO: 1641130 - RNA, 15 nt, Pseudomonas putida KT2440
ccucacggcagugca

SEQ ID NO: 1641131 - RNA, 18 nt, Pseudomonas putida KT2440
ccucacggcgaacacccc

SEQ ID NO: 1641132 - RNA, 20 nt, Pseudomonas putida KT2440
ccucacucaccgcacaggca

SEQ ID NO: 1641133 - RNA, 15 nt, Pseudomonas putida KT2440
ccucaagcggccucg

SEQ ID NO: 1641134 - RNA, 14 nt, Pseudomonas putida KT2440
ccucaccgccgcau

SEQ ID NO: 1641135 - RNA, 10 nt, Pseudomonas putida KT2440
ccucaacccu

SEQ ID NO: 1641136 - RNA, 15 nt, Pseudomonas putida KT2440
ccucaacccucgccc

SEQ ID NO: 1641137 - RNA, 17 nt, Pseudomonas putida KT2440
ccucaaaggcagccucg

SEQ ID NO: 1641138 - RNA, 15 nt, Pseudomonas putida KT2440
ccucaacaagcugau

SEQ ID NO: 1641139 - RNA, 20 nt, Pseudomonas putida KT2440
ccugccgaugggcacuggcc

SEQ ID NO: 1641140 - RNA, 15 nt, Pseudomonas putida KT2440
ccugccgcagcgcau

SEQ ID NO: 1641141 - RNA, 15 nt, Pseudomonas putida KT2440
ccugccgcagcuggc

SEQ ID NO: 1641142 - RNA, 21 nt, Pseudomonas putida KT2440
ccugccacgauggucacccgc

SEQ ID NO: 1641143 - RNA, 12 nt, Pseudomonas putida KT2440
ccugccaccagu

SEQ ID NO: 1641144 - RNA, 12 nt, Pseudomonas putida KT2440
ccugccacccau

SEQ ID NO: 1641145 - RNA, 13 nt, Pseudomonas putida KT2440
ccugccaccccgc

SEQ ID NO: 1641146 - RNA, 17 nt, Pseudomonas putida KT2440
ccugccggccucaauuc

SEQ ID NO: 1641147 - RNA, 20 nt, Pseudomonas putida KT2440
ccugccggccucaauuccag

SEQ ID NO: 1641148 - RNA, 18 nt, Pseudomonas putida KT2440
ccugccgggucaaggcca

SEQ ID NO: 1641149 - RNA, 20 nt, Pseudomonas putida KT2440
ccugcaucccuggguucucu

SEQ ID NO: 1641150 - RNA, 23 nt, Pseudomonas putida KT2440
ccugcauugcgcgucacugcacc

SEQ ID NO: 1641151 - RNA, 19 nt, Pseudomonas putida KT2440
ccugccacacacccgggcc

SEQ ID NO: 1641152 - RNA, 22 nt, Pseudomonas putida KT2440
ccugcagcuucccggccuggcg

SEQ ID NO: 1641153 - RNA, 16 nt, Pseudomonas putida KT2440
ccugcauccacaccag

SEQ ID NO: 1641154 - RNA, 19 nt, Pseudomonas putida KT2440
ccugcauccacaccagcgg

SEQ ID NO: 1641155 - RNA, 18 nt, Pseudomonas putida KT2440
ccugcgccuguuuuccau

SEQ ID NO: 1641156 - RNA, 19 nt, Pseudomonas putida KT2440
ccugcgcaggcgccgccag

SEQ ID NO: 1641157 - RNA, 16 nt, Pseudomonas putida KT2440
ccugcgcccaaucacc

SEQ ID NO: 1641158 - RNA, 19 nt, Pseudomonas putida KT2440
ccugcgcccaaucaccaau

SEQ ID NO: 1641159 - RNA, 21 nt, Pseudomonas putida KT2440
ccugcgucaggaccugguccc

SEQ ID NO: 1641160 - RNA, 17 nt, Pseudomonas putida KT2440
ccugcguacccagcccc

SEQ ID NO: 1641161 - RNA, 19 nt, Pseudomonas putida KT2440
ccugcguacccagcccccc

SEQ ID NO: 1641162 - RNA, 18 nt, Pseudomonas putida KT2440
ccugcgcuccagcagcuc

SEQ ID NO: 1641163 - RNA, 13 nt, Pseudomonas putida KT2440
ccugcaaccccug

SEQ ID NO: 1641164 - RNA, 19 nt, Pseudomonas putida KT2440
ccugcaaccccuggaaacc

SEQ ID NO: 1641165 - RNA, 12 nt, Pseudomonas putida KT2440
ccugcaacaccu

SEQ ID NO: 1641166 - RNA, 14 nt, Pseudomonas putida KT2440
ccugcaacaccucc

SEQ ID NO: 1641167 - RNA, 20 nt, Pseudomonas putida KT2440
ccugcaaggcaaugcccaug

SEQ ID NO: 1641168 - RNA, 20 nt, Pseudomonas putida KT2440
ccugcaagccggcgaacagc

SEQ ID NO: 1641169 - RNA, 15 nt, Pseudomonas putida KT2440
ccugcaaucagcuca

SEQ ID NO: 1641170 - RNA, 16 nt, Pseudomonas putida KT2440
ccugcaaucagcucac

SEQ ID NO: 1641171 - RNA, 20 nt, Pseudomonas putida KT2440
ccugcaaucagcucacaggc

SEQ ID NO: 1641172 - RNA, 16 nt, Pseudomonas putida KT2440
ccugcaauugcacccg

SEQ ID NO: 1641173 - RNA, 14 nt, Pseudomonas putida KT2440
ccugcagcccggca

SEQ ID NO: 1641174 - RNA, 12 nt, Pseudomonas putida KT2440
ccugcagccgca

SEQ ID NO: 1641175 - RNA, 19 nt, Pseudomonas putida KT2440
ccugcagccgcaccugccc

SEQ ID NO: 1641176 - RNA, 18 nt, Pseudomonas putida KT2440
ccugcagcucagccagca

SEQ ID NO: 1641177 - RNA, 19 nt, Pseudomonas putida KT2440
ccugcagagacaucuccau

SEQ ID NO: 1641178 - RNA, 14 nt, Pseudomonas putida KT2440
ccugcagcaccagc

SEQ ID NO: 1641179 - RNA, 13 nt, Pseudomonas putida KT2440
ccugcagcaggcc

SEQ ID NO: 1641180 - RNA, 16 nt, Pseudomonas putida KT2440
ccugaugaaagcgcau

SEQ ID NO: 1641181 - RNA, 14 nt, Pseudomonas putida KT2440
ccugaucgccucca

SEQ ID NO: 1641182 - RNA, 22 nt, Pseudomonas putida KT2440
ccugauguucggugcucaggcu

SEQ ID NO: 1641183 - RNA, 23 nt, Pseudomonas putida KT2440
ccugaugcgagcuaccugacuug

SEQ ID NO: 1641184 - RNA, 17 nt, Pseudomonas putida KT2440
ccugaugcaccaggccc

SEQ ID NO: 1641185 - RNA, 19 nt, Pseudomonas putida KT2440
ccugaugcagcagugccag

SEQ ID NO: 1641186 - RNA, 13 nt, Pseudomonas putida KT2440
ccugaagcccugg

SEQ ID NO: 1641187 - RNA, 14 nt, Pseudomonas putida KT2440
ccugaagcccugga

SEQ ID NO: 1641188 - RNA, 20 nt, Pseudomonas putida KT2440
ccugaagcaggggcuggacu

SEQ ID NO: 1641189 - RNA, 12 nt, Pseudomonas putida KT2440
ccugaaucagca

SEQ ID NO: 1641190 - RNA, 17 nt, Pseudomonas putida KT2440
ccugaaauuuuugaaau

SEQ ID NO: 1641191 - RNA, 13 nt, Pseudomonas putida KT2440
ccucuuagcgggc

SEQ ID NO: 1641192 - RNA, 11 nt, Pseudomonas putida KT2440
ccucugcugcg

SEQ ID NO: 1641193 - RNA, 22 nt, Pseudomonas putida KT2440
ccucuggguagccaccuuugac

SEQ ID NO: 1641194 - RNA, 18 nt, Pseudomonas putida KT2440
ccucuguuugcuggucag

SEQ ID NO: 1641195 - RNA, 20 nt, Pseudomonas putida KT2440
ccucuucgcgggcaagcccg

SEQ ID NO: 1641196 - RNA, 24 nt, Pseudomonas putida KT2440
ccucuucgcggguaaacccgcgcc

SEQ ID NO: 1641197 - RNA, 23 nt, Pseudomonas putida KT2440
ccucuucgcggguaaacccgcuc

SEQ ID NO: 1641198 - RNA, 19 nt, Pseudomonas putida KT2440
ccucuucgaagacgccgcc

SEQ ID NO: 1641199 - RNA, 21 nt, Pseudomonas putida KT2440
ccucuucgaagacgccgccau

SEQ ID NO: 1641200 - RNA, 18 nt, Pseudomonas putida KT2440
ccucuucggccagcaacu

SEQ ID NO: 1641201 - RNA, 19 nt, Pseudomonas putida KT2440
ccucuugcaccugucccag

SEQ ID NO: 1641202 - RNA, 19 nt, Pseudomonas putida KT2440
ccugagccaaggccgccca

SEQ ID NO: 1641203 - RNA, 20 nt, Pseudomonas putida KT2440
ccugagccaaggccgcccag

SEQ ID NO: 1641204 - RNA, 20 nt, Pseudomonas putida KT2440
ccugagccuuguucgcgcag

SEQ ID NO: 1641205 - RNA, 16 nt, Pseudomonas putida KT2440
ccugagcggugaaacc

SEQ ID NO: 1641206 - RNA, 13 nt, Pseudomonas putida KT2440
ccugagcuucaac

SEQ ID NO: 1641207 - RNA, 16 nt, Pseudomonas putida KT2440
ccugagcuucaacgcg

SEQ ID NO: 1641208 - RNA, 20 nt, Pseudomonas putida KT2440
ccugagcuucaaucaugaag

SEQ ID NO: 1641209 - RNA, 23 nt, Pseudomonas putida KT2440
ccugagcuucaaucaugaagcua

SEQ ID NO: 1641210 - RNA, 23 nt, Pseudomonas putida KT2440
ccugaguuagacauuagaaaaug

SEQ ID NO: 1641211 - RNA, 19 nt, Pseudomonas putida KT2440
ccugagucuggcgccugac

SEQ ID NO: 1641212 - RNA, 24 nt, Pseudomonas putida KT2440
ccugaguauucuccuucuuccaga

SEQ ID NO: 1641213 - RNA, 20 nt, Pseudomonas putida KT2440
ccugagucaggcgcccugcc

SEQ ID NO: 1641214 - RNA, 18 nt, Pseudomonas putida KT2440
ccugagggucgugagccu

SEQ ID NO: 1641215 - RNA, 21 nt, Pseudomonas putida KT2440
ccugagggucgugagccugca

SEQ ID NO: 1641216 - RNA, 13 nt, Pseudomonas putida KT2440
ccugaccaucagc

SEQ ID NO: 1641217 - RNA, 17 nt, Pseudomonas putida KT2440
ccugaccaucagccugu

SEQ ID NO: 1641218 - RNA, 20 nt, Pseudomonas putida KT2440
ccugacgcaagcgcgccgcc

SEQ ID NO: 1641219 - RNA, 14 nt, Pseudomonas putida KT2440
ccugacgcgccgcc

SEQ ID NO: 1641220 - RNA, 17 nt, Pseudomonas putida KT2440
ccugacacauaggcagc

SEQ ID NO: 1641221 - RNA, 19 nt, Pseudomonas putida KT2440
ccugacacauaggcagcca

SEQ ID NO: 1641222 - RNA, 18 nt, Pseudomonas putida KT2440
cgaagaucgguacaugcg

SEQ ID NO: 1641223 - RNA, 22 nt, Pseudomonas putida KT2440
cgaagaggccaguaccagcagc

SEQ ID NO: 1641224 - RNA, 21 nt, Pseudomonas putida KT2440
cgaagaggcccgaacagacaa

SEQ ID NO: 1641225 - RNA, 23 nt, Pseudomonas putida KT2440
cgaagaggcccucaagggcgcug

SEQ ID NO: 1641226 - RNA, 16 nt, Pseudomonas putida KT2440
cgaagaggccggcaca

SEQ ID NO: 1641227 - RNA, 13 nt, Pseudomonas putida KT2440
cgaagaggccggu

SEQ ID NO: 1641228 - RNA, 15 nt, Pseudomonas putida KT2440
cgaagagggcgacac

SEQ ID NO: 1641229 - RNA, 15 nt, Pseudomonas putida KT2440
cgaagcgcggcaagg

SEQ ID NO: 1641230 - RNA, 15 nt, Pseudomonas putida KT2440
cgaagcgaacacagu

SEQ ID NO: 1641231 - RNA, 19 nt, Pseudomonas putida KT2440
cgaacgcgaguaacgcccu

SEQ ID NO: 1641232 - RNA, 15 nt, Pseudomonas putida KT2440
cgaagaccgccgccc

SEQ ID NO: 1641233 - RNA, 20 nt, Pseudomonas putida KT2440
cgaagaccgccgcccagguc

SEQ ID NO: 1641234 - RNA, 22 nt, Pseudomonas putida KT2440
cgaagaccgccgcccaggucau

SEQ ID NO: 1641235 - RNA, 17 nt, Pseudomonas putida KT2440
cgaagucgaacuugacg

SEQ ID NO: 1641236 - RNA, 18 nt, Pseudomonas putida KT2440
cgaagucuguaagucguu

SEQ ID NO: 1641237 - RNA, 22 nt, Pseudomonas putida KT2440
cgaagucagguaggugcugacc

SEQ ID NO: 1641238 - RNA, 14 nt, Pseudomonas putida KT2440
cgaagguguuugac

SEQ ID NO: 1641239 - RNA, 22 nt, Pseudomonas putida KT2440
cgaagggccgcaacgcggcccu

SEQ ID NO: 1641240 - RNA, 17 nt, Pseudomonas putida KT2440
cgaagggccgccaagcg

SEQ ID NO: 1641241 - RNA, 19 nt, Pseudomonas putida KT2440
cgaagggauguuggaauaa

SEQ ID NO: 1641242 - RNA, 18 nt, Pseudomonas putida KT2440
cgaaggcuucguggaaga

SEQ ID NO: 1641243 - RNA, 17 nt, Pseudomonas putida KT2440
cgaaggcgucacccgcg

SEQ ID NO: 1641244 - RNA, 20 nt, Pseudomonas putida KT2440
cgaagcggcccccuggcccu

SEQ ID NO: 1641245 - RNA, 16 nt, Pseudomonas putida KT2440
cgaagcggccaaccgc

SEQ ID NO: 1641246 - RNA, 17 nt, Pseudomonas putida KT2440
cgaaggccuucagguug

SEQ ID NO: 1641247 - RNA, 15 nt, Pseudomonas putida KT2440
cgaacaggcagacca

SEQ ID NO: 1641248 - RNA, 21 nt, Pseudomonas putida KT2440
cgaacagcauccagcgccaga

SEQ ID NO: 1641249 - RNA, 13 nt, Pseudomonas putida KT2440
cgaacagcaccgc

SEQ ID NO: 1641250 - RNA, 17 nt, Pseudomonas putida KT2440
cgaacagcaccgccaug

SEQ ID NO: 1641251 - RNA, 18 nt, Pseudomonas putida KT2440
cgaacaccgguuuguccu

SEQ ID NO: 1641252 - RNA, 19 nt, Pseudomonas putida KT2440
cgaacaccgguuuguccug

SEQ ID NO: 1641253 - RNA, 17 nt, Pseudomonas putida KT2440
cgaacaccagccccagc

SEQ ID NO: 1641254 - RNA, 17 nt, Pseudomonas putida KT2440
cgaacaauucuuccagc

SEQ ID NO: 1641255 - RNA, 20 nt, Pseudomonas putida KT2440
cgaacacaaucgguucgccc

SEQ ID NO: 1641256 - RNA, 12 nt, Pseudomonas putida KT2440
cgaacaaaaccc

SEQ ID NO: 1641257 - RNA, 16 nt, Pseudomonas putida KT2440
cgaacaaggcucagcu

SEQ ID NO: 1641258 - RNA, 21 nt, Pseudomonas putida KT2440
cgaacaacgccaccgaaggcg

SEQ ID NO: 1641259 - RNA, 14 nt, Pseudomonas putida KT2440
cgaacaucugcucg

SEQ ID NO: 1641260 - RNA, 14 nt, Pseudomonas putida KT2440
cgaaccacagcacg

SEQ ID NO: 1641261 - RNA, 17 nt, Pseudomonas putida KT2440
cgaacccgcugccaccc

SEQ ID NO: 1641262 - RNA, 13 nt, Pseudomonas putida KT2440
cgaacccuugacc

SEQ ID NO: 1641263 - RNA, 15 nt, Pseudomonas putida KT2440
cgaacccuugaccuu

SEQ ID NO: 1641264 - RNA, 14 nt, Pseudomonas putida KT2440
cgaacgcccgaccu

SEQ ID NO: 1641265 - RNA, 17 nt, Pseudomonas putida KT2440
cgaacgccgccugccga

SEQ ID NO: 1641266 - RNA, 21 nt, Pseudomonas putida KT2440
cgaaccggcgcuggccaggcu

SEQ ID NO: 1641267 - RNA, 14 nt, Pseudomonas putida KT2440
cgaaagggccgcaa

SEQ ID NO: 1641268 - RNA, 18 nt, Pseudomonas putida KT2440
cgaaagggccgcaaagcg

SEQ ID NO: 1641269 - RNA, 21 nt, Pseudomonas putida KT2440
cgaaaucugccugcugcaaca

SEQ ID NO: 1641270 - RNA, 21 nt, Pseudomonas putida KT2440
cgaaaucagccuucagugcuu

SEQ ID NO: 1641271 - RNA, 21 nt, Pseudomonas putida KT2440
cgaaauuaccuuacugcaguu

SEQ ID NO: 1641272 - RNA, 16 nt, Pseudomonas putida KT2440
cgaaacguagucgacc

SEQ ID NO: 1641273 - RNA, 17 nt, Pseudomonas putida KT2440
cgaaacgcggcaaccug

SEQ ID NO: 1641274 - RNA, 14 nt, Pseudomonas putida KT2440
cgaaaccgcccggg

SEQ ID NO: 1641275 - RNA, 17 nt, Pseudomonas putida KT2440
cgaaacugcgcucaacc

SEQ ID NO: 1641276 - RNA, 14 nt, Pseudomonas putida KT2440
cgaaacacagcagg

SEQ ID NO: 1641277 - RNA, 19 nt, Pseudomonas putida KT2440
ccuugguccgggucugauu

SEQ ID NO: 1641278 - RNA, 17 nt, Pseudomonas putida KT2440
ccuugggccggcgcagg

SEQ ID NO: 1641279 - RNA, 17 nt, Pseudomonas putida KT2440
ccuugggcucagccgcc

SEQ ID NO: 1641280 - RNA, 20 nt, Pseudomonas putida KT2440
ccuugggggugaagcccugc

SEQ ID NO: 1641281 - RNA, 16 nt, Pseudomonas putida KT2440
ccuuggucaggaucac

SEQ ID NO: 1641282 - RNA, 20 nt, Pseudomonas putida KT2440
ccuuggucaggaucacccag

SEQ ID NO: 1641283 - RNA, 21 nt, Pseudomonas putida KT2440
ccuuucuuggcaugcgacgcg

SEQ ID NO: 1641284 - RNA, 17 nt, Pseudomonas putida KT2440
ccuuucuuaugccuggg

SEQ ID NO: 1641285 - RNA, 20 nt, Pseudomonas putida KT2440
ccuucauccucgacgaccag

SEQ ID NO: 1641286 - RNA, 22 nt, Pseudomonas putida KT2440
ccuucaugccgaacgauucugc

SEQ ID NO: 1641287 - RNA, 15 nt, Pseudomonas putida KT2440
ccuucuccagcucgc

SEQ ID NO: 1641288 - RNA, 23 nt, Pseudomonas putida KT2440
ccuucuauuaaugcacgccugga

SEQ ID NO: 1641289 - RNA, 15 nt, Pseudomonas putida KT2440
ccuuccccaggccgc

SEQ ID NO: 1641290 - RNA, 18 nt, Pseudomonas putida KT2440
ccuuccccaggccgccca

SEQ ID NO: 1641291 - RNA, 18 nt, Pseudomonas putida KT2440
ccuuccagcuucugcugg

SEQ ID NO: 1641292 - RNA, 12 nt, Pseudomonas putida KT2440
ccuuccagcccg

SEQ ID NO: 1641293 - RNA, 14 nt, Pseudomonas putida KT2440
ccuuccagcccgcc

SEQ ID NO: 1641294 - RNA, 19 nt, Pseudomonas putida KT2440
ccuuccagcccgccugcuc

SEQ ID NO: 1641295 - RNA, 19 nt, Pseudomonas putida KT2440
ccuuccacucuuccaccgc

SEQ ID NO: 1641296 - RNA, 20 nt, Pseudomonas putida KT2440
ccuucccgccauugcaccac

SEQ ID NO: 1641297 - RNA, 18 nt, Pseudomonas putida KT2440
ccuucccgucgagccggg

SEQ ID NO: 1641298 - RNA, 22 nt, Pseudomonas putida KT2440
ccuugcggcaagcucagguuac

SEQ ID NO: 1641299 - RNA, 14 nt, Pseudomonas putida KT2440
ccuugcgcugggca

SEQ ID NO: 1641300 - RNA, 15 nt, Pseudomonas putida KT2440
ccuugcgcugggcau

SEQ ID NO: 1641301 - RNA, 17 nt, Pseudomonas putida KT2440
ccuugcgcggcgcgccc

SEQ ID NO: 1641302 - RNA, 22 nt, Pseudomonas putida KT2440
ccuugcgcggcgcgcccugcuc

SEQ ID NO: 1641303 - RNA, 15 nt, Pseudomonas putida KT2440
ccuugcgcaucaagc

SEQ ID NO: 1641304 - RNA, 19 nt, Pseudomonas putida KT2440
ccuugggcaacaccgccag

SEQ ID NO: 1641305 - RNA, 16 nt, Pseudomonas putida KT2440
ccuuggcgugcacgcu

SEQ ID NO: 1641306 - RNA, 16 nt, Pseudomonas putida KT2440
ccuuggcuacgcaagg

SEQ ID NO: 1641307 - RNA, 22 nt, Pseudomonas putida KT2440
ccuuggcuacgcaaggugccaa

SEQ ID NO: 1641308 - RNA, 13 nt, Pseudomonas putida KT2440
ccuugcgcacgcc

SEQ ID NO: 1641309 - RNA, 15 nt, Pseudomonas putida KT2440
ccuugcgcacgcgcu

SEQ ID NO: 1641310 - RNA, 16 nt, Pseudomonas putida KT2440
ccuugccuaccugauc

SEQ ID NO: 1641311 - RNA, 17 nt, Pseudomonas putida KT2440
ccuugccuuccggcccg

SEQ ID NO: 1641312 - RNA, 14 nt, Pseudomonas putida KT2440
ccuugccugggccg

SEQ ID NO: 1641313 - RNA, 16 nt, Pseudomonas putida KT2440
ccuugccugggccggu

SEQ ID NO: 1641314 - RNA, 14 nt, Pseudomonas putida KT2440
ccuugcccagcucc

SEQ ID NO: 1641315 - RNA, 14 nt, Pseudomonas putida KT2440
ccuugcccugcagc

SEQ ID NO: 1641316 - RNA, 20 nt, Pseudomonas putida KT2440
ccuugcccugcagcuucccg

SEQ ID NO: 1641317 - RNA, 13 nt, Pseudomonas putida KT2440
ccuugccgccccg

SEQ ID NO: 1641318 - RNA, 17 nt, Pseudomonas putida KT2440
ccuugccgcucaccacc

SEQ ID NO: 1641319 - RNA, 20 nt, Pseudomonas putida KT2440
ccuugccgcuggcuuccuca

SEQ ID NO: 1641320 - RNA, 18 nt, Pseudomonas putida KT2440
ccuugccguagaugccgu

SEQ ID NO: 1641321 - RNA, 22 nt, Pseudomonas putida KT2440
ccuucugaaaggcguaggcaca

SEQ ID NO: 1641322 - RNA, 20 nt, Pseudomonas putida KT2440
ccuucugccguuugcuggcc

SEQ ID NO: 1641323 - RNA, 23 nt, Pseudomonas putida KT2440
ccuucuggugaaagucgaccagc

SEQ ID NO: 1641324 - RNA, 20 nt, Pseudomonas putida KT2440
ccuugagcgccgcgcccaug

SEQ ID NO: 1641325 - RNA, 18 nt, Pseudomonas putida KT2440
ccuugaguucccaggcag

SEQ ID NO: 1641326 - RNA, 15 nt, Pseudomonas putida KT2440
ccuugcacucccccu

SEQ ID NO: 1641327 - RNA, 14 nt, Pseudomonas putida KT2440
ccuugcacaguucg

SEQ ID NO: 1641328 - RNA, 22 nt, Pseudomonas putida KT2440
ccuugcacaguucgaaaaccug

SEQ ID NO: 1641329 - RNA, 21 nt, Pseudomonas putida KT2440
ccuugcagcgccgcauccagc

SEQ ID NO: 1641330 - RNA, 21 nt, Pseudomonas putida KT2440
ccuugccauaacuccagcgcc

SEQ ID NO: 1641331 - RNA, 17 nt, Pseudomonas putida KT2440
ccuugauuaccagcgcc

SEQ ID NO: 1641332 - RNA, 19 nt, Pseudomonas putida KT2440
ccuguuccggccucuucgc

SEQ ID NO: 1641333 - RNA, 17 nt, Pseudomonas putida KT2440
ccuguucccccaccggc

SEQ ID NO: 1641334 - RNA, 17 nt, Pseudomonas putida KT2440
ccuguugccgcuucgac

SEQ ID NO: 1641335 - RNA, 15 nt, Pseudomonas putida KT2440
ccuguugcgauuucu

SEQ ID NO: 1641336 - RNA, 18 nt, Pseudomonas putida KT2440
ccuguuuggccgcauaua

SEQ ID NO: 1641337 - RNA, 11 nt, Pseudomonas putida KT2440
ccuguggcugu

SEQ ID NO: 1641338 - RNA, 23 nt, Pseudomonas putida KT2440
ccuguggcugugguucaccgugu

SEQ ID NO: 1641339 - RNA, 24 nt, Pseudomonas putida KT2440
ccugugggagcacaagcacgcgcu

SEQ ID NO: 1641340 - RNA, 20 nt, Pseudomonas putida KT2440
ccugugggagcgggcaugcc

SEQ ID NO: 1641341 - RNA, 20 nt, Pseudomonas putida KT2440
ccugugggagcgggcgcgcc

SEQ ID NO: 1641342 - RNA, 15 nt, Pseudomonas putida KT2440
ccuguguccaacacc

SEQ ID NO: 1641343 - RNA, 19 nt, Pseudomonas putida KT2440
ccuguguccacccccgcuc

SEQ ID NO: 1641344 - RNA, 23 nt, Pseudomonas putida KT2440
ccugugguuucacacucgccagg

SEQ ID NO: 1641345 - RNA, 19 nt, Pseudomonas putida KT2440
ccuguggguaacccugcuc

SEQ ID NO: 1641346 - RNA, 17 nt, Pseudomonas putida KT2440
ccuguggggcaacugcg

SEQ ID NO: 1641347 - RNA, 18 nt, Pseudomonas putida KT2440
ccuguggggcaacugcgc

SEQ ID NO: 1641348 - RNA, 16 nt, Pseudomonas putida KT2440
ccuguguucaaccacc

SEQ ID NO: 1641349 - RNA, 16 nt, Pseudomonas putida KT2440
ccugugcccaaccacc

SEQ ID NO: 1641350 - RNA, 23 nt, Pseudomonas putida KT2440
ccugugagaucgagcgccgcccg

SEQ ID NO: 1641351 - RNA, 21 nt, Pseudomonas putida KT2440
ccugucgcgacgggcugcucc

SEQ ID NO: 1641352 - RNA, 19 nt, Pseudomonas putida KT2440
ccugucguuauccugcagc

SEQ ID NO: 1641353 - RNA, 13 nt, Pseudomonas putida KT2440
ccugguaaggcuc

SEQ ID NO: 1641354 - RNA, 21 nt, Pseudomonas putida KT2440
ccugguaggucacuucagugc

SEQ ID NO: 1641355 - RNA, 16 nt, Pseudomonas putida KT2440
ccuggguuuauuucuc

SEQ ID NO: 1641356 - RNA, 19 nt, Pseudomonas putida KT2440
ccuggguuuuaaccggccc

SEQ ID NO: 1641357 - RNA, 20 nt, Pseudomonas putida KT2440
ccuggguuuuaaccggcccu

SEQ ID NO: 1641358 - RNA, 23 nt, Pseudomonas putida KT2440
ccugguuauuuuuuaacaaggca

SEQ ID NO: 1641359 - RNA, 16 nt, Pseudomonas putida KT2440
ccugguccgugagaaa

SEQ ID NO: 1641360 - RNA, 20 nt, Pseudomonas putida KT2440
ccuggucacgcaguucgucg

SEQ ID NO: 1641361 - RNA, 20 nt, Pseudomonas putida KT2440
ccuggucacucugccgcccc

SEQ ID NO: 1641362 - RNA, 13 nt, Pseudomonas putida KT2440
ccugcucguccau

SEQ ID NO: 1641363 - RNA, 15 nt, Pseudomonas putida KT2440
ccugcguugccccca

SEQ ID NO: 1641364 - RNA, 18 nt, Pseudomonas putida KT2440
ccugcugcaacaacugga

SEQ ID NO: 1641365 - RNA, 15 nt, Pseudomonas putida KT2440
ccugcugcagcuccg

SEQ ID NO: 1641366 - RNA, 23 nt, Pseudomonas putida KT2440
ccugcugacgcaggguagccccg

SEQ ID NO: 1641367 - RNA, 18 nt, Pseudomonas putida KT2440
ccugcugauuagaguagu

SEQ ID NO: 1641368 - RNA, 12 nt, Pseudomonas putida KT2440
ccuguccccuug

SEQ ID NO: 1641369 - RNA, 18 nt, Pseudomonas putida KT2440
ccugucaagcguuuuuug

SEQ ID NO: 1641370 - RNA, 16 nt, Pseudomonas putida KT2440
ccugucacgccuucaa

SEQ ID NO: 1641371 - RNA, 18 nt, Pseudomonas putida KT2440
ccugucacguugcccgac

SEQ ID NO: 1641372 - RNA, 22 nt, Pseudomonas putida KT2440
ccgaagcuaucgccagcaggcc

SEQ ID NO: 1641373 - RNA, 17 nt, Pseudomonas putida KT2440
ccgaacuucccccuccc

SEQ ID NO: 1641374 - RNA, 18 nt, Pseudomonas putida KT2440
ccgaaggcgcuggcgaga

SEQ ID NO: 1641375 - RNA, 23 nt, Pseudomonas putida KT2440
ccgaagcuugcagucaccuggcc

SEQ ID NO: 1641376 - RNA, 11 nt, Pseudomonas putida KT2440
ccgaagugaug

SEQ ID NO: 1641377 - RNA, 16 nt, Pseudomonas putida KT2440
ccgacaacagcaugcu

SEQ ID NO: 1641378 - RNA, 14 nt, Pseudomonas putida KT2440
ccgacaacagcugc

SEQ ID NO: 1641379 - RNA, 16 nt, Pseudomonas putida KT2440
ccgacaacagcugcau

SEQ ID NO: 1641380 - RNA, 11 nt, Pseudomonas putida KT2440
ccgacaaaaac

SEQ ID NO: 1641381 - RNA, 17 nt, Pseudomonas putida KT2440
ccgacaaaaacaacaau

SEQ ID NO: 1641382 - RNA, 18 nt, Pseudomonas putida KT2440
ccgacaaaaacaacaaua

SEQ ID NO: 1641383 - RNA, 23 nt, Pseudomonas putida KT2440
ccgacacaugcaaacccuggccc

SEQ ID NO: 1641384 - RNA, 19 nt, Pseudomonas putida KT2440
ccgacaaaacugagcaaga

SEQ ID NO: 1641385 - RNA, 18 nt, Pseudomonas putida KT2440
ccgacaagggcuacgaaa

SEQ ID NO: 1641386 - RNA, 14 nt, Pseudomonas putida KT2440
ccgacaaguucauu

SEQ ID NO: 1641387 - RNA, 17 nt, Pseudomonas putida KT2440
aaaccacagcggccaca

SEQ ID NO: 1641388 - RNA, 17 nt, Pseudomonas putida KT2440
aaaccaauuacuuggcc

SEQ ID NO: 1641389 - RNA, 21 nt, Pseudomonas putida KT2440
ccgaacgcagcgccgccaacu

SEQ ID NO: 1641390 - RNA, 23 nt, Pseudomonas putida KT2440
ccgaaccuugcuugaccuuguca

SEQ ID NO: 1641391 - RNA, 22 nt, Pseudomonas putida KT2440
ccgaacgauucugccagcuccu

SEQ ID NO: 1641392 - RNA, 24 nt, Pseudomonas putida KT2440
ccgaacgauucugccagcuccugg

SEQ ID NO: 1641393 - RNA, 17 nt, Pseudomonas putida KT2440
ccgaaccggcgaucagg

SEQ ID NO: 1641394 - RNA, 21 nt, Pseudomonas putida KT2440
ccgaaccggcgaucagggugu

SEQ ID NO: 1641395 - RNA, 19 nt, Pseudomonas putida KT2440
ccgaacagacaacaucaaa

SEQ ID NO: 1641396 - RNA, 23 nt, Pseudomonas putida KT2440
ccgaaaucagcaacgccaccagu

SEQ ID NO: 1641397 - RNA, 12 nt, Pseudomonas putida KT2440
ccgaacaccgcc

SEQ ID NO: 1641398 - RNA, 18 nt, Pseudomonas putida KT2440
cccuuuucuacauggugg

SEQ ID NO: 1641399 - RNA, 23 nt, Pseudomonas putida KT2440
cccuuugcgggugagcaugccga

SEQ ID NO: 1641400 - RNA, 19 nt, Pseudomonas putida KT2440
cccuuucgcggguaaaccc

SEQ ID NO: 1641401 - RNA, 19 nt, Pseudomonas putida KT2440
ccgaaauaugcagugcccg

SEQ ID NO: 1641402 - RNA, 23 nt, Pseudomonas putida KT2440
cccuuccugaguauucuccuucu

SEQ ID NO: 1641403 - RNA, 15 nt, Pseudomonas putida KT2440
cccuuccggcaacuu

SEQ ID NO: 1641404 - RNA, 15 nt, Pseudomonas putida KT2440
cccuuccccccuggc

SEQ ID NO: 1641405 - RNA, 17 nt, Pseudomonas putida KT2440
cccuuccaugccccuca

SEQ ID NO: 1641406 - RNA, 20 nt, Pseudomonas putida KT2440
cccuuccccaggccgcccac

SEQ ID NO: 1641407 - RNA, 23 nt, Pseudomonas putida KT2440
cccuuccccaggccgcccaccca

SEQ ID NO: 1641408 - RNA, 14 nt, Pseudomonas putida KT2440
cccuucaugcgccc

SEQ ID NO: 1641409 - RNA, 14 nt, Pseudomonas putida KT2440
cccuuccagcccgc

SEQ ID NO: 1641410 - RNA, 16 nt, Pseudomonas putida KT2440
cccuuccagcccgccu

SEQ ID NO: 1641411 - RNA, 20 nt, Pseudomonas putida KT2440
cccuucgcgggcacgcccgc

SEQ ID NO: 1641412 - RNA, 22 nt, Pseudomonas putida KT2440
cccuucgcgggcacgcccgcuc

SEQ ID NO: 1641413 - RNA, 20 nt, Pseudomonas putida KT2440
cccuucgcggguaaacccgc

SEQ ID NO: 1641414 - RNA, 19 nt, Pseudomonas putida KT2440
cccuucggcaaucaccgcc

SEQ ID NO: 1641415 - RNA, 20 nt, Pseudomonas putida KT2440
cccuucggcaaucaccgcca

SEQ ID NO: 1641416 - RNA, 22 nt, Pseudomonas putida KT2440
cccuucgcggaagauacccgcc

SEQ ID NO: 1641417 - RNA, 22 nt, Pseudomonas putida KT2440
cccuucgcggaagcucuccagg

SEQ ID NO: 1641418 - RNA, 13 nt, Pseudomonas putida KT2440
cccuucgacgcuc

SEQ ID NO: 1641419 - RNA, 17 nt, Pseudomonas putida KT2440
cccuucgacgcucaagu

SEQ ID NO: 1641420 - RNA, 20 nt, Pseudomonas putida KT2440
cccuucgcaggcacgcccgc

SEQ ID NO: 1641421 - RNA, 22 nt, Pseudomonas putida KT2440
cccuucgcaggcacgcccgcuc

SEQ ID NO: 1641422 - RNA, 16 nt, Pseudomonas putida KT2440
cccuguagagcgccuu

SEQ ID NO: 1641423 - RNA, 22 nt, Pseudomonas putida KT2440
cccugucguuauccugcagcac

SEQ ID NO: 1641424 - RNA, 21 nt, Pseudomonas putida KT2440
cccuguuucgcccaaauguua

SEQ ID NO: 1641425 - RNA, 17 nt, Pseudomonas putida KT2440
cccuucauccgcggcau

SEQ ID NO: 1641426 - RNA, 15 nt, Pseudomonas putida KT2440
cccugugccgggguu

SEQ ID NO: 1641427 - RNA, 22 nt, Pseudomonas putida KT2440
cccugugggagcgggcuugccc

SEQ ID NO: 1641428 - RNA, 19 nt, Pseudomonas putida KT2440
cccuugucagccgccgcug

SEQ ID NO: 1641429 - RNA, 16 nt, Pseudomonas putida KT2440
cccuugggcucagccg

SEQ ID NO: 1641430 - RNA, 21 nt, Pseudomonas putida KT2440
cccuuggucaggaucacccag

SEQ ID NO: 1641431 - RNA, 22 nt, Pseudomonas putida KT2440
cccuucgucgauguccagcgag

SEQ ID NO: 1641432 - RNA, 13 nt, Pseudomonas putida KT2440
cccuucugcugcu

SEQ ID NO: 1641433 - RNA, 21 nt, Pseudomonas putida KT2440
cccuugaacagaccccagucg

SEQ ID NO: 1641434 - RNA, 13 nt, Pseudomonas putida KT2440
cccuugagcuuca

SEQ ID NO: 1641435 - RNA, 13 nt, Pseudomonas putida KT2440
cccuugccagcau

SEQ ID NO: 1641436 - RNA, 19 nt, Pseudomonas putida KT2440
cccuggaaccccauccaca

SEQ ID NO: 1641437 - RNA, 23 nt, Pseudomonas putida KT2440
cccuggcacgcccggcaccugcc

SEQ ID NO: 1641438 - RNA, 20 nt, Pseudomonas putida KT2440
cccuggaggccggcccugcc

SEQ ID NO: 1641439 - RNA, 17 nt, Pseudomonas putida KT2440
cccuggcaugcugaugc

SEQ ID NO: 1641440 - RNA, 16 nt, Pseudomonas putida KT2440
cccuggcccgccgcca

SEQ ID NO: 1641441 - RNA, 12 nt, Pseudomonas putida KT2440
cccuggcccuua

SEQ ID NO: 1641442 - RNA, 19 nt, Pseudomonas putida KT2440
cccugcauaugcagggccu

SEQ ID NO: 1641443 - RNA, 14 nt, Pseudomonas putida KT2440
cccugcgccgccac

SEQ ID NO: 1641444 - RNA, 15 nt, Pseudomonas putida KT2440
cccugcgccgccacc

SEQ ID NO: 1641445 - RNA, 21 nt, Pseudomonas putida KT2440
cccugccuaccaccgcauccg

SEQ ID NO: 1641446 - RNA, 18 nt, Pseudomonas putida KT2440
cccugcagcuucccggcc

SEQ ID NO: 1641447 - RNA, 17 nt, Pseudomonas putida KT2440
cccugcaauuucuugag

SEQ ID NO: 1641448 - RNA, 14 nt, Pseudomonas putida KT2440
cccugcaccacggc

SEQ ID NO: 1641449 - RNA, 23 nt, Pseudomonas putida KT2440
cccgucgagccggguccacccgg

SEQ ID NO: 1641450 - RNA, 23 nt, Pseudomonas putida KT2440
ccgacuagauaaccaaccccugc

SEQ ID NO: 1641451 - RNA, 19 nt, Pseudomonas putida KT2440
ccgacggcauggccgaagc

SEQ ID NO: 1641452 - RNA, 15 nt, Pseudomonas putida KT2440
ccgacggccaauggc

SEQ ID NO: 1641453 - RNA, 16 nt, Pseudomonas putida KT2440
ccgacggugccggugg

SEQ ID NO: 1641454 - RNA, 17 nt, Pseudomonas putida KT2440
ccgagcgagugaccuug

SEQ ID NO: 1641455 - RNA, 13 nt, Pseudomonas putida KT2440
ccgagcgcggcgc

SEQ ID NO: 1641456 - RNA, 20 nt, Pseudomonas putida KT2440
ccgagcgcggcgcccagcaa

SEQ ID NO: 1641457 - RNA, 14 nt, Pseudomonas putida KT2440
ccgacuuccccggc

SEQ ID NO: 1641458 - RNA, 20 nt, Pseudomonas putida KT2440
ccgacuuccccggcgccgcc

SEQ ID NO: 1641459 - RNA, 15 nt, Pseudomonas putida KT2440
ccgacuggcgcacca

SEQ ID NO: 1641460 - RNA, 16 nt, Pseudomonas putida KT2440
ccgacuggcgcaccag

SEQ ID NO: 1641461 - RNA, 19 nt, Pseudomonas putida KT2440
ccgacuggcgcaccagcgg

SEQ ID NO: 1641462 - RNA, 18 nt, Pseudomonas putida KT2440
ccgacucuacugcccgca

SEQ ID NO: 1641463 - RNA, 17 nt, Pseudomonas putida KT2440
ccgagucaacacggcug

SEQ ID NO: 1641464 - RNA, 14 nt, Pseudomonas putida KT2440
ccgagugcccgcgc

SEQ ID NO: 1641465 - RNA, 14 nt, Pseudomonas putida KT2440
ccgagucuccgcgc

SEQ ID NO: 1641466 - RNA, 17 nt, Pseudomonas putida KT2440
ccgaguauccccaccac

SEQ ID NO: 1641467 - RNA, 22 nt, Pseudomonas putida KT2440
ccgaguguuucaaaaaaaaggg

SEQ ID NO: 1641468 - RNA, 21 nt, Pseudomonas putida KT2440
ccgauaaacacgaacaucagc

SEQ ID NO: 1641469 - RNA, 21 nt, Pseudomonas putida KT2440
ccgaggaauugcgccaggaug

SEQ ID NO: 1641470 - RNA, 14 nt, Pseudomonas putida KT2440
ccgaggacaacaag

SEQ ID NO: 1641471 - RNA, 20 nt, Pseudomonas putida KT2440
ccgaggaaguacgccggcgc

SEQ ID NO: 1641472 - RNA, 15 nt, Pseudomonas putida KT2440
ccgaggaggaggcug

SEQ ID NO: 1641473 - RNA, 21 nt, Pseudomonas putida KT2440
ccgaggccgggcagagucguu

SEQ ID NO: 1641474 - RNA, 23 nt, Pseudomonas putida KT2440
ccgaggccggguuuuucaugaag

SEQ ID NO: 1641475 - RNA, 15 nt, Pseudomonas putida KT2440
ccgagggugaggugc

SEQ ID NO: 1641476 - RNA, 21 nt, Pseudomonas putida KT2440
ccgaggggccgcuacgcgccc

SEQ ID NO: 1641477 - RNA, 21 nt, Pseudomonas putida KT2440
ccgaggucagcaccagcucau

SEQ ID NO: 1641478 - RNA, 18 nt, Pseudomonas putida KT2440
ccgaugcucgucagcccc

SEQ ID NO: 1641479 - RNA, 17 nt, Pseudomonas putida KT2440
ccgcaaagcccugccuc

SEQ ID NO: 1641480 - RNA, 10 nt, Pseudomonas putida KT2440
ccgcaaagcg

SEQ ID NO: 1641481 - RNA, 13 nt, Pseudomonas putida KT2440
ccgcaaagcggcc

SEQ ID NO: 1641482 - RNA, 18 nt, Pseudomonas putida KT2440
ccgcaaagcggcccccac

SEQ ID NO: 1641483 - RNA, 23 nt, Pseudomonas putida KT2440
ccgcaacccuuuuaucugguugc

SEQ ID NO: 1641484 - RNA, 15 nt, Pseudomonas putida KT2440
ccgcaacccagcccc

SEQ ID NO: 1641485 - RNA, 14 nt, Pseudomonas putida KT2440
ccgcaacaugaagc

SEQ ID NO: 1641486 - RNA, 19 nt, Pseudomonas putida KT2440
ccgcaacaugaagccaugg

SEQ ID NO: 1641487 - RNA, 19 nt, Pseudomonas putida KT2440
ccgcaacaccugccgcagc

SEQ ID NO: 1641488 - RNA, 22 nt, Pseudomonas putida KT2440
ccgcaacacauuauccaccagg

SEQ ID NO: 1641489 - RNA, 20 nt, Pseudomonas putida KT2440
ccgcaaauucucgagcugau

SEQ ID NO: 1641490 - RNA, 16 nt, Pseudomonas putida KT2440
ccgcaacaaccuggcc

SEQ ID NO: 1641491 - RNA, 16 nt, Pseudomonas putida KT2440
ccgcaacgcggccccg

SEQ ID NO: 1641492 - RNA, 17 nt, Pseudomonas putida KT2440
ccgcaacgcggcccugg

SEQ ID NO: 1641493 - RNA, 19 nt, Pseudomonas putida KT2440
ccgcaacgcggcccugggu

SEQ ID NO: 1641494 - RNA, 18 nt, Pseudomonas putida KT2440
ccgcaagcagucccagca

SEQ ID NO: 1641495 - RNA, 16 nt, Pseudomonas putida KT2440
ccgcaagccagccucc

SEQ ID NO: 1641496 - RNA, 17 nt, Pseudomonas putida KT2440
ccgcaagccagccuccg

SEQ ID NO: 1641497 - RNA, 23 nt, Pseudomonas putida KT2440
ccgcaagcgccgaugcucgucag

SEQ ID NO: 1641498 - RNA, 14 nt, Pseudomonas putida KT2440
ccgcaaggccgcuc

SEQ ID NO: 1641499 - RNA, 18 nt, Pseudomonas putida KT2440
ccgcaaggccgcucccac

SEQ ID NO: 1641500 - RNA, 21 nt, Pseudomonas putida KT2440
ccgcacccggcggugacccgu

SEQ ID NO: 1641501 - RNA, 13 nt, Pseudomonas putida KT2440
ccgcaccugcccg

SEQ ID NO: 1641502 - RNA, 17 nt, Pseudomonas putida KT2440
ccgcaccugcccgcccu

SEQ ID NO: 1641503 - RNA, 12 nt, Pseudomonas putida KT2440
ccgaugcccagg

SEQ ID NO: 1641504 - RNA, 14 nt, Pseudomonas putida KT2440
ccgaugcccaggcc

SEQ ID NO: 1641505 - RNA, 19 nt, Pseudomonas putida KT2440
ccgaugccguaguaagcca

SEQ ID NO: 1641506 - RNA, 15 nt, Pseudomonas putida KT2440
ccgaucuccccacca

SEQ ID NO: 1641507 - RNA, 17 nt, Pseudomonas putida KT2440
ccgaucucgauccggcc

SEQ ID NO: 1641508 - RNA, 18 nt, Pseudomonas putida KT2440
ccgaucgaagcagcagcu

SEQ ID NO: 1641509 - RNA, 17 nt, Pseudomonas putida KT2440
ccgaucaggaagccccg

SEQ ID NO: 1641510 - RNA, 14 nt, Pseudomonas putida KT2440
ccgaucagcugggu

SEQ ID NO: 1641511 - RNA, 18 nt, Pseudomonas putida KT2440
ccgaucagcacgccgccg

SEQ ID NO: 1641512 - RNA, 16 nt, Pseudomonas putida KT2440
ccgauacagcgcgccg

SEQ ID NO: 1641513 - RNA, 17 nt, Pseudomonas putida KT2440
cccggcgcuggugcagg

SEQ ID NO: 1641514 - RNA, 14 nt, Pseudomonas putida KT2440
cccggcggccagca

SEQ ID NO: 1641515 - RNA, 16 nt, Pseudomonas putida KT2440
cccggcggccagcacg

SEQ ID NO: 1641516 - RNA, 17 nt, Pseudomonas putida KT2440
cccggcgcugaucagcu

SEQ ID NO: 1641517 - RNA, 14 nt, Pseudomonas putida KT2440
cccggggcgcucca

SEQ ID NO: 1641518 - RNA, 17 nt, Pseudomonas putida KT2440
cccgggguaaccgccug

SEQ ID NO: 1641519 - RNA, 17 nt, Pseudomonas putida KT2440
cccguacagaccgccgg

SEQ ID NO: 1641520 - RNA, 15 nt, Pseudomonas putida KT2440
aaacacgaacaucag

SEQ ID NO: 1641521 - RNA, 15 nt, Pseudomonas putida KT2440
cccggucccgcugcc

SEQ ID NO: 1641522 - RNA, 17 nt, Pseudomonas putida KT2440
cccggucggccagcugc

SEQ ID NO: 1641523 - RNA, 20 nt, Pseudomonas putida KT2440
cccggucggccagcugcugc

SEQ ID NO: 1641524 - RNA, 21 nt, Pseudomonas putida KT2440
cccggucggccagcugcugcg

SEQ ID NO: 1641525 - RNA, 13 nt, Pseudomonas putida KT2440
cccggccuggcgc

SEQ ID NO: 1641526 - RNA, 14 nt, Pseudomonas putida KT2440
cccggccuggcgca

SEQ ID NO: 1641527 - RNA, 21 nt, Pseudomonas putida KT2440
cccggcgaucugucaggugug

SEQ ID NO: 1641528 - RNA, 19 nt, Pseudomonas putida KT2440
cccggcgauacucaccgcc

SEQ ID NO: 1641529 - RNA, 16 nt, Pseudomonas putida KT2440
cccggccuuggccgcu

SEQ ID NO: 1641530 - RNA, 21 nt, Pseudomonas putida KT2440
cccggccuuggccgcuggccc

SEQ ID NO: 1641531 - RNA, 17 nt, Pseudomonas putida KT2440
cccggccuuucgcgcca

SEQ ID NO: 1641532 - RNA, 19 nt, Pseudomonas putida KT2440
cccggccuuucgcgccagu

SEQ ID NO: 1641533 - RNA, 14 nt, Pseudomonas putida KT2440
cccggcgccgccag

SEQ ID NO: 1641534 - RNA, 17 nt, Pseudomonas putida KT2440
cccggcgccaugccccc

SEQ ID NO: 1641535 - RNA, 11 nt, Pseudomonas putida KT2440
cccggcgcagc

SEQ ID NO: 1641536 - RNA, 13 nt, Pseudomonas putida KT2440
cccggcgcagccg

SEQ ID NO: 1641537 - RNA, 17 nt, Pseudomonas putida KT2440
cccggcgcagccguucu

SEQ ID NO: 1641538 - RNA, 14 nt, Pseudomonas putida KT2440
cccggcgcaaugcg

SEQ ID NO: 1641539 - RNA, 19 nt, Pseudomonas putida KT2440
cccggcgcgcgcgaccgcc

SEQ ID NO: 1641540 - RNA, 18 nt, Pseudomonas putida KT2440
cccggcccagccccgagc

SEQ ID NO: 1641541 - RNA, 23 nt, Pseudomonas putida KT2440
cccggcagucagggucucggcca

SEQ ID NO: 1641542 - RNA, 18 nt, Pseudomonas putida KT2440
cccggcagugccuggaug

SEQ ID NO: 1641543 - RNA, 15 nt, Pseudomonas putida KT2440
cccggcagccaccgc

SEQ ID NO: 1641544 - RNA, 16 nt, Pseudomonas putida KT2440
cccggcagccaccgcc

SEQ ID NO: 1641545 - RNA, 22 nt, Pseudomonas putida KT2440
cccggcagaucgagcgccgccc

SEQ ID NO: 1641546 - RNA, 15 nt, Pseudomonas putida KT2440
cccggccaggccggc

SEQ ID NO: 1641547 - RNA, 16 nt, Pseudomonas putida KT2440
cccggccaggccgugc

SEQ ID NO: 1641548 - RNA, 16 nt, Pseudomonas putida KT2440
cccgcgucugccgcag

SEQ ID NO: 1641549 - RNA, 14 nt, Pseudomonas putida KT2440
cccgcgugcgccca

SEQ ID NO: 1641550 - RNA, 15 nt, Pseudomonas putida KT2440
cccgcgucagcucaa

SEQ ID NO: 1641551 - RNA, 17 nt, Pseudomonas putida KT2440
cccgcgucagcucaagc

SEQ ID NO: 1641552 - RNA, 21 nt, Pseudomonas putida KT2440
cccgcgucagcucaagcgcuc

SEQ ID NO: 1641553 - RNA, 14 nt, Pseudomonas putida KT2440
cccgcguuggcagc

SEQ ID NO: 1641554 - RNA, 22 nt, Pseudomonas putida KT2440
cccgcguucaugccggccccag

SEQ ID NO: 1641555 - RNA, 19 nt, Pseudomonas putida KT2440
cccgcuacaccggccugga

SEQ ID NO: 1641556 - RNA, 22 nt, Pseudomonas putida KT2440
cccgcguuugcaacuggcgcag

SEQ ID NO: 1641557 - RNA, 20 nt, Pseudomonas putida KT2440
cccgcgccuacagcggccug

SEQ ID NO: 1641558 - RNA, 19 nt, Pseudomonas putida KT2440
cccgcgcgcccgcggccca

SEQ ID NO: 1641559 - RNA, 19 nt, Pseudomonas putida KT2440
cccgcggcucacccaccag

SEQ ID NO: 1641560 - RNA, 15 nt, Pseudomonas putida KT2440
cccgcgccgcccagc

SEQ ID NO: 1641561 - RNA, 12 nt, Pseudomonas putida KT2440
cccgcgccgccg

SEQ ID NO: 1641562 - RNA, 13 nt, Pseudomonas putida KT2440
cccgcgccgacag

SEQ ID NO: 1641563 - RNA, 12 nt, Pseudomonas putida KT2440
cccgcgccgcca

SEQ ID NO: 1641564 - RNA, 23 nt, Pseudomonas putida KT2440
cccgcgcaggaucaugugcgcca

SEQ ID NO: 1641565 - RNA, 16 nt, Pseudomonas putida KT2440
cccgcgaagggccgcc

SEQ ID NO: 1641566 - RNA, 15 nt, Pseudomonas putida KT2440
cccgcgaagggcugc

SEQ ID NO: 1641567 - RNA, 20 nt, Pseudomonas putida KT2440
cccgcgaaggggccggcccu

SEQ ID NO: 1641568 - RNA, 20 nt, Pseudomonas putida KT2440
cccgcgaauacgguagcggc

SEQ ID NO: 1641569 - RNA, 19 nt, Pseudomonas putida KT2440
cccgcgaaucguccuggaa

SEQ ID NO: 1641570 - RNA, 18 nt, Pseudomonas putida KT2440
cccgcgaaugcuacagaa

SEQ ID NO: 1641571 - RNA, 22 nt, Pseudomonas putida KT2440
cccgcgaaugggccgcaaagcg

SEQ ID NO: 1641572 - RNA, 23 nt, Pseudomonas putida KT2440
cccgcgaagaggccagcacaagc

SEQ ID NO: 1641573 - RNA, 19 nt, Pseudomonas putida KT2440
cccgcgaagaggccaggac

SEQ ID NO: 1641574 - RNA, 19 nt, Pseudomonas putida KT2440
cccgcgaagaggccggcac

SEQ ID NO: 1641575 - RNA, 17 nt, Pseudomonas putida KT2440
cccgcgaagaggccggu

SEQ ID NO: 1641576 - RNA, 23 nt, Pseudomonas putida KT2440
cccgcgaagaggccgguacagcc

SEQ ID NO: 1641577 - RNA, 17 nt, Pseudomonas putida KT2440
cccgcgaagcagccacc

SEQ ID NO: 1641578 - RNA, 19 nt, Pseudomonas putida KT2440
cccgccuggcgccugcgcc

SEQ ID NO: 1641579 - RNA, 18 nt, Pseudomonas putida KT2440
cccgccuggugccagcgg

SEQ ID NO: 1641580 - RNA, 16 nt, Pseudomonas putida KT2440
cccgcgaaaugcccaa

SEQ ID NO: 1641581 - RNA, 15 nt, Pseudomonas putida KT2440
cccgcgaacaggccc

SEQ ID NO: 1641582 - RNA, 16 nt, Pseudomonas putida KT2440
cccgcgaugccgacag

SEQ ID NO: 1641583 - RNA, 14 nt, Pseudomonas putida KT2440
cccgcgaguccucc

SEQ ID NO: 1641584 - RNA, 22 nt, Pseudomonas putida KT2440
cccggaccagcgccgcaucgcc

SEQ ID NO: 1641585 - RNA, 21 nt, Pseudomonas putida KT2440
cccggacaacuuggcaccgac

SEQ ID NO: 1641586 - RNA, 20 nt, Pseudomonas putida KT2440
cccggacugcaccaggucca

SEQ ID NO: 1641587 - RNA, 11 nt, Pseudomonas putida KT2440
cccggcaaaca

SEQ ID NO: 1641588 - RNA, 15 nt, Pseudomonas putida KT2440
cccggaugcgcaagc

SEQ ID NO: 1641589 - RNA, 18 nt, Pseudomonas putida KT2440
cccggcaccugugcaggc

SEQ ID NO: 1641590 - RNA, 18 nt, Pseudomonas putida KT2440
cccggcaauuucauccac

SEQ ID NO: 1641591 - RNA, 23 nt, Pseudomonas putida KT2440
cccggcacaaccgaacccgcugc

SEQ ID NO: 1641592 - RNA, 17 nt, Pseudomonas putida KT2440
cccggcaauccugggug

SEQ ID NO: 1641593 - RNA, 15 nt, Pseudomonas putida KT2440
cccggcaaucgccag

SEQ ID NO: 1641594 - RNA, 16 nt, Pseudomonas putida KT2440
cccggcaaucgccagg

SEQ ID NO: 1641595 - RNA, 18 nt, Pseudomonas putida KT2440
cccggcaaucgccaggcg

SEQ ID NO: 1641596 - RNA, 10 nt, Pseudomonas putida KT2440
cccgcuccua

SEQ ID NO: 1641597 - RNA, 20 nt, Pseudomonas putida KT2440
cccgcuccuacaggccgccc

SEQ ID NO: 1641598 - RNA, 20 nt, Pseudomonas putida KT2440
cccgcuccuacgggcaaccg

SEQ ID NO: 1641599 - RNA, 12 nt, Pseudomonas putida KT2440
cccgcucccaca

SEQ ID NO: 1641600 - RNA, 13 nt, Pseudomonas putida KT2440
cccgcucccacag

SEQ ID NO: 1641601 - RNA, 15 nt, Pseudomonas putida KT2440
cccgcucccacaggc

SEQ ID NO: 1641602 - RNA, 15 nt, Pseudomonas putida KT2440
cccgcucccacaggu

SEQ ID NO: 1641603 - RNA, 14 nt, Pseudomonas putida KT2440
cccgcucacgcagc

SEQ ID NO: 1641604 - RNA, 21 nt, Pseudomonas putida KT2440
cccgcucaaagcgcaaaacca

SEQ ID NO: 1641605 - RNA, 23 nt, Pseudomonas putida KT2440
cccgcugcacaggccagccccag

SEQ ID NO: 1641606 - RNA, 19 nt, Pseudomonas putida KT2440
cccgcugccacccacaggc

SEQ ID NO: 1641607 - RNA, 21 nt, Pseudomonas putida KT2440
cccgcugccaccuuccagguc

SEQ ID NO: 1641608 - RNA, 14 nt, Pseudomonas putida KT2440
cccgcugcgccgcu

SEQ ID NO: 1641609 - RNA, 15 nt, Pseudomonas putida KT2440
cccgcugcgccgcuc

SEQ ID NO: 1641610 - RNA, 23 nt, Pseudomonas putida KT2440
cccgcugcucgaggaagcuguug

SEQ ID NO: 1641611 - RNA, 17 nt, Pseudomonas putida KT2440
cccgcuggcgaucaggc

SEQ ID NO: 1641612 - RNA, 13 nt, Pseudomonas putida KT2440
cccgcuggccgga

SEQ ID NO: 1641613 - RNA, 15 nt, Pseudomonas putida KT2440
cccgcuggccgcacc

SEQ ID NO: 1641614 - RNA, 21 nt, Pseudomonas putida KT2440
cccgcuugccuuccucggcca

SEQ ID NO: 1641615 - RNA, 16 nt, Pseudomonas putida KT2440
cccgcuucgccgcgcu

SEQ ID NO: 1641616 - RNA, 19 nt, Pseudomonas putida KT2440
cccgcuucgccgcgcugug

SEQ ID NO: 1641617 - RNA, 22 nt, Pseudomonas putida KT2440
cccgcuugcggcgacgcacuuc

SEQ ID NO: 1641618 - RNA, 12 nt, Pseudomonas putida KT2440
ccccgcccaagc

SEQ ID NO: 1641619 - RNA, 12 nt, Pseudomonas putida KT2440
ccccgccgccag

SEQ ID NO: 1641620 - RNA, 11 nt, Pseudomonas putida KT2440
ccccgccgcug

SEQ ID NO: 1641621 - RNA, 15 nt, Pseudomonas putida KT2440
ccccgccaaccccuc

SEQ ID NO: 1641622 - RNA, 15 nt, Pseudomonas putida KT2440
ccccgccacccccgc

SEQ ID NO: 1641623 - RNA, 19 nt, Pseudomonas putida KT2440
ccccggauggugugcagca

SEQ ID NO: 1641624 - RNA, 14 nt, Pseudomonas putida KT2440
ccccggcgccgcca

SEQ ID NO: 1641625 - RNA, 17 nt, Pseudomonas putida KT2440
ccccgaaccuacccggu

SEQ ID NO: 1641626 - RNA, 19 nt, Pseudomonas putida KT2440
ccccgaacgcgguaagcac

SEQ ID NO: 1641627 - RNA, 18 nt, Pseudomonas putida KT2440
ccccgaagcagccgccgc

SEQ ID NO: 1641628 - RNA, 18 nt, Pseudomonas putida KT2440
cccccggaugcgcaagca

SEQ ID NO: 1641629 - RNA, 21 nt, Pseudomonas putida KT2440
cccccggauggugugcagcaa

SEQ ID NO: 1641630 - RNA, 13 nt, Pseudomonas putida KT2440
cccccgccacccc

SEQ ID NO: 1641631 - RNA, 15 nt, Pseudomonas putida KT2440
cccccgccacccccg

SEQ ID NO: 1641632 - RNA, 21 nt, Pseudomonas putida KT2440
cccccgcugcucgaggaagcu

SEQ ID NO: 1641633 - RNA, 12 nt, Pseudomonas putida KT2440
cccccgcuccua

SEQ ID NO: 1641634 - RNA, 20 nt, Pseudomonas putida KT2440
ccccaugaugaccaccagga

SEQ ID NO: 1641635 - RNA, 21 nt, Pseudomonas putida KT2440
cccccgaaucagugcaccggc

SEQ ID NO: 1641636 - RNA, 13 nt, Pseudomonas putida KT2440
ccccccugccgcu

SEQ ID NO: 1641637 - RNA, 12 nt, Pseudomonas putida KT2440
ccccccuggccu

SEQ ID NO: 1641638 - RNA, 21 nt, Pseudomonas putida KT2440
cccccgaucuauucgacccgc

SEQ ID NO: 1641639 - RNA, 21 nt, Pseudomonas putida KT2440
ccccaaggcgagggcuucgcc

SEQ ID NO: 1641640 - RNA, 14 nt, Pseudomonas putida KT2440
ccccaaggcugcca

SEQ ID NO: 1641641 - RNA, 17 nt, Pseudomonas putida KT2440
ccccaaucuccagcccg

SEQ ID NO: 1641642 - RNA, 17 nt, Pseudomonas putida KT2440
ccccaaucccaacucca

SEQ ID NO: 1641643 - RNA, 19 nt, Pseudomonas putida KT2440
ccccaaugaaucagagcga

SEQ ID NO: 1641644 - RNA, 20 nt, Pseudomonas putida KT2440
ccccaauggcgaaccccagu

SEQ ID NO: 1641645 - RNA, 18 nt, Pseudomonas putida KT2440
cccauucgcgggcaagcc

SEQ ID NO: 1641646 - RNA, 21 nt, Pseudomonas putida KT2440
cccauucgcggguaaacccgc

SEQ ID NO: 1641647 - RNA, 13 nt, Pseudomonas putida KT2440
cccagccagcaga

SEQ ID NO: 1641648 - RNA, 14 nt, Pseudomonas putida KT2440
cccauucccacauc

SEQ ID NO: 1641649 - RNA, 14 nt, Pseudomonas putida KT2440
cccagccaacgccc

SEQ ID NO: 1641650 - RNA, 13 nt, Pseudomonas putida KT2440
cccagcaugcgcu

SEQ ID NO: 1641651 - RNA, 18 nt, Pseudomonas putida KT2440
cccagcaugcgcuugagc

SEQ ID NO: 1641652 - RNA, 22 nt, Pseudomonas putida KT2440
cccagccagccacggaucaccu

SEQ ID NO: 1641653 - RNA, 14 nt, Pseudomonas putida KT2440
cccagccacccggc

SEQ ID NO: 1641654 - RNA, 17 nt, Pseudomonas putida KT2440
cccagccagcgacagca

SEQ ID NO: 1641655 - RNA, 22 nt, Pseudomonas putida KT2440
cccagccagcgauucaguucaa

SEQ ID NO: 1641656 - RNA, 14 nt, Pseudomonas putida KT2440
ccccagguuaucca

SEQ ID NO: 1641657 - RNA, 19 nt, Pseudomonas putida KT2440
ccccagguugcaccucgga

SEQ ID NO: 1641658 - RNA, 15 nt, Pseudomonas putida KT2440
ccccagucauccggg

SEQ ID NO: 1641659 - RNA, 15 nt, Pseudomonas putida KT2440
ccccaugcucaccag

SEQ ID NO: 1641660 - RNA, 17 nt, Pseudomonas putida KT2440
ccccaugcucaccagcu

SEQ ID NO: 1641661 - RNA, 17 nt, Pseudomonas putida KT2440
ccccagcgucacccgug

SEQ ID NO: 1641662 - RNA, 18 nt, Pseudomonas putida KT2440
ccccagcguuccugggcg

SEQ ID NO: 1641663 - RNA, 13 nt, Pseudomonas putida KT2440
ccccaggccgccc

SEQ ID NO: 1641664 - RNA, 19 nt, Pseudomonas putida KT2440
ccccaggcggugcacggcc

SEQ ID NO: 1641665 - RNA, 17 nt, Pseudomonas putida KT2440
ccccagggcucuacccc

SEQ ID NO: 1641666 - RNA, 20 nt, Pseudomonas putida KT2440
ccccagggcucuaccccuuc

SEQ ID NO: 1641667 - RNA, 14 nt, Pseudomonas putida KT2440
ccccacucgcgcag

SEQ ID NO: 1641668 - RNA, 17 nt, Pseudomonas putida KT2440
ccccacucgcgcagcac

SEQ ID NO: 1641669 - RNA, 16 nt, Pseudomonas putida KT2440
ccccagaccaucaggu

SEQ ID NO: 1641670 - RNA, 16 nt, Pseudomonas putida KT2440
ccccacaacggccgca

SEQ ID NO: 1641671 - RNA, 10 nt, Pseudomonas putida KT2440
ccccagaacg

SEQ ID NO: 1641672 - RNA, 18 nt, Pseudomonas putida KT2440
ccccagaacggcacgccc

SEQ ID NO: 1641673 - RNA, 13 nt, Pseudomonas putida KT2440
cccgcccagcugg

SEQ ID NO: 1641674 - RNA, 12 nt, Pseudomonas putida KT2440
cccgcccagcug

SEQ ID NO: 1641675 - RNA, 14 nt, Pseudomonas putida KT2440
cccgcccacgccgc

SEQ ID NO: 1641676 - RNA, 16 nt, Pseudomonas putida KT2440
cccgcaugcaacccgc

SEQ ID NO: 1641677 - RNA, 18 nt, Pseudomonas putida KT2440
cccgcagcuucaacucca

SEQ ID NO: 1641678 - RNA, 20 nt, Pseudomonas putida KT2440
cccgcagcuucaacuccacc

SEQ ID NO: 1641679 - RNA, 14 nt, Pseudomonas putida KT2440
cccgcaggccgcag

SEQ ID NO: 1641680 - RNA, 16 nt, Pseudomonas putida KT2440
cccgcaggccgcagcc

SEQ ID NO: 1641681 - RNA, 17 nt, Pseudomonas putida KT2440
cccgcauaaccaccacc

SEQ ID NO: 1641682 - RNA, 22 nt, Pseudomonas putida KT2440
cccgauuccuugcagcgccgca

SEQ ID NO: 1641683 - RNA, 15 nt, Pseudomonas putida KT2440
cccgauggccuugau

SEQ ID NO: 1641684 - RNA, 18 nt, Pseudomonas putida KT2440
cccgaugaucaggccgcu

SEQ ID NO: 1641685 - RNA, 21 nt, Pseudomonas putida KT2440
cccgaucggguacuccaccac

SEQ ID NO: 1641686 - RNA, 13 nt, Pseudomonas putida KT2440
cccgccccugcuu

SEQ ID NO: 1641687 - RNA, 16 nt, Pseudomonas putida KT2440
cccgccccugcuugac

SEQ ID NO: 1641688 - RNA, 14 nt, Pseudomonas putida KT2440
cccgccccucuucc

SEQ ID NO: 1641689 - RNA, 12 nt, Pseudomonas putida KT2440
cccgcccggccu

SEQ ID NO: 1641690 - RNA, 15 nt, Pseudomonas putida KT2440
cccgcccuagcgguc

SEQ ID NO: 1641691 - RNA, 15 nt, Pseudomonas putida KT2440
cccgcccucacucac

SEQ ID NO: 1641692 - RNA, 22 nt, Pseudomonas putida KT2440
cccgccguguucccagcacccc

SEQ ID NO: 1641693 - RNA, 13 nt, Pseudomonas putida KT2440
cccgccggcacuu

SEQ ID NO: 1641694 - RNA, 16 nt, Pseudomonas putida KT2440
cccgccugacgccgcc

SEQ ID NO: 1641695 - RNA, 18 nt, Pseudomonas putida KT2440
cccgccugacgccgccag

SEQ ID NO: 1641696 - RNA, 12 nt, Pseudomonas putida KT2440
cccgccugcuca

SEQ ID NO: 1641697 - RNA, 18 nt, Pseudomonas putida KT2440
cccgcgaaagggccagca

SEQ ID NO: 1641698 - RNA, 19 nt, Pseudomonas putida KT2440
cccgcgaaagggccggccc

SEQ ID NO: 1641699 - RNA, 20 nt, Pseudomonas putida KT2440
cccgcgaaagggccggcccu

SEQ ID NO: 1641700 - RNA, 23 nt, Pseudomonas putida KT2440
cccgcgaaagggccggcccugcu

SEQ ID NO: 1641701 - RNA, 20 nt, Pseudomonas putida KT2440
cccgcgaaagggccgggccu

SEQ ID NO: 1641702 - RNA, 17 nt, Pseudomonas putida KT2440
ccccuggcgcuuuccag

SEQ ID NO: 1641703 - RNA, 18 nt, Pseudomonas putida KT2440
ccccugcgccgccaccug

SEQ ID NO: 1641704 - RNA, 23 nt, Pseudomonas putida KT2440
ccccucauucaaagccugcucca

SEQ ID NO: 1641705 - RNA, 19 nt, Pseudomonas putida KT2440
ccccuuccagcuucugcaa

SEQ ID NO: 1641706 - RNA, 19 nt, Pseudomonas putida KT2440
ccccuuccccaggccgccc

SEQ ID NO: 1641707 - RNA, 21 nt, Pseudomonas putida KT2440
ccccgguaaugcugguggugg

SEQ ID NO: 1641708 - RNA, 19 nt, Pseudomonas putida KT2440
ccccggguaaucagcuuga

SEQ ID NO: 1641709 - RNA, 15 nt, Pseudomonas putida KT2440
ccccggucagcagga

SEQ ID NO: 1641710 - RNA, 16 nt, Pseudomonas putida KT2440
ccccggucagcaggaa

SEQ ID NO: 1641711 - RNA, 14 nt, Pseudomonas putida KT2440
ccccguugcgcagc

SEQ ID NO: 1641712 - RNA, 14 nt, Pseudomonas putida KT2440
ccccguucgcccug

SEQ ID NO: 1641713 - RNA, 19 nt, Pseudomonas putida KT2440
ccccuacgucagcuugcaa

SEQ ID NO: 1641714 - RNA, 13 nt, Pseudomonas putida KT2440
cccgagcaaagcc

SEQ ID NO: 1641715 - RNA, 23 nt, Pseudomonas putida KT2440
cccgagcccccgcugcucgagga

SEQ ID NO: 1641716 - RNA, 22 nt, Pseudomonas putida KT2440
cccgauccucaucguccaccgc

SEQ ID NO: 1641717 - RNA, 19 nt, Pseudomonas putida KT2440
cccgacgccggccugccgc

SEQ ID NO: 1641718 - RNA, 14 nt, Pseudomonas putida KT2440
cccgacugacgcua

SEQ ID NO: 1641719 - RNA, 21 nt, Pseudomonas putida KT2440
cccgacugacgcuacgccgcc

SEQ ID NO: 1641720 - RNA, 14 nt, Pseudomonas putida KT2440
cccgacggcucuug

SEQ ID NO: 1641721 - RNA, 18 nt, Pseudomonas putida KT2440
cccgaacgacacggcagg

SEQ ID NO: 1641722 - RNA, 15 nt, Pseudomonas putida KT2440
cccgaagcagccgcc

SEQ ID NO: 1641723 - RNA, 22 nt, Pseudomonas putida KT2440
ccaugcgggacucgaucugugg

SEQ ID NO: 1641724 - RNA, 20 nt, Pseudomonas putida KT2440
ccaugcgaccaguaccgcgc

SEQ ID NO: 1641725 - RNA, 13 nt, Pseudomonas putida KT2440
ccaugcgcgugcg

SEQ ID NO: 1641726 - RNA, 20 nt, Pseudomonas putida KT2440
ccaugcugcagaaccgccag

SEQ ID NO: 1641727 - RNA, 16 nt, Pseudomonas putida KT2440
ccaugcucggccagcu

SEQ ID NO: 1641728 - RNA, 14 nt, Pseudomonas putida KT2440
ccaugcuuuccagg

SEQ ID NO: 1641729 - RNA, 19 nt, Pseudomonas putida KT2440
ccaugcuuuccaggucggg

SEQ ID NO: 1641730 - RNA, 15 nt, Pseudomonas putida KT2440
ccauucaccagcuuc

SEQ ID NO: 1641731 - RNA, 15 nt, Pseudomonas putida KT2440
ccauugacccgcuug

SEQ ID NO: 1641732 - RNA, 16 nt, Pseudomonas putida KT2440
ccauugagcacucaac

SEQ ID NO: 1641733 - RNA, 22 nt, Pseudomonas putida KT2440
ccauugagcuguuucaugcugc

SEQ ID NO: 1641734 - RNA, 22 nt, Pseudomonas putida KT2440
ccauugagguugacguuguagc

SEQ ID NO: 1641735 - RNA, 22 nt, Pseudomonas putida KT2440
ccauuggccgcgcgcccaucug

SEQ ID NO: 1641736 - RNA, 12 nt, Pseudomonas putida KT2440
ccauugcaggcu

SEQ ID NO: 1641737 - RNA, 16 nt, Pseudomonas putida KT2440
ccauuggggcugcauu

SEQ ID NO: 1641738 - RNA, 19 nt, Pseudomonas putida KT2440
ccauuggggcugcauugca

SEQ ID NO: 1641739 - RNA, 12 nt, Pseudomonas putida KT2440
cccaaccccagc

SEQ ID NO: 1641740 - RNA, 19 nt, Pseudomonas putida KT2440
cccaacccggucccgcccu

SEQ ID NO: 1641741 - RNA, 15 nt, Pseudomonas putida KT2440
cccaauaaaaacaac

SEQ ID NO: 1641742 - RNA, 15 nt, Pseudomonas putida KT2440
cccaauaauaaaaaa

SEQ ID NO: 1641743 - RNA, 19 nt, Pseudomonas putida KT2440
cccaauccucagcgcgugc

SEQ ID NO: 1641744 - RNA, 14 nt, Pseudomonas putida KT2440
cccaaucaccaaug

SEQ ID NO: 1641745 - RNA, 17 nt, Pseudomonas putida KT2440
cccaauaauaaaaaaag

SEQ ID NO: 1641746 - RNA, 20 nt, Pseudomonas putida KT2440
cccaauggacgcgcaagccg

SEQ ID NO: 1641747 - RNA, 16 nt, Pseudomonas putida KT2440
cccaaugggcaccggc

SEQ ID NO: 1641748 - RNA, 16 nt, Pseudomonas putida KT2440
cccaaucgccacacaa

SEQ ID NO: 1641749 - RNA, 18 nt, Pseudomonas putida KT2440
cccaaucggguaaaacgc

SEQ ID NO: 1641750 - RNA, 18 nt, Pseudomonas putida KT2440
cccaaacagcaucaaugc

SEQ ID NO: 1641751 - RNA, 21 nt, Pseudomonas putida KT2440
ccauuggugcccuugaugauc

SEQ ID NO: 1641752 - RNA, 14 nt, Pseudomonas putida KT2440
ccauuuacugcaga

SEQ ID NO: 1641753 - RNA, 15 nt, Pseudomonas putida KT2440
ccauuucaccugcuc

SEQ ID NO: 1641754 - RNA, 23 nt, Pseudomonas putida KT2440
ccauuucccaaagauaccccugc

SEQ ID NO: 1641755 - RNA, 21 nt, Pseudomonas putida KT2440
cccacggcguccaggcccgcc

SEQ ID NO: 1641756 - RNA, 22 nt, Pseudomonas putida KT2440
cccacgcucuguaucgaacagg

SEQ ID NO: 1641757 - RNA, 15 nt, Pseudomonas putida KT2440
cccacgcggguccag

SEQ ID NO: 1641758 - RNA, 19 nt, Pseudomonas putida KT2440
cccacgcggguccagcgcg

SEQ ID NO: 1641759 - RNA, 23 nt, Pseudomonas putida KT2440
cccacgcacaucguccgccgcgc

SEQ ID NO: 1641760 - RNA, 23 nt, Pseudomonas putida KT2440
cccacuuggaaaacagcgcgcga

SEQ ID NO: 1641761 - RNA, 12 nt, Pseudomonas putida KT2440
cccacuucugcc

SEQ ID NO: 1641762 - RNA, 19 nt, Pseudomonas putida KT2440
cccacuucugcggccaggg

SEQ ID NO: 1641763 - RNA, 13 nt, Pseudomonas putida KT2440
cccacucccacag

SEQ ID NO: 1641764 - RNA, 18 nt, Pseudomonas putida KT2440
cccagcagguacaccgcc

SEQ ID NO: 1641765 - RNA, 11 nt, Pseudomonas putida KT2440
cccaccaccag

SEQ ID NO: 1641766 - RNA, 13 nt, Pseudomonas putida KT2440
cccaccaccuucu

SEQ ID NO: 1641767 - RNA, 18 nt, Pseudomonas putida KT2440
cccaccacggccuggccu

SEQ ID NO: 1641768 - RNA, 20 nt, Pseudomonas putida KT2440
cccaccacggccuggccugc

SEQ ID NO: 1641769 - RNA, 20 nt, Pseudomonas putida KT2440
cccacagugcuuccagcagg

SEQ ID NO: 1641770 - RNA, 21 nt, Pseudomonas putida KT2440
cccacagguaugugagcugcg

SEQ ID NO: 1641771 - RNA, 18 nt, Pseudomonas putida KT2440
cccacaggugcagcacag

SEQ ID NO: 1641772 - RNA, 14 nt, Pseudomonas putida KT2440
cccacagguuuagc

SEQ ID NO: 1641773 - RNA, 21 nt, Pseudomonas putida KT2440
cccacaggggccgcgcagccu

SEQ ID NO: 1641774 - RNA, 14 nt, Pseudomonas putida KT2440
cccacaaaggccgc

SEQ ID NO: 1641775 - RNA, 20 nt, Pseudomonas putida KT2440
cccacacccgcgcguugcgg

SEQ ID NO: 1641776 - RNA, 15 nt, Pseudomonas putida KT2440
cccacagaaggcugc

SEQ ID NO: 1641777 - RNA, 12 nt, Pseudomonas putida KT2440
cccaccauggua

SEQ ID NO: 1641778 - RNA, 22 nt, Pseudomonas putida KT2440
cccacccucguaacgagccuug

SEQ ID NO: 1641779 - RNA, 18 nt, Pseudomonas putida KT2440
cccaccccagcguuccug

SEQ ID NO: 1641780 - RNA, 14 nt, Pseudomonas putida KT2440
cccaccgacagccc

SEQ ID NO: 1641781 - RNA, 16 nt, Pseudomonas putida KT2440
cccaccuucacgccau

SEQ ID NO: 1641782 - RNA, 16 nt, Pseudomonas putida KT2440
cccaccggccgccgcc

SEQ ID NO: 1641783 - RNA, 17 nt, Pseudomonas putida KT2440
cccaccggccgccgcca

SEQ ID NO: 1641784 - RNA, 21 nt, Pseudomonas putida KT2440
ccaucccacucauaaugaaaa

SEQ ID NO: 1641785 - RNA, 15 nt, Pseudomonas putida KT2440
ccaucagcagcugcc

SEQ ID NO: 1641786 - RNA, 16 nt, Pseudomonas putida KT2440
ccaucagcagcugccg

SEQ ID NO: 1641787 - RNA, 18 nt, Pseudomonas putida KT2440
ccaucagcagcuguugcu

SEQ ID NO: 1641788 - RNA, 20 nt, Pseudomonas putida KT2440
ccaucagcgccgccaauaac

SEQ ID NO: 1641789 - RNA, 14 nt, Pseudomonas putida KT2440
ccaucaggaacagc

SEQ ID NO: 1641790 - RNA, 13 nt, Pseudomonas putida KT2440
ccaucacggccug

SEQ ID NO: 1641791 - RNA, 14 nt, Pseudomonas putida KT2440
ccaucaccgcccgc

SEQ ID NO: 1641792 - RNA, 19 nt, Pseudomonas putida KT2440
ccaucaccggcgaguccug

SEQ ID NO: 1641793 - RNA, 20 nt, Pseudomonas putida KT2440
ccaucacuuccggcugcagc

SEQ ID NO: 1641794 - RNA, 15 nt, Pseudomonas putida KT2440
ccaugagugcaggca

SEQ ID NO: 1641795 - RNA, 16 nt, Pseudomonas putida KT2440
ccaugagugcaggcau

SEQ ID NO: 1641796 - RNA, 18 nt, Pseudomonas putida KT2440
ccaucuucacggcaagcc

SEQ ID NO: 1641797 - RNA, 14 nt, Pseudomonas putida KT2440
ccaugaucugcccg

SEQ ID NO: 1641798 - RNA, 15 nt, Pseudomonas putida KT2440
ccaugaucgccgccg

SEQ ID NO: 1641799 - RNA, 15 nt, Pseudomonas putida KT2440
ccaugaugaccacca

SEQ ID NO: 1641800 - RNA, 16 nt, Pseudomonas putida KT2440
ccaugaugaccaccag

SEQ ID NO: 1641801 - RNA, 19 nt, Pseudomonas putida KT2440
ccaugauguggcugguggc

SEQ ID NO: 1641802 - RNA, 12 nt, Pseudomonas putida KT2440
ccauccugcugu

SEQ ID NO: 1641803 - RNA, 18 nt, Pseudomonas putida KT2440
ccauccuugaagaacacc

SEQ ID NO: 1641804 - RNA, 19 nt, Pseudomonas putida KT2440
ccauccuugaagaacaccu

SEQ ID NO: 1641805 - RNA, 15 nt, Pseudomonas putida KT2440
ccaucgcacacccug

SEQ ID NO: 1641806 - RNA, 19 nt, Pseudomonas putida KT2440
ccaucgacccgcugcccgu

SEQ ID NO: 1641807 - RNA, 13 nt, Pseudomonas putida KT2440
ccaucgaccuggc

SEQ ID NO: 1641808 - RNA, 20 nt, Pseudomonas putida KT2440
ccaucgcauaugccccaggc

SEQ ID NO: 1641809 - RNA, 21 nt, Pseudomonas putida KT2440
ccaucgcauaugccccaggca

SEQ ID NO: 1641810 - RNA, 21 nt, Pseudomonas putida KT2440
ccaucuccagcucgccgccca

SEQ ID NO: 1641811 - RNA, 18 nt, Pseudomonas putida KT2440
ccaucucaggcccaccag

SEQ ID NO: 1641812 - RNA, 19 nt, Pseudomonas putida KT2440
ccaggucggggugauugca

SEQ ID NO: 1641813 - RNA, 14 nt, Pseudomonas putida KT2440
ccaggucggucagc

SEQ ID NO: 1641814 - RNA, 16 nt, Pseudomonas putida KT2440
ccaggucggucagcac

SEQ ID NO: 1641815 - RNA, 20 nt, Pseudomonas putida KT2440
ccaggucuuccuccgacagc

SEQ ID NO: 1641816 - RNA, 22 nt, Pseudomonas putida KT2440
ccaggugaaucagcggcaggcu

SEQ ID NO: 1641817 - RNA, 14 nt, Pseudomonas putida KT2440
ccaggucggacagg

SEQ ID NO: 1641818 - RNA, 17 nt, Pseudomonas putida KT2440
ccaggucggacaggguc

SEQ ID NO: 1641819 - RNA, 21 nt, Pseudomonas putida KT2440
ccaggucgcgguucgacugcc

SEQ ID NO: 1641820 - RNA, 17 nt, Pseudomonas putida KT2440
ccaggucgauccgggug

SEQ ID NO: 1641821 - RNA, 19 nt, Pseudomonas putida KT2440
ccaggucgccagcaccauc

SEQ ID NO: 1641822 - RNA, 21 nt, Pseudomonas putida KT2440
ccaggucgccggugugcaucc

SEQ ID NO: 1641823 - RNA, 17 nt, Pseudomonas putida KT2440
ccagugcuucacugccg

SEQ ID NO: 1641824 - RNA, 19 nt, Pseudomonas putida KT2440
ccagugcgcccgaggcaau

SEQ ID NO: 1641825 - RNA, 21 nt, Pseudomonas putida KT2440
ccaguucgacgcugcugucca

SEQ ID NO: 1641826 - RNA, 14 nt, Pseudomonas putida KT2440
ccaguuccugcuug

SEQ ID NO: 1641827 - RNA, 17 nt, Pseudomonas putida KT2440
ccaguuccucggccuga

SEQ ID NO: 1641828 - RNA, 17 nt, Pseudomonas putida KT2440
ccaguuucaccugacca

SEQ ID NO: 1641829 - RNA, 14 nt, Pseudomonas putida KT2440
ccauaguugaccag

SEQ ID NO: 1641830 - RNA, 19 nt, Pseudomonas putida KT2440
ccauaguugaccagcacca

SEQ ID NO: 1641831 - RNA, 14 nt, Pseudomonas putida KT2440
ccauaacuccagcg

SEQ ID NO: 1641832 - RNA, 16 nt, Pseudomonas putida KT2440
ccauaacgcccacguu

SEQ ID NO: 1641833 - RNA, 14 nt, Pseudomonas putida KT2440
ccaucaccacaaaa

SEQ ID NO: 1641834 - RNA, 14 nt, Pseudomonas putida KT2440
ccaucaccaaaggc

SEQ ID NO: 1641835 - RNA, 23 nt, Pseudomonas putida KT2440
ccaucaauaccggcaugcccagu

SEQ ID NO: 1641836 - RNA, 15 nt, Pseudomonas putida KT2440
ccagcgggucgucgc

SEQ ID NO: 1641837 - RNA, 23 nt, Pseudomonas putida KT2440
ccagcgggucgucgcccaggcgc

SEQ ID NO: 1641838 - RNA, 20 nt, Pseudomonas putida KT2440
ccagcggucagcaucuucuu

SEQ ID NO: 1641839 - RNA, 15 nt, Pseudomonas putida KT2440
ccagcggucugcugc

SEQ ID NO: 1641840 - RNA, 15 nt, Pseudomonas putida KT2440
ccagcggcagcaagu

SEQ ID NO: 1641841 - RNA, 16 nt, Pseudomonas putida KT2440
ccagcggaucaccgac

SEQ ID NO: 1641842 - RNA, 16 nt, Pseudomonas putida KT2440
ccagcggccgcuugau

SEQ ID NO: 1641843 - RNA, 16 nt, Pseudomonas putida KT2440
ccagcggaauggucga

SEQ ID NO: 1641844 - RNA, 13 nt, Pseudomonas putida KT2440
ccagcgcugcauu

SEQ ID NO: 1641845 - RNA, 20 nt, Pseudomonas putida KT2440
ccagcgcucguaggcuucac

SEQ ID NO: 1641846 - RNA, 17 nt, Pseudomonas putida KT2440
ccagcgcuccagcaacg

SEQ ID NO: 1641847 - RNA, 16 nt, Pseudomonas putida KT2440
ccagcgcgcugcgcaa

SEQ ID NO: 1641848 - RNA, 16 nt, Pseudomonas putida KT2440
ccagcgcggccacgcc

SEQ ID NO: 1641849 - RNA, 22 nt, Pseudomonas putida KT2440
ccagcgcgaucaccagccccuc

SEQ ID NO: 1641850 - RNA, 16 nt, Pseudomonas putida KT2440
ccagcgcgccagcagg

SEQ ID NO: 1641851 - RNA, 16 nt, Pseudomonas putida KT2440
ccagcguuuccggguu

SEQ ID NO: 1641852 - RNA, 19 nt, Pseudomonas putida KT2440
ccagcuacgcgagccaccg

SEQ ID NO: 1641853 - RNA, 16 nt, Pseudomonas putida KT2440
ccagcguucggccagc

SEQ ID NO: 1641854 - RNA, 17 nt, Pseudomonas putida KT2440
ccagcguucucgcucag

SEQ ID NO: 1641855 - RNA, 15 nt, Pseudomonas putida KT2440
ccagcucacgcaagc

SEQ ID NO: 1641856 - RNA, 23 nt, Pseudomonas putida KT2440
ccagcucacgcaagcggcccuga

SEQ ID NO: 1641857 - RNA, 16 nt, Pseudomonas putida KT2440
ccagcguugucccgcc

SEQ ID NO: 1641858 - RNA, 18 nt, Pseudomonas putida KT2440
ccagcuaucucccagccu

SEQ ID NO: 1641859 - RNA, 22 nt, Pseudomonas putida KT2440
ccagcuaucucccagccugggc

SEQ ID NO: 1641860 - RNA, 22 nt, Pseudomonas putida KT2440
ccagcucaaccccaaaccgcuc

SEQ ID NO: 1641861 - RNA, 14 nt, Pseudomonas putida KT2440
ccagcuccuggccg

SEQ ID NO: 1641862 - RNA, 16 nt, Pseudomonas putida KT2440
ccagcuccuggccgcc

SEQ ID NO: 1641863 - RNA, 17 nt, Pseudomonas putida KT2440
ccagcuccuggccgccc

SEQ ID NO: 1641864 - RNA, 20 nt, Pseudomonas putida KT2440
ccagcuccuggccgcccgcc

SEQ ID NO: 1641865 - RNA, 17 nt, Pseudomonas putida KT2440
ccagcuccuucuucacc

SEQ ID NO: 1641866 - RNA, 16 nt, Pseudomonas putida KT2440
ccagcucauccagccg

SEQ ID NO: 1641867 - RNA, 18 nt, Pseudomonas putida KT2440
ccagcucauccagccgcg

SEQ ID NO: 1641868 - RNA, 20 nt, Pseudomonas putida KT2440
ccagcucauccagccgcguc

SEQ ID NO: 1641869 - RNA, 21 nt, Pseudomonas putida KT2440
ccagcgucagggucucgcggc

SEQ ID NO: 1641870 - RNA, 15 nt, Pseudomonas putida KT2440
ccagcgucaccacca

SEQ ID NO: 1641871 - RNA, 17 nt, Pseudomonas putida KT2440
ccagcgucacccguggc

SEQ ID NO: 1641872 - RNA, 22 nt, Pseudomonas putida KT2440
ccagcgucacccguggcagccc

SEQ ID NO: 1641873 - RNA, 14 nt, Pseudomonas putida KT2440
ccagcgguugagau

SEQ ID NO: 1641874 - RNA, 16 nt, Pseudomonas putida KT2440
ccagcgguugagauga

SEQ ID NO: 1641875 - RNA, 14 nt, Pseudomonas putida KT2440
ccagcguaagcugg

SEQ ID NO: 1641876 - RNA, 16 nt, Pseudomonas putida KT2440
ccagcguggccgccaa

SEQ ID NO: 1641877 - RNA, 23 nt, Pseudomonas putida KT2440
ccagcguggccugcaagccggcg

SEQ ID NO: 1641878 - RNA, 17 nt, Pseudomonas putida KT2440
ccagcgugggccgugca

SEQ ID NO: 1641879 - RNA, 22 nt, Pseudomonas putida KT2440
ccagcgugggccgugcaggcgg

SEQ ID NO: 1641880 - RNA, 16 nt, Pseudomonas putida KT2440
ccagcgugaaccggcu

SEQ ID NO: 1641881 - RNA, 21 nt, Pseudomonas putida KT2440
ccagcgucuuuggccugcuug

SEQ ID NO: 1641882 - RNA, 22 nt, Pseudomonas putida KT2440
ccagcgucuuuggccugcuuga

SEQ ID NO: 1641883 - RNA, 15 nt, Pseudomonas putida KT2440
ccagcgugcccgcca

SEQ ID NO: 1641884 - RNA, 18 nt, Pseudomonas putida KT2440
ccagcgugcccgccacac

SEQ ID NO: 1641885 - RNA, 16 nt, Pseudomonas putida KT2440
ccagcgaauagcaaca

SEQ ID NO: 1641886 - RNA, 16 nt, Pseudomonas putida KT2440
ccagccuggccccacc

SEQ ID NO: 1641887 - RNA, 17 nt, Pseudomonas putida KT2440
ccagccuggccccaccc

SEQ ID NO: 1641888 - RNA, 18 nt, Pseudomonas putida KT2440
ccagccuggccccaccca

SEQ ID NO: 1641889 - RNA, 19 nt, Pseudomonas putida KT2440
ccagccugggcugucgccu

SEQ ID NO: 1641890 - RNA, 21 nt, Pseudomonas putida KT2440
ccagccguccucgacccaguc

SEQ ID NO: 1641891 - RNA, 20 nt, Pseudomonas putida KT2440
ccagccgucgauuacccagc

SEQ ID NO: 1641892 - RNA, 19 nt, Pseudomonas putida KT2440
ccagccguggcaacgccac

SEQ ID NO: 1641893 - RNA, 14 nt, Pseudomonas putida KT2440
ccagccuccggccc

SEQ ID NO: 1641894 - RNA, 20 nt, Pseudomonas putida KT2440
ccagccguuguuugucaccc

SEQ ID NO: 1641895 - RNA, 17 nt, Pseudomonas putida KT2440
ccagccucuucuucaag

SEQ ID NO: 1641896 - RNA, 23 nt, Pseudomonas putida KT2440
ccacuccgggugaucauucaggc

SEQ ID NO: 1641897 - RNA, 16 nt, Pseudomonas putida KT2440
ccacuccagccgucga

SEQ ID NO: 1641898 - RNA, 16 nt, Pseudomonas putida KT2440
ccacucggcaaucugc

SEQ ID NO: 1641899 - RNA, 18 nt, Pseudomonas putida KT2440
ccacugaccagcccggcu

SEQ ID NO: 1641900 - RNA, 19 nt, Pseudomonas putida KT2440
ccacugaccagcccggcuc

SEQ ID NO: 1641901 - RNA, 16 nt, Pseudomonas putida KT2440
ccacugaugcgcgucc

SEQ ID NO: 1641902 - RNA, 21 nt, Pseudomonas putida KT2440
ccagccggucauccagcagcu

SEQ ID NO: 1641903 - RNA, 12 nt, Pseudomonas putida KT2440
ccagccggcccg

SEQ ID NO: 1641904 - RNA, 17 nt, Pseudomonas putida KT2440
ccagccggcccggcugg

SEQ ID NO: 1641905 - RNA, 18 nt, Pseudomonas putida KT2440
ccagccggcccggcuggc

SEQ ID NO: 1641906 - RNA, 13 nt, Pseudomonas putida KT2440
ccagcgccaguac

SEQ ID NO: 1641907 - RNA, 15 nt, Pseudomonas putida KT2440
ccagcgcaucggcca

SEQ ID NO: 1641908 - RNA, 13 nt, Pseudomonas putida KT2440
ccagcgccccgcc

SEQ ID NO: 1641909 - RNA, 21 nt, Pseudomonas putida KT2440
ccagcgccuuggccugcucac

SEQ ID NO: 1641910 - RNA, 15 nt, Pseudomonas putida KT2440
ccagcgccugcugcc

SEQ ID NO: 1641911 - RNA, 14 nt, Pseudomonas putida KT2440
ccagcgccuccccc

SEQ ID NO: 1641912 - RNA, 15 nt, Pseudomonas putida KT2440
ccagcgccuccccca

SEQ ID NO: 1641913 - RNA, 12 nt, Pseudomonas putida KT2440
ccagcgccucca

SEQ ID NO: 1641914 - RNA, 13 nt, Pseudomonas putida KT2440
ccagcgccgcgcc

SEQ ID NO: 1641915 - RNA, 20 nt, Pseudomonas putida KT2440
ccagcgccgcgccaccgauc

SEQ ID NO: 1641916 - RNA, 22 nt, Pseudomonas putida KT2440
ccagcgaggcaaucagggcauc

SEQ ID NO: 1641917 - RNA, 13 nt, Pseudomonas putida KT2440
ccagcgaguggcc

SEQ ID NO: 1641918 - RNA, 20 nt, Pseudomonas putida KT2440
ccagcgauaaaccagcagcg

SEQ ID NO: 1641919 - RNA, 16 nt, Pseudomonas putida KT2440
ccagcgaugcugucgg

SEQ ID NO: 1641920 - RNA, 20 nt, Pseudomonas putida KT2440
ccagcgauggcggaucagcg

SEQ ID NO: 1641921 - RNA, 15 nt, Pseudomonas putida KT2440
ccagcgccaccgcgc

SEQ ID NO: 1641922 - RNA, 16 nt, Pseudomonas putida KT2440
ccagcgccaccggcag

SEQ ID NO: 1641923 - RNA, 13 nt, Pseudomonas putida KT2440
ccagcgccagcca

SEQ ID NO: 1641924 - RNA, 15 nt, Pseudomonas putida KT2440
ccagcgcaccacugu

SEQ ID NO: 1641925 - RNA, 21 nt, Pseudomonas putida KT2440
ccaggcuugguuuggccucug

SEQ ID NO: 1641926 - RNA, 22 nt, Pseudomonas putida KT2440
ccaggcuugguuuggccucugg

SEQ ID NO: 1641927 - RNA, 17 nt, Pseudomonas putida KT2440
ccaggcuuucgaccucg

SEQ ID NO: 1641928 - RNA, 17 nt, Pseudomonas putida KT2440
ccagggaaauuggccag

SEQ ID NO: 1641929 - RNA, 18 nt, Pseudomonas putida KT2440
ccagggaagaauugcugg

SEQ ID NO: 1641930 - RNA, 21 nt, Pseudomonas putida KT2440
ccagggcaaaaugcagcaagc

SEQ ID NO: 1641931 - RNA, 13 nt, Pseudomonas putida KT2440
ccagggcaagcaa

SEQ ID NO: 1641932 - RNA, 20 nt, Pseudomonas putida KT2440
ccagggcaagcaaucagaac

SEQ ID NO: 1641933 - RNA, 15 nt, Pseudomonas putida KT2440
ccagggcaucgacca

SEQ ID NO: 1641934 - RNA, 18 nt, Pseudomonas putida KT2440
ccagggcaucggcgcccc

SEQ ID NO: 1641935 - RNA, 19 nt, Pseudomonas putida KT2440
ccagggcaucggcgccccg

SEQ ID NO: 1641936 - RNA, 20 nt, Pseudomonas putida KT2440
ccaggcucgcccgggucagg

SEQ ID NO: 1641937 - RNA, 13 nt, Pseudomonas putida KT2440
ccaggcuagccgg

SEQ ID NO: 1641938 - RNA, 12 nt, Pseudomonas putida KT2440
ccaggcucucca

SEQ ID NO: 1641939 - RNA, 13 nt, Pseudomonas putida KT2440
ccaggcuggcgcu

SEQ ID NO: 1641940 - RNA, 19 nt, Pseudomonas putida KT2440
ccaggcuggcgcuaccccu

SEQ ID NO: 1641941 - RNA, 21 nt, Pseudomonas putida KT2440
ccaggcuggcgcuaccccugu

SEQ ID NO: 1641942 - RNA, 13 nt, Pseudomonas putida KT2440
ccaggcuggccag

SEQ ID NO: 1641943 - RNA, 15 nt, Pseudomonas putida KT2440
ccaggcuggccagca

SEQ ID NO: 1641944 - RNA, 18 nt, Pseudomonas putida KT2440
ccaggcuggccagcaagu

SEQ ID NO: 1641945 - RNA, 19 nt, Pseudomonas putida KT2440
ccaggcugcgcgccauggc

SEQ ID NO: 1641946 - RNA, 14 nt, Pseudomonas putida KT2440
ccagguccaccagc

SEQ ID NO: 1641947 - RNA, 18 nt, Pseudomonas putida KT2440
ccagguccaggccagcuu

SEQ ID NO: 1641948 - RNA, 23 nt, Pseudomonas putida KT2440
ccaggucauccgcacgcauguca

SEQ ID NO: 1641949 - RNA, 16 nt, Pseudomonas putida KT2440
ccagggggcagcugcu

SEQ ID NO: 1641950 - RNA, 16 nt, Pseudomonas putida KT2440
ccagggccuuggccug

SEQ ID NO: 1641951 - RNA, 20 nt, Pseudomonas putida KT2440
ccagggccugaccgcccagc

SEQ ID NO: 1641952 - RNA, 18 nt, Pseudomonas putida KT2440
ccagggcgcaacgcccgc

SEQ ID NO: 1641953 - RNA, 24 nt, Pseudomonas putida KT2440
ccagggcccucaacccucgcccag

SEQ ID NO: 1641954 - RNA, 14 nt, Pseudomonas putida KT2440
ccaggccgcccacc

SEQ ID NO: 1641955 - RNA, 16 nt, Pseudomonas putida KT2440
ccaggccgcccaccca

SEQ ID NO: 1641956 - RNA, 20 nt, Pseudomonas putida KT2440
ccaggcccugacgccagcgc

SEQ ID NO: 1641957 - RNA, 15 nt, Pseudomonas putida KT2440
ccaggcccugcagcg

SEQ ID NO: 1641958 - RNA, 16 nt, Pseudomonas putida KT2440
ccaggcccugcagcgc

SEQ ID NO: 1641959 - RNA, 17 nt, Pseudomonas putida KT2440
ccaggcccugcagcgcu

SEQ ID NO: 1641960 - RNA, 15 nt, Pseudomonas putida KT2440
ccaggcccgacucca

SEQ ID NO: 1641961 - RNA, 14 nt, Pseudomonas putida KT2440
ccaggccauccagc

SEQ ID NO: 1641962 - RNA, 20 nt, Pseudomonas putida KT2440
ccaggcccaccaccggugcg

SEQ ID NO: 1641963 - RNA, 14 nt, Pseudomonas putida KT2440
ccaggcccaccaug

SEQ ID NO: 1641964 - RNA, 18 nt, Pseudomonas putida KT2440
ccaggccguugaucagcg

SEQ ID NO: 1641965 - RNA, 14 nt, Pseudomonas putida KT2440
ccaggcggccagcc

SEQ ID NO: 1641966 - RNA, 15 nt, Pseudomonas putida KT2440
ccaggcggccagcca

SEQ ID NO: 1641967 - RNA, 18 nt, Pseudomonas putida KT2440
ccaggcgcggcagcauga

SEQ ID NO: 1641968 - RNA, 14 nt, Pseudomonas putida KT2440
ccaggcgcggcucg

SEQ ID NO: 1641969 - RNA, 18 nt, Pseudomonas putida KT2440
ccaggcggucgcccaugu

SEQ ID NO: 1641970 - RNA, 24 nt, Pseudomonas putida KT2440
ccaggcggucgcccauguugcgcu

SEQ ID NO: 1641971 - RNA, 15 nt, Pseudomonas putida KT2440
ccaggaucggcacga

SEQ ID NO: 1641972 - RNA, 16 nt, Pseudomonas putida KT2440
ccaggaucacuggccu

SEQ ID NO: 1641973 - RNA, 13 nt, Pseudomonas putida KT2440
ccaggaucaacug

SEQ ID NO: 1641974 - RNA, 19 nt, Pseudomonas putida KT2440
ccaggacuucagcaguucg

SEQ ID NO: 1641975 - RNA, 18 nt, Pseudomonas putida KT2440
ccaggcaguccugcaacu

SEQ ID NO: 1641976 - RNA, 17 nt, Pseudomonas putida KT2440
ccaggcauacagcuggc

SEQ ID NO: 1641977 - RNA, 22 nt, Pseudomonas putida KT2440
ccaggccagcuucgacgaagaa

SEQ ID NO: 1641978 - RNA, 16 nt, Pseudomonas putida KT2440
ccaggcauugcccgcg

SEQ ID NO: 1641979 - RNA, 17 nt, Pseudomonas putida KT2440
ccaggccaaacaggccg

SEQ ID NO: 1641980 - RNA, 15 nt, Pseudomonas putida KT2440
ccaggcacuggccag

SEQ ID NO: 1641981 - RNA, 18 nt, Pseudomonas putida KT2440
ccaggcacuggccagcgg

SEQ ID NO: 1641982 - RNA, 20 nt, Pseudomonas putida KT2440
ccaggcacuggccagcggcg

SEQ ID NO: 1641983 - RNA, 17 nt, Pseudomonas putida KT2440
ccaggcacaccgagcca

SEQ ID NO: 1641984 - RNA, 16 nt, Pseudomonas putida KT2440
ccaggauugccgggcu

SEQ ID NO: 1641985 - RNA, 16 nt, Pseudomonas putida KT2440
ccaggauuggccgcaa

SEQ ID NO: 1641986 - RNA, 18 nt, Pseudomonas putida KT2440
ccaggcaaaaaaaagggg

SEQ ID NO: 1641987 - RNA, 22 nt, Pseudomonas putida KT2440
ccaggcaaaguugagcgccgcg

SEQ ID NO: 1641988 - RNA, 17 nt, Pseudomonas putida KT2440
ccagcugcaucagguag

SEQ ID NO: 1641989 - RNA, 20 nt, Pseudomonas putida KT2440
ccagcugcgcugccugcugg

SEQ ID NO: 1641990 - RNA, 12 nt, Pseudomonas putida KT2440
ccagcugcugcc

SEQ ID NO: 1641991 - RNA, 11 nt, Pseudomonas putida KT2440
ccagcuggcuc

SEQ ID NO: 1641992 - RNA, 15 nt, Pseudomonas putida KT2440
ccagcuggcucaucu

SEQ ID NO: 1641993 - RNA, 20 nt, Pseudomonas putida KT2440
ccagcuggcucaucugccgg

SEQ ID NO: 1641994 - RNA, 11 nt, Pseudomonas putida KT2440
ccagcugaaag

SEQ ID NO: 1641995 - RNA, 23 nt, Pseudomonas putida KT2440
ccagcugaagugccaaggcuuuu

SEQ ID NO: 1641996 - RNA, 17 nt, Pseudomonas putida KT2440
ccagcugcaccaccugc

SEQ ID NO: 1641997 - RNA, 13 nt, Pseudomonas putida KT2440
ccagcucggcugg

SEQ ID NO: 1641998 - RNA, 17 nt, Pseudomonas putida KT2440
ccagcucggcuggcugu

SEQ ID NO: 1641999 - RNA, 16 nt, Pseudomonas putida KT2440
ccagcucggccuugcg

SEQ ID NO: 1642000 - RNA, 17 nt, Pseudomonas putida KT2440
ccagcucggcaaggcgu

SEQ ID NO: 1642001 - RNA, 17 nt, Pseudomonas putida KT2440
ccagcucggcaguggcg

SEQ ID NO: 1642002 - RNA, 22 nt, Pseudomonas putida KT2440
ccaggaacgcugccuccacacc

SEQ ID NO: 1642003 - RNA, 16 nt, Pseudomonas putida KT2440
ccaggaacggcccgcg

SEQ ID NO: 1642004 - RNA, 17 nt, Pseudomonas putida KT2440
ccaggaaggccucgccg

SEQ ID NO: 1642005 - RNA, 20 nt, Pseudomonas putida KT2440
ccaggaagucgauguucagc

SEQ ID NO: 1642006 - RNA, 18 nt, Pseudomonas putida KT2440
ccaggaacagcgcagcca

SEQ ID NO: 1642007 - RNA, 21 nt, Pseudomonas putida KT2440
ccagcuugacggugcgcgcca

SEQ ID NO: 1642008 - RNA, 16 nt, Pseudomonas putida KT2440
ccagcuugccaccauc

SEQ ID NO: 1642009 - RNA, 18 nt, Pseudomonas putida KT2440
ccagcuugccgucgcugg

SEQ ID NO: 1642010 - RNA, 17 nt, Pseudomonas putida KT2440
ccagcuugaagcggccu

SEQ ID NO: 1642011 - RNA, 18 nt, Pseudomonas putida KT2440
ccagcuugugaucccgcg

SEQ ID NO: 1642012 - RNA, 21 nt, Pseudomonas putida KT2440
ccagcuuggcaggcuucauga

SEQ ID NO: 1642013 - RNA, 14 nt, Pseudomonas putida KT2440
ccagcuuggucagg

SEQ ID NO: 1642014 - RNA, 15 nt, Pseudomonas putida KT2440
ccagcuuggucaggg

SEQ ID NO: 1642015 - RNA, 13 nt, Pseudomonas putida KT2440
ccagcuugugccg

SEQ ID NO: 1642016 - RNA, 15 nt, Pseudomonas putida KT2440
cauuucgaagcuguc

SEQ ID NO: 1642017 - RNA, 20 nt, Pseudomonas putida KT2440
cauuucgaagcugucuucuu

SEQ ID NO: 1642018 - RNA, 19 nt, Pseudomonas putida KT2440
cauuucggugaagaucgcc

SEQ ID NO: 1642019 - RNA, 15 nt, Pseudomonas putida KT2440
cauuucccuacagcc

SEQ ID NO: 1642020 - RNA, 11 nt, Pseudomonas putida KT2440
cauuucaggcu

SEQ ID NO: 1642021 - RNA, 14 nt, Pseudomonas putida KT2440
cauuucaccugcuc

SEQ ID NO: 1642022 - RNA, 21 nt, Pseudomonas putida KT2440
cauuucacgcacggccuuccc

SEQ ID NO: 1642023 - RNA, 17 nt, Pseudomonas putida KT2440
cauuucacagcaaaaaa

SEQ ID NO: 1642024 - RNA, 18 nt, Pseudomonas putida KT2440
cauuugcucgacaaaccc

SEQ ID NO: 1642025 - RNA, 19 nt, Pseudomonas putida KT2440
cauuugcagcacaaggcug

SEQ ID NO: 1642026 - RNA, 16 nt, Pseudomonas putida KT2440
cauuucguccaggcuc

SEQ ID NO: 1642027 - RNA, 15 nt, Pseudomonas putida KT2440
cauuucugcaugucc

SEQ ID NO: 1642028 - RNA, 19 nt, Pseudomonas putida KT2440
cauuucuucagcaggaagc

SEQ ID NO: 1642029 - RNA, 16 nt, Pseudomonas putida KT2440
cauuggccgcgcgccc

SEQ ID NO: 1642030 - RNA, 23 nt, Pseudomonas putida KT2440
cauuggcaauugcggguguggcc

SEQ ID NO: 1642031 - RNA, 21 nt, Pseudomonas putida KT2440
cauuggcggcaggcgcagcug

SEQ ID NO: 1642032 - RNA, 19 nt, Pseudomonas putida KT2440
cauuggggcugcauugcag

SEQ ID NO: 1642033 - RNA, 22 nt, Pseudomonas putida KT2440
cauuggucgugcauguagccaa

SEQ ID NO: 1642034 - RNA, 16 nt, Pseudomonas putida KT2440
cauugucauugcccaa

SEQ ID NO: 1642035 - RNA, 20 nt, Pseudomonas putida KT2440
cauuguugcaacgcagcgcg

SEQ ID NO: 1642036 - RNA, 18 nt, Pseudomonas putida KT2440
cauuguucuggccaccga

SEQ ID NO: 1642037 - RNA, 14 nt, Pseudomonas putida KT2440
cauugugcgccccc

SEQ ID NO: 1642038 - RNA, 19 nt, Pseudomonas putida KT2440
cauucgcgcccgcagugca

SEQ ID NO: 1642039 - RNA, 21 nt, Pseudomonas putida KT2440
cauucgcggguaaacccgcuc

SEQ ID NO: 1642040 - RNA, 19 nt, Pseudomonas putida KT2440
cauucgcgggugaacccgc

SEQ ID NO: 1642041 - RNA, 16 nt, Pseudomonas putida KT2440
cauucgcgggcaagcc

SEQ ID NO: 1642042 - RNA, 13 nt, Pseudomonas putida KT2440
cauucgcgggcau

SEQ ID NO: 1642043 - RNA, 20 nt, Pseudomonas putida KT2440
cauucggugacgaucaccag

SEQ ID NO: 1642044 - RNA, 21 nt, Pseudomonas putida KT2440
cauugcaagguccuuguaaga

SEQ ID NO: 1642045 - RNA, 21 nt, Pseudomonas putida KT2440
cauugcccgcgauagcaaacc

SEQ ID NO: 1642046 - RNA, 16 nt, Pseudomonas putida KT2440
cauugcccaagcgcuc

SEQ ID NO: 1642047 - RNA, 21 nt, Pseudomonas putida KT2440
cauugcccaagcgcuccgcca

SEQ ID NO: 1642048 - RNA, 21 nt, Pseudomonas putida KT2440
cauugcagggcggccucggcc

SEQ ID NO: 1642049 - RNA, 20 nt, Pseudomonas putida KT2440
cauugccaacagcaguugcu

SEQ ID NO: 1642050 - RNA, 23 nt, Pseudomonas putida KT2440
cauugccaacagcaguugcugcu

SEQ ID NO: 1642051 - RNA, 23 nt, Pseudomonas putida KT2440
cauugcggcugaauccuagcuuc

SEQ ID NO: 1642052 - RNA, 21 nt, Pseudomonas putida KT2440
cauugcuggaguguaaccaug

SEQ ID NO: 1642053 - RNA, 17 nt, Pseudomonas putida KT2440
cauugcugaucccugcc

SEQ ID NO: 1642054 - RNA, 17 nt, Pseudomonas putida KT2440
cauugcuaauuucaggu

SEQ ID NO: 1642055 - RNA, 15 nt, Pseudomonas putida KT2440
cauucgccggcaagc

SEQ ID NO: 1642056 - RNA, 16 nt, Pseudomonas putida KT2440
cauucgccggcaagcu

SEQ ID NO: 1642057 - RNA, 18 nt, Pseudomonas putida KT2440
cauucgcccgcaccgccg

SEQ ID NO: 1642058 - RNA, 17 nt, Pseudomonas putida KT2440
cauucgcauuaccagca

SEQ ID NO: 1642059 - RNA, 18 nt, Pseudomonas putida KT2440
cauucgcauuaccagcac

SEQ ID NO: 1642060 - RNA, 16 nt, Pseudomonas putida KT2440
cauucgauagccugca

SEQ ID NO: 1642061 - RNA, 15 nt, Pseudomonas putida KT2440
cauuccguuggccac

SEQ ID NO: 1642062 - RNA, 19 nt, Pseudomonas putida KT2440
cauuccgccgucaccgccg

SEQ ID NO: 1642063 - RNA, 19 nt, Pseudomonas putida KT2440
cauucagcuuuggcuauca

SEQ ID NO: 1642064 - RNA, 14 nt, Pseudomonas putida KT2440
cauucaggccaucu

SEQ ID NO: 1642065 - RNA, 22 nt, Pseudomonas putida KT2440
cauucaggcacggcaccagcac

SEQ ID NO: 1642066 - RNA, 13 nt, Pseudomonas putida KT2440
cauucaaagccug

SEQ ID NO: 1642067 - RNA, 16 nt, Pseudomonas putida KT2440
cauucaaagccugcuc

SEQ ID NO: 1642068 - RNA, 21 nt, Pseudomonas putida KT2440
caugugcggguucucccccau

SEQ ID NO: 1642069 - RNA, 23 nt, Pseudomonas putida KT2440
caugugcucggguucguacaggu

SEQ ID NO: 1642070 - RNA, 20 nt, Pseudomonas putida KT2440
caugugccuggcccggcccg

SEQ ID NO: 1642071 - RNA, 12 nt, Pseudomonas putida KT2440
caugugccaggu

SEQ ID NO: 1642072 - RNA, 15 nt, Pseudomonas putida KT2440
cauuagaaaauggcu

SEQ ID NO: 1642073 - RNA, 15 nt, Pseudomonas putida KT2440
cauuacgcggcagca

SEQ ID NO: 1642074 - RNA, 16 nt, Pseudomonas putida KT2440
cauuacgcggcagcag

SEQ ID NO: 1642075 - RNA, 18 nt, Pseudomonas putida KT2440
cauuacgcggcagcagca

SEQ ID NO: 1642076 - RNA, 23 nt, Pseudomonas putida KT2440
cauuacgcggcagcagcagcccc

SEQ ID NO: 1642077 - RNA, 22 nt, Pseudomonas putida KT2440
caugcugcugcagcacugccug

SEQ ID NO: 1642078 - RNA, 17 nt, Pseudomonas putida KT2440
caugcugcagaaccgcc

SEQ ID NO: 1642079 - RNA, 17 nt, Pseudomonas putida KT2440
caugcugccaggcaaag

SEQ ID NO: 1642080 - RNA, 18 nt, Pseudomonas putida KT2440
caugcugccaggcaaagu

SEQ ID NO: 1642081 - RNA, 22 nt, Pseudomonas putida KT2440
caugcugaugcgguagugcagg

SEQ ID NO: 1642082 - RNA, 22 nt, Pseudomonas putida KT2440
caugcucggccagcucgccaaa

SEQ ID NO: 1642083 - RNA, 22 nt, Pseudomonas putida KT2440
caugcucggcggugccugcagc

SEQ ID NO: 1642084 - RNA, 14 nt, Pseudomonas putida KT2440
caugcucaggaaca

SEQ ID NO: 1642085 - RNA, 15 nt, Pseudomonas putida KT2440
caugcucaucgcggc

SEQ ID NO: 1642086 - RNA, 13 nt, Pseudomonas putida KT2440
caugcucaugcgc

SEQ ID NO: 1642087 - RNA, 18 nt, Pseudomonas putida KT2440
caugcuccugcgccaccu

SEQ ID NO: 1642088 - RNA, 14 nt, Pseudomonas putida KT2440
caucuucaccuugc

SEQ ID NO: 1642089 - RNA, 15 nt, Pseudomonas putida KT2440
caucuuccugccacu

SEQ ID NO: 1642090 - RNA, 13 nt, Pseudomonas putida KT2440
caucuucgcgcuc

SEQ ID NO: 1642091 - RNA, 18 nt, Pseudomonas putida KT2440
caucuuccagccugcagc

SEQ ID NO: 1642092 - RNA, 11 nt, Pseudomonas putida KT2440
caugcugugcc

SEQ ID NO: 1642093 - RNA, 14 nt, Pseudomonas putida KT2440
caugcuggccagga

SEQ ID NO: 1642094 - RNA, 15 nt, Pseudomonas putida KT2440
caugguagauaagag

SEQ ID NO: 1642095 - RNA, 22 nt, Pseudomonas putida KT2440
cauggucgcguuguucagcagc

SEQ ID NO: 1642096 - RNA, 17 nt, Pseudomonas putida KT2440
caugggucacucccggg

SEQ ID NO: 1642097 - RNA, 19 nt, Pseudomonas putida KT2440
cauggcuugcguuucuuca

SEQ ID NO: 1642098 - RNA, 22 nt, Pseudomonas putida KT2440
cauggccgccacaugcugcgcc

SEQ ID NO: 1642099 - RNA, 21 nt, Pseudomonas putida KT2440
cauggccacggugucggacag

SEQ ID NO: 1642100 - RNA, 22 nt, Pseudomonas putida KT2440
cauggccacggugucggacagg

SEQ ID NO: 1642101 - RNA, 13 nt, Pseudomonas putida KT2440
cauggccagccgg

SEQ ID NO: 1642102 - RNA, 15 nt, Pseudomonas putida KT2440
cauggccaguuccug

SEQ ID NO: 1642103 - RNA, 16 nt, Pseudomonas putida KT2440
cauggcuaagccaagc

SEQ ID NO: 1642104 - RNA, 18 nt, Pseudomonas putida KT2440
cauggcucaacuggcagg

SEQ ID NO: 1642105 - RNA, 19 nt, Pseudomonas putida KT2440
cauggcucaacuggcaggg

SEQ ID NO: 1642106 - RNA, 16 nt, Pseudomonas putida KT2440
cauggcucacacccag

SEQ ID NO: 1642107 - RNA, 18 nt, Pseudomonas putida KT2440
cauggcucacacccaggc

SEQ ID NO: 1642108 - RNA, 16 nt, Pseudomonas putida KT2440
cauguagccaaucauc

SEQ ID NO: 1642109 - RNA, 23 nt, Pseudomonas putida KT2440
cauguagccaaucaucuugccau

SEQ ID NO: 1642110 - RNA, 18 nt, Pseudomonas putida KT2440
cauguccuuggcccagcc

SEQ ID NO: 1642111 - RNA, 14 nt, Pseudomonas putida KT2440
cauguccuugcugc

SEQ ID NO: 1642112 - RNA, 16 nt, Pseudomonas putida KT2440
cauguccugaagcagg

SEQ ID NO: 1642113 - RNA, 18 nt, Pseudomonas putida KT2440
cauguccugcugcaggcu

SEQ ID NO: 1642114 - RNA, 20 nt, Pseudomonas putida KT2440
cauguccugcugcaggcucu

SEQ ID NO: 1642115 - RNA, 16 nt, Pseudomonas putida KT2440
caugucggcagccagg

SEQ ID NO: 1642116 - RNA, 15 nt, Pseudomonas putida KT2440
ccacggccuggccug

SEQ ID NO: 1642117 - RNA, 23 nt, Pseudomonas putida KT2440
ccacggccuucuucacgcaugua

SEQ ID NO: 1642118 - RNA, 13 nt, Pseudomonas putida KT2440
ccacggccgccaa

SEQ ID NO: 1642119 - RNA, 21 nt, Pseudomonas putida KT2440
ccacggcaauucgccggcagc

SEQ ID NO: 1642120 - RNA, 17 nt, Pseudomonas putida KT2440
ccacggaaggccacgcc

SEQ ID NO: 1642121 - RNA, 15 nt, Pseudomonas putida KT2440
ccacgcucgugcagg

SEQ ID NO: 1642122 - RNA, 14 nt, Pseudomonas putida KT2440
ccacgcuccagucg

SEQ ID NO: 1642123 - RNA, 19 nt, Pseudomonas putida KT2440
ccacgcgggcuaugcgauu

SEQ ID NO: 1642124 - RNA, 16 nt, Pseudomonas putida KT2440
ccacgcggguccagcg

SEQ ID NO: 1642125 - RNA, 16 nt, Pseudomonas putida KT2440
ccacgcuagucaagcu

SEQ ID NO: 1642126 - RNA, 21 nt, Pseudomonas putida KT2440
ccacgcuagucaagcugcgcc

SEQ ID NO: 1642127 - RNA, 12 nt, Pseudomonas putida KT2440
ccacgccgccag

SEQ ID NO: 1642128 - RNA, 18 nt, Pseudomonas putida KT2440
ccacgcgcaaaugcuugc

SEQ ID NO: 1642129 - RNA, 16 nt, Pseudomonas putida KT2440
ccacgcgcaggccacg

SEQ ID NO: 1642130 - RNA, 22 nt, Pseudomonas putida KT2440
ccacgcaccagggcuggcagcg

SEQ ID NO: 1642131 - RNA, 19 nt, Pseudomonas putida KT2440
ccacgcacaucacguuugg

SEQ ID NO: 1642132 - RNA, 20 nt, Pseudomonas putida KT2440
ccacgcacaucguccgccgc

SEQ ID NO: 1642133 - RNA, 14 nt, Pseudomonas putida KT2440
ccacgcccauggcu

SEQ ID NO: 1642134 - RNA, 16 nt, Pseudomonas putida KT2440
ccacgcccaacccagc

SEQ ID NO: 1642135 - RNA, 18 nt, Pseudomonas putida KT2440
ccacgcccaacccagcca

SEQ ID NO: 1642136 - RNA, 17 nt, Pseudomonas putida KT2440
ccacgcccuggcccgcc

SEQ ID NO: 1642137 - RNA, 23 nt, Pseudomonas putida KT2440
ccacgcccuggcccgccgccacc

SEQ ID NO: 1642138 - RNA, 12 nt, Pseudomonas putida KT2440
ccacgcccggcc

SEQ ID NO: 1642139 - RNA, 17 nt, Pseudomonas putida KT2440
ccacgcccgccggcacu

SEQ ID NO: 1642140 - RNA, 23 nt, Pseudomonas putida KT2440
ccacgcccgccggcacuuccucg

SEQ ID NO: 1642141 - RNA, 14 nt, Pseudomonas putida KT2440
ccacguucccgcca

SEQ ID NO: 1642142 - RNA, 16 nt, Pseudomonas putida KT2440
ccacguucugcagccu

SEQ ID NO: 1642143 - RNA, 16 nt, Pseudomonas putida KT2440
ccacguccggccagca

SEQ ID NO: 1642144 - RNA, 19 nt, Pseudomonas putida KT2440
ccacguccggccagcaaca

SEQ ID NO: 1642145 - RNA, 20 nt, Pseudomonas putida KT2440
ccacguccggccagcaacag

SEQ ID NO: 1642146 - RNA, 20 nt, Pseudomonas putida KT2440
ccacuaccgcaaaugcugcc

SEQ ID NO: 1642147 - RNA, 21 nt, Pseudomonas putida KT2440
ccacuaagaagcaaccgcugc

SEQ ID NO: 1642148 - RNA, 22 nt, Pseudomonas putida KT2440
ccacucauaaugaaaacccuuc

SEQ ID NO: 1642149 - RNA, 18 nt, Pseudomonas putida KT2440
ccacguagugcuucugcc

SEQ ID NO: 1642150 - RNA, 23 nt, Pseudomonas putida KT2440
ccacguccacuaccuccagcccg

SEQ ID NO: 1642151 - RNA, 13 nt, Pseudomonas putida KT2440
ccacgucacgcac

SEQ ID NO: 1642152 - RNA, 18 nt, Pseudomonas putida KT2440
ccacgucacgcaccaugu

SEQ ID NO: 1642153 - RNA, 22 nt, Pseudomonas putida KT2440
ccacgguacuuggcgcugucgg

SEQ ID NO: 1642154 - RNA, 18 nt, Pseudomonas putida KT2440
ccacggcggcgaucagcg

SEQ ID NO: 1642155 - RNA, 20 nt, Pseudomonas putida KT2440
ccacggcguccaggcccgcc

SEQ ID NO: 1642156 - RNA, 22 nt, Pseudomonas putida KT2440
ccacggcguccaggcccgccag

SEQ ID NO: 1642157 - RNA, 14 nt, Pseudomonas putida KT2440
ccaccaccgaccgc

SEQ ID NO: 1642158 - RNA, 14 nt, Pseudomonas putida KT2440
ccaccacccgcugg

SEQ ID NO: 1642159 - RNA, 15 nt, Pseudomonas putida KT2440
ccaccacccugucgu

SEQ ID NO: 1642160 - RNA, 18 nt, Pseudomonas putida KT2440
ccacagggaccucacagc

SEQ ID NO: 1642161 - RNA, 11 nt, Pseudomonas putida KT2440
ccacagggcaa

SEQ ID NO: 1642162 - RNA, 22 nt, Pseudomonas putida KT2440
ccacagggcaaacaccuugccc

SEQ ID NO: 1642163 - RNA, 14 nt, Pseudomonas putida KT2440
ccacaggggccgcg

SEQ ID NO: 1642164 - RNA, 20 nt, Pseudomonas putida KT2440
ccacaggcacaggcccagca

SEQ ID NO: 1642165 - RNA, 21 nt, Pseudomonas putida KT2440
ccacaggcacaggcccagcaa

SEQ ID NO: 1642166 - RNA, 23 nt, Pseudomonas putida KT2440
ccacaggcacaggcccagcaaca

SEQ ID NO: 1642167 - RNA, 21 nt, Pseudomonas putida KT2440
ccaccaccgcguacagcugcu

SEQ ID NO: 1642168 - RNA, 24 nt, Pseudomonas putida KT2440
ccaccaccggugcguacucgacca

SEQ ID NO: 1642169 - RNA, 12 nt, Pseudomonas putida KT2440
ccaccaccuucu

SEQ ID NO: 1642170 - RNA, 18 nt, Pseudomonas putida KT2440
ccaccacgaacgccccca

SEQ ID NO: 1642171 - RNA, 16 nt, Pseudomonas putida KT2440
ccaccaccugcagggu

SEQ ID NO: 1642172 - RNA, 17 nt, Pseudomonas putida KT2440
ccaccagcacugcugcg

SEQ ID NO: 1642173 - RNA, 23 nt, Pseudomonas putida KT2440
ccaccagaugaccaaagaucagc

SEQ ID NO: 1642174 - RNA, 12 nt, Pseudomonas putida KT2440
ccaccagcaaca

SEQ ID NO: 1642175 - RNA, 17 nt, Pseudomonas putida KT2440
ccaccacggccuggccu

SEQ ID NO: 1642176 - RNA, 17 nt, Pseudomonas putida KT2440
ccaccacguagugcuuc

SEQ ID NO: 1642177 - RNA, 19 nt, Pseudomonas putida KT2440
ccaccaggcgcggcagcau

SEQ ID NO: 1642178 - RNA, 18 nt, Pseudomonas putida KT2440
ccaccaggccgaucacca

SEQ ID NO: 1642179 - RNA, 23 nt, Pseudomonas putida KT2440
ccaccaggucgguagggaucacc

SEQ ID NO: 1642180 - RNA, 19 nt, Pseudomonas putida KT2440
ccaccaguugguaaaacac

SEQ ID NO: 1642181 - RNA, 13 nt, Pseudomonas putida KT2440
ccaccagugcuuc

SEQ ID NO: 1642182 - RNA, 16 nt, Pseudomonas putida KT2440
ccaccagugcuuccag

SEQ ID NO: 1642183 - RNA, 20 nt, Pseudomonas putida KT2440
ccaccaugcgaugguacagc

SEQ ID NO: 1642184 - RNA, 16 nt, Pseudomonas putida KT2440
ccaccaugcucggcca

SEQ ID NO: 1642185 - RNA, 21 nt, Pseudomonas putida KT2440
ccaccaugcucggccagcucg

SEQ ID NO: 1642186 - RNA, 16 nt, Pseudomonas putida KT2440
ccacccaaccgcgcca

SEQ ID NO: 1642187 - RNA, 15 nt, Pseudomonas putida KT2440
ccaccauucccugca

SEQ ID NO: 1642188 - RNA, 19 nt, Pseudomonas putida KT2440
ccaccaucggccaggaaaa

SEQ ID NO: 1642189 - RNA, 20 nt, Pseudomonas putida KT2440
ccacccucgcacuccgcccg

SEQ ID NO: 1642190 - RNA, 18 nt, Pseudomonas putida KT2440
ccacccugaugcagcagu

SEQ ID NO: 1642191 - RNA, 22 nt, Pseudomonas putida KT2440
ccacccugaugcagcagugcca

SEQ ID NO: 1642192 - RNA, 16 nt, Pseudomonas putida KT2440
ccacccggucccgccc

SEQ ID NO: 1642193 - RNA, 20 nt, Pseudomonas putida KT2440
ccacgaucacgcccgggcca

SEQ ID NO: 1642194 - RNA, 21 nt, Pseudomonas putida KT2440
ccacgaugccugggcgguccu

SEQ ID NO: 1642195 - RNA, 18 nt, Pseudomonas putida KT2440
ccacgaugccuucgacca

SEQ ID NO: 1642196 - RNA, 15 nt, Pseudomonas putida KT2440
ccacgcacagcugug

SEQ ID NO: 1642197 - RNA, 20 nt, Pseudomonas putida KT2440
ccacgaaucgauaccugggu

SEQ ID NO: 1642198 - RNA, 22 nt, Pseudomonas putida KT2440
ccaccugccaacgcaccgacca

SEQ ID NO: 1642199 - RNA, 23 nt, Pseudomonas putida KT2440
ccaccugccaacgcaccgaccac

SEQ ID NO: 1642200 - RNA, 19 nt, Pseudomonas putida KT2440
ccaccugaugcaccaggcc

SEQ ID NO: 1642201 - RNA, 23 nt, Pseudomonas putida KT2440
ccaccguauuaaggcaaguggaa

SEQ ID NO: 1642202 - RNA, 14 nt, Pseudomonas putida KT2440
ccaccuaucaggag

SEQ ID NO: 1642203 - RNA, 19 nt, Pseudomonas putida KT2440
ccaccucaucccccggccc

SEQ ID NO: 1642204 - RNA, 15 nt, Pseudomonas putida KT2440
ccaccuccaccccgc

SEQ ID NO: 1642205 - RNA, 17 nt, Pseudomonas putida KT2440
ccaccuccccaaucacc

SEQ ID NO: 1642206 - RNA, 14 nt, Pseudomonas putida KT2440
ccaccggcuuccag

SEQ ID NO: 1642207 - RNA, 15 nt, Pseudomonas putida KT2440
ccaccggcuccaccu

SEQ ID NO: 1642208 - RNA, 16 nt, Pseudomonas putida KT2440
ccacagcugcacaucu

SEQ ID NO: 1642209 - RNA, 21 nt, Pseudomonas putida KT2440
ccacaggaaugucaccgcggc

SEQ ID NO: 1642210 - RNA, 21 nt, Pseudomonas putida KT2440
ccacaggaauuacgcaggcuc

SEQ ID NO: 1642211 - RNA, 23 nt, Pseudomonas putida KT2440
ccacaggaauuacgcaggcucca

SEQ ID NO: 1642212 - RNA, 14 nt, Pseudomonas putida KT2440
ccacaggaaucacc

SEQ ID NO: 1642213 - RNA, 20 nt, Pseudomonas putida KT2440
ccacaggaaucaccagaccu

SEQ ID NO: 1642214 - RNA, 16 nt, Pseudomonas putida KT2440
ccacagcgccugcugc

SEQ ID NO: 1642215 - RNA, 13 nt, Pseudomonas putida KT2440
ccacagccuccag

SEQ ID NO: 1642216 - RNA, 22 nt, Pseudomonas putida KT2440
ccacagccgagggcaugggcca

SEQ ID NO: 1642217 - RNA, 18 nt, Pseudomonas putida KT2440
ccacaccaaagucagcca

SEQ ID NO: 1642218 - RNA, 16 nt, Pseudomonas putida KT2440
ccacacaccccagaac

SEQ ID NO: 1642219 - RNA, 15 nt, Pseudomonas putida KT2440
ccacacacccgggcc

SEQ ID NO: 1642220 - RNA, 18 nt, Pseudomonas putida KT2440
ccacacaccgcaacccag

SEQ ID NO: 1642221 - RNA, 13 nt, Pseudomonas putida KT2440
ccacacccgcuac

SEQ ID NO: 1642222 - RNA, 20 nt, Pseudomonas putida KT2440
ccacacccucguccccgcgc

SEQ ID NO: 1642223 - RNA, 21 nt, Pseudomonas putida KT2440
ccacacccucguccccgcgcu

SEQ ID NO: 1642224 - RNA, 13 nt, Pseudomonas putida KT2440
ccaaucuccagcc

SEQ ID NO: 1642225 - RNA, 19 nt, Pseudomonas putida KT2440
ccaaugcugccuuuuccug

SEQ ID NO: 1642226 - RNA, 19 nt, Pseudomonas putida KT2440
ccaauggcgaaccccaguu

SEQ ID NO: 1642227 - RNA, 18 nt, Pseudomonas putida KT2440
ccaauugguuaaaagcca

SEQ ID NO: 1642228 - RNA, 21 nt, Pseudomonas putida KT2440
ccaauuugcggccauugaggu

SEQ ID NO: 1642229 - RNA, 18 nt, Pseudomonas putida KT2440
ccaauuuggccagcuucu

SEQ ID NO: 1642230 - RNA, 15 nt, Pseudomonas putida KT2440
ccaaucagguuguuc

SEQ ID NO: 1642231 - RNA, 19 nt, Pseudomonas putida KT2440
ccaaucggguaaaacgccc

SEQ ID NO: 1642232 - RNA, 23 nt, Pseudomonas putida KT2440
ccaaucggguaaaacgccccccg

SEQ ID NO: 1642233 - RNA, 22 nt, Pseudomonas putida KT2440
ccaaucgggugaggaugaggga

SEQ ID NO: 1642234 - RNA, 17 nt, Pseudomonas putida KT2440
ccaaucgcugugcaaca

SEQ ID NO: 1642235 - RNA, 17 nt, Pseudomonas putida KT2440
ccaaucgccgcaaccgc

SEQ ID NO: 1642236 - RNA, 15 nt, Pseudomonas putida KT2440
ccaaucgaucugcuc

SEQ ID NO: 1642237 - RNA, 24 nt, Pseudomonas putida KT2440
ccaaucaacccguucaggucauug

SEQ ID NO: 1642238 - RNA, 16 nt, Pseudomonas putida KT2440
ccaagugcuaaugcuc

SEQ ID NO: 1642239 - RNA, 21 nt, Pseudomonas putida KT2440
ccaagugaccggaauguuacc

SEQ ID NO: 1642240 - RNA, 14 nt, Pseudomonas putida KT2440
ccaaggcgguggag

SEQ ID NO: 1642241 - RNA, 13 nt, Pseudomonas putida KT2440
ccaauagcccgcu

SEQ ID NO: 1642242 - RNA, 15 nt, Pseudomonas putida KT2440
ccaaggccugcacca

SEQ ID NO: 1642243 - RNA, 17 nt, Pseudomonas putida KT2440
ccaaggccaacugcgcc

SEQ ID NO: 1642244 - RNA, 20 nt, Pseudomonas putida KT2440
ccaaggccaacugcgcccgc

SEQ ID NO: 1642245 - RNA, 16 nt, Pseudomonas putida KT2440
ccaaggcaccaacugc

SEQ ID NO: 1642246 - RNA, 18 nt, Pseudomonas putida KT2440
ccaaggaccagacccgcu

SEQ ID NO: 1642247 - RNA, 18 nt, Pseudomonas putida KT2440
ccaaggaacugcgcugcc

SEQ ID NO: 1642248 - RNA, 15 nt, Pseudomonas putida KT2440
ccaacugcucuacca

SEQ ID NO: 1642249 - RNA, 23 nt, Pseudomonas putida KT2440
ccaacugcucuaccaacugagcu

SEQ ID NO: 1642250 - RNA, 16 nt, Pseudomonas putida KT2440
ccaacugcgcccgccc

SEQ ID NO: 1642251 - RNA, 18 nt, Pseudomonas putida KT2440
ccaacugcgcccgccccu

SEQ ID NO: 1642252 - RNA, 21 nt, Pseudomonas putida KT2440
ccaacugcaauucgugaacca

SEQ ID NO: 1642253 - RNA, 15 nt, Pseudomonas putida KT2440
ccaacggcacucgaa

SEQ ID NO: 1642254 - RNA, 14 nt, Pseudomonas putida KT2440
ccaacgcagcaugc

SEQ ID NO: 1642255 - RNA, 12 nt, Pseudomonas putida KT2440
ccaacgccccag

SEQ ID NO: 1642256 - RNA, 20 nt, Pseudomonas putida KT2440
ccaacgccgauagccagcug

SEQ ID NO: 1642257 - RNA, 14 nt, Pseudomonas putida KT2440
ccaaagucagccag

SEQ ID NO: 1642258 - RNA, 16 nt, Pseudomonas putida KT2440
ccaaagucagccagcc

SEQ ID NO: 1642259 - RNA, 11 nt, Pseudomonas putida KT2440
ccaaagggcug

SEQ ID NO: 1642260 - RNA, 21 nt, Pseudomonas putida KT2440
ccaaaggcccgugguuggagc

SEQ ID NO: 1642261 - RNA, 19 nt, Pseudomonas putida KT2440
ccaaaggcgcgucccccgg

SEQ ID NO: 1642262 - RNA, 20 nt, Pseudomonas putida KT2440
ccaacaguugaccaaggaac

SEQ ID NO: 1642263 - RNA, 12 nt, Pseudomonas putida KT2440
ccaacaggcucu

SEQ ID NO: 1642264 - RNA, 15 nt, Pseudomonas putida KT2440
ccaacaggcucucca

SEQ ID NO: 1642265 - RNA, 20 nt, Pseudomonas putida KT2440
ccaacagcaguugcugcugc

SEQ ID NO: 1642266 - RNA, 20 nt, Pseudomonas putida KT2440
ccaacagcauccaaagccaa

SEQ ID NO: 1642267 - RNA, 20 nt, Pseudomonas putida KT2440
ccaaaucccuuugcccgcca

SEQ ID NO: 1642268 - RNA, 14 nt, Pseudomonas putida KT2440
ccaacaacagucaa

SEQ ID NO: 1642269 - RNA, 16 nt, Pseudomonas putida KT2440
caucugcgccugugca

SEQ ID NO: 1642270 - RNA, 15 nt, Pseudomonas putida KT2440
caucugcugcggcag

SEQ ID NO: 1642271 - RNA, 19 nt, Pseudomonas putida KT2440
caucugcugcggcaggcug

SEQ ID NO: 1642272 - RNA, 16 nt, Pseudomonas putida KT2440
caucugucagcgccag

SEQ ID NO: 1642273 - RNA, 20 nt, Pseudomonas putida KT2440
caucugccgggucggccugc

SEQ ID NO: 1642274 - RNA, 16 nt, Pseudomonas putida KT2440
caucugcgccccgcuc

SEQ ID NO: 1642275 - RNA, 23 nt, Pseudomonas putida KT2440
caucugcgccccgcucgccuggc

SEQ ID NO: 1642276 - RNA, 15 nt, Pseudomonas putida KT2440
caucugcaccggcag

SEQ ID NO: 1642277 - RNA, 22 nt, Pseudomonas putida KT2440
caucguccuugcagggcaccag

SEQ ID NO: 1642278 - RNA, 15 nt, Pseudomonas putida KT2440
caucgcucaacuggc

SEQ ID NO: 1642279 - RNA, 15 nt, Pseudomonas putida KT2440
caucgcugacuucca

SEQ ID NO: 1642280 - RNA, 18 nt, Pseudomonas putida KT2440
caucgcugacuuccagca

SEQ ID NO: 1642281 - RNA, 22 nt, Pseudomonas putida KT2440
caucuccagcucgccgcccagu

SEQ ID NO: 1642282 - RNA, 15 nt, Pseudomonas putida KT2440
caucuccauagguua

SEQ ID NO: 1642283 - RNA, 18 nt, Pseudomonas putida KT2440
caucuccaugaaggccgg

SEQ ID NO: 1642284 - RNA, 19 nt, Pseudomonas putida KT2440
caucuccacugcgccaaac

SEQ ID NO: 1642285 - RNA, 12 nt, Pseudomonas putida KT2440
caucuccaaugc

SEQ ID NO: 1642286 - RNA, 20 nt, Pseudomonas putida KT2440
caucucaugcgagaugcccu

SEQ ID NO: 1642287 - RNA, 13 nt, Pseudomonas putida KT2440
cauccugcacugc

SEQ ID NO: 1642288 - RNA, 22 nt, Pseudomonas putida KT2440
cauccucgugauagauaucaag

SEQ ID NO: 1642289 - RNA, 23 nt, Pseudomonas putida KT2440
cauccucaccggcaaagcugauc

SEQ ID NO: 1642290 - RNA, 17 nt, Pseudomonas putida KT2440
cauccuccgcccugccc

SEQ ID NO: 1642291 - RNA, 16 nt, Pseudomonas putida KT2440
cauccucgacacccag

SEQ ID NO: 1642292 - RNA, 20 nt, Pseudomonas putida KT2440
cauccguucggcgcgcugcu

SEQ ID NO: 1642293 - RNA, 20 nt, Pseudomonas putida KT2440
cauccgggccgucaccgcug

SEQ ID NO: 1642294 - RNA, 16 nt, Pseudomonas putida KT2440
cauccgcguccccuuc

SEQ ID NO: 1642295 - RNA, 18 nt, Pseudomonas putida KT2440
cauccgcguccccuucac

SEQ ID NO: 1642296 - RNA, 23 nt, Pseudomonas putida KT2440
cauccggaauuucugcaccuugc

SEQ ID NO: 1642297 - RNA, 19 nt, Pseudomonas putida KT2440
caucccuggcacgcccggc

SEQ ID NO: 1642298 - RNA, 21 nt, Pseudomonas putida KT2440
caucccuggcacgcccggcac

SEQ ID NO: 1642299 - RNA, 19 nt, Pseudomonas putida KT2440
caucgaugcccgucccuuc

SEQ ID NO: 1642300 - RNA, 15 nt, Pseudomonas putida KT2440
caucgauguacaccc

SEQ ID NO: 1642301 - RNA, 20 nt, Pseudomonas putida KT2440
caucgauguacaccccgacc

SEQ ID NO: 1642302 - RNA, 23 nt, Pseudomonas putida KT2440
caucgaucccuggggccaagugg

SEQ ID NO: 1642303 - RNA, 12 nt, Pseudomonas putida KT2440
caucgaccagua

SEQ ID NO: 1642304 - RNA, 13 nt, Pseudomonas putida KT2440
caucgacccuggc

SEQ ID NO: 1642305 - RNA, 22 nt, Pseudomonas putida KT2440
caucgacgaugccguacaccau

SEQ ID NO: 1642306 - RNA, 13 nt, Pseudomonas putida KT2440
caucgaccggcag

SEQ ID NO: 1642307 - RNA, 15 nt, Pseudomonas putida KT2440
caucgaccugccacu

SEQ ID NO: 1642308 - RNA, 21 nt, Pseudomonas putida KT2440
caucgaccugccacugcgcua

SEQ ID NO: 1642309 - RNA, 21 nt, Pseudomonas putida KT2440
cauccugcgcggccacuacca

SEQ ID NO: 1642310 - RNA, 19 nt, Pseudomonas putida KT2440
cauccugcgugcugugcac

SEQ ID NO: 1642311 - RNA, 17 nt, Pseudomonas putida KT2440
caucgcgcacuugccag

SEQ ID NO: 1642312 - RNA, 15 nt, Pseudomonas putida KT2440
caucgcgccgaccag

SEQ ID NO: 1642313 - RNA, 19 nt, Pseudomonas putida KT2440
caucgccgucaucaccacu

SEQ ID NO: 1642314 - RNA, 15 nt, Pseudomonas putida KT2440
caucgccggcacgcu

SEQ ID NO: 1642315 - RNA, 19 nt, Pseudomonas putida KT2440
caucgcauaugccccaggc

SEQ ID NO: 1642316 - RNA, 18 nt, Pseudomonas putida KT2440
caucagugcccccgccac

SEQ ID NO: 1642317 - RNA, 19 nt, Pseudomonas putida KT2440
caucagguagcugggcccg

SEQ ID NO: 1642318 - RNA, 21 nt, Pseudomonas putida KT2440
caucagguagcugggcccgcc

SEQ ID NO: 1642319 - RNA, 13 nt, Pseudomonas putida KT2440
caucaggcacagg

SEQ ID NO: 1642320 - RNA, 18 nt, Pseudomonas putida KT2440
caucauccaccacccugg

SEQ ID NO: 1642321 - RNA, 13 nt, Pseudomonas putida KT2440
caucaucaaagac

SEQ ID NO: 1642322 - RNA, 16 nt, Pseudomonas putida KT2440
caucauccugcuggcc

SEQ ID NO: 1642323 - RNA, 21 nt, Pseudomonas putida KT2440
caucaucggcaugcagcggcc

SEQ ID NO: 1642324 - RNA, 15 nt, Pseudomonas putida KT2440
caucacgucacagcc

SEQ ID NO: 1642325 - RNA, 17 nt, Pseudomonas putida KT2440
caucacggcgcaggccg

SEQ ID NO: 1642326 - RNA, 14 nt, Pseudomonas putida KT2440
caucacgccgcgcu

SEQ ID NO: 1642327 - RNA, 20 nt, Pseudomonas putida KT2440
caucaaucgcuccaggcggc

SEQ ID NO: 1642328 - RNA, 15 nt, Pseudomonas putida KT2440
caucaaugcaauguu

SEQ ID NO: 1642329 - RNA, 19 nt, Pseudomonas putida KT2440
caucaaugcaauguuuuca

SEQ ID NO: 1642330 - RNA, 20 nt, Pseudomonas putida KT2440
caucaaugcaggaucuggcu

SEQ ID NO: 1642331 - RNA, 14 nt, Pseudomonas putida KT2440
caucagccgcgccc

SEQ ID NO: 1642332 - RNA, 19 nt, Pseudomonas putida KT2440
caucagauggcccgguccc

SEQ ID NO: 1642333 - RNA, 15 nt, Pseudomonas putida KT2440
caucagcgccgccaa

SEQ ID NO: 1642334 - RNA, 20 nt, Pseudomonas putida KT2440
caucagcgccgccaauaaca

SEQ ID NO: 1642335 - RNA, 14 nt, Pseudomonas putida KT2440
caucagccggcuuc

SEQ ID NO: 1642336 - RNA, 18 nt, Pseudomonas putida KT2440
caucagccggucucccag

SEQ ID NO: 1642337 - RNA, 17 nt, Pseudomonas putida KT2440
caucagcgcacccuuug

SEQ ID NO: 1642338 - RNA, 22 nt, Pseudomonas putida KT2440
cauacggcgcacucucgucacc

SEQ ID NO: 1642339 - RNA, 22 nt, Pseudomonas putida KT2440
cauauaccgcgcacgcaucugc

SEQ ID NO: 1642340 - RNA, 15 nt, Pseudomonas putida KT2440
cauaucaggauugcc

SEQ ID NO: 1642341 - RNA, 21 nt, Pseudomonas putida KT2440
cauaucaggcaugccagcagc

SEQ ID NO: 1642342 - RNA, 20 nt, Pseudomonas putida KT2440
cauauugcugagccaguuca

SEQ ID NO: 1642343 - RNA, 19 nt, Pseudomonas putida KT2440
caucaacgaaucauccucg

SEQ ID NO: 1642344 - RNA, 21 nt, Pseudomonas putida KT2440
caucaacucacuuucagcgcc

SEQ ID NO: 1642345 - RNA, 15 nt, Pseudomonas putida KT2440
cauaacgccccagca

SEQ ID NO: 1642346 - RNA, 17 nt, Pseudomonas putida KT2440
cauaaccaccaccgacc

SEQ ID NO: 1642347 - RNA, 12 nt, Pseudomonas putida KT2440
cauaacaagaac

SEQ ID NO: 1642348 - RNA, 18 nt, Pseudomonas putida KT2440
cauaagcugucagcaccu

SEQ ID NO: 1642349 - RNA, 17 nt, Pseudomonas putida KT2440
cauaagcgacacccugg

SEQ ID NO: 1642350 - RNA, 21 nt, Pseudomonas putida KT2440
cauaaaaaagggccccuucaa

SEQ ID NO: 1642351 - RNA, 17 nt, Pseudomonas putida KT2440
cauaaaccccagccuuc

SEQ ID NO: 1642352 - RNA, 16 nt, Pseudomonas putida KT2440
cauacaggaccaggcc

SEQ ID NO: 1642353 - RNA, 15 nt, Pseudomonas putida KT2440
cauaccaauggcaau

SEQ ID NO: 1642354 - RNA, 19 nt, Pseudomonas putida KT2440
cauaccaauggcaaucgcc

SEQ ID NO: 1642355 - RNA, 23 nt, Pseudomonas putida KT2440
cauaccaauggcaaucgccuggc

SEQ ID NO: 1642356 - RNA, 21 nt, Pseudomonas putida KT2440
cauacacccggucgcucaacu

SEQ ID NO: 1642357 - RNA, 17 nt, Pseudomonas putida KT2440
cauacagcuggccuugc

SEQ ID NO: 1642358 - RNA, 16 nt, Pseudomonas putida KT2440
cauacagccagaaagc

SEQ ID NO: 1642359 - RNA, 23 nt, Pseudomonas putida KT2440
cauaccucgaccgucgcuggacg

SEQ ID NO: 1642360 - RNA, 18 nt, Pseudomonas putida KT2440
cauaccucccgcacugcu

SEQ ID NO: 1642361 - RNA, 18 nt, Pseudomonas putida KT2440
cauaccgcugggcacccu

SEQ ID NO: 1642362 - RNA, 16 nt, Pseudomonas putida KT2440
caguuuucaaugcugc

SEQ ID NO: 1642363 - RNA, 12 nt, Pseudomonas putida KT2440
caguuugcacug

SEQ ID NO: 1642364 - RNA, 17 nt, Pseudomonas putida KT2440
caguuuuuguaccugug

SEQ ID NO: 1642365 - RNA, 11 nt, Pseudomonas putida KT2440
caguuuuucuc

SEQ ID NO: 1642366 - RNA, 18 nt, Pseudomonas putida KT2440
caguuucagcgccuucuu

SEQ ID NO: 1642367 - RNA, 13 nt, Pseudomonas putida KT2440
caguuguccaggc

SEQ ID NO: 1642368 - RNA, 23 nt, Pseudomonas putida KT2440
caguuccuggcggaucugacggc

SEQ ID NO: 1642369 - RNA, 18 nt, Pseudomonas putida KT2440
caguucgaaaccacccug

SEQ ID NO: 1642370 - RNA, 24 nt, Pseudomonas putida KT2440
caguucgauguaggcagcugccuu

SEQ ID NO: 1642371 - RNA, 19 nt, Pseudomonas putida KT2440
caguucgcagccauaguuu

SEQ ID NO: 1642372 - RNA, 19 nt, Pseudomonas putida KT2440
caguucgcagcccacggcc

SEQ ID NO: 1642373 - RNA, 15 nt, Pseudomonas putida KT2440
caguucgccacccga

SEQ ID NO: 1642374 - RNA, 18 nt, Pseudomonas putida KT2440
caguucccggugcuggcu

SEQ ID NO: 1642375 - RNA, 18 nt, Pseudomonas putida KT2440
caguuccgcguccuugac

SEQ ID NO: 1642376 - RNA, 17 nt, Pseudomonas putida KT2440
caguuccauccaguccg

SEQ ID NO: 1642377 - RNA, 22 nt, Pseudomonas putida KT2440
caguucgcgcaccaucggcucc

SEQ ID NO: 1642378 - RNA, 21 nt, Pseudomonas putida KT2440
caguucgcggaucugcugcuu

SEQ ID NO: 1642379 - RNA, 18 nt, Pseudomonas putida KT2440
caguucggaaaacuccug

SEQ ID NO: 1642380 - RNA, 14 nt, Pseudomonas putida KT2440
caguucguccaggc

SEQ ID NO: 1642381 - RNA, 15 nt, Pseudomonas putida KT2440
caguucggcggcccc

SEQ ID NO: 1642382 - RNA, 18 nt, Pseudomonas putida KT2440
caguucggcggccccggc

SEQ ID NO: 1642383 - RNA, 15 nt, Pseudomonas putida KT2440
caguucuuggcggcu

SEQ ID NO: 1642384 - RNA, 12 nt, Pseudomonas putida KT2440
caguugcugcug

SEQ ID NO: 1642385 - RNA, 14 nt, Pseudomonas putida KT2440
caguugcuucugca

SEQ ID NO: 1642386 - RNA, 16 nt, Pseudomonas putida KT2440
caguugcuggcugguc

SEQ ID NO: 1642387 - RNA, 21 nt, Pseudomonas putida KT2440
caguuggccggcauggcgugc

SEQ ID NO: 1642388 - RNA, 16 nt, Pseudomonas putida KT2440
caguuccaccggcaag

SEQ ID NO: 1642389 - RNA, 20 nt, Pseudomonas putida KT2440
caguucauugcgaaucugca

SEQ ID NO: 1642390 - RNA, 19 nt, Pseudomonas putida KT2440
caguucacggaucgccagg

SEQ ID NO: 1642391 - RNA, 17 nt, Pseudomonas putida KT2440
caguucaccauccgcca

SEQ ID NO: 1642392 - RNA, 22 nt, Pseudomonas putida KT2440
caguguucgaacgggcauuuuu

SEQ ID NO: 1642393 - RNA, 21 nt, Pseudomonas putida KT2440
caguguguugcgguggaagcu

SEQ ID NO: 1642394 - RNA, 17 nt, Pseudomonas putida KT2440
cagugugaccuucaacc

SEQ ID NO: 1642395 - RNA, 19 nt, Pseudomonas putida KT2440
cagugucugcaacugccca

SEQ ID NO: 1642396 - RNA, 20 nt, Pseudomonas putida KT2440
cagugucugcaacugcccac

SEQ ID NO: 1642397 - RNA, 16 nt, Pseudomonas putida KT2440
cagugucccggccagg

SEQ ID NO: 1642398 - RNA, 22 nt, Pseudomonas putida KT2440
cagugucagcggcgcagcgcug

SEQ ID NO: 1642399 - RNA, 14 nt, Pseudomonas putida KT2440
cagugucaguugcu

SEQ ID NO: 1642400 - RNA, 20 nt, Pseudomonas putida KT2440
caguuacccuguacccgcug

SEQ ID NO: 1642401 - RNA, 14 nt, Pseudomonas putida KT2440
caguguacauggcc

SEQ ID NO: 1642402 - RNA, 20 nt, Pseudomonas putida KT2440
caguguagacaugaggcccu

SEQ ID NO: 1642403 - RNA, 21 nt, Pseudomonas putida KT2440
caguguagacaugaggcccuc

SEQ ID NO: 1642404 - RNA, 17 nt, Pseudomonas putida KT2440
cagugguugugcuggcc

SEQ ID NO: 1642405 - RNA, 18 nt, Pseudomonas putida KT2440
cagugguguacagcaaca

SEQ ID NO: 1642406 - RNA, 11 nt, Pseudomonas putida KT2440
cagugggagcg

SEQ ID NO: 1642407 - RNA, 23 nt, Pseudomonas putida KT2440
caguggcacccacagcgccugcu

SEQ ID NO: 1642408 - RNA, 17 nt, Pseudomonas putida KT2440
cagugcuuccagcagga

SEQ ID NO: 1642409 - RNA, 20 nt, Pseudomonas putida KT2440
cagugcuuccagggcgccgu

SEQ ID NO: 1642410 - RNA, 23 nt, Pseudomonas putida KT2440
cagugcuucacagcguugcagaa

SEQ ID NO: 1642411 - RNA, 16 nt, Pseudomonas putida KT2440
cagugcuucacugccg

SEQ ID NO: 1642412 - RNA, 17 nt, Pseudomonas putida KT2440
cagugccgcagucccgc

SEQ ID NO: 1642413 - RNA, 22 nt, Pseudomonas putida KT2440
cagugccgcaagcagucccagc

SEQ ID NO: 1642414 - RNA, 19 nt, Pseudomonas putida KT2440
cagugccaugaacaccacc

SEQ ID NO: 1642415 - RNA, 23 nt, Pseudomonas putida KT2440
cagguauccggguccauccccgc

SEQ ID NO: 1642416 - RNA, 22 nt, Pseudomonas putida KT2440
cagguaguucacuggccagcag

SEQ ID NO: 1642417 - RNA, 17 nt, Pseudomonas putida KT2440
cagguagugcgcggccg

SEQ ID NO: 1642418 - RNA, 18 nt, Pseudomonas putida KT2440
cagugcgcgcaacagugc

SEQ ID NO: 1642419 - RNA, 20 nt, Pseudomonas putida KT2440
cagugcgcgcaacagugccc

SEQ ID NO: 1642420 - RNA, 22 nt, Pseudomonas putida KT2440
cagugcggcaaccaccaacagc

SEQ ID NO: 1642421 - RNA, 18 nt, Pseudomonas putida KT2440
cagugcggcggcacugau

SEQ ID NO: 1642422 - RNA, 13 nt, Pseudomonas putida KT2440
cagugccugcucc

SEQ ID NO: 1642423 - RNA, 21 nt, Pseudomonas putida KT2440
cagugccuucaggcacaccuc

SEQ ID NO: 1642424 - RNA, 22 nt, Pseudomonas putida KT2440
cagugccuucaggcacaccucg

SEQ ID NO: 1642425 - RNA, 18 nt, Pseudomonas putida KT2440
cagugccugaccggucag

SEQ ID NO: 1642426 - RNA, 15 nt, Pseudomonas putida KT2440
cagcaacugcgccca

SEQ ID NO: 1642427 - RNA, 14 nt, Pseudomonas putida KT2440
cagcaacggugaac

SEQ ID NO: 1642428 - RNA, 14 nt, Pseudomonas putida KT2440
cagcaacucccccc

SEQ ID NO: 1642429 - RNA, 22 nt, Pseudomonas putida KT2440
cagcaacuccccccgcgccaga

SEQ ID NO: 1642430 - RNA, 22 nt, Pseudomonas putida KT2440
cagcaacuggugaaucagcccc

SEQ ID NO: 1642431 - RNA, 18 nt, Pseudomonas putida KT2440
cagcaaguugaagaacag

SEQ ID NO: 1642432 - RNA, 22 nt, Pseudomonas putida KT2440
cagcaagaccagaaacccaggg

SEQ ID NO: 1642433 - RNA, 22 nt, Pseudomonas putida KT2440
cagcaacggccgcgccgcgccc

SEQ ID NO: 1642434 - RNA, 19 nt, Pseudomonas putida KT2440
cagcaacggguucagguac

SEQ ID NO: 1642435 - RNA, 21 nt, Pseudomonas putida KT2440
cagcaacggguucagguacag

SEQ ID NO: 1642436 - RNA, 17 nt, Pseudomonas putida KT2440
aaaaugcccccgccgaa

SEQ ID NO: 1642437 - RNA, 12 nt, Pseudomonas putida KT2440
cagcaacaccgc

SEQ ID NO: 1642438 - RNA, 20 nt, Pseudomonas putida KT2440
cagcaacaccguagcgagca

SEQ ID NO: 1642439 - RNA, 14 nt, Pseudomonas putida KT2440
cagcaacagcccca

SEQ ID NO: 1642440 - RNA, 21 nt, Pseudomonas putida KT2440
cagcaacagccccaucaccag

SEQ ID NO: 1642441 - RNA, 16 nt, Pseudomonas putida KT2440
cagcaaaugcccacug

SEQ ID NO: 1642442 - RNA, 19 nt, Pseudomonas putida KT2440
cagcaaagguuugucgccc

SEQ ID NO: 1642443 - RNA, 24 nt, Pseudomonas putida KT2440
cagcaaauacgguugcagcacacu

SEQ ID NO: 1642444 - RNA, 14 nt, Pseudomonas putida KT2440
aaaaugcagcaagc

SEQ ID NO: 1642445 - RNA, 15 nt, Pseudomonas putida KT2440
aaaaugcagcaagcu

SEQ ID NO: 1642446 - RNA, 17 nt, Pseudomonas putida KT2440
cagcaacagcugccggg

SEQ ID NO: 1642447 - RNA, 13 nt, Pseudomonas putida KT2440
cagaucaggcaau

SEQ ID NO: 1642448 - RNA, 13 nt, Pseudomonas putida KT2440
cagaucagcagca

SEQ ID NO: 1642449 - RNA, 15 nt, Pseudomonas putida KT2440
cagauccgcaggguc

SEQ ID NO: 1642450 - RNA, 19 nt, Pseudomonas putida KT2440
cagaucccgcuccucggcc

SEQ ID NO: 1642451 - RNA, 12 nt, Pseudomonas putida KT2440
cagauccaugua

SEQ ID NO: 1642452 - RNA, 18 nt, Pseudomonas putida KT2440
aaaaucggguaacaggga

SEQ ID NO: 1642453 - RNA, 19 nt, Pseudomonas putida KT2440
cagcaaaccgaccaggcag

SEQ ID NO: 1642454 - RNA, 14 nt, Pseudomonas putida KT2440
cagauugcaucacu

SEQ ID NO: 1642455 - RNA, 14 nt, Pseudomonas putida KT2440
cagcagccaacgcc

SEQ ID NO: 1642456 - RNA, 15 nt, Pseudomonas putida KT2440
cagcagccaacgccc

SEQ ID NO: 1642457 - RNA, 17 nt, Pseudomonas putida KT2440
cagcagccaacgcccca

SEQ ID NO: 1642458 - RNA, 17 nt, Pseudomonas putida KT2440
cagcagcaggcccgcca

SEQ ID NO: 1642459 - RNA, 23 nt, Pseudomonas putida KT2440
cagcagcaggcccgccaccgccu

SEQ ID NO: 1642460 - RNA, 14 nt, Pseudomonas putida KT2440
cagcagcagcccca

SEQ ID NO: 1642461 - RNA, 15 nt, Pseudomonas putida KT2440
cagcagcagccccag

SEQ ID NO: 1642462 - RNA, 20 nt, Pseudomonas putida KT2440
cagcagcaccgaggcgugau

SEQ ID NO: 1642463 - RNA, 20 nt, Pseudomonas putida KT2440
cagcagcaccgccaccaugc

SEQ ID NO: 1642464 - RNA, 21 nt, Pseudomonas putida KT2440
cagcacugcauuggccacgcc

SEQ ID NO: 1642465 - RNA, 22 nt, Pseudomonas putida KT2440
cagcacugcauuggccacgccc

SEQ ID NO: 1642466 - RNA, 12 nt, Pseudomonas putida KT2440
cagcacugccag

SEQ ID NO: 1642467 - RNA, 14 nt, Pseudomonas putida KT2440
cagcacgucaccca

SEQ ID NO: 1642468 - RNA, 18 nt, Pseudomonas putida KT2440
cagcacgggcacacuggc

SEQ ID NO: 1642469 - RNA, 22 nt, Pseudomonas putida KT2440
cagcacgggcagcuugcguuug

SEQ ID NO: 1642470 - RNA, 13 nt, Pseudomonas putida KT2440
cagcaccagcucc

SEQ ID NO: 1642471 - RNA, 12 nt, Pseudomonas putida KT2440
cagcaccaucag

SEQ ID NO: 1642472 - RNA, 17 nt, Pseudomonas putida KT2440
cagcaccaucagagcgc

SEQ ID NO: 1642473 - RNA, 19 nt, Pseudomonas putida KT2440
cagcaccaucagagcgcca

SEQ ID NO: 1642474 - RNA, 12 nt, Pseudomonas putida KT2440
cagcaccagcgc

SEQ ID NO: 1642475 - RNA, 22 nt, Pseudomonas putida KT2440
cagcaccaccugugccggcagc

SEQ ID NO: 1642476 - RNA, 18 nt, Pseudomonas putida KT2440
cagcaccacccaccagca

SEQ ID NO: 1642477 - RNA, 22 nt, Pseudomonas putida KT2440
cagcaccaaugaaagugucggc

SEQ ID NO: 1642478 - RNA, 13 nt, Pseudomonas putida KT2440
cagcaccuccacc

SEQ ID NO: 1642479 - RNA, 17 nt, Pseudomonas putida KT2440
cagcaccugcagguaca

SEQ ID NO: 1642480 - RNA, 18 nt, Pseudomonas putida KT2440
cagcaccugcagguacag

SEQ ID NO: 1642481 - RNA, 24 nt, Pseudomonas putida KT2440
cagcaccugcagguacagcagcug

SEQ ID NO: 1642482 - RNA, 14 nt, Pseudomonas putida KT2440
cagcacgaacagca

SEQ ID NO: 1642483 - RNA, 21 nt, Pseudomonas putida KT2440
cagcaccgagucgccuucaca

SEQ ID NO: 1642484 - RNA, 14 nt, Pseudomonas putida KT2440
cagcaccgacuggc

SEQ ID NO: 1642485 - RNA, 20 nt, Pseudomonas putida KT2440
cagcacccuuccccccuggc

SEQ ID NO: 1642486 - RNA, 14 nt, Pseudomonas putida KT2440
cagcaccuccaccu

SEQ ID NO: 1642487 - RNA, 13 nt, Pseudomonas putida KT2440
cagaucacuucca

SEQ ID NO: 1642488 - RNA, 18 nt, Pseudomonas putida KT2440
cagaucacccuuggccac

SEQ ID NO: 1642489 - RNA, 13 nt, Pseudomonas putida KT2440
aaaauccgccugg

SEQ ID NO: 1642490 - RNA, 23 nt, Pseudomonas putida KT2440
cagauaacccugguacagauggc

SEQ ID NO: 1642491 - RNA, 15 nt, Pseudomonas putida KT2440
cagauacugcacccu

SEQ ID NO: 1642492 - RNA, 16 nt, Pseudomonas putida KT2440
cagauacugcacccuc

SEQ ID NO: 1642493 - RNA, 17 nt, Pseudomonas putida KT2440
cagauaggcgccgugcu

SEQ ID NO: 1642494 - RNA, 19 nt, Pseudomonas putida KT2440
cagauaaaccugccaccca

SEQ ID NO: 1642495 - RNA, 23 nt, Pseudomonas putida KT2440
cagaguauugaauguugaucgcu

SEQ ID NO: 1642496 - RNA, 17 nt, Pseudomonas putida KT2440
cagaggugguacaguca

SEQ ID NO: 1642497 - RNA, 16 nt, Pseudomonas putida KT2440
cagagcgcccaccaau

SEQ ID NO: 1642498 - RNA, 17 nt, Pseudomonas putida KT2440
cagagcgcccaccaauu

SEQ ID NO: 1642499 - RNA, 18 nt, Pseudomonas putida KT2440
cagagcgccagcaagcgc

SEQ ID NO: 1642500 - RNA, 17 nt, Pseudomonas putida KT2440
cagagcgaaaugggccg

SEQ ID NO: 1642501 - RNA, 23 nt, Pseudomonas putida KT2440
cagagcgaaaugggccggcgccc

SEQ ID NO: 1642502 - RNA, 17 nt, Pseudomonas putida KT2440
cagaggcguagcaagca

SEQ ID NO: 1642503 - RNA, 22 nt, Pseudomonas putida KT2440
cagagggaagggcgucugcucc

SEQ ID NO: 1642504 - RNA, 23 nt, Pseudomonas putida KT2440
cagagggucuugggucgccacgc

SEQ ID NO: 1642505 - RNA, 19 nt, Pseudomonas putida KT2440
cagagccggugccauccac

SEQ ID NO: 1642506 - RNA, 18 nt, Pseudomonas putida KT2440
cagaaucucaaccaccuc

SEQ ID NO: 1642507 - RNA, 15 nt, Pseudomonas putida KT2440
cagacaacgcggcgg

SEQ ID NO: 1642508 - RNA, 20 nt, Pseudomonas putida KT2440
cagacaacuggccaggguac

SEQ ID NO: 1642509 - RNA, 10 nt, Pseudomonas putida KT2440
cagaaucauc

SEQ ID NO: 1642510 - RNA, 17 nt, Pseudomonas putida KT2440
cagaaucaucaacgccg

SEQ ID NO: 1642511 - RNA, 17 nt, Pseudomonas putida KT2440
cagaaucgcggucuugu

SEQ ID NO: 1642512 - RNA, 16 nt, Pseudomonas putida KT2440
cagacggugcgccuga

SEQ ID NO: 1642513 - RNA, 17 nt, Pseudomonas putida KT2440
cagacgaccagcaugcg

SEQ ID NO: 1642514 - RNA, 20 nt, Pseudomonas putida KT2440
cagacccugacucaugccuu

SEQ ID NO: 1642515 - RNA, 17 nt, Pseudomonas putida KT2440
cagaccuccgucugcuc

SEQ ID NO: 1642516 - RNA, 14 nt, Pseudomonas putida KT2440
cagaccgcaacagu

SEQ ID NO: 1642517 - RNA, 21 nt, Pseudomonas putida KT2440
cagaccgccgaucgaagcagc

SEQ ID NO: 1642518 - RNA, 15 nt, Pseudomonas putida KT2440
cagaccgccgggccc

SEQ ID NO: 1642519 - RNA, 15 nt, Pseudomonas putida KT2440
cagaaccccggcccu

SEQ ID NO: 1642520 - RNA, 16 nt, Pseudomonas putida KT2440
cagaacaucaggucug

SEQ ID NO: 1642521 - RNA, 20 nt, Pseudomonas putida KT2440
cagaacaucaggucugccag

SEQ ID NO: 1642522 - RNA, 15 nt, Pseudomonas putida KT2440
cagaacgccgggagg

SEQ ID NO: 1642523 - RNA, 16 nt, Pseudomonas putida KT2440
cagaaagaauggaaag

SEQ ID NO: 1642524 - RNA, 14 nt, Pseudomonas putida KT2440
aaaauauugcgaaa

SEQ ID NO: 1642525 - RNA, 22 nt, Pseudomonas putida KT2440
cacuuggccugcugauuagagu

SEQ ID NO: 1642526 - RNA, 20 nt, Pseudomonas putida KT2440
cacuucccacguaccuuuca

SEQ ID NO: 1642527 - RNA, 23 nt, Pseudomonas putida KT2440
cacuucgguuucuuucucaggcg

SEQ ID NO: 1642528 - RNA, 20 nt, Pseudomonas putida KT2440
cacuucgccguacuggcugc

SEQ ID NO: 1642529 - RNA, 15 nt, Pseudomonas putida KT2440
cacuucgccuuccuc

SEQ ID NO: 1642530 - RNA, 12 nt, Pseudomonas putida KT2440
cacuuccacacc

SEQ ID NO: 1642531 - RNA, 14 nt, Pseudomonas putida KT2440
cacuuccacacccg

SEQ ID NO: 1642532 - RNA, 19 nt, Pseudomonas putida KT2440
cacuucaauggcacccuca

SEQ ID NO: 1642533 - RNA, 15 nt, Pseudomonas putida KT2440
cacuucaagcacgcc

SEQ ID NO: 1642534 - RNA, 15 nt, Pseudomonas putida KT2440
cacuugaagugcccg

SEQ ID NO: 1642535 - RNA, 17 nt, Pseudomonas putida KT2440
cacuugcguucgccgcu

SEQ ID NO: 1642536 - RNA, 20 nt, Pseudomonas putida KT2440
cacuugccagccgcccaagc

SEQ ID NO: 1642537 - RNA, 15 nt, Pseudomonas putida KT2440
cacuugucccggccc

SEQ ID NO: 1642538 - RNA, 19 nt, Pseudomonas putida KT2440
cacuugucccggcccagcc

SEQ ID NO: 1642539 - RNA, 21 nt, Pseudomonas putida KT2440
cacuugucccggcccagccgc

SEQ ID NO: 1642540 - RNA, 18 nt, Pseudomonas putida KT2440
cacuugcucggugcugcu

SEQ ID NO: 1642541 - RNA, 22 nt, Pseudomonas putida KT2440
cacugucggguuggucgccagg

SEQ ID NO: 1642542 - RNA, 23 nt, Pseudomonas putida KT2440
cacuguccuggguuacggcggcc

SEQ ID NO: 1642543 - RNA, 21 nt, Pseudomonas putida KT2440
cacuggucgccucgacgcaga

SEQ ID NO: 1642544 - RNA, 15 nt, Pseudomonas putida KT2440
cacugguaguucauc

SEQ ID NO: 1642545 - RNA, 14 nt, Pseudomonas putida KT2440
cacugcuucugagc

SEQ ID NO: 1642546 - RNA, 12 nt, Pseudomonas putida KT2440
cacuggccagca

SEQ ID NO: 1642547 - RNA, 21 nt, Pseudomonas putida KT2440
cacuggccagcagggccgccc

SEQ ID NO: 1642548 - RNA, 14 nt, Pseudomonas putida KT2440
cacuggcaggccuu

SEQ ID NO: 1642549 - RNA, 16 nt, Pseudomonas putida KT2440
cacuggcauccggcag

SEQ ID NO: 1642550 - RNA, 12 nt, Pseudomonas putida KT2440
cacuggcaugcg

SEQ ID NO: 1642551 - RNA, 22 nt, Pseudomonas putida KT2440
cacuggccaacuccccacccag

SEQ ID NO: 1642552 - RNA, 23 nt, Pseudomonas putida KT2440
cacuggcugauagccgccagcau

SEQ ID NO: 1642553 - RNA, 14 nt, Pseudomonas putida KT2440
cacuggcugcugcg

SEQ ID NO: 1642554 - RNA, 23 nt, Pseudomonas putida KT2440
cacuggcugcugcgguuugcucu

SEQ ID NO: 1642555 - RNA, 14 nt, Pseudomonas putida KT2440
cacugucccggcac

SEQ ID NO: 1642556 - RNA, 22 nt, Pseudomonas putida KT2440
cacuguugcuggcgacgcugcc

SEQ ID NO: 1642557 - RNA, 15 nt, Pseudomonas putida KT2440
cacuguucagguguu

SEQ ID NO: 1642558 - RNA, 15 nt, Pseudomonas putida KT2440
cacucaggugagcca

SEQ ID NO: 1642559 - RNA, 16 nt, Pseudomonas putida KT2440
cacucagcggguccuc

SEQ ID NO: 1642560 - RNA, 20 nt, Pseudomonas putida KT2440
cacuccagcgaguggccacg

SEQ ID NO: 1642561 - RNA, 20 nt, Pseudomonas putida KT2440
cacucagccgcugcgccugc

SEQ ID NO: 1642562 - RNA, 18 nt, Pseudomonas putida KT2440
cacucacgcaacucuacc

SEQ ID NO: 1642563 - RNA, 17 nt, Pseudomonas putida KT2440
cacucaccgcacaggca

SEQ ID NO: 1642564 - RNA, 14 nt, Pseudomonas putida KT2440
cacucaccgcgccc

SEQ ID NO: 1642565 - RNA, 16 nt, Pseudomonas putida KT2440
cacucaaccaccgcuc

SEQ ID NO: 1642566 - RNA, 18 nt, Pseudomonas putida KT2440
cacuagccccuacgucag

SEQ ID NO: 1642567 - RNA, 20 nt, Pseudomonas putida KT2440
cacguucacgcaagcgccug

SEQ ID NO: 1642568 - RNA, 14 nt, Pseudomonas putida KT2440
cacguuacgccaga

SEQ ID NO: 1642569 - RNA, 15 nt, Pseudomonas putida KT2440
cacguugcugccugu

SEQ ID NO: 1642570 - RNA, 18 nt, Pseudomonas putida KT2440
cacguugcugccugugcc

SEQ ID NO: 1642571 - RNA, 18 nt, Pseudomonas putida KT2440
cacguuguagcccaccac

SEQ ID NO: 1642572 - RNA, 20 nt, Pseudomonas putida KT2440
cacuacgccggccaagguca

SEQ ID NO: 1642573 - RNA, 14 nt, Pseudomonas putida KT2440
cacuaagcgaaaca

SEQ ID NO: 1642574 - RNA, 22 nt, Pseudomonas putida KT2440
cacucccgggaucaccgcaagc

SEQ ID NO: 1642575 - RNA, 17 nt, Pseudomonas putida KT2440
cacuccccaucagcagc

SEQ ID NO: 1642576 - RNA, 21 nt, Pseudomonas putida KT2440
cacucccccuuggugcaaugg

SEQ ID NO: 1642577 - RNA, 22 nt, Pseudomonas putida KT2440
cacucccauguagaccaccagc

SEQ ID NO: 1642578 - RNA, 18 nt, Pseudomonas putida KT2440
cacuccagggucugcgcu

SEQ ID NO: 1642579 - RNA, 19 nt, Pseudomonas putida KT2440
cacuccagucggcauccuc

SEQ ID NO: 1642580 - RNA, 18 nt, Pseudomonas putida KT2440
cacuccgcccguaugcau

SEQ ID NO: 1642581 - RNA, 14 nt, Pseudomonas putida KT2440
cacuccugugcggc

SEQ ID NO: 1642582 - RNA, 15 nt, Pseudomonas putida KT2440
cacucgcgcagcaca

SEQ ID NO: 1642583 - RNA, 16 nt, Pseudomonas putida KT2440
cacucgcgcagcacau

SEQ ID NO: 1642584 - RNA, 17 nt, Pseudomonas putida KT2440
cacucucgcggugccuu

SEQ ID NO: 1642585 - RNA, 17 nt, Pseudomonas putida KT2440
cacucugccgccccucc

SEQ ID NO: 1642586 - RNA, 20 nt, Pseudomonas putida KT2440
cacucugccgccccuccacc

SEQ ID NO: 1642587 - RNA, 12 nt, Pseudomonas putida KT2440
cacucugggcuu

SEQ ID NO: 1642588 - RNA, 14 nt, Pseudomonas putida KT2440
cacucugggcuuug

SEQ ID NO: 1642589 - RNA, 22 nt, Pseudomonas putida KT2440
cacucugggcuuugaaagguuu

SEQ ID NO: 1642590 - RNA, 19 nt, Pseudomonas putida KT2440
cacugaccagcccggcucc

SEQ ID NO: 1642591 - RNA, 12 nt, Pseudomonas putida KT2440
cacugaccaggu

SEQ ID NO: 1642592 - RNA, 16 nt, Pseudomonas putida KT2440
cacugacagcaugccc

SEQ ID NO: 1642593 - RNA, 17 nt, Pseudomonas putida KT2440
cacugacaaagccugca

SEQ ID NO: 1642594 - RNA, 22 nt, Pseudomonas putida KT2440
cacugacaaagccugcacccag

SEQ ID NO: 1642595 - RNA, 13 nt, Pseudomonas putida KT2440
cacugagcaccac

SEQ ID NO: 1642596 - RNA, 19 nt, Pseudomonas putida KT2440
cacugaggcguagcacaag

SEQ ID NO: 1642597 - RNA, 14 nt, Pseudomonas putida KT2440
cacugcaaauaccc

SEQ ID NO: 1642598 - RNA, 21 nt, Pseudomonas putida KT2440
cacugaugucguugaccgugu

SEQ ID NO: 1642599 - RNA, 13 nt, Pseudomonas putida KT2440
cacugaugucuuc

SEQ ID NO: 1642600 - RNA, 22 nt, Pseudomonas putida KT2440
cacugcacgcuucgauccgcgc

SEQ ID NO: 1642601 - RNA, 21 nt, Pseudomonas putida KT2440
cacugcacggcaauugccacc

SEQ ID NO: 1642602 - RNA, 18 nt, Pseudomonas putida KT2440
cacugcaccucccgccac

SEQ ID NO: 1642603 - RNA, 20 nt, Pseudomonas putida KT2440
cacugcagaucaccagcucg

SEQ ID NO: 1642604 - RNA, 14 nt, Pseudomonas putida KT2440
cacugcaggagcgg

SEQ ID NO: 1642605 - RNA, 23 nt, Pseudomonas putida KT2440
cacugcguauuuuugcgccaggc

SEQ ID NO: 1642606 - RNA, 23 nt, Pseudomonas putida KT2440
cacugcguucaucgaacugcaag

SEQ ID NO: 1642607 - RNA, 13 nt, Pseudomonas putida KT2440
cacugcgcgccgu

SEQ ID NO: 1642608 - RNA, 23 nt, Pseudomonas putida KT2440
cacugcgcuacgacccaccgacc

SEQ ID NO: 1642609 - RNA, 14 nt, Pseudomonas putida KT2440
cacugcugccgccc

SEQ ID NO: 1642610 - RNA, 23 nt, Pseudomonas putida KT2440
cacugcugccgcccucuugcugc

SEQ ID NO: 1642611 - RNA, 19 nt, Pseudomonas putida KT2440
cacugcucaucugcgccag

SEQ ID NO: 1642612 - RNA, 20 nt, Pseudomonas putida KT2440
cacugccgugaucgccgggc

SEQ ID NO: 1642613 - RNA, 16 nt, Pseudomonas putida KT2440
cacugccugcacggca

SEQ ID NO: 1642614 - RNA, 12 nt, Pseudomonas putida KT2440
cacugccugcau

SEQ ID NO: 1642615 - RNA, 17 nt, Pseudomonas putida KT2440
cacugccuggccacugu

SEQ ID NO: 1642616 - RNA, 12 nt, Pseudomonas putida KT2440
cacugcccggcg

SEQ ID NO: 1642617 - RNA, 21 nt, Pseudomonas putida KT2440
cacugcccaagccauccacca

SEQ ID NO: 1642618 - RNA, 14 nt, Pseudomonas putida KT2440
cacugccaucucgc

SEQ ID NO: 1642619 - RNA, 20 nt, Pseudomonas putida KT2440
cacugccaucucgccaagca

SEQ ID NO: 1642620 - RNA, 21 nt, Pseudomonas putida KT2440
cagcgucagggucucgcggcu

SEQ ID NO: 1642621 - RNA, 19 nt, Pseudomonas putida KT2440
cagcgucaugcgguacagc

SEQ ID NO: 1642622 - RNA, 17 nt, Pseudomonas putida KT2440
cagcgucggcagagcgc

SEQ ID NO: 1642623 - RNA, 19 nt, Pseudomonas putida KT2440
cagcgucggcagagcgcca

SEQ ID NO: 1642624 - RNA, 15 nt, Pseudomonas putida KT2440
cagcgucgucugcgu

SEQ ID NO: 1642625 - RNA, 23 nt, Pseudomonas putida KT2440
cagcgucucgaugcaauccgcca

SEQ ID NO: 1642626 - RNA, 19 nt, Pseudomonas putida KT2440
cagcgugacgauggccacc

SEQ ID NO: 1642627 - RNA, 15 nt, Pseudomonas putida KT2440
cagcguggccugcaa

SEQ ID NO: 1642628 - RNA, 18 nt, Pseudomonas putida KT2440
aaaauucuccccgcugaa

SEQ ID NO: 1642629 - RNA, 14 nt, Pseudomonas putida KT2440
cagcguugcuggcg

SEQ ID NO: 1642630 - RNA, 20 nt, Pseudomonas putida KT2440
cagcguugcauuccaucauc

SEQ ID NO: 1642631 - RNA, 17 nt, Pseudomonas putida KT2440
cagcggucagcaucuuc

SEQ ID NO: 1642632 - RNA, 19 nt, Pseudomonas putida KT2440
cagcgguucgaccaauggc

SEQ ID NO: 1642633 - RNA, 23 nt, Pseudomonas putida KT2440
cagcgguucgaccgacaugccaa

SEQ ID NO: 1642634 - RNA, 14 nt, Pseudomonas putida KT2440
cagcgguggcaaau

SEQ ID NO: 1642635 - RNA, 15 nt, Pseudomonas putida KT2440
cagcggucugcugcg

SEQ ID NO: 1642636 - RNA, 21 nt, Pseudomonas putida KT2440
cagcggucugcugcgucagca

SEQ ID NO: 1642637 - RNA, 22 nt, Pseudomonas putida KT2440
cagcgguagauguagcggguca

SEQ ID NO: 1642638 - RNA, 15 nt, Pseudomonas putida KT2440
cagcggguggucgcu

SEQ ID NO: 1642639 - RNA, 16 nt, Pseudomonas putida KT2440
cagcguacacugcagg

SEQ ID NO: 1642640 - RNA, 16 nt, Pseudomonas putida KT2440
cagcguagccguccuu

SEQ ID NO: 1642641 - RNA, 14 nt, Pseudomonas putida KT2440
cagcgggcacaggc

SEQ ID NO: 1642642 - RNA, 21 nt, Pseudomonas putida KT2440
cagcgggcguaccuggcugcu

SEQ ID NO: 1642643 - RNA, 13 nt, Pseudomonas putida KT2440
cagcgggcucgcc

SEQ ID NO: 1642644 - RNA, 14 nt, Pseudomonas putida KT2440
cagcgggcucgccc

SEQ ID NO: 1642645 - RNA, 18 nt, Pseudomonas putida KT2440
cagcgggcucgcccacac

SEQ ID NO: 1642646 - RNA, 19 nt, Pseudomonas putida KT2440
cagcgggguguagccgcuu

SEQ ID NO: 1642647 - RNA, 15 nt, Pseudomonas putida KT2440
cagcgcauccaccuc

SEQ ID NO: 1642648 - RNA, 15 nt, Pseudomonas putida KT2440
cagcgcauaggccaa

SEQ ID NO: 1642649 - RNA, 20 nt, Pseudomonas putida KT2440
cagcgcauaggccaagguug

SEQ ID NO: 1642650 - RNA, 17 nt, Pseudomonas putida KT2440
cagcgccugcaggccca

SEQ ID NO: 1642651 - RNA, 14 nt, Pseudomonas putida KT2440
cagcgccugcagcg

SEQ ID NO: 1642652 - RNA, 14 nt, Pseudomonas putida KT2440
cagcgccugcugcc

SEQ ID NO: 1642653 - RNA, 14 nt, Pseudomonas putida KT2440
cagcgccugcugcu

SEQ ID NO: 1642654 - RNA, 16 nt, Pseudomonas putida KT2440
cagcgccugcugcugg

SEQ ID NO: 1642655 - RNA, 21 nt, Pseudomonas putida KT2440
cagcgcggagagguggcagaa

SEQ ID NO: 1642656 - RNA, 16 nt, Pseudomonas putida KT2440
cagcgcggaacacacg

SEQ ID NO: 1642657 - RNA, 22 nt, Pseudomonas putida KT2440
cagcgcuaucucggacacguca

SEQ ID NO: 1642658 - RNA, 20 nt, Pseudomonas putida KT2440
cagcgggagucgaaccugcc

SEQ ID NO: 1642659 - RNA, 17 nt, Pseudomonas putida KT2440
cagcggccccaucaccc

SEQ ID NO: 1642660 - RNA, 18 nt, Pseudomonas putida KT2440
cagcggccaguaaggauc

SEQ ID NO: 1642661 - RNA, 21 nt, Pseudomonas putida KT2440
cagcggcgccacccagaacag

SEQ ID NO: 1642662 - RNA, 20 nt, Pseudomonas putida KT2440
cagcggccugugcaugucca

SEQ ID NO: 1642663 - RNA, 14 nt, Pseudomonas putida KT2440
cagcggcaggcugg

SEQ ID NO: 1642664 - RNA, 18 nt, Pseudomonas putida KT2440
cagcggcacggccaccau

SEQ ID NO: 1642665 - RNA, 15 nt, Pseudomonas putida KT2440
cagcggcacgucacu

SEQ ID NO: 1642666 - RNA, 22 nt, Pseudomonas putida KT2440
cagcggcagaucacgcaaccuc

SEQ ID NO: 1642667 - RNA, 14 nt, Pseudomonas putida KT2440
cagcggcagcaagu

SEQ ID NO: 1642668 - RNA, 22 nt, Pseudomonas putida KT2440
cagcggcaaccugacccgcgcc

SEQ ID NO: 1642669 - RNA, 23 nt, Pseudomonas putida KT2440
cagcggcaagguagccugcugac

SEQ ID NO: 1642670 - RNA, 18 nt, Pseudomonas putida KT2440
cagcggcaacaccagcag

SEQ ID NO: 1642671 - RNA, 20 nt, Pseudomonas putida KT2440
cagcggcaacaccagcagcc

SEQ ID NO: 1642672 - RNA, 18 nt, Pseudomonas putida KT2440
cagcggccagcgccuggc

SEQ ID NO: 1642673 - RNA, 20 nt, Pseudomonas putida KT2440
cagccauaguuuugugccac

SEQ ID NO: 1642674 - RNA, 16 nt, Pseudomonas putida KT2440
cagccauagccaguag

SEQ ID NO: 1642675 - RNA, 12 nt, Pseudomonas putida KT2440
cagcccaccacg

SEQ ID NO: 1642676 - RNA, 16 nt, Pseudomonas putida KT2440
cagcccaccgagcuug

SEQ ID NO: 1642677 - RNA, 14 nt, Pseudomonas putida KT2440
cagcccacggccgc

SEQ ID NO: 1642678 - RNA, 15 nt, Pseudomonas putida KT2440
cagcccacggccgcc

SEQ ID NO: 1642679 - RNA, 13 nt, Pseudomonas putida KT2440
cagcccagcgcca

SEQ ID NO: 1642680 - RNA, 13 nt, Pseudomonas putida KT2440
cagcccagcgccg

SEQ ID NO: 1642681 - RNA, 15 nt, Pseudomonas putida KT2440
cagcccagcgccgcc

SEQ ID NO: 1642682 - RNA, 15 nt, Pseudomonas putida KT2440
cagccccacgcccag

SEQ ID NO: 1642683 - RNA, 12 nt, Pseudomonas putida KT2440
cagcccauuuca

SEQ ID NO: 1642684 - RNA, 23 nt, Pseudomonas putida KT2440
cagccccaacccaccagcacugc

SEQ ID NO: 1642685 - RNA, 20 nt, Pseudomonas putida KT2440
cagccccaagguggaaaucg

SEQ ID NO: 1642686 - RNA, 22 nt, Pseudomonas putida KT2440
cagccccaaucccaacuccacu

SEQ ID NO: 1642687 - RNA, 18 nt, Pseudomonas putida KT2440
cagcccaguaccacuucc

SEQ ID NO: 1642688 - RNA, 18 nt, Pseudomonas putida KT2440
cagcccaugaacagcaag

SEQ ID NO: 1642689 - RNA, 19 nt, Pseudomonas putida KT2440
cagcccaugaacagcaagu

SEQ ID NO: 1642690 - RNA, 18 nt, Pseudomonas putida KT2440
cagcccccaccgggcugg

SEQ ID NO: 1642691 - RNA, 20 nt, Pseudomonas putida KT2440
cagcccccaacccucacucg

SEQ ID NO: 1642692 - RNA, 22 nt, Pseudomonas putida KT2440
cagccccaucaccagcccgaag

SEQ ID NO: 1642693 - RNA, 14 nt, Pseudomonas putida KT2440
cagccccagggccc

SEQ ID NO: 1642694 - RNA, 13 nt, Pseudomonas putida KT2440
cagccccagcggc

SEQ ID NO: 1642695 - RNA, 18 nt, Pseudomonas putida KT2440
cagccccagcggcaaccu

SEQ ID NO: 1642696 - RNA, 14 nt, Pseudomonas putida KT2440
cagccccagcccgc

SEQ ID NO: 1642697 - RNA, 12 nt, Pseudomonas putida KT2440
cagccccagccg

SEQ ID NO: 1642698 - RNA, 13 nt, Pseudomonas putida KT2440
cagccccagccuc

SEQ ID NO: 1642699 - RNA, 21 nt, Pseudomonas putida KT2440
cagccccagcgccuuggccug

SEQ ID NO: 1642700 - RNA, 22 nt, Pseudomonas putida KT2440
cagccccgccaacaacaagcgc

SEQ ID NO: 1642701 - RNA, 16 nt, Pseudomonas putida KT2440
cagccccgccgccccc

SEQ ID NO: 1642702 - RNA, 19 nt, Pseudomonas putida KT2440
cagccccgccgccccccag

SEQ ID NO: 1642703 - RNA, 23 nt, Pseudomonas putida KT2440
cagcccccggauggugugcagca

SEQ ID NO: 1642704 - RNA, 15 nt, Pseudomonas putida KT2440
cagcccccccaaggc

SEQ ID NO: 1642705 - RNA, 13 nt, Pseudomonas putida KT2440
cagcccccccagc

SEQ ID NO: 1642706 - RNA, 16 nt, Pseudomonas putida KT2440
cagcccccccagcaac

SEQ ID NO: 1642707 - RNA, 16 nt, Pseudomonas putida KT2440
cagccccuucuauuaa

SEQ ID NO: 1642708 - RNA, 22 nt, Pseudomonas putida KT2440
cagcccgaacgacacggcaggg

SEQ ID NO: 1642709 - RNA, 17 nt, Pseudomonas putida KT2440
cagcccgauggccuuga

SEQ ID NO: 1642710 - RNA, 21 nt, Pseudomonas putida KT2440
cagcccggcaauuucauccac

SEQ ID NO: 1642711 - RNA, 18 nt, Pseudomonas putida KT2440
cagccaaugcagaugguc

SEQ ID NO: 1642712 - RNA, 14 nt, Pseudomonas putida KT2440
cagccaaaucagcu

SEQ ID NO: 1642713 - RNA, 15 nt, Pseudomonas putida KT2440
cagccaacgccccac

SEQ ID NO: 1642714 - RNA, 17 nt, Pseudomonas putida KT2440
cagccaacgccccaccc

SEQ ID NO: 1642715 - RNA, 17 nt, Pseudomonas putida KT2440
cagccaacgccccaggc

SEQ ID NO: 1642716 - RNA, 19 nt, Pseudomonas putida KT2440
cagccaacgccccaggccg

SEQ ID NO: 1642717 - RNA, 14 nt, Pseudomonas putida KT2440
cagccaaccgcccc

SEQ ID NO: 1642718 - RNA, 18 nt, Pseudomonas putida KT2440
cagccaaccgccccaccc

SEQ ID NO: 1642719 - RNA, 24 nt, Pseudomonas putida KT2440
cagcagcgaagggcucaacgccag

SEQ ID NO: 1642720 - RNA, 21 nt, Pseudomonas putida KT2440
cagcagcgacaacgcgaaagc

SEQ ID NO: 1642721 - RNA, 22 nt, Pseudomonas putida KT2440
cagcagcgacaccagcgcacca

SEQ ID NO: 1642722 - RNA, 11 nt, Pseudomonas putida KT2440
cagccagcaga

SEQ ID NO: 1642723 - RNA, 13 nt, Pseudomonas putida KT2440
cagccagguuuuu

SEQ ID NO: 1642724 - RNA, 17 nt, Pseudomonas putida KT2440
cagccaguucgacaggu

SEQ ID NO: 1642725 - RNA, 21 nt, Pseudomonas putida KT2440
cagcgagugcguagccuucag

SEQ ID NO: 1642726 - RNA, 23 nt, Pseudomonas putida KT2440
cagcgaggguuccaggccacggu

SEQ ID NO: 1642727 - RNA, 20 nt, Pseudomonas putida KT2440
cagcgaggggacgaucugca

SEQ ID NO: 1642728 - RNA, 15 nt, Pseudomonas putida KT2440
cagcgaucaguuccg

SEQ ID NO: 1642729 - RNA, 19 nt, Pseudomonas putida KT2440
cagcgauaaaccagcagcg

SEQ ID NO: 1642730 - RNA, 19 nt, Pseudomonas putida KT2440
cagcgcagcuucucaagca

SEQ ID NO: 1642731 - RNA, 22 nt, Pseudomonas putida KT2440
cagcgcagcaucuuccugccac

SEQ ID NO: 1642732 - RNA, 16 nt, Pseudomonas putida KT2440
cagcgcagccaccagc

SEQ ID NO: 1642733 - RNA, 20 nt, Pseudomonas putida KT2440
cagcgcaaaaaaugugcgca

SEQ ID NO: 1642734 - RNA, 14 nt, Pseudomonas putida KT2440
cagcgacccugagu

SEQ ID NO: 1642735 - RNA, 20 nt, Pseudomonas putida KT2440
cagcgacaugccggccacca

SEQ ID NO: 1642736 - RNA, 21 nt, Pseudomonas putida KT2440
cagcgacaugccggccaccac

SEQ ID NO: 1642737 - RNA, 22 nt, Pseudomonas putida KT2440
cagcgacaugccggccaccaca

SEQ ID NO: 1642738 - RNA, 21 nt, Pseudomonas putida KT2440
cagcgaccagcugccauacag

SEQ ID NO: 1642739 - RNA, 20 nt, Pseudomonas putida KT2440
cagccuuuagcgcaucuucc

SEQ ID NO: 1642740 - RNA, 17 nt, Pseudomonas putida KT2440
cagcgacagcaucggca

SEQ ID NO: 1642741 - RNA, 20 nt, Pseudomonas putida KT2440
cagcgacagcaucggcaggu

SEQ ID NO: 1642742 - RNA, 19 nt, Pseudomonas putida KT2440
cagccuucagauaguccuu

SEQ ID NO: 1642743 - RNA, 18 nt, Pseudomonas putida KT2440
cagccuucagugcuucac

SEQ ID NO: 1642744 - RNA, 12 nt, Pseudomonas putida KT2440
cagccgcgcuga

SEQ ID NO: 1642745 - RNA, 17 nt, Pseudomonas putida KT2440
cagccgcucagccaccu

SEQ ID NO: 1642746 - RNA, 17 nt, Pseudomonas putida KT2440
cagccggcuaucggcca

SEQ ID NO: 1642747 - RNA, 21 nt, Pseudomonas putida KT2440
cagccggcuaucggccagcaa

SEQ ID NO: 1642748 - RNA, 16 nt, Pseudomonas putida KT2440
cagccggcugaugaac

SEQ ID NO: 1642749 - RNA, 16 nt, Pseudomonas putida KT2440
cagccggcuuccagcg

SEQ ID NO: 1642750 - RNA, 17 nt, Pseudomonas putida KT2440
cagccggcuuccagcga

SEQ ID NO: 1642751 - RNA, 14 nt, Pseudomonas putida KT2440
cagccggcgccggu

SEQ ID NO: 1642752 - RNA, 14 nt, Pseudomonas putida KT2440
cagccgcuguucug

SEQ ID NO: 1642753 - RNA, 22 nt, Pseudomonas putida KT2440
cagccgcuguucugcagucagg

SEQ ID NO: 1642754 - RNA, 13 nt, Pseudomonas putida KT2440
cagccggccuugc

SEQ ID NO: 1642755 - RNA, 19 nt, Pseudomonas putida KT2440
cagcccgucacgugccuuc

SEQ ID NO: 1642756 - RNA, 19 nt, Pseudomonas putida KT2440
cagcccggugcccuugccg

SEQ ID NO: 1642757 - RNA, 15 nt, Pseudomonas putida KT2440
cagcccgguccaugu

SEQ ID NO: 1642758 - RNA, 15 nt, Pseudomonas putida KT2440
cagcccggcgccgag

SEQ ID NO: 1642759 - RNA, 15 nt, Pseudomonas putida KT2440
cagcccggcuucaca

SEQ ID NO: 1642760 - RNA, 14 nt, Pseudomonas putida KT2440
cagcccggcaaacu

SEQ ID NO: 1642761 - RNA, 16 nt, Pseudomonas putida KT2440
cagcccggcggccagc

SEQ ID NO: 1642762 - RNA, 18 nt, Pseudomonas putida KT2440
cagcccggcggccagcac

SEQ ID NO: 1642763 - RNA, 14 nt, Pseudomonas putida KT2440
cagccgggcugcaa

SEQ ID NO: 1642764 - RNA, 20 nt, Pseudomonas putida KT2440
cagccggucauccagcagcu

SEQ ID NO: 1642765 - RNA, 21 nt, Pseudomonas putida KT2440
cagccgucgauuacccagcgc

SEQ ID NO: 1642766 - RNA, 14 nt, Pseudomonas putida KT2440
cagccgucgccgcu

SEQ ID NO: 1642767 - RNA, 23 nt, Pseudomonas putida KT2440
cagccgucggcgucaacgguaac

SEQ ID NO: 1642768 - RNA, 17 nt, Pseudomonas putida KT2440
cagccggucucccagcg

SEQ ID NO: 1642769 - RNA, 16 nt, Pseudomonas putida KT2440
cagccguucccgggca

SEQ ID NO: 1642770 - RNA, 17 nt, Pseudomonas putida KT2440
cagccguucaccuuuga

SEQ ID NO: 1642771 - RNA, 13 nt, Pseudomonas putida KT2440
cagccguugcugg

SEQ ID NO: 1642772 - RNA, 17 nt, Pseudomonas putida KT2440
cagccguugcugggcug

SEQ ID NO: 1642773 - RNA, 16 nt, Pseudomonas putida KT2440
cagccgugccuuccag

SEQ ID NO: 1642774 - RNA, 19 nt, Pseudomonas putida KT2440
cagccguggcaacgccaca

SEQ ID NO: 1642775 - RNA, 20 nt, Pseudomonas putida KT2440
cagccguggcaacgccacac

SEQ ID NO: 1642776 - RNA, 20 nt, Pseudomonas putida KT2440
cagccuaccaacgcagcaug

SEQ ID NO: 1642777 - RNA, 19 nt, Pseudomonas putida KT2440
cagccuaagguugcuccug

SEQ ID NO: 1642778 - RNA, 14 nt, Pseudomonas putida KT2440
cagggugccagacc

SEQ ID NO: 1642779 - RNA, 23 nt, Pseudomonas putida KT2440
caggguggcgcugaccaacaggc

SEQ ID NO: 1642780 - RNA, 19 nt, Pseudomonas putida KT2440
caggguggcgauccacagc

SEQ ID NO: 1642781 - RNA, 19 nt, Pseudomonas putida KT2440
cagggugcgcgcgggcucu

SEQ ID NO: 1642782 - RNA, 19 nt, Pseudomonas putida KT2440
caggguuguggugagcccu

SEQ ID NO: 1642783 - RNA, 15 nt, Pseudomonas putida KT2440
caggguugucccggu

SEQ ID NO: 1642784 - RNA, 17 nt, Pseudomonas putida KT2440
cagggugugcugcugcc

SEQ ID NO: 1642785 - RNA, 18 nt, Pseudomonas putida KT2440
cagguaaaccugccugau

SEQ ID NO: 1642786 - RNA, 19 nt, Pseudomonas putida KT2440
cagguaaaaaucaugcagu

SEQ ID NO: 1642787 - RNA, 15 nt, Pseudomonas putida KT2440
cagguaaugcacaag

SEQ ID NO: 1642788 - RNA, 14 nt, Pseudomonas putida KT2440
cagguaauccacca

SEQ ID NO: 1642789 - RNA, 19 nt, Pseudomonas putida KT2440
cagguaauccaccagccgc

SEQ ID NO: 1642790 - RNA, 16 nt, Pseudomonas putida KT2440
cagguaagucacaggc

SEQ ID NO: 1642791 - RNA, 23 nt, Pseudomonas putida KT2440
cagguaauacgcugugcucuggc

SEQ ID NO: 1642792 - RNA, 15 nt, Pseudomonas putida KT2440
cagguacaccgccuc

SEQ ID NO: 1642793 - RNA, 13 nt, Pseudomonas putida KT2440
cagguacagcagc

SEQ ID NO: 1642794 - RNA, 14 nt, Pseudomonas putida KT2440
cagguacagcagcu

SEQ ID NO: 1642795 - RNA, 16 nt, Pseudomonas putida KT2440
cagguacaggcaaaga

SEQ ID NO: 1642796 - RNA, 18 nt, Pseudomonas putida KT2440
cagguaaugcgccgcacc

SEQ ID NO: 1642797 - RNA, 14 nt, Pseudomonas putida KT2440
cagguacaguuccc

SEQ ID NO: 1642798 - RNA, 23 nt, Pseudomonas putida KT2440
cagguaccaggcugccacggcgg

SEQ ID NO: 1642799 - RNA, 20 nt, Pseudomonas putida KT2440
cagguagccuuccagcuccu

SEQ ID NO: 1642800 - RNA, 17 nt, Pseudomonas putida KT2440
cagguacucgcgacuga

SEQ ID NO: 1642801 - RNA, 21 nt, Pseudomonas putida KT2440
cagguaggcgccacgccgcca

SEQ ID NO: 1642802 - RNA, 20 nt, Pseudomonas putida KT2440
cagguagcgucgcgcgccca

SEQ ID NO: 1642803 - RNA, 23 nt, Pseudomonas putida KT2440
cagggccuggacgcgugcaaggg

SEQ ID NO: 1642804 - RNA, 15 nt, Pseudomonas putida KT2440
cagggcgagcacacc

SEQ ID NO: 1642805 - RNA, 20 nt, Pseudomonas putida KT2440
cagggcgaugcccuucaggc

SEQ ID NO: 1642806 - RNA, 21 nt, Pseudomonas putida KT2440
cagggauuccuuggucagguc

SEQ ID NO: 1642807 - RNA, 17 nt, Pseudomonas putida KT2440
cagggcaaaaugcagca

SEQ ID NO: 1642808 - RNA, 20 nt, Pseudomonas putida KT2440
cagggcaaaaugcagcaagc

SEQ ID NO: 1642809 - RNA, 19 nt, Pseudomonas putida KT2440
cagggcaaacaccuugccc

SEQ ID NO: 1642810 - RNA, 22 nt, Pseudomonas putida KT2440
cagggcaaacaccuugccccgc

SEQ ID NO: 1642811 - RNA, 16 nt, Pseudomonas putida KT2440
cagggauacugcugaa

SEQ ID NO: 1642812 - RNA, 20 nt, Pseudomonas putida KT2440
cagggcaaagcccaguucuu

SEQ ID NO: 1642813 - RNA, 13 nt, Pseudomonas putida KT2440
cagggcaacggca

SEQ ID NO: 1642814 - RNA, 21 nt, Pseudomonas putida KT2440
caggguacuugugugccugcu

SEQ ID NO: 1642815 - RNA, 17 nt, Pseudomonas putida KT2440
cagggucgggcacaggc

SEQ ID NO: 1642816 - RNA, 18 nt, Pseudomonas putida KT2440
cagggucgggcacaggcc

SEQ ID NO: 1642817 - RNA, 20 nt, Pseudomonas putida KT2440
cagggucgggcacaggccca

SEQ ID NO: 1642818 - RNA, 14 nt, Pseudomonas putida KT2440
cagggucgcgcccc

SEQ ID NO: 1642819 - RNA, 21 nt, Pseudomonas putida KT2440
cagggucgcgccccaagcggg

SEQ ID NO: 1642820 - RNA, 14 nt, Pseudomonas putida KT2440
cagggucagggcca

SEQ ID NO: 1642821 - RNA, 17 nt, Pseudomonas putida KT2440
cagggucagggccaggc

SEQ ID NO: 1642822 - RNA, 19 nt, Pseudomonas putida KT2440
cagggucagggccaggccg

SEQ ID NO: 1642823 - RNA, 20 nt, Pseudomonas putida KT2440
cagggcugauugagcagcug

SEQ ID NO: 1642824 - RNA, 17 nt, Pseudomonas putida KT2440
cagggcgcgaaaagccu

SEQ ID NO: 1642825 - RNA, 23 nt, Pseudomonas putida KT2440
cagggcgcgaaaagccugcacca

SEQ ID NO: 1642826 - RNA, 15 nt, Pseudomonas putida KT2440
cagggcugcgcgccc

SEQ ID NO: 1642827 - RNA, 21 nt, Pseudomonas putida KT2440
caggggagggcgugaaaaaag

SEQ ID NO: 1642828 - RNA, 21 nt, Pseudomonas putida KT2440
caggggcagaugcuccaaccc

SEQ ID NO: 1642829 - RNA, 16 nt, Pseudomonas putida KT2440
caggggacagccacau

SEQ ID NO: 1642830 - RNA, 21 nt, Pseudomonas putida KT2440
caggggacagccacaugccag

SEQ ID NO: 1642831 - RNA, 20 nt, Pseudomonas putida KT2440
caggggacgcauauccuuug

SEQ ID NO: 1642832 - RNA, 20 nt, Pseudomonas putida KT2440
caggcgcugcagggcgccga

SEQ ID NO: 1642833 - RNA, 18 nt, Pseudomonas putida KT2440
caggcguucgucaagcuc

SEQ ID NO: 1642834 - RNA, 17 nt, Pseudomonas putida KT2440
caggcuaauggcgcgcc

SEQ ID NO: 1642835 - RNA, 19 nt, Pseudomonas putida KT2440
caggcggguagaggaaggc

SEQ ID NO: 1642836 - RNA, 15 nt, Pseudomonas putida KT2440
caggcgggcagcgca

SEQ ID NO: 1642837 - RNA, 21 nt, Pseudomonas putida KT2440
caggcucugcuccagcugcuc

SEQ ID NO: 1642838 - RNA, 12 nt, Pseudomonas putida KT2440
caggcucggcca

SEQ ID NO: 1642839 - RNA, 14 nt, Pseudomonas putida KT2440
caggcucggccacc

SEQ ID NO: 1642840 - RNA, 19 nt, Pseudomonas putida KT2440
caggcucucagcccauuuc

SEQ ID NO: 1642841 - RNA, 16 nt, Pseudomonas putida KT2440
caggcucuccagccgc

SEQ ID NO: 1642842 - RNA, 12 nt, Pseudomonas putida KT2440
caggcugaugga

SEQ ID NO: 1642843 - RNA, 18 nt, Pseudomonas putida KT2440
caggcugauggauuccuc

SEQ ID NO: 1642844 - RNA, 22 nt, Pseudomonas putida KT2440
caggcugauguugaugugcggc

SEQ ID NO: 1642845 - RNA, 13 nt, Pseudomonas putida KT2440
caggcugagcccg

SEQ ID NO: 1642846 - RNA, 21 nt, Pseudomonas putida KT2440
caggcugacguugucauggcu

SEQ ID NO: 1642847 - RNA, 16 nt, Pseudomonas putida KT2440
caggcuuugcugcagg

SEQ ID NO: 1642848 - RNA, 14 nt, Pseudomonas putida KT2440
caggcuuucggcca

SEQ ID NO: 1642849 - RNA, 22 nt, Pseudomonas putida KT2440
caggcuuguccuugagcgccgc

SEQ ID NO: 1642850 - RNA, 20 nt, Pseudomonas putida KT2440
caggcugaucaccgccgcca

SEQ ID NO: 1642851 - RNA, 20 nt, Pseudomonas putida KT2440
caggcugccaaaccgcccca

SEQ ID NO: 1642852 - RNA, 14 nt, Pseudomonas putida KT2440
cagggaaacaaauc

SEQ ID NO: 1642853 - RNA, 15 nt, Pseudomonas putida KT2440
caggccuuuucacac

SEQ ID NO: 1642854 - RNA, 14 nt, Pseudomonas putida KT2440
caggcgaagacgaa

SEQ ID NO: 1642855 - RNA, 23 nt, Pseudomonas putida KT2440
caggcgaauauugagguuggcgc

SEQ ID NO: 1642856 - RNA, 16 nt, Pseudomonas putida KT2440
caggcgacgagccagu

SEQ ID NO: 1642857 - RNA, 23 nt, Pseudomonas putida KT2440
caggcgacggaacggccgcaccu

SEQ ID NO: 1642858 - RNA, 16 nt, Pseudomonas putida KT2440
caggccuccccgcuuu

SEQ ID NO: 1642859 - RNA, 23 nt, Pseudomonas putida KT2440
caggccgugaaccaucccacuca

SEQ ID NO: 1642860 - RNA, 16 nt, Pseudomonas putida KT2440
caggccaccggcagca

SEQ ID NO: 1642861 - RNA, 18 nt, Pseudomonas putida KT2440
caggccaccggcagcacc

SEQ ID NO: 1642862 - RNA, 22 nt, Pseudomonas putida KT2440
caggccaccggcagcaccugcc

SEQ ID NO: 1642863 - RNA, 22 nt, Pseudomonas putida KT2440
caggccaaguacggccagcagg

SEQ ID NO: 1642864 - RNA, 17 nt, Pseudomonas putida KT2440
caggccaaugcccaugc

SEQ ID NO: 1642865 - RNA, 21 nt, Pseudomonas putida KT2440
caggccaaugcccaugcccag

SEQ ID NO: 1642866 - RNA, 23 nt, Pseudomonas putida KT2440
caggccaacaaaaaaagcccgca

SEQ ID NO: 1642867 - RNA, 21 nt, Pseudomonas putida KT2440
caggcgccauuuggcgccggu

SEQ ID NO: 1642868 - RNA, 16 nt, Pseudomonas putida KT2440
caggcgcccccugggc

SEQ ID NO: 1642869 - RNA, 17 nt, Pseudomonas putida KT2440
caggcgcccccugggcg

SEQ ID NO: 1642870 - RNA, 13 nt, Pseudomonas putida KT2440
caggcgccccggc

SEQ ID NO: 1642871 - RNA, 13 nt, Pseudomonas putida KT2440
caggcgcccugcc

SEQ ID NO: 1642872 - RNA, 21 nt, Pseudomonas putida KT2440
caggcgcucgggggugcacag

SEQ ID NO: 1642873 - RNA, 23 nt, Pseudomonas putida KT2440
caggcgcucgcuccagggcaggc

SEQ ID NO: 1642874 - RNA, 15 nt, Pseudomonas putida KT2440
caggcgcgugccuga

SEQ ID NO: 1642875 - RNA, 17 nt, Pseudomonas putida KT2440
caggcgcuccagcaggg

SEQ ID NO: 1642876 - RNA, 18 nt, Pseudomonas putida KT2440
caggcgcggcucgaugcu

SEQ ID NO: 1642877 - RNA, 16 nt, Pseudomonas putida KT2440
caggcgcucaccccgc

SEQ ID NO: 1642878 - RNA, 20 nt, Pseudomonas putida KT2440
caggcgcucaccccgccccu

SEQ ID NO: 1642879 - RNA, 15 nt, Pseudomonas putida KT2440
caggcgcgccugcac

SEQ ID NO: 1642880 - RNA, 17 nt, Pseudomonas putida KT2440
caggcgcgccugcaccu

SEQ ID NO: 1642881 - RNA, 24 nt, Pseudomonas putida KT2440
caggcgcgccugcaccugacgagc

SEQ ID NO: 1642882 - RNA, 23 nt, Pseudomonas putida KT2440
caggcagcacaugccacgcacca

SEQ ID NO: 1642883 - RNA, 20 nt, Pseudomonas putida KT2440
caggcacggcaccagcacca

SEQ ID NO: 1642884 - RNA, 19 nt, Pseudomonas putida KT2440
caggcacgacugaacaccu

SEQ ID NO: 1642885 - RNA, 20 nt, Pseudomonas putida KT2440
caggcacgcccgcucccaca

SEQ ID NO: 1642886 - RNA, 23 nt, Pseudomonas putida KT2440
caggcacuaagcgaaacaccagc

SEQ ID NO: 1642887 - RNA, 15 nt, Pseudomonas putida KT2440
caggcacuggccagc

SEQ ID NO: 1642888 - RNA, 20 nt, Pseudomonas putida KT2440
caggcacuggccagcggcgc

SEQ ID NO: 1642889 - RNA, 14 nt, Pseudomonas putida KT2440
caggcaggccagca

SEQ ID NO: 1642890 - RNA, 20 nt, Pseudomonas putida KT2440
caggcaggccagcacggcca

SEQ ID NO: 1642891 - RNA, 15 nt, Pseudomonas putida KT2440
caggcagccuccagg

SEQ ID NO: 1642892 - RNA, 18 nt, Pseudomonas putida KT2440
caggcaguaggccaccgu

SEQ ID NO: 1642893 - RNA, 19 nt, Pseudomonas putida KT2440
caggcaggaacuggcugcc

SEQ ID NO: 1642894 - RNA, 21 nt, Pseudomonas putida KT2440
caggcauuguugcaacgcagc

SEQ ID NO: 1642895 - RNA, 18 nt, Pseudomonas putida KT2440
caggcauacaggaccagg

SEQ ID NO: 1642896 - RNA, 19 nt, Pseudomonas putida KT2440
caggcauacgaggccgucg

SEQ ID NO: 1642897 - RNA, 20 nt, Pseudomonas putida KT2440
caggcaguucgagcgccuga

SEQ ID NO: 1642898 - RNA, 20 nt, Pseudomonas putida KT2440
caggcaguuucaggcgcuca

SEQ ID NO: 1642899 - RNA, 18 nt, Pseudomonas putida KT2440
caggauuggccgcaacac

SEQ ID NO: 1642900 - RNA, 15 nt, Pseudomonas putida KT2440
caggauugccgcagc

SEQ ID NO: 1642901 - RNA, 16 nt, Pseudomonas putida KT2440
caggcaaaaaaaaggg

SEQ ID NO: 1642902 - RNA, 23 nt, Pseudomonas putida KT2440
caggcaaacgaaaucugccugcu

SEQ ID NO: 1642903 - RNA, 13 nt, Pseudomonas putida KT2440
caggcacagcacg

SEQ ID NO: 1642904 - RNA, 18 nt, Pseudomonas putida KT2440
caggcacaggccagccag

SEQ ID NO: 1642905 - RNA, 16 nt, Pseudomonas putida KT2440
caggcacaggcccagc

SEQ ID NO: 1642906 - RNA, 17 nt, Pseudomonas putida KT2440
caggcacaggcccagca

SEQ ID NO: 1642907 - RNA, 22 nt, Pseudomonas putida KT2440
caggcacacaaacaccggcccc

SEQ ID NO: 1642908 - RNA, 19 nt, Pseudomonas putida KT2440
caggcaauggcgaaccgcu

SEQ ID NO: 1642909 - RNA, 17 nt, Pseudomonas putida KT2440
caggagcggguucaccc

SEQ ID NO: 1642910 - RNA, 19 nt, Pseudomonas putida KT2440
caggaauuacgcaggcucc

SEQ ID NO: 1642911 - RNA, 20 nt, Pseudomonas putida KT2440
caggaauuacgcaggcucca

SEQ ID NO: 1642912 - RNA, 19 nt, Pseudomonas putida KT2440
caggaugcuucggcugauc

SEQ ID NO: 1642913 - RNA, 19 nt, Pseudomonas putida KT2440
caggauggccgcaggccca

SEQ ID NO: 1642914 - RNA, 17 nt, Pseudomonas putida KT2440
caggauggcauuggcca

SEQ ID NO: 1642915 - RNA, 21 nt, Pseudomonas putida KT2440
caggauggcauuggccaacuc

SEQ ID NO: 1642916 - RNA, 14 nt, Pseudomonas putida KT2440
caggaugccgugcg

SEQ ID NO: 1642917 - RNA, 18 nt, Pseudomonas putida KT2440
caggauggugacugccag

SEQ ID NO: 1642918 - RNA, 19 nt, Pseudomonas putida KT2440
cagcuggcucaucugccgg

SEQ ID NO: 1642919 - RNA, 14 nt, Pseudomonas putida KT2440
cagcuggcaaugca

SEQ ID NO: 1642920 - RNA, 15 nt, Pseudomonas putida KT2440
cagcuggccaccuug

SEQ ID NO: 1642921 - RNA, 16 nt, Pseudomonas putida KT2440
cagcuggccaucgacc

SEQ ID NO: 1642922 - RNA, 16 nt, Pseudomonas putida KT2440
cagcuucccggccugg

SEQ ID NO: 1642923 - RNA, 16 nt, Pseudomonas putida KT2440
cagcuuccgccaccac

SEQ ID NO: 1642924 - RNA, 23 nt, Pseudomonas putida KT2440
cagcuggugagcguccaucuugg

SEQ ID NO: 1642925 - RNA, 18 nt, Pseudomonas putida KT2440
cagcuggucgaggcggcu

SEQ ID NO: 1642926 - RNA, 18 nt, Pseudomonas putida KT2440
cagcuugugccgcugcgc

SEQ ID NO: 1642927 - RNA, 12 nt, Pseudomonas putida KT2440
cagcuucugggc

SEQ ID NO: 1642928 - RNA, 12 nt, Pseudomonas putida KT2440
cagcuucuccag

SEQ ID NO: 1642929 - RNA, 21 nt, Pseudomonas putida KT2440
cagcuucucaagcaucuggua

SEQ ID NO: 1642930 - RNA, 20 nt, Pseudomonas putida KT2440
caggaaauacgccgccaccg

SEQ ID NO: 1642931 - RNA, 22 nt, Pseudomonas putida KT2440
caggaaaacugcgggcugagga

SEQ ID NO: 1642932 - RNA, 13 nt, Pseudomonas putida KT2440
caggaacuccugc

SEQ ID NO: 1642933 - RNA, 20 nt, Pseudomonas putida KT2440
caggaacgguguaucggcca

SEQ ID NO: 1642934 - RNA, 18 nt, Pseudomonas putida KT2440
caggaagaucacgucggc

SEQ ID NO: 1642935 - RNA, 12 nt, Pseudomonas putida KT2440
caggaagcuggc

SEQ ID NO: 1642936 - RNA, 16 nt, Pseudomonas putida KT2440
caggaagcuguacagc

SEQ ID NO: 1642937 - RNA, 23 nt, Pseudomonas putida KT2440
cagcuggagacgaacagcgccgc

SEQ ID NO: 1642938 - RNA, 14 nt, Pseudomonas putida KT2440
cagcugcgccagcc

SEQ ID NO: 1642939 - RNA, 22 nt, Pseudomonas putida KT2440
cagcugcugcucuuucggcagc

SEQ ID NO: 1642940 - RNA, 23 nt, Pseudomonas putida KT2440
cagcugcuggauugccugaucaa

SEQ ID NO: 1642941 - RNA, 17 nt, Pseudomonas putida KT2440
cagcugcugcagggccc

SEQ ID NO: 1642942 - RNA, 17 nt, Pseudomonas putida KT2440
cagcugcugccccaugc

SEQ ID NO: 1642943 - RNA, 13 nt, Pseudomonas putida KT2440
cagcugcgcugcc

SEQ ID NO: 1642944 - RNA, 15 nt, Pseudomonas putida KT2440
cagcugcgcugccug

SEQ ID NO: 1642945 - RNA, 13 nt, Pseudomonas putida KT2440
cagcugccgggcc

SEQ ID NO: 1642946 - RNA, 15 nt, Pseudomonas putida KT2440
cagcugccgggccgg

SEQ ID NO: 1642947 - RNA, 18 nt, Pseudomonas putida KT2440
cagcugccauacagccag

SEQ ID NO: 1642948 - RNA, 23 nt, Pseudomonas putida KT2440
cagcugccauacagccagaaagc

SEQ ID NO: 1642949 - RNA, 16 nt, Pseudomonas putida KT2440
cagcugcauuggcggc

SEQ ID NO: 1642950 - RNA, 19 nt, Pseudomonas putida KT2440
cagcugcauuggcggcagg

SEQ ID NO: 1642951 - RNA, 16 nt, Pseudomonas putida KT2440
cagcugccacucuuca

SEQ ID NO: 1642952 - RNA, 23 nt, Pseudomonas putida KT2440
cagcugccacucuucaccauggg

SEQ ID NO: 1642953 - RNA, 14 nt, Pseudomonas putida KT2440
cagcugcaacagcg

SEQ ID NO: 1642954 - RNA, 16 nt, Pseudomonas putida KT2440
cagcugcacaucucca

SEQ ID NO: 1642955 - RNA, 18 nt, Pseudomonas putida KT2440
cagcugcaccaccugcuc

SEQ ID NO: 1642956 - RNA, 14 nt, Pseudomonas putida KT2440
cagcugcagugcug

SEQ ID NO: 1642957 - RNA, 18 nt, Pseudomonas putida KT2440
cagcugcauauaccgcgc

SEQ ID NO: 1642958 - RNA, 19 nt, Pseudomonas putida KT2440
cagcugaagugccaaggcu

SEQ ID NO: 1642959 - RNA, 18 nt, Pseudomonas putida KT2440
cagcucgucgagcaacuu

SEQ ID NO: 1642960 - RNA, 16 nt, Pseudomonas putida KT2440
cagcucuuugggggug

SEQ ID NO: 1642961 - RNA, 16 nt, Pseudomonas putida KT2440
cagcucggccgaugcc

SEQ ID NO: 1642962 - RNA, 21 nt, Pseudomonas putida KT2440
cagcucggcuggcugucgaag

SEQ ID NO: 1642963 - RNA, 23 nt, Pseudomonas putida KT2440
cagcucggcuggcugucgaaggc

SEQ ID NO: 1642964 - RNA, 21 nt, Pseudomonas putida KT2440
cagcucgggaacauucucugc

SEQ ID NO: 1642965 - RNA, 23 nt, Human
uuauauagaaauguauucuuuua

SEQ ID NO: 1642966 - RNA, 18 nt, Human
gccuuggggcugaugcag

SEQ ID NO: 1642967 - RNA, 19 nt, Human
uucauaagaauucuguuga

SEQ ID NO: 1642968 - RNA, 19 nt, Human
cugagauuuugcuugagca

SEQ ID NO: 1642969 - RNA, 17 nt, Human
cuagaacucccuuucaa

SEQ ID NO: 1642970 - RNA, 21 nt, Human
cuuugccauguggcagaucua

SEQ ID NO: 1642971 - RNA, 19 nt, Human
gcauuuaggccaugggaca

SEQ ID NO: 1642972 - RNA, 18 nt, Human
aacugccaucauuuacuu

SEQ ID NO: 1642973 - RNA, 14 nt, Human
ugaagauuuaccac

SEQ ID NO: 1642974 - RNA, 17 nt, Human
uccagccagggcaagag

SEQ ID NO: 1642975 - RNA, 14 nt, Human
gaaucacuugaacc

SEQ ID NO: 1642976 - RNA, 20 nt, Human
cuacuggcugccagaaucua

SEQ ID NO: 1642977 - RNA, 18 nt, Human
ggaauugaggacacugau

SEQ ID NO: 1642978 - RNA, 15 nt, Human
ccucuuagaugcagu

SEQ ID NO: 1642979 - RNA, 14 nt, Human
augccuuuucccaa

SEQ ID NO: 1642980 - RNA, 17 nt, Human
aacuaucucauuuccaa

SEQ ID NO: 1642981 - RNA, 17 nt, Human
acuaaaaauuaaaaccu

SEQ ID NO: 1642982 - RNA, 23 nt, Human
uucuaaaaguuuaaguucuauga

SEQ ID NO: 1642983 - RNA, 22 nt, Human
ucugaacccagggaagacaaga

SEQ ID NO: 1642984 - RNA, 11 nt, Human
ggacuugaacc

SEQ ID NO: 1642985 - RNA, 16 nt, Human
uacagugagccaagag

SEQ ID NO: 1642986 - RNA, 20 nt, Human
agccuuggggcugaugcagu

SEQ ID NO: 1642987 - RNA, 14 nt, Human
auccuucagccuga

SEQ ID NO: 1642988 - RNA, 23 nt, Human
aauauuccuuaagauauuaacug

SEQ ID NO: 1642989 - RNA, 14 nt, Human
gauuuaccacuugu

SEQ ID NO: 1642990 - RNA, 19 nt, Human
ucugugagaugcuagaacu

SEQ ID NO: 1642991 - RNA, 16 nt, Human
ucuucagcagagaagu

SEQ ID NO: 1642992 - RNA, 11 nt, Human
ucacuugagcc

SEQ ID NO: 1642993 - RNA, 18 nt, Human
uagaacucccuuucaaca

SEQ ID NO: 1642994 - RNA, 15 nt, Human
auguauguaauacau

SEQ ID NO: 1642995 - RNA, 13 nt, Human
cacuccagccuga

SEQ ID NO: 1642996 - RNA, 15 nt, Human
cagaucacuugagcu

SEQ ID NO: 1642997 - RNA, 22 nt, Human
cagcacagccucuuagaugcag

SEQ ID NO: 1642998 - RNA, 22 nt, Human
cugcucaauaaaguacaagagc

SEQ ID NO: 1642999 - RNA, 17 nt, Human
uucuccacuggaaaacu

SEQ ID NO: 1643000 - RNA, 22 nt, Human
gacucaccucccccaucucuuc

SEQ ID NO: 1643001 - RNA, 13 nt, Human
ccuuugcaccucc

SEQ ID NO: 1643002 - RNA, 18 nt, Human
aaacugccaucauuuacu

SEQ ID NO: 1643003 - RNA, 19 nt, Human
auuuaguuauaaaaauaua

SEQ ID NO: 1643004 - RNA, 21 nt, Human
cagacacaugugcuggccacc

SEQ ID NO: 1643005 - RNA, 17 nt, Human
cccaucucagguguguu

SEQ ID NO: 1643006 - RNA, 14 nt, Human
cacuaaacaaagag

SEQ ID NO: 1643007 - RNA, 19 nt, Human
cuuuuaaagaaacaaaaau

SEQ ID NO: 1643008 - RNA, 16 nt, Human
aauuucuucaacuccc

SEQ ID NO: 1643009 - RNA, 19 nt, Human
aauauuauguuaaaacugg

SEQ ID NO: 1643010 - RNA, 20 nt, Human
aucaaccugccagcuggccu

SEQ ID NO: 1643011 - RNA, 13 nt, Human
ggugugugcagca

SEQ ID NO: 1643012 - RNA, 13 nt, Human
gaagaacugaaau

SEQ ID NO: 1643013 - RNA, 14 nt, Human
ucucuacauaaaau

SEQ ID NO: 1643014 - RNA, 17 nt, Human
gacagugaaagaaaaua

SEQ ID NO: 1643015 - RNA, 18 nt, Human
uucucuaggaaauauuua

SEQ ID NO: 1643016 - RNA, 22 nt, Human
aaucacuggcuguuaaucuuuc

SEQ ID NO: 1643017 - RNA, 18 nt, Human
cuccagccugagcgacag

SEQ ID NO: 1643018 - RNA, 12 nt, Human
ucuauguagaau

SEQ ID NO: 1643019 - RNA, 16 nt, Human
ggggcagcaccuccua

SEQ ID NO: 1643020 - RNA, 15 nt, Human
caggcaaauuccuga

SEQ ID NO: 1643021 - RNA, 20 nt, Human
guuccuuccucugagccuug

SEQ ID NO: 1643022 - RNA, 19 nt, Human
augcagagguccacaacac

SEQ ID NO: 1643023 - RNA, 20 nt, Human
accggccuuugcaccuccau

SEQ ID NO: 1643024 - RNA, 16 nt, Human
ucagucucccucccuu

SEQ ID NO: 1643025 - RNA, 13 nt, Human
gguccacaacaca

SEQ ID NO: 1643026 - RNA, 20 nt, Human
ggucaacauagugagacacu

SEQ ID NO: 1643027 - RNA, 15 nt, Human
aucuuauaauuuaaa

SEQ ID NO: 1643028 - RNA, 17 nt, Human
gaaagccaugugcagcc

SEQ ID NO: 1643029 - RNA, 16 nt, Human
gacauuugcucaugga

SEQ ID NO: 1643030 - RNA, 14 nt, Human
cagagguugcagug

SEQ ID NO: 1643031 - RNA, 14 nt, Human
aaauaaauaaauaa

SEQ ID NO: 1643032 - RNA, 14 nt, Human
caaggaaggaaaga

SEQ ID NO: 1643033 - RNA, 16 nt, Human
agugaaagaaaauaac

SEQ ID NO: 1643034 - RNA, 14 nt, Human
uuucuaugaaauau

SEQ ID NO: 1643035 - RNA, 17 nt, Human
accugcugagccccaag

SEQ ID NO: 1643036 - RNA, 19 nt, Human
uguucaugcccauaccccu

SEQ ID NO: 1643037 - RNA, 14 nt, Human
aucuaugccacaag

SEQ ID NO: 1643038 - RNA, 13 nt, Human
uaguuuuuaaagu

SEQ ID NO: 1643039 - RNA, 23 nt, Human
aagccauccccgcuccugguugg

SEQ ID NO: 1643040 - RNA, 18 nt, Human
uaugaggcuacagaacua

SEQ ID NO: 1643041 - RNA, 21 nt, Human
cuaguaucaaaagaaagaaaa

SEQ ID NO: 1643042 - RNA, 17 nt, Human
aaggugaucuggcucug

SEQ ID NO: 1643043 - RNA, 20 nt, Human
aaagacagugaaagaaaaua

SEQ ID NO: 1643044 - RNA, 19 nt, Human
cugccccccagcccuccuu

SEQ ID NO: 1643045 - RNA, 14 nt, Human
uauauuuccuuauu

SEQ ID NO: 1643046 - RNA, 15 nt, Human
gucaaugcagccccc

SEQ ID NO: 1643047 - RNA, 20 nt, Human
gaccauacuaauuauacccc

SEQ ID NO: 1643048 - RNA, 17 nt, Human
augcagagguccacaac

SEQ ID NO: 1643049 - RNA, 12 nt, Human
guagacacacau

SEQ ID NO: 1643050 - RNA, 14 nt, Human
gaaaaaauaacaau

SEQ ID NO: 1643051 - RNA, 21 nt, Human
auauuuccuuauucagaauuu

SEQ ID NO: 1643052 - RNA, 15 nt, Human
ucuuauaauuuaaaa

SEQ ID NO: 1643053 - RNA, 16 nt, Human
gacuauuauauuucca

SEQ ID NO: 1643054 - RNA, 17 nt, Human
aaucuuucacaggggac

SEQ ID NO: 1643055 - RNA, 13 nt, Human
ccagcccuccuua

SEQ ID NO: 1643056 - RNA, 11 nt, Human
ccugagcccca

SEQ ID NO: 1643057 - RNA, 14 nt, Human
cagauccuggaaau

SEQ ID NO: 1643058 - RNA, 22 nt, Human
ugaaaaaguucugcagauaaac

SEQ ID NO: 1643059 - RNA, 15 nt, Human
agcuaaauauauauu

SEQ ID NO: 1643060 - RNA, 19 nt, Human
uuguacucugaaaguuuug

SEQ ID NO: 1643061 - RNA, 23 nt, Human
uguucccuggggcuuuaacuccu

SEQ ID NO: 1643062 - RNA, 17 nt, Human
gaucuacaugucuagag

SEQ ID NO: 1643063 - RNA, 18 nt, Human
uaaaagacaaggaaaaaa

SEQ ID NO: 1643064 - RNA, 15 nt, Human
aaacauaugaauuau

SEQ ID NO: 1643065 - RNA, 18 nt, Human
uuuuaaaaaagaaacauu

SEQ ID NO: 1643066 - RNA, 20 nt, Human
cacuguggguagacacacau

SEQ ID NO: 1643067 - RNA, 19 nt, Human
uccagaaagugacaagcuc

SEQ ID NO: 1643068 - RNA, 17 nt, Human
acuuccagauccuggaa

SEQ ID NO: 1643069 - RNA, 18 nt, Human
uuauguuccuuuuaaaga

SEQ ID NO: 1643070 - RNA, 20 nt, Human
ugcagccaccaguccauugg

SEQ ID NO: 1643071 - RNA, 24 nt, Human
ugucuugaauuguaggugacuauu

SEQ ID NO: 1643072 - RNA, 17 nt, Human
caggcuggcgugcagca

SEQ ID NO: 1643073 - RNA, 22 nt, Human
uucuaugcuuguaacugucuuc

SEQ ID NO: 1643074 - RNA, 14 nt, Human
acugccaucauuua

SEQ ID NO: 1643075 - RNA, 12 nt, Human
cagacacaugug

SEQ ID NO: 1643076 - RNA, 18 nt, Human
ccaagcugguggcucugu

SEQ ID NO: 1643077 - RNA, 15 nt, Human
auaugcuucuuugug

SEQ ID NO: 1643078 - RNA, 18 nt, Human
uagaauauauuuccuuau

SEQ ID NO: 1643079 - RNA, 20 nt, Human
aggagaggcaaagaaaggag

SEQ ID NO: 1643080 - RNA, 13 nt, Human
uuuuauaugcuau

SEQ ID NO: 1643081 - RNA, 15 nt, Human
aauacaaaaacuuag

SEQ ID NO: 1643082 - RNA, 15 nt, Human
uccucaacucugagu

SEQ ID NO: 1643083 - RNA, 20 nt, Human
uauguccuuggugccuggag

SEQ ID NO: 1643084 - RNA, 23 nt, Human
gcuggcgugcagcaucagcaucc

SEQ ID NO: 1643085 - RNA, 22 nt, Human
ggaaaugauguuucauaagaau

SEQ ID NO: 1643086 - RNA, 22 nt, Human
ugaauuguaggugacuauuaua

SEQ ID NO: 1643087 - RNA, 20 nt, Human
cauagugagacacugucucu

SEQ ID NO: 1643088 - RNA, 13 nt, Human
uccuacuuccccu

SEQ ID NO: 1643089 - RNA, 14 nt, Human
aucaggaaagagag

SEQ ID NO: 1643090 - RNA, 21 nt, Human
agucaagggugugugcagcau

SEQ ID NO: 1643091 - RNA, 21 nt, Human
caacacaucaggaaagagagc

SEQ ID NO: 1643092 - RNA, 22 nt, Human
cuaggaugggaacaaggaagga

SEQ ID NO: 1643093 - RNA, 16 nt, Human
cuaguuuauauagaaa

SEQ ID NO: 1643094 - RNA, 23 nt, Human
aggaggaucacuuuaggccuggu

SEQ ID NO: 1643095 - RNA, 15 nt, Human
cuaagcaaaauguga

SEQ ID NO: 1643096 - RNA, 13 nt, Human
cguuaauguaaag

SEQ ID NO: 1643097 - RNA, 14 nt, Human
guaacuaauuuuaa

SEQ ID NO: 1643098 - RNA, 21 nt, Human
uaauaggcguaacuaauuuua

SEQ ID NO: 1643099 - RNA, 23 nt, Human
uuacgaaauacguuaggaggaca

SEQ ID NO: 1643100 - RNA, 14 nt, Human
uacuaauuuuaaaa

SEQ ID NO: 1643101 - RNA, 20 nt, Human
ucaauaaaauccauacauuu

SEQ ID NO: 1643102 - RNA, 13 nt, Human
uauauuuuagaua

SEQ ID NO: 1643103 - RNA, 16 nt, Human
augcuguauuuuaaaa

SEQ ID NO: 1643104 - RNA, 15 nt, Human
auauaaauaaaaaua

SEQ ID NO: 1643105 - RNA, 20 nt, Human
gaaacgaggauugggaaaaa

SEQ ID NO: 1643106 - RNA, 22 nt, Human
uuguaacaagccuccuuuuaaa

SEQ ID NO: 1643107 - RNA, 22 nt, Human
uuuuauagcuacuaauuuuaaa

SEQ ID NO: 1643108 - RNA, 17 nt, Human
ucuuucacauuuaaaua

SEQ ID NO: 1643109 - RNA, 15 nt, Human
gaaaugauguuucau

SEQ ID NO: 1643110 - RNA, 15 nt, Human
ccacaagaaaugaaa

SEQ ID NO: 1643111 - RNA, 20 nt, Human
agcuucacuguaaaauaaua

SEQ ID NO: 1643112 - RNA, 22 nt, Human
cagcccuggugggcagagaggu

SEQ ID NO: 1643113 - RNA, 21 nt, Human
caaggagaggcaaagaaagga

SEQ ID NO: 1643114 - RNA, 16 nt, Human
aaugaaagcagggacu

SEQ ID NO: 1643115 - RNA, 22 nt, Human
cuuguaaaggaauuuaaaaauc

SEQ ID NO: 1643116 - RNA, 11 nt, Human
aacaaggaagg

SEQ ID NO: 1643117 - RNA, 20 nt, Human
auuuccuuauucagaauuuc

SEQ ID NO: 1643118 - RNA, 23 nt, Human
cagagguugcagugagccgagau

SEQ ID NO: 1643119 - RNA, 14 nt, Human
ucccuugaugaaga

SEQ ID NO: 1643120 - RNA, 17 nt, Human
acuugaacccauauuug

SEQ ID NO: 1643121 - RNA, 14 nt, Human
cugaggcuccacuu

SEQ ID NO: 1643122 - RNA, 13 nt, Human
ccugagcuugcag

SEQ ID NO: 1643123 - RNA, 15 nt, Human
aagccagauuuuccu

SEQ ID NO: 1643124 - RNA, 14 nt, Human
ugagguugugugug

SEQ ID NO: 1643125 - RNA, 17 nt, Human
cuaaggcaggaggauca

SEQ ID NO: 1643126 - RNA, 14 nt, Human
ccucugcagcuucc

SEQ ID NO: 1643127 - RNA, 18 nt, Human
uucugauauuggacagua

SEQ ID NO: 1643128 - RNA, 19 nt, Human
gcacuaguauuucuaugaa

SEQ ID NO: 1643129 - RNA, 22 nt, Human
gcagagagguagggauggggcu

SEQ ID NO: 1643130 - RNA, 11 nt, Human
ggucacaggaa

SEQ ID NO: 1643131 - RNA, 20 nt, Human
cagccugagcgacagugaga

SEQ ID NO: 1643132 - RNA, 20 nt, Human
cuuccccucugcagcuucca

SEQ ID NO: 1643133 - RNA, 16 nt, Human
gccuaagugcagcccc

SEQ ID NO: 1643134 - RNA, 18 nt, Human
cucuggccuucggccucc

SEQ ID NO: 1643135 - RNA, 19 nt, Human
uaccauuauggauaaagau

SEQ ID NO: 1643136 - RNA, 20 nt, Human
uaucauuuaguuauaaaaau

SEQ ID NO: 1643137 - RNA, 23 nt, Human
uuucccaucucagguguguugca

SEQ ID NO: 1643138 - RNA, 12 nt, Human
gcaacaugguga

SEQ ID NO: 1643139 - RNA, 21 nt, Human
acaugagguacugagagugaa

SEQ ID NO: 1643140 - RNA, 22 nt, Human
cuggguuccuuccucugagccu

SEQ ID NO: 1643141 - RNA, 22 nt, Human
cugccagaaucuagagcaaagc

SEQ ID NO: 1643142 - RNA, 14 nt, Human
ccacuggacucacc

SEQ ID NO: 1643143 - RNA, 18 nt, Human
aggaaaaaauaacaauga

SEQ ID NO: 1643144 - RNA, 12 nt, Human
agaaaacaauaa

SEQ ID NO: 1643145 - RNA, 22 nt, Human
agcuuguauuccuuuuucucuc

SEQ ID NO: 1643146 - RNA, 13 nt, Human
uuucuaaaaguuu

SEQ ID NO: 1643147 - RNA, 19 nt, Human
cccauggcacucuauguuc

SEQ ID NO: 1643148 - RNA, 19 nt, Human
aaacaaaaggauaaugaau

SEQ ID NO: 1643149 - RNA, 17 nt, Human
ucgggauuaguacacac

SEQ ID NO: 1643150 - RNA, 12 nt, Human
uauaauuuaaaa

SEQ ID NO: 1643151 - RNA, 15 nt, Human
auacguuaggaggac

SEQ ID NO: 1643152 - RNA, 16 nt, Human
ccacaagaacccccuu

SEQ ID NO: 1643153 - RNA, 18 nt, Human
uuuauguuuaauucugaa

SEQ ID NO: 1643154 - RNA, 18 nt, Human
ugcauagguuuaauaauu

SEQ ID NO: 1643155 - RNA, 14 nt, Human
accauuuuuacuug

SEQ ID NO: 1643156 - RNA, 14 nt, Human
auccuugaagauuu

SEQ ID NO: 1643157 - RNA, 22 nt, Human
ucaacuccaaacugacucuuaa

SEQ ID NO: 1643158 - RNA, 22 nt, Human
uaucuauguagaauauauuucc

SEQ ID NO: 1643159 - RNA, 17 nt, Human
ccugucgguuuauucac

SEQ ID NO: 1643160 - RNA, 18 nt, Human
ugugcuggccaccugcug

SEQ ID NO: 1643161 - RNA, 17 nt, Human
gaagaccucauuuugaa

SEQ ID NO: 1643162 - RNA, 20 nt, Human
ggccuaugcagagguccaca

SEQ ID NO: 1643163 - RNA, 19 nt, Human
cuuccuaauuccacagcug

SEQ ID NO: 1643164 - RNA, 19 nt, Human
cgcccacuagacccacugg

SEQ ID NO: 1643165 - RNA, 15 nt, Human
uuucaaaaaaaaacc

SEQ ID NO: 1643166 - RNA, 14 nt, Human
cgucccccucuggc

SEQ ID NO: 1643167 - RNA, 21 nt, Human
cugauauuggacaguaaaauc

SEQ ID NO: 1643168 - RNA, 15 nt, Human
cucccugccccccag

SEQ ID NO: 1643169 - RNA, 17 nt, Human
uguaaaggaauuuaaaa

SEQ ID NO: 1643170 - RNA, 21 nt, Human
ccauccugccccugagcccau

SEQ ID NO: 1643171 - RNA, 17 nt, Human
ggaaggcugaggcagga

SEQ ID NO: 1643172 - RNA, 22 nt, Human
caggggccacaccaaccuucug

SEQ ID NO: 1643173 - RNA, 14 nt, Human
augggaacaaggaa

SEQ ID NO: 1643174 - RNA, 15 nt, Human
uacagaacuaaaaau

SEQ ID NO: 1643175 - RNA, 23 nt, Human
cucagcccuggugggcagagagg

SEQ ID NO: 1643176 - RNA, 12 nt, Human
acagagacagaa

SEQ ID NO: 1643177 - RNA, 19 nt, Human
gccugaucaccugcccugc

SEQ ID NO: 1643178 - RNA, 23 nt, Human
cuggccgggagccugaucaccug

SEQ ID NO: 1643179 - RNA, 19 nt, Human
ucaccaaggcugauuaaac

SEQ ID NO: 1643180 - RNA, 14 nt, Human
uucuggaauaaucc

SEQ ID NO: 1643181 - RNA, 21 nt, Human
aggaagggacacauaucaaac

SEQ ID NO: 1643182 - RNA, 14 nt, Human
gcugauuaaaccaa

SEQ ID NO: 1643183 - RNA, 17 nt, Human
gcucaccagucccuccc

SEQ ID NO: 1643184 - RNA, 14 nt, Human
auuguccaggucua

SEQ ID NO: 1643185 - RNA, 15 nt, Human
agguguguugcagug

SEQ ID NO: 1643186 - RNA, 23 nt, Human
uagacacacaugaaguccaagca

SEQ ID NO: 1643187 - RNA, 13 nt, Human
aggcauagcccug

SEQ ID NO: 1643188 - RNA, 13 nt, Human
caacaucuaguga

SEQ ID NO: 1643189 - RNA, 13 nt, Human
aggaaaaaauaac

SEQ ID NO: 1643190 - RNA, 18 nt, Human
acuuuaugcuaagugaaa

SEQ ID NO: 1643191 - RNA, 15 nt, Human
aaacaauuugaauau

SEQ ID NO: 1643192 - RNA, 14 nt, Human
agcucaccaguccc

SEQ ID NO: 1643193 - RNA, 16 nt, Human
uaucaaaagaaagaaa

SEQ ID NO: 1643194 - RNA, 18 nt, Human
uuuguuaaaugauuucau

SEQ ID NO: 1643195 - RNA, 17 nt, Human
aguugauaaguacauga

SEQ ID NO: 1643196 - RNA, 20 nt, Human
gacaggcacuaucuggguuu

SEQ ID NO: 1643197 - RNA, 17 nt, Human
caugagggcuggaugcu

SEQ ID NO: 1643198 - RNA, 19 nt, Human
uguuggacgagaaaacaau

SEQ ID NO: 1643199 - RNA, 17 nt, Human
agaaacaaaaaucaaac

SEQ ID NO: 1643200 - RNA, 13 nt, Human
uuuaaaaaaaaac

SEQ ID NO: 1643201 - RNA, 19 nt, Human
guaguccuguaauggaagc

SEQ ID NO: 1643202 - RNA, 16 nt, Human
uacaaaugggaaacaa

SEQ ID NO: 1643203 - RNA, 20 nt, Human
cauaucaaacugaaacaaaa

SEQ ID NO: 1643204 - RNA, 14 nt, Human
agggcuaauaucuu

SEQ ID NO: 1643205 - RNA, 15 nt, Human
ugaugggcaaaaaac

SEQ ID NO: 1643206 - RNA, 23 nt, Human
cucagucucccucccuuggggcc

SEQ ID NO: 1643207 - RNA, 16 nt, Human
auuauacccccugcaa

SEQ ID NO: 1643208 - RNA, 17 nt, Human
uacaaaugcauuucuaa

SEQ ID NO: 1643209 - RNA, 20 nt, Human
cacuagacccacuggacuca

SEQ ID NO: 1643210 - RNA, 17 nt, Human
uccuacaagacacagug

SEQ ID NO: 1643211 - RNA, 11 nt, Human
auaauuuaaau

SEQ ID NO: 1643212 - RNA, 17 nt, Human
caccugcugagccccaa

SEQ ID NO: 1643213 - RNA, 15 nt, Human
guggagacaucugga

SEQ ID NO: 1643214 - RNA, 19 nt, Human
ugccucaagcuaugugagc

SEQ ID NO: 1643215 - RNA, 18 nt, Human
aggaugggaacaaggaag

SEQ ID NO: 1643216 - RNA, 16 nt, Human
agagguccacaacaca

SEQ ID NO: 1643217 - RNA, 22 nt, Human
ccacagcuguaugauucccagc

SEQ ID NO: 1643218 - RNA, 21 nt, Human
agcccuuccccucugcagcuu

SEQ ID NO: 1643219 - RNA, 14 nt, Human
aaccugagccccaa

SEQ ID NO: 1643220 - RNA, 15 nt, Human
gucucuugaggcaca

SEQ ID NO: 1643221 - RNA, 22 nt, Human
auuuucuucucacauuuauauu

SEQ ID NO: 1643222 - RNA, 16 nt, Human
ccugcaaagcccagcu

SEQ ID NO: 1643223 - RNA, 23 nt, Human
aacuuguaaaggaauuuaaaaau

SEQ ID NO: 1643224 - RNA, 23 nt, Human
cccacuggacucaccucccccau

SEQ ID NO: 1643225 - RNA, 16 nt, Human
aaauaguuuaugauuc

SEQ ID NO: 1643226 - RNA, 12 nt, Human
ugacauuagaug

SEQ ID NO: 1643227 - RNA, 15 nt, Human
aacaaggaaggaaag

SEQ ID NO: 1643228 - RNA, 18 nt, Human
aagucuuucacauuuaaa

SEQ ID NO: 1643229 - RNA, 22 nt, Human
augguuguauuauuuuuuaaaa

SEQ ID NO: 1643230 - RNA, 14 nt, Human
auuuaauuauuuca

SEQ ID NO: 1643231 - RNA, 12 nt, Human
uaccuccaagga

SEQ ID NO: 1643232 - RNA, 12 nt, Human
ccugccagcugg

SEQ ID NO: 1643233 - RNA, 16 nt, Human
auaacuggaaacuuca

SEQ ID NO: 1643234 - RNA, 21 nt, Human
acaguuaccucugccucagaa

SEQ ID NO: 1643235 - RNA, 20 nt, Human
aguuuuuuuuuaaaaaagaa

SEQ ID NO: 1643236 - RNA, 19 nt, Human
ggacucaccucccccaucu

SEQ ID NO: 1643237 - RNA, 16 nt, Human
ugcaaauugucacagg

SEQ ID NO: 1643238 - RNA, 12 nt, Human
acacugaagaag

SEQ ID NO: 1643239 - RNA, 19 nt, Human
cugccaaaacaucaaccug

SEQ ID NO: 1643240 - RNA, 16 nt, Human
ugacuuaaugccacua

SEQ ID NO: 1643241 - RNA, 17 nt, Human
caagacccaaaaggcag

SEQ ID NO: 1643242 - RNA, 19 nt, Human
aaagacagugaaagaaaau

SEQ ID NO: 1643243 - RNA, 23 nt, Human
aaccugccagcuggccuugugag

SEQ ID NO: 1643244 - RNA, 14 nt, Human
uugacccacaagaa

SEQ ID NO: 1643245 - RNA, 21 nt, Human
ccauaccccuggccaaggaag

SEQ ID NO: 1643246 - RNA, 22 nt, Human
uaauucugguagcuaaauauau

SEQ ID NO: 1643247 - RNA, 17 nt, Human
auuucuaaaaguuuaag

SEQ ID NO: 1643248 - RNA, 23 nt, Human
acgaggauugggaaaaaguaauu

SEQ ID NO: 1643249 - RNA, 21 nt, Human
ucuucaacucccugcccccca

SEQ ID NO: 1643250 - RNA, 17 nt, Human
cuagaaaacaggcaaau

SEQ ID NO: 1643251 - RNA, 22 nt, Human
uccuuuuaaagaaacaaaaauc

SEQ ID NO: 1643252 - RNA, 15 nt, Human
gaaaugaaagcaggg

SEQ ID NO: 1643253 - RNA, 12 nt, Human
aauacuuuauaa

SEQ ID NO: 1643254 - RNA, 21 nt, Human
cagagguccacaacacacaga

SEQ ID NO: 1643255 - RNA, 22 nt, Human
aguauguuagugcaaauuguca

SEQ ID NO: 1643256 - RNA, 17 nt, Human
acuccugcuagaacagu

SEQ ID NO: 1643257 - RNA, 20 nt, Human
auaaauggcuuccuggcaau

SEQ ID NO: 1643258 - RNA, 16 nt, Human
cacgggggccaaggau

SEQ ID NO: 1643259 - RNA, 19 nt, Human
gaaugggggcagcaccucc

SEQ ID NO: 1643260 - RNA, 17 nt, Human
guggcucugugugcucu

SEQ ID NO: 1643261 - RNA, 13 nt, Human
aagaccagccugg

SEQ ID NO: 1643262 - RNA, 17 nt, Human
agacagugaaagaaaau

SEQ ID NO: 1643263 - RNA, 13 nt, Human
cuucucaacucca

SEQ ID NO: 1643264 - RNA, 21 nt, Human
augaauacuuuauaaaggauu

SEQ ID NO: 1643265 - RNA, 15 nt, Human
cccugagguugugug

SEQ ID NO: 1643266 - RNA, 23 nt, Human
uuuuauagcuacuaauuuuaaaa

SEQ ID NO: 1643267 - RNA, 16 nt, Human
cccccagcccuccuua

SEQ ID NO: 1643268 - RNA, 12 nt, Human
ucccccucuggc

SEQ ID NO: 1643269 - RNA, 14 nt, Human
uugccaugugcuag

SEQ ID NO: 1643270 - RNA, 23 nt, Human
cucaggggggugguuuucccauc

SEQ ID NO: 1643271 - RNA, 12 nt, Human
gucccaggcuga

SEQ ID NO: 1643272 - RNA, 22 nt, Human
caugaguaacugauuuguaaca

SEQ ID NO: 1643273 - RNA, 16 nt, Human
cauagaaguaaaaaca

SEQ ID NO: 1643274 - RNA, 22 nt, Human
aaaugauguuucauaagaauuc

SEQ ID NO: 1643275 - RNA, 16 nt, Human
gacaagcucacagacc

SEQ ID NO: 1643276 - RNA, 16 nt, Human
gacauagaauuaacac

SEQ ID NO: 1643277 - RNA, 21 nt, Human
caauuuuguuauguauauuuu

SEQ ID NO: 1643278 - RNA, 21 nt, Human
caaaguugauuaagaaaggaa

SEQ ID NO: 1643279 - RNA, 20 nt, Human
ccgaggugggcagaucacuu

SEQ ID NO: 1643280 - RNA, 12 nt, Human
aaaugaaagcag

SEQ ID NO: 1643281 - RNA, 17 nt, Human
guuuaauucugaaagca

SEQ ID NO: 1643282 - RNA, 18 nt, Human
uaggugacuauuauauuu

SEQ ID NO: 1643283 - RNA, 15 nt, Human
gacagggaggacgcu

SEQ ID NO: 1643284 - RNA, 14 nt, Human
uuagagaauuuccu

SEQ ID NO: 1643285 - RNA, 15 nt, Human
agcaccaucauuccc

SEQ ID NO: 1643286 - RNA, 18 nt, Human
cuuagaugggcauggugg

SEQ ID NO: 1643287 - RNA, 13 nt, Human
aagacaaggaaaa

SEQ ID NO: 1643288 - RNA, 11 nt, Human
caaaaaucaaa

SEQ ID NO: 1643289 - RNA, 15 nt, Human
aagccuccuuuuaaa

SEQ ID NO: 1643290 - RNA, 20 nt, Human
accugauuucugagcauuua

SEQ ID NO: 1643291 - RNA, 16 nt, Human
ugagccaaauguaaaa

SEQ ID NO: 1643292 - RNA, 13 nt, Human
aaaauaacgauaa

SEQ ID NO: 1643293 - RNA, 23 nt, Human
auguuaaaacugggacaggggag

SEQ ID NO: 1643294 - RNA, 22 nt, Human
aucaccaaggcugauuaaacca

SEQ ID NO: 1643295 - RNA, 21 nt, Human
cuauguucuaagaagugaaaa

SEQ ID NO: 1643296 - RNA, 14 nt, Human
auuauuuuuuaaaa

SEQ ID NO: 1643297 - RNA, 14 nt, Human
uauaauuuaaaaua

SEQ ID NO: 1643298 - RNA, 16 nt, Human
ugaaauuguauuacaa

SEQ ID NO: 1643299 - RNA, 19 nt, Human
uauauuuuuuguuaaauga

SEQ ID NO: 1643300 - RNA, 11 nt, Human
accauuuuuac

SEQ ID NO: 1643301 - RNA, 16 nt, Human
ccaugugcagccacca

SEQ ID NO: 1643302 - RNA, 13 nt, Human
aaggcaggaggau

SEQ ID NO: 1643303 - RNA, 14 nt, Human
ucucagaaggaaag

SEQ ID NO: 1643304 - RNA, 21 nt, Human
cucuucuggguuccuuccucu

SEQ ID NO: 1643305 - RNA, 16 nt, Human
caaaaggauaaugaau

SEQ ID NO: 1643306 - RNA, 15 nt, Human
aguauaggccaggca

SEQ ID NO: 1643307 - RNA, 15 nt, Human
auauuuuuuguuaaa

SEQ ID NO: 1643308 - RNA, 22 nt, Human
aauuccuaccucuucaccugac

SEQ ID NO: 1643309 - RNA, 15 nt, Human
caagcucacagaccu

SEQ ID NO: 1643310 - RNA, 20 nt, Human
guucugcagauaaacaguag

SEQ ID NO: 1643311 - RNA, 21 nt, Human
aaagauuugauguauguaaua

SEQ ID NO: 1643312 - RNA, 15 nt, Human
gaaagaaaauaacga

SEQ ID NO: 1643313 - RNA, 14 nt, Human
uauaaauaaaaaua

SEQ ID NO: 1643314 - RNA, 17 nt, Human
uuacagagacagaaagc

SEQ ID NO: 1643315 - RNA, 21 nt, Human
gacagugaaagaaaauaacaa

SEQ ID NO: 1643316 - RNA, 16 nt, Human
cauuuguauaaaauaa

SEQ ID NO: 1643317 - RNA, 18 nt, Human
auuauuuuuuaaaaaaau

SEQ ID NO: 1643318 - RNA, 13 nt, Human
cucaccuccccca

SEQ ID NO: 1643319 - RNA, 18 nt, Human
auccuucagccugaaaga

SEQ ID NO: 1643320 - RNA, 17 nt, Human
caggagcaucuccucaa

SEQ ID NO: 1643321 - RNA, 16 nt, Human
cauuauggauaaagau

SEQ ID NO: 1643322 - RNA, 21 nt, Human
auccccaagccuggcaaggga

SEQ ID NO: 1643323 - RNA, 21 nt, Human
aaucaccaaggcugauuaaac

SEQ ID NO: 1643324 - RNA, 20 nt, Human
augcaguuguugcccacagc

SEQ ID NO: 1643325 - RNA, 17 nt, Human
caucagcaucccuagaa

SEQ ID NO: 1643326 - RNA, 19 nt, Human
uuuccaagaaauauuccuu

SEQ ID NO: 1643327 - RNA, 16 nt, Human
aggguguguaaguaga

SEQ ID NO: 1643328 - RNA, 13 nt, Human
agaauauauuucc

SEQ ID NO: 1643329 - RNA, 17 nt, Human
aaaggaaggaagggaca

SEQ ID NO: 1643330 - RNA, 16 nt, Human
agcccugccucaagcu

SEQ ID NO: 1643331 - RNA, 21 nt, Human
gcgagacccugucucaauaaa

SEQ ID NO: 1643332 - RNA, 20 nt, Human
cuauguagaauauauuuccu

SEQ ID NO: 1643333 - RNA, 22 nt, Human
aaacauccuacaagacacagug

SEQ ID NO: 1643334 - RNA, 15 nt, Human
gauuaagaaaggaag

SEQ ID NO: 1643335 - RNA, 14 nt, Human
cauggccacaucug

SEQ ID NO: 1643336 - RNA, 19 nt, Human
uauuuaauuauuucacuuu

SEQ ID NO: 1643337 - RNA, 21 nt, Human
aaaugucuugcuugauuguau

SEQ ID NO: 1643338 - RNA, 18 nt, Human
auggcuugaguuuaaauu

SEQ ID NO: 1643339 - RNA, 14 nt, Human
uucacauuuaaaua

SEQ ID NO: 1643340 - RNA, 19 nt, Human
cagugagccaaauguaaaa

SEQ ID NO: 1643341 - RNA, 23 nt, Human
gaccccugagcuugcagagauga

SEQ ID NO: 1643342 - RNA, 18 nt, Human
acuggacucaccuccccc

SEQ ID NO: 1643343 - RNA, 14 nt, Human
ccugccccugagcc

SEQ ID NO: 1643344 - RNA, 17 nt, Human
uugugaagcaaaauuuu

SEQ ID NO: 1643345 - RNA, 19 nt, Human
aaaggaaggaagggacaca

SEQ ID NO: 1643346 - RNA, 22 nt, Human
ucccuagaaagccaugugcagc

SEQ ID NO: 1643347 - RNA, 23 nt, Human
ugauguuucauaagaauucuguu

SEQ ID NO: 1643348 - RNA, 22 nt, Human
aauugacccacaagaaaugaaa

SEQ ID NO: 1643349 - RNA, 11 nt, Human
uuauauuuauu

SEQ ID NO: 1643350 - RNA, 21 nt, Human
cucaaaacuucagacauagaa

SEQ ID NO: 1643351 - RNA, 16 nt, Human
ucucuaccaaaaaaag

SEQ ID NO: 1643352 - RNA, 20 nt, Human
ucaaaacuucagacauagaa

SEQ ID NO: 1643353 - RNA, 21 nt, Human
aggaugggaacaaggaaggaa

SEQ ID NO: 1643354 - RNA, 20 nt, Human
aaacuuuaugcuaagugaaa

SEQ ID NO: 1643355 - RNA, 17 nt, Human
cugagcgacagugagac

SEQ ID NO: 1643356 - RNA, 13 nt, Human
aauaucucuucuc

SEQ ID NO: 1643357 - RNA, 23 nt, Human
uaauuuguaguguuggagaagaa

SEQ ID NO: 1643358 - RNA, 12 nt, Human
accccugagcuu

SEQ ID NO: 1643359 - RNA, 12 nt, Human
caaccugccagc

SEQ ID NO: 1643360 - RNA, 20 nt, Human
caaauauaaauaaaaauaau

SEQ ID NO: 1643361 - RNA, 14 nt, Human
ugugaaaagcucca

SEQ ID NO: 1643362 - RNA, 15 nt, Human
aauuauuucacuuua

SEQ ID NO: 1643363 - RNA, 16 nt, Human
ccugaucaccugcccu

SEQ ID NO: 1643364 - RNA, 17 nt, Human
augccccgucccccucu

SEQ ID NO: 1643365 - RNA, 18 nt, Human
agcauuguuggcuguucc

SEQ ID NO: 1643366 - RNA, 17 nt, Human
cugaucaccugcccugc

SEQ ID NO: 1643367 - RNA, 17 nt, Human
ccucuggcuccagcugg

SEQ ID NO: 1643368 - RNA, 19 nt, Human
ggaauuucuucaacucccu

SEQ ID NO: 1643369 - RNA, 16 nt, Human
gucuaucuuugagcgc

SEQ ID NO: 1643370 - RNA, 19 nt, Human
cccacuggacucaccuccc

SEQ ID NO: 1643371 - RNA, 14 nt, Human
gaaaacaauaacga

SEQ ID NO: 1643372 - RNA, 20 nt, Human
caggcugagccucagucucc

SEQ ID NO: 1643373 - RNA, 15 nt, Human
ugagcucagcccugg

SEQ ID NO: 1643374 - RNA, 16 nt, Human
ccuaagugcagccccg

SEQ ID NO: 1643375 - RNA, 15 nt, Human
gccccauucaacauc

SEQ ID NO: 1643376 - RNA, 23 nt, Human
ugaaaugaguuuuucuuuucauu

SEQ ID NO: 1643377 - RNA, 15 nt, Human
ugauuucauucaaua

SEQ ID NO: 1643378 - RNA, 16 nt, Human
uccugcaauuccacuu

SEQ ID NO: 1643379 - RNA, 22 nt, Human
uuugaaacgaggauugggaaaa

SEQ ID NO: 1643380 - RNA, 15 nt, Human
gaaaacaaggaugaa

SEQ ID NO: 1643381 - RNA, 23 nt, Human
ucacagaaugacugacaaagaca

SEQ ID NO: 1643382 - RNA, 16 nt, Human
ccauuuuuagugaaau

SEQ ID NO: 1643383 - RNA, 14 nt, Human
uaauaucuuaucuu

SEQ ID NO: 1643384 - RNA, 22 nt, Human
aacucccugccccccagcccuc

SEQ ID NO: 1643385 - RNA, 16 nt, Human
auaucauagcaaauaa

SEQ ID NO: 1643386 - RNA, 15 nt, Human
auuuauuaaguauuu

SEQ ID NO: 1643387 - RNA, 23 nt, Human
gauaaggcuguucuuuaaauguc

SEQ ID NO: 1643388 - RNA, 21 nt, Human
cuggccuucggccuccauccu

SEQ ID NO: 1643389 - RNA, 13 nt, Human
ucucagggcagau

SEQ ID NO: 1643390 - RNA, 20 nt, Human
cuucuuuguguuauuucccu

SEQ ID NO: 1643391 - RNA, 23 nt, Human
aauacacuguuaucuucacuuuu

SEQ ID NO: 1643392 - RNA, 21 nt, Human
cuagucuguuuucccuccuug

SEQ ID NO: 1643393 - RNA, 16 nt, Human
ggcagagagguaggga

SEQ ID NO: 1643394 - RNA, 16 nt, Human
agguacuucaaauccu

SEQ ID NO: 1643395 - RNA, 14 nt, Human
ccaggcaugguggu

SEQ ID NO: 1643396 - RNA, 21 nt, Human
agacaagaaggaaagauuuug

SEQ ID NO: 1643397 - RNA, 13 nt, Human
uaagugcagcccc

SEQ ID NO: 1643398 - RNA, 19 nt, Human
cuucacccugaggugagca

SEQ ID NO: 1643399 - RNA, 16 nt, Human
aauuuuuaauuauaug

SEQ ID NO: 1643400 - RNA, 13 nt, Human
caucugagccccg

SEQ ID NO: 1643401 - RNA, 20 nt, Human
ugccccccagcccuccuuau

SEQ ID NO: 1643402 - RNA, 22 nt, Human
uugacccacaagaaaugaaagc

SEQ ID NO: 1643403 - RNA, 18 nt, Human
agauauuaacugagaagg

SEQ ID NO: 1643404 - RNA, 20 nt, Human
uggaaacacauguuccccuu

SEQ ID NO: 1643405 - RNA, 12 nt, Human
uaguacacacuu

SEQ ID NO: 1643406 - RNA, 16 nt, Human
ugccucaccccuugcc

SEQ ID NO: 1643407 - RNA, 18 nt, Human
augggggcagcaccuccu

SEQ ID NO: 1643408 - RNA, 13 nt, Human
uccccaaaugcuu

SEQ ID NO: 1643409 - RNA, 21 nt, Human
gcauggccacaucugagcccc

SEQ ID NO: 1643410 - RNA, 15 nt, Human
aaauguauucuuuua

SEQ ID NO: 1643411 - RNA, 19 nt, Human
agugccuccaaguucaaaa

SEQ ID NO: 1643412 - RNA, 14 nt, Human
cuauuauauuucca

SEQ ID NO: 1643413 - RNA, 22 nt, Human
uggguuccuuccucugagccuu

SEQ ID NO: 1643414 - RNA, 21 nt, Human
cacuugaacccgggaggcaga

SEQ ID NO: 1643415 - RNA, 15 nt, Human
ugccccgucccccuc

SEQ ID NO: 1643416 - RNA, 18 nt, Human
gccuucggccuccauccu

SEQ ID NO: 1643417 - RNA, 19 nt, Human
agcuacuaauuuuaaaaug

SEQ ID NO: 1643418 - RNA, 12 nt, Human
uaaaugcucaau

SEQ ID NO: 1643419 - RNA, 21 nt, Human
auucauagcagcuuauucaca

SEQ ID NO: 1643420 - RNA, 16 nt, Human
gaauauaaauuuauca

SEQ ID NO: 1643421 - RNA, 12 nt, Human
aauaaaaacaaa

SEQ ID NO: 1643422 - RNA, 16 nt, Human
acaccaaccuucugag

SEQ ID NO: 1643423 - RNA, 17 nt, Human
uucaaaacuuauuggaa

SEQ ID NO: 1643424 - RNA, 21 nt, Human
gacagaaagcagaacagugau

SEQ ID NO: 1643425 - RNA, 16 nt, Human
gugaaaccuggucucu

SEQ ID NO: 1643426 - RNA, 15 nt, Human
ugcagccaccagucc

SEQ ID NO: 1643427 - RNA, 22 nt, Human
aacaaaguugauuaagaaagga

SEQ ID NO: 1643428 - RNA, 13 nt, Human
aggauuugaaauu

SEQ ID NO: 1643429 - RNA, 19 nt, Human
gaaaauaacgauaaaagac

SEQ ID NO: 1643430 - RNA, 20 nt, Human
aaauccuugaagauuuacca

SEQ ID NO: 1643431 - RNA, 21 nt, Human
uagaugagagaacagggcuga

SEQ ID NO: 1643432 - RNA, 15 nt, Human
auuucacuuuagaaa

SEQ ID NO: 1643433 - RNA, 22 nt, Human
ggcauuuaggccaugggacagg

SEQ ID NO: 1643434 - RNA, 16 nt, Human
aagaaaggagauacag

SEQ ID NO: 1643435 - RNA, 16 nt, Human
uuuauauuugaaauau

SEQ ID NO: 1643436 - RNA, 14 nt, Human
cagugaaagaaaau

SEQ ID NO: 1643437 - RNA, 22 nt, Human
cucugagccuugggaccccuga

SEQ ID NO: 1643438 - RNA, 14 nt, Human
agcguuaauguaaa

SEQ ID NO: 1643439 - RNA, 18 nt, Human
cagcugcucaauaaagua

SEQ ID NO: 1643440 - RNA, 21 nt, Human
cuuguuggacgagaaaacaau

SEQ ID NO: 1643441 - RNA, 14 nt, Human
caguucugaagaag

SEQ ID NO: 1643442 - RNA, 19 nt, Human
cuccagcuggccgggagcc

SEQ ID NO: 1643443 - RNA, 15 nt, Human
uagauaggccauggg

SEQ ID NO: 1643444 - RNA, 23 nt, Human
caaagcugaaauggacuuuugua

SEQ ID NO: 1643445 - RNA, 18 nt, Human
acaaaugggaaacaaaag

SEQ ID NO: 1643446 - RNA, 15 nt, Human
acgagauacagaauu

SEQ ID NO: 1643447 - RNA, 22 nt, Human
ucugcuaugcuauugaaguuuu

SEQ ID NO: 1643448 - RNA, 21 nt, Human
ccaguccauugggcaggcaga

SEQ ID NO: 1643449 - RNA, 13 nt, Human
cuuaucaaaggac

SEQ ID NO: 1643450 - RNA, 21 nt, Human
acagugaaagaaaauaacaau

SEQ ID NO: 1643451 - RNA, 18 nt, Human
uagcccuuccccucugca

SEQ ID NO: 1643452 - RNA, 15 nt, Human
uuucccagucuucag

SEQ ID NO: 1643453 - RNA, 21 nt, Human
aacuuguaaaggaauuuaaaa

SEQ ID NO: 1643454 - RNA, 14 nt, Human
acccaaaaggcaga

SEQ ID NO: 1643455 - RNA, 13 nt, Human
aaguaaaggcaaa

SEQ ID NO: 1643456 - RNA, 14 nt, Human
agcucuaucaccaa

SEQ ID NO: 1643457 - RNA, 22 nt, Human
uuuauagcuacuaauuuuaaaa

SEQ ID NO: 1643458 - RNA, 17 nt, Human
uaugccacaagaacccc

SEQ ID NO: 1643459 - RNA, 20 nt, Human
agccuucucucaaggagagg

SEQ ID NO: 1643460 - RNA, 19 nt, Human
uggagccuacuaaaugcuc

SEQ ID NO: 1643461 - RNA, 15 nt, Human
cccccagcccuccuu

SEQ ID NO: 1643462 - RNA, 12 nt, Human
aucauuuacuuu

SEQ ID NO: 1643463 - RNA, 18 nt, Human
gcccuggugggcagagag

SEQ ID NO: 1643464 - RNA, 18 nt, Human
uggcucuggacaggcacu

SEQ ID NO: 1643465 - RNA, 21 nt, Human
ugagaaggcuguggauuuaau

SEQ ID NO: 1643466 - RNA, 18 nt, Human
ugagcucagcccuggugg

SEQ ID NO: 1643467 - RNA, 21 nt, Human
aagcuccauuuuuagugaaau

SEQ ID NO: 1643468 - RNA, 14 nt, Human
gccucagucucccu

SEQ ID NO: 1643469 - RNA, 18 nt, Human
gcauggccacaucugagc

SEQ ID NO: 1643470 - RNA, 15 nt, Human
gugaacuugguuuua

SEQ ID NO: 1643471 - RNA, 20 nt, Human
gaaaauaacaauaaaagaca

SEQ ID NO: 1643472 - RNA, 20 nt, Human
acuaaauugacacuuaaaaa

SEQ ID NO: 1643473 - RNA, 17 nt, Human
agucccaggcugagccu

SEQ ID NO: 1643474 - RNA, 17 nt, Human
gggcaguguucccuggg

SEQ ID NO: 1643475 - RNA, 14 nt, Human
uccacuuggucugu

SEQ ID NO: 1643476 - RNA, 22 nt, Human
ugguuguauuauuuuuuaaaaa

SEQ ID NO: 1643477 - RNA, 21 nt, Human
aggguuaugauuaaguaauga

SEQ ID NO: 1643478 - RNA, 15 nt, Human
cugcagauaaacagu

SEQ ID NO: 1643479 - RNA, 11 nt, Human
acuuugaagag

SEQ ID NO: 1643480 - RNA, 17 nt, Human
uuauaaucuuucacagg

SEQ ID NO: 1643481 - RNA, 13 nt, Human
aacacaacuauau

SEQ ID NO: 1643482 - RNA, 11 nt, Human
gcaugguuuag

SEQ ID NO: 1643483 - RNA, 20 nt, Human
ucacaugaacuuguaaagga

SEQ ID NO: 1643484 - RNA, 20 nt, Human
uguaagaaaauaucacuugu

SEQ ID NO: 1643485 - RNA, 15 nt, Human
ccgucccccucuggc

SEQ ID NO: 1643486 - RNA, 23 nt, Human
cuaguaauuggaaaggcagcucu

SEQ ID NO: 1643487 - RNA, 12 nt, Human
agggcaagagag

SEQ ID NO: 1643488 - RNA, 23 nt, Human
aaaauaucacuugucaauaaaau

SEQ ID NO: 1643489 - RNA, 13 nt, Human
gugagcaucaucu

SEQ ID NO: 1643490 - RNA, 18 nt, Human
aacagauuucaaaaaaaa

SEQ ID NO: 1643491 - RNA, 23 nt, Human
aagagccuuuuuuugaaaaaaag

SEQ ID NO: 1643492 - RNA, 17 nt, Human
cccacuagacccacugg

SEQ ID NO: 1643493 - RNA, 19 nt, Human
uaccccuggccaaggaaga

SEQ ID NO: 1643494 - RNA, 23 nt, Human
cacagauuugagcucagcccugg

SEQ ID NO: 1643495 - RNA, 14 nt, Human
auuuaaauauaugc

SEQ ID NO: 1643496 - RNA, 16 nt, Human
cuuuuaguuuuuaaag

SEQ ID NO: 1643497 - RNA, 20 nt, Human
guccccuauccuacuucccc

SEQ ID NO: 1643498 - RNA, 22 nt, Human
gagccucagucucccucccuug

SEQ ID NO: 1643499 - RNA, 14 nt, Human
cugcaaagcccagc

SEQ ID NO: 1643500 - RNA, 17 nt, Human
ccuacuuccccuuccua

SEQ ID NO: 1643501 - RNA, 18 nt, Human
gaagcaccaaucaugaau

SEQ ID NO: 1643502 - RNA, 14 nt, Human
aaauuuaucauuua

SEQ ID NO: 1643503 - RNA, 19 nt, Human
guacugagagugaacaaau

SEQ ID NO: 1643504 - RNA, 22 nt, Human
uuccccuuccuaauuccacagc

SEQ ID NO: 1643505 - RNA, 17 nt, Human
acaucgcagacacaugu

SEQ ID NO: 1643506 - RNA, 17 nt, Human
cauuguuggcuguuccu

SEQ ID NO: 1643507 - RNA, 17 nt, Human
aguaaaaggaaaugcuc

SEQ ID NO: 1643508 - RNA, 15 nt, Human
uguuaaaugauuuca

SEQ ID NO: 1643509 - RNA, 19 nt, Human
cagcacgggggccaaggau

SEQ ID NO: 1643510 - RNA, 14 nt, Human
uaguaucaaaagaa

SEQ ID NO: 1643511 - RNA, 11 nt, Human
gccaugggaca

SEQ ID NO: 1643512 - RNA, 16 nt, Human
agaugcuagaacuccc

SEQ ID NO: 1643513 - RNA, 19 nt, Human
agaucuacaugucuagaga

SEQ ID NO: 1643514 - RNA, 18 nt, Human
gaggcuccacuuggucug

SEQ ID NO: 1643515 - RNA, 19 nt, Human
aacacaucaggaaagagag

SEQ ID NO: 1643516 - RNA, 15 nt, Human
guuauaaaaauauau

SEQ ID NO: 1643517 - RNA, 12 nt, Human
uauauuuccuua

SEQ ID NO: 1643518 - RNA, 21 nt, Human
uguauaaaauaauuuuuauau

SEQ ID NO: 1643519 - RNA, 13 nt, Human
auguagaauauau

SEQ ID NO: 1643520 - RNA, 17 nt, Human
ccccaguuguuucuacu

SEQ ID NO: 1643521 - RNA, 22 nt, Human
ucucagcuucacccugagguga

SEQ ID NO: 1643522 - RNA, 20 nt, Human
aaagagugaaggauuuaugu

SEQ ID NO: 1643523 - RNA, 20 nt, Human
acaagacccaaaaggcagaa

SEQ ID NO: 1643524 - RNA, 12 nt, Human
uucucuaggaaa

SEQ ID NO: 1643525 - RNA, 22 nt, Human
uagacacacaugaaguccaagc

SEQ ID NO: 1643526 - RNA, 20 nt, Human
ucugaaaguuuuggaaacgu

SEQ ID NO: 1643527 - RNA, 18 nt, Human
ccugaaagaggaaugaag

SEQ ID NO: 1643528 - RNA, 18 nt, Human
cuuuuaaagaaacaaaaa

SEQ ID NO: 1643529 - RNA, 14 nt, Human
ggaaguagaggagg

SEQ ID NO: 1643530 - RNA, 14 nt, Human
uacguuaggaggac

SEQ ID NO: 1643531 - RNA, 19 nt, Human
cagauccccaagccuggca

SEQ ID NO: 1643532 - RNA, 16 nt, Human
agugagacagcucugc

SEQ ID NO: 1643533 - RNA, 18 nt, Human
aaauaacgauaaaagaca

SEQ ID NO: 1643534 - RNA, 22 nt, Human
aggcuccacuuggucugugaga

SEQ ID NO: 1643535 - RNA, 23 nt, Human
aucgcagacacaugugcuggcca

SEQ ID NO: 1643536 - RNA, 23 nt, Human
ccacaccaaccuucugaggagcu

SEQ ID NO: 1643537 - RNA, 21 nt, Human
gccucaagcuaugugagcuca

SEQ ID NO: 1643538 - RNA, 17 nt, Human
gauaaaagacagugaaa

SEQ ID NO: 1643539 - RNA, 13 nt, Human
caguuauuauauu

SEQ ID NO: 1643540 - RNA, 14 nt, Human
ucaauaaauaaaua

SEQ ID NO: 1643541 - RNA, 21 nt, Human
gcaaaauuuuuucucuaggaa

SEQ ID NO: 1643542 - RNA, 14 nt, Human
auuuccaagaaaua

SEQ ID NO: 1643543 - RNA, 22 nt, Human
caugucuagagaacacugugcu

SEQ ID NO: 1643544 - RNA, 20 nt, Human
cagagaaguuuucuggaggu

SEQ ID NO: 1643545 - RNA, 22 nt, Human
acacugucucuaccaaaaaaag

SEQ ID NO: 1643546 - RNA, 17 nt, Human
cucaugagggcuggaug

SEQ ID NO: 1643547 - RNA, 15 nt, Human
aagaaaauaacaaua

SEQ ID NO: 1643548 - RNA, 18 nt, Human
cacuccagugagacagcu

SEQ ID NO: 1643549 - RNA, 15 nt, Human
ugguuuagaaagcuu

SEQ ID NO: 1643550 - RNA, 18 nt, Human
cccacuagacccacugga

SEQ ID NO: 1643551 - RNA, 19 nt, Human
ucugagcauuuaauaugga

SEQ ID NO: 1643552 - RNA, 13 nt, Human
ucugcagcuucca

SEQ ID NO: 1643553 - RNA, 20 nt, Human
agaaaaccuaagcaaacuua

SEQ ID NO: 1643554 - RNA, 15 nt, Human
agggaagacaagaag

SEQ ID NO: 1643555 - RNA, 19 nt, Human
gccuggucaacauagugag

SEQ ID NO: 1643556 - RNA, 14 nt, Human
agcaaguauuagaa

SEQ ID NO: 1643557 - RNA, 18 nt, Human
auuauuucacuuuagaaa

SEQ ID NO: 1643558 - RNA, 17 nt, Human
cagucucuugaggcaca

SEQ ID NO: 1643559 - RNA, 13 nt, Human
cuccacuggaaaa

SEQ ID NO: 1643560 - RNA, 18 nt, Human
aguuuauauagaaaugua

SEQ ID NO: 1643561 - RNA, 21 nt, Human
ccaaauauaaauaaaaauaau

SEQ ID NO: 1643562 - RNA, 18 nt, Human
cccaagccuggcaaggga

SEQ ID NO: 1643563 - RNA, 13 nt, Human
ccaccugccuaua

SEQ ID NO: 1643564 - RNA, 17 nt, Human
auuuaguuauaaaaaua

SEQ ID NO: 1643565 - RNA, 23 nt, Human
agccaccaguccauugggcaggc

SEQ ID NO: 1643566 - RNA, 22 nt, Human
aaggagaggcaaagaaaggaga

SEQ ID NO: 1643567 - RNA, 18 nt, Human
cuuuccacagaagcucca

SEQ ID NO: 1643568 - RNA, 23 nt, Human
aggagcuguugagguaccuccaa

SEQ ID NO: 1643569 - RNA, 14 nt, Human
cucuggcuccagcu

SEQ ID NO: 1643570 - RNA, 17 nt, Human
cguaaucguguccccua

SEQ ID NO: 1643571 - RNA, 23 nt, Human
aggaccggccuuugcaccuccau

SEQ ID NO: 1643572 - RNA, 17 nt, Human
uccucugagccuuggga

SEQ ID NO: 1643573 - RNA, 17 nt, Human
ccucagucucccucccu

SEQ ID NO: 1643574 - RNA, 14 nt, Human
uccagauccuggaa

SEQ ID NO: 1643575 - RNA, 18 nt, Human
cccacuggacucaccucc

SEQ ID NO: 1643576 - RNA, 14 nt, Human
gauuaguacacacu

SEQ ID NO: 1643577 - RNA, 16 nt, Human
ugagcucaggagguca

SEQ ID NO: 1643578 - RNA, 15 nt, Human
ccuggugggcagaga

SEQ ID NO: 1643579 - RNA, 22 nt, Human
aauuuuuucucuaggaaauauu

SEQ ID NO: 1643580 - RNA, 15 nt, Human
auuuaauuauuucac

SEQ ID NO: 1643581 - RNA, 22 nt, Human
aagcugguggcucugugugcuc

SEQ ID NO: 1643582 - RNA, 12 nt, Human
aucguguccccu

SEQ ID NO: 1643583 - RNA, 21 nt, Human
ucagggcagaugaugcuuuga

SEQ ID NO: 1643584 - RNA, 14 nt, Human
uaaauaguuuauga

SEQ ID NO: 1643585 - RNA, 15 nt, Human
aaacugaaacaaaau

SEQ ID NO: 1643586 - RNA, 17 nt, Human
cuaagcuucacuguaaa

SEQ ID NO: 1643587 - RNA, 16 nt, Human
uuaauaauuuuuaauu

SEQ ID NO: 1643588 - RNA, 17 nt, Human
cauaguaccucugcuau

SEQ ID NO: 1643589 - RNA, 22 nt, Human
gcuaauuagcauggccacaucu

SEQ ID NO: 1643590 - RNA, 16 nt, Human
uucacauuuaaauaaa

SEQ ID NO: 1643591 - RNA, 12 nt, Human
aagagcuuaaca

SEQ ID NO: 1643592 - RNA, 17 nt, Human
cagugaaagaaaauaac

SEQ ID NO: 1643593 - RNA, 21 nt, Human
uaucuuccuauaauuuuagac

SEQ ID NO: 1643594 - RNA, 22 nt, Human
gauaagagauguugacucuaaa

SEQ ID NO: 1643595 - RNA, 13 nt, Human
auccugaggcucc

SEQ ID NO: 1643596 - RNA, 13 nt, Human
gacaaggaaaaaa

SEQ ID NO: 1643597 - RNA, 13 nt, Human
aucucaauauuuc

SEQ ID NO: 1643598 - RNA, 15 nt, Human
ugagacacugucucu

SEQ ID NO: 1643599 - RNA, 19 nt, Human
gacagucaccucauggaau

SEQ ID NO: 1643600 - RNA, 18 nt, Human
accaagcugguggcucug

SEQ ID NO: 1643601 - RNA, 16 nt, Human
ccuggugggcagagag

SEQ ID NO: 1643602 - RNA, 19 nt, Human
uaucacuugucaauaaaau

SEQ ID NO: 1643603 - RNA, 20 nt, Human
ccgauaucuucagaaaaccu

SEQ ID NO: 1643604 - RNA, 13 nt, Human
gaccagccugguc

SEQ ID NO: 1643605 - RNA, 13 nt, Human
caacauagugaga

SEQ ID NO: 1643606 - RNA, 15 nt, Human
ucaccagucccuccc

SEQ ID NO: 1643607 - RNA, 22 nt, Human
aaaguugauuuaaggccaggca

SEQ ID NO: 1643608 - RNA, 17 nt, Human
cuacacuccagugagac

SEQ ID NO: 1643609 - RNA, 16 nt, Human
ugacacuuaaaaaugg

SEQ ID NO: 1643610 - RNA, 23 nt, Human
uugaaguuuuggcaauugacuau

SEQ ID NO: 1643611 - RNA, 20 nt, Human
agcagcccuuagcccuuccc

SEQ ID NO: 1643612 - RNA, 23 nt, Human
cagcaccuccuaagaaggcaccu

SEQ ID NO: 1643613 - RNA, 17 nt, Human
gaugggaacaaggaagg

SEQ ID NO: 1643614 - RNA, 19 nt, Human
cuggggcuuuaacuccugc

SEQ ID NO: 1643615 - RNA, 23 nt, Human
aacuccugcuagaacagucucuu

SEQ ID NO: 1643616 - RNA, 18 nt, Human
aaaagacaaggaaaaaau

SEQ ID NO: 1643617 - RNA, 19 nt, Human
gauaaagcuuaggucaaag

SEQ ID NO: 1643618 - RNA, 12 nt, Human
gccauaaaacuu

SEQ ID NO: 1643619 - RNA, 21 nt, Human
aggaagaucccuuuguccaca

SEQ ID NO: 1643620 - RNA, 22 nt, Human
ucugcuggagacauugaggcag

SEQ ID NO: 1643621 - RNA, 13 nt, Human
agacacugucucu

SEQ ID NO: 1643622 - RNA, 16 nt, Human
gagaaacuggaacucu

SEQ ID NO: 1643623 - RNA, 15 nt, Human
aauugacccacaaga

SEQ ID NO: 1643624 - RNA, 18 nt, Human
ggaacuggugucuucagg

SEQ ID NO: 1643625 - RNA, 19 nt, Human
uguggauuuaauguggaaa

SEQ ID NO: 1643626 - RNA, 20 nt, Human
auaagccagacaucaacaga

SEQ ID NO: 1643627 - RNA, 19 nt, Human
uaguuuaugauuccaccua

SEQ ID NO: 1643628 - RNA, 20 nt, Human
gacauuugcucauggaauug

SEQ ID NO: 1643629 - RNA, 21 nt, Human
auaugcucuaaacauguuuau

SEQ ID NO: 1643630 - RNA, 11 nt, Human
augggacaggg

SEQ ID NO: 1643631 - RNA, 13 nt, Human
aaagaaaggagau

SEQ ID NO: 1643632 - RNA, 13 nt, Human
uuuagugaaauau

SEQ ID NO: 1643633 - RNA, 16 nt, Human
gugagacagcucugca

SEQ ID NO: 1643634 - RNA, 12 nt, Human
ccuucagccuga

SEQ ID NO: 1643635 - RNA, 12 nt, Human
ccccuugccaua

SEQ ID NO: 1643636 - RNA, 15 nt, Human
uuuagugaaauauua

SEQ ID NO: 1643637 - RNA, 16 nt, Human
uagaauauauuuccuu

SEQ ID NO: 1643638 - RNA, 21 nt, Human
gccuuuucccaacuccagaaa

SEQ ID NO: 1643639 - RNA, 21 nt, Human
ccccugcaaagcccagcuuga

SEQ ID NO: 1643640 - RNA, 17 nt, Human
ucgcagacacaugugcu

SEQ ID NO: 1643641 - RNA, 20 nt, Human
ccagugagacagcucugcau

SEQ ID NO: 1643642 - RNA, 23 nt, Human
gaaaaaguucugcagauaaacag

SEQ ID NO: 1643643 - RNA, 21 nt, Human
caggcacuaucuggguuuugg

SEQ ID NO: 1643644 - RNA, 17 nt, Human
gacagucaccucaugga

SEQ ID NO: 1643645 - RNA, 11 nt, Human
ugggggcagca

SEQ ID NO: 1643646 - RNA, 18 nt, Human
aaaguugauuaagaaagg

SEQ ID NO: 1643647 - RNA, 18 nt, Human
gagucccaggcugagccu

SEQ ID NO: 1643648 - RNA, 15 nt, Human
agaauaccacaggaa

SEQ ID NO: 1643649 - RNA, 17 nt, Human
aggguguguaaguagau

SEQ ID NO: 1643650 - RNA, 14 nt, Human
gagaggcaaagaaa

SEQ ID NO: 1643651 - RNA, 17 nt, Human
ccuauccuacuuccccu

SEQ ID NO: 1643652 - RNA, 18 nt, Human
uguggucacaggaaguag

SEQ ID NO: 1643653 - RNA, 14 nt, Human
aucaaaagaaagaa

SEQ ID NO: 1643654 - RNA, 23 nt, Human
aaauuuacagagacagaaagcag

SEQ ID NO: 1643655 - RNA, 14 nt, Human
cuuguacucugaaa

SEQ ID NO: 1643656 - RNA, 14 nt, Human
agcuggaaacacau

SEQ ID NO: 1643657 - RNA, 14 nt, Human
aaacugaaacaaaa

SEQ ID NO: 1643658 - RNA, 18 nt, Human
cagugaaagaaaauaaca

SEQ ID NO: 1643659 - RNA, 12 nt, Human
gaagaccucauu

SEQ ID NO: 1643660 - RNA, 18 nt, Human
uggccaccugcugagccc

SEQ ID NO: 1643661 - RNA, 17 nt, Human
uccauccugaggcucca

SEQ ID NO: 1643662 - RNA, 14 nt, Human
cucugccucagaaa

SEQ ID NO: 1643663 - RNA, 20 nt, Human
aacagucucuugaggcacag

SEQ ID NO: 1643664 - RNA, 14 nt, Human
aaauauuauuuuau

SEQ ID NO: 1643665 - RNA, 21 nt, Human
cugguagcuaaauauauauuu

SEQ ID NO: 1643666 - RNA, 14 nt, Human
uauaauuuaaauau

SEQ ID NO: 1643667 - RNA, 18 nt, Human
uaguaucaaaagaaagaa

SEQ ID NO: 1643668 - RNA, 15 nt, Human
auauaucauagcaaa

SEQ ID NO: 1643669 - RNA, 22 nt, Human
caaauuuacagagacagaaagc

SEQ ID NO: 1643670 - RNA, 21 nt, Human
cuaccaaaaaucucaauauuu

SEQ ID NO: 1643671 - RNA, 23 nt, Human
caacacccugagguugugugugg

SEQ ID NO: 1643672 - RNA, 21 nt, Human
aagacucgggauuaguacaca

SEQ ID NO: 1643673 - RNA, 15 nt, Human
cuccagggagucuca

SEQ ID NO: 1643674 - RNA, 16 nt, Human
caaacugaaacaaaau

SEQ ID NO: 1643675 - RNA, 18 nt, Human
aacugccaucauuuacuu

SEQ ID NO: 1643676 - RNA, 21 nt, Human
ugccagcuggccuugugagga

SEQ ID NO: 1643677 - RNA, 10 nt, Human
aaacacaugu

SEQ ID NO: 1643678 - RNA, 17 nt, Human
cccccugcaaagcccag

SEQ ID NO: 1643679 - RNA, 14 nt, Human
auauuuauuuuaau

SEQ ID NO: 1643680 - RNA, 14 nt, Human
agucugacuguuuc

SEQ ID NO: 1643681 - RNA, 19 nt, Human
gcugaugggcaaaaaacca

SEQ ID NO: 1643682 - RNA, 18 nt, Human
ggccuugugaggagcugg

SEQ ID NO: 1643683 - RNA, 14 nt, Human
aacgauaaaagaca

SEQ ID NO: 1643684 - RNA, 15 nt, Human
acaagacccaaaagg

SEQ ID NO: 1643685 - RNA, 14 nt, Human
aagcucuaucacca

SEQ ID NO: 1643686 - RNA, 18 nt, Human
uucaauaucuuuuuuuua

SEQ ID NO: 1643687 - RNA, 21 nt, Human
uggggaauauguuagagaauu

SEQ ID NO: 1643688 - RNA, 20 nt, Human
uauuuauuacuguaagaaaa

SEQ ID NO: 1643689 - RNA, 13 nt, Human
aaauaaaaauaau

SEQ ID NO: 1643690 - RNA, 15 nt, Human
uccaagccucauguc

SEQ ID NO: 1643691 - RNA, 13 nt, Human
ccccucugcagcu

SEQ ID NO: 1643692 - RNA, 18 nt, Human
gcagugucugcuggagac

SEQ ID NO: 1643693 - RNA, 16 nt, Human
cuggaugcucucguug

SEQ ID NO: 1643694 - RNA, 18 nt, Human
acagucucuugaggcaca

SEQ ID NO: 1643695 - RNA, 17 nt, Human
cugagaugggagaauca

SEQ ID NO: 1643696 - RNA, 17 nt, Human
auaucuuaucuuccuau

SEQ ID NO: 1643697 - RNA, 14 nt, Human
uucagccugaaaga

SEQ ID NO: 1643698 - RNA, 15 nt, Human
ggacucaccuccccc

SEQ ID NO: 1643699 - RNA, 23 nt, Human
aucuuccuauaauuuuagacauu

SEQ ID NO: 1643700 - RNA, 20 nt, Human
gagccugaucaccugcccug

SEQ ID NO: 1643701 - RNA, 19 nt, Human
ugauggaguuucucuagaa

SEQ ID NO: 1643702 - RNA, 16 nt, Human
aaaagcuccauuuuua

SEQ ID NO: 1643703 - RNA, 18 nt, Human
aacaaugcuguauuuuaa

SEQ ID NO: 1643704 - RNA, 16 nt, Human
acaaauccaaugaaau

SEQ ID NO: 1643705 - RNA, 16 nt, Human
agccuacuaaaugcuc

SEQ ID NO: 1643706 - RNA, 20 nt, Human
uuaaauggucaauuuuguua

SEQ ID NO: 1643707 - RNA, 23 nt, Human
aaguauccuucagccugaaagag

SEQ ID NO: 1643708 - RNA, 16 nt, Human
gcuucacuguaaaaua

SEQ ID NO: 1643709 - RNA, 23 nt, Human
ucaauaucuuuuuuuuaauaaac

SEQ ID NO: 1643710 - RNA, 12 nt, Human
uauucacaagac

SEQ ID NO: 1643711 - RNA, 17 nt, Human
caaacauauauaacaau

SEQ ID NO: 1643712 - RNA, 20 nt, Human
aaagaaaggagauacagugg

SEQ ID NO: 1643713 - RNA, 19 nt, Human
ugggacaggggagaaccua

SEQ ID NO: 1643714 - RNA, 14 nt, Human
aucaccaaggcuga

SEQ ID NO: 1643715 - RNA, 18 nt, Human
ucucuaggaaauauuuau

SEQ ID NO: 1643716 - RNA, 21 nt, Human
uuuuauggcacuaguauuucu

SEQ ID NO: 1643717 - RNA, 17 nt, Human
agugauuaccagggacu

SEQ ID NO: 1643718 - RNA, 22 nt, Human
acacauaucaaacugaaacaaa

SEQ ID NO: 1643719 - RNA, 19 nt, Human
caaaacuuauuggaauguu

SEQ ID NO: 1643720 - RNA, 15 nt, Human
accucccccaucucu

SEQ ID NO: 1643721 - RNA, 14 nt, Human
aucuucagaaaacc

SEQ ID NO: 1643722 - RNA, 16 nt, Human
ugcagugucugcugga

SEQ ID NO: 1643723 - RNA, 19 nt, Human
gcaggcacugccaaaacau

SEQ ID NO: 1643724 - RNA, 15 nt, Human
cugacucuuaagaag

SEQ ID NO: 1643725 - RNA, 17 nt, Human
gcccuuccccucugcag

SEQ ID NO: 1643726 - RNA, 14 nt, Human
caugaacuuguaaa

SEQ ID NO: 1643727 - RNA, 21 nt, Human
aagucuuucacauuuaaauaa

SEQ ID NO: 1643728 - RNA, 20 nt, Human
auccucgaggcccuagcauu

SEQ ID NO: 1643729 - RNA, 15 nt, Human
ccaaaauauaaucag

SEQ ID NO: 1643730 - RNA, 15 nt, Human
uagagaauuuccuua

SEQ ID NO: 1643731 - RNA, 22 nt, Human
ugaauggcuaagcaaaauguga

SEQ ID NO: 1643732 - RNA, 15 nt, Human
ggccuucggccucca

SEQ ID NO: 1643733 - RNA, 19 nt, Human
acaaauuuacagagacaga

SEQ ID NO: 1643734 - RNA, 14 nt, Human
caaggcuagaacca

SEQ ID NO: 1643735 - RNA, 11 nt, Human
aacauuuaugu

SEQ ID NO: 1643736 - RNA, 16 nt, Human
auauuuccaagaaaua

SEQ ID NO: 1643737 - RNA, 14 nt, Human
ggcaccucucuggg

SEQ ID NO: 1643738 - RNA, 15 nt, Human
caaggaaaaaauaac

SEQ ID NO: 1643739 - RNA, 17 nt, Human
ccaaaaaucucaauauu

SEQ ID NO: 1643740 - RNA, 15 nt, Human
aaugaauggcuaagc

SEQ ID NO: 1643741 - RNA, 21 nt, Human
auaauuuuuauauuugaaaua

SEQ ID NO: 1643742 - RNA, 21 nt, Human
gcagcauuguuggcuguuccu

SEQ ID NO: 1643743 - RNA, 15 nt, Human
gccccugcacuccag

SEQ ID NO: 1643744 - RNA, 18 nt, Human
cccaggcugagccucagu

SEQ ID NO: 1643745 - RNA, 16 nt, Human
gccaaauguaaaauag

SEQ ID NO: 1643746 - RNA, 23 nt, Human
aauaggcugaugggcaaaaaacc

SEQ ID NO: 1643747 - RNA, 19 nt, Human
auucccagccagcacagcc

SEQ ID NO: 1643748 - RNA, 14 nt, Human
gaggcacagaaacu

SEQ ID NO: 1643749 - RNA, 18 nt, Human
cuccccaaaugcuuucca

SEQ ID NO: 1643750 - RNA, 18 nt, Human
aucuuauaauuuaaaaua

SEQ ID NO: 1643751 - RNA, 20 nt, Human
cagucccuccccaaaugcuu

SEQ ID NO: 1643752 - RNA, 22 nt, Human
gaauaaccaacacccugagguu

SEQ ID NO: 1643753 - RNA, 14 nt, Human
aaugauuaugaauu

SEQ ID NO: 1643754 - RNA, 19 nt, Human
aaaauaacaauaaaagaca

SEQ ID NO: 1643755 - RNA, 15 nt, Human
uccuacaagacacag

SEQ ID NO: 1643756 - RNA, 13 nt, Human
uuauguuuaauuc

SEQ ID NO: 1643757 - RNA, 11 nt, Human
ucaccugcccu

SEQ ID NO: 1643758 - RNA, 14 nt, Human
acuuuuauaagaaa

SEQ ID NO: 1643759 - RNA, 13 nt, Human
agagauaaagcuu

SEQ ID NO: 1643760 - RNA, 13 nt, Human
uaacgauaaaaga

SEQ ID NO: 1643761 - RNA, 15 nt, Human
ucauaagaauucugu

SEQ ID NO: 1643762 - RNA, 22 nt, Human
uuauaagaaauaggaaauauuu

SEQ ID NO: 1643763 - RNA, 20 nt, Human
uugauaaguacaugauaagc

SEQ ID NO: 1643764 - RNA, 16 nt, Human
acaaaaggaaugugua

SEQ ID NO: 1643765 - RNA, 22 nt, Human
cugaaacaaaauuagaaaugua

SEQ ID NO: 1643766 - RNA, 20 nt, Human
aggacaaaaggaauguguaa

SEQ ID NO: 1643767 - RNA, 21 nt, Human
uguaaaauggugugaccacug

SEQ ID NO: 1643768 - RNA, 23 nt, Human
aucuaugccacaagaacccccuu

SEQ ID NO: 1643769 - RNA, 20 nt, Human
uggauuuaauguggaaauga

SEQ ID NO: 1643770 - RNA, 22 nt, Human
caccucccccaucucuucuggg

SEQ ID NO: 1643771 - RNA, 14 nt, Human
uaaaggaauuuaaa

SEQ ID NO: 1643772 - RNA, 16 nt, Human
gccuucucucaaggag

SEQ ID NO: 1643773 - RNA, 23 nt, Human
auaucuuuuuuuuaauaaaccau

SEQ ID NO: 1643774 - RNA, 14 nt, Human
uaaauaaauaaaua

SEQ ID NO: 1643775 - RNA, 14 nt, Human
auaaauaaauaaau

SEQ ID NO: 1643776 - RNA, 13 nt, Human
cccaaaaggcaga

SEQ ID NO: 1643777 - RNA, 21 nt, Human
auuccuuuuucucuccucucc

SEQ ID NO: 1643778 - RNA, 16 nt, Human
guuucacaccuuaucu

SEQ ID NO: 1643779 - RNA, 19 nt, Human
uccauccugaggcuccacu

SEQ ID NO: 1643780 - RNA, 18 nt, Human
ugaaaaaguucugcagau

SEQ ID NO: 1643781 - RNA, 15 nt, Human
cacaggacagcccuu

SEQ ID NO: 1643782 - RNA, 14 nt, Human
uggacucaccuccc

SEQ ID NO: 1643783 - RNA, 18 nt, Human
ugaagagugugaggaaaa

SEQ ID NO: 1643784 - RNA, 17 nt, Human
auuagcauggccacauc

SEQ ID NO: 1643785 - RNA, 18 nt, Human
cuaauaucuuaucuuccu

SEQ ID NO: 1643786 - RNA, 14 nt, Human
aaaacuuauuggaa

SEQ ID NO: 1643787 - RNA, 16 nt, Human
cccuuuacccccauga

SEQ ID NO: 1643788 - RNA, 16 nt, Human
uauuuuugugauuuug

SEQ ID NO: 1643789 - RNA, 17 nt, Human
aauaaaguguuugaaag

SEQ ID NO: 1643790 - RNA, 17 nt, Human
cuuccuaauuccacagc

SEQ ID NO: 1643791 - RNA, 22 nt, Human
uaauaggcguaacuaauuuuaa

SEQ ID NO: 1643792 - RNA, 21 nt, Human
ccucuguucugcacacagcac

SEQ ID NO: 1643793 - RNA, 18 nt, Human
aaaaguucugcagauaaa

SEQ ID NO: 1643794 - RNA, 23 nt, Human
ucuuagaugcaguucugaagaag

SEQ ID NO: 1643795 - RNA, 11 nt, Human
gagguaaaagc

SEQ ID NO: 1643796 - RNA, 15 nt, Human
ucaagggugugugca

SEQ ID NO: 1643797 - RNA, 17 nt, Human
aaaauuagaaauguaau

SEQ ID NO: 1643798 - RNA, 16 nt, Human
cuucacuguaaaauaa

SEQ ID NO: 1643799 - RNA, 15 nt, Human
cuuuucccaacucca

SEQ ID NO: 1643800 - RNA, 13 nt, Human
gcagaacagugau

SEQ ID NO: 1643801 - RNA, 12 nt, Human
gacagugaaaga

SEQ ID NO: 1643802 - RNA, 21 nt, Human
auguuuaauucugaaagcaac

SEQ ID NO: 1643803 - RNA, 15 nt, Human
augguuguauuauuu

SEQ ID NO: 1643804 - RNA, 21 nt, Human
cccccucuggcuccagcuggc

SEQ ID NO: 1643805 - RNA, 19 nt, Human
acuuuuauaagaaauagga

SEQ ID NO: 1643806 - RNA, 14 nt, Human
gcagaucacuugag

SEQ ID NO: 1643807 - RNA, 20 nt, Human
agcccuggugggcagagagg

SEQ ID NO: 1643808 - RNA, 23 nt, Human
cacuggacucaccucccccaucu

SEQ ID NO: 1643809 - RNA, 15 nt, Human
ccuugccaugugcua

SEQ ID NO: 1643810 - RNA, 18 nt, Human
aaauauaaauaaaaauaa

SEQ ID NO: 1643811 - RNA, 17 nt, Human
gccccccagcccuccuu

SEQ ID NO: 1643812 - RNA, 16 nt, Human
uguaguccuguaaugg

SEQ ID NO: 1643813 - RNA, 18 nt, Human
uggagggaagccuugggg

SEQ ID NO: 1643814 - RNA, 17 nt, Human
ccacugcagaagacagu

SEQ ID NO: 1643815 - RNA, 23 nt, Human
uuuauuaggaguaccauaauucu

SEQ ID NO: 1643816 - RNA, 23 nt, Human
ccccucuggcuccagcuggccgg

SEQ ID NO: 1643817 - RNA, 20 nt, Human
ugauuauaugucacuuugcu

SEQ ID NO: 1643818 - RNA, 14 nt, Human
ggccacaucugagc

SEQ ID NO: 1643819 - RNA, 12 nt, Human
caucaggaaaga

SEQ ID NO: 1643820 - RNA, 14 nt, Human
caggcacaguggcu

SEQ ID NO: 1643821 - RNA, 21 nt, Human
ucacagaaugacugacaaaga

SEQ ID NO: 1643822 - RNA, 15 nt, Human
gcaagcucuaucacc

SEQ ID NO: 1643823 - RNA, 16 nt, Human
acaugaacuuguaaag

SEQ ID NO: 1643824 - RNA, 20 nt, Human
guaucaaaagaaagaaaauc

SEQ ID NO: 1643825 - RNA, 16 nt, Human
aauauaaauaaaaaua

SEQ ID NO: 1643826 - RNA, 23 nt, Human
auuuuauagcuacuaauuuuaaa

SEQ ID NO: 1643827 - RNA, 23 nt, Human
cuucaacucccugccccccagcc

SEQ ID NO: 1643828 - RNA, 19 nt, Human
uggccacaucugagccccg

SEQ ID NO: 1643829 - RNA, 23 nt, Human
ucaugcccauaccccuggccaag

SEQ ID NO: 1643830 - RNA, 16 nt, Human
cugcucucaguucacu

SEQ ID NO: 1643831 - RNA, 16 nt, Human
aaagaaaggagauaca

SEQ ID NO: 1643832 - RNA, 20 nt, Human
ucuaugagggcuaauaucuu

SEQ ID NO: 1643833 - RNA, 16 nt, Human
uauaucaauuuaaaaa

SEQ ID NO: 1643834 - RNA, 19 nt, Human
gucuuucacauuuaaauaa

SEQ ID NO: 1643835 - RNA, 15 nt, Human
aauguuuguccuugg

SEQ ID NO: 1643836 - RNA, 20 nt, Human
uggaauaauccuaaacauau

SEQ ID NO: 1643837 - RNA, 18 nt, Human
ggcacagaaacuccuguu

SEQ ID NO: 1643838 - RNA, 15 nt, Human
ccaucucaggugugu

SEQ ID NO: 1643839 - RNA, 23 nt, Human
uuuccaucaaggguacacugccu

SEQ ID NO: 1643840 - RNA, 15 nt, Human
aaggaaaaaauaaca

SEQ ID NO: 1643841 - RNA, 16 nt, Human
augcuaagugaaauaa

SEQ ID NO: 1643842 - RNA, 15 nt, Human
cugcacuccagccug

SEQ ID NO: 1643843 - RNA, 20 nt, Human
ggcaggaggaucacuugagc

SEQ ID NO: 1643844 - RNA, 20 nt, Human
aaaguugauuaagaaaggaa

SEQ ID NO: 1643845 - RNA, 16 nt, Human
gcagugucugcuggag

SEQ ID NO: 1643846 - RNA, 17 nt, Human
ucuuauaauuuaaaaua

SEQ ID NO: 1643847 - RNA, 19 nt, Human
gcccuuccccucugcagcu

SEQ ID NO: 1643848 - RNA, 20 nt, Human
caccuccuaagaaggcaccu

SEQ ID NO: 1643849 - RNA, 15 nt, Human
cuaguaauuggaaag

SEQ ID NO: 1643850 - RNA, 22 nt, Human
aaugggcacaggguuuauguuu

SEQ ID NO: 1643851 - RNA, 22 nt, Human
auauuuccuuauucagaauuuc

SEQ ID NO: 1643852 - RNA, 18 nt, Human
auuagaaauguaauuaug

SEQ ID NO: 1643853 - RNA, 16 nt, Human
uuagauagaugaagaa

SEQ ID NO: 1643854 - RNA, 22 nt, Human
aucucuucuggguuccuuccuc

SEQ ID NO: 1643855 - RNA, 16 nt, Human
ggcugaggcaggagga

SEQ ID NO: 1643856 - RNA, 16 nt, Human
uaacaauaaaagacaa

SEQ ID NO: 1643857 - RNA, 15 nt, Human
aacugaaacaaaauu

SEQ ID NO: 1643858 - RNA, 20 nt, Human
uaauucugguagcuaaauau

SEQ ID NO: 1643859 - RNA, 17 nt, Human
aacaaaauuagaaaugu

SEQ ID NO: 1643860 - RNA, 20 nt, Human
ccagcuggccgggagccuga

SEQ ID NO: 1643861 - RNA, 12 nt, Human
auuuuaaaagaa

SEQ ID NO: 1643862 - RNA, 13 nt, Human
auaauuuuagaca

SEQ ID NO: 1643863 - RNA, 16 nt, Human
ugauuuaaggccaggc

SEQ ID NO: 1643864 - RNA, 22 nt, Human
uucugguagcuaaauauauauu

SEQ ID NO: 1643865 - RNA, 19 nt, Human
uuuuaucugcuaugcuauu

SEQ ID NO: 1643866 - RNA, 17 nt, Human
auguugacaugggacau

SEQ ID NO: 1643867 - RNA, 18 nt, Human
uaauuauguucuaagugc

SEQ ID NO: 1643868 - RNA, 16 nt, Human
ucuaaaaguuuaaguu

SEQ ID NO: 1643869 - RNA, 17 nt, Human
cauaaaauacaaaaacu

SEQ ID NO: 1643870 - RNA, 17 nt, Human
caaauaagucaucugau

SEQ ID NO: 1643871 - RNA, 22 nt, Human
uaauaucuuaucuuccuauaau

SEQ ID NO: 1643872 - RNA, 17 nt, Human
uuucccuccuuggagac

SEQ ID NO: 1643873 - RNA, 14 nt, Human
gaaugauuaugaau

SEQ ID NO: 1643874 - RNA, 13 nt, Human
acuuauuggaaug

SEQ ID NO: 1643875 - RNA, 17 nt, Human
auggcuaguaucaaaag

SEQ ID NO: 1643876 - RNA, 15 nt, Human
auuauuuuuuaaaaa

SEQ ID NO: 1643877 - RNA, 22 nt, Human
ccagcuggccuugugaggagcu

SEQ ID NO: 1643878 - RNA, 22 nt, Human
uuuaauaauguuucaaacauau

SEQ ID NO: 1643879 - RNA, 23 nt, Human
uuagaugcaguucugaagaagau

SEQ ID NO: 1643880 - RNA, 13 nt, Human
uucaaaaaaaaac

SEQ ID NO: 1643881 - RNA, 15 nt, Human
gccucagucucccuc

SEQ ID NO: 1643882 - RNA, 18 nt, Human
aaggaugccccguccccc

SEQ ID NO: 1643883 - RNA, 16 nt, Human
acaucaggaaagagag

SEQ ID NO: 1643884 - RNA, 10 nt, Human
agcuuugagg

SEQ ID NO: 1643885 - RNA, 17 nt, Human
uuucauaagaauucugu

SEQ ID NO: 1643886 - RNA, 12 nt, Human
agcuuggaaugu

SEQ ID NO: 1643887 - RNA, 12 nt, Human
cauagaaguaaa

SEQ ID NO: 1643888 - RNA, 20 nt, Human
uuaaguuuuuuuuuaaaaaa

SEQ ID NO: 1643889 - RNA, 21 nt, Human
uauuacuguaagaaaauauca

SEQ ID NO: 1643890 - RNA, 18 nt, Human
aaauauuuauuuuaauaa

SEQ ID NO: 1643891 - RNA, 17 nt, Human
agucuucagcagagaag

SEQ ID NO: 1643892 - RNA, 18 nt, Human
uuggggccuaugcagagg

SEQ ID NO: 1643893 - RNA, 20 nt, Human
aguugauuuaaggccaggca

SEQ ID NO: 1643894 - RNA, 20 nt, Human
gggaggcagagguugcagug

SEQ ID NO: 1643895 - RNA, 12 nt, Human
cuaagaagugaa

SEQ ID NO: 1643896 - RNA, 14 nt, Human
ugcucauggaauug

SEQ ID NO: 1643897 - RNA, 12 nt, Human
gacccugucuca

SEQ ID NO: 1643898 - RNA, 14 nt, Human
acgcauggaaaagu

SEQ ID NO: 1643899 - RNA, 21 nt, Human
cuggguuuuggggggacgcua

SEQ ID NO: 1643900 - RNA, 20 nt, Human
uaauaucuuaucuuccuaua

SEQ ID NO: 1643901 - RNA, 14 nt, Human
aucuauguagaaua

SEQ ID NO: 1643902 - RNA, 19 nt, Human
gguuuaauaauuuuuaauu

SEQ ID NO: 1643903 - RNA, 20 nt, Human
agaggagaaacuggaacucu

SEQ ID NO: 1643904 - RNA, 13 nt, Human
aacucuauaaugu

SEQ ID NO: 1643905 - RNA, 21 nt, Human
cuggaaacacauguuccccuu

SEQ ID NO: 1643906 - RNA, 21 nt, Human
caguaguuagcuuucuuccug

SEQ ID NO: 1643907 - RNA, 22 nt, Human
gcuugcagagaugaggccgcca

SEQ ID NO: 1643908 - RNA, 22 nt, Human
auauaaauaaaaauaauccuca

SEQ ID NO: 1643909 - RNA, 21 nt, Human
aaugaauggcuaagcaaaaug

SEQ ID NO: 1643910 - RNA, 15 nt, Human
aguucugaagaagau

SEQ ID NO: 1643911 - RNA, 17 nt, Human
cacaccaaccuucugag

SEQ ID NO: 1643912 - RNA, 17 nt, Human
guuucuagagaugguuu

SEQ ID NO: 1643913 - RNA, 16 nt, Human
uaaacuuugauuuuau

SEQ ID NO: 1643914 - RNA, 15 nt, Human
cagccagcacagccu

SEQ ID NO: 1643915 - RNA, 17 nt, Human
gauaucuucagaaaacc

SEQ ID NO: 1643916 - RNA, 18 nt, Human
gccugagcgacagugaga

SEQ ID NO: 1643917 - RNA, 14 nt, Human
ugacacuuaaaaau

SEQ ID NO: 1643918 - RNA, 20 nt, Human
cugagguuguguguggaagg

SEQ ID NO: 1643919 - RNA, 12 nt, Human
cagugaaagaaa

SEQ ID NO: 1643920 - RNA, 14 nt, Human
ugcuagaacucccu

SEQ ID NO: 1643921 - RNA, 17 nt, Human
agguccacaacacacag

SEQ ID NO: 1643922 - RNA, 23 nt, Human
cuugauaaauggcuuccuggcaa

SEQ ID NO: 1643923 - RNA, 21 nt, Human
cgaaguauccuucagccugaa

SEQ ID NO: 1643924 - RNA, 20 nt, Human
aauuuuuucucuaggaaaua

SEQ ID NO: 1643925 - RNA, 21 nt, Human
gugcucuauuaccauuaugga

SEQ ID NO: 1643926 - RNA, 14 nt, Human
aaauaaaaacaaag

SEQ ID NO: 1643927 - RNA, 16 nt, Human
gccucagucucccucc

SEQ ID NO: 1643928 - RNA, 15 nt, Human
aaaauaacaaugaaa

SEQ ID NO: 1643929 - RNA, 19 nt, Human
agauuugagcucagcccug

SEQ ID NO: 1643930 - RNA, 16 nt, Human
caauaacgauaaaaga

SEQ ID NO: 1643931 - RNA, 15 nt, Human
ugcuugucccugugg

SEQ ID NO: 1643932 - RNA, 21 nt, Human
aauauauuuccuuauucagaa

SEQ ID NO: 1643933 - RNA, 16 nt, Human
auaaauaaauaaauaa

SEQ ID NO: 1643934 - RNA, 16 nt, Human
aauaaauaaauaaaua

SEQ ID NO: 1643935 - RNA, 16 nt, Human
uaaauaaauaaauaaa

SEQ ID NO: 1643936 - RNA, 16 nt, Human
aaauaaauaaauaaau

SEQ ID NO: 1643937 - RNA, 11 nt, Human
aauaaauaaau

SEQ ID NO: 1643938 - RNA, 22 nt, Human
ggcuaagcuucacuguaaaaua

SEQ ID NO: 1643939 - RNA, 15 nt, Human
uuagugaaauauuau

SEQ ID NO: 1643940 - RNA, 21 nt, Human
cuccagggagucucagcuuca

SEQ ID NO: 1643941 - RNA, 22 nt, Human
ggacagcccuucuuuccacaga

SEQ ID NO: 1643942 - RNA, 16 nt, Human
ucaguuuuugugaaaa

SEQ ID NO: 1643943 - RNA, 12 nt, Human
acacuuaaaaau

SEQ ID NO: 1643944 - RNA, 17 nt, Human
guagaaugggggcagca

SEQ ID NO: 1643945 - RNA, 19 nt, Human
uguauacugugugcuaaaa

SEQ ID NO: 1643946 - RNA, 22 nt, Human
cuaagcuucacuguaaaauaau

SEQ ID NO: 1643947 - RNA, 16 nt, Human
uggaaacgaagcacca

SEQ ID NO: 1643948 - RNA, 20 nt, Human
uccaagccucauguccacug

SEQ ID NO: 1643949 - RNA, 22 nt, Human
ucucucaaggagaggcaaagaa

SEQ ID NO: 1643950 - RNA, 16 nt, Human
ggaugccccguccccc

SEQ ID NO: 1643951 - RNA, 17 nt, Human
cucuuuugggauuuuug

SEQ ID NO: 1643952 - RNA, 19 nt, Human
ccauccugccccugagccc

SEQ ID NO: 1643953 - RNA, 20 nt, Human
acaccuuaucuauguagaau

SEQ ID NO: 1643954 - RNA, 13 nt, Human
auaacgauaaaag

SEQ ID NO: 1643955 - RNA, 19 nt, Human
uggugaacuugguuuuaau

SEQ ID NO: 1643956 - RNA, 19 nt, Human
agaugcuagaacucccuuu

SEQ ID NO: 1643957 - RNA, 21 nt, Human
accaacacccugagguugugu

SEQ ID NO: 1643958 - RNA, 21 nt, Human
auuauauuuccaagaaauauu

SEQ ID NO: 1643959 - RNA, 14 nt, Human
gaucuaugccacaa

SEQ ID NO: 1643960 - RNA, 22 nt, Human
uucauagaguucccaugaacua

SEQ ID NO: 1643961 - RNA, 17 nt, Human
guuccuuuuaaagaaac

SEQ ID NO: 1643962 - RNA, 18 nt, Human
gaugcaguucugaagaag

SEQ ID NO: 1643963 - RNA, 17 nt, Human
ucagcguuaauguaaag

SEQ ID NO: 1643964 - RNA, 19 nt, Human
uuuccugaaaacccuugcc

SEQ ID NO: 1643965 - RNA, 13 nt, Human
cacauuuaaauaa

SEQ ID NO: 1643966 - RNA, 16 nt, Human
ggagaggcaaagaaag

SEQ ID NO: 1643967 - RNA, 18 nt, Human
gcacuccagccugagcga

SEQ ID NO: 1643968 - RNA, 12 nt, Human
aagaaaggaagu

SEQ ID NO: 1643969 - RNA, 13 nt, Human
agcucugcccauc

SEQ ID NO: 1643970 - RNA, 20 nt, Human
agagaucucuguagaaggag

SEQ ID NO: 1643971 - RNA, 21 nt, Human
uauacugugugcuaaaacaag

SEQ ID NO: 1643972 - RNA, 22 nt, Human
agaaugagagacacacugaaga

SEQ ID NO: 1643973 - RNA, 17 nt, Human
accugagccccaaaagg

SEQ ID NO: 1643974 - RNA, 19 nt, Human
auaauuuuuauauuugaaa

SEQ ID NO: 1643975 - RNA, 17 nt, Human
gccaugggacagggagg

SEQ ID NO: 1643976 - RNA, 21 nt, Human
aaggcaggaggaucacuugag

SEQ ID NO: 1643977 - RNA, 19 nt, Human
cuuggggccuaugcagagg

SEQ ID NO: 1643978 - RNA, 11 nt, Human
cuauuuaauua

SEQ ID NO: 1643979 - RNA, 22 nt, Human
ucauucccguugaacgucacau

SEQ ID NO: 1643980 - RNA, 11 nt, Human
auuaaaaccuc

SEQ ID NO: 1643981 - RNA, 18 nt, Human
gccugggcaacaugguga

SEQ ID NO: 1643982 - RNA, 19 nt, Human
agugaggagcuuugaaacg

SEQ ID NO: 1643983 - RNA, 22 nt, Human
cccccugcaaagcccagcuuga

SEQ ID NO: 1643984 - RNA, 17 nt, Human
cucagucucccucccuu

SEQ ID NO: 1643985 - RNA, 19 nt, Human
gagccucagucucccuccc

SEQ ID NO: 1643986 - RNA, 16 nt, Human
accucugccucagaaa

SEQ ID NO: 1643987 - RNA, 17 nt, Human
aaagaaacauuugguaa

SEQ ID NO: 1643988 - RNA, 22 nt, Human
augucuagagaacacugugcuc

SEQ ID NO: 1643989 - RNA, 15 nt, Human
caaauccaaugaaau

SEQ ID NO: 1643990 - RNA, 19 nt, Human
ucuuaucuuccuauaauuu

SEQ ID NO: 1643991 - RNA, 15 nt, Human
aaagaaagaaaauca

SEQ ID NO: 1643992 - RNA, 18 nt, Human
auuuaggccaugggacag

SEQ ID NO: 1643993 - RNA, 19 nt, Human
uaucucauuuccaagcaag

SEQ ID NO: 1643994 - RNA, 13 nt, Human
ugccagcuggccu

SEQ ID NO: 1643995 - RNA, 19 nt, Human
auuguaguccuguaaugga

SEQ ID NO: 1643996 - RNA, 12 nt, Human
cuacaagacaca

SEQ ID NO: 1643997 - RNA, 14 nt, Human
auuuucuauaauuu

SEQ ID NO: 1643998 - RNA, 18 nt, Human
ccugaggugagcaucauc

SEQ ID NO: 1643999 - RNA, 15 nt, Human
gaucuggcucuggac

SEQ ID NO: 1644000 - RNA, 18 nt, Human
aaaucuuauaauuuaaaa

SEQ ID NO: 1644001 - RNA, 12 nt, Human
cuaccaaaaaaa

SEQ ID NO: 1644002 - RNA, 12 nt, Human
cagaacagugau

SEQ ID NO: 1644003 - RNA, 19 nt, Human
auguuccuuuuaaagaaac

SEQ ID NO: 1644004 - RNA, 23 nt, Human
aguaauuggaaaggcagcucuaa

SEQ ID NO: 1644005 - RNA, 19 nt, Human
aaugagcacgcauggaaaa

SEQ ID NO: 1644006 - RNA, 15 nt, Human
aacgauaaaagacag

SEQ ID NO: 1644007 - RNA, 16 nt, Human
uaucuuccuauaauuu

SEQ ID NO: 1644008 - RNA, 15 nt, Human
cagaauucauucacu

SEQ ID NO: 1644009 - RNA, 22 nt, Human
auauaugcuaagucuuauauau

SEQ ID NO: 1644010 - RNA, 14 nt, Human
aaauauaaauaaaa

SEQ ID NO: 1644011 - RNA, 14 nt, Human
auaaauaaaaauaa

SEQ ID NO: 1644012 - RNA, 12 nt, Human
uuuuauauuuga

SEQ ID NO: 1644013 - RNA, 20 nt, Human
uuucuuccuggauuccucac

SEQ ID NO: 1644014 - RNA, 18 nt, Human
aaaaccuaagcaaacuua

SEQ ID NO: 1644015 - RNA, 23 nt, Human
ugaauuauguuugcauguucacu

SEQ ID NO: 1644016 - RNA, 18 nt, Human
cauggugaaaccuggucu

SEQ ID NO: 1644017 - RNA, 21 nt, Human
ccucccuuggggccuaugcag

SEQ ID NO: 1644018 - RNA, 16 nt, Human
acuuuuauaagaaaua

SEQ ID NO: 1644019 - RNA, 17 nt, Human
aaaguacaagagcuuaa

SEQ ID NO: 1644020 - RNA, 16 nt, Human
uagcuacuaauuuuaa

SEQ ID NO: 1644021 - RNA, 14 nt, Human
aaaagaaagaaaau

SEQ ID NO: 1644022 - RNA, 16 nt, Human
ugcaugguuuagaaag

SEQ ID NO: 1644023 - RNA, 18 nt, Human
uauaggauguggggaagu

SEQ ID NO: 1644024 - RNA, 20 nt, Human
acaaugacuuguacucugaa

SEQ ID NO: 1644025 - RNA, 14 nt, Human
acaaauccaaugaa

SEQ ID NO: 1644026 - RNA, 16 nt, Human
gucauuauuaggaagu

SEQ ID NO: 1644027 - RNA, 16 nt, Human
agaacuaaaaauuaaa

SEQ ID NO: 1644028 - RNA, 20 nt, Human
ugagcgcccacuagacccac

SEQ ID NO: 1644029 - RNA, 17 nt, Human
gccugagcgacagugag

SEQ ID NO: 1644030 - RNA, 15 nt, Human
ugcagauaaacagua

SEQ ID NO: 1644031 - RNA, 22 nt, Human
auaacaaugcuguauuuuaaaa

SEQ ID NO: 1644032 - RNA, 17 nt, Human
agucugacuguuuccau

SEQ ID NO: 1644033 - RNA, 16 nt, Human
aguuuauauagaaaug

SEQ ID NO: 1644034 - RNA, 14 nt, Human
aauauuauuuuaua

SEQ ID NO: 1644035 - RNA, 23 nt, Human
caucaacagauaaauaguuuaug

SEQ ID NO: 1644036 - RNA, 18 nt, Human
ggccacaucugagccccg

SEQ ID NO: 1644037 - RNA, 22 nt, Human
cugccaaaacaucaaccugcca

SEQ ID NO: 1644038 - RNA, 12 nt, Human
agggauggggcu

SEQ ID NO: 1644039 - RNA, 15 nt, Human
cugccagcuggccuu

SEQ ID NO: 1644040 - RNA, 15 nt, Human
cuaucuuugagcgcc

SEQ ID NO: 1644041 - RNA, 12 nt, Human
ucuacacuccag

SEQ ID NO: 1644042 - RNA, 14 nt, Human
cguguccccuaucc

SEQ ID NO: 1644043 - RNA, 15 nt, Human
aagucauuauuagga

SEQ ID NO: 1644044 - RNA, 19 nt, Human
gagacauugaggcaggcac

SEQ ID NO: 1644045 - RNA, 22 nt, Human
aauuguaggugacuauuauauu

SEQ ID NO: 1644046 - RNA, 17 nt, Human
aaacauccuacaagaca

SEQ ID NO: 1644047 - RNA, 21 nt, Human
uccuacaagacacagugacca

SEQ ID NO: 1644048 - RNA, 14 nt, Human
cuugagguaaaagc

SEQ ID NO: 1644049 - RNA, 21 nt, Human
gccuauagucccacuacuugu

SEQ ID NO: 1644050 - RNA, 16 nt, Human
guucugcacacagcac

SEQ ID NO: 1644051 - RNA, 22 nt, Human
uuuauaagaaauaggaaauauu

SEQ ID NO: 1644052 - RNA, 16 nt, Human
uuugcuguuauuuuau

SEQ ID NO: 1644053 - RNA, 12 nt, Human
ggaggcugagau

SEQ ID NO: 1644054 - RNA, 13 nt, Human
uagcauggccaca

SEQ ID NO: 1644055 - RNA, 22 nt, Human
uagaaauguauucuuuuaguuu

SEQ ID NO: 1644056 - RNA, 16 nt, Human
cuucaacucccugccc

SEQ ID NO: 1644057 - RNA, 18 nt, Human
aagggaauuucuucaacu

SEQ ID NO: 1644058 - RNA, 15 nt, Human
ugagcgcccacuaga

SEQ ID NO: 1644059 - RNA, 18 nt, Human
uauguuccuuuuaaagaa

SEQ ID NO: 1644060 - RNA, 17 nt, Human
gacaaggaaaaaauaac

SEQ ID NO: 1644061 - RNA, 14 nt, Human
cccugccucaagcu

SEQ ID NO: 1644062 - RNA, 12 nt, Human
gaaaauaacaau

SEQ ID NO: 1644063 - RNA, 21 nt, Human
gcagaucuacaugucuagaga

SEQ ID NO: 1644064 - RNA, 18 nt, Human
auguuccuuuuaaagaaa

SEQ ID NO: 1644065 - RNA, 12 nt, Human
cuucaacucccu

SEQ ID NO: 1644066 - RNA, 13 nt, Human
uaauuuuuauauu

SEQ ID NO: 1644067 - RNA, 15 nt, Human
acuuuuauaagaaau

SEQ ID NO: 1644068 - RNA, 19 nt, Human
uuacagaaagauuugaugu

SEQ ID NO: 1644069 - RNA, 20 nt, Human
ccaacacccugagguugugu

SEQ ID NO: 1644070 - RNA, 12 nt, Human
cauuauauuuau

SEQ ID NO: 1644071 - RNA, 18 nt, Human
ccacuuggucugugagau

SEQ ID NO: 1644072 - RNA, 23 nt, Human
cuggggcuuuaacuccugcuaga

SEQ ID NO: 1644073 - RNA, 12 nt, Human
cauguuccccuu

SEQ ID NO: 1644074 - RNA, 22 nt, Human
gaugggaacaaggaaggaaaga

SEQ ID NO: 1644075 - RNA, 15 nt, Human
cucaacaaacauaau

SEQ ID NO: 1644076 - RNA, 19 nt, Human
uucuuuaucuuuuuaguau

SEQ ID NO: 1644077 - RNA, 22 nt, Human
cacagauuugagcucagcccug

SEQ ID NO: 1644078 - RNA, 20 nt, Human
gaaggcugaggcaggaggau

SEQ ID NO: 1644079 - RNA, 16 nt, Human
aaaaugugauauguac

SEQ ID NO: 1644080 - RNA, 16 nt, Human
gagcucgugggacagu

SEQ ID NO: 1644081 - RNA, 12 nt, Human
augaccaacauc

SEQ ID NO: 1644082 - RNA, 17 nt, Human
aaauaacgauaaaagac

SEQ ID NO: 1644083 - RNA, 14 nt, Human
uuuuaaaaaagaaa

SEQ ID NO: 1644084 - RNA, 14 nt, Human
cccugucucaauaa

SEQ ID NO: 1644085 - RNA, 19 nt, Human
guggauuuaauguggaaau

SEQ ID NO: 1644086 - RNA, 13 nt, Human
ucuagagcaaagc

SEQ ID NO: 1644087 - RNA, 12 nt, Human
uuuuuuuuaaaa

SEQ ID NO: 1644088 - RNA, 22 nt, Human
agaauuuuaugcggcauuuucu

SEQ ID NO: 1644089 - RNA, 14 nt, Human
ccugccccccagcc

SEQ ID NO: 1644090 - RNA, 22 nt, Human
aucaucaagucuuucacauuua

SEQ ID NO: 1644091 - RNA, 21 nt, Human
cuguuaucuucacuuuuauaa

SEQ ID NO: 1644092 - RNA, 16 nt, Human
uuuuagugaaauauua

SEQ ID NO: 1644093 - RNA, 23 nt, Human
gccccugcacuccagccugagcg

SEQ ID NO: 1644094 - RNA, 22 nt, Human
cuuccuaauuccacagcugcuc

SEQ ID NO: 1644095 - RNA, 15 nt, Human
gcagagguugcagug

SEQ ID NO: 1644096 - RNA, 14 nt, Human
cagucucccucccu

SEQ ID NO: 1644097 - RNA, 14 nt, Human
agauguagaggaga

SEQ ID NO: 1644098 - RNA, 12 nt, Human
ugccaaaauaua

SEQ ID NO: 1644099 - RNA, 15 nt, Human
cucgugggacaguca

SEQ ID NO: 1644100 - RNA, 18 nt, Human
caaggcuagaaccaccug

SEQ ID NO: 1644101 - RNA, 15 nt, Human
caaaaaaaggaagga

SEQ ID NO: 1644102 - RNA, 19 nt, Human
ucuguuuucccuccuugga

SEQ ID NO: 1644103 - RNA, 18 nt, Human
ucucagguguguugcagu

SEQ ID NO: 1644104 - RNA, 16 nt, Human
uuauaauuuaaaauau

SEQ ID NO: 1644105 - RNA, 22 nt, Human
cacuaguauuucuaugaaauau

SEQ ID NO: 1644106 - RNA, 22 nt, Human
ugaagcaaaauuuuuucucuag

SEQ ID NO: 1644107 - RNA, 23 nt, Human
uagauaggucagugcaaauacuc

SEQ ID NO: 1644108 - RNA, 22 nt, Human
aauaugccccauucaacaucua

SEQ ID NO: 1644109 - RNA, 15 nt, Human
cauuuacuuuuaaac

SEQ ID NO: 1644110 - RNA, 22 nt, Human
uuuccuuauucagaauuucuaa

SEQ ID NO: 1644111 - RNA, 21 nt, Human
ucccuggggcuuuaacuccug

SEQ ID NO: 1644112 - RNA, 15 nt, Human
caaaacuuauuggaa

SEQ ID NO: 1644113 - RNA, 13 nt, Human
ugauuauauguca

SEQ ID NO: 1644114 - RNA, 12 nt, Human
auuuaucauuua

SEQ ID NO: 1644115 - RNA, 15 nt, Human
aauaaauaaauaaaa

SEQ ID NO: 1644116 - RNA, 19 nt, Human
gcauggccacaucugagcc

SEQ ID NO: 1644117 - RNA, 18 nt, Human
augauguuucauaagaau

SEQ ID NO: 1644118 - RNA, 17 nt, Human
uuaaauggucaauuuug

SEQ ID NO: 1644119 - RNA, 15 nt, Human
aagaaggaaagauuu

SEQ ID NO: 1644120 - RNA, 14 nt, Human
uaaaauagugaaua

SEQ ID NO: 1644121 - RNA, 12 nt, Human
aauuuuaaaaug

SEQ ID NO: 1644122 - RNA, 16 nt, Human
uguucuaagaagugaa

SEQ ID NO: 1644123 - RNA, 16 nt, Human
ucagcagagaaguuuu

SEQ ID NO: 1644124 - RNA, 21 nt, Human
aucuuuuuuuuaauaaaccau

SEQ ID NO: 1644125 - RNA, 15 nt, Human
uuaaguauuuuauua

SEQ ID NO: 1644126 - RNA, 20 nt, Human
caaaguugauuaagaaagga

SEQ ID NO: 1644127 - RNA, 15 nt, Human
gcacuacuguacucc

SEQ ID NO: 1644128 - RNA, 19 nt, Human
ggaaaaaauaacaaugaaa

SEQ ID NO: 1644129 - RNA, 22 nt, Human
caucaucuucuggguuaggccu

SEQ ID NO: 1644130 - RNA, 15 nt, Human
acucaacaaacauaa

SEQ ID NO: 1644131 - RNA, 18 nt, Human
cauagugagacacugucu

SEQ ID NO: 1644132 - RNA, 17 nt, Human
ccugagcuugcagagau

SEQ ID NO: 1644133 - RNA, 15 nt, Human
uucuguuaaaauaua

SEQ ID NO: 1644134 - RNA, 22 nt, Human
auauauaacaaugcuguauuuu

SEQ ID NO: 1644135 - RNA, 19 nt, Human
uacaaaaaaaaaaaaaaau

SEQ ID NO: 1644136 - RNA, 19 nt, Human
uuuauaucaauuuaaaaaa

SEQ ID NO: 1644137 - RNA, 15 nt, Human
cgggagccugaucac

SEQ ID NO: 1644138 - RNA, 18 nt, Human
uagugaaauauuauuuua

SEQ ID NO: 1644139 - RNA, 16 nt, Human
uaccccuggccaagga

SEQ ID NO: 1644140 - RNA, 14 nt, Human
auauauuuccuuau

SEQ ID NO: 1644141 - RNA, 15 nt, Human
uccauugggcaggca

SEQ ID NO: 1644142 - RNA, 13 nt, Human
uucuauaauuuaa

SEQ ID NO: 1644143 - RNA, 18 nt, Human
aucagcaucccuagaaag

SEQ ID NO: 1644144 - RNA, 15 nt, Human
cagucucccucccuu

SEQ ID NO: 1644145 - RNA, 16 nt, Human
uaagaaauaggaaaua

SEQ ID NO: 1644146 - RNA, 17 nt, Human
uucacuuuuauaagaaa

SEQ ID NO: 1644147 - RNA, 19 nt, Human
agcucugcccauccugccc

SEQ ID NO: 1644148 - RNA, 17 nt, Human
ugaaauauuauuuuaua

SEQ ID NO: 1644149 - RNA, 20 nt, Human
uaaaagacaaggaaaaaaua

SEQ ID NO: 1644150 - RNA, 17 nt, Human
ugaauauaaauuuauca

SEQ ID NO: 1644151 - RNA, 12 nt, Human
uuauuucacuuu

SEQ ID NO: 1644152 - RNA, 21 nt, Human
accaaggagccaaacauccua

SEQ ID NO: 1644153 - RNA, 17 nt, Human
auuuuaauaauguuuca

SEQ ID NO: 1644154 - RNA, 18 nt, Human
cucccuuggggccuaugc

SEQ ID NO: 1644155 - RNA, 13 nt, Human
ccugccccccagc

SEQ ID NO: 1644156 - RNA, 16 nt, Human
ggcugagccucagucu

SEQ ID NO: 1644157 - RNA, 17 nt, Human
ucauacuucuuaggguu

SEQ ID NO: 1644158 - RNA, 12 nt, Human
guugauggaaau

SEQ ID NO: 1644159 - RNA, 18 nt, Human
uaauuuuagacauucuuu

SEQ ID NO: 1644160 - RNA, 17 nt, Human
ugguucccuugaugaag

SEQ ID NO: 1644161 - RNA, 17 nt, Human
aauaacaauaaaagaca

SEQ ID NO: 1644162 - RNA, 15 nt, Human
cccugccccccagcc

SEQ ID NO: 1644163 - RNA, 17 nt, Human
agcgacagugagacucu

SEQ ID NO: 1644164 - RNA, 18 nt, Human
aaaaucuuauaauuuaaa

SEQ ID NO: 1644165 - RNA, 15 nt, Human
agaggcaaagaaagg

SEQ ID NO: 1644166 - RNA, 13 nt, Human
uguauauuuuaua

SEQ ID NO: 1644167 - RNA, 15 nt, Human
cauguccacugguuc

SEQ ID NO: 1644168 - RNA, 14 nt, Human
uggcuugaguuuaa

SEQ ID NO: 1644169 - RNA, 21 nt, Human
acgcucucuggccuucggccu

SEQ ID NO: 1644170 - RNA, 17 nt, Human
ugaccacugcagaagac

SEQ ID NO: 1644171 - RNA, 18 nt, Human
aguccauugggcaggcag

SEQ ID NO: 1644172 - RNA, 12 nt, Human
gcugaggcagga

SEQ ID NO: 1644173 - RNA, 14 nt, Human
gcguugagccacca

SEQ ID NO: 1644174 - RNA, 14 nt, Human
acuuugauuuuaua

SEQ ID NO: 1644175 - RNA, 19 nt, Human
acccccagcuuugaggaaa

SEQ ID NO: 1644176 - RNA, 21 nt, Human
gccugaucaccugcccugcug

SEQ ID NO: 1644177 - RNA, 14 nt, Human
ccaugggacaggga

SEQ ID NO: 1644178 - RNA, 19 nt, Human
uuugccaaguucuccacua

SEQ ID NO: 1644179 - RNA, 16 nt, Human
agcuugaaaccuucac

SEQ ID NO: 1644180 - RNA, 20 nt, Human
uaggaauugacccacaagaa

SEQ ID NO: 1644181 - RNA, 14 nt, Human
acuggacucaccuc

SEQ ID NO: 1644182 - RNA, 12 nt, Human
ugugaggagcug

SEQ ID NO: 1644183 - RNA, 22 nt, Human
gaaaaucuuauaauuuaaaaua

SEQ ID NO: 1644184 - RNA, 15 nt, Human
cgagacaagcagccc

SEQ ID NO: 1644185 - RNA, 23 nt, Human
aauguauucuuuuaguuuuuaaa

SEQ ID NO: 1644186 - RNA, 13 nt, Human
aagcuucuguucc

SEQ ID NO: 1644187 - RNA, 17 nt, Human
gacgagaaaacaauaac

SEQ ID NO: 1644188 - RNA, 21 nt, Human
guuuguuuauuuguuuuucca

SEQ ID NO: 1644189 - RNA, 14 nt, Human
acacugaagaagca

SEQ ID NO: 1644190 - RNA, 18 nt, Human
uauuuucuauaauuuaaa

SEQ ID NO: 1644191 - RNA, 16 nt, Human
uucucuaggaaauauu

SEQ ID NO: 1644192 - RNA, 11 nt, Human
cugacaaagac

SEQ ID NO: 1644193 - RNA, 17 nt, Human
cucgugggacagucacc

SEQ ID NO: 1644194 - RNA, 14 nt, Human
ucagucucccuccc

SEQ ID NO: 1644195 - RNA, 17 nt, Human
cagcagugccaaaauau

SEQ ID NO: 1644196 - RNA, 20 nt, Human
uggggcuaaggcaggaggau

SEQ ID NO: 1644197 - RNA, 14 nt, Human
acuauuauauuucc

SEQ ID NO: 1644198 - RNA, 18 nt, Human
cagcuuauugucuaguga

SEQ ID NO: 1644199 - RNA, 22 nt, Human
ggccauuacccccagcuuugag

SEQ ID NO: 1644200 - RNA, 21 nt, Human
uuagaaauguaauuauguucu

SEQ ID NO: 1644201 - RNA, 13 nt, Human
cuaugaaauauua

SEQ ID NO: 1644202 - RNA, 20 nt, Human
cugcacuccagccugagcga

SEQ ID NO: 1644203 - RNA, 16 nt, Human
agcuaaauauauauuu

SEQ ID NO: 1644204 - RNA, 14 nt, Human
uuccccucugcagc

SEQ ID NO: 1644205 - RNA, 17 nt, Human
uuauuacuguaagaaaa

SEQ ID NO: 1644206 - RNA, 18 nt, Human
uuacaaaugggaaacaaa

SEQ ID NO: 1644207 - RNA, 12 nt, Human
aaggaugccccg

SEQ ID NO: 1644208 - RNA, 22 nt, Human
accuuaucuauguagaauauau

SEQ ID NO: 1644209 - RNA, 14 nt, Human
gccaggcacagugg

SEQ ID NO: 1644210 - RNA, 15 nt, Human
cucguggaacaguua

SEQ ID NO: 1644211 - RNA, 22 nt, Human
ugagacucugucucaguccaug

SEQ ID NO: 1644212 - RNA, 20 nt, Human
augucgucaaagcugaaaug

SEQ ID NO: 1644213 - RNA, 23 nt, Human
caggcauggugguuuacgccuau

SEQ ID NO: 1644214 - RNA, 14 nt, Human
cagagaaguuuucu

SEQ ID NO: 1644215 - RNA, 12 nt, Human
caagaaggaaag

SEQ ID NO: 1644216 - RNA, 14 nt, Human
agcucguggaacag

SEQ ID NO: 1644217 - RNA, 20 nt, Human
uuauucacuguauguccuug

SEQ ID NO: 1644218 - RNA, 23 nt, Human
uaaaagacagugaaagaaaauaa

SEQ ID NO: 1644219 - RNA, 18 nt, Human
auagugagacacugucuc

SEQ ID NO: 1644220 - RNA, 21 nt, Human
cuaaauugacacuuaaaaaug

SEQ ID NO: 1644221 - RNA, 12 nt, Human
auaacuggaaac

SEQ ID NO: 1644222 - RNA, 19 nt, Human
uucccuugaugaagaaguu

SEQ ID NO: 1644223 - RNA, 22 nt, Human
caggauuagauaaggcuguucu

SEQ ID NO: 1644224 - RNA, 16 nt, Human
agacauugaggcaggc

SEQ ID NO: 1644225 - RNA, 19 nt, Human
accaaaaaaaggaaggaag

SEQ ID NO: 1644226 - RNA, 16 nt, Human
ugcacaucaaaauaug

SEQ ID NO: 1644227 - RNA, 21 nt, Human
cuauuuaauuauuucacuuua

SEQ ID NO: 1644228 - RNA, 17 nt, Human
uaauuccacagcugcuc

SEQ ID NO: 1644229 - RNA, 15 nt, Human
guuuuucuuuucauu

SEQ ID NO: 1644230 - RNA, 15 nt, Human
cccugcaaagcccag

SEQ ID NO: 1644231 - RNA, 17 nt, Human
uagaauauauuuccuua

SEQ ID NO: 1644232 - RNA, 24 nt, Human
cauaugaaaaggcuaagcuucacu

SEQ ID NO: 1644233 - RNA, 18 nt, Human
uaauaauguuucaaacau

SEQ ID NO: 1644234 - RNA, 14 nt, Human
auuaagaaaggaag

SEQ ID NO: 1644235 - RNA, 22 nt, Human
uaaaacaagcacuaaacaaaga

SEQ ID NO: 1644236 - RNA, 15 nt, Human
ggcuggcgugcagca

SEQ ID NO: 1644237 - RNA, 13 nt, Human
ccaaggaugcccc

SEQ ID NO: 1644238 - RNA, 16 nt, Human
cuuuaugcuaagugaa

SEQ ID NO: 1644239 - RNA, 16 nt, Human
gaagccagaucuaugc

SEQ ID NO: 1644240 - RNA, 13 nt, Human
aacucccugcccc

SEQ ID NO: 1644241 - RNA, 22 nt, Human
ccuuccccucugcagcuuccag

SEQ ID NO: 1644242 - RNA, 16 nt, Human
gagaacacugugcucu

SEQ ID NO: 1644243 - RNA, 14 nt, Human
cuggccgggagccu

SEQ ID NO: 1644244 - RNA, 21 nt, Human
ucaguuccagccuucucucaa

SEQ ID NO: 1644245 - RNA, 15 nt, Human
aauacuuuauaaagg

SEQ ID NO: 1644246 - RNA, 16 nt, Human
auuccaccuacaugag

SEQ ID NO: 1644247 - RNA, 16 nt, Human
acagagacagaaagca

SEQ ID NO: 1644248 - RNA, 12 nt, Human
aauaaaguacaa

SEQ ID NO: 1644249 - RNA, 16 nt, Human
gagcaucaucuucugg

SEQ ID NO: 1644250 - RNA, 19 nt, Human
ucagguguguugcaguguc

SEQ ID NO: 1644251 - RNA, 21 nt, Human
ggaagacaagaaggaaagauu

SEQ ID NO: 1644252 - RNA, 19 nt, Human
gaaagaaaauaacaauaaa

SEQ ID NO: 1644253 - RNA, 14 nt, Human
aaaagaaacauuug

SEQ ID NO: 1644254 - RNA, 14 nt, Human
uuucuguuaaaaua

SEQ ID NO: 1644255 - RNA, 22 nt, Human
gagucccaggcugagccucagu

SEQ ID NO: 1644256 - RNA, 19 nt, Human
aagcauuccaacuaucuca

SEQ ID NO: 1644257 - RNA, 16 nt, Human
ccucaaaacuucagac

SEQ ID NO: 1644258 - RNA, 14 nt, Human
gccauuacccccag

SEQ ID NO: 1644259 - RNA, 20 nt, Human
auacugugugcuaaaacaag

SEQ ID NO: 1644260 - RNA, 13 nt, Human
agcgacagugaga

SEQ ID NO: 1644261 - RNA, 21 nt, Human
aguuagcuuucuuccuggauu

SEQ ID NO: 1644262 - RNA, 21 nt, Human
ugagcucagcccuggugggca

SEQ ID NO: 1644263 - RNA, 21 nt, Human
ugccuguaaucacagcuacuu

SEQ ID NO: 1644264 - RNA, 22 nt, Human
aagacccaaaaggcagaagcaa

SEQ ID NO: 1644265 - RNA, 16 nt, Human
aguaaaggcaaacuua

SEQ ID NO: 1644266 - RNA, 13 nt, Human
cguugagccacca

SEQ ID NO: 1644267 - RNA, 12 nt, Human
ucuuaagaagac

SEQ ID NO: 1644268 - RNA, 14 nt, Human
auaaauaaauaaaa

SEQ ID NO: 1644269 - RNA, 17 nt, Human
ucugugagaugcuagaa

SEQ ID NO: 1644270 - RNA, 22 nt, Human
acagauuugagcucagcccugg

SEQ ID NO: 1644271 - RNA, 21 nt, Human
gacagucaccucauggaauug

SEQ ID NO: 1644272 - RNA, 15 nt, Human
cuugaaaacuuuaug

SEQ ID NO: 1644273 - RNA, 22 nt, Human
agaaaacaauaacgauaaaaga

SEQ ID NO: 1644274 - RNA, 15 nt, Human
agcagugccaaaaua

SEQ ID NO: 1644275 - RNA, 19 nt, Human
agccuucucucaaggagag

SEQ ID NO: 1644276 - RNA, 17 nt, Human
ccaaggaugccccgucc

SEQ ID NO: 1644277 - RNA, 11 nt, Human
auuuuugaagc

SEQ ID NO: 1644278 - RNA, 14 nt, Human
auacaaaaaaaaaa

SEQ ID NO: 1644279 - RNA, 19 nt, Human
aguauuucuaugaaauauu

SEQ ID NO: 1644280 - RNA, 20 nt, Human
cuaaaugucaaucagccuag

SEQ ID NO: 1644281 - RNA, 15 nt, Human
acaucaacagauaaa

SEQ ID NO: 1644282 - RNA, 17 nt, Human
uuccaagugauugaaac

SEQ ID NO: 1644283 - RNA, 14 nt, Human
uugcuggagcucug

SEQ ID NO: 1644284 - RNA, 19 nt, Human
uuauauuucuguuaaaaua

SEQ ID NO: 1644285 - RNA, 16 nt, Human
gcaggcagauguuccu

SEQ ID NO: 1644286 - RNA, 16 nt, Human
gcuucuguuccgugcu

SEQ ID NO: 1644287 - RNA, 13 nt, Human
cucugagccuugg

SEQ ID NO: 1644288 - RNA, 15 nt, Human
cagcuggccuuguga

SEQ ID NO: 1644289 - RNA, 17 nt, Human
gcaugguuuagaaagcu

SEQ ID NO: 1644290 - RNA, 17 nt, Human
gugggauacuauuuaau

SEQ ID NO: 1644291 - RNA, 22 nt, Human
agcuaaugaaguguuuagcaua

SEQ ID NO: 1644292 - RNA, 18 nt, Human
uuguacucugaaaguuuu

SEQ ID NO: 1644293 - RNA, 14 nt, Human
auaaaauaauuuuu

SEQ ID NO: 1644294 - RNA, 14 nt, Human
cucuugaggcacag

SEQ ID NO: 1644295 - RNA, 14 nt, Human
agaaauaggaaaua

SEQ ID NO: 1644296 - RNA, 16 nt, Human
aagacugcacaucaaa

SEQ ID NO: 1644297 - RNA, 17 nt, Human
aucaaggguacacugcc

SEQ ID NO: 1644298 - RNA, 19 nt, Human
gcuggccuugugaggagcu

SEQ ID NO: 1644299 - RNA, 14 nt, Human
gccagggcaagaga

SEQ ID NO: 1644300 - RNA, 19 nt, Human
ggagcuggaaacacauguu

SEQ ID NO: 1644301 - RNA, 18 nt, Human
uguugcagugucugcugg

SEQ ID NO: 1644302 - RNA, 12 nt, Human
gccagggcaaga

SEQ ID NO: 1644303 - RNA, 16 nt, Human
gaagauguagaggaga

SEQ ID NO: 1644304 - RNA, 20 nt, Human
aauuaaguuuuuuuuuaaaa

SEQ ID NO: 1644305 - RNA, 14 nt, Human
ccucagucucccuc

SEQ ID NO: 1644306 - RNA, 23 nt, Human
cugagaaggcuguggauuuaaug

SEQ ID NO: 1644307 - RNA, 23 nt, Human
gauauuaaccaggggccaugaau

SEQ ID NO: 1644308 - RNA, 16 nt, Human
gacaaggaaaaaauaa

SEQ ID NO: 1644309 - RNA, 15 nt, Human
gaccacugcagaaga

SEQ ID NO: 1644310 - RNA, 14 nt, Human
cugucucaguccau

SEQ ID NO: 1644311 - RNA, 19 nt, Human
ucaguuauuauauuuacaa

SEQ ID NO: 1644312 - RNA, 13 nt, Human
ugccaaaauauaa

SEQ ID NO: 1644313 - RNA, 22 nt, Human
gaaauaagccagacaucaacag

SEQ ID NO: 1644314 - RNA, 14 nt, Human
cugccagcuggccu

SEQ ID NO: 1644315 - RNA, 19 nt, Human
guacaagagcuuaacagug

SEQ ID NO: 1644316 - RNA, 21 nt, Human
ucuuaggguuaugauuaagua

SEQ ID NO: 1644317 - RNA, 13 nt, Human
uuuugaaucauca

SEQ ID NO: 1644318 - RNA, 13 nt, Human
uaaauaaauaaau

SEQ ID NO: 1644319 - RNA, 21 nt, Human
gacugcuaguuuauauagaaa

SEQ ID NO: 1644320 - RNA, 20 nt, Human
ucauucacucaacaaacaua

SEQ ID NO: 1644321 - RNA, 15 nt, Human
uuuaaggauucugag

SEQ ID NO: 1644322 - RNA, 13 nt, Human
uaacaauaaaaga

SEQ ID NO: 1644323 - RNA, 15 nt, Human
uuuaaaugucugaaa

SEQ ID NO: 1644324 - RNA, 15 nt, Human
cuuaagaagacugca

SEQ ID NO: 1644325 - RNA, 20 nt, Human
aacaagccuccuuuuaaagu

SEQ ID NO: 1644326 - RNA, 16 nt, Human
auugucuagugaaacu

SEQ ID NO: 1644327 - RNA, 16 nt, Human
aaguauaggccaggca

SEQ ID NO: 1644328 - RNA, 17 nt, Human
aggaaaaugggcuuugg

SEQ ID NO: 1644329 - RNA, 17 nt, Human
uguucuaagaagugaaa

SEQ ID NO: 1644330 - RNA, 20 nt, Human
ucugguagcuaaauauauau

SEQ ID NO: 1644331 - RNA, 22 nt, Human
ugguagcuaaauauauauuuua

SEQ ID NO: 1644332 - RNA, 19 nt, Human
aaucuacacuccagugaga

SEQ ID NO: 1644333 - RNA, 21 nt, Human
auauaugcuaagucuuauaua

SEQ ID NO: 1644334 - RNA, 14 nt, Human
auuuauguuuaauu

SEQ ID NO: 1644335 - RNA, 18 nt, Human
uaaaagacagugaaagaa

SEQ ID NO: 1644336 - RNA, 23 nt, Human
uaggauggcuaguaucaaaagaa

SEQ ID NO: 1644337 - RNA, 20 nt, Human
auauguuagagaauuuccuu

SEQ ID NO: 1644338 - RNA, 22 nt, Human
acuuugauuuuauaugcuauuu

SEQ ID NO: 1644339 - RNA, 18 nt, Human
aggaaguauaggccaggc

SEQ ID NO: 1644340 - RNA, 18 nt, Human
ccucaagcuaugugagcu

SEQ ID NO: 1644341 - RNA, 16 nt, Human
caucugaugagaacaa

SEQ ID NO: 1644342 - RNA, 16 nt, Human
guugagguaccuccaa

SEQ ID NO: 1644343 - RNA, 14 nt, Human
ugcuaagucuuaua

SEQ ID NO: 1644344 - RNA, 12 nt, Human
gacacugucucu

SEQ ID NO: 1644345 - RNA, 19 nt, Human
agaaaauaacaauaaaaga

SEQ ID NO: 1644346 - RNA, 18 nt, Human
cagucucccucccuuggg

SEQ ID NO: 1644347 - RNA, 19 nt, Human
gaggcagagguugcaguga

SEQ ID NO: 1644348 - RNA, 15 nt, Human
uacaggauuugaaau

SEQ ID NO: 1644349 - RNA, 18 nt, Human
ggaaggcugaggcaggag

SEQ ID NO: 1644350 - RNA, 14 nt, Human
cuggaaaucagggu

SEQ ID NO: 1644351 - RNA, 21 nt, Human
gaaauguuuacagauccccaa

SEQ ID NO: 1644352 - RNA, 19 nt, Human
cccacuugccauaaaacuu

SEQ ID NO: 1644353 - RNA, 14 nt, Human
ccaaauauaaauaa

SEQ ID NO: 1644354 - RNA, 21 nt, Human
ugaccauacuaauuauacccc

SEQ ID NO: 1644355 - RNA, 15 nt, Human
ucugucucaguccau

SEQ ID NO: 1644356 - RNA, 16 nt, Human
uuucuauaauuuaaau

SEQ ID NO: 1644357 - RNA, 12 nt, Human
gccccugagccc

SEQ ID NO: 1644358 - RNA, 17 nt, Human
aagacaaggaaaaaaua

SEQ ID NO: 1644359 - RNA, 19 nt, Human
agacucgggauuaguacac

SEQ ID NO: 1644360 - RNA, 14 nt, Human
aauuguauuacaaa

SEQ ID NO: 1644361 - RNA, 15 nt, Human
gccuugggaccccug

SEQ ID NO: 1644362 - RNA, 12 nt, Human
cccucugcagcu

SEQ ID NO: 1644363 - RNA, 22 nt, Human
ccauacuaauuauacccccugc

SEQ ID NO: 1644364 - RNA, 14 nt, Human
cagauuugagcuca

SEQ ID NO: 1644365 - RNA, 16 nt, Human
cagauccccaagccug

SEQ ID NO: 1644366 - RNA, 17 nt, Human
acaagaaaugaaagcag

SEQ ID NO: 1644367 - RNA, 21 nt, Human
auuuguauaaaauaauuuuua

SEQ ID NO: 1644368 - RNA, 23 nt, Human
aauaauccucaguuuuugugaaa

SEQ ID NO: 1644369 - RNA, 17 nt, Human
uccucacuuugaagagu

SEQ ID NO: 1644370 - RNA, 19 nt, Human
aagcuuguauuccuuuuuc

SEQ ID NO: 1644371 - RNA, 15 nt, Human
acucaccucccccau

SEQ ID NO: 1644372 - RNA, 14 nt, Human
aggggcagcagugc

SEQ ID NO: 1644373 - RNA, 24 nt, Human
uggccgggagccugaucaccugcc

SEQ ID NO: 1644374 - RNA, 23 nt, Human
gcuuuggucuaucuuugagcgcc

SEQ ID NO: 1644375 - RNA, 18 nt, Human
cugagccuugggaccccu

SEQ ID NO: 1644376 - RNA, 18 nt, Human
uucagcagagaaguuuuc

SEQ ID NO: 1644377 - RNA, 15 nt, Human
cuguaaaauaauaac

SEQ ID NO: 1644378 - RNA, 14 nt, Human
auuuauuuuaauaa

SEQ ID NO: 1644379 - RNA, 20 nt, Human
agaauucuguugauggaaau

SEQ ID NO: 1644380 - RNA, 13 nt, Human
aguguuuagcaua

SEQ ID NO: 1644381 - RNA, 17 nt, Human
uauuuauuaaguauuuu

SEQ ID NO: 1644382 - RNA, 18 nt, Human
cugaugggcaaaaaacca

SEQ ID NO: 1644383 - RNA, 15 nt, Human
gcuaauaucuuaucu

SEQ ID NO: 1644384 - RNA, 18 nt, Human
uaaugaauacuuuauaaa

SEQ ID NO: 1644385 - RNA, 20 nt, Human
ggaaggcugaggcaggagga

SEQ ID NO: 1644386 - RNA, 21 nt, Human
uugaggaaaaugggcuuugga

SEQ ID NO: 1644387 - RNA, 17 nt, Human
aggccaggcacaguggc

SEQ ID NO: 1644388 - RNA, 14 nt, Human
cuucucuucacagu

SEQ ID NO: 1644389 - RNA, 19 nt, Human
aggucuaccaaaaaucuca

SEQ ID NO: 1644390 - RNA, 13 nt, Human
uuaaauuguaaua

SEQ ID NO: 1644391 - RNA, 15 nt, Human
aauauauauuuuaga

SEQ ID NO: 1644392 - RNA, 22 nt, Human
agcagcauaaauguugacaugg

SEQ ID NO: 1644393 - RNA, 18 nt, Human
cagagucaagggugugug

SEQ ID NO: 1644394 - RNA, 17 nt, Human
gugccuguaaucacagc

SEQ ID NO: 1644395 - RNA, 20 nt, Human
ugagagugaacaaauuuaca

SEQ ID NO: 1644396 - RNA, 15 nt, Human
ccaaggagccaaaca

SEQ ID NO: 1644397 - RNA, 21 nt, Human
cagugagacagcucugcauac

SEQ ID NO: 1644398 - RNA, 18 nt, Human
uaggaaauauuuuaaugu

SEQ ID NO: 1644399 - RNA, 17 nt, Human
caauaaauaaauaaaua

SEQ ID NO: 1644400 - RNA, 16 nt, Human
gucucaauaaauaaau

SEQ ID NO: 1644401 - RNA, 23 nt, Human
auuuauguuccuuuuaaagaaac

SEQ ID NO: 1644402 - RNA, 19 nt, Human
uugugggauacuauuuaau

SEQ ID NO: 1644403 - RNA, 20 nt, Human
aaaagacagugaaagaaaau

SEQ ID NO: 1644404 - RNA, 16 nt, Human
cugcacuccagccuga

SEQ ID NO: 1644405 - RNA, 14 nt, Human
acccugaggugagc

SEQ ID NO: 1644406 - RNA, 15 nt, Human
auaauccuaaacaua

SEQ ID NO: 1644407 - RNA, 19 nt, Human
aucuauguagaauauauuu

SEQ ID NO: 1644408 - RNA, 19 nt, Human
cagagucaagggugugugc

SEQ ID NO: 1644409 - RNA, 22 nt, Human
cggaggucgaggcuacagugag

SEQ ID NO: 1644410 - RNA, 23 nt, Human
auuauauggcuugaguuuaaauu

SEQ ID NO: 1644411 - RNA, 15 nt, Human
cccaucucaggugug

SEQ ID NO: 1644412 - RNA, 13 nt, Human
aacauuuauguuc

SEQ ID NO: 1644413 - RNA, 22 nt, Human
aaacguauucaaacaauuugaa

SEQ ID NO: 1644414 - RNA, 23 nt, Human
uuauagcuacuaauuuuaaaaug

SEQ ID NO: 1644415 - RNA, 19 nt, Human
gaccggccuuugcaccucc

SEQ ID NO: 1644416 - RNA, 19 nt, Human
caugaguaacugauuugua

SEQ ID NO: 1644417 - RNA, 14 nt, Human
uuuuauaagaaaua

SEQ ID NO: 1644418 - RNA, 14 nt, Human
ggcuacagugagcc

SEQ ID NO: 1644419 - RNA, 18 nt, Human
acuguuaucuucacuuuu

SEQ ID NO: 1644420 - RNA, 17 nt, Human
uaagaaauaggaaauau

SEQ ID NO: 1644421 - RNA, 14 nt, Human
cauuuauguuccuu

SEQ ID NO: 1644422 - RNA, 12 nt, Human
cuuaagcuuuca

SEQ ID NO: 1644423 - RNA, 14 nt, Human
ugcagcuuccaggc

SEQ ID NO: 1644424 - RNA, 14 nt, Human
aaagaaacaaaaau

SEQ ID NO: 1644425 - RNA, 15 nt, Human
auagaaguaaaaaca

SEQ ID NO: 1644426 - RNA, 14 nt, Human
agagguccacaaca

SEQ ID NO: 1644427 - RNA, 19 nt, Human
uacuucuuaggguuaugau

SEQ ID NO: 1644428 - RNA, 21 nt, Human
cuguguccucaugagggcugg

SEQ ID NO: 1644429 - RNA, 20 nt, Human
uuagcauaguaccucugcua

SEQ ID NO: 1644430 - RNA, 18 nt, Human
acuguacuccagccaggg

SEQ ID NO: 1644431 - RNA, 18 nt, Human
acauguuacaacacggac

SEQ ID NO: 1644432 - RNA, 18 nt, Human
auaccccuggccaaggaa

SEQ ID NO: 1644433 - RNA, 13 nt, Human
aggcuagauguau

SEQ ID NO: 1644434 - RNA, 16 nt, Human
cgcauggaaaaguuuc

SEQ ID NO: 1644435 - RNA, 16 nt, Human
cugagcuugcagagau

SEQ ID NO: 1644436 - RNA, 18 nt, Human
cuaggcauagcccugccu

SEQ ID NO: 1644437 - RNA, 15 nt, Human
gcuguauuuuaaaag

SEQ ID NO: 1644438 - RNA, 23 nt, Human
gggaaacaaaaggauaaugaaua

SEQ ID NO: 1644439 - RNA, 16 nt, Human
auuuguauaaaauaau

SEQ ID NO: 1644440 - RNA, 20 nt, Human
ugauuucugagcauuuaaua

SEQ ID NO: 1644441 - RNA, 18 nt, Human
cuggggcuuuaacuccug

SEQ ID NO: 1644442 - RNA, 21 nt, Human
auacuauuuaauuauuucacu

SEQ ID NO: 1644443 - RNA, 19 nt, Human
uccacaaguaaaaggaaau

SEQ ID NO: 1644444 - RNA, 22 nt, Human
agaaauaggaaauauuuuaaug

SEQ ID NO: 1644445 - RNA, 17 nt, Human
ccaucaguuccagccuu

SEQ ID NO: 1644446 - RNA, 14 nt, Human
auugaggcaggcac

SEQ ID NO: 1644447 - RNA, 14 nt, Human
uuuguauaaaauaa

SEQ ID NO: 1644448 - RNA, 17 nt, Human
cuggacucaccuccccc

SEQ ID NO: 1644449 - RNA, 13 nt, Human
aaguucaaaacuu

SEQ ID NO: 1644450 - RNA, 17 nt, Human
guugauuuaaggccagg

SEQ ID NO: 1644451 - RNA, 14 nt, Human
cauagaaguaaaaa

SEQ ID NO: 1644452 - RNA, 15 nt, Human
uaguauggcaaacug

SEQ ID NO: 1644453 - RNA, 21 nt, Human
cgacagugagacucugucuca

SEQ ID NO: 1644454 - RNA, 19 nt, Human
ggucgaggcuacagugagc

SEQ ID NO: 1644455 - RNA, 17 nt, Human
gcaaauugucacaggac

SEQ ID NO: 1644456 - RNA, 15 nt, Human
cuccucaacucugag

SEQ ID NO: 1644457 - RNA, 12 nt, Human
aguguuugaaag

SEQ ID NO: 1644458 - RNA, 22 nt, Human
gaggggagcaugggaagugacg

SEQ ID NO: 1644459 - RNA, 17 nt, Human
acucugcaagaagaaau

SEQ ID NO: 1644460 - RNA, 16 nt, Human
aaaguguuugaaagcu

SEQ ID NO: 1644461 - RNA, 15 nt, Human
uccagauccuggaaa

SEQ ID NO: 1644462 - RNA, 18 nt, Human
ugccauguggcagaucua

SEQ ID NO: 1644463 - RNA, 16 nt, Human
aucaauuuaaaaaaaa

SEQ ID NO: 1644464 - RNA, 17 nt, Human
uccagcuggccgggagc

SEQ ID NO: 1644465 - RNA, 15 nt, Human
ucuaugaaauauuau

SEQ ID NO: 1644466 - RNA, 15 nt, Human
guguugcagugucug

SEQ ID NO: 1644467 - RNA, 17 nt, Human
aagacagugaaagaaaa

SEQ ID NO: 1644468 - RNA, 21 nt, Human
gccaaauauaaauaaaaauaa

SEQ ID NO: 1644469 - RNA, 19 nt, Human
uauauuuuugugauuuugu

SEQ ID NO: 1644470 - RNA, 17 nt, Human
cugccucagaaaacaag

SEQ ID NO: 1644471 - RNA, 19 nt, Human
gucaaucagccuaguugau

SEQ ID NO: 1644472 - RNA, 15 nt, Human
ucucaauaaauaaau

SEQ ID NO: 1644473 - RNA, 13 nt, Human
ugggcaaaaaacc

SEQ ID NO: 1644474 - RNA, 16 nt, Human
uagaaaacaggcaaau

SEQ ID NO: 1644475 - RNA, 16 nt, Human
cugagccucagucucc

SEQ ID NO: 1644476 - RNA, 16 nt, Human
cagaagcaacccaaau

SEQ ID NO: 1644477 - RNA, 17 nt, Human
acauagugagacacugu

SEQ ID NO: 1644478 - RNA, 21 nt, Human
cugcccugcugagucccaggc

SEQ ID NO: 1644479 - RNA, 21 nt, Human
gauaaaagacagugaaagaaa

SEQ ID NO: 1644480 - RNA, 23 nt, Human
uguggaaggugaucuggcucugg

SEQ ID NO: 1644481 - RNA, 22 nt, Human
caaugcuguauuuuaaaagaau

SEQ ID NO: 1644482 - RNA, 15 nt, Human
aagugaaaaucuaca

SEQ ID NO: 1644483 - RNA, 18 nt, Human
uaaaauccauacauuugu

SEQ ID NO: 1644484 - RNA, 19 nt, Human
auagcuacuaauuuuaaaa

SEQ ID NO: 1644485 - RNA, 15 nt, Human
uggcuaauuagcaug

SEQ ID NO: 1644486 - RNA, 19 nt, Human
cuucuggguuccuuccucu

SEQ ID NO: 1644487 - RNA, 19 nt, Human
uaggugacuauuauauuuc

SEQ ID NO: 1644488 - RNA, 16 nt, Human
gccaaggaagaucccu

SEQ ID NO: 1644489 - RNA, 12 nt, Human
uaaauauauauu

SEQ ID NO: 1644490 - RNA, 17 nt, Human
augauuaaguaaugaua

SEQ ID NO: 1644491 - RNA, 13 nt, Human
caccaaggagcca

SEQ ID NO: 1644492 - RNA, 13 nt, Human
cacuguaaaauaa

SEQ ID NO: 1644493 - RNA, 17 nt, Human
ccccuggccaaggaaga

SEQ ID NO: 1644494 - RNA, 18 nt, Human
ugccuaggcauagcccug

SEQ ID NO: 1644495 - RNA, 11 nt, Human
guauggcaaac

SEQ ID NO: 1644496 - RNA, 19 nt, Human
uguuugccgcuuaagcuuu

SEQ ID NO: 1644497 - RNA, 17 nt, Human
auauuugaaauauugac

SEQ ID NO: 1644498 - RNA, 22 nt, Human
cugggacaggggagaaccuagg

SEQ ID NO: 1644499 - RNA, 14 nt, Human
aaaggaauuuaaaa

SEQ ID NO: 1644500 - RNA, 13 nt, Human
ugcauuucuaaag

SEQ ID NO: 1644501 - RNA, 16 nt, Human
gaugggcaaaaaacca

SEQ ID NO: 1644502 - RNA, 21 nt, Human
acaagaaggaaagauuuuguu

SEQ ID NO: 1644503 - RNA, 14 nt, Human
ugggcagaucacuu

SEQ ID NO: 1644504 - RNA, 16 nt, Human
uccuguaauggaagca

SEQ ID NO: 1644505 - RNA, 20 nt, Human
agccuaguugaucagcuuau

SEQ ID NO: 1644506 - RNA, 16 nt, Human
auuugaugcuacagga

SEQ ID NO: 1644507 - RNA, 16 nt, Human
caaaaaaaggaaggaa

SEQ ID NO: 1644508 - RNA, 15 nt, Human
aagaagugaaaaucu

SEQ ID NO: 1644509 - RNA, 21 nt, Human
uaggugacuauuauauuucca

SEQ ID NO: 1644510 - RNA, 13 nt, Human
cccuccuuaucaa

SEQ ID NO: 1644511 - RNA, 23 nt, Human
ucuagcaugucgucaaagcugaa

SEQ ID NO: 1644512 - RNA, 14 nt, Human
cagcaucagcaucc

SEQ ID NO: 1644513 - RNA, 18 nt, Human
uauauuuccuuauucaga

SEQ ID NO: 1644514 - RNA, 13 nt, Human
augcuagaacucc

SEQ ID NO: 1644515 - RNA, 13 nt, Human
uaguuuauauaga

SEQ ID NO: 1644516 - RNA, 18 nt, Human
ccauccugccccugagcc

SEQ ID NO: 1644517 - RNA, 16 nt, Human
cugucucuaccaaaaa

SEQ ID NO: 1644518 - RNA, 18 nt, Human
auaggaaauauuuuaaug

SEQ ID NO: 1644519 - RNA, 15 nt, Human
aaaacaggcaaauuc

SEQ ID NO: 1644520 - RNA, 22 nt, Human
ccaaacauccuacaagacacag

SEQ ID NO: 1644521 - RNA, 14 nt, Human
ccacaaucuaggau

SEQ ID NO: 1644522 - RNA, 22 nt, Human
cagugagccaaauguaaaauag

SEQ ID NO: 1644523 - RNA, 14 nt, Human
ucuuuuuuuuaaua

SEQ ID NO: 1644524 - RNA, 13 nt, Human
gauuguaaaaugg

SEQ ID NO: 1644525 - RNA, 17 nt, Human
ccuuggugccuggagcc

SEQ ID NO: 1644526 - RNA, 19 nt, Human
acaauaacgauaaaagaca

SEQ ID NO: 1644527 - RNA, 18 nt, Human
ccuugggaccccugagcu

SEQ ID NO: 1644528 - RNA, 19 nt, Human
acagugauuaccagggacu

SEQ ID NO: 1644529 - RNA, 16 nt, Human
aagcauuuagauguau

SEQ ID NO: 1644530 - RNA, 19 nt, Human
agaucacuugagcucagga

SEQ ID NO: 1644531 - RNA, 21 nt, Human
auuauauuuauuacuguaaga

SEQ ID NO: 1644532 - RNA, 20 nt, Human
acagaaagauuugauguaug

SEQ ID NO: 1644533 - RNA, 16 nt, Human
ucaaacuuuacagaaa

SEQ ID NO: 1644534 - RNA, 20 nt, Human
auauuuuauaucaauuuaaa

SEQ ID NO: 1644535 - RNA, 18 nt, Human
gaccccugagcuugcaga

SEQ ID NO: 1644536 - RNA, 16 nt, Human
auccuugaagauuuac

SEQ ID NO: 1644537 - RNA, 22 nt, Human
ggacaguaaaauccacagacca

SEQ ID NO: 1644538 - RNA, 16 nt, Human
cuucuggguuccuucc

SEQ ID NO: 1644539 - RNA, 22 nt, Human
gucucuaccaaaaaaaggaagg

SEQ ID NO: 1644540 - RNA, 22 nt, Human
ugauugugggauacuauuuaau

SEQ ID NO: 1644541 - RNA, 16 nt, Human
uaaugaauacuuuaua

SEQ ID NO: 1644542 - RNA, 14 nt, Human
uugugauugauuau

SEQ ID NO: 1644543 - RNA, 13 nt, Human
uaccccuggccaa

SEQ ID NO: 1644544 - RNA, 15 nt, Human
uaaauaaauaaaaac

SEQ ID NO: 1644545 - RNA, 15 nt, Human
aaaauacaaaaaaaa

SEQ ID NO: 1644546 - RNA, 18 nt, Human
ugagaugguuucuagaga

SEQ ID NO: 1644547 - RNA, 18 nt, Human
uuacuguaagaaaauauc

SEQ ID NO: 1644548 - RNA, 18 nt, Human
gaaaauaacaauaaaaga

SEQ ID NO: 1644549 - RNA, 18 nt, Human
agucuucagcagagaagu

SEQ ID NO: 1644550 - RNA, 20 nt, Human
aacaaugcuguauuuuaaaa

SEQ ID NO: 1644551 - RNA, 19 nt, Human
cacaggaaccacaagacug

SEQ ID NO: 1644552 - RNA, 17 nt, Human
aauaacgauaaaagaca

SEQ ID NO: 1644553 - RNA, 23 nt, Human
uugauuuuauaugcuauuuauua

SEQ ID NO: 1644554 - RNA, 18 nt, Human
accaccugccuauauuuu

SEQ ID NO: 1644555 - RNA, 20 nt, Human
ccaaauguucaucaaugaau

SEQ ID NO: 1644556 - RNA, 15 nt, Human
cuucucuucacaguc

SEQ ID NO: 1644557 - RNA, 23 nt, Human
gaaaacaauaacgauaaaagaca

SEQ ID NO: 1644558 - RNA, 14 nt, Human
uucuaugaaauauu

SEQ ID NO: 1644559 - RNA, 20 nt, Human
ggaaaguuuucuccacugga

SEQ ID NO: 1644560 - RNA, 17 nt, Human
cugcacuccagccugag

SEQ ID NO: 1644561 - RNA, 21 nt, Human
uuagauaaggcuguucuuuaa

SEQ ID NO: 1644562 - RNA, 16 nt, Human
gcagcaucagcauccc

SEQ ID NO: 1644563 - RNA, 21 nt, Human
ccggccuuugcaccuccaugg

SEQ ID NO: 1644564 - RNA, 13 nt, Human
auuccucacuuug

SEQ ID NO: 1644565 - RNA, 22 nt, Human
ggcagcuuuccucaaaacuuca

SEQ ID NO: 1644566 - RNA, 14 nt, Human
ugcuggagcucugc

SEQ ID NO: 1644567 - RNA, 16 nt, Human
uagaaagccaugugca

SEQ ID NO: 1644568 - RNA, 23 nt, Human
aucacagcuacuugggaggcuga

SEQ ID NO: 1644569 - RNA, 17 nt, Human
cccaggcugagccucag

SEQ ID NO: 1644570 - RNA, 18 nt, Human
guuaguauuguccagguc

SEQ ID NO: 1644571 - RNA, 17 nt, Human
auaucaauuuaaaaaaa

SEQ ID NO: 1644572 - RNA, 20 nt, Human
auguuccuuuuaaagaaaca

SEQ ID NO: 1644573 - RNA, 16 nt, Human
uggcaagcucuaucac

SEQ ID NO: 1644574 - RNA, 13 nt, Human
aaaguguuugaaa

SEQ ID NO: 1644575 - RNA, 18 nt, Human
acaaaaggauaaugaaua

SEQ ID NO: 1644576 - RNA, 22 nt, Human
caccagucugacuguuuccauc

SEQ ID NO: 1644577 - RNA, 20 nt, Human
uaguuauaaaaauauauagc

SEQ ID NO: 1644578 - RNA, 12 nt, Human
caggcauggugg

SEQ ID NO: 1644579 - RNA, 17 nt, Human
ucuggaggucucugaac

SEQ ID NO: 1644580 - RNA, 18 nt, Human
ugcagugucugcuggaga

SEQ ID NO: 1644581 - RNA, 15 nt, Human
ggccaccugcugagc

SEQ ID NO: 1644582 - RNA, 16 nt, Human
gccaugugcuaguaau

SEQ ID NO: 1644583 - RNA, 13 nt, Human
accaacacccuga

SEQ ID NO: 1644584 - RNA, 17 nt, Human
gaaaaucaggcuggcca

SEQ ID NO: 1644585 - RNA, 20 nt, Human
cugauauuggacaguaaaau

SEQ ID NO: 1644586 - RNA, 13 nt, Human
ugaaauuguauua

SEQ ID NO: 1644587 - RNA, 15 nt, Human
ccugcaaagcccagc

SEQ ID NO: 1644588 - RNA, 14 nt, Human
gagagugaacaaau

SEQ ID NO: 1644589 - RNA, 22 nt, Human
gcagaugaugcuuugagaacau

SEQ ID NO: 1644590 - RNA, 14 nt, Human
gcuggcgugcagca

SEQ ID NO: 1644591 - RNA, 16 nt, Human
gucuucaggggccaca

SEQ ID NO: 1644592 - RNA, 18 nt, Human
uacaugucuagagaacac

SEQ ID NO: 1644593 - RNA, 20 nt, Human
auuacauuuguauaaaauaa

SEQ ID NO: 1644594 - RNA, 19 nt, Human
gugacuuaaugccacuaaa

SEQ ID NO: 1644595 - RNA, 19 nt, Human
auuucuucaacucccugcc

SEQ ID NO: 1644596 - RNA, 13 nt, Human
augauuccaccua

SEQ ID NO: 1644597 - RNA, 19 nt, Human
cuggacucaccucccccau

SEQ ID NO: 1644598 - RNA, 16 nt, Human
aaauaacaaugaaagu

SEQ ID NO: 1644599 - RNA, 19 nt, Human
acucugucucaguccauga

SEQ ID NO: 1644600 - RNA, 19 nt, Human
ccagccagggcaagagagc

SEQ ID NO: 1644601 - RNA, 18 nt, Human
gcuccauuuuuagugaaa

SEQ ID NO: 1644602 - RNA, 15 nt, Human
agacaaggaaaaaau

SEQ ID NO: 1644603 - RNA, 18 nt, Human
uuguaaaggaauuuaaaa

SEQ ID NO: 1644604 - RNA, 15 nt, Human
uaacgauaaaagaca

SEQ ID NO: 1644605 - RNA, 17 nt, Human
acaaaaggaauguguaa

SEQ ID NO: 1644606 - RNA, 14 nt, Human
gauaaaagacagug

SEQ ID NO: 1644607 - RNA, 21 nt, Human
cucaguccaugaagauguaga

SEQ ID NO: 1644608 - RNA, 17 nt, Human
uaucuuuuuuuuaauaa

SEQ ID NO: 1644609 - RNA, 20 nt, Human
uuguaggugacuauuauauu

SEQ ID NO: 1644610 - RNA, 18 nt, Human
gcuacagugagccaagag

SEQ ID NO: 1644611 - RNA, 21 nt, Human
accaccugccuauauuuuuug

SEQ ID NO: 1644612 - RNA, 19 nt, Human
guauucuuuuaguuuuuaa

SEQ ID NO: 1644613 - RNA, 13 nt, Human
aagaucagccugg

SEQ ID NO: 1644614 - RNA, 19 nt, Human
ccuuagcccuuccccucug

SEQ ID NO: 1644615 - RNA, 14 nt, Human
ucuauaauuuaaau

SEQ ID NO: 1644616 - RNA, 16 nt, Human
aaggagaggcaaagaa

SEQ ID NO: 1644617 - RNA, 16 nt, Human
ucuuggggaauauguu

SEQ ID NO: 1644618 - RNA, 15 nt, Human
uagggugauauuaac

SEQ ID NO: 1644619 - RNA, 15 nt, Human
cuacuaauuuuaaaa

SEQ ID NO: 1644620 - RNA, 21 nt, Human
aaagcugaaauggacuuuugu

SEQ ID NO: 1644621 - RNA, 15 nt, Human
uuacagagacagaaa

SEQ ID NO: 1644622 - RNA, 15 nt, Human
uugacacuuaaaaau

SEQ ID NO: 1644623 - RNA, 16 nt, Human
augaauacuuuauaaa

SEQ ID NO: 1644624 - RNA, 21 nt, Human
gaaagcagggacuugaaccca

SEQ ID NO: 1644625 - RNA, 22 nt, Human
ggggugguuuucccaucucagg

SEQ ID NO: 1644626 - RNA, 17 nt, Human
gaaacaaaaaucaaacu

SEQ ID NO: 1644627 - RNA, 16 nt, Human
agguugcagugagccg

SEQ ID NO: 1644628 - RNA, 19 nt, Human
aaaaucuuauaauuuaaaa

SEQ ID NO: 1644629 - RNA, 23 nt, Human
uccaacuaucucauuuccaagca

SEQ ID NO: 1644630 - RNA, 21 nt, Human
acugaaacaaaauuagaaaug

SEQ ID NO: 1644631 - RNA, 20 nt, Human
agaaggcuguggauuuaaug

SEQ ID NO: 1644632 - RNA, 20 nt, Human
acaagacacagugaccauac

SEQ ID NO: 1644633 - RNA, 16 nt, Human
guuccuuccucugagc

SEQ ID NO: 1644634 - RNA, 12 nt, Human
uaaaaauuaaaa

SEQ ID NO: 1644635 - RNA, 21 nt, Human
caaggaaaaaauaacaaugaa

SEQ ID NO: 1644636 - RNA, 19 nt, Human
caaguaaaaggaaaugcuc

SEQ ID NO: 1644637 - RNA, 14 nt, Human
auuauuucacuuua

SEQ ID NO: 1644638 - RNA, 17 nt, Human
acacuguuaucuucacu

SEQ ID NO: 1644639 - RNA, 15 nt, Human
uuaauucugaaagca

SEQ ID NO: 1644640 - RNA, 23 nt, Human
cauuguggucacaggaaguagag

SEQ ID NO: 1644641 - RNA, 16 nt, Human
caugguuuagaaagcu

SEQ ID NO: 1644642 - RNA, 20 nt, Human
uaacaagccuccuuuuaaag

SEQ ID NO: 1644643 - RNA, 17 nt, Human
aaauauaaauaaaaaua

SEQ ID NO: 1644644 - RNA, 23 nt, Human
caagagagcgagacccugucuca

SEQ ID NO: 1644645 - RNA, 13 nt, Human
aagaaaauaacga

SEQ ID NO: 1644646 - RNA, 19 nt, Human
caacucccugccccccagc

SEQ ID NO: 1644647 - RNA, 16 nt, Human
agauaaggcuguucuu

SEQ ID NO: 1644648 - RNA, 20 nt, Human
ucacuguauguccuuggugc

SEQ ID NO: 1644649 - RNA, 13 nt, Human
ccuccuuuuaaag

SEQ ID NO: 1644650 - RNA, 11 nt, Human
auggauaaaga

SEQ ID NO: 1644651 - RNA, 14 nt, Human
aaauaggaaauauu

SEQ ID NO: 1644652 - RNA, 12 nt, Human
agaaucuagagc

SEQ ID NO: 1644653 - RNA, 21 nt, Human
cuccauggaaacgaagcacca

SEQ ID NO: 1644654 - RNA, 18 nt, Human
ugaacuugguuuuaauua

SEQ ID NO: 1644655 - RNA, 12 nt, Human
aaaagaaagaaa

SEQ ID NO: 1644656 - RNA, 18 nt, Human
acauaaaauacaaaaacu

SEQ ID NO: 1644657 - RNA, 21 nt, Human
aauaauguuucaaacauauau

SEQ ID NO: 1644658 - RNA, 19 nt, Human
uuauggcacuaguauuucu

SEQ ID NO: 1644659 - RNA, 15 nt, Human
acaaggaaaaaauaa

SEQ ID NO: 1644660 - RNA, 17 nt, Human
ccugggcaacaugguga

SEQ ID NO: 1644661 - RNA, 16 nt, Human
ucucuaggaaauauuu

SEQ ID NO: 1644662 - RNA, 14 nt, Human
cucagucucccucc

SEQ ID NO: 1644663 - RNA, 14 nt, Human
aaaauacaaaaaaa

SEQ ID NO: 1644664 - RNA, 16 nt, Human
agauagaugaagaagc

SEQ ID NO: 1644665 - RNA, 20 nt, Human
aucuauguagaauauauuuc

SEQ ID NO: 1644666 - RNA, 21 nt, Human
gaagcuagaaaacaggcaaau

SEQ ID NO: 1644667 - RNA, 14 nt, Human
aaagaggaaugaag

SEQ ID NO: 1644668 - RNA, 23 nt, Human
ucggccuccauccugaggcucca

SEQ ID NO: 1644669 - RNA, 15 nt, Human
gaauauauuuccuua

SEQ ID NO: 1644670 - RNA, 20 nt, Human
acggacgaaccuugaaaacu

SEQ ID NO: 1644671 - RNA, 18 nt, Human
ucugcaagaagaaaucau

SEQ ID NO: 1644672 - RNA, 16 nt, Human
gcaucccuagaaagcc

SEQ ID NO: 1644673 - RNA, 18 nt, Human
gcuauaggauguggggaa

SEQ ID NO: 1644674 - RNA, 16 nt, Human
ucuugagguaaaagca

SEQ ID NO: 1644675 - RNA, 18 nt, Human
cacaaguaaaaggaaaug

SEQ ID NO: 1644676 - RNA, 15 nt, Human
uucacauuuaaauaa

SEQ ID NO: 1644677 - RNA, 14 nt, Human
cucaauaaauaaau

SEQ ID NO: 1644678 - RNA, 17 nt, Human
cuuccucugagccuugg

SEQ ID NO: 1644679 - RNA, 21 nt, Human
ugcuggccaccugcugagccc

SEQ ID NO: 1644680 - RNA, 18 nt, Human
acaugaacuuguaaagga

SEQ ID NO: 1644681 - RNA, 21 nt, Human
ugaugcuacaggauuugaaau

SEQ ID NO: 1644682 - RNA, 19 nt, Human
cuggcucuggacaggcacu

SEQ ID NO: 1644683 - RNA, 16 nt, Human
caggcugagccucagu

SEQ ID NO: 1644684 - RNA, 23 nt, Human
augucaauucuugccaaauauaa

SEQ ID NO: 1644685 - RNA, 22 nt, Human
auuacuguaagaaaauaucacu

SEQ ID NO: 1644686 - RNA, 18 nt, Human
ccuuccuaauuccacagc

SEQ ID NO: 1644687 - RNA, 13 nt, Human
acacacaugaagu

SEQ ID NO: 1644688 - RNA, 20 nt, Human
gaagggacacauaucaaacu

SEQ ID NO: 1644689 - RNA, 12 nt, Human
cuguuaucuuca

SEQ ID NO: 1644690 - RNA, 14 nt, Human
uaugaauuacauuu

SEQ ID NO: 1644691 - RNA, 15 nt, Human
auauugacuuuuuau

SEQ ID NO: 1644692 - RNA, 14 nt, Human
cagccaccagucca

SEQ ID NO: 1644693 - RNA, 12 nt, Human
acauaaaauaca

SEQ ID NO: 1644694 - RNA, 20 nt, Human
gaaaauaacgauaaaagaca

SEQ ID NO: 1644695 - RNA, 13 nt, Human
caaaaaaaaaccc

SEQ ID NO: 1644696 - RNA, 15 nt, Human
gucucuacauaaaau

SEQ ID NO: 1644697 - RNA, 13 nt, Human
cacaacuauauug

SEQ ID NO: 1644698 - RNA, 14 nt, Human
caaaugcauuucua

SEQ ID NO: 1644699 - RNA, 22 nt, Human
ugaguuuuucuuuucauuuacc

SEQ ID NO: 1644700 - RNA, 20 nt, Human
uaugcuauuuauuaaguauu

SEQ ID NO: 1644701 - RNA, 18 nt, Human
ggaggacgcucucuggcc

SEQ ID NO: 1644702 - RNA, 20 nt, Human
uauacugugugcuaaaacaa

SEQ ID NO: 1644703 - RNA, 19 nt, Human
gcucauggaauuggagcuc

SEQ ID NO: 1644704 - RNA, 14 nt, Human
cuuuacagaaagau

SEQ ID NO: 1644705 - RNA, 22 nt, Human
uucuacuggcugccagaaucua

SEQ ID NO: 1644706 - RNA, 18 nt, Human
ggggcuuuaacuccugcu

SEQ ID NO: 1644707 - RNA, 15 nt, Human
acagugaaagaaaau

SEQ ID NO: 1644708 - RNA, 18 nt, Human
auuaaguuuuuuuuuaaa

SEQ ID NO: 1644709 - RNA, 15 nt, Human
ugaaacccugucucu

SEQ ID NO: 1644710 - RNA, 16 nt, Human
cugaucaccugcccug

SEQ ID NO: 1644711 - RNA, 14 nt, Human
cuuggucugugaga

SEQ ID NO: 1644712 - RNA, 16 nt, Human
aacaauaaaagacaag

SEQ ID NO: 1644713 - RNA, 13 nt, Human
acaagagcuuaac

SEQ ID NO: 1644714 - RNA, 14 nt, Human
gagcucagcccugg

SEQ ID NO: 1644715 - RNA, 14 nt, Human
augggccauaugaa

SEQ ID NO: 1644716 - RNA, 13 nt, Human
acggggugaaacc

SEQ ID NO: 1644717 - RNA, 18 nt, Human
aguucuccacuagcuaug

SEQ ID NO: 1644718 - RNA, 15 nt, Human
acuauuauauuucca

SEQ ID NO: 1644719 - RNA, 18 nt, Human
ccucuggcuccagcuggc

SEQ ID NO: 1644720 - RNA, 14 nt, Human
gaaagcagaacagu

SEQ ID NO: 1644721 - RNA, 16 nt, Human
uucaguuauuauauuu

SEQ ID NO: 1644722 - RNA, 16 nt, Human
aagaaauauuccuuaa

SEQ ID NO: 1644723 - RNA, 11 nt, Human
cauaugaaaag

SEQ ID NO: 1644724 - RNA, 19 nt, Human
cuccuuggagacagggccc

SEQ ID NO: 1644725 - RNA, 13 nt, Human
cuagcagugagcc

SEQ ID NO: 1644726 - RNA, 23 nt, Human
auuucugagcauuuaauauggau

SEQ ID NO: 1644727 - RNA, 20 nt, Human
aucuacaugucuagagaaca

SEQ ID NO: 1644728 - RNA, 12 nt, Human
ccagcuuugagg

SEQ ID NO: 1644729 - RNA, 20 nt, Human
cuggccaccugcugagcccc

SEQ ID NO: 1644730 - RNA, 22 nt, Human
cccaugauguuuagaaacacaa

SEQ ID NO: 1644731 - RNA, 12 nt, Human
agauuucaaaaa

SEQ ID NO: 1644732 - RNA, 13 nt, Human
uuggacgagaaaa

SEQ ID NO: 1644733 - RNA, 15 nt, Human
acaaaguugauuaag

SEQ ID NO: 1644734 - RNA, 18 nt, Human
ucuucaacucccugcccc

SEQ ID NO: 1644735 - RNA, 16 nt, Human
uucccaacuccagaaa

SEQ ID NO: 1644736 - RNA, 22 nt, Human
gucucuacuaaaaauacaaaaa

SEQ ID NO: 1644737 - RNA, 17 nt, Human
ccacuggacucaccucc

SEQ ID NO: 1644738 - RNA, 24 nt, Human
uggcagaucuacaugucuagagaa

SEQ ID NO: 1644739 - RNA, 23 nt, Human
caucucuucuggguuccuuccuc

SEQ ID NO: 1644740 - RNA, 22 nt, Human
cccuauccuacuuccccuuccu

SEQ ID NO: 1644741 - RNA, 13 nt, Human
auugaggcaggca

SEQ ID NO: 1644742 - RNA, 19 nt, Human
uauacugugugcuaaaaca

SEQ ID NO: 1644743 - RNA, 11 nt, Human
aaauaaauaaa

SEQ ID NO: 1644744 - RNA, 13 nt, Human
auaaauaaaaaua

SEQ ID NO: 1644745 - RNA, 18 nt, Human
acaaggaaggaaagaugu

SEQ ID NO: 1644746 - RNA, 22 nt, Human
cauaaauguugacaugggacau

SEQ ID NO: 1644747 - RNA, 13 nt, Human
aaaugaaagcagg

SEQ ID NO: 1644748 - RNA, 13 nt, Human
agagguccacaac

SEQ ID NO: 1644749 - RNA, 15 nt, Human
uguauuuuaaaagaa

SEQ ID NO: 1644750 - RNA, 12 nt, Human
uucagccugaaa

SEQ ID NO: 1644751 - RNA, 19 nt, Human
auguuuacagauccccaag

SEQ ID NO: 1644752 - RNA, 23 nt, Human
gcuguggauuuaauguggaaaug

SEQ ID NO: 1644753 - RNA, 12 nt, Human
gguauuuuaauc

SEQ ID NO: 1644754 - RNA, 15 nt, Human
uugcucauggaauug

SEQ ID NO: 1644755 - RNA, 18 nt, Human
ccuucggccuccauccug

SEQ ID NO: 1644756 - RNA, 20 nt, Human
uuuaaauaaaguguuugaaa

SEQ ID NO: 1644757 - RNA, 15 nt, Human
acucugcaagaagaa

SEQ ID NO: 1644758 - RNA, 21 nt, Human
uauaaaauaauuuuuauauuu

SEQ ID NO: 1644759 - RNA, 15 nt, Human
uuggggaauauguua

SEQ ID NO: 1644760 - RNA, 22 nt, Human
cuuuccacagaagcuccaggua

SEQ ID NO: 1644761 - RNA, 17 nt, Human
ccaccugcugagcccca

SEQ ID NO: 1644762 - RNA, 18 nt, Human
cagaaagcagaacaguga

SEQ ID NO: 1644763 - RNA, 16 nt, Human
acauuuauauuuuugu

SEQ ID NO: 1644764 - RNA, 17 nt, Human
caaaacuuauuggaaug

SEQ ID NO: 1644765 - RNA, 17 nt, Human
acaaaugcauuucuaaa

SEQ ID NO: 1644766 - RNA, 15 nt, Human
ucauaauaaguugca

SEQ ID NO: 1644767 - RNA, 21 nt, Human
agaauucuguugauggaaaua

SEQ ID NO: 1644768 - RNA, 22 nt, Human
cuccuccagggagucucagcuu

SEQ ID NO: 1644769 - RNA, 18 nt, Human
uguacuuuauuuucuaua

SEQ ID NO: 1644770 - RNA, 18 nt, Human
uauaacaaugcuguauuu

SEQ ID NO: 1644771 - RNA, 21 nt, Human
uacaugagguacugagaguga

SEQ ID NO: 1644772 - RNA, 19 nt, Human
auccuacaagacacaguga

SEQ ID NO: 1644773 - RNA, 13 nt, Human
cacuuugaagagu

SEQ ID NO: 1644774 - RNA, 17 nt, Human
uuauauuugaaauauug

SEQ ID NO: 1644775 - RNA, 23 nt, Human
cauccucgaggcccuagcauuuc

SEQ ID NO: 1644776 - RNA, 19 nt, Human
gccccccagcccuccuuau

SEQ ID NO: 1644777 - RNA, 23 nt, Human
ggauguggggaaguuaggaacug

SEQ ID NO: 1644778 - RNA, 18 nt, Human
cagccucuuagaugcagu

SEQ ID NO: 1644779 - RNA, 14 nt, Human
cagauccccaagcc

SEQ ID NO: 1644780 - RNA, 20 nt, Human
uuaacacaugauccugcaau

SEQ ID NO: 1644781 - RNA, 21 nt, Human
uccagccuucucucaaggaga

SEQ ID NO: 1644782 - RNA, 23 nt, Human
ugucuucaggggccacaccaacc

SEQ ID NO: 1644783 - RNA, 12 nt, Human
uauaggccaggc

SEQ ID NO: 1644784 - RNA, 17 nt, Human
agaggcaaagaaaggag

SEQ ID NO: 1644785 - RNA, 22 nt, Human
auaucaaacugaaacaaaauua

SEQ ID NO: 1644786 - RNA, 16 nt, Human
aagaagcuagaaaaca

SEQ ID NO: 1644787 - RNA, 20 nt, Human
aguuguuucuacuacaugga

SEQ ID NO: 1644788 - RNA, 22 nt, Human
agugagcagucaggaaagagaa

SEQ ID NO: 1644789 - RNA, 18 nt, Human
auagcuacuaauuuuaaa

SEQ ID NO: 1644790 - RNA, 17 nt, Human
aacaaaaaucaaacuuu

SEQ ID NO: 1644791 - RNA, 20 nt, Human
uagaugcaguucugaagaag

SEQ ID NO: 1644792 - RNA, 17 nt, Human
aaccuagggugauauua

SEQ ID NO: 1644793 - RNA, 15 nt, Human
ccacaggaaccacaa

SEQ ID NO: 1644794 - RNA, 21 nt, Human
ccaugugcagccaccagucca

SEQ ID NO: 1644795 - RNA, 16 nt, Human
gucuguuuucccuccu

SEQ ID NO: 1644796 - RNA, 16 nt, Human
cacuaguauuucuaug

SEQ ID NO: 1644797 - RNA, 18 nt, Human
uggcuguuaaucuuucaa

SEQ ID NO: 1644798 - RNA, 20 nt, Human
ugagucccaggcugagccuc

SEQ ID NO: 1644799 - RNA, 12 nt, Human
aauuuaaauaua

SEQ ID NO: 1644800 - RNA, 20 nt, Human
aaggaugccccgucccccuc

SEQ ID NO: 1644801 - RNA, 17 nt, Human
ugaacuugguuuuaauu

SEQ ID NO: 1644802 - RNA, 22 nt, Human
aaacuuuacagaaagauuugau

SEQ ID NO: 1644803 - RNA, 18 nt, Human
uaaguuuuuuuuuaaaaa

SEQ ID NO: 1644804 - RNA, 19 nt, Human
uggggcuuuaacuccugcu

SEQ ID NO: 1644805 - RNA, 21 nt, Human
cucuugaaguauauauaucau

SEQ ID NO: 1644806 - RNA, 18 nt, Human
cauagguuuaauaauuuu

SEQ ID NO: 1644807 - RNA, 15 nt, Human
augggaacaaggaag

SEQ ID NO: 1644808 - RNA, 19 nt, Human
aauuuuguuauguauauuu

SEQ ID NO: 1644809 - RNA, 20 nt, Human
uguuggugaacuugguuuua

SEQ ID NO: 1644810 - RNA, 18 nt, Human
aaguugauaugccuuuuc

SEQ ID NO: 1644811 - RNA, 21 nt, Human
gaacagucucuugaggcacag

SEQ ID NO: 1644812 - RNA, 20 nt, Human
accuacacgagauacagaau

SEQ ID NO: 1644813 - RNA, 13 nt, Human
cuauuauauuucc

SEQ ID NO: 1644814 - RNA, 18 nt, Human
ugaagcuguguccucaug

SEQ ID NO: 1644815 - RNA, 21 nt, Human
ccuggugccucaccccuugcc

SEQ ID NO: 1644816 - RNA, 16 nt, Human
auuuuaauaauguuuc

SEQ ID NO: 1644817 - RNA, 14 nt, Human
aaaaaaggaaggaa

SEQ ID NO: 1644818 - RNA, 18 nt, Human
augagcacgcauggaaaa

SEQ ID NO: 1644819 - RNA, 22 nt, Human
cuuguacucugaaaguuuugga

SEQ ID NO: 1644820 - RNA, 16 nt, Human
ccucagucucccuccc

SEQ ID NO: 1644821 - RNA, 15 nt, Human
aaauauaaauaaaaa

SEQ ID NO: 1644822 - RNA, 12 nt, Human
gcugaugcaguu

SEQ ID NO: 1644823 - RNA, 16 nt, Human
ucuuauaauuuaaaau

SEQ ID NO: 1644824 - RNA, 21 nt, Human
aauuuacagagacagaaagca

SEQ ID NO: 1644825 - RNA, 17 nt, Human
caaauccaaugaaauga

SEQ ID NO: 1644826 - RNA, 19 nt, Human
agaugagagaacagggcug

SEQ ID NO: 1644827 - RNA, 17 nt, Human
agggagucucagcuuca

SEQ ID NO: 1644828 - RNA, 15 nt, Human
uguuaucuucacuuu

SEQ ID NO: 1644829 - RNA, 13 nt, Human
caacucccugccc

SEQ ID NO: 1644830 - RNA, 13 nt, Human
aaaggaaggaagg

SEQ ID NO: 1644831 - RNA, 18 nt, Human
ggaugggaacaaggaagg

SEQ ID NO: 1644832 - RNA, 11 nt, Human
uuauauuucca

SEQ ID NO: 1644833 - RNA, 17 nt, Human
uuuuauaugcuauuuau

SEQ ID NO: 1644834 - RNA, 13 nt, Human
uaaagaaacaaaa

SEQ ID NO: 1644835 - RNA, 22 nt, Human
auauuuuagauagaugaagaag

SEQ ID NO: 1644836 - RNA, 14 nt, Human
uaaaagacaaggaa

SEQ ID NO: 1644837 - RNA, 16 nt, Human
guccgaggugggcaga

SEQ ID NO: 1644838 - RNA, 16 nt, Human
ugagccccggaggucg

SEQ ID NO: 1644839 - RNA, 15 nt, Human
ggcaagcucuaucac

SEQ ID NO: 1644840 - RNA, 20 nt, Human
agaugcaguucugaagaaga

SEQ ID NO: 1644841 - RNA, 12 nt, Human
uaauuccacagc

SEQ ID NO: 1644842 - RNA, 12 nt, Human
auagcaaauaag

SEQ ID NO: 1644843 - RNA, 19 nt, Human
cccugccucaagcuaugug

SEQ ID NO: 1644844 - RNA, 15 nt, Human
cauuccaagccucau

SEQ ID NO: 1644845 - RNA, 13 nt, Human
uuuaaaaaagaaa

SEQ ID NO: 1644846 - RNA, 17 nt, Human
uauauuuccaagaaaua

SEQ ID NO: 1644847 - RNA, 20 nt, Human
cuuccaggcuggcgugcagc

SEQ ID NO: 1644848 - RNA, 17 nt, Human
ggcacaacacaucagga

SEQ ID NO: 1644849 - RNA, 23 nt, Human
agccccaaguggaacgagacaag

SEQ ID NO: 1644850 - RNA, 15 nt, Human
gcuguuaaucuuuca

SEQ ID NO: 1644851 - RNA, 12 nt, Human
cuccauuuuuag

SEQ ID NO: 1644852 - RNA, 17 nt, Human
ggcucuggacaggcacu

SEQ ID NO: 1644853 - RNA, 20 nt, Human
aaauaauuuuuauauuugaa

SEQ ID NO: 1644854 - RNA, 14 nt, Human
acuuggucugugag

SEQ ID NO: 1644855 - RNA, 22 nt, Human
uuugaugcuacaggauuugaaa

SEQ ID NO: 1644856 - RNA, 20 nt, Human
ugguuguauuauuuuuuaaa

SEQ ID NO: 1644857 - RNA, 13 nt, Human
aucaggcuggcca

SEQ ID NO: 1644858 - RNA, 21 nt, Human
uggaaacguauucaaacaauu

SEQ ID NO: 1644859 - RNA, 22 nt, Human
uccagccuucucucaaggagag

SEQ ID NO: 1644860 - RNA, 21 nt, Human
acacaucaggaaagagagcac

SEQ ID NO: 1644861 - RNA, 16 nt, Human
aaaugggaaacaaaag

SEQ ID NO: 1644862 - RNA, 22 nt, Human
cuuaucuauguagaauauauuu

SEQ ID NO: 1644863 - RNA, 14 nt, Human
uugaaauuguauua

SEQ ID NO: 1644864 - RNA, 20 nt, Human
cuuauucacaagacccaaaa

SEQ ID NO: 1644865 - RNA, 16 nt, Human
aauauuuuaauguuuc

SEQ ID NO: 1644866 - RNA, 21 nt, Human
ugccuaggcauagcccugccu

SEQ ID NO: 1644867 - RNA, 12 nt, Human
gauaaaagacag

SEQ ID NO: 1644868 - RNA, 20 nt, Human
gcuggagacauugaggcagg

SEQ ID NO: 1644869 - RNA, 20 nt, Human
acaugagguacugagaguga

SEQ ID NO: 1644870 - RNA, 15 nt, Human
gauccugcaauucca

SEQ ID NO: 1644871 - RNA, 23 nt, Human
cccgcuccugguuggucacagaa

SEQ ID NO: 1644872 - RNA, 13 nt, Human
ucuauaauuuaaa

SEQ ID NO: 1644873 - RNA, 22 nt, Human
gaaaggaaguauaggccaggca

SEQ ID NO: 1644874 - RNA, 13 nt, Human
acaauaaaagaca

SEQ ID NO: 1644875 - RNA, 16 nt, Human
uaggauguugaaaaag

SEQ ID NO: 1644876 - RNA, 16 nt, Human
ccuccuuuuaaaguaa

SEQ ID NO: 1644877 - RNA, 16 nt, Human
gccaaggaugccccgu

SEQ ID NO: 1644878 - RNA, 23 nt, Human
aggugaucuggcucuggacaggc

SEQ ID NO: 1644879 - RNA, 19 nt, Human
uggaacaguuaccucugcc

SEQ ID NO: 1644880 - RNA, 18 nt, Human
ucaccagucccuccccaa

SEQ ID NO: 1644881 - RNA, 23 nt, Human
caauaacgauaaaagacagugaa

SEQ ID NO: 1644882 - RNA, 22 nt, Human
gugccucaccccuugccauaau

SEQ ID NO: 1644883 - RNA, 19 nt, Human
aauauaugaggcuacagaa

SEQ ID NO: 1644884 - RNA, 17 nt, Human
cuacaugucuagagaac

SEQ ID NO: 1644885 - RNA, 15 nt, Human
aauuuaucauuuagu

SEQ ID NO: 1644886 - RNA, 21 nt, Human
ugcucaauaaaguacaagagc

SEQ ID NO: 1644887 - RNA, 22 nt, Human
caauaaaagacaaggaaaaaau

SEQ ID NO: 1644888 - RNA, 20 nt, Human
uuacaaauccaaugaaauga

SEQ ID NO: 1644889 - RNA, 23 nt, Human
caccucauggaauuggagcucgu

SEQ ID NO: 1644890 - RNA, 13 nt, Human
ucacuguaaaaua

SEQ ID NO: 1644891 - RNA, 17 nt, Human
uuauaucaauuuaaaaa

SEQ ID NO: 1644892 - RNA, 16 nt, Human
augccccgucccccuc

SEQ ID NO: 1644893 - RNA, 15 nt, Human
aggcaccucucuggg

SEQ ID NO: 1644894 - RNA, 15 nt, Human
uggauuccucacuuu

SEQ ID NO: 1644895 - RNA, 17 nt, Human
uaaaagacagugaaaga

SEQ ID NO: 1644896 - RNA, 17 nt, Human
gacucaccucccccauc

SEQ ID NO: 1644897 - RNA, 16 nt, Human
guuuuuuuuuaaaaaa

SEQ ID NO: 1644898 - RNA, 20 nt, Human
ccucaagcuaugugagcuca

SEQ ID NO: 1644899 - RNA, 23 nt, Human
agcccuccuuaucaaaggacacc

SEQ ID NO: 1644900 - RNA, 17 nt, Human
ugaucaccugcccugcu

SEQ ID NO: 1644901 - RNA, 14 nt, Human
cucccugcccccca

SEQ ID NO: 1644902 - RNA, 13 nt, Human
uuuuaaaaaagaa

SEQ ID NO: 1644903 - RNA, 16 nt, Human
ucuuuuaguuuuuaaa

SEQ ID NO: 1644904 - RNA, 14 nt, Human
uccacaacacacag

SEQ ID NO: 1644905 - RNA, 19 nt, Human
gagguacugagagugaaca

SEQ ID NO: 1644906 - RNA, 16 nt, Human
aaauauuauguuaaaa

SEQ ID NO: 1644907 - RNA, 14 nt, Human
cacuuauaggaauu

SEQ ID NO: 1644908 - RNA, 18 nt, Human
uuuuauaucaauuuaaaa

SEQ ID NO: 1644909 - RNA, 20 nt, Human
aagcuucacuguaaaauaau

SEQ ID NO: 1644910 - RNA, 19 nt, Human
uguuaucuucacuuuuaua

SEQ ID NO: 1644911 - RNA, 14 nt, Human
aaagagaacuucca

SEQ ID NO: 1644912 - RNA, 14 nt, Human
aagaagugaaaauc

SEQ ID NO: 1644913 - RNA, 22 nt, Human
ucuagcaugucgucaaagcuga

SEQ ID NO: 1644914 - RNA, 22 nt, Human
gugaacaaauuuacagagacag

SEQ ID NO: 1644915 - RNA, 16 nt, Human
cagucucccucccuug

SEQ ID NO: 1644916 - RNA, 17 nt, Human
ggaaauauuuauuuuaa

SEQ ID NO: 1644917 - RNA, 17 nt, Human
aggcuagaaccaccugc

SEQ ID NO: 1644918 - RNA, 21 nt, Human
uccuucagccugaaagaggaa

SEQ ID NO: 1644919 - RNA, 11 nt, Human
cgauaaaagac

SEQ ID NO: 1644920 - RNA, 18 nt, Human
acagagacagaaagcaga

SEQ ID NO: 1644921 - RNA, 22 nt, Human
aauuuaaaaaaaaaccugagcc

SEQ ID NO: 1644922 - RNA, 18 nt, Human
agcagugccaaaauauaa

SEQ ID NO: 1644923 - RNA, 19 nt, Human
cucauggaauuggagcucg

SEQ ID NO: 1644924 - RNA, 11 nt, Human
aggcaggagga

SEQ ID NO: 1644925 - RNA, 21 nt, Human
uagggugauauuaaccagggg

SEQ ID NO: 1644926 - RNA, 19 nt, Human
cucugcaagaagaaaucau

SEQ ID NO: 1644927 - RNA, 22 nt, Human
accaaucaugaauuaguuuuau

SEQ ID NO: 1644928 - RNA, 19 nt, Human
accuccuaagaaggcaccu

SEQ ID NO: 1644929 - RNA, 19 nt, Human
agaguuuagcuggaaaagu

SEQ ID NO: 1644930 - RNA, 19 nt, Human
ccccugcaaagcccagcuu

SEQ ID NO: 1644931 - RNA, 13 nt, Human
cugaugggcaaaa

SEQ ID NO: 1644932 - RNA, 20 nt, Human
uguaauaggcguaacuaauu

SEQ ID NO: 1644933 - RNA, 15 nt, Human
gagaugcuagaacuc

SEQ ID NO: 1644934 - RNA, 14 nt, Human
cugaacccagggaa

SEQ ID NO: 1644935 - RNA, 17 nt, Human
uccuuggugccuggagc

SEQ ID NO: 1644936 - RNA, 20 nt, Human
aagucuuucacauuuaaaua

SEQ ID NO: 1644937 - RNA, 15 nt, Human
aggcagauguuccua

SEQ ID NO: 1644938 - RNA, 17 nt, Human
cucugauccgagcucag

SEQ ID NO: 1644939 - RNA, 13 nt, Human
aggccuggugugu

SEQ ID NO: 1644940 - RNA, 18 nt, Human
ugcuauuuauuaaguauu

SEQ ID NO: 1644941 - RNA, 23 nt, Human
cgaaauacguuaggaggacaaaa

SEQ ID NO: 1644942 - RNA, 13 nt, Human
uuguaacugucuu

SEQ ID NO: 1644943 - RNA, 17 nt, Human
cuccuaagaaggcaccu

SEQ ID NO: 1644944 - RNA, 13 nt, Human
gagcucaggaggu

SEQ ID NO: 1644945 - RNA, 14 nt, Human
agguugcagugagc

SEQ ID NO: 1644946 - RNA, 14 nt, Human
agaugcuagaacuc

SEQ ID NO: 1644947 - RNA, 22 nt, Human
uaagaauucuguugauggaaau

SEQ ID NO: 1644948 - RNA, 15 nt, Human
auuucuaugaaauau

SEQ ID NO: 1644949 - RNA, 19 nt, Human
uaggaggacaaaaggaaug

SEQ ID NO: 1644950 - RNA, 22 nt, Human
uguuuuuccaguaguuagcuuu

SEQ ID NO: 1644951 - RNA, 21 nt, Human
cucagugucaaugcagccccc

SEQ ID NO: 1644952 - RNA, 18 nt, Human
cuucucacauuuauauuu

SEQ ID NO: 1644953 - RNA, 21 nt, Human
uuacauuuguauaaaauaauu

SEQ ID NO: 1644954 - RNA, 14 nt, Human
cugccccccagccc

SEQ ID NO: 1644955 - RNA, 13 nt, Human
aagacagugaaag

SEQ ID NO: 1644956 - RNA, 17 nt, Human
gaucuggcucuggacag

SEQ ID NO: 1644957 - RNA, 22 nt, Human
ccgggagccugaucaccugccc

SEQ ID NO: 1644958 - RNA, 16 nt, Human
ucccugccccccagcc

SEQ ID NO: 1644959 - RNA, 14 nt, Human
auauauuuuagaua

SEQ ID NO: 1644960 - RNA, 19 nt, Human
agaaaauaacgauaaaaga

SEQ ID NO: 1644961 - RNA, 21 nt, Human
caagacccaaaaggcagaagc

SEQ ID NO: 1644962 - RNA, 13 nt, Human
acaugucuagaga

SEQ ID NO: 1644963 - RNA, 23 nt, Human
gcccuggugccucaccccuugcc

SEQ ID NO: 1644964 - RNA, 20 nt, Human
cccuuccuaauuccacagcu

SEQ ID NO: 1644965 - RNA, 16 nt, Human
uugauuaagaaaggaa

SEQ ID NO: 1644966 - RNA, 16 nt, Human
auaaugaauacuuuau

SEQ ID NO: 1644967 - RNA, 22 nt, Human
augcagagguccacaacacaca

SEQ ID NO: 1644968 - RNA, 22 nt, Human
cugcuggagacauugaggcagg

SEQ ID NO: 1644969 - RNA, 21 nt, Human
auggcagcuuuccucaaaacu

SEQ ID NO: 1644970 - RNA, 21 nt, Human
uuauagcuacuaauuuuaaaa

SEQ ID NO: 1644971 - RNA, 21 nt, Human
ucacaugaacuuguaaaggaa

SEQ ID NO: 1644972 - RNA, 20 nt, Human
cuggccuucggccuccaucc

SEQ ID NO: 1644973 - RNA, 21 nt, Human
auggaaauacacuguuaucuu

SEQ ID NO: 1644974 - RNA, 23 nt, Human
auucaauaucuuuuuuuuaauaa

SEQ ID NO: 1644975 - RNA, 21 nt, Human
caacacacagauuugagcuca

SEQ ID NO: 1644976 - RNA, 17 nt, Human
caaccuucugaggagcu

SEQ ID NO: 1644977 - RNA, 22 nt, Human
agacucugucucaguccaugaa

SEQ ID NO: 1644978 - RNA, 13 nt, Human
uuccucugagccu

SEQ ID NO: 1644979 - RNA, 17 nt, Human
agggcauagaaguaaaa

SEQ ID NO: 1644980 - RNA, 23 nt, Human
uaaaauauaugaggcuacagaac

SEQ ID NO: 1644981 - RNA, 16 nt, Human
cagggacuugaaccca

SEQ ID NO: 1644982 - RNA, 18 nt, Human
agguccacaacacacaga

SEQ ID NO: 1644983 - RNA, 18 nt, Human
ugggauacuauuuaauua

SEQ ID NO: 1644984 - RNA, 12 nt, Human
aauauauuuccu

SEQ ID NO: 1644985 - RNA, 14 nt, Human
acaagagcuuaaca

SEQ ID NO: 1644986 - RNA, 13 nt, Human
auuuuaaaagaau

SEQ ID NO: 1644987 - RNA, 18 nt, Human
cucuauguucuaagaagu

SEQ ID NO: 1644988 - RNA, 15 nt, Human
cuguauguccuuggu

SEQ ID NO: 1644989 - RNA, 11 nt, Human
aauuuaaauau

SEQ ID NO: 1644990 - RNA, 18 nt, Human
uaauuagcauggccacau

SEQ ID NO: 1644991 - RNA, 14 nt, Human
acauauauaacaau

SEQ ID NO: 1644992 - RNA, 14 nt, Human
cugcugagucccag

SEQ ID NO: 1644993 - RNA, 21 nt, Human
cccacuggacucaccuccccc

SEQ ID NO: 1644994 - RNA, 18 nt, Human
ucaaggguacacugccuu

SEQ ID NO: 1644995 - RNA, 22 nt, Human
aucuucacuuuuauaagaaaua

SEQ ID NO: 1644996 - RNA, 23 nt, Human
uccacaaguaaaaggaaaugcuc

SEQ ID NO: 1644997 - RNA, 15 nt, Human
aagccuggcaaggga

SEQ ID NO: 1644998 - RNA, 16 nt, Human
aucacuuuaggccugg

SEQ ID NO: 1644999 - RNA, 15 nt, Human
agacagcucugcaua

SEQ ID NO: 1645000 - RNA, 15 nt, Human
gcccacuagacccac

SEQ ID NO: 1645001 - RNA, 14 nt, Human
caagaaggaaagau

SEQ ID NO: 1645002 - RNA, 21 nt, Human
gaagugaaaaucuacacucca

SEQ ID NO: 1645003 - RNA, 13 nt, Human
auuggacaguaaa

SEQ ID NO: 1645004 - RNA, 17 nt, Human
agugagacagcucugca

SEQ ID NO: 1645005 - RNA, 16 nt, Human
uuauauuuccaagaaa

SEQ ID NO: 1645006 - RNA, 14 nt, Human
ugagcucagcccug

SEQ ID NO: 1645007 - RNA, 22 nt, Human
cugaaauggaacagauuucaaa

SEQ ID NO: 1645008 - RNA, 15 nt, Human
cugaggcaggaggau

SEQ ID NO: 1645009 - RNA, 18 nt, Human
auucugguagcuaaauau

SEQ ID NO: 1645010 - RNA, 22 nt, Human
aaacaaggaugaauuaaguuuu

SEQ ID NO: 1645011 - RNA, 16 nt, Human
aaguugauuaagaaag

SEQ ID NO: 1645012 - RNA, 16 nt, Human
gaugcuuugagaacau

SEQ ID NO: 1645013 - RNA, 22 nt, Human
ucuacuaaaaauacaaaaaaaa

SEQ ID NO: 1645014 - RNA, 16 nt, Human
aacgagacaagcagcc

SEQ ID NO: 1645015 - RNA, 14 nt, Human
ugagcucaccaguc

SEQ ID NO: 1645016 - RNA, 16 nt, Human
auuccuuaagauauua

SEQ ID NO: 1645017 - RNA, 15 nt, Human
cuggaaacacauguu

SEQ ID NO: 1645018 - RNA, 18 nt, Human
gacccacuggacucaccu

SEQ ID NO: 1645019 - RNA, 15 nt, Human
ucugcagauaaacag

SEQ ID NO: 1645020 - RNA, 16 nt, Human
uuaaauuguaauaggc

SEQ ID NO: 1645021 - RNA, 15 nt, Human
uuuaauaauuuuuaa

SEQ ID NO: 1645022 - RNA, 22 nt, Human
cuucaacucccugccccccagc

SEQ ID NO: 1645023 - RNA, 17 nt, Human
guuagagaauuuccuua

SEQ ID NO: 1645024 - RNA, 22 nt, Human
cuggagacauugaggcaggcac

SEQ ID NO: 1645025 - RNA, 12 nt, Human
agacagugaaag

SEQ ID NO: 1645026 - RNA, 22 nt, Human
cucagcccuggugggcagagag

SEQ ID NO: 1645027 - RNA, 22 nt, Human
uggaaaguuuaugguuguauua

SEQ ID NO: 1645028 - RNA, 14 nt, Human
aguuuuuuuuuaaa

SEQ ID NO: 1645029 - RNA, 20 nt, Human
aauucuugccaaauauaaau

SEQ ID NO: 1645030 - RNA, 15 nt, Human
gcacagccucuuaga

SEQ ID NO: 1645031 - RNA, 19 nt, Human
cugccagaaucuagagcaa

SEQ ID NO: 1645032 - RNA, 21 nt, Human
gaaaacaauaacgauaaaaga

SEQ ID NO: 1645033 - RNA, 22 nt, Human
ccgggaggcagagguugcagug

SEQ ID NO: 1645034 - RNA, 17 nt, Human
aguuuauauagaaaugu

SEQ ID NO: 1645035 - RNA, 23 nt, Human
uauguuaaaacugggacagggga

SEQ ID NO: 1645036 - RNA, 19 nt, Human
gcacacagcacgggggcca

SEQ ID NO: 1645037 - RNA, 23 nt, Human
cugaaaucauacuucuuaggguu

SEQ ID NO: 1645038 - RNA, 15 nt, Human
agccucagucucccu

SEQ ID NO: 1645039 - RNA, 15 nt, Human
augcccauaccccug

SEQ ID NO: 1645040 - RNA, 19 nt, Human
cugcaaagcccagcuugaa

SEQ ID NO: 1645041 - RNA, 21 nt, Human
cuacauaaaauacaaaaacuu

SEQ ID NO: 1645042 - RNA, 18 nt, Human
uacauuuguauaaaauaa

SEQ ID NO: 1645043 - RNA, 13 nt, Human
ccucuggcuccag

SEQ ID NO: 1645044 - RNA, 12 nt, Human
caugggaaguga

SEQ ID NO: 1645045 - RNA, 20 nt, Human
cugagccucagucucccucc

SEQ ID NO: 1645046 - RNA, 14 nt, Human
aauauuauguuaaa

SEQ ID NO: 1645047 - RNA, 18 nt, Human
caagcuaugugagcucac

SEQ ID NO: 1645048 - RNA, 14 nt, Human
uuaauuauuucacu

SEQ ID NO: 1645049 - RNA, 17 nt, Human
caucgcagacacaugug

SEQ ID NO: 1645050 - RNA, 21 nt, Human
uuauguuuaauucugaaagca

SEQ ID NO: 1645051 - RNA, 19 nt, Human
cuuccagauccuggaaauc

SEQ ID NO: 1645052 - RNA, 20 nt, Human
uuaaugccacuaaauugaca

SEQ ID NO: 1645053 - RNA, 19 nt, Human
ucaauucuugccaaauaua

SEQ ID NO: 1645054 - RNA, 14 nt, Human
cuaagucuuauaua

SEQ ID NO: 1645055 - RNA, 19 nt, Human
agcagcuuauucacaagac

SEQ ID NO: 1645056 - RNA, 18 nt, Human
ugauuauuuuauguuuua

SEQ ID NO: 1645057 - RNA, 16 nt, Human
cuagaacucccuuuca

SEQ ID NO: 1645058 - RNA, 13 nt, Human
cauggaaaaguuu

SEQ ID NO: 1645059 - RNA, 22 nt, Human
uccaugaguugcaguuuuuucc

SEQ ID NO: 1645060 - RNA, 19 nt, Human
uccccuauccuacuucccc

SEQ ID NO: 1645061 - RNA, 14 nt, Human
guaacugauuugua

SEQ ID NO: 1645062 - RNA, 20 nt, Human
uaugcuucuguuuuauaauu

SEQ ID NO: 1645063 - RNA, 21 nt, Human
cucaagcuaugugagcucacc

SEQ ID NO: 1645064 - RNA, 17 nt, Human
agcccuuccccucugca

SEQ ID NO: 1645065 - RNA, 18 nt, Human
auagucaaauugugugaa

SEQ ID NO: 1645066 - RNA, 22 nt, Human
aaaaaaccugagccccaaaagg

SEQ ID NO: 1645067 - RNA, 21 nt, Human
ccuuuuuuugaaaaaaagcuu

SEQ ID NO: 1645068 - RNA, 14 nt, Human
uuaaacuuugauuu

SEQ ID NO: 1645069 - RNA, 20 nt, Human
aauaucuuuuuuuuaauaaa

SEQ ID NO: 1645070 - RNA, 18 nt, Human
gaauaauccuaaacauau

SEQ ID NO: 1645071 - RNA, 16 nt, Human
ccugagcuugcagaga

SEQ ID NO: 1645072 - RNA, 22 nt, Human
aggauggcuaguaucaaaagaa

SEQ ID NO: 1645073 - RNA, 17 nt, Human
uaucuucagaaaaccua

SEQ ID NO: 1645074 - RNA, 15 nt, Human
aaauauuuauuuuaa

SEQ ID NO: 1645075 - RNA, 22 nt, Human
ucugguagcuaaauauauauuu

SEQ ID NO: 1645076 - RNA, 18 nt, Human
acaaauccaaugaaauga

SEQ ID NO: 1645077 - RNA, 23 nt, Human
uuuauauuucuguuaaaauauau

SEQ ID NO: 1645078 - RNA, 17 nt, Human
ggaacauuuauguuccu

SEQ ID NO: 1645079 - RNA, 15 nt, Human
caaggagaggcaaag

SEQ ID NO: 1645080 - RNA, 23 nt, Human
gcugaguguuucacaccuuaucu

SEQ ID NO: 1645081 - RNA, 17 nt, Human
aacagauuucaaaaaaa

SEQ ID NO: 1645082 - RNA, 13 nt, Human
uggcuccagcugg

SEQ ID NO: 1645083 - RNA, 17 nt, Human
uuauuucccucccaagu

SEQ ID NO: 1645084 - RNA, 14 nt, Human
cuacaagacacagu

SEQ ID NO: 1645085 - RNA, 19 nt, Human
acuucagcgguuuauauaa

SEQ ID NO: 1645086 - RNA, 17 nt, Human
aaagcagggacuugaac

SEQ ID NO: 1645087 - RNA, 18 nt, Human
ucuaugaaauauuauguu

SEQ ID NO: 1645088 - RNA, 14 nt, Human
cuucacccugaggu

SEQ ID NO: 1645089 - RNA, 21 nt, Human
cuugaggcacagaaacuccug

SEQ ID NO: 1645090 - RNA, 19 nt, Human
cucuguucugcacacagca

SEQ ID NO: 1645091 - RNA, 16 nt, Human
cuuggagacagggccc

SEQ ID NO: 1645092 - RNA, 23 nt, Human
ggaggcagagguugcagugagcc

SEQ ID NO: 1645093 - RNA, 20 nt, Human
agggcaguguucccuggggc

SEQ ID NO: 1645094 - RNA, 23 nt, Human
ggaacaguuaccucugccucaga

SEQ ID NO: 1645095 - RNA, 20 nt, Human
aggcugagaugggagaauca

SEQ ID NO: 1645096 - RNA, 16 nt, Human
auuuuuagugaaauau

SEQ ID NO: 1645097 - RNA, 16 nt, Human
cuggguugaagggcag

SEQ ID NO: 1645098 - RNA, 19 nt, Human
ccagaucuaugccacaaga

SEQ ID NO: 1645099 - RNA, 19 nt, Human
acuaucucauuuccaagca

SEQ ID NO: 1645100 - RNA, 19 nt, Human
aaauuaaaaccucuuugug

SEQ ID NO: 1645101 - RNA, 15 nt, Human
cucccuuggggccua

SEQ ID NO: 1645102 - RNA, 22 nt, Human
agaagcaccaaucaugaauuag

SEQ ID NO: 1645103 - RNA, 17 nt, Human
ugaugcuuugagaacau

SEQ ID NO: 1645104 - RNA, 19 nt, Human
auuuugugaagcaaaauuu

SEQ ID NO: 1645105 - RNA, 14 nt, Human
acaugucuagagaa

SEQ ID NO: 1645106 - RNA, 14 nt, Human
gacaagaaggaaag

SEQ ID NO: 1645107 - RNA, 19 nt, Human
ucaguccaugaagauguag

SEQ ID NO: 1645108 - RNA, 12 nt, Human
uagcauuucucc

SEQ ID NO: 1645109 - RNA, 12 nt, Human
uuauucacugua

SEQ ID NO: 1645110 - RNA, 18 nt, Human
acagaaagcagaacagug

SEQ ID NO: 1645111 - RNA, 20 nt, Human
uccucaugagggcuggaugc

SEQ ID NO: 1645112 - RNA, 13 nt, Human
cucagaaaacaag

SEQ ID NO: 1645113 - RNA, 17 nt, Human
agacacacugaagaagc

SEQ ID NO: 1645114 - RNA, 15 nt, Human
uauuuauuuuaauaa

SEQ ID NO: 1645115 - RNA, 16 nt, Human
uccucacuuugaagag

SEQ ID NO: 1645116 - RNA, 17 nt, Human
gcagcauuguuggcugu

SEQ ID NO: 1645117 - RNA, 17 nt, Human
uuagauagaugaagaag

SEQ ID NO: 1645118 - RNA, 11 nt, Human
caucuagugag

SEQ ID NO: 1645119 - RNA, 13 nt, Human
auaucuucagaaa

SEQ ID NO: 1645120 - RNA, 16 nt, Human
aaauauaaauaaaaau

SEQ ID NO: 1645121 - RNA, 16 nt, Human
uguugagguaccucca

SEQ ID NO: 1645122 - RNA, 21 nt, Human
aaaauuuuuucucuaggaaau

SEQ ID NO: 1645123 - RNA, 15 nt, Human
ccagcacagccucuu

SEQ ID NO: 1645124 - RNA, 21 nt, Human
cuaggaugggaacaaggaagg

SEQ ID NO: 1645125 - RNA, 18 nt, Human
gccccgucccccucuggc

SEQ ID NO: 1645126 - RNA, 18 nt, Human
cuccauuuuuagugaaau

SEQ ID NO: 1645127 - RNA, 15 nt, Human
acuuuauaaaggauu

SEQ ID NO: 1645128 - RNA, 21 nt, Human
agaagcuagaaaacaggcaaa

SEQ ID NO: 1645129 - RNA, 21 nt, Human
gcccugcugagucccaggcug

SEQ ID NO: 1645130 - RNA, 20 nt, Human
aaggagccaaacauccuaca

SEQ ID NO: 1645131 - RNA, 18 nt, Human
ucaagggugugugcagca

SEQ ID NO: 1645132 - RNA, 12 nt, Human
acaccuuaucua

SEQ ID NO: 1645133 - RNA, 11 nt, Human
gcuacagugag

SEQ ID NO: 1645134 - RNA, 15 nt, Human
uacaaaugcauuucu

SEQ ID NO: 1645135 - RNA, 20 nt, Human
acuuuauuuucuauaauuua

SEQ ID NO: 1645136 - RNA, 21 nt, Human
cugagccucagucucccuccc

SEQ ID NO: 1645137 - RNA, 16 nt, Human
augggaacaaggaagg

SEQ ID NO: 1645138 - RNA, 18 nt, Human
ucuauguagaauauauuu

SEQ ID NO: 1645139 - RNA, 21 nt, Human
augcuacaggauuugaaauug

SEQ ID NO: 1645140 - RNA, 14 nt, Human
ccaccugcugagcc

SEQ ID NO: 1645141 - RNA, 13 nt, Human
cuacauaaaauac

SEQ ID NO: 1645142 - RNA, 17 nt, Human
uggcuaagcaaaaugug

SEQ ID NO: 1645143 - RNA, 14 nt, Human
ucuucagaaaaccu

SEQ ID NO: 1645144 - RNA, 17 nt, Human
aagaaacaaaaaucaaa

SEQ ID NO: 1645145 - RNA, 14 nt, Human
ggccuucggccucc

SEQ ID NO: 1645146 - RNA, 20 nt, Human
caaauguucaucaaugaaug

SEQ ID NO: 1645147 - RNA, 18 nt, Human
cugagucccaggcugagc

SEQ ID NO: 1645148 - RNA, 19 nt, Human
aaaauaacgauaaaagaca

SEQ ID NO: 1645149 - RNA, 20 nt, Human
uaaaacaagcacuaaacaaa

SEQ ID NO: 1645150 - RNA, 19 nt, Human
agcguugagccaccaagcu

SEQ ID NO: 1645151 - RNA, 16 nt, Human
ccuccuuaucaaagga

SEQ ID NO: 1645152 - RNA, 16 nt, Human
uauucagaauuucuaa

SEQ ID NO: 1645153 - RNA, 21 nt, Human
cuggccaccugcugagcccca

SEQ ID NO: 1645154 - RNA, 17 nt, Human
gaagcaccaaucaugaa

SEQ ID NO: 1645155 - RNA, 16 nt, Human
uucuauaauuuaaaua

SEQ ID NO: 1645156 - RNA, 23 nt, Human
augaauuaaguuuuuuuuuaaaa

SEQ ID NO: 1645157 - RNA, 20 nt, Human
acuccagugagacagcucug

SEQ ID NO: 1645158 - RNA, 16 nt, Human
agugucaaugcagccc

SEQ ID NO: 1645159 - RNA, 22 nt, Human
auacuuuggccauuacccccag

SEQ ID NO: 1645160 - RNA, 13 nt, Human
cacaacacacaga

SEQ ID NO: 1645161 - RNA, 23 nt, Human
uaacgauaaaagacagugaaaga

SEQ ID NO: 1645162 - RNA, 17 nt, Human
aggcuggcgugcagcau

SEQ ID NO: 1645163 - RNA, 19 nt, Human
accauuuuggcaagcucua

SEQ ID NO: 1645164 - RNA, 15 nt, Human
agucaccucauggaa

SEQ ID NO: 1645165 - RNA, 19 nt, Human
uggcaagcucuaucaccaa

SEQ ID NO: 1645166 - RNA, 21 nt, Human
acaaggaaggaaagaugugaa

SEQ ID NO: 1645167 - RNA, 12 nt, Human
cuuccucugagc

SEQ ID NO: 1645168 - RNA, 11 nt, Human
cuguuuuauaa

SEQ ID NO: 1645169 - RNA, 17 nt, Human
gggcuaaggcaggagga

SEQ ID NO: 1645170 - RNA, 22 nt, Human
uggaagccagaucuaugccaca

SEQ ID NO: 1645171 - RNA, 13 nt, Human
cugcacuccagcc

SEQ ID NO: 1645172 - RNA, 19 nt, Human
cuaagcuucacuguaaaau

SEQ ID NO: 1645173 - RNA, 13 nt, Human
uacuuuauuuucu

SEQ ID NO: 1645174 - RNA, 20 nt, Human
ugagagacacacugaagaag

SEQ ID NO: 1645175 - RNA, 20 nt, Human
aaaaucuuauaauuuaaaau

SEQ ID NO: 1645176 - RNA, 16 nt, Human
aaauguaauuauguuc

SEQ ID NO: 1645177 - RNA, 12 nt, Human
guaaaggcaaac

SEQ ID NO: 1645178 - RNA, 20 nt, Human
uggaacagauuucaaaaaaa

SEQ ID NO: 1645179 - RNA, 20 nt, Human
gccgggcgugguggugagug

SEQ ID NO: 1645180 - RNA, 22 nt, Human
uacugagagugaacaaauuuac

SEQ ID NO: 1645181 - RNA, 17 nt, Human
ucugguagcuaaauaua

SEQ ID NO: 1645182 - RNA, 18 nt, Human
augucugaaauggaacag

SEQ ID NO: 1645183 - RNA, 18 nt, Human
gcaaagcccagcuugaaa

SEQ ID NO: 1645184 - RNA, 19 nt, Human
cccuuccccucugcagcuu

SEQ ID NO: 1645185 - RNA, 14 nt, Human
aggggaccagagag

SEQ ID NO: 1645186 - RNA, 15 nt, Human
cauuuaguuauaaaa

SEQ ID NO: 1645187 - RNA, 15 nt, Human
cuggguuccuuccuc

SEQ ID NO: 1645188 - RNA, 11 nt, Human
ugccauaaaac

SEQ ID NO: 1645189 - RNA, 16 nt, Human
ccuuccccucugcagc

SEQ ID NO: 1645190 - RNA, 15 nt, Human
uuccaagaaauauuc

SEQ ID NO: 1645191 - RNA, 18 nt, Human
acacuguuaucuucacuu

SEQ ID NO: 1645192 - RNA, 19 nt, Human
acgaaauacguuaggagga

SEQ ID NO: 1645193 - RNA, 17 nt, Human
cuaucucauuuccaagc

SEQ ID NO: 1645194 - RNA, 19 nt, Human
aagucuuucacauuuaaau

SEQ ID NO: 1645195 - RNA, 20 nt, Human
uccagccugagcgacaguga

SEQ ID NO: 1645196 - RNA, 13 nt, Human
guuguguguggaa

SEQ ID NO: 1645197 - RNA, 16 nt, Human
uuccuuacucuugauu

SEQ ID NO: 1645198 - RNA, 16 nt, Human
aggaggaucacuugag

SEQ ID NO: 1645199 - RNA, 23 nt, Human
ggaugaauuaaguuuuuuuuuaa

SEQ ID NO: 1645200 - RNA, 15 nt, Human
auuuuaaaagaauga

SEQ ID NO: 1645201 - RNA, 21 nt, Human
acagcccuucuuuccacagaa

SEQ ID NO: 1645202 - RNA, 21 nt, Human
caccagucugacuguuuccau

SEQ ID NO: 1645203 - RNA, 22 nt, Human
gcuccuccagggagucucagcu

SEQ ID NO: 1645204 - RNA, 11 nt, Human
ugugugcagca

SEQ ID NO: 1645205 - RNA, 18 nt, Human
acuugccauaaaacuuag

SEQ ID NO: 1645206 - RNA, 12 nt, Human
guauaggccagg

SEQ ID NO: 1645207 - RNA, 13 nt, Human
ccagcacagccuc

SEQ ID NO: 1645208 - RNA, 20 nt, Human
aaagacaaggaaaaaauaac

SEQ ID NO: 1645209 - RNA, 12 nt, Human
aagaaaauaaca

SEQ ID NO: 1645210 - RNA, 23 nt, Human
caaauaagucaucugaugagaac

SEQ ID NO: 1645211 - RNA, 23 nt, Human
cccagcccuccuuaucaaaggac

SEQ ID NO: 1645212 - RNA, 13 nt, Human
auugggcaggcag

SEQ ID NO: 1645213 - RNA, 12 nt, Human
cuguuaaaauau

SEQ ID NO: 1645214 - RNA, 17 nt, Human
auaauuuaaauauaugc

SEQ ID NO: 1645215 - RNA, 15 nt, Human
ugucaauaaaaucca

SEQ ID NO: 1645216 - RNA, 22 nt, Human
uauuucuaugaaauauuauguu

SEQ ID NO: 1645217 - RNA, 16 nt, Human
uugccauaauuacuau

SEQ ID NO: 1645218 - RNA, 18 nt, Human
auagaauuaacacaugau

SEQ ID NO: 1645219 - RNA, 21 nt, Human
agucucccucccuuggggccu

SEQ ID NO: 1645220 - RNA, 18 nt, Human
agaagcaacccaaauguu

SEQ ID NO: 1645221 - RNA, 22 nt, Human
auggaaauguuuacagaucccc

SEQ ID NO: 1645222 - RNA, 18 nt, Human
ggaaagaauaaccaacac

SEQ ID NO: 1645223 - RNA, 20 nt, Human
aaugauguuucauaagaauu

SEQ ID NO: 1645224 - RNA, 20 nt, Human
aaugaauacuuuauaaagga

SEQ ID NO: 1645225 - RNA, 15 nt, Human
caggaaguagaggag

SEQ ID NO: 1645226 - RNA, 18 nt, Human
uaagcuucacuguaaaau

SEQ ID NO: 1645227 - RNA, 14 nt, Human
cucaccagucccuc

SEQ ID NO: 1645228 - RNA, 17 nt, Human
gauggaguuucucuaga

SEQ ID NO: 1645229 - RNA, 22 nt, Human
agucuuucacauuuaaauaaag

SEQ ID NO: 1645230 - RNA, 17 nt, Human
aaauguucaucaaugaa

SEQ ID NO: 1645231 - RNA, 12 nt, Human
ccagucccuccc

SEQ ID NO: 1645232 - RNA, 20 nt, Human
aaguucaaaacuuauuggaa

SEQ ID NO: 1645233 - RNA, 20 nt, Human
ggguuccuuccucugagccu

SEQ ID NO: 1645234 - RNA, 15 nt, Human
cccacucugcaagaa

SEQ ID NO: 1645235 - RNA, 22 nt, Human
cuccugccuaagugcagccccg

SEQ ID NO: 1645236 - RNA, 13 nt, Human
aauuauuucacuu

SEQ ID NO: 1645237 - RNA, 12 nt, Human
agaauauauuuc

SEQ ID NO: 1645238 - RNA, 19 nt, Human
accccugagcuugcagaga

SEQ ID NO: 1645239 - RNA, 21 nt, Human
caucuagcaugucgucaaagc

SEQ ID NO: 1645240 - RNA, 14 nt, Human
aguauaggccaggc

SEQ ID NO: 1645241 - RNA, 16 nt, Human
uauuuuaauguuucuu

SEQ ID NO: 1645242 - RNA, 14 nt, Human
auugucuagugaaa

SEQ ID NO: 1645243 - RNA, 23 nt, Human
auuccugacugcuaguuuauaua

SEQ ID NO: 1645244 - RNA, 17 nt, Human
cucacaggagcaucucc

SEQ ID NO: 1645245 - RNA, 17 nt, Human
aaagacaaggaaaaaau

SEQ ID NO: 1645246 - RNA, 14 nt, Human
aagagugaaggauu

SEQ ID NO: 1645247 - RNA, 13 nt, Human
aaggaaggaaaga

SEQ ID NO: 1645248 - RNA, 15 nt, Human
ucccuuuguccacaa

SEQ ID NO: 1645249 - RNA, 14 nt, Human
ugcuucuguuuuau

SEQ ID NO: 1645250 - RNA, 22 nt, Human
aaccuacacgagauacagaauu

SEQ ID NO: 1645251 - RNA, 18 nt, Human
agcaaaauuuuuucucua

SEQ ID NO: 1645252 - RNA, 15 nt, Human
ccacaucugagcccc

SEQ ID NO: 1645253 - RNA, 15 nt, Human
uauaauuuaaauaua

SEQ ID NO: 1645254 - RNA, 16 nt, Human
ucugcagauaaacagu

SEQ ID NO: 1645255 - RNA, 17 nt, Human
uuaauaauuuuuaauua

SEQ ID NO: 1645256 - RNA, 14 nt, Human
caucauuuacuuuu

SEQ ID NO: 1645257 - RNA, 13 nt, Human
auagugagacacu

SEQ ID NO: 1645258 - RNA, 16 nt, Human
caggaaguagaggagg

SEQ ID NO: 1645259 - RNA, 20 nt, Human
caagagccuuuuuuugaaaa

SEQ ID NO: 1645260 - RNA, 16 nt, Human
gaaguaucuugguugu

SEQ ID NO: 1645261 - RNA, 18 nt, Human
auaaaguguuugaaagcu

SEQ ID NO: 1645262 - RNA, 18 nt, Human
aaagaaaaucaggcuggc

SEQ ID NO: 1645263 - RNA, 23 nt, Human
uuuguauaaaauaauuuuuauau

SEQ ID NO: 1645264 - RNA, 17 nt, Human
caauaacgauaaaagac

SEQ ID NO: 1645265 - RNA, 14 nt, Human
gcugguggcucugu

SEQ ID NO: 1645266 - RNA, 18 nt, Human
ugggcacaggguuuaugu

SEQ ID NO: 1645267 - RNA, 17 nt, Human
caggaaucacuggcugu

SEQ ID NO: 1645268 - RNA, 23 nt, Human
aauauuuauuuuaauaauguuuc

SEQ ID NO: 1645269 - RNA, 15 nt, Human
gccuaagugcagccc

SEQ ID NO: 1645270 - RNA, 17 nt, Human
cagacaucaacagauaa

SEQ ID NO: 1645271 - RNA, 12 nt, Human
uuaauaaaccau

SEQ ID NO: 1645272 - RNA, 20 nt, Human
guugagccaccaagcuggug

SEQ ID NO: 1645273 - RNA, 14 nt, Human
ggcaauagucaaau

SEQ ID NO: 1645274 - RNA, 20 nt, Human
accucugccucagaaaacaa

SEQ ID NO: 1645275 - RNA, 23 nt, Human
caggaaucacuggcuguuaaucu

SEQ ID NO: 1645276 - RNA, 14 nt, Human
gccaggcauggugg

SEQ ID NO: 1645277 - RNA, 13 nt, Human
ccucauggaauug

SEQ ID NO: 1645278 - RNA, 20 nt, Human
ucuucuggguuccuuccucu

SEQ ID NO: 1645279 - RNA, 13 nt, Human
agacagcucugca

SEQ ID NO: 1645280 - RNA, 20 nt, Human
agcccuuccccucugcagcu

SEQ ID NO: 1645281 - RNA, 17 nt, Human
uuuuuaauuauauggcu

SEQ ID NO: 1645282 - RNA, 21 nt, Human
gggagccugaucaccugcccu

SEQ ID NO: 1645283 - RNA, 16 nt, Human
gauguugacucuaaag

SEQ ID NO: 1645284 - RNA, 15 nt, Human
gucccaggcugagcc

SEQ ID NO: 1645285 - RNA, 15 nt, Human
uucugcacacagcac

SEQ ID NO: 1645286 - RNA, 19 nt, Human
cuguuauuuuaucugcuau

SEQ ID NO: 1645287 - RNA, 22 nt, Human
guacacugccuucucaacucca

SEQ ID NO: 1645288 - RNA, 16 nt, Human
aauaaaguguuugaaa

SEQ ID NO: 1645289 - RNA, 23 nt, Human
gggccuaugcagagguccacaac

SEQ ID NO: 1645290 - RNA, 18 nt, Human
caaggcugauuaaaccaa

SEQ ID NO: 1645291 - RNA, 13 nt, Human
cuuuccaugaguu

SEQ ID NO: 1645292 - RNA, 17 nt, Human
auaaguacaugauaagc

SEQ ID NO: 1645293 - RNA, 17 nt, Human
auguuucauaagaauuc

SEQ ID NO: 1645294 - RNA, 15 nt, Human
ugaaauuguauuaca

SEQ ID NO: 1645295 - RNA, 22 nt, Human
cuuccccucugcagcuuccagg

SEQ ID NO: 1645296 - RNA, 12 nt, Human
cuccaaggaccg

SEQ ID NO: 1645297 - RNA, 23 nt, Human
ugaauuacauuuguauaaaauaa

SEQ ID NO: 1645298 - RNA, 13 nt, Human
aagugcagccccg

SEQ ID NO: 1645299 - RNA, 19 nt, Human
cccccucuggcuccagcug

SEQ ID NO: 1645300 - RNA, 19 nt, Human
caaagugucuugaauugua

SEQ ID NO: 1645301 - RNA, 17 nt, Human
cagggcugaagcugugu

SEQ ID NO: 1645302 - RNA, 16 nt, Human
auaaauaaaaacaaag

SEQ ID NO: 1645303 - RNA, 19 nt, Human
ugaaauggacuuuuguaca

SEQ ID NO: 1645304 - RNA, 15 nt, Human
aggaacuggugucuu

SEQ ID NO: 1645305 - RNA, 19 nt, Human
auuuuagauagaugaagaa

SEQ ID NO: 1645306 - RNA, 20 nt, Human
auaauccuaaacauaugaau

SEQ ID NO: 1645307 - RNA, 19 nt, Human
gagccugaucaccugcccu

SEQ ID NO: 1645308 - RNA, 18 nt, Human
acaaaugcauuucuaaag

SEQ ID NO: 1645309 - RNA, 14 nt, Human
auuuauuaaguauu

SEQ ID NO: 1645310 - RNA, 17 nt, Human
ugcacaucaaaauaugc

SEQ ID NO: 1645311 - RNA, 12 nt, Human
gcucagcccugg

SEQ ID NO: 1645312 - RNA, 18 nt, Human
caagccucauguccacug

SEQ ID NO: 1645313 - RNA, 18 nt, Human
uauagcuacuaauuuuaa

SEQ ID NO: 1645314 - RNA, 21 nt, Human
cuuccaggcuggcgugcagca

SEQ ID NO: 1645315 - RNA, 19 nt, Human
ucccucccaaguaaauguu

SEQ ID NO: 1645316 - RNA, 20 nt, Human
cagcuggccgggagccugau

SEQ ID NO: 1645317 - RNA, 23 nt, Human
aaugcuccuccagggagucucag

SEQ ID NO: 1645318 - RNA, 17 nt, Human
ugacuauuauauuucca

SEQ ID NO: 1645319 - RNA, 16 nt, Human
acaaggaugaauuaag

SEQ ID NO: 1645320 - RNA, 12 nt, Human
auaaaauacaaa

SEQ ID NO: 1645321 - RNA, 12 nt, Human
uauuuuaauguu

SEQ ID NO: 1645322 - RNA, 21 nt, Human
agggugauauuaaccaggggc

SEQ ID NO: 1645323 - RNA, 20 nt, Human
aucauuuaguuauaaaaaua

SEQ ID NO: 1645324 - RNA, 23 nt, Human
gcuaugcuauugaaguuuuggca

SEQ ID NO: 1645325 - RNA, 23 nt, Human
agcucugcccauccugccccuga

SEQ ID NO: 1645326 - RNA, 18 nt, Human
auuuuagacauucuuuau

SEQ ID NO: 1645327 - RNA, 23 nt, Human
agaaugauuaugaauuacauuug

SEQ ID NO: 1645328 - RNA, 23 nt, Human
uaaguuuuuuuuuaaaaaagaaa

SEQ ID NO: 1645329 - RNA, 17 nt, Human
guauuauuuuuuaaaaa

SEQ ID NO: 1645330 - RNA, 18 nt, Human
aaaguaacccuacaaaac

SEQ ID NO: 1645331 - RNA, 20 nt, Human
aauuguaggugacuauuaua

SEQ ID NO: 1645332 - RNA, 12 nt, Human
aguuauaaaaau

SEQ ID NO: 1645333 - RNA, 22 nt, Human
acaccuuguacuuuauuuucua

SEQ ID NO: 1645334 - RNA, 14 nt, Human
ggagauacagugga

SEQ ID NO: 1645335 - RNA, 19 nt, Human
agucaaauugugugaaagg

SEQ ID NO: 1645336 - RNA, 20 nt, Human
augguuuagaaagcuugccc

SEQ ID NO: 1645337 - RNA, 19 nt, Human
agacagugaaagaaaauaa

SEQ ID NO: 1645338 - RNA, 12 nt, Human
aggaaauauuuu

SEQ ID NO: 1645339 - RNA, 20 nt, Human
aggugggcagaucacuugag

SEQ ID NO: 1645340 - RNA, 12 nt, Human
gguuuauauaag

SEQ ID NO: 1645341 - RNA, 18 nt, Human
uauuucuguuaaaauaua

SEQ ID NO: 1645342 - RNA, 17 nt, Human
agcuggaaacacauguu

SEQ ID NO: 1645343 - RNA, 13 nt, Human
ggacaaaaggaau

SEQ ID NO: 1645344 - RNA, 15 nt, Human
uucggccuccauccu

SEQ ID NO: 1645345 - RNA, 14 nt, Human
agagaauuuccuua

SEQ ID NO: 1645346 - RNA, 21 nt, Human
uuauuuucuauaauuuaaaua

SEQ ID NO: 1645347 - RNA, 16 nt, Human
uuucacauuuaaauaa

SEQ ID NO: 1645348 - RNA, 18 nt, Human
gaaaugaaagcagggacu

SEQ ID NO: 1645349 - RNA, 14 nt, Human
ccaaugaaaugagu

SEQ ID NO: 1645350 - RNA, 20 nt, Human
gagccucagucucccucccu

SEQ ID NO: 1645351 - RNA, 22 nt, Human
uucauucacucaacaaacauaa

SEQ ID NO: 1645352 - RNA, 13 nt, Human
agcccagcuugaa

SEQ ID NO: 1645353 - RNA, 19 nt, Human
cuaguaucaaaagaaagaa

SEQ ID NO: 1645354 - RNA, 22 nt, Human
gaugguucccuugaugaagaag

SEQ ID NO: 1645355 - RNA, 15 nt, Human
aaucagagauaaagc

SEQ ID NO: 1645356 - RNA, 22 nt, Human
aaagacagugaaagaaaauaac

SEQ ID NO: 1645357 - RNA, 22 nt, Human
aauaagucaucugaugagaaca

SEQ ID NO: 1645358 - RNA, 17 nt, Human
gaaugagagacacacug

SEQ ID NO: 1645359 - RNA, 23 nt, Human
uguugagguaccuccaaggaccg

SEQ ID NO: 1645360 - RNA, 21 nt, Human
agccucuuagaugcaguucug

SEQ ID NO: 1645361 - RNA, 20 nt, Human
auucccagccagcacagccu

SEQ ID NO: 1645362 - RNA, 21 nt, Human
cuucucacauuuauauuuuug

SEQ ID NO: 1645363 - RNA, 19 nt, Human
auuuucuauaauuuaaaua

SEQ ID NO: 1645364 - RNA, 17 nt, Human
agauagaugaagaagcu

SEQ ID NO: 1645365 - RNA, 22 nt, Human
uuccuagucuguuuucccuccu

SEQ ID NO: 1645366 - RNA, 18 nt, Human
aguagcugcccuuucuca

SEQ ID NO: 1645367 - RNA, 17 nt, Human
gcucaggaggucaagau

SEQ ID NO: 1645368 - RNA, 12 nt, Human
aucuucagaaaa

SEQ ID NO: 1645369 - RNA, 17 nt, Human
agagacagaaagcagaa

SEQ ID NO: 1645370 - RNA, 22 nt, Human
aggaugccccgucccccucugg

SEQ ID NO: 1645371 - RNA, 19 nt, Human
gcuuguauuccuuuuucuc

SEQ ID NO: 1645372 - RNA, 22 nt, Human
gaugcaguucugaagaagaugg

SEQ ID NO: 1645373 - RNA, 22 nt, Human
aagagccuuuuuuugaaaaaaa

SEQ ID NO: 1645374 - RNA, 14 nt, Human
ucaaugcagccccc

SEQ ID NO: 1645375 - RNA, 14 nt, Human
gaaggugaucuggc

SEQ ID NO: 1645376 - RNA, 15 nt, Human
agugacaagcucaca

SEQ ID NO: 1645377 - RNA, 16 nt, Human
cugcugagucccaggc

SEQ ID NO: 1645378 - RNA, 19 nt, Human
acuauuauauuuccaagaa

SEQ ID NO: 1645379 - RNA, 17 nt, Human
guuuaauaauuuuuaau

SEQ ID NO: 1645380 - RNA, 18 nt, Human
guuuaugguuguauuauu

SEQ ID NO: 1645381 - RNA, 20 nt, Human
agccuuuuuuugaaaaaaag

SEQ ID NO: 1645382 - RNA, 23 nt, Human
ugaaaaucuuauaauuuaaaaua

SEQ ID NO: 1645383 - RNA, 14 nt, Human
aaaacuucagacau

SEQ ID NO: 1645384 - RNA, 15 nt, Human
aucaaaggacaccau

SEQ ID NO: 1645385 - RNA, 19 nt, Human
aaugaauggcuaagcaaaa

SEQ ID NO: 1645386 - RNA, 17 nt, Human
ccugccccccagcccuc

SEQ ID NO: 1645387 - RNA, 23 nt, Human
uugacccucacaggagcaucucc

SEQ ID NO: 1645388 - RNA, 22 nt, Human
agacccacuggacucaccuccc

SEQ ID NO: 1645389 - RNA, 22 nt, Human
caagcucuaucaccaaggagcc

SEQ ID NO: 1645390 - RNA, 20 nt, Human
ccugccuaagugcagccccg

SEQ ID NO: 1645391 - RNA, 23 nt, Human
accucucuggguugaagggcagu

SEQ ID NO: 1645392 - RNA, 22 nt, Human
aggacaccauuuuggcaagcuc

SEQ ID NO: 1645393 - RNA, 23 nt, Human
auacaguggagacaucuggaaag

SEQ ID NO: 1645394 - RNA, 16 nt, Human
cuguggauuuaaugug

SEQ ID NO: 1645395 - RNA, 14 nt, Human
ccuuaucaaaggac

SEQ ID NO: 1645396 - RNA, 13 nt, Human
ccaggcugagccu

SEQ ID NO: 1645397 - RNA, 18 nt, Human
auguuagagaauuuccuu

SEQ ID NO: 1645398 - RNA, 17 nt, Human
cuucacuguaaaauaau

SEQ ID NO: 1645399 - RNA, 16 nt, Human
uagagaauuuccuuac

SEQ ID NO: 1645400 - RNA, 16 nt, Human
aaauauuccuuaagau

SEQ ID NO: 1645401 - RNA, 22 nt, Human
aauaauccuaaacauaugaauu

SEQ ID NO: 1645402 - RNA, 16 nt, Human
uugucaauaaaaucca

SEQ ID NO: 1645403 - RNA, 23 nt, Human
aaaaugggcuuuggaugauuauu

SEQ ID NO: 1645404 - RNA, 19 nt, Human
auuuucaguuauuauauuu

SEQ ID NO: 1645405 - RNA, 21 nt, Human
cagcccuuagcccuuccccuc

SEQ ID NO: 1645406 - RNA, 15 nt, Human
aucaauuuaaaaaaa

SEQ ID NO: 1645407 - RNA, 17 nt, Human
ugcccauaccccuggcc

SEQ ID NO: 1645408 - RNA, 16 nt, Human
auaauccuaaacauau

SEQ ID NO: 1645409 - RNA, 18 nt, Human
ccaaccuucugaggagcu

SEQ ID NO: 1645410 - RNA, 15 nt, Human
auuucauucaauauc

SEQ ID NO: 1645411 - RNA, 18 nt, Human
ugaagaagcuagaaaaca

SEQ ID NO: 1645412 - RNA, 13 nt, Human
cucugcagcuucc

SEQ ID NO: 1645413 - RNA, 16 nt, Human
ggaguuucucuagaag

SEQ ID NO: 1645414 - RNA, 16 nt, Human
aaaauaauccucaguu

SEQ ID NO: 1645415 - RNA, 16 nt, Human
agugaaggauuuaugu

SEQ ID NO: 1645416 - RNA, 14 nt, Human
aauggcuaagcaaa

SEQ ID NO: 1645417 - RNA, 19 nt, Human
cugagccucagucucccuc

SEQ ID NO: 1645418 - RNA, 20 nt, Human
gcccacucugcaagaagaaa

SEQ ID NO: 1645419 - RNA, 20 nt, Human
gcagagaugaggccgccaug

SEQ ID NO: 1645420 - RNA, 15 nt, Human
ccaugugcagccacc

SEQ ID NO: 1645421 - RNA, 22 nt, Human
cuccagccugagcgacagugag

SEQ ID NO: 1645422 - RNA, 23 nt, Human
cuagucuguuuucccuccuugga

SEQ ID NO: 1645423 - RNA, 23 nt, Human
uuguaacaagccuccuuuuaaag

SEQ ID NO: 1645424 - RNA, 23 nt, Human
cuaggaugggaacaaggaaggaa

SEQ ID NO: 1645425 - RNA, 18 nt, Human
auuuuuagugaaauauua

SEQ ID NO: 1645426 - RNA, 16 nt, Human
gucucuacauaaaaua

SEQ ID NO: 1645427 - RNA, 15 nt, Human
ucaaaggacaccauu

SEQ ID NO: 1645428 - RNA, 22 nt, Human
agaucacuugagcucaggaggu

SEQ ID NO: 1645429 - RNA, 13 nt, Human
aaaaauccuacuu

SEQ ID NO: 1645430 - RNA, 17 nt, Human
uaucaauuuaaaaaaaa

SEQ ID NO: 1645431 - RNA, 21 nt, Human
guacuccagccagggcaagag

SEQ ID NO: 1645432 - RNA, 23 nt, Human
gaucuacaugucuagagaacacu

SEQ ID NO: 1645433 - RNA, 13 nt, Human
uagcuaaguuuug

SEQ ID NO: 1645434 - RNA, 23 nt, Human
aucucuucuggguuccuuccucu

SEQ ID NO: 1645435 - RNA, 23 nt, Human
ugcauagguuuaauaauuuuuaa

SEQ ID NO: 1645436 - RNA, 15 nt, Human
aaaaaagaaacauuu

SEQ ID NO: 1645437 - RNA, 20 nt, Human
uacaucccuuaccugggaaa

SEQ ID NO: 1645438 - RNA, 22 nt, Human
agacucgggauuaguacacacu

SEQ ID NO: 1645439 - RNA, 15 nt, Human
agaaaacaauaacga

SEQ ID NO: 1645440 - RNA, 15 nt, Human
agggcucacagaauu

SEQ ID NO: 1645441 - RNA, 15 nt, Human
ggaaauauuuuaaug

SEQ ID NO: 1645442 - RNA, 20 nt, Human
auaucauagcaaauaaguca

SEQ ID NO: 1645443 - RNA, 20 nt, Human
uggccacacaggaucuuuug

SEQ ID NO: 1645444 - RNA, 13 nt, Human
agcuaaauauaua

SEQ ID NO: 1645445 - RNA, 14 nt, Human
agacacugucucua

SEQ ID NO: 1645446 - RNA, 22 nt, Human
uaaaguugauuuaaggccaggc

SEQ ID NO: 1645447 - RNA, 22 nt, Human
aaauaacaaugaaaguugauaa

SEQ ID NO: 1645448 - RNA, 16 nt, Human
agugaaauauuauuuu

SEQ ID NO: 1645449 - RNA, 16 nt, Human
aagcuucacuguaaaa

SEQ ID NO: 1645450 - RNA, 22 nt, Human
agcauuguuggcuguuccugca

SEQ ID NO: 1645451 - RNA, 19 nt, Human
cucacauuuauauuuuugu

SEQ ID NO: 1645452 - RNA, 17 nt, Human
agcuaaauauauauuuu

SEQ ID NO: 1645453 - RNA, 17 nt, Human
cuucugaggagcuguug

SEQ ID NO: 1645454 - RNA, 14 nt, Human
cuuucauaauaagu

SEQ ID NO: 1645455 - RNA, 22 nt, Human
uuaccucugccucagaaaacaa

SEQ ID NO: 1645456 - RNA, 14 nt, Human
cuaaacauaugaau

SEQ ID NO: 1645457 - RNA, 12 nt, Human
cuacauaaaaua

SEQ ID NO: 1645458 - RNA, 14 nt, Human
ccgcuuaagcuuuc

SEQ ID NO: 1645459 - RNA, 15 nt, Human
gaauaaccaacaccc

SEQ ID NO: 1645460 - RNA, 20 nt, Human
uuuagacauucuuuaucuuu

SEQ ID NO: 1645461 - RNA, 14 nt, Human
gaaacgaagcacca

SEQ ID NO: 1645462 - RNA, 21 nt, Human
cauuucuugagguaaaagcau

SEQ ID NO: 1645463 - RNA, 16 nt, Human
ccagucccuccccaaa

SEQ ID NO: 1645464 - RNA, 19 nt, Human
ugcuauuugcuguuauuuu

SEQ ID NO: 1645465 - RNA, 15 nt, Human
cuugugaggagcugg

SEQ ID NO: 1645466 - RNA, 20 nt, Human
agcuuauugucuagugaaac

SEQ ID NO: 1645467 - RNA, 20 nt, Human
cugcacacagcacgggggcc

SEQ ID NO: 1645468 - RNA, 19 nt, Human
augaauuacauuuguauaa

SEQ ID NO: 1645469 - RNA, 13 nt, Human
uggacgagaaaac

SEQ ID NO: 1645470 - RNA, 15 nt, Human
cuucugaggagcugu

SEQ ID NO: 1645471 - RNA, 15 nt, Human
auaaauaaaaauaau

SEQ ID NO: 1645472 - RNA, 14 nt, Human
cugguggcucugug

SEQ ID NO: 1645473 - RNA, 15 nt, Human
ccucagucucccucc

SEQ ID NO: 1645474 - RNA, 14 nt, Human
ugaagauguagagg

SEQ ID NO: 1645475 - RNA, 22 nt, Human
cuacauaaaauacaaaaacuua

SEQ ID NO: 1645476 - RNA, 20 nt, Human
ccccuauccuacuuccccuu

SEQ ID NO: 1645477 - RNA, 19 nt, Human
auuuacagagacagaaagc

SEQ ID NO: 1645478 - RNA, 19 nt, Human
auagugaggagcuuugaaa

SEQ ID NO: 1645479 - RNA, 16 nt, Human
auuucaaaaaaaaacc

SEQ ID NO: 1645480 - RNA, 16 nt, Human
cacuuaaaaaugguuu

SEQ ID NO: 1645481 - RNA, 16 nt, Human
aaguaaaggcaaacuu

SEQ ID NO: 1645482 - RNA, 21 nt, Human
ccugaucaccugcccugcuga

SEQ ID NO: 1645483 - RNA, 15 nt, Human
acaugugcuggccac

SEQ ID NO: 1645484 - RNA, 20 nt, Human
aagucaucugaugagaacaa

SEQ ID NO: 1645485 - RNA, 22 nt, Human
caguauggcagcuuuccucaaa

SEQ ID NO: 1645486 - RNA, 18 nt, Human
uuacagguccugcugaaa

SEQ ID NO: 1645487 - RNA, 23 nt, Human
uagauguauagguugaugguggu

SEQ ID NO: 1645488 - RNA, 19 nt, Human
acagucaccucauggaauu

SEQ ID NO: 1645489 - RNA, 17 nt, Human
aaagcuccauuuuuagu

SEQ ID NO: 1645490 - RNA, 14 nt, Human
guccacaaguaaaa

SEQ ID NO: 1645491 - RNA, 19 nt, Human
caagcagcccuuagcccuu

SEQ ID NO: 1645492 - RNA, 20 nt, Human
cuacuuccccuuccuaauuc

SEQ ID NO: 1645493 - RNA, 13 nt, Human
cagaaacuccugu

SEQ ID NO: 1645494 - RNA, 15 nt, Human
auaauuuugugaagc

SEQ ID NO: 1645495 - RNA, 12 nt, Human
gcuaaggcagga

SEQ ID NO: 1645496 - RNA, 16 nt, Human
aaaaauuccaagugau

SEQ ID NO: 1645497 - RNA, 17 nt, Human
aaauaacaauaaaagac

SEQ ID NO: 1645498 - RNA, 22 nt, Human
gaugcaguuguugcccacagcu

SEQ ID NO: 1645499 - RNA, 15 nt, Human
aucuuuaacccacua

SEQ ID NO: 1645500 - RNA, 17 nt, Human
gaaguauaggccaggca

SEQ ID NO: 1645501 - RNA, 17 nt, Human
gcagcaucagcaucccu

SEQ ID NO: 1645502 - RNA, 13 nt, Human
ucuaccaaaaaaa

SEQ ID NO: 1645503 - RNA, 18 nt, Human
acauuugcucauggaauu

SEQ ID NO: 1645504 - RNA, 20 nt, Human
gaaacugcccacucugcaag

SEQ ID NO: 1645505 - RNA, 14 nt, Human
aaucucaauauuuc

SEQ ID NO: 1645506 - RNA, 12 nt, Human
ggcagcaccucc

SEQ ID NO: 1645507 - RNA, 16 nt, Human
cucaauaaaguacaag

SEQ ID NO: 1645508 - RNA, 23 nt, Human
gaaaaucuuauaauuuaaaauau

SEQ ID NO: 1645509 - RNA, 19 nt, Human
gaaggcaccucucuggguu

SEQ ID NO: 1645510 - RNA, 12 nt, Human
caggacagcccu

SEQ ID NO: 1645511 - RNA, 14 nt, Human
aauauaaauaaaaa

SEQ ID NO: 1645512 - RNA, 15 nt, Human
aagcacuaaacaaag

SEQ ID NO: 1645513 - RNA, 18 nt, Human
acugacucuuaagaagac

SEQ ID NO: 1645514 - RNA, 15 nt, Human
auuugguaaggggaa

SEQ ID NO: 1645515 - RNA, 21 nt, Human
ugcccauccugccccugagcc

SEQ ID NO: 1645516 - RNA, 20 nt, Human
cugaggcaggaggaucacuu

SEQ ID NO: 1645517 - RNA, 21 nt, Human
augaugcuuugagaacauacu

SEQ ID NO: 1645518 - RNA, 15 nt, Human
gugaccacugcagaa

SEQ ID NO: 1645519 - RNA, 22 nt, Human
cucuggccuucggccuccaucc

SEQ ID NO: 1645520 - RNA, 14 nt, Human
caucaucuucuggg

SEQ ID NO: 1645521 - RNA, 21 nt, Human
auuuacaaaugggaaacaaaa

SEQ ID NO: 1645522 - RNA, 19 nt, Human
acauauagcagcucuugaa

SEQ ID NO: 1645523 - RNA, 16 nt, Human
ccuaugcagaggucca

SEQ ID NO: 1645524 - RNA, 14 nt, Human
gggcaagagagcga

SEQ ID NO: 1645525 - RNA, 13 nt, Human
caucgcagacaca

SEQ ID NO: 1645526 - RNA, 21 nt, Human
gucaagaucagccugggcaac

SEQ ID NO: 1645527 - RNA, 17 nt, Human
uaacgauaaaagacagu

SEQ ID NO: 1645528 - RNA, 19 nt, Human
uaaugaaguguuuagcaua

SEQ ID NO: 1645529 - RNA, 12 nt, Human
uaguuuuuaaag

SEQ ID NO: 1645530 - RNA, 16 nt, Human
uauaaauuuaucauuu

SEQ ID NO: 1645531 - RNA, 21 nt, Human
uuuauauaagcuuguauuccu

SEQ ID NO: 1645532 - RNA, 23 nt, Human
cucauguccacugguucuucuug

SEQ ID NO: 1645533 - RNA, 12 nt, Human
uauuauuuuuua

SEQ ID NO: 1645534 - RNA, 18 nt, Human
uacuuuauuuucuauaau

SEQ ID NO: 1645535 - RNA, 21 nt, Human
uccccuugggggugguggaug

SEQ ID NO: 1645536 - RNA, 23 nt, Human
uguugcccacagcuguaugauuc

SEQ ID NO: 1645537 - RNA, 15 nt, Human
uuauaugcuauuuau

SEQ ID NO: 1645538 - RNA, 13 nt, Human
guaacuaauuuua

SEQ ID NO: 1645539 - RNA, 14 nt, Human
auauuugaaauauu

SEQ ID NO: 1645540 - RNA, 22 nt, Human
aaaggaauguguaagucuuuaa

SEQ ID NO: 1645541 - RNA, 16 nt, Human
uuagagaauuuccuua

SEQ ID NO: 1645542 - RNA, 17 nt, Human
uaggaugggaacaagga

SEQ ID NO: 1645543 - RNA, 23 nt, Human
ggucuaucuuugagcgcccacua

SEQ ID NO: 1645544 - RNA, 21 nt, Human
ucaagucuuucacauuuaaau

SEQ ID NO: 1645545 - RNA, 15 nt, Human
uuauauuucuguuaa

SEQ ID NO: 1645546 - RNA, 21 nt, Human
uaaaagacagugaaagaaaau

SEQ ID NO: 1645547 - RNA, 23 nt, Human
gaaugagagacacacugaagaag

SEQ ID NO: 1645548 - RNA, 14 nt, Human
aaaaaggaaggaag

SEQ ID NO: 1645549 - RNA, 20 nt, Human
acagcccuucuuuccacaga

SEQ ID NO: 1645550 - RNA, 22 nt, Human
ucuggguuccuuccucugagcc

SEQ ID NO: 1645551 - RNA, 12 nt, Human
cagauuuuccug

SEQ ID NO: 1645552 - RNA, 23 nt, Human
agcaugucgucaaagcugaaaug

SEQ ID NO: 1645553 - RNA, 14 nt, Human
acgagaaaacaaua

SEQ ID NO: 1645554 - RNA, 13 nt, Human
aacgucacaucuu

SEQ ID NO: 1645555 - RNA, 14 nt, Human
agcguugagccacc

SEQ ID NO: 1645556 - RNA, 21 nt, Human
uauuauuuuauagcuacuaau

SEQ ID NO: 1645557 - RNA, 18 nt, Human
gaaauacguuaggaggac

SEQ ID NO: 1645558 - RNA, 14 nt, Human
ggacucaccucccc

SEQ ID NO: 1645559 - RNA, 23 nt, Human
ucuaccaaaaaucucaauauuuc

SEQ ID NO: 1645560 - RNA, 12 nt, Human
acaagaaaugaa

SEQ ID NO: 1645561 - RNA, 22 nt, Human
ugaccauacuaauuauaccccc

SEQ ID NO: 1645562 - RNA, 20 nt, Human
ugaaaaucuuauaauuuaaa

SEQ ID NO: 1645563 - RNA, 16 nt, Human
ugugagaugcuagaac

SEQ ID NO: 1645564 - RNA, 14 nt, Human
cccacuugccauaa

SEQ ID NO: 1645565 - RNA, 21 nt, Human
guauacugugugcuaaaacaa

SEQ ID NO: 1645566 - RNA, 22 nt, Human
gaauuucuucaacucccugccc

SEQ ID NO: 1645567 - RNA, 19 nt, Human
acauuuauguuccuuuuaa

SEQ ID NO: 1645568 - RNA, 17 nt, Human
uugcaguuuuuuccuag

SEQ ID NO: 1645569 - RNA, 18 nt, Human
uuauuacuguaagaaaau

SEQ ID NO: 1645570 - RNA, 15 nt, Human
aaauaauuuuuauau

SEQ ID NO: 1645571 - RNA, 20 nt, Human
cccugcacuccagccugagc

SEQ ID NO: 1645572 - RNA, 13 nt, Human
ccccagcccuccu

SEQ ID NO: 1645573 - RNA, 19 nt, Human
ucucaaggagaggcaaaga

SEQ ID NO: 1645574 - RNA, 16 nt, Human
ccacuuggucugugag

SEQ ID NO: 1645575 - RNA, 17 nt, Human
uccacaacacacagauu

SEQ ID NO: 1645576 - RNA, 14 nt, Human
uuauuauauuuaca

SEQ ID NO: 1645577 - RNA, 22 nt, Human
gcuaaaacaagcacuaaacaaa

SEQ ID NO: 1645578 - RNA, 18 nt, Human
aacaaaguugauuaagaa

SEQ ID NO: 1645579 - RNA, 17 nt, Human
aaccuucugaggagcug

SEQ ID NO: 1645580 - RNA, 20 nt, Human
cucccugccccccagcccuc

SEQ ID NO: 1645581 - RNA, 17 nt, Human
cgauaaaagacagugaa

SEQ ID NO: 1645582 - RNA, 17 nt, Human
uauauuguagauaauac

SEQ ID NO: 1645583 - RNA, 13 nt, Human
aauuuuuauauuu

SEQ ID NO: 1645584 - RNA, 21 nt, Human
cuccagcuggccgggagccug

SEQ ID NO: 1645585 - RNA, 15 nt, Human
gcuguucuuuaaaug

SEQ ID NO: 1645586 - RNA, 15 nt, Human
agccugaaagaggaa

SEQ ID NO: 1645587 - RNA, 18 nt, Human
auucuugccaaauauaaa

SEQ ID NO: 1645588 - RNA, 23 nt, Human
ucucuaccaaaaaaaggaaggaa

SEQ ID NO: 1645589 - RNA, 17 nt, Human
guugcugggggggauug

SEQ ID NO: 1645590 - RNA, 14 nt, Human
auuugaaauuguau

SEQ ID NO: 1645591 - RNA, 17 nt, Human
uaugcuauugaaguuuu

SEQ ID NO: 1645592 - RNA, 18 nt, Human
cuuccucugagccuuggg

SEQ ID NO: 1645593 - RNA, 22 nt, Human
uaccucugcuauuugcuguuau

SEQ ID NO: 1645594 - RNA, 23 nt, Human
gagaaaugagcacgcauggaaaa

SEQ ID NO: 1645595 - RNA, 23 nt, Human
gaacagauuucaaaaaaaaaccc

SEQ ID NO: 1645596 - RNA, 22 nt, Human
caucucuucuggguuccuuccu

SEQ ID NO: 1645597 - RNA, 20 nt, Human
agcauuguuggcuguuccug

SEQ ID NO: 1645598 - RNA, 21 nt, Human
cucagcuucacccugagguga

SEQ ID NO: 1645599 - RNA, 19 nt, Human
acucugcaagaagaaauca

SEQ ID NO: 1645600 - RNA, 23 nt, Human
uguagguagaucuggucuuuaga

SEQ ID NO: 1645601 - RNA, 15 nt, Human
gaagauguagaggag

SEQ ID NO: 1645602 - RNA, 18 nt, Human
gagccucagucucccucc

SEQ ID NO: 1645603 - RNA, 15 nt, Human
uaaauaaauaaauaa

SEQ ID NO: 1645604 - RNA, 15 nt, Human
auaaauaaauaaaua

SEQ ID NO: 1645605 - RNA, 22 nt, Human
cuucagccugaaagaggaauga

SEQ ID NO: 1645606 - RNA, 14 nt, Human
ugagaugcuagaac

SEQ ID NO: 1645607 - RNA, 22 nt, Human
uauaagaaauaggaaauauuuu

SEQ ID NO: 1645608 - RNA, 18 nt, Human
cuuucacauuuaaauaaa

SEQ ID NO: 1645609 - RNA, 17 nt, Human
uacagaacuaaaaauua

SEQ ID NO: 1645610 - RNA, 15 nt, Human
cugcuacuaucuguu

SEQ ID NO: 1645611 - RNA, 15 nt, Human
uuaguuuuuaaagua

SEQ ID NO: 1645612 - RNA, 16 nt, Human
ugacuauuauauuucc

SEQ ID NO: 1645613 - RNA, 19 nt, Human
uggugagugccuguaauca

SEQ ID NO: 1645614 - RNA, 21 nt, Human
ccaaggaugccccgucccccu

SEQ ID NO: 1645615 - RNA, 19 nt, Human
augaguaacugauuuguaa

SEQ ID NO: 1645616 - RNA, 17 nt, Human
aaaaauccuacuuucau

SEQ ID NO: 1645617 - RNA, 14 nt, Human
agacaucaacagau

SEQ ID NO: 1645618 - RNA, 15 nt, Human
gacaguauggcagcu

SEQ ID NO: 1645619 - RNA, 23 nt, Human
aucaccaaggcugauuaaaccaa

SEQ ID NO: 1645620 - RNA, 20 nt, Human
aaucuuucacaggggacagg

SEQ ID NO: 1645621 - RNA, 19 nt, Human
ugaaauuguauuacaaauc

SEQ ID NO: 1645622 - RNA, 22 nt, Human
gucacaggaaguagaggaggcc

SEQ ID NO: 1645623 - RNA, 16 nt, Human
uuuucucuaggaaaua

SEQ ID NO: 1645624 - RNA, 22 nt, Human
agaaagugacaagcucacagac

SEQ ID NO: 1645625 - RNA, 19 nt, Human
gucaaauugugugaaaggu

SEQ ID NO: 1645626 - RNA, 22 nt, Human
ccauuucuugagguaaaagcau

SEQ ID NO: 1645627 - RNA, 15 nt, Human
agauuucaaaaaaaa

SEQ ID NO: 1645628 - RNA, 12 nt, Human
gacgagaaaaca

SEQ ID NO: 1645629 - RNA, 21 nt, Human
ucuggguugaagggcaguguu

SEQ ID NO: 1645630 - RNA, 12 nt, Human
cuuaucuuccua

SEQ ID NO: 1645631 - RNA, 20 nt, Human
caucccuagaaagccaugug

SEQ ID NO: 1645632 - RNA, 21 nt, Human
gaaaaaaagcuuuuuuugaau

SEQ ID NO: 1645633 - RNA, 15 nt, Human
ucacaggacagcccu

SEQ ID NO: 1645634 - RNA, 18 nt, Human
uguauucuuuuaguuuuu

SEQ ID NO: 1645635 - RNA, 16 nt, Human
ugagaugcuagaacuc

SEQ ID NO: 1645636 - RNA, 22 nt, Human
cgaggugggcagaucacuugag

SEQ ID NO: 1645637 - RNA, 21 nt, Human
uuccugacugcuaguuuauau

SEQ ID NO: 1645638 - RNA, 21 nt, Human
aacauagugagacacugucuc

SEQ ID NO: 1645639 - RNA, 22 nt, Human
ugucucuacuaaaaauacaaaa

SEQ ID NO: 1645640 - RNA, 18 nt, Human
aaggagaggcaaagaaag

SEQ ID NO: 1645641 - RNA, 20 nt, Human
ucucguugacccucacagga

SEQ ID NO: 1645642 - RNA, 16 nt, Human
ugcuguauuuuaaaag

SEQ ID NO: 1645643 - RNA, 19 nt, Human
uauauuuccaagaaauauu

SEQ ID NO: 1645644 - RNA, 16 nt, Human
auuuaguuauaaaaau

SEQ ID NO: 1645645 - RNA, 19 nt, Human
cucaagcuaugugagcuca

SEQ ID NO: 1645646 - RNA, 17 nt, Human
cucguggaacaguuacc

SEQ ID NO: 1645647 - RNA, 17 nt, Human
gccuaagugcagccccg

SEQ ID NO: 1645648 - RNA, 22 nt, Human
ccucccuuggggccuaugcaga

SEQ ID NO: 1645649 - RNA, 17 nt, Human
uuuccaugaguugcagu

SEQ ID NO: 1645650 - RNA, 18 nt, Human
aauuuuagacauucuuua

SEQ ID NO: 1645651 - RNA, 12 nt, Human
uugggcaggcag

SEQ ID NO: 1645652 - RNA, 19 nt, Human
acuggacucaccuccccca

SEQ ID NO: 1645653 - RNA, 16 nt, Human
ccccugcacuccagcc

SEQ ID NO: 1645654 - RNA, 20 nt, Human
ucagaauuucuaaaaguuua

SEQ ID NO: 1645655 - RNA, 20 nt, Human
acaucuggaaaguuuucucc

SEQ ID NO: 1645656 - RNA, 20 nt, Human
cucagcuucacccugaggug

SEQ ID NO: 1645657 - RNA, 18 nt, Human
cauuauggauaaagauga

SEQ ID NO: 1645658 - RNA, 22 nt, Human
uguugcccacagcuguaugauu

SEQ ID NO: 1645659 - RNA, 16 nt, Human
agaugagagaacaggg

SEQ ID NO: 1645660 - RNA, 16 nt, Human
ugagccccgaaucuga

SEQ ID NO: 1645661 - RNA, 12 nt, Human
uaagaaggcacc

SEQ ID NO: 1645662 - RNA, 21 nt, Human
gucucuaccaaaaaaaggaag

SEQ ID NO: 1645663 - RNA, 15 nt, Human
auaucaauuuaaaaa

SEQ ID NO: 1645664 - RNA, 19 nt, Human
guuguauuauuuuuuaaaa

SEQ ID NO: 1645665 - RNA, 21 nt, Human
uguccucaugagggcuggaug

SEQ ID NO: 1645666 - RNA, 20 nt, Human
caagcucuaucaccaaggag

SEQ ID NO: 1645667 - RNA, 19 nt, Human
ugaacaaauuuacagagac

SEQ ID NO: 1645668 - RNA, 19 nt, Human
gcuccagugauaagagaug

SEQ ID NO: 1645669 - RNA, 17 nt, Human
caagaaaugaaagcagg

SEQ ID NO: 1645670 - RNA, 18 nt, Human
cuucacuguaaaauaaua

SEQ ID NO: 1645671 - RNA, 18 nt, Human
ucuucuggguuccuuccu

SEQ ID NO: 1645672 - RNA, 17 nt, Human
uguuggcuguuccugca

SEQ ID NO: 1645673 - RNA, 13 nt, Human
acacuuaaaaaug

SEQ ID NO: 1645674 - RNA, 22 nt, Human
agggagucucagcuucacccug

SEQ ID NO: 1645675 - RNA, 14 nt, Human
ugagcuugcagaga

SEQ ID NO: 1645676 - RNA, 22 nt, Human
agacacugucucuaccaaaaaa

SEQ ID NO: 1645677 - RNA, 18 nt, Human
ugagccaccaagcuggug

SEQ ID NO: 1645678 - RNA, 13 nt, Human
ucuaagaagugaa

SEQ ID NO: 1645679 - RNA, 12 nt, Human
caacccaaaugu

SEQ ID NO: 1645680 - RNA, 19 nt, Human
ugagucccaggcugagccu

SEQ ID NO: 1645681 - RNA, 17 nt, Human
ucucuggccuucggccu

SEQ ID NO: 1645682 - RNA, 13 nt, Human
auaacuggaaacu

SEQ ID NO: 1645683 - RNA, 18 nt, Human
acugugugcuaaaacaag

SEQ ID NO: 1645684 - RNA, 22 nt, Human
uugaaaaucuuauaauuuaaaa

SEQ ID NO: 1645685 - RNA, 13 nt, Human
aucuggcucugga

SEQ ID NO: 1645686 - RNA, 15 nt, Human
augauaacuggaaac

SEQ ID NO: 1645687 - RNA, 20 nt, Human
cucuguucugcacacagcac

SEQ ID NO: 1645688 - RNA, 14 nt, Human
cacccugagguugu

SEQ ID NO: 1645689 - RNA, 23 nt, Human
ggccuccauccugaggcuccacu

SEQ ID NO: 1645690 - RNA, 14 nt, Human
cacaucaggaaaga

SEQ ID NO: 1645691 - RNA, 18 nt, Human
uaaauugacacuuaaaaa

SEQ ID NO: 1645692 - RNA, 20 nt, Human
agcuacuaauuuuaaaaugu

SEQ ID NO: 1645693 - RNA, 15 nt, Human
uggacgagaaaacaa

SEQ ID NO: 1645694 - RNA, 19 nt, Human
uuccucccuucucuucaca

SEQ ID NO: 1645695 - RNA, 13 nt, Human
cugagagugaaca

SEQ ID NO: 1645696 - RNA, 15 nt, Human
ugcuguauuuuaaaa

SEQ ID NO: 1645697 - RNA, 21 nt, Human
ugggaggcugagaugggagaa

SEQ ID NO: 1645698 - RNA, 20 nt, Human
acuauagugugagccaggaa

SEQ ID NO: 1645699 - RNA, 14 nt, Human
uggccaccugcuga

SEQ ID NO: 1645700 - RNA, 21 nt, Human
uuccuaauuccacagcugcuc

SEQ ID NO: 1645701 - RNA, 23 nt, Human
acguaaucguguccccuauccua

SEQ ID NO: 1645702 - RNA, 13 nt, Human
ggaaguagaggag

SEQ ID NO: 1645703 - RNA, 12 nt, Human
acucccugcccc

SEQ ID NO: 1645704 - RNA, 21 nt, Human
gagauuuugcuugagcaggau

SEQ ID NO: 1645705 - RNA, 15 nt, Human
uuaauuuguaguguu

SEQ ID NO: 1645706 - RNA, 13 nt, Human
cauuuguauaaaa

SEQ ID NO: 1645707 - RNA, 16 nt, Human
ggcuaauaucuuaucu

SEQ ID NO: 1645708 - RNA, 18 nt, Human
aucuacacuccagugaga

SEQ ID NO: 1645709 - RNA, 23 nt, Human
uuuaaugccgauaucuucagaaa

SEQ ID NO: 1645710 - RNA, 14 nt, Human
ccaugaccaacauc

SEQ ID NO: 1645711 - RNA, 18 nt, Human
uccaggcuggcgugcagc

SEQ ID NO: 1645712 - RNA, 16 nt, Human
gaaauguauucuuuua

SEQ ID NO: 1645713 - RNA, 14 nt, Human
aauaguuuaugauu

SEQ ID NO: 1645714 - RNA, 15 nt, Human
uaaaagacaaggaaa

SEQ ID NO: 1645715 - RNA, 18 nt, Human
cuaauuagcauggccaca

SEQ ID NO: 1645716 - RNA, 15 nt, Human
cacuuggucugugag

SEQ ID NO: 1645717 - RNA, 17 nt, Human
gucaaaguucauagagu

SEQ ID NO: 1645718 - RNA, 21 nt, Human
uucagcucagcuaaugaagug

SEQ ID NO: 1645719 - RNA, 11 nt, Human
ugcagugagcc

SEQ ID NO: 1645720 - RNA, 20 nt, Human
uggggcuuuaacuccugcua

SEQ ID NO: 1645721 - RNA, 14 nt, Human
cuguaaucacagcu

SEQ ID NO: 1645722 - RNA, 21 nt, Human
aacauggugaaaccuggucuc

SEQ ID NO: 1645723 - RNA, 14 nt, Human
uauuugaaauauug

SEQ ID NO: 1645724 - RNA, 22 nt, Human
accauuucuugagguaaaagca

SEQ ID NO: 1645725 - RNA, 14 nt, Human
agugucuugaauug

SEQ ID NO: 1645726 - RNA, 14 nt, Human
acagaauuuuaugc

SEQ ID NO: 1645727 - RNA, 22 nt, Human
gauaaaagacagugaaagaaaa

SEQ ID NO: 1645728 - RNA, 20 nt, Human
agccuuggggcugaugcagu

SEQ ID NO: 1645729 - RNA, 16 nt, Human
auaguaccucugcuau

SEQ ID NO: 1645730 - RNA, 13 nt, Human
aacaagccuccuu

SEQ ID NO: 1645731 - RNA, 18 nt, Human
aagaaauaggaaauauuu

SEQ ID NO: 1645732 - RNA, 12 nt, Human
caaguaaauguu

SEQ ID NO: 1645733 - RNA, 17 nt, Human
ucuaccaaaaaaaggaa

SEQ ID NO: 1645734 - RNA, 14 nt, Human
aggaaggaaagaug

SEQ ID NO: 1645735 - RNA, 24 nt, Human
uaauuuaaaauaugcucuaaacau

SEQ ID NO: 1645736 - RNA, 23 nt, Human
acuggcuaauuagcauggccaca

SEQ ID NO: 1645737 - RNA, 23 nt, Human
cucuacuaaaaauacaaaaaaaa

SEQ ID NO: 1645738 - RNA, 22 nt, Human
aauuacauuuguauaaaauaau

SEQ ID NO: 1645739 - RNA, 22 nt, Human
aacaaggaaggaaagaugugaa

SEQ ID NO: 1645740 - RNA, 16 nt, Human
caaaguugauuaagaa

SEQ ID NO: 1645741 - RNA, 13 nt, Human
aaaaaugguuuaa

SEQ ID NO: 1645742 - RNA, 14 nt, Human
ugcuguauuuuaaa

SEQ ID NO: 1645743 - RNA, 17 nt, Human
gcaagcucuaucaccaa

SEQ ID NO: 1645744 - RNA, 18 nt, Human
ccaagccuggcaagggaa

SEQ ID NO: 1645745 - RNA, 14 nt, Human
uauuugcuguuauu

SEQ ID NO: 1645746 - RNA, 16 nt, Human
agggaggacgcucucu

SEQ ID NO: 1645747 - RNA, 18 nt, Human
aggcauagcccugccuca

SEQ ID NO: 1645748 - RNA, 18 nt, Human
auguuaaaacugggacag

SEQ ID NO: 1645749 - RNA, 22 nt, Human
ucuuccuggauuccucacuuug

SEQ ID NO: 1645750 - RNA, 23 nt, Human
uacaaaugggaaacaaaaggaua

SEQ ID NO: 1645751 - RNA, 16 nt, Human
guccauugggcaggca

SEQ ID NO: 1645752 - RNA, 18 nt, Human
ugaggcaggcacugccaa

SEQ ID NO: 1645753 - RNA, 13 nt, Human
uaagaaaggaagu

SEQ ID NO: 1645754 - RNA, 14 nt, Human
cuacagaacuaaaa

SEQ ID NO: 1645755 - RNA, 19 nt, Human
augaaguacucauacaugu

SEQ ID NO: 1645756 - RNA, 16 nt, Human
ucuuggucucaguguc

SEQ ID NO: 1645757 - RNA, 18 nt, Human
cuggguuaggccuugccu

SEQ ID NO: 1645758 - RNA, 13 nt, Human
uaaauauauauuu

SEQ ID NO: 1645759 - RNA, 19 nt, Human
auuagaaauguaauuaugu

SEQ ID NO: 1645760 - RNA, 21 nt, Human
acacugucucuaccaaaaaaa

SEQ ID NO: 1645761 - RNA, 14 nt, Human
ggccgggagccuga

SEQ ID NO: 1645762 - RNA, 17 nt, Human
guccgaggugggcagau

SEQ ID NO: 1645763 - RNA, 21 nt, Human
aagaaauaggaaauauuuuaa

SEQ ID NO: 1645764 - RNA, 14 nt, Human
uaaauuuaucauuu

SEQ ID NO: 1645765 - RNA, 21 nt, Human
acuauuauauuuccaagaaau

SEQ ID NO: 1645766 - RNA, 14 nt, Human
cucccuuggggccu

SEQ ID NO: 1645767 - RNA, 16 nt, Human
ccaggcugagccucag

SEQ ID NO: 1645768 - RNA, 15 nt, Human
aguuuauauagaaau

SEQ ID NO: 1645769 - RNA, 20 nt, Human
caaacauccuacaagacaca

SEQ ID NO: 1645770 - RNA, 19 nt, Human
caaggaugccccguccccc

SEQ ID NO: 1645771 - RNA, 13 nt, Human
gaugggcaaaaaa

SEQ ID NO: 1645772 - RNA, 17 nt, Human
agauacaguggagacau

SEQ ID NO: 1645773 - RNA, 22 nt, Human
uuuauggcacuaguauuucuau

SEQ ID NO: 1645774 - RNA, 17 nt, Human
agaacucccuuucaaca

SEQ ID NO: 1645775 - RNA, 21 nt, Human
auuuuccugaaaacccuugcc

SEQ ID NO: 1645776 - RNA, 14 nt, Human
cucaacucugagug

SEQ ID NO: 1645777 - RNA, 16 nt, Human
cuuauaauuuaaaaua

SEQ ID NO: 1645778 - RNA, 17 nt, Human
ucuauaauguguucauu

SEQ ID NO: 1645779 - RNA, 21 nt, Human
aauucauucacucaacaaaca

SEQ ID NO: 1645780 - RNA, 16 nt, Human
cccacuggacucaccu

SEQ ID NO: 1645781 - RNA, 19 nt, Human
gauggaguuucucuagaag

SEQ ID NO: 1645782 - RNA, 13 nt, Human
gccacaagaaccc

SEQ ID NO: 1645783 - RNA, 12 nt, Human
auucugaaagca

SEQ ID NO: 1645784 - RNA, 20 nt, Human
agaagaacugaaaucauacu

SEQ ID NO: 1645785 - RNA, 12 nt, Human
ucugcacacagc

SEQ ID NO: 1645786 - RNA, 18 nt, Human
gcagcccuuagcccuucc

SEQ ID NO: 1645787 - RNA, 12 nt, Human
acugaaaucaua

SEQ ID NO: 1645788 - RNA, 18 nt, Human
cuuugagcgcccacuaga

SEQ ID NO: 1645789 - RNA, 14 nt, Human
uaauuauuucacuu

SEQ ID NO: 1645790 - RNA, 22 nt, Human
cuucagaaaaccuaagcaaacu

SEQ ID NO: 1645791 - RNA, 21 nt, Human
uuguuuuucagcguuaaugua

SEQ ID NO: 1645792 - RNA, 16 nt, Human
uuuaaggauucugaga

SEQ ID NO: 1645793 - RNA, 15 nt, Human
cugaaagaggaauga

SEQ ID NO: 1645794 - RNA, 13 nt, Human
acaucaggaaaga

SEQ ID NO: 1645795 - RNA, 13 nt, Human
uauuuauuuuaau

SEQ ID NO: 1645796 - RNA, 16 nt, Human
aaagacaaggaaaaaa

SEQ ID NO: 1645797 - RNA, 21 nt, Human
gcuggccaccugcugagcccc

SEQ ID NO: 1645798 - RNA, 15 nt, Human
uacuaauuuuaaaau

SEQ ID NO: 1645799 - RNA, 20 nt, Human
cagcuuccaggcuggcgugc

SEQ ID NO: 1645800 - RNA, 14 nt, Human
caccaaccuucuga

SEQ ID NO: 1645801 - RNA, 18 nt, Human
uaauuuuaacucuauaau

SEQ ID NO: 1645802 - RNA, 16 nt, Human
cuuagcccuuccccuc

SEQ ID NO: 1645803 - RNA, 14 nt, Human
gugagcuacaaaug

SEQ ID NO: 1645804 - RNA, 20 nt, Human
cuugccauaauuacuauguc

SEQ ID NO: 1645805 - RNA, 15 nt, Human
ccucauguccacugg

SEQ ID NO: 1645806 - RNA, 21 nt, Human
gcacuguggguagacacacau

SEQ ID NO: 1645807 - RNA, 20 nt, Human
aagggcuguuauaaucuuuc

SEQ ID NO: 1645808 - RNA, 13 nt, Human
agaaguaaaaaca

SEQ ID NO: 1645809 - RNA, 18 nt, Human
cuuuccaugaguugcagu

SEQ ID NO: 1645810 - RNA, 20 nt, Human
uuuuaaagaaacaaaaauca

SEQ ID NO: 1645811 - RNA, 23 nt, Human
ucuccauguacuggcaagaccug

SEQ ID NO: 1645812 - RNA, 20 nt, Human
cacagcacgggggccaagga

SEQ ID NO: 1645813 - RNA, 18 nt, Human
agcugcucaauaaaguac

SEQ ID NO: 1645814 - RNA, 13 nt, Human
ugaauauaaauuu

SEQ ID NO: 1645815 - RNA, 20 nt, Human
auuuucaguuauuauauuua

SEQ ID NO: 1645816 - RNA, 21 nt, Human
aauuaaguuuuuuuuuaaaaa

SEQ ID NO: 1645817 - RNA, 12 nt, Human
aaugcagccccc

SEQ ID NO: 1645818 - RNA, 15 nt, Human
ugcuucuguuuuaua

SEQ ID NO: 1645819 - RNA, 19 nt, Human
uccuauaauuuuagacauu

SEQ ID NO: 1645820 - RNA, 16 nt, Human
uuguaaaggaauuuaa

SEQ ID NO: 1645821 - RNA, 20 nt, Human
ggcuaauaucuuaucuuccu

SEQ ID NO: 1645822 - RNA, 19 nt, Human
cccugccccccagcccucc

SEQ ID NO: 1645823 - RNA, 22 nt, Human
agacccugucucaauaaauaaa

SEQ ID NO: 1645824 - RNA, 15 nt, Human
acugaagaagcacca

SEQ ID NO: 1645825 - RNA, 15 nt, Human
gacucaccuccccca

SEQ ID NO: 1645826 - RNA, 20 nt, Human
uaauaaguugcauagguuua

SEQ ID NO: 1645827 - RNA, 18 nt, Human
aaagagugaaggauuuau

SEQ ID NO: 1645828 - RNA, 16 nt, Human
uauccuacuuccccuu

SEQ ID NO: 1645829 - RNA, 16 nt, Human
acaugugcuggccacc

SEQ ID NO: 1645830 - RNA, 16 nt, Human
cuaggcauagcccugc

SEQ ID NO: 1645831 - RNA, 16 nt, Human
cccuauccuacuuccc

SEQ ID NO: 1645832 - RNA, 15 nt, Human
agagacagaaagcag

SEQ ID NO: 1645833 - RNA, 20 nt, Human
caaacugccaucauuuacuu

SEQ ID NO: 1645834 - RNA, 13 nt, Human
aucaaugaaugaa

SEQ ID NO: 1645835 - RNA, 13 nt, Human
ucccaaguaaaug

SEQ ID NO: 1645836 - RNA, 21 nt, Human
uuuucaggcuagauguaugua

SEQ ID NO: 1645837 - RNA, 17 nt, Human
gucucagcuucacccug

SEQ ID NO: 1645838 - RNA, 22 nt, Human
uuuccaagcaaguauuagaaua

SEQ ID NO: 1645839 - RNA, 23 nt, Human
cuagacccacuggacucaccucc

SEQ ID NO: 1645840 - RNA, 17 nt, Human
agaaucacuugaacccg

SEQ ID NO: 1645841 - RNA, 16 nt, Human
uaaaagacaaggaaaa

SEQ ID NO: 1645842 - RNA, 13 nt, Human
auugauuauaugu

SEQ ID NO: 1645843 - RNA, 21 nt, Human
gucucagugucaaugcagccc

SEQ ID NO: 1645844 - RNA, 16 nt, Human
uaaaggaauuuaaaaa

SEQ ID NO: 1645845 - RNA, 22 nt, Human
auguuccuuuuaaagaaacaaa

SEQ ID NO: 1645846 - RNA, 18 nt, Human
uuuugugaagcaaaauuu

SEQ ID NO: 1645847 - RNA, 17 nt, Human
cuacagaacuaaaaauu

SEQ ID NO: 1645848 - RNA, 16 nt, Human
gauuuaaggccaggca

SEQ ID NO: 1645849 - RNA, 18 nt, Human
caugaagauguagaggag

SEQ ID NO: 1645850 - RNA, 12 nt, Human
acaagacacagu

SEQ ID NO: 1645851 - RNA, 22 nt, Human
uguaacugucuucuagcaguga

SEQ ID NO: 1645852 - RNA, 15 nt, Human
guucugcagauaaac

SEQ ID NO: 1645853 - RNA, 15 nt, Human
cuccacuggaaaacu

SEQ ID NO: 1645854 - RNA, 16 nt, Human
ggaacaaggaaggaaa

SEQ ID NO: 1645855 - RNA, 21 nt, Human
caaagcccagcuugaaaccuu

SEQ ID NO: 1645856 - RNA, 23 nt, Human
uaucuauguagaauauauuuccu

SEQ ID NO: 1645857 - RNA, 17 nt, Human
ccagggaagacaagaag

SEQ ID NO: 1645858 - RNA, 15 nt, Human
auaaaguguuugaaa

SEQ ID NO: 1645859 - RNA, 22 nt, Human
uguauacugugugcuaaaacaa

SEQ ID NO: 1645860 - RNA, 20 nt, Human
uaucuucacuuuuauaagaa

SEQ ID NO: 1645861 - RNA, 19 nt, Human
auaaaagacaaggaaaaaa

SEQ ID NO: 1645862 - RNA, 22 nt, Human
gucaagaucagccugggcaaca

SEQ ID NO: 1645863 - RNA, 19 nt, Human
acauuuguauaaaauaauu

SEQ ID NO: 1645864 - RNA, 14 nt, Human
gcuuuaacuccugc

SEQ ID NO: 1645865 - RNA, 14 nt, Human
uauuuauuuuaaua

SEQ ID NO: 1645866 - RNA, 21 nt, Human
aauuccugacugcuaguuuau

SEQ ID NO: 1645867 - RNA, 15 nt, Human
gcaacccaaauguuc

SEQ ID NO: 1645868 - RNA, 14 nt, Human
auuuguauaaaaua

SEQ ID NO: 1645869 - RNA, 17 nt, Human
aagcuuuuuuugaauca

SEQ ID NO: 1645870 - RNA, 19 nt, Human
agccugaucaccugcccug

SEQ ID NO: 1645871 - RNA, 22 nt, Human
cugaggcuccacuuggucugug

SEQ ID NO: 1645872 - RNA, 11 nt, Human
uucacagggga

SEQ ID NO: 1645873 - RNA, 13 nt, Human
uaaaaguuuaagu

SEQ ID NO: 1645874 - RNA, 20 nt, Human
gggcaagagagcgagacccu

SEQ ID NO: 1645875 - RNA, 22 nt, Human
uaaaauaauuuuuauauuugaa

SEQ ID NO: 1645876 - RNA, 20 nt, Human
uaugaaaaggcuaagcuuca

SEQ ID NO: 1645877 - RNA, 19 nt, Human
ccaccugccuauauuuuuu

SEQ ID NO: 1645878 - RNA, 19 nt, Human
cucugccucagaaaacaag

SEQ ID NO: 1645879 - RNA, 15 nt, Human
aaaaaauaacaauga

SEQ ID NO: 1645880 - RNA, 14 nt, Human
guccauugggcagg

SEQ ID NO: 1645881 - RNA, 19 nt, Human
auugaggacacugauaugg

SEQ ID NO: 1645882 - RNA, 15 nt, Human
cuacaagacacagug

SEQ ID NO: 1645883 - RNA, 13 nt, Human
uuauucacaagac

SEQ ID NO: 1645884 - RNA, 19 nt, Human
auaaaagacagugaaagaa

SEQ ID NO: 1645885 - RNA, 21 nt, Human
cccccauuguggucacaggaa

SEQ ID NO: 1645886 - RNA, 22 nt, Human
gccugguguguucaagaccagc

SEQ ID NO: 1645887 - RNA, 12 nt, Human
acaugagguacu

SEQ ID NO: 1645888 - RNA, 20 nt, Human
aaaaaccugagccccaaaag

SEQ ID NO: 1645889 - RNA, 15 nt, Human
aagccaugugcagcc

SEQ ID NO: 1645890 - RNA, 16 nt, Human
ccaccugcugagcccc

SEQ ID NO: 1645891 - RNA, 22 nt, Human
aaauguugacaugggacauuug

SEQ ID NO: 1645892 - RNA, 15 nt, Human
aaggaauuuaaaaau

SEQ ID NO: 1645893 - RNA, 15 nt, Human
ugcaauuccacuuau

SEQ ID NO: 1645894 - RNA, 22 nt, Human
aggcugaugggcaaaaaaccaa

SEQ ID NO: 1645895 - RNA, 23 nt, Human
gucucccucccuuggggccuaug

SEQ ID NO: 1645896 - RNA, 17 nt, Human
gucaaagcugaaaugga

SEQ ID NO: 1645897 - RNA, 21 nt, Human
agucuguuuucccuccuugga

SEQ ID NO: 1645898 - RNA, 19 nt, Human
uugugccccugcacuccag

SEQ ID NO: 1645899 - RNA, 19 nt, Human
cucuugaggcacagaaacu

SEQ ID NO: 1645900 - RNA, 14 nt, Human
agaaaauaacaaua

SEQ ID NO: 1645901 - RNA, 21 nt, Human
ccuuccccucugcagcuucca

SEQ ID NO: 1645902 - RNA, 23 nt, Human
cagagucaagggugugugcagca

SEQ ID NO: 1645903 - RNA, 22 nt, Human
cuuuaaugccgauaucuucaga

SEQ ID NO: 1645904 - RNA, 15 nt, Human
gaacuaaaaauuaaa

SEQ ID NO: 1645905 - RNA, 16 nt, Human
aaggagauacagugga

SEQ ID NO: 1645906 - RNA, 12 nt, Human
cugaggagcugu

SEQ ID NO: 1645907 - RNA, 13 nt, Human
cuaggcauagccc

SEQ ID NO: 1645908 - RNA, 14 nt, Human
aacuuugauuuuau

SEQ ID NO: 1645909 - RNA, 23 nt, Human
gcauuguuggcuguuccugcagu

SEQ ID NO: 1645910 - RNA, 15 nt, Human
augaauuaaguuuuu

SEQ ID NO: 1645911 - RNA, 13 nt, Human
uaaaauacaaaaa

SEQ ID NO: 1645912 - RNA, 18 nt, Human
gaaggugaucuggcucug

SEQ ID NO: 1645913 - RNA, 14 nt, Human
cuuuuaguuuuuaa

SEQ ID NO: 1645914 - RNA, 19 nt, Human
ccgggcgugguggugagug

SEQ ID NO: 1645915 - RNA, 13 nt, Human
aaaugggaaacaa

SEQ ID NO: 1645916 - RNA, 17 nt, Human
gcaucuccucaacucug

SEQ ID NO: 1645917 - RNA, 23 nt, Human
agccuugggaccccugagcuugc

SEQ ID NO: 1645918 - RNA, 11 nt, Human
ccacaucugag

SEQ ID NO: 1645919 - RNA, 10 nt, Human
accugagccc

SEQ ID NO: 1645920 - RNA, 22 nt, Human
caacacaucaggaaagagagca

SEQ ID NO: 1645921 - RNA, 17 nt, Human
cuucuagcagugagcca

SEQ ID NO: 1645922 - RNA, 18 nt, Human
agugucaaugcagccccc

SEQ ID NO: 1645923 - RNA, 15 nt, Human
agcucuaucaccaag

SEQ ID NO: 1645924 - RNA, 15 nt, Human
cuggacucaccuccc

SEQ ID NO: 1645925 - RNA, 11 nt, Human
aaccugagccc

SEQ ID NO: 1645926 - RNA, 16 nt, Human
auccuacaagacacag

SEQ ID NO: 1645927 - RNA, 21 nt, Human
aaaauaugccccauucaacau

SEQ ID NO: 1645928 - RNA, 17 nt, Human
ucagacauagaauuaac

SEQ ID NO: 1645929 - RNA, 20 nt, Human
gcccauccugccccugagcc

SEQ ID NO: 1645930 - RNA, 14 nt, Human
aagcaacccaaaug

SEQ ID NO: 1645931 - RNA, 19 nt, Human
cuuacucuugauuguggga

SEQ ID NO: 1645932 - RNA, 15 nt, Human
auaggaaauauuuua

SEQ ID NO: 1645933 - RNA, 14 nt, Human
gucccaggcugagc

SEQ ID NO: 1645934 - RNA, 23 nt, Human
ugcagagguccacaacacacaga

SEQ ID NO: 1645935 - RNA, 21 nt, Human
aaugugacuuaaugccacuaa

SEQ ID NO: 1645936 - RNA, 20 nt, Human
gcauuguuggcuguuccugc

SEQ ID NO: 1645937 - RNA, 23 nt, Human
acugcuaguuuauauagaaaugu

SEQ ID NO: 1645938 - RNA, 23 nt, Human
gggagccugaucaccugcccugc

SEQ ID NO: 1645939 - RNA, 17 nt, Human
ucuauguagaauauauu

SEQ ID NO: 1645940 - RNA, 20 nt, Human
aaaacaagcacuaaacaaag

SEQ ID NO: 1645941 - RNA, 20 nt, Human
uuucuucaacucccugcccc

SEQ ID NO: 1645942 - RNA, 14 nt, Human
gggaagacaagaag

SEQ ID NO: 1645943 - RNA, 13 nt, Human
aacaauaaaagac

SEQ ID NO: 1645944 - RNA, 18 nt, Human
ugugaccacugcagaaga

SEQ ID NO: 1645945 - RNA, 23 nt, Human
agaguuuagcuggaaaaguaugu

SEQ ID NO: 1645946 - RNA, 11 nt, Human
caacucccugc

SEQ ID NO: 1645947 - RNA, 14 nt, Human
accacaagacugca

SEQ ID NO: 1645948 - RNA, 14 nt, Human
gggcuggaugcucu

SEQ ID NO: 1645949 - RNA, 22 nt, Human
caagcacuaaacaaagagugaa

SEQ ID NO: 1645950 - RNA, 17 nt, Human
ucuuuaucuuuuuagua

SEQ ID NO: 1645951 - RNA, 22 nt, Human
cauuuaguuauaaaaauauaua

SEQ ID NO: 1645952 - RNA, 22 nt, Human
gacacaugugcuggccaccugc

SEQ ID NO: 1645953 - RNA, 16 nt, Human
cucagcccuggugggc

SEQ ID NO: 1645954 - RNA, 17 nt, Human
aaauccuacuuucauaa

SEQ ID NO: 1645955 - RNA, 15 nt, Human
ccagauccuggaaau

SEQ ID NO: 1645956 - RNA, 19 nt, Human
agagccuuuuuuugaaaaa

SEQ ID NO: 1645957 - RNA, 14 nt, Human
cccugccccccagc

SEQ ID NO: 1645958 - RNA, 12 nt, Human
ugagagacacac

SEQ ID NO: 1645959 - RNA, 15 nt, Human
cagugucugcuggag

SEQ ID NO: 1645960 - RNA, 17 nt, Human
ugaaggauuuauguuua

SEQ ID NO: 1645961 - RNA, 14 nt, Human
gucucaauaaauaa

SEQ ID NO: 1645962 - RNA, 12 nt, Human
uguuugaaagcu

SEQ ID NO: 1645963 - RNA, 14 nt, Human
gaaaguuuucucca

SEQ ID NO: 1645964 - RNA, 13 nt, Human
ugaaagaaaauaa

SEQ ID NO: 1645965 - RNA, 20 nt, Human
auguuucuuggggaauaugu

SEQ ID NO: 1645966 - RNA, 17 nt, Human
guguccccuauccuacu

SEQ ID NO: 1645967 - RNA, 17 nt, Human
ugcauuuuggaaggcug

SEQ ID NO: 1645968 - RNA, 18 nt, Human
gccuuggggcugaugcag

SEQ ID NO: 1645969 - RNA, 15 nt, Human
aaaaauaacaaugaa

SEQ ID NO: 1645970 - RNA, 13 nt, Human
ugagcgacaguga

SEQ ID NO: 1645971 - RNA, 22 nt, Human
accccugagcuugcagagauga

SEQ ID NO: 1645972 - RNA, 14 nt, Human
ucuccucaacucug

SEQ ID NO: 1645973 - RNA, 15 nt, Human
uggagacaucuggaa

SEQ ID NO: 1645974 - RNA, 23 nt, Human
guaauuccguagguuauuuucag

SEQ ID NO: 1645975 - RNA, 19 nt, Human
ugagcgcccacuagaccca

SEQ ID NO: 1645976 - RNA, 13 nt, Human
aguuaccucugcc

SEQ ID NO: 1645977 - RNA, 17 nt, Human
cacauguuccccuuggg

SEQ ID NO: 1645978 - RNA, 14 nt, Human
agauuucaaaaaaa

SEQ ID NO: 1645979 - RNA, 17 nt, Human
agaaaugaaagcaggga

SEQ ID NO: 1645980 - RNA, 18 nt, Human
cagggaggacgcucucug

SEQ ID NO: 1645981 - RNA, 20 nt, Human
auuacuguaagaaaauauca

SEQ ID NO: 1645982 - RNA, 16 nt, Human
agaauauauuuccuua

SEQ ID NO: 1645983 - RNA, 23 nt, Human
uuuauaugcuucuguuuuauaau

SEQ ID NO: 1645984 - RNA, 14 nt, Human
acguuaggaggaca

SEQ ID NO: 1645985 - RNA, 14 nt, Human
uaguuucccuugca

SEQ ID NO: 1645986 - RNA, 22 nt, Human
cccagcccuccuuaucaaagga

SEQ ID NO: 1645987 - RNA, 17 nt, Human
auucagaauuucuaaaa

SEQ ID NO: 1645988 - RNA, 15 nt, Human
agaugggcauggugg

SEQ ID NO: 1645989 - RNA, 18 nt, Human
gaugccccgucccccucu

SEQ ID NO: 1645990 - RNA, 12 nt, Human
cucauggaauug

SEQ ID NO: 1645991 - RNA, 17 nt, Human
cuaauaucuuaucuucc

SEQ ID NO: 1645992 - RNA, 11 nt, Human
gaguuucucua

SEQ ID NO: 1645993 - RNA, 14 nt, Human
ugagacucugucuc

SEQ ID NO: 1645994 - RNA, 15 nt, Human
aauauauuuccuuau

SEQ ID NO: 1645995 - RNA, 23 nt, Human
agcagcccuuagcccuuccccuc

SEQ ID NO: 1645996 - RNA, 21 nt, Human
aauaauccucaguuuuuguga

SEQ ID NO: 1645997 - RNA, 18 nt, Human
cccucuggcuccagcugg

SEQ ID NO: 1645998 - RNA, 12 nt, Human
uacuaaaugcuc

SEQ ID NO: 1645999 - RNA, 15 nt, Human
uaacaauaaaagaca

SEQ ID NO: 1646000 - RNA, 13 nt, Human
uuuaacuccugcu

SEQ ID NO: 1646001 - RNA, 16 nt, Human
uaggaaauauuuuaau

SEQ ID NO: 1646002 - RNA, 17 nt, Human
acccacuggacucaccu

SEQ ID NO: 1646003 - RNA, 17 nt, Human
agcuucacuguaaaaua

SEQ ID NO: 1646004 - RNA, 15 nt, Human
aaauauaaucagaga

SEQ ID NO: 1646005 - RNA, 18 nt, Human
cuuuucccaacuccagaa

SEQ ID NO: 1646006 - RNA, 13 nt, Human
aacaaaauuagaa

SEQ ID NO: 1646007 - RNA, 13 nt, Human
ucuacuaaaaaua

SEQ ID NO: 1646008 - RNA, 16 nt, Human
cugagcauuuaauaug

SEQ ID NO: 1646009 - RNA, 20 nt, Human
guguggaaggugaucuggcu

SEQ ID NO: 1646010 - RNA, 18 nt, Human
uuuaguuauaaaaauaua

SEQ ID NO: 1646011 - RNA, 22 nt, Human
gugugaccacugcagaagacag

SEQ ID NO: 1646012 - RNA, 20 nt, Human
ucuucagcagagaaguuuuc

SEQ ID NO: 1646013 - RNA, 22 nt, Human
uguucugauauuggacaguaaa

SEQ ID NO: 1646014 - RNA, 16 nt, Human
agggcaguguucccug

SEQ ID NO: 1646015 - RNA, 18 nt, Human
auuugcuggagcucugcc

SEQ ID NO: 1646016 - RNA, 15 nt, Human
ucagucucccucccu

SEQ ID NO: 1646017 - RNA, 16 nt, Human
guuggcuguuccugca

SEQ ID NO: 1646018 - RNA, 13 nt, Human
caagaaggaaaga

SEQ ID NO: 1646019 - RNA, 23 nt, Human
auaauguguucauucuggaauaa

SEQ ID NO: 1646020 - RNA, 15 nt, Human
uaugcuuguaacugu

SEQ ID NO: 1646021 - RNA, 19 nt, Human
aaacaauaacgauaaaaga

SEQ ID NO: 1646022 - RNA, 16 nt, Human
ugaugggcaaaaaacc

SEQ ID NO: 1646023 - RNA, 22 nt, Human
gcacagccucuuagaugcaguu

SEQ ID NO: 1646024 - RNA, 21 nt, Human
gaaggaaagaauaaccaacac

SEQ ID NO: 1646025 - RNA, 19 nt, Human
cuagucuguuuucccuccu

SEQ ID NO: 1646026 - RNA, 17 nt, Human
uccugccccugagccca

SEQ ID NO: 1646027 - RNA, 16 nt, Human
ugcuauugaaguuuug

SEQ ID NO: 1646028 - RNA, 16 nt, Human
acugcuaguuuauaua

SEQ ID NO: 1646029 - RNA, 21 nt, Human
aguuguugcccacagcuguau

SEQ ID NO: 1646030 - RNA, 18 nt, Human
aaacaaaauuagaaaugu

SEQ ID NO: 1646031 - RNA, 22 nt, Human
cgugcuugucccuguggaagua

SEQ ID NO: 1646032 - RNA, 17 nt, Human
cuccaaguucaaaacuu

SEQ ID NO: 1646033 - RNA, 16 nt, Human
acaugaaguccaagca

SEQ ID NO: 1646034 - RNA, 18 nt, Human
cuggaaacuucagcgguu

SEQ ID NO: 1646035 - RNA, 12 nt, Human
cccccagcccuc

SEQ ID NO: 1646036 - RNA, 19 nt, Human
cugacugcuaguuuauaua

SEQ ID NO: 1646037 - RNA, 19 nt, Human
uagugagcagucaggaaag

SEQ ID NO: 1646038 - RNA, 23 nt, Human
agcuggaaacacauguuccccuu

SEQ ID NO: 1646039 - RNA, 22 nt, Human
gucucagcuucacccugaggug

SEQ ID NO: 1646040 - RNA, 16 nt, Human
caugucuagagaacac

SEQ ID NO: 1646041 - RNA, 22 nt, Human
aaaucaggguuaguauugucca

SEQ ID NO: 1646042 - RNA, 14 nt, Human
guauuuuaaaagaa

SEQ ID NO: 1646043 - RNA, 23 nt, Human
uaagaaauaggaaauauuuuaau

SEQ ID NO: 1646044 - RNA, 12 nt, Human
cuacagugagcc

SEQ ID NO: 1646045 - RNA, 21 nt, Human
uggggcuuuaacuccugcuag

SEQ ID NO: 1646046 - RNA, 23 nt, Human
uauuuuauuaggaguaccauaau

SEQ ID NO: 1646047 - RNA, 21 nt, Human
auguuuacagauccccaagcc

SEQ ID NO: 1646048 - RNA, 18 nt, Human
gagcgacagugagacucu

SEQ ID NO: 1646049 - RNA, 15 nt, Human
aaucucaauauuuca

SEQ ID NO: 1646050 - RNA, 13 nt, Human
uacagagacagaa

SEQ ID NO: 1646051 - RNA, 20 nt, Human
accucauggaauuggagcuc

SEQ ID NO: 1646052 - RNA, 16 nt, Human
ugacaagcucacagac

SEQ ID NO: 1646053 - RNA, 20 nt, Human
ccauuguggucacaggaagu

SEQ ID NO: 1646054 - RNA, 12 nt, Human
ucaccccuugcc

SEQ ID NO: 1646055 - RNA, 16 nt, Human
accuccuaagaaggca

SEQ ID NO: 1646056 - RNA, 19 nt, Human
ccuccauccugaggcucca

SEQ ID NO: 1646057 - RNA, 19 nt, Human
ccugccuaagugcagcccc

SEQ ID NO: 1646058 - RNA, 22 nt, Human
accuaacgaaguauccuucagc

SEQ ID NO: 1646059 - RNA, 22 nt, Human
cagcacgggggccaaggaugcc

SEQ ID NO: 1646060 - RNA, 20 nt, Human
auaacaaugcuguauuuuaa

SEQ ID NO: 1646061 - RNA, 18 nt, Human
aagaccucauuuugaagg

SEQ ID NO: 1646062 - RNA, 16 nt, Human
auuuaaggauucugag

SEQ ID NO: 1646063 - RNA, 19 nt, Human
auuuccuuauucagaauuu

SEQ ID NO: 1646064 - RNA, 21 nt, Human
gauguggggaaguuaggaacu

SEQ ID NO: 1646065 - RNA, 20 nt, Human
augcuucuguuuuauaauuu

SEQ ID NO: 1646066 - RNA, 14 nt, Human
uuuuauaugcuauu

SEQ ID NO: 1646067 - RNA, 13 nt, Human
aaauccuugaaga

SEQ ID NO: 1646068 - RNA, 22 nt, Human
guguccccuauccuacuucccc

SEQ ID NO: 1646069 - RNA, 19 nt, Human
caguccauugggcaggcag

SEQ ID NO: 1646070 - RNA, 21 nt, Human
cucuacauaaaauacaaaaac

SEQ ID NO: 1646071 - RNA, 22 nt, Human
aaguggaacgagacaagcagcc

SEQ ID NO: 1646072 - RNA, 16 nt, Human
aauuccacagcugcuc

SEQ ID NO: 1646073 - RNA, 21 nt, Human
acagugauuaccagggacuga

SEQ ID NO: 1646074 - RNA, 20 nt, Human
cagugaaagaaaauaacgau

SEQ ID NO: 1646075 - RNA, 18 nt, Human
gaaaauaacgauaaaaga

SEQ ID NO: 1646076 - RNA, 16 nt, Human
cauuuaguuauaaaaa

SEQ ID NO: 1646077 - RNA, 11 nt, Human
auuuaaaaauc

SEQ ID NO: 1646078 - RNA, 15 nt, Human
cgagacccugucuca

SEQ ID NO: 1646079 - RNA, 18 nt, Human
cuaccaaaaaaaggaagg

SEQ ID NO: 1646080 - RNA, 17 nt, Human
guggggcuaaggcagga

SEQ ID NO: 1646081 - RNA, 14 nt, Human
ugaggcaggaggau

SEQ ID NO: 1646082 - RNA, 15 nt, Human
acaaaugggaaacaa

SEQ ID NO: 1646083 - RNA, 14 nt, Human
cgugcuugucccug

SEQ ID NO: 1646084 - RNA, 15 nt, Human
uaaaguaaaggcaaa

SEQ ID NO: 1646085 - RNA, 18 nt, Human
agucuguuuucccuccuu

SEQ ID NO: 1646086 - RNA, 16 nt, Human
auaucaauuuaaaaaa

SEQ ID NO: 1646087 - RNA, 18 nt, Human
ccacaucugagccccgaa

SEQ ID NO: 1646088 - RNA, 15 nt, Human
auguuagagaauuuc

SEQ ID NO: 1646089 - RNA, 22 nt, Human
uauuccuuuuucucuccucucc

SEQ ID NO: 1646090 - RNA, 21 nt, Human
uccauccugaggcuccacuug

SEQ ID NO: 1646091 - RNA, 18 nt, Human
cuguuuucccuccuugga

SEQ ID NO: 1646092 - RNA, 14 nt, Human
uaacuaauuuuaac

SEQ ID NO: 1646093 - RNA, 18 nt, Human
cuccauccugaggcucca

SEQ ID NO: 1646094 - RNA, 12 nt, Human
agggacccccaa

SEQ ID NO: 1646095 - RNA, 18 nt, Human
uuuucucuccucucccca

SEQ ID NO: 1646096 - RNA, 22 nt, Human
cuggugucuucaggggccacac

SEQ ID NO: 1646097 - RNA, 10 nt, Human
auguuuucag

SEQ ID NO: 1646098 - RNA, 17 nt, Human
gaacagauuucaaaaaa

SEQ ID NO: 1646099 - RNA, 19 nt, Human
auuguaggugacuauuaua

SEQ ID NO: 1646100 - RNA, 14 nt, Human
uaauccuaaacaua

SEQ ID NO: 1646101 - RNA, 15 nt, Human
cuaagugcagccccg

SEQ ID NO: 1646102 - RNA, 17 nt, Human
ccaguaguuagcuuucu

SEQ ID NO: 1646103 - RNA, 20 nt, Human
gagcaucaucuucuggguua

SEQ ID NO: 1646104 - RNA, 17 nt, Human
acaaaugggaaacaaaa

SEQ ID NO: 1646105 - RNA, 19 nt, Human
auucagaauuucuaaaagu

SEQ ID NO: 1646106 - RNA, 20 nt, Human
ccuccugccuaagugcagcc

SEQ ID NO: 1646107 - RNA, 16 nt, Human
ugcauagguuuaauaa

SEQ ID NO: 1646108 - RNA, 15 nt, Human
uaaaaggaaaugcuc

SEQ ID NO: 1646109 - RNA, 14 nt, Human
ugcaccuccaugga

SEQ ID NO: 1646110 - RNA, 23 nt, Human
uaagaauucuguugauggaaaua

SEQ ID NO: 1646111 - RNA, 23 nt, Human
aggaugguucccuugaugaagaa

SEQ ID NO: 1646112 - RNA, 19 nt, Human
caucaaggguacacugccu

SEQ ID NO: 1646113 - RNA, 22 nt, Human
aucuauguagaauauauuuccu

SEQ ID NO: 1646114 - RNA, 21 nt, Human
gagcaucuccucaacucugag

SEQ ID NO: 1646115 - RNA, 23 nt, Human
uggcuugaguuuaaauuguaaua

SEQ ID NO: 1646116 - RNA, 20 nt, Human
ccaaguaaauguuuguccuu

SEQ ID NO: 1646117 - RNA, 18 nt, Human
auaauccuaaacauauga

SEQ ID NO: 1646118 - RNA, 12 nt, Human
cuugguuuuaau

SEQ ID NO: 1646119 - RNA, 22 nt, Human
ugugagcucaccagucccuccc

SEQ ID NO: 1646120 - RNA, 21 nt, Human
agggcagaugaugcuuugaga

SEQ ID NO: 1646121 - RNA, 20 nt, Human
auuuugugauugauuauaug

SEQ ID NO: 1646122 - RNA, 23 nt, Human
aguacucauacauguuacaacac

SEQ ID NO: 1646123 - RNA, 15 nt, Human
augucuagagaacac

SEQ ID NO: 1646124 - RNA, 18 nt, Human
ugcaagaagaaaucauga

SEQ ID NO: 1646125 - RNA, 21 nt, Human
aaauaauuuuuauauuugaaa

SEQ ID NO: 1646126 - RNA, 17 nt, Human
uaacugauuuguaacaa

SEQ ID NO: 1646127 - RNA, 15 nt, Human
ugccccccagcccuc

SEQ ID NO: 1646128 - RNA, 18 nt, Human
gcaggaggaucacuugag

SEQ ID NO: 1646129 - RNA, 11 nt, Human
aaaaaaaaacc

SEQ ID NO: 1646130 - RNA, 17 nt, Human
aguauuucuaugaaaua

SEQ ID NO: 1646131 - RNA, 19 nt, Human
aagcuaugugagcucacca

SEQ ID NO: 1646132 - RNA, 18 nt, Human
gggaacaaggaaggaaag

SEQ ID NO: 1646133 - RNA, 15 nt, Human
cuucaacucccugcc

SEQ ID NO: 1646134 - RNA, 21 nt, Human
uaguauuucuaugaaauauua

SEQ ID NO: 1646135 - RNA, 17 nt, Human
cuggagggaagccuugg

SEQ ID NO: 1646136 - RNA, 18 nt, Human
acaagccuccuuuuaaag

SEQ ID NO: 1646137 - RNA, 21 nt, Human
aagauauuaacugagaaggcu

SEQ ID NO: 1646138 - RNA, 15 nt, Human
ucaagaucagccugg

SEQ ID NO: 1646139 - RNA, 15 nt, Human
aaaugauguuucaua

SEQ ID NO: 1646140 - RNA, 21 nt, Human
uaagucaucugaugagaacaa

SEQ ID NO: 1646141 - RNA, 21 nt, Human
ugaauuguaggugacuauuau

SEQ ID NO: 1646142 - RNA, 18 nt, Human
agauccccaagccuggca

SEQ ID NO: 1646143 - RNA, 19 nt, Human
uaccuccaaggaccggccu

SEQ ID NO: 1646144 - RNA, 21 nt, Human
cccuauccuacuuccccuucc

SEQ ID NO: 1646145 - RNA, 15 nt, Human
ucaguuuuugugaaa

SEQ ID NO: 1646146 - RNA, 19 nt, Human
agaaacaaaaaucaaacuu

SEQ ID NO: 1646147 - RNA, 16 nt, Human
acuguauguccuuggu

SEQ ID NO: 1646148 - RNA, 19 nt, Human
cggccuccauccugaggcu

SEQ ID NO: 1646149 - RNA, 22 nt, Human
agccaaacauccuacaagacac

SEQ ID NO: 1646150 - RNA, 20 nt, Human
acuucuuaggguuaugauua

SEQ ID NO: 1646151 - RNA, 14 nt, Human
cagagucaagggug

SEQ ID NO: 1646152 - RNA, 19 nt, Human
uauguagaauauauuuccu

SEQ ID NO: 1646153 - RNA, 13 nt, Human
cuacagugagcca

SEQ ID NO: 1646154 - RNA, 23 nt, Human
gaggcauuuaggccaugggacag

SEQ ID NO: 1646155 - RNA, 22 nt, Human
aaacauguuuaucguauuugau

SEQ ID NO: 1646156 - RNA, 18 nt, Human
guauuauuuuuuaaaaaa

SEQ ID NO: 1646157 - RNA, 16 nt, Human
acuaaacaaagaguga

SEQ ID NO: 1646158 - RNA, 17 nt, Human
ucuauaauuuaaauaua

SEQ ID NO: 1646159 - RNA, 13 nt, Human
acaaggaaaaaau

SEQ ID NO: 1646160 - RNA, 14 nt, Human
aggaaagaugugaa

SEQ ID NO: 1646161 - RNA, 13 nt, Human
ugggaggcugaga

SEQ ID NO: 1646162 - RNA, 18 nt, Human
acugccuucucaacucca

SEQ ID NO: 1646163 - RNA, 23 nt, Human
uccaaacugacucuuaagaagac

SEQ ID NO: 1646164 - RNA, 16 nt, Human
auccaaugaaaugagu

SEQ ID NO: 1646165 - RNA, 21 nt, Human
augucauuugcuggagcucug

SEQ ID NO: 1646166 - RNA, 21 nt, Human
ugaacaaauuuacagagacag

SEQ ID NO: 1646167 - RNA, 18 nt, Human
ggcucuggacaggcacua

SEQ ID NO: 1646168 - RNA, 19 nt, Human
auacuaauuauacccccug

SEQ ID NO: 1646169 - RNA, 15 nt, Human
cuaaggcaggaggau

SEQ ID NO: 1646170 - RNA, 19 nt, Human
acuccuguucaugcccaua

SEQ ID NO: 1646171 - RNA, 19 nt, Human
aaauaugccccauucaaca

SEQ ID NO: 1646172 - RNA, 14 nt, Human
uaaauaaaaauaau

SEQ ID NO: 1646173 - RNA, 21 nt, Human
auuauauggcuugaguuuaaa

SEQ ID NO: 1646174 - RNA, 20 nt, Human
uaagugaaauaagccagaca

SEQ ID NO: 1646175 - RNA, 21 nt, Human
acaaagacaucgauugauaug

SEQ ID NO: 1646176 - RNA, 22 nt, Human
agcccuccuuaucaaaggacac

SEQ ID NO: 1646177 - RNA, 19 nt, Human
cuggccuucggccuccauc

SEQ ID NO: 1646178 - RNA, 20 nt, Human
uguaaaggaauuuaaaaauc

SEQ ID NO: 1646179 - RNA, 23 nt, Human
ggcuaagcuucacuguaaaauaa

SEQ ID NO: 1646180 - RNA, 17 nt, Human
aggcaggaggaucacuu

SEQ ID NO: 1646181 - RNA, 12 nt, Human
cacaacacacag

SEQ ID NO: 1646182 - RNA, 17 nt, Human
cuccuuaucaaaggaca

SEQ ID NO: 1646183 - RNA, 20 nt, Human
uaaaagacagugaaagaaaa

SEQ ID NO: 1646184 - RNA, 19 nt, Human
acugccaucauuuacuuuu

SEQ ID NO: 1646185 - RNA, 20 nt, Human
gaaacauuugguaaggggaa

SEQ ID NO: 1646186 - RNA, 11 nt, Human
aaaggaaggaa

SEQ ID NO: 1646187 - RNA, 13 nt, Human
agcuucuguuccg

SEQ ID NO: 1646188 - RNA, 18 nt, Human
gucuucuagcagugagcc

SEQ ID NO: 1646189 - RNA, 17 nt, Human
caccucccccaucucuu

SEQ ID NO: 1646190 - RNA, 16 nt, Human
uauaugucacuuugcu

SEQ ID NO: 1646191 - RNA, 14 nt, Human
cuggagcucugccc

SEQ ID NO: 1646192 - RNA, 13 nt, Human
aguguuugaaagc

SEQ ID NO: 1646193 - RNA, 16 nt, Human
aacaauuugaauauaa

SEQ ID NO: 1646194 - RNA, 14 nt, Human
uguauucuuuuagu

SEQ ID NO: 1646195 - RNA, 16 nt, Human
aggccaugggacaggg

SEQ ID NO: 1646196 - RNA, 18 nt, Human
gaaaauaucacuugucaa

SEQ ID NO: 1646197 - RNA, 14 nt, Human
auccaaugaaauga

SEQ ID NO: 1646198 - RNA, 21 nt, Human
ugaaauggacuuuuguacaua

SEQ ID NO: 1646199 - RNA, 19 nt, Human
cagcuacuugggaggcuga

SEQ ID NO: 1646200 - RNA, 18 nt, Human
uaggaugggaacaaggaa

SEQ ID NO: 1646201 - RNA, 18 nt, Human
aucuggcucuggacaggc

SEQ ID NO: 1646202 - RNA, 19 nt, Human
uguaguguuggagaagaac

SEQ ID NO: 1646203 - RNA, 14 nt, Human
auuuaaggccaggc

SEQ ID NO: 1646204 - RNA, 14 nt, Human
cacaacacacagau

SEQ ID NO: 1646205 - RNA, 12 nt, Human
aacuuuacagaa

SEQ ID NO: 1646206 - RNA, 17 nt, Human
aaucuuauaauuuaaaa

SEQ ID NO: 1646207 - RNA, 22 nt, Human
gaauuaaguuuuuuuuuaaaaa

SEQ ID NO: 1646208 - RNA, 21 nt, Human
ugaaacgaggauugggaaaaa

SEQ ID NO: 1646209 - RNA, 19 nt, Human
gagcucaccagucccuccc

SEQ ID NO: 1646210 - RNA, 14 nt, Human
acaagcagcccuua

SEQ ID NO: 1646211 - RNA, 20 nt, Human
ggccaugggacagggaggac

SEQ ID NO: 1646212 - RNA, 18 nt, Human
auaucaaacugaaacaaa

SEQ ID NO: 1646213 - RNA, 14 nt, Human
ccccugagcuugca

SEQ ID NO: 1646214 - RNA, 20 nt, Human
caagccuccuuuuaaaguaa

SEQ ID NO: 1646215 - RNA, 16 nt, Human
auacuauuuaauuauu

SEQ ID NO: 1646216 - RNA, 19 nt, Human
cauaucaaacugaaacaaa

SEQ ID NO: 1646217 - RNA, 13 nt, Human
agccucagucucc

SEQ ID NO: 1646218 - RNA, 21 nt, Human
agcccuucuuuccacagaagc

SEQ ID NO: 1646219 - RNA, 13 nt, Human
augaguugcaguu

SEQ ID NO: 1646220 - RNA, 18 nt, Human
cagagacagaaagcagaa

SEQ ID NO: 1646221 - RNA, 16 nt, Human
ugcuaagucuuauaua

SEQ ID NO: 1646222 - RNA, 19 nt, Human
cagagaugaggccgccaug

SEQ ID NO: 1646223 - RNA, 16 nt, Human
uaaaauccauacauuu

SEQ ID NO: 1646224 - RNA, 22 nt, Human
aaagagugaaggauuuauguuu

SEQ ID NO: 1646225 - RNA, 17 nt, Human
acucaccucccccaucu

SEQ ID NO: 1646226 - RNA, 15 nt, Human
aaugucugaaaugga

SEQ ID NO: 1646227 - RNA, 13 nt, Human
guuuaaguucuau

SEQ ID NO: 1646228 - RNA, 22 nt, Human
ggguuccuuccucugagccuug

SEQ ID NO: 1646229 - RNA, 17 nt, Human
uucugagcauuuaauau

SEQ ID NO: 1646230 - RNA, 20 nt, Human
uuuaaggccaggcauggugg

SEQ ID NO: 1646231 - RNA, 23 nt, Human
accuccauggaaacgaagcacca

SEQ ID NO: 1646232 - RNA, 13 nt, Human
uguccacaaguaa

SEQ ID NO: 1646233 - RNA, 16 nt, Human
aucaaaagaaagaaaa

SEQ ID NO: 1646234 - RNA, 15 nt, Human
ucccccaucucuucu

SEQ ID NO: 1646235 - RNA, 16 nt, Human
ccugccccccagcccu

SEQ ID NO: 1646236 - RNA, 21 nt, Human
uugccuaggcauagcccugcc

SEQ ID NO: 1646237 - RNA, 15 nt, Human
uucaagaccagccug

SEQ ID NO: 1646238 - RNA, 18 nt, Human
auccccaagccuggcaag

SEQ ID NO: 1646239 - RNA, 20 nt, Human
agcagugagccaaauguaaa

SEQ ID NO: 1646240 - RNA, 16 nt, Human
aagaaaauaacaauaa

SEQ ID NO: 1646241 - RNA, 13 nt, Human
uaaacauguuuau

SEQ ID NO: 1646242 - RNA, 16 nt, Human
caaguaaaaggaaaug

SEQ ID NO: 1646243 - RNA, 19 nt, Human
aaggaaguauaggccaggc

SEQ ID NO: 1646244 - RNA, 17 nt, Human
ggagcucguggaacagu

SEQ ID NO: 1646245 - RNA, 22 nt, Human
cauuuaaauaaaguguuugaaa

SEQ ID NO: 1646246 - RNA, 15 nt, Human
aauucugaaagcaac

SEQ ID NO: 1646247 - RNA, 21 nt, Human
cacuaucuggguuuugggggg

SEQ ID NO: 1646248 - RNA, 19 nt, Human
cauggaauuggagcucgug

SEQ ID NO: 1646249 - RNA, 20 nt, Human
uuucauaagaauucuguuga

SEQ ID NO: 1646250 - RNA, 16 nt, Human
auaaauaaauaaaaac

SEQ ID NO: 1646251 - RNA, 20 nt, Human
gaacguaaucguguccccua

SEQ ID NO: 1646252 - RNA, 21 nt, Human
aggcucuuuugggauuuuuga

SEQ ID NO: 1646253 - RNA, 16 nt, Human
cuucggccuccauccu

SEQ ID NO: 1646254 - RNA, 21 nt, Human
acuccagccagggcaagagag

SEQ ID NO: 1646255 - RNA, 21 nt, Human
gcccccacuugccauaaaacu

SEQ ID NO: 1646256 - RNA, 23 nt, Human
auuuuagauagaugaagaagcua

SEQ ID NO: 1646257 - RNA, 16 nt, Human
uauguucuaagaagug

SEQ ID NO: 1646258 - RNA, 20 nt, Human
gaauucauucacucaacaaa

SEQ ID NO: 1646259 - RNA, 16 nt, Human
uggucugugagaugcu

SEQ ID NO: 1646260 - RNA, 17 nt, Human
uucucuaggaaauauuu

SEQ ID NO: 1646261 - RNA, 16 nt, Human
cauuucuaaagccauu

SEQ ID NO: 1646262 - RNA, 16 nt, Human
guugauggaaauacac

SEQ ID NO: 1646263 - RNA, 15 nt, Human
ucgaggcuacaguga

SEQ ID NO: 1646264 - RNA, 19 nt, Human
aaaagacagugaaagaaaa

SEQ ID NO: 1646265 - RNA, 19 nt, Human
cauggccacaucugagccc

SEQ ID NO: 1646266 - RNA, 23 nt, Human
caggcacaguggcucacaccugu

SEQ ID NO: 1646267 - RNA, 13 nt, Human
acuauuauauuuc

SEQ ID NO: 1646268 - RNA, 21 nt, Human
acugccaaaacaucaaccugc

SEQ ID NO: 1646269 - RNA, 18 nt, Human
gaagcaaaauuuuuucuc

SEQ ID NO: 1646270 - RNA, 20 nt, Human
ugaggcuccacuuggucugu

SEQ ID NO: 1646271 - RNA, 13 nt, Human
ccucccccaucuc

SEQ ID NO: 1646272 - RNA, 18 nt, Human
cugcucaauaaaguacaa

SEQ ID NO: 1646273 - RNA, 18 nt, Human
auuuauuacuguaagaaa

SEQ ID NO: 1646274 - RNA, 22 nt, Human
caaggaugccccgucccccucu

SEQ ID NO: 1646275 - RNA, 15 nt, Human
augggacagggagga

SEQ ID NO: 1646276 - RNA, 21 nt, Human
uugaggcacagaaacuccugu

SEQ ID NO: 1646277 - RNA, 18 nt, Human
uaauuauuucacuuuaga

SEQ ID NO: 1646278 - RNA, 14 nt, Human
ggcuccagcuggcc

SEQ ID NO: 1646279 - RNA, 22 nt, Human
cacuuccaagagccuuuuuuug

SEQ ID NO: 1646280 - RNA, 23 nt, Human
acugucuuguuggacgagaaaac

SEQ ID NO: 1646281 - RNA, 11 nt, Human
caauaaaagac

SEQ ID NO: 1646282 - RNA, 22 nt, Human
uuagauaaggcuguucuuuaaa

SEQ ID NO: 1646283 - RNA, 21 nt, Human
uauaagaaauaggaaauauuu

SEQ ID NO: 1646284 - RNA, 17 nt, Human
uugccaaauauaaauaa

SEQ ID NO: 1646285 - RNA, 14 nt, Human
agaaacaaaaauca

SEQ ID NO: 1646286 - RNA, 19 nt, Human
caggcagauguuccuaaua

SEQ ID NO: 1646287 - RNA, 17 nt, Human
agaaugacugacaaaga

SEQ ID NO: 1646288 - RNA, 12 nt, Human
ccaggcugagcc

SEQ ID NO: 1646289 - RNA, 17 nt, Human
agaugggagaaucacuu

SEQ ID NO: 1646290 - RNA, 19 nt, Human
ccccugagcuugcagagau

SEQ ID NO: 1646291 - RNA, 16 nt, Human
ucuucaacucccugcc

SEQ ID NO: 1646292 - RNA, 17 nt, Human
aacaguuaccucugccu

SEQ ID NO: 1646293 - RNA, 22 nt, Human
uugccuaggcauagcccugccu

SEQ ID NO: 1646294 - RNA, 19 nt, Human
aauguuuacagauccccaa

SEQ ID NO: 1646295 - RNA, 17 nt, Human
acacuaagagagaauga

SEQ ID NO: 1646296 - RNA, 17 nt, Human
aggccaugggacaggga

SEQ ID NO: 1646297 - RNA, 16 nt, Human
cacuggacucaccucc

SEQ ID NO: 1646298 - RNA, 17 nt, Human
auguuuacagaucccca

SEQ ID NO: 1646299 - RNA, 13 nt, Human
ggcaggcacugcc

SEQ ID NO: 1646300 - RNA, 12 nt, Human
gcaaagcccagc

SEQ ID NO: 1646301 - RNA, 18 nt, Human
ccugccuaagugcagccc

SEQ ID NO: 1646302 - RNA, 14 nt, Human
auguagaauauauu

SEQ ID NO: 1646303 - RNA, 19 nt, Human
aagccaugugcagccacca

SEQ ID NO: 1646304 - RNA, 17 nt, Human
gccaugugcagccacca

SEQ ID NO: 1646305 - RNA, 15 nt, Human
uuuaugguuguauua

SEQ ID NO: 1646306 - RNA, 17 nt, Human
aauucuugccaaauaua

SEQ ID NO: 1646307 - RNA, 14 nt, Human
augauguuuagaaa

SEQ ID NO: 1646308 - RNA, 13 nt, Human
uauuuaauuauuu

SEQ ID NO: 1646309 - RNA, 22 nt, Human
uauccuacuuccccuuccuaau

SEQ ID NO: 1646310 - RNA, 15 nt, Human
accaaggcugauuaa

SEQ ID NO: 1646311 - RNA, 22 nt, Human
ugggcacuguggguagacacac

SEQ ID NO: 1646312 - RNA, 16 nt, Human
uguccccuauccuacu

SEQ ID NO: 1646313 - RNA, 16 nt, Human
gaauggcuaagcaaaa

SEQ ID NO: 1646314 - RNA, 23 nt, Human
acucuauguucuaagaagugaaa

SEQ ID NO: 1646315 - RNA, 11 nt, Human
uaguuagcuuu

SEQ ID NO: 1646316 - RNA, 18 nt, Human
ugcccauaccccuggcca

SEQ ID NO: 1646317 - RNA, 18 nt, Human
auuuuaacucuauaaugu

SEQ ID NO: 1646318 - RNA, 22 nt, Human
agcuguguccucaugagggcug

SEQ ID NO: 1646319 - RNA, 14 nt, Human
cugagucccaggcu

SEQ ID NO: 1646320 - RNA, 17 nt, Human
agcuacuaauuuuaaaa

SEQ ID NO: 1646321 - RNA, 18 nt, Human
uggucaauuuuguuaugu

SEQ ID NO: 1646322 - RNA, 14 nt, Human
ccuugaugaagaag

SEQ ID NO: 1646323 - RNA, 20 nt, Human
aagaugguaccaccagucug

SEQ ID NO: 1646324 - RNA, 14 nt, Human
cugaaacaaaauua

SEQ ID NO: 1646325 - RNA, 16 nt, Human
aacagauuucaaaaaa

SEQ ID NO: 1646326 - RNA, 18 nt, Human
uuaggaggacaaaaggaa

SEQ ID NO: 1646327 - RNA, 14 nt, Human
cucaccccuugcca

SEQ ID NO: 1646328 - RNA, 14 nt, Human
cauuuaguuauaaa

SEQ ID NO: 1646329 - RNA, 15 nt, Human
ggcaauagucaaauu

SEQ ID NO: 1646330 - RNA, 15 nt, Human
augucugaaauggaa

SEQ ID NO: 1646331 - RNA, 16 nt, Human
acauuugcucauggaa

SEQ ID NO: 1646332 - RNA, 18 nt, Human
auggccacaucugagccc

SEQ ID NO: 1646333 - RNA, 12 nt, Human
agcuuucuuccu

SEQ ID NO: 1646334 - RNA, 21 nt, Human
ggaaagaauaaccaacacccu

SEQ ID NO: 1646335 - RNA, 14 nt, Human
ugaggcuacagaac

SEQ ID NO: 1646336 - RNA, 14 nt, Human
auuuuaucugcuau

SEQ ID NO: 1646337 - RNA, 18 nt, Human
cuacauaaaauacaaaaa

SEQ ID NO: 1646338 - RNA, 12 nt, Human
ggcugaugcagu

SEQ ID NO: 1646339 - RNA, 18 nt, Human
uccagcuggccgggagcc

SEQ ID NO: 1646340 - RNA, 18 nt, Human
uguaaaggaauuuaaaaa

SEQ ID NO: 1646341 - RNA, 16 nt, Human
auacauguuacaacac

SEQ ID NO: 1646342 - RNA, 18 nt, Human
uuuuagugaaauauuauu

SEQ ID NO: 1646343 - RNA, 19 nt, Human
ccuccagggagucucagcu

SEQ ID NO: 1646344 - RNA, 15 nt, Human
ucuugaggcacagaa

SEQ ID NO: 1646345 - RNA, 17 nt, Human
ugaaaaucuuauaauuu

SEQ ID NO: 1646346 - RNA, 21 nt, Human
gaaaaguauguuagugcaaau

SEQ ID NO: 1646347 - RNA, 23 nt, Human
aggcugaggcaggaggaucacuu

SEQ ID NO: 1646348 - RNA, 21 nt, Human
aauuuuuauauuugaaauauu

SEQ ID NO: 1646349 - RNA, 11 nt, Human
aaaaaggaagg

SEQ ID NO: 1646350 - RNA, 18 nt, Human
ccugcaaagcccagcuug

SEQ ID NO: 1646351 - RNA, 23 nt, Human
caccaaggagccaaacauccuac

SEQ ID NO: 1646352 - RNA, 12 nt, Human
aagaaaauaacg

SEQ ID NO: 1646353 - RNA, 23 nt, Human
cuacacgagauacagaauuuuau

SEQ ID NO: 1646354 - RNA, 23 nt, Human
ggagcaucuccucaacucugagu

SEQ ID NO: 1646355 - RNA, 13 nt, Human
gagacagcucugc

SEQ ID NO: 1646356 - RNA, 18 nt, Human
uccuaauuccacagcugc

SEQ ID NO: 1646357 - RNA, 12 nt, Human
aucuucacuuuu

SEQ ID NO: 1646358 - RNA, 19 nt, Human
uggaaauguuuacagaucc

SEQ ID NO: 1646359 - RNA, 21 nt, Human
aaacaauaacgauaaaagaca

SEQ ID NO: 1646360 - RNA, 13 nt, Human
ucucccucccuug

SEQ ID NO: 1646361 - RNA, 15 nt, Human
auccugccccugagc

SEQ ID NO: 1646362 - RNA, 13 nt, Human
uauuucuaugaaa

SEQ ID NO: 1646363 - RNA, 17 nt, Human
ccaaaagguauuuuaau

SEQ ID NO: 1646364 - RNA, 23 nt, Human
gcuggccuugugaggagcuggaa

SEQ ID NO: 1646365 - RNA, 12 nt, Human
auaaaaacaaag

SEQ ID NO: 1646366 - RNA, 18 nt, Human
caaguaaaaggaaaugcu

SEQ ID NO: 1646367 - RNA, 21 nt, Human
cauuuucuucucacauuuaua

SEQ ID NO: 1646368 - RNA, 13 nt, Human
ucuuauaauuuaa

SEQ ID NO: 1646369 - RNA, 23 nt, Human
ggaugguucccuugaugaagaag

SEQ ID NO: 1646370 - RNA, 11 nt, Human
agugucugcug

SEQ ID NO: 1646371 - RNA, 15 nt, Human
cagugaaagaaaaua

SEQ ID NO: 1646372 - RNA, 16 nt, Human
ucaaaagaaagaaaau

SEQ ID NO: 1646373 - RNA, 20 nt, Human
aggugacuauuauauuucca

SEQ ID NO: 1646374 - RNA, 21 nt, Human
guccccuauccuacuuccccu

SEQ ID NO: 1646375 - RNA, 13 nt, Human
acuaauuuuaaaa

SEQ ID NO: 1646376 - RNA, 21 nt, Human
uuggaaggcugaggcaggagg

SEQ ID NO: 1646377 - RNA, 22 nt, Human
aagaugagaugguuucuagaga

SEQ ID NO: 1646378 - RNA, 16 nt, Human
guuaucuucacuuuua

SEQ ID NO: 1646379 - RNA, 14 nt, Human
uugggaaaaaguaa

SEQ ID NO: 1646380 - RNA, 20 nt, Human
cuucaacucccugcccccca

SEQ ID NO: 1646381 - RNA, 17 nt, Human
ugucuucaggggccaca

SEQ ID NO: 1646382 - RNA, 18 nt, Human
uguauuauuuuuuaaaaa

SEQ ID NO: 1646383 - RNA, 15 nt, Human
ugggacagggaggac

SEQ ID NO: 1646384 - RNA, 18 nt, Human
acauuuauauuuuuguga

SEQ ID NO: 1646385 - RNA, 19 nt, Human
aaucaaacuuuacagaaag

SEQ ID NO: 1646386 - RNA, 16 nt, Human
cuaaaaauuaaaaccu

SEQ ID NO: 1646387 - RNA, 20 nt, Human
aauaagucaucugaugagaa

SEQ ID NO: 1646388 - RNA, 17 nt, Human
cuauccuacuuccccuu

SEQ ID NO: 1646389 - RNA, 18 nt, Human
caguuguugcccacagcu

SEQ ID NO: 1646390 - RNA, 14 nt, Human
uacaugucuagaga

SEQ ID NO: 1646391 - RNA, 17 nt, Human
cucugcaagaagaaauc

SEQ ID NO: 1646392 - RNA, 24 nt, Human
ccccugagcuugcagagaugaggc

SEQ ID NO: 1646393 - RNA, 17 nt, Human
uaauuuuuauauuugaa

SEQ ID NO: 1646394 - RNA, 14 nt, Human
gcuggagcucugcc

SEQ ID NO: 1646395 - RNA, 17 nt, Human
agcucugcccauccugc

SEQ ID NO: 1646396 - RNA, 17 nt, Human
cauuuguauaaaauaau

SEQ ID NO: 1646397 - RNA, 16 nt, Human
caugggacagggagga

SEQ ID NO: 1646398 - RNA, 19 nt, Human
ccccuauccuacuuccccu

SEQ ID NO: 1646399 - RNA, 18 nt, Human
gauuucaaaaaaaaaccc

SEQ ID NO: 1646400 - RNA, 13 nt, Human
acagcccuucuuu

SEQ ID NO: 1646401 - RNA, 19 nt, Human
cccugcaaagcccagcuug

SEQ ID NO: 1646402 - RNA, 19 nt, Human
ggagccugaucaccugccc

SEQ ID NO: 1646403 - RNA, 20 nt, Human
gaaauacacuguuaucuuca

SEQ ID NO: 1646404 - RNA, 19 nt, Human
caagaaggaaagauuuugu

SEQ ID NO: 1646405 - RNA, 20 nt, Human
uuugcaagccagauuuuccu

SEQ ID NO: 1646406 - RNA, 13 nt, Human
acaagaaaugaaa

SEQ ID NO: 1646407 - RNA, 15 nt, Human
agucuguuuucccuc

SEQ ID NO: 1646408 - RNA, 21 nt, Human
caagacugcacaucaaaauau

SEQ ID NO: 1646409 - RNA, 21 nt, Human
aaagaaaauaacgauaaaaga

SEQ ID NO: 1646410 - RNA, 14 nt, Human
gagcccauggcacu

SEQ ID NO: 1646411 - RNA, 18 nt, Human
ggaaguauaggccaggca

SEQ ID NO: 1646412 - RNA, 13 nt, Human
uuuaaaaauccua

SEQ ID NO: 1646413 - RNA, 18 nt, Human
auguuucauaagaauucu

SEQ ID NO: 1646414 - RNA, 18 nt, Human
caaacuuuacagaaagau

SEQ ID NO: 1646415 - RNA, 20 nt, Human
ucaagucuuucacauuuaaa

SEQ ID NO: 1646416 - RNA, 14 nt, Human
uggcucugugugcu

SEQ ID NO: 1646417 - RNA, 23 nt, Human
caugcugucuacacuaagagaga

SEQ ID NO: 1646418 - RNA, 19 nt, Human
uauuuuaauaauguuucaa

SEQ ID NO: 1646419 - RNA, 15 nt, Human
aggguuuggaagcca

SEQ ID NO: 1646420 - RNA, 14 nt, Human
ugacuauuauauuu

SEQ ID NO: 1646421 - RNA, 21 nt, Human
aaaagguauuuuaaucaccaa

SEQ ID NO: 1646422 - RNA, 13 nt, Human
auaaaaauauaua

SEQ ID NO: 1646423 - RNA, 17 nt, Human
uuucacauuuaaauaaa

SEQ ID NO: 1646424 - RNA, 14 nt, Human
cugcuaguuuauau

SEQ ID NO: 1646425 - RNA, 15 nt, Human
acaggguuuauguuu

SEQ ID NO: 1646426 - RNA, 15 nt, Human
aaugauuaugaauua

SEQ ID NO: 1646427 - RNA, 21 nt, Human
uuccuagucuguuuucccucc

SEQ ID NO: 1646428 - RNA, 13 nt, Human
gggcugaagcugu

SEQ ID NO: 1646429 - RNA, 23 nt, Human
cuuaagaagacugcauuauauuu

SEQ ID NO: 1646430 - RNA, 16 nt, Human
cuccauccugaggcuc

SEQ ID NO: 1646431 - RNA, 13 nt, Human
cccugcacuccag

SEQ ID NO: 1646432 - RNA, 12 nt, Human
auauaaauaaaa

SEQ ID NO: 1646433 - RNA, 17 nt, Human
augauuauuuuauguuu

SEQ ID NO: 1646434 - RNA, 13 nt, Human
auugucuagugaa

SEQ ID NO: 1646435 - RNA, 12 nt, Human
gaugagagaaca

SEQ ID NO: 1646436 - RNA, 20 nt, Human
ggagccugaucaccugcccu

SEQ ID NO: 1646437 - RNA, 21 nt, Human
auuuuuucucuaggaaauauu

SEQ ID NO: 1646438 - RNA, 12 nt, Human
cuggcuccagcu

SEQ ID NO: 1646439 - RNA, 15 nt, Human
uauuucacuuuagaa

SEQ ID NO: 1646440 - RNA, 14 nt, Human
auuucuaugaaaua

SEQ ID NO: 1646441 - RNA, 16 nt, Human
agccucagucucccuc

SEQ ID NO: 1646442 - RNA, 16 nt, Human
cagggcucacagaauu

SEQ ID NO: 1646443 - RNA, 13 nt, Human
gaaccuaggguga

SEQ ID NO: 1646444 - RNA, 15 nt, Human
gccucuuagaugcag

SEQ ID NO: 1646445 - RNA, 21 nt, Human
auacaguggagacaucuggaa

SEQ ID NO: 1646446 - RNA, 22 nt, Human
gcuauuugcuguuauuuuaucu

SEQ ID NO: 1646447 - RNA, 16 nt, Human
aaaauaacaauaaaag

SEQ ID NO: 1646448 - RNA, 23 nt, Human
gucucagcuucacccugagguga

SEQ ID NO: 1646449 - RNA, 20 nt, Human
aagacagugaaagaaaauaa

SEQ ID NO: 1646450 - RNA, 14 nt, Human
uaaggauucugaga

SEQ ID NO: 1646451 - RNA, 14 nt, Human
acccgggaggcaga

SEQ ID NO: 1646452 - RNA, 15 nt, Human
uccauccugaggcuc

SEQ ID NO: 1646453 - RNA, 17 nt, Human
cccacuggacucaccuc

SEQ ID NO: 1646454 - RNA, 22 nt, Human
ugcuggagacauugaggcaggc

SEQ ID NO: 1646455 - RNA, 16 nt, Human
acaugucuagagaaca

SEQ ID NO: 1646456 - RNA, 15 nt, Human
acauccuacaagaca

SEQ ID NO: 1646457 - RNA, 12 nt, Human
auuucaaaaaaa

SEQ ID NO: 1646458 - RNA, 13 nt, Human
aaacauccuacaa

SEQ ID NO: 1646459 - RNA, 19 nt, Human
auuaaguuuuuuuuuaaaa

SEQ ID NO: 1646460 - RNA, 16 nt, Human
acuaguuucccuugca

SEQ ID NO: 1646461 - RNA, 18 nt, Human
ccaaccuggaguugaaaa

SEQ ID NO: 1646462 - RNA, 16 nt, Human
aauugacccacaagaa

SEQ ID NO: 1646463 - RNA, 17 nt, Human
aucauuuacuuuuaaac

SEQ ID NO: 1646464 - RNA, 16 nt, Human
ccccaucucuucuggg

SEQ ID NO: 1646465 - RNA, 18 nt, Human
augaugcuuugagaacau

SEQ ID NO: 1646466 - RNA, 16 nt, Human
aucacuugagccccgg

SEQ ID NO: 1646467 - RNA, 21 nt, Human
aagacaagaaggaaagauuuu

SEQ ID NO: 1646468 - RNA, 18 nt, Human
uguucaagaccagccugg

SEQ ID NO: 1646469 - RNA, 22 nt, Human
acccugaggugagcaucaucuu

SEQ ID NO: 1646470 - RNA, 22 nt, Human
auaucuuuuuuuuaauaaacca

SEQ ID NO: 1646471 - RNA, 18 nt, Human
auguuccuaauaaagcuu

SEQ ID NO: 1646472 - RNA, 12 nt, Human
auuauauuucca

SEQ ID NO: 1646473 - RNA, 21 nt, Human
ugucucuaccaaaaaaaggaa

SEQ ID NO: 1646474 - RNA, 16 nt, Human
uacauuuguauaaaau

SEQ ID NO: 1646475 - RNA, 14 nt, Human
augaugcuuugaga

SEQ ID NO: 1646476 - RNA, 20 nt, Human
agggcagaugaugcuuugag

SEQ ID NO: 1646477 - RNA, 16 nt, Human
uggggauagugaggca

SEQ ID NO: 1646478 - RNA, 16 nt, Human
gaaaaaauaacaauga

SEQ ID NO: 1646479 - RNA, 17 nt, Human
auuuucuauaauuuaaa

SEQ ID NO: 1646480 - RNA, 12 nt, Human
gaauuggagcuc

SEQ ID NO: 1646481 - RNA, 21 nt, Human
cuaagcuucacuguaaaauaa

SEQ ID NO: 1646482 - RNA, 14 nt, Human
uauguauauuuuau

SEQ ID NO: 1646483 - RNA, 12 nt, Human
aaagaaacaaaa

SEQ ID NO: 1646484 - RNA, 22 nt, Human
gaaaacaauaacgauaaaagac

SEQ ID NO: 1646485 - RNA, 20 nt, Human
auuacccccagcuuugagga

SEQ ID NO: 1646486 - RNA, 21 nt, Human
aaguuuaugguuguauuauuu

SEQ ID NO: 1646487 - RNA, 14 nt, Human
agucucccucccuu

SEQ ID NO: 1646488 - RNA, 15 nt, Human
cgaagcaccaucauu

SEQ ID NO: 1646489 - RNA, 22 nt, Human
uacaugagguacugagagugaa

SEQ ID NO: 1646490 - RNA, 19 nt, Human
aauuuuuauauuugaaaua

SEQ ID NO: 1646491 - RNA, 21 nt, Human
gcccauccugccccugagccc

SEQ ID NO: 1646492 - RNA, 19 nt, Human
aacugaaacaaaauuagaa

SEQ ID NO: 1646493 - RNA, 16 nt, Human
gcuguuaaucuuucaa

SEQ ID NO: 1646494 - RNA, 11 nt, Human
acugggacagg

SEQ ID NO: 1646495 - RNA, 13 nt, Human
cuuagcccuuccc

SEQ ID NO: 1646496 - RNA, 20 nt, Human
gauugugccccugcacucca

SEQ ID NO: 1646497 - RNA, 13 nt, Human
gcuggagcucugc

SEQ ID NO: 1646498 - RNA, 21 nt, Human
cacaugaacuuguaaaggaau

SEQ ID NO: 1646499 - RNA, 19 nt, Human
ugcacacagcacgggggcc

SEQ ID NO: 1646500 - RNA, 15 nt, Human
ggccuccauccugag

SEQ ID NO: 1646501 - RNA, 14 nt, Human
gaacgagacaagca

SEQ ID NO: 1646502 - RNA, 15 nt, Human
uccacaaguaaaagg

SEQ ID NO: 1646503 - RNA, 14 nt, Human
caucucaggugugu

SEQ ID NO: 1646504 - RNA, 10 nt, Human
ccugagcccc

SEQ ID NO: 1646505 - RNA, 23 nt, Human
ggucucagugucaaugcagcccc

SEQ ID NO: 1646506 - RNA, 22 nt, Human
cuugaauuguaggugacuauua

SEQ ID NO: 1646507 - RNA, 22 nt, Human
acauccuacaagacacagugac

SEQ ID NO: 1646508 - RNA, 15 nt, Human
aauagugaauaaagu

SEQ ID NO: 1646509 - RNA, 22 nt, Human
ugauaguuguaccgcaauguga

SEQ ID NO: 1646510 - RNA, 18 nt, Human
uuuauggcacuaguauuu

SEQ ID NO: 1646511 - RNA, 18 nt, Human
aucuauguagaauauauu

SEQ ID NO: 1646512 - RNA, 14 nt, Human
acauagugaggagc

SEQ ID NO: 1646513 - RNA, 21 nt, Human
aaaaaguucugcagauaaaca

SEQ ID NO: 1646514 - RNA, 16 nt, Human
ugaaguacucauacau

SEQ ID NO: 1646515 - RNA, 16 nt, Human
ugagcucagcccuggu

SEQ ID NO: 1646516 - RNA, 21 nt, Human
caucucagguguguugcagug

SEQ ID NO: 1646517 - RNA, 20 nt, Human
ucagaaggaaagaauaacca

SEQ ID NO: 1646518 - RNA, 16 nt, Human
ccacuuauaggaauug

SEQ ID NO: 1646519 - RNA, 13 nt, Human
auuuuuuaaaaaa

SEQ ID NO: 1646520 - RNA, 18 nt, Human
cacuugccauaaaacuua

SEQ ID NO: 1646521 - RNA, 19 nt, Human
agagaacagggcugaagcu

SEQ ID NO: 1646522 - RNA, 14 nt, Human
caauugacuauagu

SEQ ID NO: 1646523 - RNA, 22 nt, Human
uuugcuguuauuuuaucugcua

SEQ ID NO: 1646524 - RNA, 16 nt, Human
aaaagcaucacaugaa

SEQ ID NO: 1646525 - RNA, 18 nt, Human
caugaauuaguuuuauau

SEQ ID NO: 1646526 - RNA, 16 nt, Human
cacaucaggaaagaga

SEQ ID NO: 1646527 - RNA, 18 nt, Human
gacauuugcucauggaau

SEQ ID NO: 1646528 - RNA, 15 nt, Human
ucuggcuccagcugg

SEQ ID NO: 1646529 - RNA, 19 nt, Human
cucaccucccccaucucuu

SEQ ID NO: 1646530 - RNA, 17 nt, Human
uuccaagccucaugucc

SEQ ID NO: 1646531 - RNA, 15 nt, Human
uggacucaccucccc

SEQ ID NO: 1646532 - RNA, 18 nt, Human
gaaacaaaaggauaauga

SEQ ID NO: 1646533 - RNA, 20 nt, Human
ccauacuaauuauacccccu

SEQ ID NO: 1646534 - RNA, 22 nt, Human
aaugauguuucauaagaauucu

SEQ ID NO: 1646535 - RNA, 11 nt, Human
ucaccuccccc

SEQ ID NO: 1646536 - RNA, 20 nt, Human
ccagcuugaaaccuucacuu

SEQ ID NO: 1646537 - RNA, 18 nt, Human
agagaaugagagacacac

SEQ ID NO: 1646538 - RNA, 17 nt, Human
uuagaugggcauggugg

SEQ ID NO: 1646539 - RNA, 15 nt, Human
ucucagaaggaaaga

SEQ ID NO: 1646540 - RNA, 19 nt, Human
cuagaguuuagcuggaaaa

SEQ ID NO: 1646541 - RNA, 19 nt, Human
ccccucuggcuccagcugg

SEQ ID NO: 1646542 - RNA, 15 nt, Human
ggccauuacccccag

SEQ ID NO: 1646543 - RNA, 23 nt, Human
aaagcccagcuugaaaccuucac

SEQ ID NO: 1646544 - RNA, 13 nt, Human
uuauaaaaauaua

SEQ ID NO: 1646545 - RNA, 16 nt, Human
agcuccagugauaaga

SEQ ID NO: 1646546 - RNA, 14 nt, Human
aucucuucucagaa

SEQ ID NO: 1646547 - RNA, 18 nt, Human
uuaucauuuaguuauaaa

SEQ ID NO: 1646548 - RNA, 23 nt, Human
aauuaaaaccucuuugugucccu

SEQ ID NO: 1646549 - RNA, 17 nt, Human
gccuccuuuuaaaguaa

SEQ ID NO: 1646550 - RNA, 13 nt, Human
ugaaaaucuuaua

SEQ ID NO: 1646551 - RNA, 14 nt, Human
aaauguaaaauagu

SEQ ID NO: 1646552 - RNA, 19 nt, Human
aaucagagauaaagcuuag

SEQ ID NO: 1646553 - RNA, 23 nt, Human
gacacauaucaaacugaaacaaa

SEQ ID NO: 1646554 - RNA, 22 nt, Human
cagacacaugugcuggccaccu

SEQ ID NO: 1646555 - RNA, 17 nt, Human
ccaagcugguggcucug

SEQ ID NO: 1646556 - RNA, 22 nt, Human
uggagacauugaggcaggcacu

SEQ ID NO: 1646557 - RNA, 13 nt, Human
cugaagcuguguc

SEQ ID NO: 1646558 - RNA, 15 nt, Human
uggaaacgaagcacc

SEQ ID NO: 1646559 - RNA, 23 nt, Human
uccagguagaggguguguaagua

SEQ ID NO: 1646560 - RNA, 14 nt, Human
cccugaggugagca

SEQ ID NO: 1646561 - RNA, 18 nt, Human
cugagggcauagaaguaa

SEQ ID NO: 1646562 - RNA, 23 nt, Human
ugucaauucuugccaaauauaaa

SEQ ID NO: 1646563 - RNA, 17 nt, Human
auuauuuuuuaaaaaaa

SEQ ID NO: 1646564 - RNA, 21 nt, Human
ggagacauugaggcaggcacu

SEQ ID NO: 1646565 - RNA, 14 nt, Human
cacaagaaaugaaa

SEQ ID NO: 1646566 - RNA, 13 nt, Human
guuuucccaucuc

SEQ ID NO: 1646567 - RNA, 21 nt, Human
ucauucacucaacaaacauaa

SEQ ID NO: 1646568 - RNA, 13 nt, Human
aagcauuccaacu

SEQ ID NO: 1646569 - RNA, 16 nt, Human
uaaauaaaaauaaucc

SEQ ID NO: 1646570 - RNA, 19 nt, Human
guuauuauauuuacaaaug

SEQ ID NO: 1646571 - RNA, 20 nt, Human
ucuguuuucccuccuuggag

SEQ ID NO: 1646572 - RNA, 18 nt, Human
cauguuccccuugggggu

SEQ ID NO: 1646573 - RNA, 21 nt, Human
cccuagaaagccaugugcagc

SEQ ID NO: 1646574 - RNA, 24 nt, Human
cuggcuaauuagcauggccacauc

SEQ ID NO: 1646575 - RNA, 20 nt, Human
agggaagacaagaaggaaag

SEQ ID NO: 1646576 - RNA, 14 nt, Human
uaaaauccauacau

SEQ ID NO: 1646577 - RNA, 15 nt, Human
cagaacuaaaaauua

SEQ ID NO: 1646578 - RNA, 19 nt, Human
aaguugcauagguuuaaua

SEQ ID NO: 1646579 - RNA, 17 nt, Human
acuauuuaauuauuuca

SEQ ID NO: 1646580 - RNA, 14 nt, Human
cucccucccuuggg

SEQ ID NO: 1646581 - RNA, 23 nt, Human
gauagauaggucagugcaaauac

SEQ ID NO: 1646582 - RNA, 21 nt, Human
gaaaugaguuuuucuuuucau

SEQ ID NO: 1646583 - RNA, 14 nt, Human
uaaagaaacaaaaa

SEQ ID NO: 1646584 - RNA, 19 nt, Human
augaaagcagggacuugaa

SEQ ID NO: 1646585 - RNA, 12 nt, Human
aaaauaacaaua

SEQ ID NO: 1646586 - RNA, 18 nt, Human
uuccaagaaauauuccuu

SEQ ID NO: 1646587 - RNA, 23 nt, Human
caacggggugaaacccugucucu

SEQ ID NO: 1646588 - RNA, 14 nt, Human
uuaugauuaaguaa

SEQ ID NO: 1646589 - RNA, 18 nt, Human
cauggaauuggagcucgu

SEQ ID NO: 1646590 - RNA, 17 nt, Human
caaagagaaagaggguu

SEQ ID NO: 1646591 - RNA, 17 nt, Human
uaugcuaagugaaauaa

SEQ ID NO: 1646592 - RNA, 12 nt, Human
uacuauuuaauu

SEQ ID NO: 1646593 - RNA, 18 nt, Human
cagauuugagcucagccc

SEQ ID NO: 1646594 - RNA, 19 nt, Human
ugaucaccugcccugcuga

SEQ ID NO: 1646595 - RNA, 16 nt, Human
uggcaauugacuauag

SEQ ID NO: 1646596 - RNA, 16 nt, Human
ugugcagccaccaguc

SEQ ID NO: 1646597 - RNA, 22 nt, Human
caaacaauuugaauauaaauuu

SEQ ID NO: 1646598 - RNA, 14 nt, Human
aagcaucacaugaa

SEQ ID NO: 1646599 - RNA, 15 nt, Human
uauaaauaaaaauaa

SEQ ID NO: 1646600 - RNA, 15 nt, Human
aauauaaauaaaaau

SEQ ID NO: 1646601 - RNA, 13 nt, Human
caugguggugugu

SEQ ID NO: 1646602 - RNA, 14 nt, Human
aauuagaaauguaa

SEQ ID NO: 1646603 - RNA, 21 nt, Human
aggacagcccuucuuuccaca

SEQ ID NO: 1646604 - RNA, 16 nt, Human
cugagcgacagugaga

SEQ ID NO: 1646605 - RNA, 23 nt, Human
cccuagaaagccaugugcagcca

SEQ ID NO: 1646606 - RNA, 14 nt, Human
uauauauuuuagau

SEQ ID NO: 1646607 - RNA, 19 nt, Human
ucuucacuuuuauaagaaa

SEQ ID NO: 1646608 - RNA, 22 nt, Human
acaugagguacugagagugaac

SEQ ID NO: 1646609 - RNA, 20 nt, Human
uuccacagaagcuccaggua

SEQ ID NO: 1646610 - RNA, 15 nt, Human
uugacccacaagaaa

SEQ ID NO: 1646611 - RNA, 13 nt, Human
uguuuucccuccu

SEQ ID NO: 1646612 - RNA, 15 nt, Human
auaucuuaucuuccu

SEQ ID NO: 1646613 - RNA, 16 nt, Human
cuggccuucggccucc

SEQ ID NO: 1646614 - RNA, 23 nt, Human
auauaacaaugcuguauuuuaaa

SEQ ID NO: 1646615 - RNA, 12 nt, Human
cucccugccccc

SEQ ID NO: 1646616 - RNA, 19 nt, Human
caauucuugccaaauauaa

SEQ ID NO: 1646617 - RNA, 21 nt, Human
aaacgaggauugggaaaaagu

SEQ ID NO: 1646618 - RNA, 20 nt, Human
guauuauuuuuuaaaaaaau

SEQ ID NO: 1646619 - RNA, 14 nt, Human
aagcugaguguuuc

SEQ ID NO: 1646620 - RNA, 16 nt, Human
aacuugguuuuaauua

SEQ ID NO: 1646621 - RNA, 22 nt, Human
gaagugaaaaucuacacuccag

SEQ ID NO: 1646622 - RNA, 16 nt, Human
cuacacuccagugaga

SEQ ID NO: 1646623 - RNA, 20 nt, Human
uuugccgcuuaagcuuucag

SEQ ID NO: 1646624 - RNA, 20 nt, Human
aauaagccagacaucaacag

SEQ ID NO: 1646625 - RNA, 14 nt, Human
agaauucauucacu

SEQ ID NO: 1646626 - RNA, 18 nt, Human
uauuuucaguuauuauau

SEQ ID NO: 1646627 - RNA, 13 nt, Human
uaugaaauauuau

SEQ ID NO: 1646628 - RNA, 16 nt, Human
cagcuuuccucaaaac

SEQ ID NO: 1646629 - RNA, 14 nt, Human
acuaauuuuaaaau

SEQ ID NO: 1646630 - RNA, 18 nt, Human
ucaggaaagagagcacca

SEQ ID NO: 1646631 - RNA, 20 nt, Human
gcuuccaggcuggcgugcag

SEQ ID NO: 1646632 - RNA, 16 nt, Human
ugaauuaguuuuauau

SEQ ID NO: 1646633 - RNA, 16 nt, Human
aaaauccauacauuug

SEQ ID NO: 1646634 - RNA, 15 nt, Human
auauagaaauguauu

SEQ ID NO: 1646635 - RNA, 18 nt, Human
agccugaucaccugcccu

SEQ ID NO: 1646636 - RNA, 18 nt, Human
ccugucucaauaaauaaa

SEQ ID NO: 1646637 - RNA, 20 nt, Human
gcuugcagagaugaggccgc

SEQ ID NO: 1646638 - RNA, 17 nt, Human
uucacuguaaaauaaua

SEQ ID NO: 1646639 - RNA, 13 nt, Human
cgggaggcagagg

SEQ ID NO: 1646640 - RNA, 23 nt, Human
cucuugaggcacagaaacuccug

SEQ ID NO: 1646641 - RNA, 14 nt, Human
gagacacugucucu

SEQ ID NO: 1646642 - RNA, 17 nt, Human
aggagaggcaaagaaag

SEQ ID NO: 1646643 - RNA, 23 nt, Human
cacagaaacuccuguucaugccc

SEQ ID NO: 1646644 - RNA, 18 nt, Human
uuuuaucugcuaugcuau

SEQ ID NO: 1646645 - RNA, 19 nt, Human
agucccuccccaaaugcuu

SEQ ID NO: 1646646 - RNA, 16 nt, Human
acauccuacaagacac

SEQ ID NO: 1646647 - RNA, 12 nt, Human
caauaaauaaau

SEQ ID NO: 1646648 - RNA, 16 nt, Human
augagcacgcauggaa

SEQ ID NO: 1646649 - RNA, 13 nt, Human
agacacagugacc

SEQ ID NO: 1646650 - RNA, 14 nt, Human
aggacaaaaggaau

SEQ ID NO: 1646651 - RNA, 17 nt, Human
ucccuccccaaaugcuu

SEQ ID NO: 1646652 - RNA, 19 nt, Human
gaucacuuuaggccuggug

SEQ ID NO: 1646653 - RNA, 13 nt, Human
uacauaaaauaca

SEQ ID NO: 1646654 - RNA, 13 nt, Human
cugccuucucaac

SEQ ID NO: 1646655 - RNA, 19 nt, Human
acuauuuaauuauuucacu

SEQ ID NO: 1646656 - RNA, 13 nt, Human
agaaaugaaagca

SEQ ID NO: 1646657 - RNA, 22 nt, Human
aauuuuagacauucuuuaucuu

SEQ ID NO: 1646658 - RNA, 24 nt, Human
cauucuggaauaauccuaaacaua

SEQ ID NO: 1646659 - RNA, 22 nt, Human
aacugcccacucugcaagaaga

SEQ ID NO: 1646660 - RNA, 21 nt, Human
uuuguauaaaauaauuuuuau

SEQ ID NO: 1646661 - RNA, 14 nt, Human
guagcuaaauauau

SEQ ID NO: 1646662 - RNA, 18 nt, Human
auauuucuguuaaaauau

SEQ ID NO: 1646663 - RNA, 14 nt, Human
augcuccuccaggg

SEQ ID NO: 1646664 - RNA, 16 nt, Human
cugcugagccccaagu

SEQ ID NO: 1646665 - RNA, 15 nt, Human
uagaauauauuuccu

SEQ ID NO: 1646666 - RNA, 22 nt, Human
caucgcaauguaagacucggga

SEQ ID NO: 1646667 - RNA, 22 nt, Human
aggcacaguggcucacaccugu

SEQ ID NO: 1646668 - RNA, 17 nt, Human
uaccaaaaaaaggaagg

SEQ ID NO: 1646669 - RNA, 14 nt, Human
ucuaggaaauauuu

SEQ ID NO: 1646670 - RNA, 14 nt, Human
cauuuacuuuuaaa

SEQ ID NO: 1646671 - RNA, 15 nt, Human
uuauagcuacuaauu

SEQ ID NO: 1646672 - RNA, 13 nt, Human
acaagaaggaaag

SEQ ID NO: 1646673 - RNA, 14 nt, Human
uauuaaguauuuua

SEQ ID NO: 1646674 - RNA, 15 nt, Human
agagugugaggaaaa

SEQ ID NO: 1646675 - RNA, 17 nt, Human
uaaaagacaaggaaaaa

SEQ ID NO: 1646676 - RNA, 15 nt, Human
aaggguacacugccu

SEQ ID NO: 1646677 - RNA, 13 nt, Human
ccaaaagguauuu

SEQ ID NO: 1646678 - RNA, 19 nt, Human
ugcuugucccuguggaagu

SEQ ID NO: 1646679 - RNA, 14 nt, Human
uugauggaaauaca

SEQ ID NO: 1646680 - RNA, 19 nt, Human
uaucuauguagaauauauu

SEQ ID NO: 1646681 - RNA, 13 nt, Human
caaaaggaaugug

SEQ ID NO: 1646682 - RNA, 13 nt, Human
uuaaaaaagaaac

SEQ ID NO: 1646683 - RNA, 16 nt, Human
cuagaaccaccugccu

SEQ ID NO: 1646684 - RNA, 14 nt, Human
cucaacaaacauaa

SEQ ID NO: 1646685 - RNA, 13 nt, Human
cacacugaagaag

SEQ ID NO: 1646686 - RNA, 16 nt, Human
ugaaguccaagcauuu

SEQ ID NO: 1646687 - RNA, 22 nt, Human
auguccuuggugccuggagccu

SEQ ID NO: 1646688 - RNA, 13 nt, Human
gcucucuggccuu

SEQ ID NO: 1646689 - RNA, 12 nt, Human
cuuuaucuuuuu

SEQ ID NO: 1646690 - RNA, 20 nt, Human
cccugccccccagcccuccu

SEQ ID NO: 1646691 - RNA, 22 nt, Human
cucagcuucacccugaggugag

SEQ ID NO: 1646692 - RNA, 13 nt, Human
aucuacacuccag

SEQ ID NO: 1646693 - RNA, 19 nt, Human
auuauuuuuuaaaaaaauu

SEQ ID NO: 1646694 - RNA, 23 nt, Human
uggaaauguuuacagauccccaa

SEQ ID NO: 1646695 - RNA, 22 nt, Human
ccccuuccuaauuccacagcug

SEQ ID NO: 1646696 - RNA, 23 nt, Human
cacaagaaaugaaagcagggacu

SEQ ID NO: 1646697 - RNA, 14 nt, Human
ccagcuggccggga

SEQ ID NO: 1646698 - RNA, 14 nt, Human
caaggaaaaaauaa

SEQ ID NO: 1646699 - RNA, 17 nt, Human
uaaauuuaucauuuagu

SEQ ID NO: 1646700 - RNA, 15 nt, Human
aaaucaaacuuuaca

SEQ ID NO: 1646701 - RNA, 21 nt, Human
aauaggcugaugggcaaaaaa

SEQ ID NO: 1646702 - RNA, 10 nt, Human
caacucccug

SEQ ID NO: 1646703 - RNA, 20 nt, Human
auaaauaaaaacaaaguuga

SEQ ID NO: 1646704 - RNA, 14 nt, Human
cuaagcauuccaac

SEQ ID NO: 1646705 - RNA, 18 nt, Human
ugccauaauuacuauguc

SEQ ID NO: 1646706 - RNA, 16 nt, Human
ucuucucagaaggaaa

SEQ ID NO: 1646707 - RNA, 17 nt, Human
aauaugcucuaaacaug

SEQ ID NO: 1646708 - RNA, 19 nt, Human
guccaggucuaccaaaaau

SEQ ID NO: 1646709 - RNA, 14 nt, Human
ugguauguuuucag

SEQ ID NO: 1646710 - RNA, 16 nt, Human
ccugagcgacagugag

SEQ ID NO: 1646711 - RNA, 19 nt, Human
aguugauuuaaggccaggc

SEQ ID NO: 1646712 - RNA, 14 nt, Human
agaauauauuuccu

SEQ ID NO: 1646713 - RNA, 22 nt, Human
uauuucagauaaucacaauaca

SEQ ID NO: 1646714 - RNA, 21 nt, Human
gcugagucccaggcugagccu

SEQ ID NO: 1646715 - RNA, 22 nt, Human
caaaugggaaacaaaaggauaa

SEQ ID NO: 1646716 - RNA, 13 nt, Human
aaaauaacaauga

SEQ ID NO: 1646717 - RNA, 15 nt, Human
aaaagacaaggaaaa

SEQ ID NO: 1646718 - RNA, 21 nt, Human
auaguuguaccgcaaugugac

SEQ ID NO: 1646719 - RNA, 22 nt, Human
uucaauaucuuuuuuuuaauaa

SEQ ID NO: 1646720 - RNA, 15 nt, Human
ccccugagcuugcag

SEQ ID NO: 1646721 - RNA, 13 nt, Human
ugugcuggccacc

SEQ ID NO: 1646722 - RNA, 19 nt, Human
cuaccaaaaaaaggaagga

SEQ ID NO: 1646723 - RNA, 19 nt, Human
caagagagcgagacccugu

SEQ ID NO: 1646724 - RNA, 16 nt, Human
aggaggacaaaaggaa

SEQ ID NO: 1646725 - RNA, 19 nt, Human
uggcaaacugccaucauuu

SEQ ID NO: 1646726 - RNA, 20 nt, Human
cucuaccaaaaaaaggaagg

SEQ ID NO: 1646727 - RNA, 15 nt, Human
ugagcucaccagucc

SEQ ID NO: 1646728 - RNA, 20 nt, Human
cuggcuaauuagcauggcca

SEQ ID NO: 1646729 - RNA, 14 nt, Human
agaaaugaaagcag

SEQ ID NO: 1646730 - RNA, 14 nt, Human
agagacagaaagca

SEQ ID NO: 1646731 - RNA, 22 nt, Human
agcacagccucuuagaugcagu

SEQ ID NO: 1646732 - RNA, 16 nt, Human
gauuaagaaaggaagu

SEQ ID NO: 1646733 - RNA, 20 nt, Human
aauuuugugaagcaaaauuu

SEQ ID NO: 1646734 - RNA, 12 nt, Human
uaagaagacugc

SEQ ID NO: 1646735 - RNA, 23 nt, Human
auuaccauuauggauaaagauga

SEQ ID NO: 1646736 - RNA, 22 nt, Human
gagucaagggugugugcagcau

SEQ ID NO: 1646737 - RNA, 20 nt, Human
ggugggcagaucacuugagc

SEQ ID NO: 1646738 - RNA, 11 nt, Human
agacacaugug

SEQ ID NO: 1646739 - RNA, 18 nt, Human
acucuuaagaagacugca

SEQ ID NO: 1646740 - RNA, 20 nt, Human
uugaacccgggaggcagagg

SEQ ID NO: 1646741 - RNA, 20 nt, Human
acuagaguuuagcuggaaaa

SEQ ID NO: 1646742 - RNA, 18 nt, Human
guuucaaacauauauaac

SEQ ID NO: 1646743 - RNA, 22 nt, Human
ggcacaacacaucaggaaagag

SEQ ID NO: 1646744 - RNA, 17 nt, Human
aacugccaucauuuacu

SEQ ID NO: 1646745 - RNA, 11 nt, Human
aaagaaacaaa

SEQ ID NO: 1646746 - RNA, 16 nt, Human
ucaucaaugaaugaau

SEQ ID NO: 1646747 - RNA, 22 nt, Human
auauuuacaaaugggaaacaaa

SEQ ID NO: 1646748 - RNA, 20 nt, Human
agagacacacugaagaagca

SEQ ID NO: 1646749 - RNA, 13 nt, Human
uuaugcuaaguga

SEQ ID NO: 1646750 - RNA, 21 nt, Human
ccagccuggucaacauaguga

SEQ ID NO: 1646751 - RNA, 16 nt, Human
ggccuccauccugagg

SEQ ID NO: 1646752 - RNA, 19 nt, Human
cucugcauacucauuagga

SEQ ID NO: 1646753 - RNA, 13 nt, Human
ccacaacacacag

SEQ ID NO: 1646754 - RNA, 15 nt, Human
guaaggggaauugag

SEQ ID NO: 1646755 - RNA, 11 nt, Human
aauuccacagc

SEQ ID NO: 1646756 - RNA, 19 nt, Human
auuggagcucgugggacag

SEQ ID NO: 1646757 - RNA, 19 nt, Human
uuggcaagcucuaucacca

SEQ ID NO: 1646758 - RNA, 12 nt, Human
caccuccuaaga

SEQ ID NO: 1646759 - RNA, 14 nt, Human
uauuauauuuccaa

SEQ ID NO: 1646760 - RNA, 12 nt, Human
aauaauuuuuaa

SEQ ID NO: 1646761 - RNA, 16 nt, Human
aaauauuuauuuuaau

SEQ ID NO: 1646762 - RNA, 14 nt, Human
ggagcaucuccuca

SEQ ID NO: 1646763 - RNA, 13 nt, Human
acuguaaaauaau

SEQ ID NO: 1646764 - RNA, 15 nt, Human
uaggaaauauuuauu

SEQ ID NO: 1646765 - RNA, 14 nt, Human
aauauuuauuuuaa

SEQ ID NO: 1646766 - RNA, 18 nt, Human
gccccugcacuccagccu

SEQ ID NO: 1646767 - RNA, 22 nt, Human
cagaucuaugccacaagaaccc

SEQ ID NO: 1646768 - RNA, 16 nt, Human
ccuacaugagguacug

SEQ ID NO: 1646769 - RNA, 17 nt, Human
caaauauaaauaaaaau

SEQ ID NO: 1646770 - RNA, 19 nt, Human
ucagugucaaugcagcccc

SEQ ID NO: 1646771 - RNA, 16 nt, Human
gaaucacuugaacccg

SEQ ID NO: 1646772 - RNA, 21 nt, Human
ccuccccaaaugcuuuccaug

SEQ ID NO: 1646773 - RNA, 15 nt, Human
aauaacgauaaaaga

SEQ ID NO: 1646774 - RNA, 16 nt, Human
aauuacauuuguauaa

SEQ ID NO: 1646775 - RNA, 18 nt, Human
uaucaaaagaaagaaaau

SEQ ID NO: 1646776 - RNA, 12 nt, Human
acugaaacaaaa

SEQ ID NO: 1646777 - RNA, 20 nt, Human
aauaauuuuuauauuugaaa

SEQ ID NO: 1646778 - RNA, 15 nt, Human
ccugccccccagccc

SEQ ID NO: 1646779 - RNA, 20 nt, Human
acagaacuaaaaauuaaaac

SEQ ID NO: 1646780 - RNA, 19 nt, Human
gguuccuuccucugagccu

SEQ ID NO: 1646781 - RNA, 13 nt, Human
uuuucuuuucauu

SEQ ID NO: 1646782 - RNA, 20 nt, Human
aaaugauguuucauaagaau

SEQ ID NO: 1646783 - RNA, 11 nt, Human
aaaaaaaggaa

SEQ ID NO: 1646784 - RNA, 15 nt, Human
uaucaauuuaaaaaa

SEQ ID NO: 1646785 - RNA, 18 nt, Human
uuccuaauaaagcuucug

SEQ ID NO: 1646786 - RNA, 14 nt, Human
cuccagugagacag

SEQ ID NO: 1646787 - RNA, 20 nt, Human
guaaaauagugaauaaaguc

SEQ ID NO: 1646788 - RNA, 20 nt, Human
uauaugcuaagucuuauaua

SEQ ID NO: 1646789 - RNA, 16 nt, Human
gacauugaggcaggca

SEQ ID NO: 1646790 - RNA, 20 nt, Human
uaacgauaaaagacagugaa

SEQ ID NO: 1646791 - RNA, 18 nt, Human
ccuuugcaccuccaugga

SEQ ID NO: 1646792 - RNA, 20 nt, Human
aguugauuaagaaaggaagu

SEQ ID NO: 1646793 - RNA, 14 nt, Human
ccugcugagcccca

SEQ ID NO: 1646794 - RNA, 14 nt, Human
ugaucaccugcccu

SEQ ID NO: 1646795 - RNA, 18 nt, Human
gaauuuccuuacucuuga

SEQ ID NO: 1646796 - RNA, 12 nt, Human
agacaucuggaa

SEQ ID NO: 1646797 - RNA, 22 nt, Human
uggacgagaaaacaauaacgau

SEQ ID NO: 1646798 - RNA, 20 nt, Human
aauucugguagcuaaauaua

SEQ ID NO: 1646799 - RNA, 19 nt, Human
cagaaagcagaacagugau

SEQ ID NO: 1646800 - RNA, 14 nt, Human
gcaaagcccagcuu

SEQ ID NO: 1646801 - RNA, 17 nt, Human
ggccaugggacagggag

SEQ ID NO: 1646802 - RNA, 17 nt, Human
auaaaguacaagagcuu

SEQ ID NO: 1646803 - RNA, 19 nt, Human
gugaacuugguuuuaauua

SEQ ID NO: 1646804 - RNA, 18 nt, Human
uauguuagagaauuuccu

SEQ ID NO: 1646805 - RNA, 12 nt, Human
agugcagccccg

SEQ ID NO: 1646806 - RNA, 15 nt, Human
augugcagccaccag

SEQ ID NO: 1646807 - RNA, 17 nt, Human
ugaaauaagccagacau

SEQ ID NO: 1646808 - RNA, 15 nt, Human
uucacuguaaaauaa

SEQ ID NO: 1646809 - RNA, 15 nt, Human
uaucuucacuuuuau

SEQ ID NO: 1646810 - RNA, 18 nt, Human
auuuguauaaaauaauuu

SEQ ID NO: 1646811 - RNA, 11 nt, Human
agaauauauuu

SEQ ID NO: 1646812 - RNA, 23 nt, Human
ucccuagaaagccaugugcagcc

SEQ ID NO: 1646813 - RNA, 14 nt, Human
aaaagacagugaaa

SEQ ID NO: 1646814 - RNA, 17 nt, Human
caagccuccuuuuaaag

SEQ ID NO: 1646815 - RNA, 15 nt, Human
ggaacaaggaaggaa

SEQ ID NO: 1646816 - RNA, 17 nt, Human
acacaugugcuggccac

SEQ ID NO: 1646817 - RNA, 15 nt, Human
acaagaaaugaaagc

SEQ ID NO: 1646818 - RNA, 17 nt, Human
accucauggaauuggag

SEQ ID NO: 1646819 - RNA, 14 nt, Human
aaccaacacccuga

SEQ ID NO: 1646820 - RNA, 17 nt, Human
aagaucagccugggcaa

SEQ ID NO: 1646821 - RNA, 22 nt, Human
aagccuuggggcugaugcaguu

SEQ ID NO: 1646822 - RNA, 22 nt, Human
augcuagaacucccuuucaaca

SEQ ID NO: 1646823 - RNA, 18 nt, Human
agucugacuguuuccauc

SEQ ID NO: 1646824 - RNA, 22 nt, Human
agguacugagagugaacaaauu

SEQ ID NO: 1646825 - RNA, 17 nt, Human
agacaucaacagauaaa

SEQ ID NO: 1646826 - RNA, 22 nt, Human
cgagaaaacaauaacgauaaaa

SEQ ID NO: 1646827 - RNA, 18 nt, Human
cccacuugccauaaaacu

SEQ ID NO: 1646828 - RNA, 17 nt, Human
ccaugaacuauaugacu

SEQ ID NO: 1646829 - RNA, 23 nt, Human
ccaggcacaguggcucacaccug

SEQ ID NO: 1646830 - RNA, 17 nt, Human
cccugcaaagcccagcu

SEQ ID NO: 1646831 - RNA, 13 nt, Human
cccauucaacauc

SEQ ID NO: 1646832 - RNA, 18 nt, Human
ccaagagugcacuacugu

SEQ ID NO: 1646833 - RNA, 20 nt, Human
cauggaaacgaagcaccauc

SEQ ID NO: 1646834 - RNA, 19 nt, Human
cauaucaaacugaaacaaa

SEQ ID NO: 1646835 - RNA, 13 nt, Human
cauccugaggcuc

SEQ ID NO: 1646836 - RNA, 14 nt, Human
cagcuucacccuga

SEQ ID NO: 1646837 - RNA, 13 nt, Human
caagaccagccug

SEQ ID NO: 1646838 - RNA, 12 nt, Human
caacacccugag

SEQ ID NO: 1646839 - RNA, 15 nt, Human
augucauuugcugga

SEQ ID NO: 1646840 - RNA, 19 nt, Human
augggacagggaggacgcu

SEQ ID NO: 1646841 - RNA, 15 nt, Human
cacaccuuaucuaug

SEQ ID NO: 1646842 - RNA, 18 nt, Human
cacagaaugacugacaaa

SEQ ID NO: 1646843 - RNA, 13 nt, Human
cagagauaaagcu

SEQ ID NO: 1646844 - RNA, 13 nt, Human
ggaauuggagcuc

SEQ ID NO: 1646845 - RNA, 17 nt, Human
ggaaagagaacuuccag

SEQ ID NO: 1646846 - RNA, 23 nt, Human
gcuggagcucugcccauccugcc

SEQ ID NO: 1646847 - RNA, 16 nt, Human
gcucucuggccuucgg

SEQ ID NO: 1646848 - RNA, 18 nt, Human
gacacauaucaaacugaa

SEQ ID NO: 1646849 - RNA, 22 nt, Human
gaguuuagcuggaaaaguaugu

SEQ ID NO: 1646850 - RNA, 21 nt, Human
gccccgucccccucuggcucc

SEQ ID NO: 1646851 - RNA, 23 nt, Human
cgcucucuggccuucggccucca

SEQ ID NO: 1646852 - RNA, 20 nt, Human
gaacuuccagauccuggaaa

SEQ ID NO: 1646853 - RNA, 15 nt, Human
cuucagccugaaaga

SEQ ID NO: 1646854 - RNA, 17 nt, Human
cuggcgugcagcaucag

SEQ ID NO: 1646855 - RNA, 19 nt, Human
cuucaaauccuugaagauu

SEQ ID NO: 1646856 - RNA, 19 nt, Human
cuuauugucuagugaaacu

SEQ ID NO: 1646857 - RNA, 17 nt, Human
uaaaguaaaggcaaacu

SEQ ID NO: 1646858 - RNA, 15 nt, Human
ggacaaaaggaaugu

SEQ ID NO: 1646859 - RNA, 22 nt, Human
ggagucucagcuucacccugag

SEQ ID NO: 1646860 - RNA, 19 nt, Human
guagaaugggggcagcacc

SEQ ID NO: 1646861 - RNA, 21 nt, Human
gucccuguggaaguaucuugg

SEQ ID NO: 1646862 - RNA, 17 nt, Human
guccgaggugggcagau

SEQ ID NO: 1646863 - RNA, 12 nt, Human
gugaaacccugu

SEQ ID NO: 1646864 - RNA, 14 nt, Human
guaugauucccagc

SEQ ID NO: 1646865 - RNA, 14 nt, Human
uaaaaaaaaaccug

SEQ ID NO: 1646866 - RNA, 16 nt, Human
ugaaguccaagcauuu

SEQ ID NO: 1646867 - RNA, 13 nt, Human
ugcuagaacuccc

SEQ ID NO: 1646868 - RNA, 21 nt, Human
ugggacauuugcucauggaau

SEQ ID NO: 1646869 - RNA, 22 nt, Human
ugggacagucaccucauggaau

SEQ ID NO: 1646870 - RNA, 18 nt, Human
ugucuugcuugauuguau

SEQ ID NO: 1646871 - RNA, 19 nt, Human
ugucuuguuggacgagaaa

SEQ ID NO: 1646872 - RNA, 17 nt, Human
aaaaaccccacaaucua

SEQ ID NO: 1646873 - RNA, 11 nt, Human
aaccuauguuu

SEQ ID NO: 1646874 - RNA, 18 nt, Human
aagccagauuuuccugaa

SEQ ID NO: 1646875 - RNA, 17 nt, Human
aaaguucugcagauaaa

SEQ ID NO: 1646876 - RNA, 17 nt, Human
aacacaugauccugcaa

SEQ ID NO: 1646877 - RNA, 15 nt, Human
gccccugagcccaug

SEQ ID NO: 1646878 - RNA, 19 nt, Human
gcccuuucucagggcagau

SEQ ID NO: 1646879 - RNA, 15 nt, Human
gcagcaucagcaucc

SEQ ID NO: 1646880 - RNA, 19 nt, Human
gcagcauuguuggcuguuc

SEQ ID NO: 1646881 - RNA, 19 nt, Human
gcaccuccuaagaaggcac

SEQ ID NO: 1646882 - RNA, 17 nt, Human
gauccugcaauuccacu

SEQ ID NO: 1646883 - RNA, 16 nt, Human
gaucagccugggcaac

SEQ ID NO: 1646884 - RNA, 23 nt, Human
gauaugccuuuucccaacuccag

SEQ ID NO: 1646885 - RNA, 13 nt, Human
gagugcacuacug

SEQ ID NO: 1646886 - RNA, 23 nt, Human
gagccgagauugugccccugcac

SEQ ID NO: 1646887 - RNA, 21 nt, Human
gagauacaguggagacaucug

SEQ ID NO: 1646888 - RNA, 23 nt, Human
gacugcauuauauuuauuacugu

SEQ ID NO: 1646889 - RNA, 18 nt, Human
gaauugaggacacugaua

SEQ ID NO: 1646890 - RNA, 18 nt, Human
gacauugaggcaggcacu

SEQ ID NO: 1646891 - RNA, 17 nt, Human
cuggauuccucacuuug

SEQ ID NO: 1646892 - RNA, 13 nt, Human
cugcuacuaucug

SEQ ID NO: 1646893 - RNA, 13 nt, Human
cuggaaaacugcu

SEQ ID NO: 1646894 - RNA, 20 nt, Human
cugaugggcaaaaaaccaau

SEQ ID NO: 1646895 - RNA, 14 nt, Human
cugcaagaagaaau

SEQ ID NO: 1646896 - RNA, 23 nt, Human
cguugacccucacaggagcaucu

SEQ ID NO: 1646897 - RNA, 16 nt, Human
cguugaacgucacauc

SEQ ID NO: 1646898 - RNA, 19 nt, Human
cggccuccauccugaggcu

SEQ ID NO: 1646899 - RNA, 13 nt, Human
cgcucucuggccu

SEQ ID NO: 1646900 - RNA, 16 nt, Human
cucagcuucacccuga

SEQ ID NO: 1646901 - RNA, 16 nt, Human
cucaggaggucaagau

SEQ ID NO: 1646902 - RNA, 16 nt, Human
uuacagagacagaaag

SEQ ID NO: 1646903 - RNA, 13 nt, Human
uucugcagauaaa

SEQ ID NO: 1646904 - RNA, 15 nt, Human
cgagacaagcagccc

SEQ ID NO: 1646905 - RNA, 19 nt, Human
ccuucggccuccauccuga

SEQ ID NO: 1646906 - RNA, 18 nt, Human
ccuuggggcugaugcagu

SEQ ID NO: 1646907 - RNA, 18 nt, Human
ccuauagucccacuacuu

SEQ ID NO: 1646908 - RNA, 13 nt, Human
cccuggggcuuua

SEQ ID NO: 1646909 - RNA, 15 nt, Human
guuuaugauuccacc

SEQ ID NO: 1646910 - RNA, 16 nt, Human
gcucuggacaggcacu

SEQ ID NO: 1646911 - RNA, 23 nt, Human
uaaaccaaggcuagaaccaccug

SEQ ID NO: 1646912 - RNA, 15 nt, Human
uaaccaacacccuga

SEQ ID NO: 1646913 - RNA, 17 nt, Human
uaguuguaccgcaaugu

SEQ ID NO: 1646914 - RNA, 19 nt, Human
ucacaccuuaucuauguag

SEQ ID NO: 1646915 - RNA, 21 nt, Human
ugcugagccccaaguggaacg

SEQ ID NO: 1646916 - RNA, 14 nt, Human
ugccuguaaucaca

SEQ ID NO: 1646917 - RNA, 22 nt, Human
ucacuugagcucaggaggucaa

SEQ ID NO: 1646918 - RNA, 19 nt, Human
ucacuuuaggccuggugug

SEQ ID NO: 1646919 - RNA, 15 nt, Human
ugagaugcuagaacu

SEQ ID NO: 1646920 - RNA, 16 nt, Human
ugauuuugugauugau

SEQ ID NO: 1646921 - RNA, 16 nt, Human
uguuugcuaagcauuc

SEQ ID NO: 1646922 - RNA, 17 nt, Human
cagacacaugugcuggc

SEQ ID NO: 1646923 - RNA, 18 nt, Human
caccuuaucuauguagaa

SEQ ID NO: 1646924 - RNA, 20 nt, Human
cacccugaggugagcaucau

SEQ ID NO: 1646925 - RNA, 16 nt, Human
caaacuuuacagaaag

SEQ ID NO: 1646926 - RNA, 16 nt, Human
caaacugaaacaaaau

SEQ ID NO: 1646927 - RNA, 19 nt, Human
auuccucacuuugaagagu

SEQ ID NO: 1646928 - RNA, 19 nt, Human
auuuaauuauuucacuuua

SEQ ID NO: 1646929 - RNA, 22 nt, Human
cagggaggacgcucucuggccu

SEQ ID NO: 1646930 - RNA, 14 nt, Human
caggaggaucacuu

SEQ ID NO: 1646931 - RNA, 18 nt, Human
cagccucuuagaugcagu

SEQ ID NO: 1646932 - RNA, 17 nt, Human
cagucucccucccuugg

SEQ ID NO: 1646933 - RNA, 23 nt, Human
ccaaauguaaaauagugaauaaa

SEQ ID NO: 1646934 - RNA, 12 nt, Human
ccacaagaaccc

SEQ ID NO: 1646935 - RNA, 13 nt, Human
caugagggcugga

SEQ ID NO: 1646936 - RNA, 12 nt, Human
caugauccugca

SEQ ID NO: 1646937 - RNA, 21 nt, Human
ccacuuggucugugagaugcu

SEQ ID NO: 1646938 - RNA, 18 nt, Human
ccauccugaggcuccacu

SEQ ID NO: 1646939 - RNA, 15 nt, Human
auuaaguaaugauaa

SEQ ID NO: 1646940 - RNA, 21 nt, Human
augagagacacacugaagaag

SEQ ID NO: 1646941 - RNA, 17 nt, Human
augcaguucugaagaag

SEQ ID NO: 1646942 - RNA, 15 nt, Human
aucugcuaugcuauu

SEQ ID NO: 1646943 - RNA, 12 nt, Human
aucuggcucugg

SEQ ID NO: 1646944 - RNA, 14 nt, Human
auaauccucaguuu

SEQ ID NO: 1646945 - RNA, 18 nt, Human
auaaaaauauauagcgac

SEQ ID NO: 1646946 - RNA, 13 nt, Human
aucaacagauaaa

SEQ ID NO: 1646947 - RNA, 16 nt, Human
auauuuguacaccaau

SEQ ID NO: 1646948 - RNA, 15 nt, Human
auauuuuauaucaau

SEQ ID NO: 1646949 - RNA, 15 nt, Human
auauaaucagagaua

SEQ ID NO: 1646950 - RNA, 13 nt, Human
ugcccauccugcc

SEQ ID NO: 1646951 - RNA, 14 nt, Human
uuguauuuaaggau

SEQ ID NO: 1646952 - RNA, 18 nt, Human
agccucuuagaugcaguu

SEQ ID NO: 1646953 - RNA, 20 nt, Human
agcucacagaccuuugaacu

SEQ ID NO: 1646954 - RNA, 20 nt, Human
uuuuaaaagaaugauuauga

SEQ ID NO: 1646955 - RNA, 21 nt, Human
agcugcccuuucucagggcag

SEQ ID NO: 1646956 - RNA, 15 nt, Human
agcugguggcucugu

SEQ ID NO: 1646957 - RNA, 16 nt, Human
aggcaggcacugccaa

SEQ ID NO: 1646958 - RNA, 21 nt, Human
aguguuggagaagaacugaaa

SEQ ID NO: 1646959 - RNA, 14 nt, Human
aguguuaagcguug

SEQ ID NO: 1646960 - RNA, 16 nt, Human
agguuauuuucaguua

SEQ ID NO: 1646961 - RNA, 16 nt, Human
uacguuaggaggacaa

SEQ ID NO: 1646962 - RNA, 14 nt, Human
uagcagugagccaa

SEQ ID NO: 1646963 - RNA, 20 nt, Human
ucacauuccaagccucaugu

SEQ ID NO: 1646964 - RNA, 15 nt, Human
uaccucugcuauuug

SEQ ID NO: 1646965 - RNA, 13 nt, Human
uacagugagccaa

SEQ ID NO: 1646966 - RNA, 21 nt, Human
guucaaaacuuauuggaaugu

SEQ ID NO: 1646967 - RNA, 16 nt, Human
ugagguaaaagcauca

SEQ ID NO: 1646968 - RNA, 22 nt, Human
ugauaaauggcuuccuggcaau

SEQ ID NO: 1646969 - RNA, 19 nt, Human
ucuccacuggaaaacugcu

SEQ ID NO: 1646970 - RNA, 20 nt, Human
gugagaugcuagaacucccu

SEQ ID NO: 1646971 - RNA, 16 nt, Human
gccuucucaacuccaa

SEQ ID NO: 1646972 - RNA, 21 nt, Human
gccaggaaucacuggcuguua

SEQ ID NO: 1646973 - RNA, 17 nt, Human
ggccuucggccuccauc

SEQ ID NO: 1646974 - RNA, 16 nt, Human
gauuuuauaugcuauu

SEQ ID NO: 1646975 - RNA, 13 nt, Human
gagacaagcagcc

SEQ ID NO: 1646976 - RNA, 21 nt, Human
gcagacacaugugcuggccac

SEQ ID NO: 1646977 - RNA, 18 nt, Human
gaaaacugcuacuaucug

SEQ ID NO: 1646978 - RNA, 15 nt, Human
agcaucaucuucugg

SEQ ID NO: 1646979 - RNA, 14 nt, Human
agccagacaucaac

SEQ ID NO: 1646980 - RNA, 14 nt, Human
gacuuaaugccacu

SEQ ID NO: 1646981 - RNA, 20 nt, Human
gaaagaaaauaacgauaaaa

SEQ ID NO: 1646982 - RNA, 20 nt, Human
gaaaucaggguuaguauugu

SEQ ID NO: 1646983 - RNA, 21 nt, Human
gaacucucgagcguugcuggg

SEQ ID NO: 1646984 - RNA, 19 nt, Human
gaacagucucuugaggcac

SEQ ID NO: 1646985 - RNA, 20 nt, Human
cagguguguugcagugucug

SEQ ID NO: 1646986 - RNA, 20 nt, Human
cagguccugcugaaacugcc

SEQ ID NO: 1646987 - RNA, 20 nt, Human
agauacaguggagacaucug

SEQ ID NO: 1646988 - RNA, 17 nt, Human
agagacagaaagcagaa

SEQ ID NO: 1646989 - RNA, 21 nt, Human
cugauaugggucuugauaaau

SEQ ID NO: 1646990 - RNA, 16 nt, Human
cugaaauggaacagau

SEQ ID NO: 1646991 - RNA, 15 nt, Human
cugaggugagcauca

SEQ ID NO: 1646992 - RNA, 16 nt, Human
cucugcccauccugcc

SEQ ID NO: 1646993 - RNA, 12 nt, Human
aauauauuuccu

SEQ ID NO: 1646994 - RNA, 12 nt, Human
aauauguuagag

SEQ ID NO: 1646995 - RNA, 21 nt, Human
aagguacuucaaauccuugaa

SEQ ID NO: 1646996 - RNA, 13 nt, Human
aaacaggcaaauu

SEQ ID NO: 1646997 - RNA, 21 nt, Human
aaauauuauguuaaaacuggg

SEQ ID NO: 1646998 - RNA, 18 nt, Human
accaaaaaucucaauauu

SEQ ID NO: 1646999 - RNA, 14 nt, Human
aaugauaacuggaa

SEQ ID NO: 1647000 - RNA, 20 nt, Human
aauuaacacaugauccugca

SEQ ID NO: 1647001 - RNA, 23 nt, Human
acucugcaagaagaaaucaugau

SEQ ID NO: 1647002 - RNA, 18 nt, Human
acuguuaucuucacuuuu

SEQ ID NO: 1647003 - RNA, 16 nt, Human
acucauuaggauggcu

SEQ ID NO: 1647004 - RNA, 13 nt, Human
aaucaggcuggcc

SEQ ID NO: 1647005 - RNA, 20 nt, Human
aauauguuagagaauuuccu

SEQ ID NO: 1647006 - RNA, 15 nt, Human
aauauuccuuaagau

SEQ ID NO: 1647007 - RNA, 22 nt, Human
aauaagccagacaucaacagau

SEQ ID NO: 1647008 - RNA, 21 nt, Human
aauaauuuuuauauuugaaau

SEQ ID NO: 1647009 - RNA, 19 nt, Human
acuuggucugugagaugcu

SEQ ID NO: 1647010 - RNA, 15 nt, Human
auuauggauaaagau

SEQ ID NO: 1647011 - RNA, 20 nt, Human
auucuuuuaguuuuuaaagu

SEQ ID NO: 1647012 - RNA, 14 nt, Human
auuuauuacuguaa

SEQ ID NO: 1647013 - RNA, 19 nt, Human
auuuaaggauucugagauu

SEQ ID NO: 1647014 - RNA, 14 nt, Human
auuuuauuaggagu

SEQ ID NO: 1647015 - RNA, 24 nt, Human
cacuguauguccuuggugccugga

SEQ ID NO: 1647016 - RNA, 14 nt, Human
caccucccccaucu

SEQ ID NO: 1647017 - RNA, 14 nt, Human
cacaugauccugca

SEQ ID NO: 1647018 - RNA, 14 nt, Human
caaauccaaugaaa

SEQ ID NO: 1647019 - RNA, 12 nt, Human
accccuggccaa

SEQ ID NO: 1647020 - RNA, 13 nt, Human
acaucaacagaua

SEQ ID NO: 1647021 - RNA, 13 nt, Human
acaugauccugca

SEQ ID NO: 1647022 - RNA, 22 nt, Human
acagauuugagcucagcccugg

SEQ ID NO: 1647023 - RNA, 15 nt, Human
acagagacagaaagc

SEQ ID NO: 1647024 - RNA, 19 nt, Human
acagaccuuugaacuagag

SEQ ID NO: 1647025 - RNA, 22 nt, Human
aggcugagaugggagaaucacu

SEQ ID NO: 1647026 - RNA, 14 nt, Human
aggcaccucucugg

SEQ ID NO: 1647027 - RNA, 15 nt, Human
uaaguaaugauaacu

SEQ ID NO: 1647028 - RNA, 13 nt, Human
guucaaaacuuau

SEQ ID NO: 1647029 - RNA, 22 nt, Human
gugauugaaaccuacacgagau

SEQ ID NO: 1647030 - RNA, 14 nt, Human
uauuauauuuccaa

SEQ ID NO: 1647031 - RNA, 21 nt, Human
uauuucuaugaaauauuaugu

SEQ ID NO: 1647032 - RNA, 13 nt, Human
uauuuuaaucacc

SEQ ID NO: 1647033 - RNA, 23 nt, Human
uccagugauaagagauguugacu

SEQ ID NO: 1647034 - RNA, 11 nt, Human
cccauccugcc

SEQ ID NO: 1647035 - RNA, 14 nt, Human
gcuugagcaggauu

SEQ ID NO: 1647036 - RNA, 19 nt, Human
ggaaaaaauaacaaugaaa

SEQ ID NO: 1647037 - RNA, 20 nt, Human
guaaaggggcagcagugcca

SEQ ID NO: 1647038 - RNA, 18 nt, Human
guacuccagccagggcaa

SEQ ID NO: 1647039 - RNA, 24 nt, Human
guaguccuguaauggaagcaucua

SEQ ID NO: 1647040 - RNA, 18 nt, Human
ggucccugcucucaguuc

SEQ ID NO: 1647041 - RNA, 18 nt, Human
ggcugagccucagucucc

SEQ ID NO: 1647042 - RNA, 21 nt, Human
gggagaaucacuugaacccgg

SEQ ID NO: 1647043 - RNA, 20 nt, Human
ucuuaggguuaugauuaagu

SEQ ID NO: 1647044 - RNA, 14 nt, Human
ugaaaccuggucuc

SEQ ID NO: 1647045 - RNA, 22 nt, Human
ugguucuucuuggucucagugu

SEQ ID NO: 1647046 - RNA, 12 nt, Human
uucuacuggcug

SEQ ID NO: 1647047 - RNA, 21 nt, Human
uguggccugaguaaugcauua

SEQ ID NO: 1647048 - RNA, 19 nt, Human
ugugcuaaaacaagcacua

SEQ ID NO: 1647049 - RNA, 16 nt, Human
uuccaagugauugaaa

SEQ ID NO: 1647050 - RNA, 17 nt, Human
uuguggggcuaaggcag

SEQ ID NO: 1647051 - RNA, 21 nt, Human
uugcuacagggcucacagaau

SEQ ID NO: 1647052 - RNA, 22 nt, Human
uugagcaggauuagauaaggcu

SEQ ID NO: 1647053 - RNA, 20 nt, Human
uuuucaggcuagauguaugu

SEQ ID NO: 1647054 - RNA, 21 nt, Human
uuugcuggagcucugcccauc

SEQ ID NO: 1647055 - RNA, 20 nt, Human
uccucaugagggcuggaugc

SEQ ID NO: 1647056 - RNA, 19 nt, Human
aauuuuuauauuugaaaua

SEQ ID NO: 1647057 - RNA, 14 nt, Human
agucucccucccuu

SEQ ID NO: 1647058 - RNA, 15 nt, Human
acaaggaaaaaauaa

SEQ ID NO: 1647059 - RNA, 19 nt, Human
cuuacucuugauuguggga

SEQ ID NO: 1647060 - RNA, 19 nt, Human
guuauuauauuuacaaaug

SEQ ID NO: 1647061 - RNA, 14 nt, Human
aaaauacaaaaaaa

SEQ ID NO: 1647062 - RNA, 15 nt, Human
acucugcaagaagaa

SEQ ID NO: 1647063 - RNA, 11 nt, Human
gcuacagugag

SEQ ID NO: 1647064 - RNA, 13 nt, Human
aacaauaaaagac
